United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 39

SEQ ID NO: 1630375 - DNA, 21 bp, Homo sapiens
taagaggagcagagggcaggg

SEQ ID NO: 1630376 - DNA, 21 bp, Homo sapiens
taataagaaagtataaagtca

SEQ ID NO: 1630377 - DNA, 15 bp, Homo sapiens
taataagaacagatc

SEQ ID NO: 1630378 - DNA, 16 bp, Homo sapiens
taataagaacagatca

SEQ ID NO: 1630379 - DNA, 17 bp, Homo sapiens
taataagatggctgtgg

SEQ ID NO: 1630380 - DNA, 16 bp, Homo sapiens
taataagcactgtaaa

SEQ ID NO: 1630381 - DNA, 14 bp, Homo sapiens
taataagggaaaaa

SEQ ID NO: 1630382 - DNA, 23 bp, Homo sapiens
taataagggaaaaatcaagtatt

SEQ ID NO: 1630383 - DNA, 15 bp, Homo sapiens
taataatgtttaata

SEQ ID NO: 1630384 - DNA, 22 bp, Homo sapiens
taataatttacaggttcttagg

SEQ ID NO: 1630385 - DNA, 13 bp, Homo sapiens
taatacaaggtat

SEQ ID NO: 1630386 - DNA, 22 bp, Homo sapiens
taatacaaggtataataaaatt

SEQ ID NO: 1630387 - DNA, 14 bp, Homo sapiens
taatacacaaaatc

SEQ ID NO: 1630388 - DNA, 21 bp, Homo sapiens
taatacagataagtgttcttc

SEQ ID NO: 1630389 - DNA, 21 bp, Homo sapiens
taatacagcaacaatttatga

SEQ ID NO: 1630390 - DNA, 23 bp, Homo sapiens
taatacagcagtgtcatcagaag

SEQ ID NO: 1630391 - DNA, 17 bp, Homo sapiens
taatacattccattgtt

SEQ ID NO: 1630392 - DNA, 18 bp, Homo sapiens
taatacctctgtgtgctc

SEQ ID NO: 1630393 - DNA, 20 bp, Homo sapiens
taatacctcttactttgctt

SEQ ID NO: 1630394 - DNA, 17 bp, Homo sapiens
taatacgtgccagatat

SEQ ID NO: 1630395 - DNA, 16 bp, Homo sapiens
taatactgttattctt

SEQ ID NO: 1630396 - DNA, 17 bp, Homo sapiens
taatactgttattcttt

SEQ ID NO: 1630397 - DNA, 15 bp, Homo sapiens
taatacttttgtaat

SEQ ID NO: 1630398 - DNA, 12 bp, Homo sapiens
taatagaagaac

SEQ ID NO: 1630399 - DNA, 20 bp, Homo sapiens
taatagaataaaggcagttt

SEQ ID NO: 1630400 - DNA, 22 bp, Homo sapiens
taatagaataaaggcagttttc

SEQ ID NO: 1630401 - DNA, 20 bp, Homo sapiens
taatagaatagcacagccag

SEQ ID NO: 1630402 - DNA, 21 bp, Homo sapiens
taatagaatataattatcgga

SEQ ID NO: 1630403 - DNA, 19 bp, Homo sapiens
taatagactgagtcagatg

SEQ ID NO: 1630404 - DNA, 14 bp, Homo sapiens
taatagaggagctg

SEQ ID NO: 1630405 - DNA, 23 bp, Homo sapiens
taatagcactaaccaatgccttt

SEQ ID NO: 1630406 - DNA, 15 bp, Homo sapiens
taatagcagcctttc

SEQ ID NO: 1630407 - DNA, 22 bp, Homo sapiens
taatagcctgtcataggtttta

SEQ ID NO: 1630408 - DNA, 15 bp, Homo sapiens
taatagcttctgtgt

SEQ ID NO: 1630409 - DNA, 17 bp, Homo sapiens
taatagcttctgtgtgt

SEQ ID NO: 1630410 - DNA, 15 bp, Homo sapiens
taatagcttttcctg

SEQ ID NO: 1630411 - DNA, 16 bp, Homo sapiens
taataggaacaatctt

SEQ ID NO: 1630412 - DNA, 21 bp, Homo sapiens
taataggaacaatctttgctg

SEQ ID NO: 1630413 - DNA, 20 bp, Homo sapiens
taataggaatgtccaccatg

SEQ ID NO: 1630414 - DNA, 22 bp, Homo sapiens
taataggaatgtccaccatgaa

SEQ ID NO: 1630415 - DNA, 17 bp, Homo sapiens
taatagtagatttgaac

SEQ ID NO: 1630416 - DNA, 14 bp, Homo sapiens
taatagtgcttttt

SEQ ID NO: 1630417 - DNA, 18 bp, Homo sapiens
taatagttcagtagaatt

SEQ ID NO: 1630418 - DNA, 19 bp, Homo sapiens
taatagttcagtagaatta

SEQ ID NO: 1630419 - DNA, 12 bp, Homo sapiens
taatataaaaaa

SEQ ID NO: 1630420 - DNA, 14 bp, Homo sapiens
taatataaatttaa

SEQ ID NO: 1630421 - DNA, 17 bp, Homo sapiens
taatataaatttaagca

SEQ ID NO: 1630422 - DNA, 18 bp, Homo sapiens
taatataatacacaaaat

SEQ ID NO: 1630423 - DNA, 16 bp, Homo sapiens
taatatactgcatatc

SEQ ID NO: 1630424 - DNA, 15 bp, Homo sapiens
taatatataaacaat

SEQ ID NO: 1630425 - DNA, 15 bp, Homo sapiens
taatatatacatttt

SEQ ID NO: 1630426 - DNA, 22 bp, Homo sapiens
taatatatagtccagacactta

SEQ ID NO: 1630427 - DNA, 20 bp, Homo sapiens
taatatatgtattatttata

SEQ ID NO: 1630428 - DNA, 14 bp, Homo sapiens
taatatatgtttac

SEQ ID NO: 1630429 - DNA, 12 bp, Homo sapiens
taatatattaaa

SEQ ID NO: 1630430 - DNA, 21 bp, Homo sapiens
taatatattaaaattccaaat

SEQ ID NO: 1630431 - DNA, 17 bp, Homo sapiens
taatatcaaaagaaaat

SEQ ID NO: 1630432 - DNA, 14 bp, Homo sapiens
taatatcaaataaa

SEQ ID NO: 1630433 - DNA, 16 bp, Homo sapiens
taatatcaaataaaat

SEQ ID NO: 1630434 - DNA, 21 bp, Homo sapiens
taatatcaaataaaatatcat

SEQ ID NO: 1630435 - DNA, 15 bp, Homo sapiens
taatatcaatagaag

SEQ ID NO: 1630436 - DNA, 17 bp, Homo sapiens
taatatctggcactgtt

SEQ ID NO: 1630437 - DNA, 18 bp, Homo sapiens
taatatctggcactgtta

SEQ ID NO: 1630438 - DNA, 12 bp, Homo sapiens
taatatcttgct

SEQ ID NO: 1630439 - DNA, 18 bp, Homo sapiens
taatatgctgccaaattt

SEQ ID NO: 1630440 - DNA, 13 bp, Homo sapiens
taatatgtctttt

SEQ ID NO: 1630441 - DNA, 15 bp, Homo sapiens
taatatgtgccttaa

SEQ ID NO: 1630442 - DNA, 20 bp, Homo sapiens
taatatgttaacctcagtgt

SEQ ID NO: 1630443 - DNA, 20 bp, Homo sapiens
taatatgttcttttaaatga

SEQ ID NO: 1630444 - DNA, 18 bp, Homo sapiens
gtttcctatttaatacag

SEQ ID NO: 1630445 - DNA, 17 bp, Homo sapiens
gtttcctccaagctatt

SEQ ID NO: 1630446 - DNA, 11 bp, Homo sapiens
gtttcctctgg

SEQ ID NO: 1630447 - DNA, 12 bp, Homo sapiens
gtttcctctgga

SEQ ID NO: 1630448 - DNA, 13 bp, Homo sapiens
gtttcctctggat

SEQ ID NO: 1630449 - DNA, 20 bp, Homo sapiens
gtttcctctgttcaaagctg

SEQ ID NO: 1630450 - DNA, 13 bp, Homo sapiens
gtttcctggaagc

SEQ ID NO: 1630451 - DNA, 14 bp, Homo sapiens
gtttccttttggaa

SEQ ID NO: 1630452 - DNA, 19 bp, Homo sapiens
gtttcgactggtccagctc

SEQ ID NO: 1630453 - DNA, 20 bp, Homo sapiens
gtttcgcattaagcacacac

SEQ ID NO: 1630454 - DNA, 20 bp, Homo sapiens
gtttcgtgaagtatactgta

SEQ ID NO: 1630455 - DNA, 14 bp, Homo sapiens
gtttcgtttctgta

SEQ ID NO: 1630456 - DNA, 13 bp, Homo sapiens
gtttctaaaacta

SEQ ID NO: 1630457 - DNA, 17 bp, Homo sapiens
gtttctaaaactatggt

SEQ ID NO: 1630458 - DNA, 14 bp, Homo sapiens
gtttctaagattct

SEQ ID NO: 1630459 - DNA, 15 bp, Homo sapiens
gtttctaagattcta

SEQ ID NO: 1630460 - DNA, 16 bp, Homo sapiens
gtttctaagattctaa

SEQ ID NO: 1630461 - DNA, 13 bp, Homo sapiens
gtttctaagcagt

SEQ ID NO: 1630462 - DNA, 21 bp, Homo sapiens
gtttctaaggtaacaagatga

SEQ ID NO: 1630463 - DNA, 18 bp, Homo sapiens
gtttctaataaacttgga

SEQ ID NO: 1630464 - DNA, 23 bp, Homo sapiens
gtttctaccggagagagaatgta

SEQ ID NO: 1630465 - DNA, 17 bp, Homo sapiens
gtttctagaggcctcag

SEQ ID NO: 1630466 - DNA, 18 bp, Homo sapiens
gtttctagctagaaatat

SEQ ID NO: 1630467 - DNA, 14 bp, Homo sapiens
gtttctcagatcct

SEQ ID NO: 1630468 - DNA, 14 bp, Homo sapiens
gtttctccccctgg

SEQ ID NO: 1630469 - DNA, 17 bp, Homo sapiens
gtttctccccctgggct

SEQ ID NO: 1630470 - DNA, 20 bp, Homo sapiens
gtttctccttagttggctgg

SEQ ID NO: 1630471 - DNA, 14 bp, Homo sapiens
gtttctctcttccc

SEQ ID NO: 1630472 - DNA, 13 bp, Homo sapiens
gtttctctgctgt

SEQ ID NO: 1630473 - DNA, 17 bp, Homo sapiens
gtttctctgctgtcaac

SEQ ID NO: 1630474 - DNA, 14 bp, Homo sapiens
gtttctctgtgctc

SEQ ID NO: 1630475 - DNA, 16 bp, Homo sapiens
gtttctgaaaattcca

SEQ ID NO: 1630476 - DNA, 17 bp, Homo sapiens
gtttctgaactctgaca

SEQ ID NO: 1630477 - DNA, 15 bp, Homo sapiens
gtttctgaagtactt

SEQ ID NO: 1630478 - DNA, 19 bp, Homo sapiens
gtttctgacccactgatct

SEQ ID NO: 1630479 - DNA, 22 bp, Homo sapiens
gtttctggacccttataaaatc

SEQ ID NO: 1630480 - DNA, 19 bp, Homo sapiens
gtttctgggtcctgaagaa

SEQ ID NO: 1630481 - DNA, 22 bp, Homo sapiens
gtttctgggtcctgaagaatta

SEQ ID NO: 1630482 - DNA, 23 bp, Homo sapiens
gtttctgtatatgattctctgtg

SEQ ID NO: 1630483 - DNA, 20 bp, Homo sapiens
gtttctgtgaaattctcaga

SEQ ID NO: 1630484 - DNA, 21 bp, Homo sapiens
gtttctgtgaaattctcagag

SEQ ID NO: 1630485 - DNA, 23 bp, Homo sapiens
gtttctgttgttcccgtgaattt

SEQ ID NO: 1630486 - DNA, 19 bp, Homo sapiens
gtttctgtttcaaagcaca

SEQ ID NO: 1630487 - DNA, 19 bp, Homo sapiens
gtttcttaagggcacacac

SEQ ID NO: 1630488 - DNA, 11 bp, Homo sapiens
gtttcttagac

SEQ ID NO: 1630489 - DNA, 23 bp, Homo sapiens
gtttcttcatccggcagcctgga

SEQ ID NO: 1630490 - DNA, 17 bp, Homo sapiens
gtttcttgcaagcatgc

SEQ ID NO: 1630491 - DNA, 12 bp, Homo sapiens
gtttcttgtctt

SEQ ID NO: 1630492 - DNA, 17 bp, Homo sapiens
gtttctttaagaaagta

SEQ ID NO: 1630493 - DNA, 19 bp, Homo sapiens
gtttctttcttcctcttct

SEQ ID NO: 1630494 - DNA, 20 bp, Homo sapiens
gtttctttgatcatgaataa

SEQ ID NO: 1630495 - DNA, 14 bp, Homo sapiens
gtttcttttgcaat

SEQ ID NO: 1630496 - DNA, 21 bp, Homo sapiens
gtttctttttacagcattgtc

SEQ ID NO: 1630497 - DNA, 23 bp, Homo sapiens
gtttctttttacagcattgtctt

SEQ ID NO: 1630498 - DNA, 15 bp, Homo sapiens
gtttgaaaacaaaaa

SEQ ID NO: 1630499 - DNA, 14 bp, Homo sapiens
gtttgaaatctttt

SEQ ID NO: 1630500 - DNA, 22 bp, Homo sapiens
gtttgaagagccattttggtaa

SEQ ID NO: 1630501 - DNA, 13 bp, Homo sapiens
gtttgaattcagt

SEQ ID NO: 1630502 - DNA, 17 bp, Homo sapiens
gtttgaattcctcctct

SEQ ID NO: 1630503 - DNA, 22 bp, Homo sapiens
gtttgagacaagccctggcaac

SEQ ID NO: 1630504 - DNA, 21 bp, Homo sapiens
gtttgagaccaggctgggcat

SEQ ID NO: 1630505 - DNA, 15 bp, Homo sapiens
gtttgagattctcaa

SEQ ID NO: 1630506 - DNA, 14 bp, Homo sapiens
gtttgagctgcctt

SEQ ID NO: 1630507 - DNA, 23 bp, Homo sapiens
gtttgaggatatattttcacttt

SEQ ID NO: 1630508 - DNA, 12 bp, Homo sapiens
gtttgaggctgc

SEQ ID NO: 1630509 - DNA, 23 bp, Homo sapiens
gtttgaggctgcaatgagccatg

SEQ ID NO: 1630510 - DNA, 11 bp, Homo sapiens
gtttgaggctt

SEQ ID NO: 1630511 - DNA, 12 bp, Homo sapiens
gtttgatgtatg

SEQ ID NO: 1630512 - DNA, 17 bp, Homo sapiens
gtttgatgtatgtgtga

SEQ ID NO: 1630513 - DNA, 12 bp, Homo sapiens
gtttgattggct

SEQ ID NO: 1630514 - DNA, 11 bp, Homo sapiens
gtttgatttca

SEQ ID NO: 1630515 - DNA, 21 bp, Homo sapiens
gtttgattttagctgcagaac

SEQ ID NO: 1630516 - DNA, 20 bp, Homo sapiens
gtttgcaacctctttgctca

SEQ ID NO: 1630517 - DNA, 19 bp, Homo sapiens
gtttgcactcaaatcttaa

SEQ ID NO: 1630518 - DNA, 22 bp, Homo sapiens
gtttgcactcaaatcttaagaa

SEQ ID NO: 1630519 - DNA, 22 bp, Homo sapiens
gtttgcagaaaagcacctgccg

SEQ ID NO: 1630520 - DNA, 22 bp, Homo sapiens
gtttgcagagtggaaactcagc

SEQ ID NO: 1630521 - DNA, 15 bp, Homo sapiens
gtttgcagctgtgag

SEQ ID NO: 1630522 - DNA, 21 bp, Homo sapiens
gtttgcaggttaacttagcta

SEQ ID NO: 1630523 - DNA, 12 bp, Homo sapiens
gtttgcattcct

SEQ ID NO: 1630524 - DNA, 14 bp, Homo sapiens
gtttgcatttcaga

SEQ ID NO: 1630525 - DNA, 23 bp, Homo sapiens
gtttgccccgggatattatagaa

SEQ ID NO: 1630526 - DNA, 19 bp, Homo sapiens
cagggcacgcaggaccagt

SEQ ID NO: 1630527 - DNA, 13 bp, Homo sapiens
cagggcactgact

SEQ ID NO: 1630528 - DNA, 14 bp, Homo sapiens
cagggcagacagcc

SEQ ID NO: 1630529 - DNA, 13 bp, Homo sapiens
cagggcagagcag

SEQ ID NO: 1630530 - DNA, 12 bp, Homo sapiens
cagggcagagcc

SEQ ID NO: 1630531 - DNA, 15 bp, Homo sapiens
cagggcagagccggg

SEQ ID NO: 1630532 - DNA, 16 bp, Homo sapiens
cagggcagagccggga

SEQ ID NO: 1630533 - DNA, 12 bp, Homo sapiens
cagggcagaggg

SEQ ID NO: 1630534 - DNA, 15 bp, Homo sapiens
cagggcagcaaggga

SEQ ID NO: 1630535 - DNA, 19 bp, Homo sapiens
cagggcagcaagggacctg

SEQ ID NO: 1630536 - DNA, 21 bp, Homo sapiens
cagggcagcctcccccggctc

SEQ ID NO: 1630537 - DNA, 13 bp, Homo sapiens
cagggcatctcct

SEQ ID NO: 1630538 - DNA, 15 bp, Homo sapiens
cagggcatcttgctg

SEQ ID NO: 1630539 - DNA, 19 bp, Homo sapiens
cagggcatcttgctggcta

SEQ ID NO: 1630540 - DNA, 20 bp, Homo sapiens
cagggcatggccaggtggcc

SEQ ID NO: 1630541 - DNA, 21 bp, Homo sapiens
cagggcattgctcagcccgct

SEQ ID NO: 1630542 - DNA, 22 bp, Homo sapiens
cagggccaaagcacagctgggc

SEQ ID NO: 1630543 - DNA, 23 bp, Homo sapiens
cagggccaaagcacagctgggca

SEQ ID NO: 1630544 - DNA, 17 bp, Homo sapiens
cagggccaccgcagggg

SEQ ID NO: 1630545 - DNA, 18 bp, Homo sapiens
cagggccacgctccagct

SEQ ID NO: 1630546 - DNA, 20 bp, Homo sapiens
cagggccacgctccagctgc

SEQ ID NO: 1630547 - DNA, 15 bp, Homo sapiens
cagggccacgtgcca

SEQ ID NO: 1630548 - DNA, 16 bp, Homo sapiens
cagggccacgtgccag

SEQ ID NO: 1630549 - DNA, 20 bp, Homo sapiens
cagggccacgtgccaggccc

SEQ ID NO: 1630550 - DNA, 16 bp, Homo sapiens
cagggccactcaacag

SEQ ID NO: 1630551 - DNA, 11 bp, Homo sapiens
cagggccagaa

SEQ ID NO: 1630552 - DNA, 16 bp, Homo sapiens
cagggccagaaggagg

SEQ ID NO: 1630553 - DNA, 22 bp, Homo sapiens
cagggccagaaggagggcagag

SEQ ID NO: 1630554 - DNA, 18 bp, Homo sapiens
cagggccagactggaaga

SEQ ID NO: 1630555 - DNA, 23 bp, Homo sapiens
cagggccagactggaagacactt

SEQ ID NO: 1630556 - DNA, 12 bp, Homo sapiens
cagggccagggc

SEQ ID NO: 1630557 - DNA, 13 bp, Homo sapiens
cagggccagggcc

SEQ ID NO: 1630558 - DNA, 19 bp, Homo sapiens
cagggccagggccctgcag

SEQ ID NO: 1630559 - DNA, 16 bp, Homo sapiens
cagggccatccactgt

SEQ ID NO: 1630560 - DNA, 23 bp, Homo sapiens
cagggccatctgactgccaagcc

SEQ ID NO: 1630561 - DNA, 18 bp, Homo sapiens
cagggccatgcagacctc

SEQ ID NO: 1630562 - DNA, 22 bp, Homo sapiens
cagggccatgcagacctcatgc

SEQ ID NO: 1630563 - DNA, 20 bp, Homo sapiens
gtttgtatgtgtgtagacaa

SEQ ID NO: 1630564 - DNA, 12 bp, Homo sapiens
gtttgtcagcat

SEQ ID NO: 1630565 - DNA, 14 bp, Homo sapiens
gtttgtcagcatct

SEQ ID NO: 1630566 - DNA, 17 bp, Homo sapiens
gtttgtcagcatctgac

SEQ ID NO: 1630567 - DNA, 20 bp, Homo sapiens
gtttgtcctttttcactttg

SEQ ID NO: 1630568 - DNA, 14 bp, Homo sapiens
gtttgtctatttta

SEQ ID NO: 1630569 - DNA, 15 bp, Homo sapiens
gtttgtctgtcttca

SEQ ID NO: 1630570 - DNA, 18 bp, Homo sapiens
gtttgtctgtcttcatag

SEQ ID NO: 1630571 - DNA, 21 bp, Homo sapiens
gtttgtcttccattccattgt

SEQ ID NO: 1630572 - DNA, 19 bp, Homo sapiens
gtttgtgatattaaatttc

SEQ ID NO: 1630573 - DNA, 13 bp, Homo sapiens
gtttgtgcagaat

SEQ ID NO: 1630574 - DNA, 13 bp, Homo sapiens
gtttgtggcctca

SEQ ID NO: 1630575 - DNA, 16 bp, Homo sapiens
gtttgtggcctcagaa

SEQ ID NO: 1630576 - DNA, 22 bp, Homo sapiens
gtttgtggctgggggcaggagg

SEQ ID NO: 1630577 - DNA, 13 bp, Homo sapiens
gtttgtgtgtctt

SEQ ID NO: 1630578 - DNA, 21 bp, Homo sapiens
gtttgtgtgttttgtacactt

SEQ ID NO: 1630579 - DNA, 20 bp, Homo sapiens
gtttgtgttgttgttgctgc

SEQ ID NO: 1630580 - DNA, 21 bp, Homo sapiens
gtttgtgttgttgttgctgct

SEQ ID NO: 1630581 - DNA, 15 bp, Homo sapiens
gtttgttaaaactgg

SEQ ID NO: 1630582 - DNA, 14 bp, Homo sapiens
gtttgttcatctgt

SEQ ID NO: 1630583 - DNA, 15 bp, Homo sapiens
gtttgtttataatgt

SEQ ID NO: 1630584 - DNA, 18 bp, Homo sapiens
gtttgtttcaagaacctg

SEQ ID NO: 1630585 - DNA, 14 bp, Homo sapiens
gtttgtttgtctgt

SEQ ID NO: 1630586 - DNA, 17 bp, Homo sapiens
gtttgtttgtttgtctg

SEQ ID NO: 1630587 - DNA, 12 bp, Homo sapiens
gtttgtttttgg

SEQ ID NO: 1630588 - DNA, 16 bp, Homo sapiens
gttttaaaagccttgg

SEQ ID NO: 1630589 - DNA, 23 bp, Homo sapiens
gttttaaacattaatagcagcct

SEQ ID NO: 1630590 - DNA, 17 bp, Homo sapiens
gttttaaatctgcttta

SEQ ID NO: 1630591 - DNA, 19 bp, Homo sapiens
gttttaagctaaaatgtta

SEQ ID NO: 1630592 - DNA, 17 bp, Homo sapiens
gttttaagttgtttgca

SEQ ID NO: 1630593 - DNA, 14 bp, Homo sapiens
gttttaccagctcc

SEQ ID NO: 1630594 - DNA, 17 bp, Homo sapiens
gttttactgttttaatt

SEQ ID NO: 1630595 - DNA, 13 bp, Homo sapiens
gttttacttttaa

SEQ ID NO: 1630596 - DNA, 21 bp, Homo sapiens
gttttacttttaaactgtgta

SEQ ID NO: 1630597 - DNA, 20 bp, Homo sapiens
gttttagattttctggttct

SEQ ID NO: 1630598 - DNA, 16 bp, Homo sapiens
gttttagcatttgtat

SEQ ID NO: 1630599 - DNA, 13 bp, Homo sapiens
gttttaggttcta

SEQ ID NO: 1630600 - DNA, 16 bp, Homo sapiens
gttttaggttctaaag

SEQ ID NO: 1630601 - DNA, 21 bp, Homo sapiens
gttttaggttctaaagttcta

SEQ ID NO: 1630602 - DNA, 15 bp, Homo sapiens
gttttagtgtctgac

SEQ ID NO: 1630603 - DNA, 18 bp, Homo sapiens
gttttagtgtctgaccta

SEQ ID NO: 1630604 - DNA, 16 bp, Homo sapiens
gttttagtttaatagt

SEQ ID NO: 1630605 - DNA, 13 bp, Homo sapiens
gttttagtttctg

SEQ ID NO: 1630606 - DNA, 18 bp, Homo sapiens
gttttatactgtacttaa

SEQ ID NO: 1630607 - DNA, 18 bp, Homo sapiens
gttttatagcctggactg

SEQ ID NO: 1630608 - DNA, 12 bp, Homo sapiens
gttttatatctt

SEQ ID NO: 1630609 - DNA, 18 bp, Homo sapiens
gttttatgcgtgtgacag

SEQ ID NO: 1630610 - DNA, 14 bp, Homo sapiens
gttttattcctgta

SEQ ID NO: 1630611 - DNA, 20 bp, Homo sapiens
gttttattcctgtatgttgt

SEQ ID NO: 1630612 - DNA, 12 bp, Homo sapiens
gttttattttaa

SEQ ID NO: 1630613 - DNA, 17 bp, Homo sapiens
gttttcaaaataaaaat

SEQ ID NO: 1630614 - DNA, 21 bp, Homo sapiens
gttttcaaactgctgcatact

SEQ ID NO: 1630615 - DNA, 23 bp, Homo sapiens
gttttcaactcttccctgaactt

SEQ ID NO: 1630616 - DNA, 20 bp, Homo sapiens
gttttcagaacctcttcccc

SEQ ID NO: 1630617 - DNA, 14 bp, Homo sapiens
gttttcagactcag

SEQ ID NO: 1630618 - DNA, 17 bp, Homo sapiens
gttttcagactcagact

SEQ ID NO: 1630619 - DNA, 17 bp, Homo sapiens
gttttcagtgtacatgg

SEQ ID NO: 1630620 - DNA, 16 bp, Homo sapiens
gttttcataacttgct

SEQ ID NO: 1630621 - DNA, 19 bp, Homo sapiens
gttttcataacttgctgaa

SEQ ID NO: 1630622 - DNA, 20 bp, Homo sapiens
gttttcattttagacattca

SEQ ID NO: 1630623 - DNA, 16 bp, Homo sapiens
gttttccaccctggaa

SEQ ID NO: 1630624 - DNA, 23 bp, Homo sapiens
gttttcccccagcaacgcccctc

SEQ ID NO: 1630625 - DNA, 16 bp, Homo sapiens
gttttcctaaatgcag

SEQ ID NO: 1630626 - DNA, 13 bp, Homo sapiens
gttttccttctgt

SEQ ID NO: 1630627 - DNA, 18 bp, Homo sapiens
gttttctagatgacataa

SEQ ID NO: 1630628 - DNA, 19 bp, Homo sapiens
gttttctcagaacagctga

SEQ ID NO: 1630629 - DNA, 20 bp, Homo sapiens
gttttctcagaacagctgaa

SEQ ID NO: 1630630 - DNA, 17 bp, Homo sapiens
gttttctctcggctccc

SEQ ID NO: 1630631 - DNA, 16 bp, Homo sapiens
gttttctgaaacacac

SEQ ID NO: 1630632 - DNA, 15 bp, Homo sapiens
gttttctgagaaaga

SEQ ID NO: 1630633 - DNA, 22 bp, Homo sapiens
gttttcttcaagggaagaaaca

SEQ ID NO: 1630634 - DNA, 23 bp, Homo sapiens
gttttcttcaagggaagaaacac

SEQ ID NO: 1630635 - DNA, 12 bp, Homo sapiens
gttttcttccca

SEQ ID NO: 1630636 - DNA, 15 bp, Homo sapiens
gttttcttctttccc

SEQ ID NO: 1630637 - DNA, 21 bp, Homo sapiens
gttttcttctttccctggaca

SEQ ID NO: 1630638 - DNA, 14 bp, Homo sapiens
gttttgaaagaaaa

SEQ ID NO: 1630639 - DNA, 18 bp, Homo sapiens
gttttgaaagaaaaatac

SEQ ID NO: 1630640 - DNA, 17 bp, Homo sapiens
gttttgaactaataaaa

SEQ ID NO: 1630641 - DNA, 15 bp, Homo sapiens
taaagtgatgtttgt

SEQ ID NO: 1630642 - DNA, 21 bp, Homo sapiens
taaagtgatgtttgtgtgttt

SEQ ID NO: 1630643 - DNA, 14 bp, Homo sapiens
taaagtgatttttg

SEQ ID NO: 1630644 - DNA, 19 bp, Homo sapiens
taaagtgtaacaattgtgt

SEQ ID NO: 1630645 - DNA, 13 bp, Homo sapiens
taaagtgttactt

SEQ ID NO: 1630646 - DNA, 17 bp, Homo sapiens
taaagttacactgttca

SEQ ID NO: 1630647 - DNA, 18 bp, Homo sapiens
taaagttacttgaatttc

SEQ ID NO: 1630648 - DNA, 17 bp, Homo sapiens
taaagttcattgcaatt

SEQ ID NO: 1630649 - DNA, 13 bp, Homo sapiens
taaagttccttaa

SEQ ID NO: 1630650 - DNA, 15 bp, Homo sapiens
taaagttctaagatt

SEQ ID NO: 1630651 - DNA, 18 bp, Homo sapiens
taaagttctaagattctg

SEQ ID NO: 1630652 - DNA, 17 bp, Homo sapiens
taaagttctgagtgttt

SEQ ID NO: 1630653 - DNA, 14 bp, Homo sapiens
taaagttcttattt

SEQ ID NO: 1630654 - DNA, 21 bp, Homo sapiens
taaagttcttattttagtata

SEQ ID NO: 1630655 - DNA, 13 bp, Homo sapiens
taaagttgctttt

SEQ ID NO: 1630656 - DNA, 12 bp, Homo sapiens
taaagttgtact

SEQ ID NO: 1630657 - DNA, 13 bp, Homo sapiens
taaagttgtactt

SEQ ID NO: 1630658 - DNA, 13 bp, Homo sapiens
taaagttgtattg

SEQ ID NO: 1630659 - DNA, 12 bp, Homo sapiens
taaagtttacaa

SEQ ID NO: 1630660 - DNA, 12 bp, Homo sapiens
taaagtttctag

SEQ ID NO: 1630661 - DNA, 14 bp, Homo sapiens
taaagtttgcttag

SEQ ID NO: 1630662 - DNA, 17 bp, Homo sapiens
taaagtttgcttagaaa

SEQ ID NO: 1630663 - DNA, 19 bp, Homo sapiens
taaagtttttaaagtgtgt

SEQ ID NO: 1630664 - DNA, 15 bp, Homo sapiens
taaataaaaatgcat

SEQ ID NO: 1630665 - DNA, 14 bp, Homo sapiens
taaataaaagcaca

SEQ ID NO: 1630666 - DNA, 17 bp, Homo sapiens
taaataaaagtgatcaa

SEQ ID NO: 1630667 - DNA, 19 bp, Homo sapiens
taaataaaagtgatcaata

SEQ ID NO: 1630668 - DNA, 15 bp, Homo sapiens
taaataaaatgtgta

SEQ ID NO: 1630669 - DNA, 20 bp, Homo sapiens
taaataaaatgtgtacagtg

SEQ ID NO: 1630670 - DNA, 14 bp, Homo sapiens
taaataaaccactg

SEQ ID NO: 1630671 - DNA, 15 bp, Homo sapiens
taaataaaccactgt

SEQ ID NO: 1630672 - DNA, 13 bp, Homo sapiens
taaataaaccctt

SEQ ID NO: 1630673 - DNA, 12 bp, Homo sapiens
taaataaactat

SEQ ID NO: 1630674 - DNA, 16 bp, Homo sapiens
taaataaactatttat

SEQ ID NO: 1630675 - DNA, 22 bp, Homo sapiens
taaataaactatttatatcaca

SEQ ID NO: 1630676 - DNA, 15 bp, Homo sapiens
taaataaagaagaaa

SEQ ID NO: 1630677 - DNA, 16 bp, Homo sapiens
taaataaatcattaat

SEQ ID NO: 1630678 - DNA, 22 bp, Homo sapiens
taaataaatgaagtatttctca

SEQ ID NO: 1630679 - DNA, 12 bp, Homo sapiens
taaataaatttc

SEQ ID NO: 1630680 - DNA, 11 bp, Homo sapiens
taaataagaga

SEQ ID NO: 1630681 - DNA, 13 bp, Homo sapiens
taaataagagatt

SEQ ID NO: 1630682 - DNA, 15 bp, Homo sapiens
taaataagattctaa

SEQ ID NO: 1630683 - DNA, 18 bp, Homo sapiens
taaataagattctaacgg

SEQ ID NO: 1630684 - DNA, 17 bp, Homo sapiens
taaataatcacacacac

SEQ ID NO: 1630685 - DNA, 17 bp, Homo sapiens
taaataatgcttcagat

SEQ ID NO: 1630686 - DNA, 17 bp, Homo sapiens
taaataatttatttaat

SEQ ID NO: 1630687 - DNA, 17 bp, Homo sapiens
taaatacaaaaatgaat

SEQ ID NO: 1630688 - DNA, 18 bp, Homo sapiens
taaatacaaaaatgaata

SEQ ID NO: 1630689 - DNA, 14 bp, Homo sapiens
taaatacagacact

SEQ ID NO: 1630690 - DNA, 19 bp, Homo sapiens
taaatacagataattcatt

SEQ ID NO: 1630691 - DNA, 22 bp, Homo sapiens
taaatacagataattcatttgt

SEQ ID NO: 1630692 - DNA, 17 bp, Homo sapiens
taaatactgcaaatcag

SEQ ID NO: 1630693 - DNA, 14 bp, Homo sapiens
taaatactggactc

SEQ ID NO: 1630694 - DNA, 15 bp, Homo sapiens
taaatactggactca

SEQ ID NO: 1630695 - DNA, 17 bp, Homo sapiens
taaatactggactcagg

SEQ ID NO: 1630696 - DNA, 13 bp, Homo sapiens
taaatactgtgaa

SEQ ID NO: 1630697 - DNA, 23 bp, Homo sapiens
taaataggaatcattcagaaatg

SEQ ID NO: 1630698 - DNA, 18 bp, Homo sapiens
taaataggttcagatttt

SEQ ID NO: 1630699 - DNA, 17 bp, Homo sapiens
taaatataaatagctaa

SEQ ID NO: 1630700 - DNA, 18 bp, Homo sapiens
taaatataattctgtaaa

SEQ ID NO: 1630701 - DNA, 17 bp, Homo sapiens
taaatatatatgtcaat

SEQ ID NO: 1630702 - DNA, 17 bp, Homo sapiens
taaatatatttaagata

SEQ ID NO: 1630703 - DNA, 23 bp, Homo sapiens
taaatatccatttatcttttgta

SEQ ID NO: 1630704 - DNA, 22 bp, Homo sapiens
taaatatctgtacttcttcgat

SEQ ID NO: 1630705 - DNA, 23 bp, Homo sapiens
taaatattctacacatgtaaaat

SEQ ID NO: 1630706 - DNA, 18 bp, Homo sapiens
taaattggattattttct

SEQ ID NO: 1630707 - DNA, 18 bp, Homo sapiens
taaatttaaacttacaaa

SEQ ID NO: 1630708 - DNA, 22 bp, Homo sapiens
taaatttaagcaaacgtctatt

SEQ ID NO: 1630709 - DNA, 22 bp, Homo sapiens
taaatttaagcttaagccataa

SEQ ID NO: 1630710 - DNA, 17 bp, Homo sapiens
taaatttaataccagat

SEQ ID NO: 1630711 - DNA, 16 bp, Homo sapiens
taaatttaatgctgcc

SEQ ID NO: 1630712 - DNA, 17 bp, Homo sapiens
taaatttcaaatgcaga

SEQ ID NO: 1630713 - DNA, 20 bp, Homo sapiens
taaatttcccagttaaagat

SEQ ID NO: 1630714 - DNA, 16 bp, Homo sapiens
taaatttcttatgtga

SEQ ID NO: 1630715 - DNA, 17 bp, Homo sapiens
taaatttcttggcaaat

SEQ ID NO: 1630716 - DNA, 22 bp, Homo sapiens
taaatttgaatgttaagcagat

SEQ ID NO: 1630717 - DNA, 14 bp, Homo sapiens
taaatttgtactat

SEQ ID NO: 1630718 - DNA, 19 bp, Homo sapiens
taaatttgtactatttaac

SEQ ID NO: 1630719 - DNA, 20 bp, Homo sapiens
taaatttgttctttgtttag

SEQ ID NO: 1630720 - DNA, 13 bp, Homo sapiens
taaattttaaagc

SEQ ID NO: 1630721 - DNA, 17 bp, Homo sapiens
taaattttaactaaatt

SEQ ID NO: 1630722 - DNA, 20 bp, Homo sapiens
taaattttaatgtaaaattc

SEQ ID NO: 1630723 - DNA, 22 bp, Homo sapiens
taaattttaatgtaaaattcat

SEQ ID NO: 1630724 - DNA, 16 bp, Homo sapiens
taaattttacccttta

SEQ ID NO: 1630725 - DNA, 18 bp, Homo sapiens
taaattttaccctttaga

SEQ ID NO: 1630726 - DNA, 21 bp, Homo sapiens
taaattttcatgaatgtgctg

SEQ ID NO: 1630727 - DNA, 17 bp, Homo sapiens
taaattttgagttctac

SEQ ID NO: 1630728 - DNA, 15 bp, Homo sapiens
taaattttgtgtctc

SEQ ID NO: 1630729 - DNA, 16 bp, Homo sapiens
taaatttttttcctta

SEQ ID NO: 1630730 - DNA, 22 bp, Homo sapiens
taaattttttttggtcaaattt

SEQ ID NO: 1630731 - DNA, 13 bp, Homo sapiens
taacaaaaaataa

SEQ ID NO: 1630732 - DNA, 16 bp, Homo sapiens
taacaaaaaataaatt

SEQ ID NO: 1630733 - DNA, 22 bp, Homo sapiens
taacaaaagatttgtttttgta

SEQ ID NO: 1630734 - DNA, 17 bp, Homo sapiens
taacaaaccaacatctt

SEQ ID NO: 1630735 - DNA, 20 bp, Homo sapiens
taacaaactacatgtaatcc

SEQ ID NO: 1630736 - DNA, 22 bp, Homo sapiens
taacaaagaacctaacatttat

SEQ ID NO: 1630737 - DNA, 12 bp, Homo sapiens
taacaaatctaa

SEQ ID NO: 1630738 - DNA, 21 bp, Homo sapiens
taacaaatggagctttctgta

SEQ ID NO: 1630739 - DNA, 12 bp, Homo sapiens
taacaaattatg

SEQ ID NO: 1630740 - DNA, 19 bp, Homo sapiens
taacaagaactttaaattg

SEQ ID NO: 1630741 - DNA, 17 bp, Homo sapiens
taacaagatctttcagg

SEQ ID NO: 1630742 - DNA, 18 bp, Homo sapiens
taacaagccaaacattct

SEQ ID NO: 1630743 - DNA, 21 bp, Homo sapiens
taacaaggaatgcctgtgcca

SEQ ID NO: 1630744 - DNA, 21 bp, Homo sapiens
taacaaggagctcaccctgcc

SEQ ID NO: 1630745 - DNA, 20 bp, Homo sapiens
taacaagggctgcaatgccc

SEQ ID NO: 1630746 - DNA, 22 bp, Homo sapiens
taacaagggttttaatgtaatt

SEQ ID NO: 1630747 - DNA, 20 bp, Homo sapiens
taacaagtataaaaaattct

SEQ ID NO: 1630748 - DNA, 12 bp, Homo sapiens
taacaataataa

SEQ ID NO: 1630749 - DNA, 16 bp, Homo sapiens
taacaataatatttca

SEQ ID NO: 1630750 - DNA, 23 bp, Homo sapiens
taacaataatatttcaagtgcct

SEQ ID NO: 1630751 - DNA, 14 bp, Homo sapiens
taacaatataactg

SEQ ID NO: 1630752 - DNA, 15 bp, Homo sapiens
taacaatctaacaat

SEQ ID NO: 1630753 - DNA, 13 bp, Homo sapiens
taacaatgacaag

SEQ ID NO: 1630754 - DNA, 10 bp, Homo sapiens
taacaatgat

SEQ ID NO: 1630755 - DNA, 15 bp, Homo sapiens
taacaatgtaataaa

SEQ ID NO: 1630756 - DNA, 17 bp, Homo sapiens
taacaatgtaataaaaa

SEQ ID NO: 1630757 - DNA, 18 bp, Homo sapiens
taacaattgtgtagcctt

SEQ ID NO: 1630758 - DNA, 19 bp, Homo sapiens
taacaattgtgtagccttt

SEQ ID NO: 1630759 - DNA, 21 bp, Homo sapiens
taacaattttttattaaattt

SEQ ID NO: 1630760 - DNA, 12 bp, Homo sapiens
caggtgcagagg

SEQ ID NO: 1630761 - DNA, 16 bp, Homo sapiens
caggtgccactccctg

SEQ ID NO: 1630762 - DNA, 17 bp, Homo sapiens
caggtgccatgcctgct

SEQ ID NO: 1630763 - DNA, 19 bp, Homo sapiens
caggtgccgccagctgccg

SEQ ID NO: 1630764 - DNA, 12 bp, Homo sapiens
caggtgcctcca

SEQ ID NO: 1630765 - DNA, 23 bp, Homo sapiens
caggtgccttacatcttttctaa

SEQ ID NO: 1630766 - DNA, 19 bp, Homo sapiens
caggtgctcaataaatgat

SEQ ID NO: 1630767 - DNA, 14 bp, Homo sapiens
caggtgctgtccat

SEQ ID NO: 1630768 - DNA, 20 bp, Homo sapiens
caggtgcttttgatgtgaaa

SEQ ID NO: 1630769 - DNA, 19 bp, Homo sapiens
caggtggactgactgtgtt

SEQ ID NO: 1630770 - DNA, 15 bp, Homo sapiens
caggtggagggcaca

SEQ ID NO: 1630771 - DNA, 19 bp, Homo sapiens
caggtggagggcacagccc

SEQ ID NO: 1630772 - DNA, 21 bp, Homo sapiens
caggtggagggtttgcactcc

SEQ ID NO: 1630773 - DNA, 18 bp, Homo sapiens
caggtggatcacctgacg

SEQ ID NO: 1630774 - DNA, 16 bp, Homo sapiens
caggtggatgaggaga

SEQ ID NO: 1630775 - DNA, 19 bp, Homo sapiens
caggtggccactccagacc

SEQ ID NO: 1630776 - DNA, 21 bp, Homo sapiens
caggtggccactccagacccc

SEQ ID NO: 1630777 - DNA, 12 bp, Homo sapiens
caggtggccaga

SEQ ID NO: 1630778 - DNA, 18 bp, Homo sapiens
caggtggccagaagagct

SEQ ID NO: 1630779 - DNA, 19 bp, Homo sapiens
caggtggccagcctggatc

SEQ ID NO: 1630780 - DNA, 17 bp, Homo sapiens
caggtggccgcccctga

SEQ ID NO: 1630781 - DNA, 20 bp, Homo sapiens
caggtggccgcccctgaggc

SEQ ID NO: 1630782 - DNA, 18 bp, Homo sapiens
caggtggcctagcaggca

SEQ ID NO: 1630783 - DNA, 12 bp, Homo sapiens
caggtggcctgc

SEQ ID NO: 1630784 - DNA, 19 bp, Homo sapiens
caggtggcgtgagaggcaa

SEQ ID NO: 1630785 - DNA, 17 bp, Homo sapiens
caggtgggggttgctgt

SEQ ID NO: 1630786 - DNA, 21 bp, Homo sapiens
caggtgggggttgctgtataa

SEQ ID NO: 1630787 - DNA, 21 bp, Homo sapiens
caggtgggtgtgggacacctg

SEQ ID NO: 1630788 - DNA, 18 bp, Homo sapiens
caggtggtgaattttcca

SEQ ID NO: 1630789 - DNA, 22 bp, Homo sapiens
caggtggtggcactgagccccc

SEQ ID NO: 1630790 - DNA, 18 bp, Homo sapiens
caggtgtctgccccctct

SEQ ID NO: 1630791 - DNA, 23 bp, Homo sapiens
caggtgtgactctagcaaggctc

SEQ ID NO: 1630792 - DNA, 15 bp, Homo sapiens
caggtgtgcacgtgg

SEQ ID NO: 1630793 - DNA, 17 bp, Homo sapiens
caggtgtgcctgtgctc

SEQ ID NO: 1630794 - DNA, 19 bp, Homo sapiens
caggtgtgcctgtgctcct

SEQ ID NO: 1630795 - DNA, 20 bp, Homo sapiens
caggtgtgcctgtgctcctg

SEQ ID NO: 1630796 - DNA, 21 bp, Homo sapiens
caggtgtgcctgtgctcctgc

SEQ ID NO: 1630797 - DNA, 23 bp, Homo sapiens
caggtgtgcctgtgctcctgccc

SEQ ID NO: 1630798 - DNA, 19 bp, Homo sapiens
caggtgtgggatctgggga

SEQ ID NO: 1630799 - DNA, 20 bp, Homo sapiens
caggtgtgggatctggggag

SEQ ID NO: 1630800 - DNA, 16 bp, Homo sapiens
caggtgtggtggctca

SEQ ID NO: 1630801 - DNA, 18 bp, Homo sapiens
caggtgttaacattccaa

SEQ ID NO: 1630802 - DNA, 15 bp, Homo sapiens
caggtgttactagaa

SEQ ID NO: 1630803 - DNA, 13 bp, Homo sapiens
caggtgttgccaa

SEQ ID NO: 1630804 - DNA, 14 bp, Homo sapiens
caggtgttgccaaa

SEQ ID NO: 1630805 - DNA, 22 bp, Homo sapiens
caggtgttgccatttctctgct

SEQ ID NO: 1630806 - DNA, 19 bp, Homo sapiens
caggtgttgggacctgctg

SEQ ID NO: 1630807 - DNA, 20 bp, Homo sapiens
caggtgtttatatctccttt

SEQ ID NO: 1630808 - DNA, 16 bp, Homo sapiens
caggtgtttctttcct

SEQ ID NO: 1630809 - DNA, 20 bp, Homo sapiens
caggttagcctttgccctgt

SEQ ID NO: 1630810 - DNA, 16 bp, Homo sapiens
caggttatgtcagcag

SEQ ID NO: 1630811 - DNA, 18 bp, Homo sapiens
caggttatgtcagcagct

SEQ ID NO: 1630812 - DNA, 21 bp, Homo sapiens
caggttattgcaataaagtat

SEQ ID NO: 1630813 - DNA, 13 bp, Homo sapiens
caggttccagaac

SEQ ID NO: 1630814 - DNA, 23 bp, Homo sapiens
caggttccagaacagccctcggc

SEQ ID NO: 1630815 - DNA, 18 bp, Homo sapiens
caggttccatccaccacc

SEQ ID NO: 1630816 - DNA, 15 bp, Homo sapiens
caggttcccccagca

SEQ ID NO: 1630817 - DNA, 15 bp, Homo sapiens
caggttcctttttca

SEQ ID NO: 1630818 - DNA, 22 bp, Homo sapiens
caggttctccgttagctcctgt

SEQ ID NO: 1630819 - DNA, 23 bp, Homo sapiens
caggttctccgttagctcctgtg

SEQ ID NO: 1630820 - DNA, 17 bp, Homo sapiens
cagtcagttcccggagc

SEQ ID NO: 1630821 - DNA, 20 bp, Homo sapiens
cagtcagttcccggagcaca

SEQ ID NO: 1630822 - DNA, 15 bp, Homo sapiens
cagtcataactaaat

SEQ ID NO: 1630823 - DNA, 13 bp, Homo sapiens
cagtcatcaaagc

SEQ ID NO: 1630824 - DNA, 17 bp, Homo sapiens
cagtcatggcctgagat

SEQ ID NO: 1630825 - DNA, 23 bp, Homo sapiens
cagtcattatgagaggcaatgat

SEQ ID NO: 1630826 - DNA, 22 bp, Homo sapiens
cagtcattcagcagcaaatttt

SEQ ID NO: 1630827 - DNA, 23 bp, Homo sapiens
cagtcattctaggatgtggagct

SEQ ID NO: 1630828 - DNA, 19 bp, Homo sapiens
cagtccaaccagaaacacc

SEQ ID NO: 1630829 - DNA, 17 bp, Homo sapiens
cagtccacaggggccac

SEQ ID NO: 1630830 - DNA, 22 bp, Homo sapiens
cagtccactgttgagccccagt

SEQ ID NO: 1630831 - DNA, 14 bp, Homo sapiens
cagtccagccagct

SEQ ID NO: 1630832 - DNA, 19 bp, Homo sapiens
cagtccatgctccagggtc

SEQ ID NO: 1630833 - DNA, 22 bp, Homo sapiens
cagtcccagacaattccattca

SEQ ID NO: 1630834 - DNA, 16 bp, Homo sapiens
cagtccccacccctgc

SEQ ID NO: 1630835 - DNA, 18 bp, Homo sapiens
cagtccccacccctgccc

SEQ ID NO: 1630836 - DNA, 19 bp, Homo sapiens
cagtccccacccctgcccc

SEQ ID NO: 1630837 - DNA, 21 bp, Homo sapiens
cagtccccacccctgccccca

SEQ ID NO: 1630838 - DNA, 20 bp, Homo sapiens
cagtccccacccgcctgcag

SEQ ID NO: 1630839 - DNA, 21 bp, Homo sapiens
cagtccccacccgcctgcaga

SEQ ID NO: 1630840 - DNA, 14 bp, Homo sapiens
cagtccccagccct

SEQ ID NO: 1630841 - DNA, 14 bp, Homo sapiens
cagtccccccaccc

SEQ ID NO: 1630842 - DNA, 20 bp, Homo sapiens
cagtccccccaccctcattc

SEQ ID NO: 1630843 - DNA, 22 bp, Homo sapiens
cagtccccgaggagctgggccc

SEQ ID NO: 1630844 - DNA, 15 bp, Homo sapiens
cagtccccgctagtg

SEQ ID NO: 1630845 - DNA, 14 bp, Homo sapiens
cagtcccctcccat

SEQ ID NO: 1630846 - DNA, 15 bp, Homo sapiens
cagtcccctcccatc

SEQ ID NO: 1630847 - DNA, 17 bp, Homo sapiens
cagtcccctcccatctg

SEQ ID NO: 1630848 - DNA, 18 bp, Homo sapiens
cagtcccctctctctggg

SEQ ID NO: 1630849 - DNA, 20 bp, Homo sapiens
cagtcccctctctctgggtc

SEQ ID NO: 1630850 - DNA, 23 bp, Homo sapiens
cagtccctcgccgtccctcccag

SEQ ID NO: 1630851 - DNA, 14 bp, Homo sapiens
cagtccctggagct

SEQ ID NO: 1630852 - DNA, 18 bp, Homo sapiens
cagtccgcagtctggcct

SEQ ID NO: 1630853 - DNA, 18 bp, Homo sapiens
cagtcctagctcttacac

SEQ ID NO: 1630854 - DNA, 12 bp, Homo sapiens
cagtcctatttt

SEQ ID NO: 1630855 - DNA, 12 bp, Homo sapiens
cagtcctcagga

SEQ ID NO: 1630856 - DNA, 23 bp, Homo sapiens
cagtcctccactcgacccagaat

SEQ ID NO: 1630857 - DNA, 19 bp, Homo sapiens
cagtcctcccaccttggcc

SEQ ID NO: 1630858 - DNA, 16 bp, Homo sapiens
cagtcctcttattcct

SEQ ID NO: 1630859 - DNA, 13 bp, Homo sapiens
cagtcctctttca

SEQ ID NO: 1630860 - DNA, 15 bp, Homo sapiens
cagtcctgaggagag

SEQ ID NO: 1630861 - DNA, 15 bp, Homo sapiens
cagtcctgcctggcc

SEQ ID NO: 1630862 - DNA, 16 bp, Homo sapiens
cagtcctgcctggcca

SEQ ID NO: 1630863 - DNA, 21 bp, Homo sapiens
cagtcctgcctggccaggcag

SEQ ID NO: 1630864 - DNA, 12 bp, Homo sapiens
cagtcctggagg

SEQ ID NO: 1630865 - DNA, 14 bp, Homo sapiens
cagtcctggtcctg

SEQ ID NO: 1630866 - DNA, 18 bp, Homo sapiens
cagtcctggtcctggctg

SEQ ID NO: 1630867 - DNA, 13 bp, Homo sapiens
cagtcctggtggg

SEQ ID NO: 1630868 - DNA, 13 bp, Homo sapiens
cagtcctttccca

SEQ ID NO: 1630869 - DNA, 21 bp, Homo sapiens
cagtcctttcccaccattcct

SEQ ID NO: 1630870 - DNA, 23 bp, Homo sapiens
cagtcctttcccaccattcctgc

SEQ ID NO: 1630871 - DNA, 14 bp, Homo sapiens
cagtcctttgtaaa

SEQ ID NO: 1630872 - DNA, 13 bp, Homo sapiens
cagtcgaccccaa

SEQ ID NO: 1630873 - DNA, 15 bp, Homo sapiens
cagtcgaccccaaag

SEQ ID NO: 1630874 - DNA, 21 bp, Homo sapiens
cagtcgcaggatccgctgcca

SEQ ID NO: 1630875 - DNA, 22 bp, Homo sapiens
cagtcgcaggatccgctgccac

SEQ ID NO: 1630876 - DNA, 17 bp, Homo sapiens
cagtcggcatgccagga

SEQ ID NO: 1630877 - DNA, 13 bp, Homo sapiens
cagtcgggggctg

SEQ ID NO: 1630878 - DNA, 18 bp, Homo sapiens
cagtcgggggctggccta

SEQ ID NO: 1630879 - DNA, 12 bp, Homo sapiens
cagtcgtgatgt

SEQ ID NO: 1630880 - DNA, 13 bp, Homo sapiens
cagtcgtgcctgt

SEQ ID NO: 1630881 - DNA, 22 bp, Homo sapiens
cagtcgttttagtgtctgacct

SEQ ID NO: 1630882 - DNA, 15 bp, Homo sapiens
cagtctatcattgtt

SEQ ID NO: 1630883 - DNA, 20 bp, Homo sapiens
cagtctcacagagaagctcc

SEQ ID NO: 1630884 - DNA, 14 bp, Homo sapiens
cagtctcagagacc

SEQ ID NO: 1630885 - DNA, 16 bp, Homo sapiens
cagtctcagagaccag

SEQ ID NO: 1630886 - DNA, 20 bp, Homo sapiens
cagtctcagagaccagcact

SEQ ID NO: 1630887 - DNA, 15 bp, Homo sapiens
cagtctcaggaaatc

SEQ ID NO: 1630888 - DNA, 19 bp, Homo sapiens
cagtctcaggagcatgggg

SEQ ID NO: 1630889 - DNA, 13 bp, Homo sapiens
cagtctcatttct

SEQ ID NO: 1630890 - DNA, 21 bp, Homo sapiens
cagtctcccaggccccctgca

SEQ ID NO: 1630891 - DNA, 23 bp, Homo sapiens
cagtctcccaggccccctgcatc

SEQ ID NO: 1630892 - DNA, 16 bp, Homo sapiens
cagtctccttcagcac

SEQ ID NO: 1630893 - DNA, 17 bp, Homo sapiens
cagtctccttcagcacg

SEQ ID NO: 1630894 - DNA, 22 bp, Homo sapiens
cagtctcgggtggctagtcaga

SEQ ID NO: 1630895 - DNA, 21 bp, Homo sapiens
cagtctctataccaataaagt

SEQ ID NO: 1630896 - DNA, 14 bp, Homo sapiens
cagtctctcttctc

SEQ ID NO: 1630897 - DNA, 17 bp, Homo sapiens
cagtctctcttctctcc

SEQ ID NO: 1630898 - DNA, 13 bp, Homo sapiens
cagtctctggaaa

SEQ ID NO: 1630899 - DNA, 19 bp, Homo sapiens
cagtctctttaatcttcag

SEQ ID NO: 1630900 - DNA, 20 bp, Homo sapiens
cagtctgggtaacagggaga

SEQ ID NO: 1630901 - DNA, 21 bp, Homo sapiens
cagtctgggtaacagggagac

SEQ ID NO: 1630902 - DNA, 15 bp, Homo sapiens
cagtctgttatgcac

SEQ ID NO: 1630903 - DNA, 22 bp, Homo sapiens
cagtctgttatgcactgtggtt

SEQ ID NO: 1630904 - DNA, 24 bp, Homo sapiens
cagtctgttatgcactgtggtttc

SEQ ID NO: 1630905 - DNA, 21 bp, Homo sapiens
cagtctgttccccatggccac

SEQ ID NO: 1630906 - DNA, 23 bp, Homo sapiens
cagtcttatagcaagactgttag

SEQ ID NO: 1630907 - DNA, 13 bp, Homo sapiens
cagtcttcctgac

SEQ ID NO: 1630908 - DNA, 16 bp, Homo sapiens
cagtcttcctgacact

SEQ ID NO: 1630909 - DNA, 16 bp, Homo sapiens
cagtcttctctctggc

SEQ ID NO: 1630910 - DNA, 16 bp, Homo sapiens
cagtcttgcctaggcc

SEQ ID NO: 1630911 - DNA, 18 bp, Homo sapiens
cagtcttgcctaggccaa

SEQ ID NO: 1630912 - DNA, 16 bp, Homo sapiens
cagtcttggctcactg

SEQ ID NO: 1630913 - DNA, 15 bp, Homo sapiens
cagtctttgctcagt

SEQ ID NO: 1630914 - DNA, 16 bp, Homo sapiens
cagtctttgctcagtg

SEQ ID NO: 1630915 - DNA, 17 bp, Homo sapiens
cagtctttgctcagtgt

SEQ ID NO: 1630916 - DNA, 17 bp, Homo sapiens
cagtgaaatacatcctt

SEQ ID NO: 1630917 - DNA, 15 bp, Homo sapiens
cagtgaacacatttt

SEQ ID NO: 1630918 - DNA, 12 bp, Homo sapiens
cagtgaacattc

SEQ ID NO: 1630919 - DNA, 15 bp, Homo sapiens
cagtgaacattccca

SEQ ID NO: 1630920 - DNA, 17 bp, Homo sapiens
cagtgaagacttcttgg

SEQ ID NO: 1630921 - DNA, 14 bp, Homo sapiens
cagtgaagagtaag

SEQ ID NO: 1630922 - DNA, 13 bp, Homo sapiens
cagtgaagcagca

SEQ ID NO: 1630923 - DNA, 17 bp, Homo sapiens
cagtgaagcagcactgt

SEQ ID NO: 1630924 - DNA, 12 bp, Homo sapiens
cagtgaagcctc

SEQ ID NO: 1630925 - DNA, 20 bp, Homo sapiens
cagtgaatatttttgtattt

SEQ ID NO: 1630926 - DNA, 18 bp, Homo sapiens
cagtgaatccctgggagc

SEQ ID NO: 1630927 - DNA, 21 bp, Homo sapiens
cagtgacacaatctcggctca

SEQ ID NO: 1630928 - DNA, 21 bp, Homo sapiens
cagtgacactggaccaggtcc

SEQ ID NO: 1630929 - DNA, 20 bp, Homo sapiens
cagtgacagagttcactata

SEQ ID NO: 1630930 - DNA, 19 bp, Homo sapiens
cagtgacatcaaagcctgg

SEQ ID NO: 1630931 - DNA, 20 bp, Homo sapiens
cagtgacatcaaagcctggc

SEQ ID NO: 1630932 - DNA, 16 bp, Homo sapiens
cagtgacgtgcacctg

SEQ ID NO: 1630933 - DNA, 16 bp, Homo sapiens
cagtgactcctgctgg

SEQ ID NO: 1630934 - DNA, 20 bp, Homo sapiens
cagtgactcctgctggtacc

SEQ ID NO: 1630935 - DNA, 18 bp, Homo sapiens
gttgccaactaagccctc

SEQ ID NO: 1630936 - DNA, 15 bp, Homo sapiens
gttgccactctcctc

SEQ ID NO: 1630937 - DNA, 12 bp, Homo sapiens
gttgccagcaga

SEQ ID NO: 1630938 - DNA, 17 bp, Homo sapiens
gttgccaggttgcagct

SEQ ID NO: 1630939 - DNA, 19 bp, Homo sapiens
gttgccaggttgcagctgc

SEQ ID NO: 1630940 - DNA, 12 bp, Homo sapiens
gttgccatttct

SEQ ID NO: 1630941 - DNA, 11 bp, Homo sapiens
gttgccccaga

SEQ ID NO: 1630942 - DNA, 19 bp, Homo sapiens
gttgcccctttctcttttc

SEQ ID NO: 1630943 - DNA, 15 bp, Homo sapiens
gttgcctgaaaaatg

SEQ ID NO: 1630944 - DNA, 15 bp, Homo sapiens
gttgcgacggagaga

SEQ ID NO: 1630945 - DNA, 16 bp, Homo sapiens
gttgcgacggagagaa

SEQ ID NO: 1630946 - DNA, 23 bp, Homo sapiens
gttgcgtggactctgcacatgtc

SEQ ID NO: 1630947 - DNA, 22 bp, Homo sapiens
gttgctcagcaaggggctctgc

SEQ ID NO: 1630948 - DNA, 18 bp, Homo sapiens
gttgctctgtttcttcct

SEQ ID NO: 1630949 - DNA, 19 bp, Homo sapiens
gttgctcttggaaagctga

SEQ ID NO: 1630950 - DNA, 16 bp, Homo sapiens
gttgctgatccctgct

SEQ ID NO: 1630951 - DNA, 18 bp, Homo sapiens
gttgctgatccctgctct

SEQ ID NO: 1630952 - DNA, 22 bp, Homo sapiens
gttgctgatggcccctccagca

SEQ ID NO: 1630953 - DNA, 11 bp, Homo sapiens
gttgctgctgt

SEQ ID NO: 1630954 - DNA, 12 bp, Homo sapiens
gttgctgctgtt

SEQ ID NO: 1630955 - DNA, 22 bp, Homo sapiens
gttgctgggagctgaaaaatca

SEQ ID NO: 1630956 - DNA, 12 bp, Homo sapiens
gttgctgtggct

SEQ ID NO: 1630957 - DNA, 15 bp, Homo sapiens
gttgctgtttcacaa

SEQ ID NO: 1630958 - DNA, 22 bp, Homo sapiens
gttgcttagatgagggtgactg

SEQ ID NO: 1630959 - DNA, 14 bp, Homo sapiens
gttgcttcccgctg

SEQ ID NO: 1630960 - DNA, 21 bp, Homo sapiens
gttgcttctcaggctatatgc

SEQ ID NO: 1630961 - DNA, 23 bp, Homo sapiens
gttgctttaaagtacctgtagtg

SEQ ID NO: 1630962 - DNA, 18 bp, Homo sapiens
gttgctttaatatgagct

SEQ ID NO: 1630963 - DNA, 14 bp, Homo sapiens
gttgctttgccaga

SEQ ID NO: 1630964 - DNA, 19 bp, Homo sapiens
gttgctttgccagagcagg

SEQ ID NO: 1630965 - DNA, 15 bp, Homo sapiens
gttgcttttttgact

SEQ ID NO: 1630966 - DNA, 15 bp, Homo sapiens
gttggaaaagaatac

SEQ ID NO: 1630967 - DNA, 20 bp, Homo sapiens
gttggaaaagaatacagaaa

SEQ ID NO: 1630968 - DNA, 22 bp, Homo sapiens
gttggaagctaccagagctcta

SEQ ID NO: 1630969 - DNA, 15 bp, Homo sapiens
gttggaatggatttt

SEQ ID NO: 1630970 - DNA, 17 bp, Homo sapiens
gttggaatggatttttc

SEQ ID NO: 1630971 - DNA, 21 bp, Homo sapiens
gttggacacctttaggttctt

SEQ ID NO: 1630972 - DNA, 20 bp, Homo sapiens
gttggacatttttttcgaat

SEQ ID NO: 1630973 - DNA, 14 bp, Homo sapiens
gttggactctcagg

SEQ ID NO: 1630974 - DNA, 16 bp, Homo sapiens
gttggactctcaggga

SEQ ID NO: 1630975 - DNA, 10 bp, Homo sapiens
gttggagaaa

SEQ ID NO: 1630976 - DNA, 13 bp, Homo sapiens
gttggagagcagc

SEQ ID NO: 1630977 - DNA, 14 bp, Homo sapiens
gttggagagcagca

SEQ ID NO: 1630978 - DNA, 13 bp, Homo sapiens
gttggagccactc

SEQ ID NO: 1630979 - DNA, 19 bp, Homo sapiens
gttggagcctgcagggtgg

SEQ ID NO: 1630980 - DNA, 15 bp, Homo sapiens
gttggagctcattct

SEQ ID NO: 1630981 - DNA, 18 bp, Homo sapiens
gttggagtactatattta

SEQ ID NO: 1630982 - DNA, 16 bp, Homo sapiens
gttggagtagaatgta

SEQ ID NO: 1630983 - DNA, 23 bp, Homo sapiens
gttggatggatgggtggatggcc

SEQ ID NO: 1630984 - DNA, 15 bp, Homo sapiens
gttggcactcacaga

SEQ ID NO: 1630985 - DNA, 19 bp, Homo sapiens
gttggcactcacagacctg

SEQ ID NO: 1630986 - DNA, 20 bp, Homo sapiens
gttggcactcacagacctgg

SEQ ID NO: 1630987 - DNA, 13 bp, Homo sapiens
gttggcagagaag

SEQ ID NO: 1630988 - DNA, 15 bp, Homo sapiens
gttggcaggagctcc

SEQ ID NO: 1630989 - DNA, 14 bp, Homo sapiens
gttggcaggctggc

SEQ ID NO: 1630990 - DNA, 16 bp, Homo sapiens
gttggcaggctggcca

SEQ ID NO: 1630991 - DNA, 15 bp, Homo sapiens
gttggcatagctctg

SEQ ID NO: 1630992 - DNA, 18 bp, Homo sapiens
gttggcatagctctgggg

SEQ ID NO: 1630993 - DNA, 18 bp, Homo sapiens
gttggccaggctggtcta

SEQ ID NO: 1630994 - DNA, 13 bp, Homo sapiens
gttggcctgcact

SEQ ID NO: 1630995 - DNA, 15 bp, Homo sapiens
gttggctcaggcaga

SEQ ID NO: 1630996 - DNA, 16 bp, Homo sapiens
gttggctgctgcggct

SEQ ID NO: 1630997 - DNA, 15 bp, Homo sapiens
gttgggaacatgctg

SEQ ID NO: 1630998 - DNA, 16 bp, Homo sapiens
gttgggacctgctgct

SEQ ID NO: 1630999 - DNA, 14 bp, Homo sapiens
gttgggagaatgtc

SEQ ID NO: 1631000 - DNA, 15 bp, Homo sapiens
gttgggagcactgga

SEQ ID NO: 1631001 - DNA, 16 bp, Homo sapiens
gttgggagcactggag

SEQ ID NO: 1631002 - DNA, 22 bp, Homo sapiens
gttgggagccctttggagaacg

SEQ ID NO: 1631003 - DNA, 15 bp, Homo sapiens
gttgggagcctagct

SEQ ID NO: 1631004 - DNA, 19 bp, Homo sapiens
gttgggattcctgacccag

SEQ ID NO: 1631005 - DNA, 22 bp, Homo sapiens
gttgggattgggggctggtgcc

SEQ ID NO: 1631006 - DNA, 23 bp, Homo sapiens
gttgggcaagacctcttccctct

SEQ ID NO: 1631007 - DNA, 16 bp, Homo sapiens
gttgggcccctgagga

SEQ ID NO: 1631008 - DNA, 17 bp, Homo sapiens
gttgggcccctgaggag

SEQ ID NO: 1631009 - DNA, 17 bp, Homo sapiens
gttgggggacagccttc

SEQ ID NO: 1631010 - DNA, 14 bp, Homo sapiens
gttggtaaacagtt

SEQ ID NO: 1631011 - DNA, 18 bp, Homo sapiens
gttggtagccatttggta

SEQ ID NO: 1631012 - DNA, 13 bp, Homo sapiens
gttggtagtttct

SEQ ID NO: 1631013 - DNA, 12 bp, Homo sapiens
gttggtgactga

SEQ ID NO: 1631014 - DNA, 17 bp, Homo sapiens
gttgtaaaatagaaaaa

SEQ ID NO: 1631015 - DNA, 18 bp, Homo sapiens
gttgtaaatgctcgtgtg

SEQ ID NO: 1631016 - DNA, 20 bp, Homo sapiens
gttgtaaatgctcgtgtgat

SEQ ID NO: 1631017 - DNA, 14 bp, Homo sapiens
gttgtaacctgctg

SEQ ID NO: 1631018 - DNA, 15 bp, Homo sapiens
gttgtaacttatatt

SEQ ID NO: 1631019 - DNA, 16 bp, Homo sapiens
gttgtaagaattctga

SEQ ID NO: 1631020 - DNA, 17 bp, Homo sapiens
gttgtaatatttcttca

SEQ ID NO: 1631021 - DNA, 16 bp, Homo sapiens
gttgtaccaagtgaaa

SEQ ID NO: 1631022 - DNA, 23 bp, Homo sapiens
gttgtacctcttttgcttgccaa

SEQ ID NO: 1631023 - DNA, 19 bp, Homo sapiens
gttcgcaccattctcctgc

SEQ ID NO: 1631024 - DNA, 14 bp, Homo sapiens
gttcgttggttata

SEQ ID NO: 1631025 - DNA, 14 bp, Homo sapiens
gttctaaagatgga

SEQ ID NO: 1631026 - DNA, 17 bp, Homo sapiens
gttctaaagatggaaaa

SEQ ID NO: 1631027 - DNA, 14 bp, Homo sapiens
gttctaaagctctg

SEQ ID NO: 1631028 - DNA, 18 bp, Homo sapiens
gttctaaaggactaacat

SEQ ID NO: 1631029 - DNA, 15 bp, Homo sapiens
gttctaaagttctaa

SEQ ID NO: 1631030 - DNA, 19 bp, Homo sapiens
gttctaaagttctaagatt

SEQ ID NO: 1631031 - DNA, 13 bp, Homo sapiens
gttctaacctcct

SEQ ID NO: 1631032 - DNA, 21 bp, Homo sapiens
gttctaagactcaaatgttct

SEQ ID NO: 1631033 - DNA, 21 bp, Homo sapiens
gttctaagatgtgatattcta

SEQ ID NO: 1631034 - DNA, 14 bp, Homo sapiens
gttctaagattcta

SEQ ID NO: 1631035 - DNA, 15 bp, Homo sapiens
gttctaagattctga

SEQ ID NO: 1631036 - DNA, 13 bp, Homo sapiens
gttctaaggccta

SEQ ID NO: 1631037 - DNA, 20 bp, Homo sapiens
gttctaaggcctaggattct

SEQ ID NO: 1631038 - DNA, 15 bp, Homo sapiens
gttctaagtttctaa

SEQ ID NO: 1631039 - DNA, 19 bp, Homo sapiens
gttctaagtttctaagatt

SEQ ID NO: 1631040 - DNA, 20 bp, Homo sapiens
gttctacctcaggcagctca

SEQ ID NO: 1631041 - DNA, 21 bp, Homo sapiens
gttctacctcaggcagctcaa

SEQ ID NO: 1631042 - DNA, 22 bp, Homo sapiens
gttctagacatggaggttctaa

SEQ ID NO: 1631043 - DNA, 19 bp, Homo sapiens
gttctagacgcccctccca

SEQ ID NO: 1631044 - DNA, 20 bp, Homo sapiens
gttctagacgcccctcccaa

SEQ ID NO: 1631045 - DNA, 23 bp, Homo sapiens
gttctaggcactgtagttctaag

SEQ ID NO: 1631046 - DNA, 21 bp, Homo sapiens
caggccccaccggccaggccg

SEQ ID NO: 1631047 - DNA, 23 bp, Homo sapiens
caggccccactccttcctgattg

SEQ ID NO: 1631048 - DNA, 13 bp, Homo sapiens
caggccccagcaa

SEQ ID NO: 1631049 - DNA, 20 bp, Homo sapiens
caggcccccaggtgccagtt

SEQ ID NO: 1631050 - DNA, 21 bp, Homo sapiens
caggccccccgcagcaccctg

SEQ ID NO: 1631051 - DNA, 15 bp, Homo sapiens
caggcccctgaggac

SEQ ID NO: 1631052 - DNA, 17 bp, Homo sapiens
caggcccgcaccccggc

SEQ ID NO: 1631053 - DNA, 19 bp, Homo sapiens
caggcccggcgcggtggct

SEQ ID NO: 1631054 - DNA, 14 bp, Homo sapiens
caggcccggggctg

SEQ ID NO: 1631055 - DNA, 19 bp, Homo sapiens
caggcccgtcggagctgcc

SEQ ID NO: 1631056 - DNA, 21 bp, Homo sapiens
caggcccgtcggagctgcctg

SEQ ID NO: 1631057 - DNA, 23 bp, Homo sapiens
caggcccgtcggagctgcctgca

SEQ ID NO: 1631058 - DNA, 18 bp, Homo sapiens
caggccctccatgggcta

SEQ ID NO: 1631059 - DNA, 20 bp, Homo sapiens
caggccctccatgggctagt

SEQ ID NO: 1631060 - DNA, 21 bp, Homo sapiens
caggccctccatgggctagtg

SEQ ID NO: 1631061 - DNA, 15 bp, Homo sapiens
caggccctctgcctg

SEQ ID NO: 1631062 - DNA, 16 bp, Homo sapiens
caggccctctgcctgc

SEQ ID NO: 1631063 - DNA, 23 bp, Homo sapiens
caggccctgccagtggggaagga

SEQ ID NO: 1631064 - DNA, 15 bp, Homo sapiens
caggccctggcctcc

SEQ ID NO: 1631065 - DNA, 18 bp, Homo sapiens
caggccctggcctcccct

SEQ ID NO: 1631066 - DNA, 20 bp, Homo sapiens
caggccctggcctcccctgc

SEQ ID NO: 1631067 - DNA, 17 bp, Homo sapiens
caggccctgtggcagga

SEQ ID NO: 1631068 - DNA, 16 bp, Homo sapiens
caggcccttcctctcc

SEQ ID NO: 1631069 - DNA, 17 bp, Homo sapiens
caggcccttcctctcca

SEQ ID NO: 1631070 - DNA, 19 bp, Homo sapiens
caggcccttcctctccact

SEQ ID NO: 1631071 - DNA, 21 bp, Homo sapiens
caggcccttcctctccactgc

SEQ ID NO: 1631072 - DNA, 15 bp, Homo sapiens
caggcccttggctgc

SEQ ID NO: 1631073 - DNA, 16 bp, Homo sapiens
caggcccttggctgca

SEQ ID NO: 1631074 - DNA, 19 bp, Homo sapiens
caggccctttggcttctga

SEQ ID NO: 1631075 - DNA, 14 bp, Homo sapiens
caggccgaggcagg

SEQ ID NO: 1631076 - DNA, 14 bp, Homo sapiens
caggccgcagctct

SEQ ID NO: 1631077 - DNA, 23 bp, Homo sapiens
caggccgggcttgggccctgcac

SEQ ID NO: 1631078 - DNA, 19 bp, Homo sapiens
caggccggggtggagcatg

SEQ ID NO: 1631079 - DNA, 23 bp, Homo sapiens
caggccgttccccttggcttcct

SEQ ID NO: 1631080 - DNA, 21 bp, Homo sapiens
caggcctccaacgcccctgtg

SEQ ID NO: 1631081 - DNA, 22 bp, Homo sapiens
caggcctccaacgcccctgtgg

SEQ ID NO: 1631082 - DNA, 18 bp, Homo sapiens
caggcctccagcctctcc

SEQ ID NO: 1631083 - DNA, 19 bp, Homo sapiens
caggcctccagcctctccc

SEQ ID NO: 1631084 - DNA, 13 bp, Homo sapiens
caggcctccctct

SEQ ID NO: 1631085 - DNA, 22 bp, Homo sapiens
caggcctccctctctcttctgc

SEQ ID NO: 1631086 - DNA, 14 bp, Homo sapiens
caggcctccctgca

SEQ ID NO: 1631087 - DNA, 20 bp, Homo sapiens
caggcctccctgcagactcc

SEQ ID NO: 1631088 - DNA, 14 bp, Homo sapiens
caggcctctgcctg

SEQ ID NO: 1631089 - DNA, 21 bp, Homo sapiens
caggcctctgcctgctgggga

SEQ ID NO: 1631090 - DNA, 19 bp, Homo sapiens
caggcctgaagtcttctcc

SEQ ID NO: 1631091 - DNA, 14 bp, Homo sapiens
caggcctgaccagg

SEQ ID NO: 1631092 - DNA, 16 bp, Homo sapiens
caggcctgaccagggg

SEQ ID NO: 1631093 - DNA, 16 bp, Homo sapiens
caggcctgagatttca

SEQ ID NO: 1631094 - DNA, 23 bp, Homo sapiens
caggcctgagatttcatctgctc

SEQ ID NO: 1631095 - DNA, 18 bp, Homo sapiens
caggcctgatcttgcctg

SEQ ID NO: 1631096 - DNA, 12 bp, Homo sapiens
caggcctggcct

SEQ ID NO: 1631097 - DNA, 13 bp, Homo sapiens
caggcctggcctc

SEQ ID NO: 1631098 - DNA, 15 bp, Homo sapiens
caggcctggcctctg

SEQ ID NO: 1631099 - DNA, 11 bp, Homo sapiens
caggcctggga

SEQ ID NO: 1631100 - DNA, 13 bp, Homo sapiens
caggcctgggacc

SEQ ID NO: 1631101 - DNA, 18 bp, Homo sapiens
caggcctgtccaccctgc

SEQ ID NO: 1631102 - DNA, 23 bp, Homo sapiens
caggcctgttgctatagagccta

SEQ ID NO: 1631103 - DNA, 10 bp, Homo sapiens
caggccttca

SEQ ID NO: 1631104 - DNA, 16 bp, Homo sapiens
caggccttcatcctcc

SEQ ID NO: 1631105 - DNA, 22 bp, Homo sapiens
caggcgatggggcaagacagaa

SEQ ID NO: 1631106 - DNA, 15 bp, Homo sapiens
caggcgccccttccc

SEQ ID NO: 1631107 - DNA, 19 bp, Homo sapiens
caggcgcctataatcccag

SEQ ID NO: 1631108 - DNA, 24 bp, Homo sapiens
caggcgcctataatcccagctact

SEQ ID NO: 1631109 - DNA, 14 bp, Homo sapiens
caggcgctgcaggg

SEQ ID NO: 1631110 - DNA, 16 bp, Homo sapiens
caggcgggaggaggtg

SEQ ID NO: 1631111 - DNA, 22 bp, Homo sapiens
caggcggggcccagcgctctcc

SEQ ID NO: 1631112 - DNA, 16 bp, Homo sapiens
caggcggggtgctgtg

SEQ ID NO: 1631113 - DNA, 15 bp, Homo sapiens
caggcgttggtgcca

SEQ ID NO: 1631114 - DNA, 15 bp, Homo sapiens
caggcgtttctgaag

SEQ ID NO: 1631115 - DNA, 15 bp, Homo sapiens
caggctaagaccctg

SEQ ID NO: 1631116 - DNA, 11 bp, Homo sapiens
caggctactgt

SEQ ID NO: 1631117 - DNA, 13 bp, Homo sapiens
caggctattattt

SEQ ID NO: 1631118 - DNA, 22 bp, Homo sapiens
caggctcactgccaggccagcc

SEQ ID NO: 1631119 - DNA, 22 bp, Homo sapiens
caggctcatagggaagacctgc

SEQ ID NO: 1631120 - DNA, 22 bp, Homo sapiens
caggctcatgccatcatgccca

SEQ ID NO: 1631121 - DNA, 13 bp, Homo sapiens
caggctccatgca

SEQ ID NO: 1631122 - DNA, 17 bp, Homo sapiens
caggctccatgcacctc

SEQ ID NO: 1631123 - DNA, 18 bp, Homo sapiens
caggctccatgcacctcc

SEQ ID NO: 1631124 - DNA, 20 bp, Homo sapiens
caggctccctttctcttctt

SEQ ID NO: 1631125 - DNA, 19 bp, Homo sapiens
caggctcctggctgtgccc

SEQ ID NO: 1631126 - DNA, 21 bp, Homo sapiens
caggctcctggctgtgcccag

SEQ ID NO: 1631127 - DNA, 22 bp, Homo sapiens
caggctcctggctgtgcccagc

SEQ ID NO: 1631128 - DNA, 18 bp, Homo sapiens
caggctccttcctgtctt

SEQ ID NO: 1631129 - DNA, 19 bp, Homo sapiens
caggctcggaggaccctgg

SEQ ID NO: 1631130 - DNA, 12 bp, Homo sapiens
caggctctgcac

SEQ ID NO: 1631131 - DNA, 13 bp, Homo sapiens
caggctctgggct

SEQ ID NO: 1631132 - DNA, 16 bp, Homo sapiens
caggctcttcctggac

SEQ ID NO: 1631133 - DNA, 14 bp, Homo sapiens
caggctcttctcct

SEQ ID NO: 1631134 - DNA, 15 bp, Homo sapiens
caggctcttctcctt

SEQ ID NO: 1631135 - DNA, 22 bp, Homo sapiens
caggctcttctcctttcacaac

SEQ ID NO: 1631136 - DNA, 19 bp, Homo sapiens
caggctgaattacagtgaa

SEQ ID NO: 1631137 - DNA, 19 bp, Homo sapiens
gttgacaccattctcctgc

SEQ ID NO: 1631138 - DNA, 20 bp, Homo sapiens
gttgacaccattctcctgcc

SEQ ID NO: 1631139 - DNA, 18 bp, Homo sapiens
gttgacagttcatatgta

SEQ ID NO: 1631140 - DNA, 16 bp, Homo sapiens
gttgacagttctgaag

SEQ ID NO: 1631141 - DNA, 17 bp, Homo sapiens
gttgacagttctgaaga

SEQ ID NO: 1631142 - DNA, 15 bp, Homo sapiens
gttgacgagactggt

SEQ ID NO: 1631143 - DNA, 14 bp, Homo sapiens
gttgagatccagtg

SEQ ID NO: 1631144 - DNA, 14 bp, Homo sapiens
gttgagcaagcagt

SEQ ID NO: 1631145 - DNA, 16 bp, Homo sapiens
gttgagccccaagtcc

SEQ ID NO: 1631146 - DNA, 19 bp, Homo sapiens
gttgagccccagtgctgga

SEQ ID NO: 1631147 - DNA, 17 bp, Homo sapiens
gttgaggggctcctgga

SEQ ID NO: 1631148 - DNA, 18 bp, Homo sapiens
gttgaggggctcctggaa

SEQ ID NO: 1631149 - DNA, 23 bp, Homo sapiens
gttgatagcaagtgaatttttct

SEQ ID NO: 1631150 - DNA, 22 bp, Homo sapiens
gttgatcagccttatgtggaag

SEQ ID NO: 1631151 - DNA, 17 bp, Homo sapiens
gttgatttttactgtgt

SEQ ID NO: 1631152 - DNA, 24 bp, Homo sapiens
gttgcaagactcgaataaaatctg

SEQ ID NO: 1631153 - DNA, 17 bp, Homo sapiens
gttgcaaggccgctgtt

SEQ ID NO: 1631154 - DNA, 17 bp, Homo sapiens
gttgcaccatctgcttg

SEQ ID NO: 1631155 - DNA, 17 bp, Homo sapiens
gttgcactaactgctgg

SEQ ID NO: 1631156 - DNA, 17 bp, Homo sapiens
gttgcagtgagctgaga

SEQ ID NO: 1631157 - DNA, 15 bp, Homo sapiens
gttgcagtggagagg

SEQ ID NO: 1631158 - DNA, 17 bp, Homo sapiens
gttgcagtggcctggcc

SEQ ID NO: 1631159 - DNA, 18 bp, Homo sapiens
gttgcatagcagtatatg

SEQ ID NO: 1631160 - DNA, 18 bp, Homo sapiens
gttgcatatgagcctgcc

SEQ ID NO: 1631161 - DNA, 16 bp, Homo sapiens
gttgcatgtagtaaca

SEQ ID NO: 1631162 - DNA, 19 bp, Homo sapiens
gttgccaaatatgtcctgg

SEQ ID NO: 1631163 - DNA, 21 bp, Homo sapiens
gtgctggaagtctccatgaag

SEQ ID NO: 1631164 - DNA, 20 bp, Homo sapiens
gtgctggaattccacaggga

SEQ ID NO: 1631165 - DNA, 22 bp, Homo sapiens
gtgctggcccacccagtccatg

SEQ ID NO: 1631166 - DNA, 12 bp, Homo sapiens
gtgctgggacca

SEQ ID NO: 1631167 - DNA, 13 bp, Homo sapiens
gtgctgggaccag

SEQ ID NO: 1631168 - DNA, 17 bp, Homo sapiens
gtgctgggaccagagcc

SEQ ID NO: 1631169 - DNA, 20 bp, Homo sapiens
gtgctgggactgagccagtc

SEQ ID NO: 1631170 - DNA, 23 bp, Homo sapiens
gtgctgggaggagggagagggag

SEQ ID NO: 1631171 - DNA, 20 bp, Homo sapiens
gtgctgggattacaggcgtg

SEQ ID NO: 1631172 - DNA, 19 bp, Homo sapiens
gtgctgggccagtggctgg

SEQ ID NO: 1631173 - DNA, 19 bp, Homo sapiens
gtgctgggttcccactccc

SEQ ID NO: 1631174 - DNA, 22 bp, Homo sapiens
gtgctggtcagagagacctcat

SEQ ID NO: 1631175 - DNA, 21 bp, Homo sapiens
gtgctggtctattttgatttt

SEQ ID NO: 1631176 - DNA, 15 bp, Homo sapiens
gtgctggtgaacact

SEQ ID NO: 1631177 - DNA, 18 bp, Homo sapiens
gtgctggtgaacactgtg

SEQ ID NO: 1631178 - DNA, 19 bp, Homo sapiens
gtgctggtgaacactgtga

SEQ ID NO: 1631179 - DNA, 14 bp, Homo sapiens
gtgctggtgcatca

SEQ ID NO: 1631180 - DNA, 15 bp, Homo sapiens
gtgctggtgtcctga

SEQ ID NO: 1631181 - DNA, 16 bp, Homo sapiens
gtgctggtgtcctgac

SEQ ID NO: 1631182 - DNA, 21 bp, Homo sapiens
gtgctgtacccttccacctcc

SEQ ID NO: 1631183 - DNA, 17 bp, Homo sapiens
gtgctgtcttttgttct

SEQ ID NO: 1631184 - DNA, 15 bp, Homo sapiens
gtgctgtgagggagg

SEQ ID NO: 1631185 - DNA, 13 bp, Homo sapiens
gtgctgtgcctgc

SEQ ID NO: 1631186 - DNA, 17 bp, Homo sapiens
gtgctgtgctctggcac

SEQ ID NO: 1631187 - DNA, 21 bp, Homo sapiens
gtgctgtggacatgtgggtgg

SEQ ID NO: 1631188 - DNA, 11 bp, Homo sapiens
gtgctgtggcc

SEQ ID NO: 1631189 - DNA, 13 bp, Homo sapiens
gtgctgtgtgccc

SEQ ID NO: 1631190 - DNA, 17 bp, Homo sapiens
gtgctgtgtgccccact

SEQ ID NO: 1631191 - DNA, 15 bp, Homo sapiens
gtgcttagttggctt

SEQ ID NO: 1631192 - DNA, 19 bp, Homo sapiens
gtgcttattctcaaagcag

SEQ ID NO: 1631193 - DNA, 15 bp, Homo sapiens
gtgcttcaattaata

SEQ ID NO: 1631194 - DNA, 14 bp, Homo sapiens
gtgcttcagagttt

SEQ ID NO: 1631195 - DNA, 15 bp, Homo sapiens
gtgcttcagcctgag

SEQ ID NO: 1631196 - DNA, 19 bp, Homo sapiens
gtgcttccaacaaggacag

SEQ ID NO: 1631197 - DNA, 19 bp, Homo sapiens
gtgcttcccccacccctcc

SEQ ID NO: 1631198 - DNA, 20 bp, Homo sapiens
gtgcttcccccacccctcca

SEQ ID NO: 1631199 - DNA, 23 bp, Homo sapiens
gtgcttcccccacccctccacgt

SEQ ID NO: 1631200 - DNA, 13 bp, Homo sapiens
gtgcttgaaggcc

SEQ ID NO: 1631201 - DNA, 15 bp, Homo sapiens
gtgcttgaaggccct

SEQ ID NO: 1631202 - DNA, 18 bp, Homo sapiens
gtgcttgaaggccctgct

SEQ ID NO: 1631203 - DNA, 23 bp, Homo sapiens
gtgcttgctggtgcctgccacct

SEQ ID NO: 1631204 - DNA, 19 bp, Homo sapiens
gtgcttgtcattccagagt

SEQ ID NO: 1631205 - DNA, 19 bp, Homo sapiens
gtgcttgtttacagcacta

SEQ ID NO: 1631206 - DNA, 21 bp, Homo sapiens
gtgctttagagataattgctt

SEQ ID NO: 1631207 - DNA, 18 bp, Homo sapiens
gtgctttgtgttcagttt

SEQ ID NO: 1631208 - DNA, 20 bp, Homo sapiens
gtgctttgttgatttagatg

SEQ ID NO: 1631209 - DNA, 12 bp, Homo sapiens
gtgcttttctgt

SEQ ID NO: 1631210 - DNA, 15 bp, Homo sapiens
gtgcttttgatgtga

SEQ ID NO: 1631211 - DNA, 23 bp, Homo sapiens
gtgctttttaagaatatttttag

SEQ ID NO: 1631212 - DNA, 12 bp, Homo sapiens
gtggaaaaccag

SEQ ID NO: 1631213 - DNA, 15 bp, Homo sapiens
gtggaaaaccaggaa

SEQ ID NO: 1631214 - DNA, 20 bp, Homo sapiens
gtggaaagtagctgctagtg

SEQ ID NO: 1631215 - DNA, 20 bp, Homo sapiens
gtggaaatcaaccctctcct

SEQ ID NO: 1631216 - DNA, 16 bp, Homo sapiens
gtggaacgaaaatgaa

SEQ ID NO: 1631217 - DNA, 15 bp, Homo sapiens
gtggaagaagggaga

SEQ ID NO: 1631218 - DNA, 16 bp, Homo sapiens
gtggaagccctccttc

SEQ ID NO: 1631219 - DNA, 17 bp, Homo sapiens
gtggaagccctccttcc

SEQ ID NO: 1631220 - DNA, 16 bp, Homo sapiens
gtggaaggcaagccag

SEQ ID NO: 1631221 - DNA, 20 bp, Homo sapiens
gtggaagggggtgtgcgtgc

SEQ ID NO: 1631222 - DNA, 15 bp, Homo sapiens
gtggaagtgtgggtc

SEQ ID NO: 1631223 - DNA, 19 bp, Homo sapiens
gtggaagtgtgggtctgtg

SEQ ID NO: 1631224 - DNA, 20 bp, Homo sapiens
gtggaagtgtgggtctgtgt

SEQ ID NO: 1631225 - DNA, 21 bp, Homo sapiens
gtggaagtgtgggtctgtgtg

SEQ ID NO: 1631226 - DNA, 22 bp, Homo sapiens
gtggaagtgtgggtctgtgtgt

SEQ ID NO: 1631227 - DNA, 23 bp, Homo sapiens
gtggaataaacattaattttgtg

SEQ ID NO: 1631228 - DNA, 18 bp, Homo sapiens
gtggaatataaggaaagc

SEQ ID NO: 1631229 - DNA, 18 bp, Homo sapiens
gtggaatgcagggaagag

SEQ ID NO: 1631230 - DNA, 15 bp, Homo sapiens
gtggacaccaggagt

SEQ ID NO: 1631231 - DNA, 20 bp, Homo sapiens
gtggacaggatgaggacaga

SEQ ID NO: 1631232 - DNA, 22 bp, Homo sapiens
gtggacaggatgaggacagagg

SEQ ID NO: 1631233 - DNA, 23 bp, Homo sapiens
gtggacaggcccagcgcggccag

SEQ ID NO: 1631234 - DNA, 16 bp, Homo sapiens
gtggacagtcctggga

SEQ ID NO: 1631235 - DNA, 18 bp, Homo sapiens
gtggacatgtgggtggag

SEQ ID NO: 1631236 - DNA, 13 bp, Homo sapiens
gtggaccaggaca

SEQ ID NO: 1631237 - DNA, 19 bp, Homo sapiens
gtggacccagcgggcaggt

SEQ ID NO: 1631238 - DNA, 22 bp, Homo sapiens
gtggaccctgtcttctgggcac

SEQ ID NO: 1631239 - DNA, 19 bp, Homo sapiens
gtggaccgtggacaggccc

SEQ ID NO: 1631240 - DNA, 17 bp, Homo sapiens
gtggaccttaggccttc

SEQ ID NO: 1631241 - DNA, 18 bp, Homo sapiens
gtggaccttaggccttcc

SEQ ID NO: 1631242 - DNA, 21 bp, Homo sapiens
gtggaccttaggccttcctct

SEQ ID NO: 1631243 - DNA, 18 bp, Homo sapiens
gtggacgagagggctgtg

SEQ ID NO: 1631244 - DNA, 22 bp, Homo sapiens
gtggacgagagggctgtgagca

SEQ ID NO: 1631245 - DNA, 21 bp, Homo sapiens
gtggactctgaggactcctga

SEQ ID NO: 1631246 - DNA, 22 bp, Homo sapiens
gtggactctgaggactcctgag

SEQ ID NO: 1631247 - DNA, 20 bp, Homo sapiens
gtggactgagtgggaagccc

SEQ ID NO: 1631248 - DNA, 14 bp, Homo sapiens
gtggactgcattta

SEQ ID NO: 1631249 - DNA, 20 bp, Homo sapiens
gtggactgcatttaaatttg

SEQ ID NO: 1631250 - DNA, 15 bp, Homo sapiens
gtggactgtcctgag

SEQ ID NO: 1631251 - DNA, 17 bp, Homo sapiens
gtggagaaaattggaac

SEQ ID NO: 1631252 - DNA, 20 bp, Homo sapiens
gtggagaaagcactgacctg

SEQ ID NO: 1631253 - DNA, 14 bp, Homo sapiens
gtggagaagggagg

SEQ ID NO: 1631254 - DNA, 15 bp, Homo sapiens
gtggagaagggaggg

SEQ ID NO: 1631255 - DNA, 11 bp, Homo sapiens
gtggagactgc

SEQ ID NO: 1631256 - DNA, 16 bp, Homo sapiens
gtggagagctggtgcc

SEQ ID NO: 1631257 - DNA, 18 bp, Homo sapiens
gtggagagggaatgtgaa

SEQ ID NO: 1631258 - DNA, 22 bp, Homo sapiens
gtggagagggacagcccactga

SEQ ID NO: 1631259 - DNA, 20 bp, Homo sapiens
gtggagaggggtgcacccac

SEQ ID NO: 1631260 - DNA, 21 bp, Homo sapiens
gtggagatcagaaagtgacat

SEQ ID NO: 1631261 - DNA, 12 bp, Homo sapiens
gtggagcagcca

SEQ ID NO: 1631262 - DNA, 17 bp, Homo sapiens
gtggagcagccagagct

SEQ ID NO: 1631263 - DNA, 17 bp, Homo sapiens
gtggagcatgggcctgg

SEQ ID NO: 1631264 - DNA, 18 bp, Homo sapiens
gtggagccaagtggtcca

SEQ ID NO: 1631265 - DNA, 12 bp, Homo sapiens
gtggagccaggg

SEQ ID NO: 1631266 - DNA, 22 bp, Homo sapiens
gtggagcctgccgcccccgcct

SEQ ID NO: 1631267 - DNA, 12 bp, Homo sapiens
gtggagctggga

SEQ ID NO: 1631268 - DNA, 16 bp, Homo sapiens
gtggaggaagagccac

SEQ ID NO: 1631269 - DNA, 17 bp, Homo sapiens
gtggaggaagagccacc

SEQ ID NO: 1631270 - DNA, 11 bp, Homo sapiens
gtggaggagga

SEQ ID NO: 1631271 - DNA, 14 bp, Homo sapiens
gtggaggaggaggg

SEQ ID NO: 1631272 - DNA, 18 bp, Homo sapiens
gtggaggaggagggaggc

SEQ ID NO: 1631273 - DNA, 16 bp, Homo sapiens
gtggaggcctgatgct

SEQ ID NO: 1631274 - DNA, 19 bp, Homo sapiens
gtggaggcctgatgctgcc

SEQ ID NO: 1631275 - DNA, 20 bp, Homo sapiens
gtggaggcctgatgctgccc

SEQ ID NO: 1631276 - DNA, 14 bp, Homo sapiens
gtggaggcttcctg

SEQ ID NO: 1631277 - DNA, 12 bp, Homo sapiens
gtggagggaggg

SEQ ID NO: 1631278 - DNA, 17 bp, Homo sapiens
gtggagggcacagccct

SEQ ID NO: 1631279 - DNA, 14 bp, Homo sapiens
gtgatggttcccct

SEQ ID NO: 1631280 - DNA, 19 bp, Homo sapiens
gtgatggttgccaggacga

SEQ ID NO: 1631281 - DNA, 12 bp, Homo sapiens
gtgatgtatttt

SEQ ID NO: 1631282 - DNA, 12 bp, Homo sapiens
gtgatgtgccac

SEQ ID NO: 1631283 - DNA, 16 bp, Homo sapiens
gtgatgttctaaggct

SEQ ID NO: 1631284 - DNA, 18 bp, Homo sapiens
gtgatgttctaaggctct

SEQ ID NO: 1631285 - DNA, 19 bp, Homo sapiens
gtgatgttctaaggctctg

SEQ ID NO: 1631286 - DNA, 17 bp, Homo sapiens
gtgatgtttccagctgc

SEQ ID NO: 1631287 - DNA, 14 bp, Homo sapiens
gtgatgtttgctct

SEQ ID NO: 1631288 - DNA, 15 bp, Homo sapiens
gtgattaaacgtgca

SEQ ID NO: 1631289 - DNA, 19 bp, Homo sapiens
gtgattaaacgtgcagact

SEQ ID NO: 1631290 - DNA, 19 bp, Homo sapiens
gtgattaaagctaaggacc

SEQ ID NO: 1631291 - DNA, 14 bp, Homo sapiens
gtgattaacttgct

SEQ ID NO: 1631292 - DNA, 17 bp, Homo sapiens
gtgattagagctgcata

SEQ ID NO: 1631293 - DNA, 20 bp, Homo sapiens
cagctggcccactgctggct

SEQ ID NO: 1631294 - DNA, 16 bp, Homo sapiens
cagctggcctggacag

SEQ ID NO: 1631295 - DNA, 20 bp, Homo sapiens
cagctggctctgacaagatg

SEQ ID NO: 1631296 - DNA, 15 bp, Homo sapiens
cagctggctgggcct

SEQ ID NO: 1631297 - DNA, 21 bp, Homo sapiens
cagctggctgggccttcacca

SEQ ID NO: 1631298 - DNA, 15 bp, Homo sapiens
cagctgggacccctc

SEQ ID NO: 1631299 - DNA, 13 bp, Homo sapiens
cagctgggagcac

SEQ ID NO: 1631300 - DNA, 20 bp, Homo sapiens
cagctgggcagggtgagaag

SEQ ID NO: 1631301 - DNA, 17 bp, Homo sapiens
cagctgggcatgccatg

SEQ ID NO: 1631302 - DNA, 20 bp, Homo sapiens
cagctgggcatgccatgtct

SEQ ID NO: 1631303 - DNA, 22 bp, Homo sapiens
cagctgggcatgccatgtctga

SEQ ID NO: 1631304 - DNA, 12 bp, Homo sapiens
cagctgggcccc

SEQ ID NO: 1631305 - DNA, 13 bp, Homo sapiens
cagctgggcccca

SEQ ID NO: 1631306 - DNA, 18 bp, Homo sapiens
cagctgggccccatgctc

SEQ ID NO: 1631307 - DNA, 11 bp, Homo sapiens
cagctgggctc

SEQ ID NO: 1631308 - DNA, 15 bp, Homo sapiens
cagctgggctctgca

SEQ ID NO: 1631309 - DNA, 16 bp, Homo sapiens
cagctgggctctgcaa

SEQ ID NO: 1631310 - DNA, 15 bp, Homo sapiens
cagctggggagcagc

SEQ ID NO: 1631311 - DNA, 18 bp, Homo sapiens
cagctggggcgtggggag

SEQ ID NO: 1631312 - DNA, 18 bp, Homo sapiens
cagctggtcagtctttgc

SEQ ID NO: 1631313 - DNA, 19 bp, Homo sapiens
cagctggtcagtctttgct

SEQ ID NO: 1631314 - DNA, 20 bp, Homo sapiens
cagctggtcagtctttgctc

SEQ ID NO: 1631315 - DNA, 22 bp, Homo sapiens
cagctggtcagtctttgctcag

SEQ ID NO: 1631316 - DNA, 20 bp, Homo sapiens
cagctggtgcaaattcagaa

SEQ ID NO: 1631317 - DNA, 21 bp, Homo sapiens
cagctggtgcaaattcagaac

SEQ ID NO: 1631318 - DNA, 24 bp, Homo sapiens
cagctggtgccaaatagccccaga

SEQ ID NO: 1631319 - DNA, 14 bp, Homo sapiens
cagctggtgcccca

SEQ ID NO: 1631320 - DNA, 15 bp, Homo sapiens
cagctggtgccccac

SEQ ID NO: 1631321 - DNA, 16 bp, Homo sapiens
cagctggtgccccacc

SEQ ID NO: 1631322 - DNA, 21 bp, Homo sapiens
cagctggtgccccacctgcct

SEQ ID NO: 1631323 - DNA, 16 bp, Homo sapiens
cagctgtaatctatga

SEQ ID NO: 1631324 - DNA, 19 bp, Homo sapiens
cagctgtagccatggctca

SEQ ID NO: 1631325 - DNA, 20 bp, Homo sapiens
cagctgtagccatggctcag

SEQ ID NO: 1631326 - DNA, 21 bp, Homo sapiens
cagctgtagccatggctcagg

SEQ ID NO: 1631327 - DNA, 21 bp, Homo sapiens
cagctgtcagaacactccaag

SEQ ID NO: 1631328 - DNA, 14 bp, Homo sapiens
cagctgtccctgtc

SEQ ID NO: 1631329 - DNA, 13 bp, Homo sapiens
cagctgtgcactt

SEQ ID NO: 1631330 - DNA, 15 bp, Homo sapiens
cagctgtgctgcacc

SEQ ID NO: 1631331 - DNA, 23 bp, Homo sapiens
cagctgtggcagagttacagttc

SEQ ID NO: 1631332 - DNA, 21 bp, Homo sapiens
cagctgtggctggaggagctg

SEQ ID NO: 1631333 - DNA, 14 bp, Homo sapiens
cagctgtttgtcat

SEQ ID NO: 1631334 - DNA, 21 bp, Homo sapiens
cagcttaaacccatacaatgt

SEQ ID NO: 1631335 - DNA, 18 bp, Homo sapiens
cagcttaacattgacttc

SEQ ID NO: 1631336 - DNA, 17 bp, Homo sapiens
cagcttagagttcttct

SEQ ID NO: 1631337 - DNA, 21 bp, Homo sapiens
cagcttatgggatccttgtct

SEQ ID NO: 1631338 - DNA, 17 bp, Homo sapiens
cagcttcagccaggagc

SEQ ID NO: 1631339 - DNA, 13 bp, Homo sapiens
cagcttcagctca

SEQ ID NO: 1631340 - DNA, 19 bp, Homo sapiens
cagcttcatgcctttgtaa

SEQ ID NO: 1631341 - DNA, 20 bp, Homo sapiens
cagcttcatgcctttgtaag

SEQ ID NO: 1631342 - DNA, 14 bp, Homo sapiens
cagcttcctcacac

SEQ ID NO: 1631343 - DNA, 19 bp, Homo sapiens
cagcttcctcacacccctg

SEQ ID NO: 1631344 - DNA, 20 bp, Homo sapiens
cagcttcctcacacccctgt

SEQ ID NO: 1631345 - DNA, 20 bp, Homo sapiens
cagcttcctttcctgtgtgt

SEQ ID NO: 1631346 - DNA, 17 bp, Homo sapiens
cagcttctctctccagg

SEQ ID NO: 1631347 - DNA, 19 bp, Homo sapiens
cagcttctctctccagggt

SEQ ID NO: 1631348 - DNA, 12 bp, Homo sapiens
cagcttctggag

SEQ ID NO: 1631349 - DNA, 13 bp, Homo sapiens
cagcttctggagc

SEQ ID NO: 1631350 - DNA, 15 bp, Homo sapiens
cagcttctggagcag

SEQ ID NO: 1631351 - DNA, 19 bp, Homo sapiens
cagcttcttcacaggcact

SEQ ID NO: 1631352 - DNA, 17 bp, Homo sapiens
cagcttgacctgaggct

SEQ ID NO: 1631353 - DNA, 15 bp, Homo sapiens
cagcttgactgcttt

SEQ ID NO: 1631354 - DNA, 22 bp, Homo sapiens
cagcttgcattgattgctacaa

SEQ ID NO: 1631355 - DNA, 13 bp, Homo sapiens
cagcttgccccgg

SEQ ID NO: 1631356 - DNA, 15 bp, Homo sapiens
cagcttgctcttcag

SEQ ID NO: 1631357 - DNA, 13 bp, Homo sapiens
cagcttgctgtca

SEQ ID NO: 1631358 - DNA, 21 bp, Homo sapiens
cagcttgctgtcacttcttca

SEQ ID NO: 1631359 - DNA, 12 bp, Homo sapiens
cagcttggctca

SEQ ID NO: 1631360 - DNA, 21 bp, Homo sapiens
cagcttggctcacaaggccca

SEQ ID NO: 1631361 - DNA, 22 bp, Homo sapiens
cagcttggctcacaaggcccag

SEQ ID NO: 1631362 - DNA, 17 bp, Homo sapiens
cagcttgggcccagctg

SEQ ID NO: 1631363 - DNA, 21 bp, Homo sapiens
cagcttgggcccagctgggct

SEQ ID NO: 1631364 - DNA, 23 bp, Homo sapiens
cagcttgggcccagctgggctct

SEQ ID NO: 1631365 - DNA, 20 bp, Homo sapiens
cagcttggggccaccaaagc

SEQ ID NO: 1631366 - DNA, 23 bp, Homo sapiens
cagcttggtattgcagagaagat

SEQ ID NO: 1631367 - DNA, 14 bp, Homo sapiens
cagcttgtgcacaa

SEQ ID NO: 1631368 - DNA, 15 bp, Homo sapiens
cagcttgtgcacaat

SEQ ID NO: 1631369 - DNA, 14 bp, Homo sapiens
cagcttgtttctat

SEQ ID NO: 1631370 - DNA, 15 bp, Homo sapiens
cagctttaaaaaaat

SEQ ID NO: 1631371 - DNA, 15 bp, Homo sapiens
cagctttaaacaaat

SEQ ID NO: 1631372 - DNA, 13 bp, Homo sapiens
cagctttatgttc

SEQ ID NO: 1631373 - DNA, 14 bp, Homo sapiens
cagctttcaagtgc

SEQ ID NO: 1631374 - DNA, 17 bp, Homo sapiens
cagctttcaagtgcctt

SEQ ID NO: 1631375 - DNA, 21 bp, Homo sapiens
cagctttcatctttgtggatg

SEQ ID NO: 1631376 - DNA, 16 bp, Homo sapiens
cagctttcatgattag

SEQ ID NO: 1631377 - DNA, 19 bp, Homo sapiens
cagctttccctgcctctca

SEQ ID NO: 1631378 - DNA, 16 bp, Homo sapiens
cagctttctcgcgccc

SEQ ID NO: 1631379 - DNA, 18 bp, Homo sapiens
cagctttctcgcgccctc

SEQ ID NO: 1631380 - DNA, 21 bp, Homo sapiens
cagctttctgggatgtcacag

SEQ ID NO: 1631381 - DNA, 18 bp, Homo sapiens
cagctttgagaagccttc

SEQ ID NO: 1631382 - DNA, 12 bp, Homo sapiens
cagctttgataa

SEQ ID NO: 1631383 - DNA, 16 bp, Homo sapiens
cagctttgatccctga

SEQ ID NO: 1631384 - DNA, 12 bp, Homo sapiens
cagcttttgcaa

SEQ ID NO: 1631385 - DNA, 13 bp, Homo sapiens
caggaaaaaataa

SEQ ID NO: 1631386 - DNA, 21 bp, Homo sapiens
caggaaaaacaaaacaaagaa

SEQ ID NO: 1631387 - DNA, 16 bp, Homo sapiens
caggaaaacctgcaga

SEQ ID NO: 1631388 - DNA, 23 bp, Homo sapiens
caggaaaactgacagaggagggc

SEQ ID NO: 1631389 - DNA, 17 bp, Homo sapiens
caggaaaatgtattgat

SEQ ID NO: 1631390 - DNA, 23 bp, Homo sapiens
caggaaacagttgcatgtagtaa

SEQ ID NO: 1631391 - DNA, 19 bp, Homo sapiens
caggaaactccacatctgc

SEQ ID NO: 1631392 - DNA, 20 bp, Homo sapiens
caggaaactccacatctgcc

SEQ ID NO: 1631393 - DNA, 20 bp, Homo sapiens
caggaaatgagagatagagg

SEQ ID NO: 1631394 - DNA, 14 bp, Homo sapiens
caggaacaaacagg

SEQ ID NO: 1631395 - DNA, 19 bp, Homo sapiens
caggaacaagtaatgtatt

SEQ ID NO: 1631396 - DNA, 14 bp, Homo sapiens
caggaacagctatg

SEQ ID NO: 1631397 - DNA, 22 bp, Homo sapiens
caggaacagctatgggagcccc

SEQ ID NO: 1631398 - DNA, 21 bp, Homo sapiens
gtgccaaatagccccagactg

SEQ ID NO: 1631399 - DNA, 21 bp, Homo sapiens
gtgccaactactactggtgat

SEQ ID NO: 1631400 - DNA, 16 bp, Homo sapiens
gtgccaagcacagtgc

SEQ ID NO: 1631401 - DNA, 19 bp, Homo sapiens
gtgccaagcacagtgcctg

SEQ ID NO: 1631402 - DNA, 13 bp, Homo sapiens
gtgccaagggccc

SEQ ID NO: 1631403 - DNA, 18 bp, Homo sapiens
gtgccaagggccccaggg

SEQ ID NO: 1631404 - DNA, 23 bp, Homo sapiens
gtgccaagggccccaggggcagc

SEQ ID NO: 1631405 - DNA, 16 bp, Homo sapiens
gtgccaagtcctagct

SEQ ID NO: 1631406 - DNA, 15 bp, Homo sapiens
gtgccacattttctt

SEQ ID NO: 1631407 - DNA, 15 bp, Homo sapiens
gtgccaccaccctgc

SEQ ID NO: 1631408 - DNA, 18 bp, Homo sapiens
gtgccacccaccagggcg

SEQ ID NO: 1631409 - DNA, 19 bp, Homo sapiens
gtgccacccacctttgcca

SEQ ID NO: 1631410 - DNA, 12 bp, Homo sapiens
gtgccacccgca

SEQ ID NO: 1631411 - DNA, 18 bp, Homo sapiens
gtgccactccctgagctt

SEQ ID NO: 1631412 - DNA, 17 bp, Homo sapiens
gtgccactgccccccga

SEQ ID NO: 1631413 - DNA, 19 bp, Homo sapiens
gtgccactgcgggagctct

SEQ ID NO: 1631414 - DNA, 21 bp, Homo sapiens
gtgccacttcttaaaggcctg

SEQ ID NO: 1631415 - DNA, 13 bp, Homo sapiens
gtgccagagaggg

SEQ ID NO: 1631416 - DNA, 15 bp, Homo sapiens
gtgccagaggtgggc

SEQ ID NO: 1631417 - DNA, 19 bp, Homo sapiens
gtgccagaggtgggcaggt

SEQ ID NO: 1631418 - DNA, 20 bp, Homo sapiens
gtgccagaggtgggcaggtg

SEQ ID NO: 1631419 - DNA, 21 bp, Homo sapiens
gtgccagaggtgggcaggtgg

SEQ ID NO: 1631420 - DNA, 22 bp, Homo sapiens
gtgccagaggtgggcaggtggt

SEQ ID NO: 1631421 - DNA, 13 bp, Homo sapiens
gtgccagatataa

SEQ ID NO: 1631422 - DNA, 21 bp, Homo sapiens
gtgccagatataactgtcttg

SEQ ID NO: 1631423 - DNA, 11 bp, Homo sapiens
gtgccagcagc

SEQ ID NO: 1631424 - DNA, 22 bp, Homo sapiens
gtgccagcagcctcgcacaggc

SEQ ID NO: 1631425 - DNA, 22 bp, Homo sapiens
gtgccagccgtgatgctcaggc

SEQ ID NO: 1631426 - DNA, 19 bp, Homo sapiens
gtgccagccttcctctgca

SEQ ID NO: 1631427 - DNA, 12 bp, Homo sapiens
gtgccaggacca

SEQ ID NO: 1631428 - DNA, 13 bp, Homo sapiens
gtgccaggaccag

SEQ ID NO: 1631429 - DNA, 16 bp, Homo sapiens
gtgccaggaccagcct

SEQ ID NO: 1631430 - DNA, 12 bp, Homo sapiens
gtgccaggcccg

SEQ ID NO: 1631431 - DNA, 20 bp, Homo sapiens
gtgccaggcccggggctggc

SEQ ID NO: 1631432 - DNA, 17 bp, Homo sapiens
gtgccagtcaagaagaa

SEQ ID NO: 1631433 - DNA, 18 bp, Homo sapiens
gtgccagtcttgtgtctg

SEQ ID NO: 1631434 - DNA, 17 bp, Homo sapiens
gtgccatagtcacatgg

SEQ ID NO: 1631435 - DNA, 23 bp, Homo sapiens
gtgccatctgtacatattactgt

SEQ ID NO: 1631436 - DNA, 17 bp, Homo sapiens
gtgccatgcctgctccc

SEQ ID NO: 1631437 - DNA, 18 bp, Homo sapiens
gtgccatgcctgctccct

SEQ ID NO: 1631438 - DNA, 20 bp, Homo sapiens
gtgccatgcctgctccctgt

SEQ ID NO: 1631439 - DNA, 23 bp, Homo sapiens
gtgccatgcctgctccctgtctg

SEQ ID NO: 1631440 - DNA, 23 bp, Homo sapiens
gtgccatgctgggccactgggga

SEQ ID NO: 1631441 - DNA, 17 bp, Homo sapiens
gtgccatggatttccac

SEQ ID NO: 1631442 - DNA, 13 bp, Homo sapiens
gtgccattcccag

SEQ ID NO: 1631443 - DNA, 11 bp, Homo sapiens
gtgcccaaagt

SEQ ID NO: 1631444 - DNA, 15 bp, Homo sapiens
gtgcccaaagtgggg

SEQ ID NO: 1631445 - DNA, 23 bp, Homo sapiens
gtgcccaagaatagatgctgact

SEQ ID NO: 1631446 - DNA, 15 bp, Homo sapiens
gtgcccaagagtggg

SEQ ID NO: 1631447 - DNA, 20 bp, Homo sapiens
gtgcccaagccagaggctgg

SEQ ID NO: 1631448 - DNA, 20 bp, Homo sapiens
gtgcccacatcccaggcttc

SEQ ID NO: 1631449 - DNA, 21 bp, Homo sapiens
gtgcccacatgtgtccatccc

SEQ ID NO: 1631450 - DNA, 16 bp, Homo sapiens
gtgcccagcaggccca

SEQ ID NO: 1631451 - DNA, 18 bp, Homo sapiens
gtgcccagcccggacctt

SEQ ID NO: 1631452 - DNA, 18 bp, Homo sapiens
gtgcccaggcccttggct

SEQ ID NO: 1631453 - DNA, 14 bp, Homo sapiens
gtgcccagggccag

SEQ ID NO: 1631454 - DNA, 16 bp, Homo sapiens
gtgcccagggttttgc

SEQ ID NO: 1631455 - DNA, 19 bp, Homo sapiens
gtgcccagtggagcctgcc

SEQ ID NO: 1631456 - DNA, 20 bp, Homo sapiens
gtgccccacctgcctggtgc

SEQ ID NO: 1631457 - DNA, 14 bp, Homo sapiens
gtgccccactccag

SEQ ID NO: 1631458 - DNA, 17 bp, Homo sapiens
gtgccccactccagcct

SEQ ID NO: 1631459 - DNA, 23 bp, Homo sapiens
gtgccccactccagcctggggac

SEQ ID NO: 1631460 - DNA, 12 bp, Homo sapiens
gtgccccagact

SEQ ID NO: 1631461 - DNA, 20 bp, Homo sapiens
gtgccccagactgagctctc

SEQ ID NO: 1631462 - DNA, 23 bp, Homo sapiens
gtgccccagactgagctctccag

SEQ ID NO: 1631463 - DNA, 14 bp, Homo sapiens
gtgccccaggacca

SEQ ID NO: 1631464 - DNA, 13 bp, Homo sapiens
gtgcccccactga

SEQ ID NO: 1631465 - DNA, 15 bp, Homo sapiens
gtgcccccactgacc

SEQ ID NO: 1631466 - DNA, 19 bp, Homo sapiens
gtgcccccactgaccagaa

SEQ ID NO: 1631467 - DNA, 18 bp, Homo sapiens
gtgcccccctcctccagt

SEQ ID NO: 1631468 - DNA, 13 bp, Homo sapiens
gtgccccccttgc

SEQ ID NO: 1631469 - DNA, 17 bp, Homo sapiens
gtgcccccgcctgccac

SEQ ID NO: 1631470 - DNA, 19 bp, Homo sapiens
gtgcccccgcctgccaccg

SEQ ID NO: 1631471 - DNA, 18 bp, Homo sapiens
gtgccccctcctctccca

SEQ ID NO: 1631472 - DNA, 16 bp, Homo sapiens
gtgccccgcctgagtc

SEQ ID NO: 1631473 - DNA, 14 bp, Homo sapiens
gtgcccctgatgca

SEQ ID NO: 1631474 - DNA, 23 bp, Homo sapiens
gtgccccttaagggttgaaggca

SEQ ID NO: 1631475 - DNA, 15 bp, Homo sapiens
gtgccctcaccacca

SEQ ID NO: 1631476 - DNA, 14 bp, Homo sapiens
gtgccctccaaaga

SEQ ID NO: 1631477 - DNA, 15 bp, Homo sapiens
gtgccctccaaagag

SEQ ID NO: 1631478 - DNA, 12 bp, Homo sapiens
gtgccctgcccc

SEQ ID NO: 1631479 - DNA, 18 bp, Homo sapiens
gtgccctgcccccatctc

SEQ ID NO: 1631480 - DNA, 19 bp, Homo sapiens
gtgccctgcccccatctcc

SEQ ID NO: 1631481 - DNA, 15 bp, Homo sapiens
gtgccctggtggaga

SEQ ID NO: 1631482 - DNA, 23 bp, Homo sapiens
gtgccctggtggagaaagcactg

SEQ ID NO: 1631483 - DNA, 20 bp, Homo sapiens
gtgcccttggtagcagcctg

SEQ ID NO: 1631484 - DNA, 14 bp, Homo sapiens
gtgccgcctgctcc

SEQ ID NO: 1631485 - DNA, 15 bp, Homo sapiens
gtgccgcctgctcct

SEQ ID NO: 1631486 - DNA, 21 bp, Homo sapiens
gtgccgcctgctcctcactgg

SEQ ID NO: 1631487 - DNA, 15 bp, Homo sapiens
gtgccgctgtctctg

SEQ ID NO: 1631488 - DNA, 23 bp, Homo sapiens
gtgccggcggcagccccacttca

SEQ ID NO: 1631489 - DNA, 13 bp, Homo sapiens
gtgccgtaattat

SEQ ID NO: 1631490 - DNA, 22 bp, Homo sapiens
gtgccgtagggagtacctgctg

SEQ ID NO: 1631491 - DNA, 23 bp, Homo sapiens
gtgccgtagggagtacctgctgc

SEQ ID NO: 1631492 - DNA, 20 bp, Homo sapiens
gtgccgtgagcaggctttgg

SEQ ID NO: 1631493 - DNA, 17 bp, Homo sapiens
gtgcctaaaataagaat

SEQ ID NO: 1631494 - DNA, 15 bp, Homo sapiens
gtgcctaaaattgta

SEQ ID NO: 1631495 - DNA, 18 bp, Homo sapiens
gtgcctatagtcccagct

SEQ ID NO: 1631496 - DNA, 19 bp, Homo sapiens
gtgcctatatctgagagac

SEQ ID NO: 1631497 - DNA, 12 bp, Homo sapiens
gtgcctcagact

SEQ ID NO: 1631498 - DNA, 17 bp, Homo sapiens
gtgcctcagactccgcc

SEQ ID NO: 1631499 - DNA, 20 bp, Homo sapiens
gtgcctcagagaccagggct

SEQ ID NO: 1631500 - DNA, 16 bp, Homo sapiens
gtgcctcagttttcct

SEQ ID NO: 1631501 - DNA, 18 bp, Homo sapiens
gtgcctccccccagaccc

SEQ ID NO: 1631502 - DNA, 16 bp, Homo sapiens
gtgcctcccttccgct

SEQ ID NO: 1631503 - DNA, 14 bp, Homo sapiens
gtgcctcgaggcac

SEQ ID NO: 1631504 - DNA, 14 bp, Homo sapiens
gtgcctctgggact

SEQ ID NO: 1631505 - DNA, 15 bp, Homo sapiens
gtgcctgagaggcag

SEQ ID NO: 1631506 - DNA, 17 bp, Homo sapiens
gtgcctgagaggcaggc

SEQ ID NO: 1631507 - DNA, 14 bp, Homo sapiens
gtgcctgcaccagg

SEQ ID NO: 1631508 - DNA, 11 bp, Homo sapiens
gtgcctgcagc

SEQ ID NO: 1631509 - DNA, 14 bp, Homo sapiens
gtgcctgccactct

SEQ ID NO: 1631510 - DNA, 21 bp, Homo sapiens
gtgcctgccactctctgggac

SEQ ID NO: 1631511 - DNA, 21 bp, Homo sapiens
gtgcctgcctttgtgtcagaa

SEQ ID NO: 1631512 - DNA, 17 bp, Homo sapiens
gtgcctgctagagcaac

SEQ ID NO: 1631513 - DNA, 18 bp, Homo sapiens
gtgcctgctagagcaacc

SEQ ID NO: 1631514 - DNA, 14 bp, Homo sapiens
gtgcctgctcagca

SEQ ID NO: 1631515 - DNA, 18 bp, Homo sapiens
gtgcctgctcagcagcca

SEQ ID NO: 1631516 - DNA, 20 bp, Homo sapiens
gtgcctgctcagcagccagt

SEQ ID NO: 1631517 - DNA, 23 bp, Homo sapiens
gtgcctggatgggggtgcaggca

SEQ ID NO: 1631518 - DNA, 15 bp, Homo sapiens
gtgcctggcctggca

SEQ ID NO: 1631519 - DNA, 14 bp, Homo sapiens
gtgcctgggccctg

SEQ ID NO: 1631520 - DNA, 16 bp, Homo sapiens
gtgcctgggggagaga

SEQ ID NO: 1631521 - DNA, 17 bp, Homo sapiens
gtgcctgggtggggctg

SEQ ID NO: 1631522 - DNA, 18 bp, Homo sapiens
gtgcctgggtggggctgc

SEQ ID NO: 1631523 - DNA, 19 bp, Homo sapiens
gtgcctggttaatattaat

SEQ ID NO: 1631524 - DNA, 19 bp, Homo sapiens
gtgcctgtcacgctctggt

SEQ ID NO: 1631525 - DNA, 15 bp, Homo sapiens
gtgcctgtgaggcag

SEQ ID NO: 1631526 - DNA, 16 bp, Homo sapiens
gtgcctgtgaggcagg

SEQ ID NO: 1631527 - DNA, 12 bp, Homo sapiens
gtgcctgtgctc

SEQ ID NO: 1631528 - DNA, 19 bp, Homo sapiens
gtgcctgtgctcctgccca

SEQ ID NO: 1631529 - DNA, 14 bp, Homo sapiens
gtgcctgtggcaga

SEQ ID NO: 1631530 - DNA, 13 bp, Homo sapiens
gtgcctgtgtcca

SEQ ID NO: 1631531 - DNA, 15 bp, Homo sapiens
gtgccttaaaaataa

SEQ ID NO: 1631532 - DNA, 18 bp, Homo sapiens
gtgccttacatcttttct

SEQ ID NO: 1631533 - DNA, 19 bp, Homo sapiens
gtgccttacatcttttcta

SEQ ID NO: 1631534 - DNA, 15 bp, Homo sapiens
gtgccttacctcctg

SEQ ID NO: 1631535 - DNA, 19 bp, Homo sapiens
gtgccttactgactgtagc

SEQ ID NO: 1631536 - DNA, 12 bp, Homo sapiens
gtgccttccaac

SEQ ID NO: 1631537 - DNA, 23 bp, Homo sapiens
gtgccttcctgtttttcacattt

SEQ ID NO: 1631538 - DNA, 12 bp, Homo sapiens
gtgccttctctc

SEQ ID NO: 1631539 - DNA, 22 bp, Homo sapiens
gtgccttctctcagctcccagg

SEQ ID NO: 1631540 - DNA, 19 bp, Homo sapiens
gtgccttcttattctcact

SEQ ID NO: 1631541 - DNA, 17 bp, Homo sapiens
gtgccttggtctctcct

SEQ ID NO: 1631542 - DNA, 14 bp, Homo sapiens
gtgccttttctgaa

SEQ ID NO: 1631543 - DNA, 16 bp, Homo sapiens
gtgccttttgcacccc

SEQ ID NO: 1631544 - DNA, 22 bp, Homo sapiens
gtgccttttgcacccctcccat

SEQ ID NO: 1631545 - DNA, 21 bp, Homo sapiens
gtgccttttgcagaagagggt

SEQ ID NO: 1631546 - DNA, 23 bp, Homo sapiens
gtgccttttgcagaagagggtgt

SEQ ID NO: 1631547 - DNA, 12 bp, Homo sapiens
gtgcgacagaga

SEQ ID NO: 1631548 - DNA, 14 bp, Homo sapiens
gtgcgaccccccac

SEQ ID NO: 1631549 - DNA, 16 bp, Homo sapiens
gtgcgaccccccaccc

SEQ ID NO: 1631550 - DNA, 15 bp, Homo sapiens
gtgcgctctgtggat

SEQ ID NO: 1631551 - DNA, 22 bp, Homo sapiens
gtgcgctctgtggatgccaggg

SEQ ID NO: 1631552 - DNA, 13 bp, Homo sapiens
gtgcgctgcctgg

SEQ ID NO: 1631553 - DNA, 14 bp, Homo sapiens
gtgcgggcctggcc

SEQ ID NO: 1631554 - DNA, 15 bp, Homo sapiens
gtgcgtctgttttgt

SEQ ID NO: 1631555 - DNA, 14 bp, Homo sapiens
gtgcgtggctgtgg

SEQ ID NO: 1631556 - DNA, 16 bp, Homo sapiens
gtgcgtgtctctgcca

SEQ ID NO: 1631557 - DNA, 14 bp, Homo sapiens
gtgcgtgtgtgtat

SEQ ID NO: 1631558 - DNA, 23 bp, Homo sapiens
gtgcgtgttagtgtgtgtgcatg

SEQ ID NO: 1631559 - DNA, 20 bp, Homo sapiens
gtgctaaagccaaccagcct

SEQ ID NO: 1631560 - DNA, 13 bp, Homo sapiens
gtgctaaattttc

SEQ ID NO: 1631561 - DNA, 14 bp, Homo sapiens
gtgctaaggttcta

SEQ ID NO: 1631562 - DNA, 15 bp, Homo sapiens
gtgctaaggttctaa

SEQ ID NO: 1631563 - DNA, 19 bp, Homo sapiens
gtgctacagggaatttgta

SEQ ID NO: 1631564 - DNA, 13 bp, Homo sapiens
gtgctacattttg

SEQ ID NO: 1631565 - DNA, 19 bp, Homo sapiens
gtgctacctgggtcctttt

SEQ ID NO: 1631566 - DNA, 18 bp, Homo sapiens
gtgctactccatgcaggg

SEQ ID NO: 1631567 - DNA, 19 bp, Homo sapiens
gtgctagaatactttttaa

SEQ ID NO: 1631568 - DNA, 21 bp, Homo sapiens
gtgctagtcactggcagcctg

SEQ ID NO: 1631569 - DNA, 18 bp, Homo sapiens
gtgctataaatgccagag

SEQ ID NO: 1631570 - DNA, 23 bp, Homo sapiens
gtgctataaatgccagagccaac

SEQ ID NO: 1631571 - DNA, 23 bp, Homo sapiens
gtgctataatctgtttttacgta

SEQ ID NO: 1631572 - DNA, 17 bp, Homo sapiens
gtgctatgcaaaataga

SEQ ID NO: 1631573 - DNA, 14 bp, Homo sapiens
gtgctattctgtgt

SEQ ID NO: 1631574 - DNA, 19 bp, Homo sapiens
gtgctatttgtacaaataa

SEQ ID NO: 1631575 - DNA, 21 bp, Homo sapiens
gtgctcacgctcccccgcagt

SEQ ID NO: 1631576 - DNA, 12 bp, Homo sapiens
gtgctcagccaa

SEQ ID NO: 1631577 - DNA, 16 bp, Homo sapiens
gtgctcagctgtggct

SEQ ID NO: 1631578 - DNA, 19 bp, Homo sapiens
gtgctcagctgtggctgga

SEQ ID NO: 1631579 - DNA, 20 bp, Homo sapiens
gtgctcatcggagactgccc

SEQ ID NO: 1631580 - DNA, 15 bp, Homo sapiens
gtgctccatctccgc

SEQ ID NO: 1631581 - DNA, 20 bp, Homo sapiens
gtgctcccctgccacactga

SEQ ID NO: 1631582 - DNA, 21 bp, Homo sapiens
gtgctcccctgccacactgat

SEQ ID NO: 1631583 - DNA, 13 bp, Homo sapiens
gtgctccctctgt

SEQ ID NO: 1631584 - DNA, 14 bp, Homo sapiens
gtgctccctggagg

SEQ ID NO: 1631585 - DNA, 18 bp, Homo sapiens
gtgctccctggaggcacg

SEQ ID NO: 1631586 - DNA, 13 bp, Homo sapiens
gtgctccgtgcct

SEQ ID NO: 1631587 - DNA, 14 bp, Homo sapiens
gtgctcctccttgg

SEQ ID NO: 1631588 - DNA, 12 bp, Homo sapiens
gtgctcctctcc

SEQ ID NO: 1631589 - DNA, 13 bp, Homo sapiens
gtgctcctgccca

SEQ ID NO: 1631590 - DNA, 13 bp, Homo sapiens
gtgctccttttct

SEQ ID NO: 1631591 - DNA, 16 bp, Homo sapiens
gtgctccttttctctt

SEQ ID NO: 1631592 - DNA, 14 bp, Homo sapiens
gtgctctaggctgc

SEQ ID NO: 1631593 - DNA, 17 bp, Homo sapiens
gtgctctcagctggcag

SEQ ID NO: 1631594 - DNA, 13 bp, Homo sapiens
gtgctctctttct

SEQ ID NO: 1631595 - DNA, 16 bp, Homo sapiens
gtgctctctttctgtc

SEQ ID NO: 1631596 - DNA, 21 bp, Homo sapiens
gtgctctgaatgggagccaga

SEQ ID NO: 1631597 - DNA, 19 bp, Homo sapiens
gtgctctggcaccatcagc

SEQ ID NO: 1631598 - DNA, 14 bp, Homo sapiens
gtgctctggcggct

SEQ ID NO: 1631599 - DNA, 24 bp, Homo sapiens
gtgctctggcggcttcctgtccac

SEQ ID NO: 1631600 - DNA, 22 bp, Homo sapiens
gtgctctggggatttctgggat

SEQ ID NO: 1631601 - DNA, 13 bp, Homo sapiens
gtgctctgtgtca

SEQ ID NO: 1631602 - DNA, 13 bp, Homo sapiens
gtgctcttggctg

SEQ ID NO: 1631603 - DNA, 20 bp, Homo sapiens
gtgctcttggctgacccctc

SEQ ID NO: 1631604 - DNA, 13 bp, Homo sapiens
gtgctctttgaag

SEQ ID NO: 1631605 - DNA, 16 bp, Homo sapiens
gtgctctttgtggcag

SEQ ID NO: 1631606 - DNA, 21 bp, Homo sapiens
gtgctctttgttactgtccac

SEQ ID NO: 1631607 - DNA, 20 bp, Homo sapiens
gtgctcttttctcctcactg

SEQ ID NO: 1631608 - DNA, 18 bp, Homo sapiens
gtgctgaactgtgcatca

SEQ ID NO: 1631609 - DNA, 22 bp, Homo sapiens
gtgctgacaacttagctcaggt

SEQ ID NO: 1631610 - DNA, 16 bp, Homo sapiens
gtgctgacggccaggg

SEQ ID NO: 1631611 - DNA, 18 bp, Homo sapiens
gtgctgacggccagggag

SEQ ID NO: 1631612 - DNA, 16 bp, Homo sapiens
gtgctgactgaacatt

SEQ ID NO: 1631613 - DNA, 21 bp, Homo sapiens
gtgctgactgaggcctgcttc

SEQ ID NO: 1631614 - DNA, 14 bp, Homo sapiens
gtgctgagattaca

SEQ ID NO: 1631615 - DNA, 21 bp, Homo sapiens
gtgctgatcctaagaattttt

SEQ ID NO: 1631616 - DNA, 15 bp, Homo sapiens
gtgctgatcctgctg

SEQ ID NO: 1631617 - DNA, 21 bp, Homo sapiens
gtgctgatcctgctgacctca

SEQ ID NO: 1631618 - DNA, 22 bp, Homo sapiens
gtgctgatcgtgctaaattttc

SEQ ID NO: 1631619 - DNA, 17 bp, Homo sapiens
gtgctgcacaaaagcag

SEQ ID NO: 1631620 - DNA, 22 bp, Homo sapiens
gtgctgcagcaccgaggggcct

SEQ ID NO: 1631621 - DNA, 13 bp, Homo sapiens
gtgctgcagtatg

SEQ ID NO: 1631622 - DNA, 21 bp, Homo sapiens
gtgctgccacacttcaggctc

SEQ ID NO: 1631623 - DNA, 12 bp, Homo sapiens
gtgctgccatgc

SEQ ID NO: 1631624 - DNA, 14 bp, Homo sapiens
gtgctgccatgcca

SEQ ID NO: 1631625 - DNA, 16 bp, Homo sapiens
gtgctgccatgccact

SEQ ID NO: 1631626 - DNA, 22 bp, Homo sapiens
gtgctgccatgccactgccagg

SEQ ID NO: 1631627 - DNA, 23 bp, Homo sapiens
gtgctgccatgccactgccaggc

SEQ ID NO: 1631628 - DNA, 21 bp, Homo sapiens
gtgctgcccgtcttcagccta

SEQ ID NO: 1631629 - DNA, 17 bp, Homo sapiens
gtgctgctaattctttg

SEQ ID NO: 1631630 - DNA, 18 bp, Homo sapiens
gtgctgctaattctttgc

SEQ ID NO: 1631631 - DNA, 16 bp, Homo sapiens
gtgctgctgtgtgctt

SEQ ID NO: 1631632 - DNA, 18 bp, Homo sapiens
cagcgcccctctgcaccc

SEQ ID NO: 1631633 - DNA, 15 bp, Homo sapiens
cagcgcgcaggcctg

SEQ ID NO: 1631634 - DNA, 14 bp, Homo sapiens
cagcgctctcctgg

SEQ ID NO: 1631635 - DNA, 16 bp, Homo sapiens
cagcgctctcctggac

SEQ ID NO: 1631636 - DNA, 17 bp, Homo sapiens
cagcggagtctgtcctg

SEQ ID NO: 1631637 - DNA, 22 bp, Homo sapiens
cagcggcagagcaattccaggc

SEQ ID NO: 1631638 - DNA, 12 bp, Homo sapiens
cagcggcccccc

SEQ ID NO: 1631639 - DNA, 14 bp, Homo sapiens
cagcggccccccgc

SEQ ID NO: 1631640 - DNA, 16 bp, Homo sapiens
cagcggcccctcccac

SEQ ID NO: 1631641 - DNA, 20 bp, Homo sapiens
cagcggccttgaagacagag

SEQ ID NO: 1631642 - DNA, 21 bp, Homo sapiens
cagcggccttgaagacagagc

SEQ ID NO: 1631643 - DNA, 17 bp, Homo sapiens
cagcggctgctcaagcc

SEQ ID NO: 1631644 - DNA, 17 bp, Homo sapiens
cagcggctggtgcaggg

SEQ ID NO: 1631645 - DNA, 20 bp, Homo sapiens
cagcggctggtgcagggcct

SEQ ID NO: 1631646 - DNA, 13 bp, Homo sapiens
cagcgggagacct

SEQ ID NO: 1631647 - DNA, 16 bp, Homo sapiens
cagcgggcagatgggc

SEQ ID NO: 1631648 - DNA, 16 bp, Homo sapiens
cagcgggccaggcccg

SEQ ID NO: 1631649 - DNA, 17 bp, Homo sapiens
cagcgggcggaggggat

SEQ ID NO: 1631650 - DNA, 13 bp, Homo sapiens
cagcgggtctcct

SEQ ID NO: 1631651 - DNA, 16 bp, Homo sapiens
cagcgggtctcctccc

SEQ ID NO: 1631652 - DNA, 15 bp, Homo sapiens
cagcggtttggggag

SEQ ID NO: 1631653 - DNA, 17 bp, Homo sapiens
cagcgtcactccagtgc

SEQ ID NO: 1631654 - DNA, 15 bp, Homo sapiens
cagcgtcccagggta

SEQ ID NO: 1631655 - DNA, 13 bp, Homo sapiens
cagcgtcccccgc

SEQ ID NO: 1631656 - DNA, 22 bp, Homo sapiens
cagcgtcccctgctactcctgt

SEQ ID NO: 1631657 - DNA, 18 bp, Homo sapiens
cagcgtccctagcagtga

SEQ ID NO: 1631658 - DNA, 13 bp, Homo sapiens
cagcgtccctggc

SEQ ID NO: 1631659 - DNA, 14 bp, Homo sapiens
cagcgtggcttaga

SEQ ID NO: 1631660 - DNA, 14 bp, Homo sapiens
cagcgtgtggagca

SEQ ID NO: 1631661 - DNA, 17 bp, Homo sapiens
cagcgtgtggagcagag

SEQ ID NO: 1631662 - DNA, 18 bp, Homo sapiens
cagcgtgtggagcagagc

SEQ ID NO: 1631663 - DNA, 20 bp, Homo sapiens
cagcgtgtggagcagagctc

SEQ ID NO: 1631664 - DNA, 14 bp, Homo sapiens
cagcgttaacacaa

SEQ ID NO: 1631665 - DNA, 14 bp, Homo sapiens
cagcgttagggctg

SEQ ID NO: 1631666 - DNA, 17 bp, Homo sapiens
cagcgttagggctgctt

SEQ ID NO: 1631667 - DNA, 24 bp, Homo sapiens
cagcgtttagtttctagaggcctc

SEQ ID NO: 1631668 - DNA, 19 bp, Homo sapiens
cagctaaacaccaacccct

SEQ ID NO: 1631669 - DNA, 22 bp, Homo sapiens
cagctaaacaccaacccctgac

SEQ ID NO: 1631670 - DNA, 22 bp, Homo sapiens
cagctaaaccaaggactgagca

SEQ ID NO: 1631671 - DNA, 13 bp, Homo sapiens
cagctaagaacct

SEQ ID NO: 1631672 - DNA, 16 bp, Homo sapiens
cagctaagaacctgga

SEQ ID NO: 1631673 - DNA, 22 bp, Homo sapiens
cagctaagatagaaagctggac

SEQ ID NO: 1631674 - DNA, 15 bp, Homo sapiens
cagctaagctaggaa

SEQ ID NO: 1631675 - DNA, 14 bp, Homo sapiens
cagctaatctgtag

SEQ ID NO: 1631676 - DNA, 19 bp, Homo sapiens
cagctaatctgtagggctg

SEQ ID NO: 1631677 - DNA, 18 bp, Homo sapiens
cagctaatttttgtattt

SEQ ID NO: 1631678 - DNA, 22 bp, Homo sapiens
cagctaatttttgtatttttag

SEQ ID NO: 1631679 - DNA, 23 bp, Homo sapiens
cagctacaaccctaccctggcag

SEQ ID NO: 1631680 - DNA, 19 bp, Homo sapiens
cagctacattcctcagctg

SEQ ID NO: 1631681 - DNA, 20 bp, Homo sapiens
cagctacattcctcagctgc

SEQ ID NO: 1631682 - DNA, 14 bp, Homo sapiens
cagctaccctcagc

SEQ ID NO: 1631683 - DNA, 15 bp, Homo sapiens
cagctaccctcagcc

SEQ ID NO: 1631684 - DNA, 16 bp, Homo sapiens
cagctaccctcagcct

SEQ ID NO: 1631685 - DNA, 18 bp, Homo sapiens
cagctaccctcagcctcc

SEQ ID NO: 1631686 - DNA, 19 bp, Homo sapiens
cagctaccctcagcctcca

SEQ ID NO: 1631687 - DNA, 24 bp, Homo sapiens
cagctaccctttttctccagctgg

SEQ ID NO: 1631688 - DNA, 20 bp, Homo sapiens
cagctactcaagaggctgag

SEQ ID NO: 1631689 - DNA, 23 bp, Homo sapiens
cagctactcaagaggctgaggca

SEQ ID NO: 1631690 - DNA, 14 bp, Homo sapiens
cagctactcagaag

SEQ ID NO: 1631691 - DNA, 15 bp, Homo sapiens
cagctactcagaagc

SEQ ID NO: 1631692 - DNA, 20 bp, Homo sapiens
cagctactcagaagcctgag

SEQ ID NO: 1631693 - DNA, 23 bp, Homo sapiens
cagctactcagaagcctgaggct

SEQ ID NO: 1631694 - DNA, 20 bp, Homo sapiens
cagctactcaggaggctgag

SEQ ID NO: 1631695 - DNA, 23 bp, Homo sapiens
cagctactcgggaggctgaggca

SEQ ID NO: 1631696 - DNA, 14 bp, Homo sapiens
cagctactctgtcc

SEQ ID NO: 1631697 - DNA, 16 bp, Homo sapiens
cagctactctgtccag

SEQ ID NO: 1631698 - DNA, 15 bp, Homo sapiens
cagctacttcctcct

SEQ ID NO: 1631699 - DNA, 17 bp, Homo sapiens
cagctacttctgggaaa

SEQ ID NO: 1631700 - DNA, 19 bp, Homo sapiens
cagctacttctgggaaaaa

SEQ ID NO: 1631701 - DNA, 16 bp, Homo sapiens
cagctacttgggaggc

SEQ ID NO: 1631702 - DNA, 19 bp, Homo sapiens
cagctacttgggaggctga

SEQ ID NO: 1631703 - DNA, 19 bp, Homo sapiens
cagctacttggtttgtgtt

SEQ ID NO: 1631704 - DNA, 17 bp, Homo sapiens
cagctactttaacacca

SEQ ID NO: 1631705 - DNA, 15 bp, Homo sapiens
cagctagactggagt

SEQ ID NO: 1631706 - DNA, 16 bp, Homo sapiens
cagctagactggagtg

SEQ ID NO: 1631707 - DNA, 21 bp, Homo sapiens
cagctagactggagtgaggct

SEQ ID NO: 1631708 - DNA, 12 bp, Homo sapiens
cagctaggactg

SEQ ID NO: 1631709 - DNA, 13 bp, Homo sapiens
cagctagtgcctt

SEQ ID NO: 1631710 - DNA, 16 bp, Homo sapiens
cagctataattctgtt

SEQ ID NO: 1631711 - DNA, 15 bp, Homo sapiens
cagctatatatttcc

SEQ ID NO: 1631712 - DNA, 19 bp, Homo sapiens
cagctatcgaacttcacaa

SEQ ID NO: 1631713 - DNA, 13 bp, Homo sapiens
cagctatgggagc

SEQ ID NO: 1631714 - DNA, 20 bp, Homo sapiens
cagctatgggagccccaggg

SEQ ID NO: 1631715 - DNA, 19 bp, Homo sapiens
cagctattaagaaaatcac

SEQ ID NO: 1631716 - DNA, 18 bp, Homo sapiens
cagctcaacctaccctgg

SEQ ID NO: 1631717 - DNA, 16 bp, Homo sapiens
cagctcaactcacagc

SEQ ID NO: 1631718 - DNA, 19 bp, Homo sapiens
cagctcaactcacagcttc

SEQ ID NO: 1631719 - DNA, 20 bp, Homo sapiens
cagctcaactcacagcttct

SEQ ID NO: 1631720 - DNA, 16 bp, Homo sapiens
cagctcaagggctggc

SEQ ID NO: 1631721 - DNA, 13 bp, Homo sapiens
cagctcaagtctt

SEQ ID NO: 1631722 - DNA, 19 bp, Homo sapiens
cagctcaagtcttccctga

SEQ ID NO: 1631723 - DNA, 13 bp, Homo sapiens
gtctgtggatcag

SEQ ID NO: 1631724 - DNA, 22 bp, Homo sapiens
gtctgtgggccgcccctggcca

SEQ ID NO: 1631725 - DNA, 14 bp, Homo sapiens
gtctgtggggaggg

SEQ ID NO: 1631726 - DNA, 22 bp, Homo sapiens
gtctgtggggtggttccgggct

SEQ ID NO: 1631727 - DNA, 21 bp, Homo sapiens
gtctgtgtaacatccaagcca

SEQ ID NO: 1631728 - DNA, 18 bp, Homo sapiens
gtctgtgtcatttcttca

SEQ ID NO: 1631729 - DNA, 14 bp, Homo sapiens
gtctgtgtcccagc

SEQ ID NO: 1631730 - DNA, 23 bp, Homo sapiens
gtctgtgtggtggagccagggcc

SEQ ID NO: 1631731 - DNA, 16 bp, Homo sapiens
gtctgtgtgtgtgtat

SEQ ID NO: 1631732 - DNA, 20 bp, Homo sapiens
gtctgtgtgtgtgtatgtgg

SEQ ID NO: 1631733 - DNA, 21 bp, Homo sapiens
gtctgtgtgtttatgtgtgtg

SEQ ID NO: 1631734 - DNA, 16 bp, Homo sapiens
gtctgttatgcactgt

SEQ ID NO: 1631735 - DNA, 18 bp, Homo sapiens
gtctgttggcaggctggc

SEQ ID NO: 1631736 - DNA, 21 bp, Homo sapiens
gtctgttggcaggctggccag

SEQ ID NO: 1631737 - DNA, 22 bp, Homo sapiens
gtctgttggcaggctggccagt

SEQ ID NO: 1631738 - DNA, 17 bp, Homo sapiens
gtctgtttgtctgaaca

SEQ ID NO: 1631739 - DNA, 18 bp, Homo sapiens
gtctgtttgtttcaagaa

SEQ ID NO: 1631740 - DNA, 15 bp, Homo sapiens
gtctgttttgtgtct

SEQ ID NO: 1631741 - DNA, 15 bp, Homo sapiens
gtctgtttttgtatc

SEQ ID NO: 1631742 - DNA, 22 bp, Homo sapiens
gtcttaaactaaatgtgcaata

SEQ ID NO: 1631743 - DNA, 13 bp, Homo sapiens
gtcttaaatgaga

SEQ ID NO: 1631744 - DNA, 20 bp, Homo sapiens
gtcttaaatgctcattttct

SEQ ID NO: 1631745 - DNA, 21 bp, Homo sapiens
gtcttaacaaaccaacatctt

SEQ ID NO: 1631746 - DNA, 21 bp, Homo sapiens
cagctccccaggactcaccct

SEQ ID NO: 1631747 - DNA, 22 bp, Homo sapiens
cagctccccaggactcaccctc

SEQ ID NO: 1631748 - DNA, 23 bp, Homo sapiens
cagctccccaggactcaccctca

SEQ ID NO: 1631749 - DNA, 17 bp, Homo sapiens
cagctccccccgcccac

SEQ ID NO: 1631750 - DNA, 16 bp, Homo sapiens
cagctcccctcggaga

SEQ ID NO: 1631751 - DNA, 17 bp, Homo sapiens
cagctccctcctgcaca

SEQ ID NO: 1631752 - DNA, 22 bp, Homo sapiens
cagctccctcgtcttcagctgc

SEQ ID NO: 1631753 - DNA, 23 bp, Homo sapiens
cagctccctcgtcttcagctgca

SEQ ID NO: 1631754 - DNA, 15 bp, Homo sapiens
cagctccctctgcct

SEQ ID NO: 1631755 - DNA, 16 bp, Homo sapiens
cagctccgcctgctgg

SEQ ID NO: 1631756 - DNA, 16 bp, Homo sapiens
cagctccgggatcagc

SEQ ID NO: 1631757 - DNA, 19 bp, Homo sapiens
cagctccgggatcagcaac

SEQ ID NO: 1631758 - DNA, 22 bp, Homo sapiens
cagctcctcctcttggagctga

SEQ ID NO: 1631759 - DNA, 13 bp, Homo sapiens
cagctcctctcct

SEQ ID NO: 1631760 - DNA, 19 bp, Homo sapiens
cagctcctctccttgggct

SEQ ID NO: 1631761 - DNA, 14 bp, Homo sapiens
cagctcctgaataa

SEQ ID NO: 1631762 - DNA, 12 bp, Homo sapiens
cagctcctgcca

SEQ ID NO: 1631763 - DNA, 14 bp, Homo sapiens
cagctcctgccagg

SEQ ID NO: 1631764 - DNA, 15 bp, Homo sapiens
cagctccttcctagc

SEQ ID NO: 1631765 - DNA, 20 bp, Homo sapiens
cagctccttcctagccttgc

SEQ ID NO: 1631766 - DNA, 19 bp, Homo sapiens
cagctccttttgtccccag

SEQ ID NO: 1631767 - DNA, 21 bp, Homo sapiens
cagctccttttgtccccaggg

SEQ ID NO: 1631768 - DNA, 22 bp, Homo sapiens
cagctccttttgtccccagggc

SEQ ID NO: 1631769 - DNA, 15 bp, Homo sapiens
cagctcgctggcttt

SEQ ID NO: 1631770 - DNA, 21 bp, Homo sapiens
cagctcgctggctttctctct

SEQ ID NO: 1631771 - DNA, 13 bp, Homo sapiens
cagctcggggagc

SEQ ID NO: 1631772 - DNA, 16 bp, Homo sapiens
cagctcggggagcctt

SEQ ID NO: 1631773 - DNA, 15 bp, Homo sapiens
cagctcgtgggctgg

SEQ ID NO: 1631774 - DNA, 14 bp, Homo sapiens
cagctctactacct

SEQ ID NO: 1631775 - DNA, 20 bp, Homo sapiens
cagctctagacactgccaca

SEQ ID NO: 1631776 - DNA, 20 bp, Homo sapiens
cagctctagttttcagcctt

SEQ ID NO: 1631777 - DNA, 20 bp, Homo sapiens
cagctctccccaggcatttg

SEQ ID NO: 1631778 - DNA, 18 bp, Homo sapiens
cagctctctgacgcttgt

SEQ ID NO: 1631779 - DNA, 14 bp, Homo sapiens
cagctctctgccct

SEQ ID NO: 1631780 - DNA, 15 bp, Homo sapiens
cagctctctgccctg

SEQ ID NO: 1631781 - DNA, 20 bp, Homo sapiens
cagctctctgggacctcctt

SEQ ID NO: 1631782 - DNA, 13 bp, Homo sapiens
cagctctcttcct

SEQ ID NO: 1631783 - DNA, 14 bp, Homo sapiens
cagctctcttcctg

SEQ ID NO: 1631784 - DNA, 14 bp, Homo sapiens
cagctctgacatcc

SEQ ID NO: 1631785 - DNA, 15 bp, Homo sapiens
cagctctgacatccc

SEQ ID NO: 1631786 - DNA, 12 bp, Homo sapiens
cagctctgagac

SEQ ID NO: 1631787 - DNA, 22 bp, Homo sapiens
cagctctgagacccttttctca

SEQ ID NO: 1631788 - DNA, 18 bp, Homo sapiens
cagctctgaggggaggca

SEQ ID NO: 1631789 - DNA, 18 bp, Homo sapiens
cagctctggacagcccca

SEQ ID NO: 1631790 - DNA, 17 bp, Homo sapiens
cagctctggagaacagt

SEQ ID NO: 1631791 - DNA, 13 bp, Homo sapiens
cagctctgtggcc

SEQ ID NO: 1631792 - DNA, 14 bp, Homo sapiens
cagctctgtggcct

SEQ ID NO: 1631793 - DNA, 17 bp, Homo sapiens
cagctctgtggcctgtg

SEQ ID NO: 1631794 - DNA, 18 bp, Homo sapiens
cagctcttctcagtgtct

SEQ ID NO: 1631795 - DNA, 12 bp, Homo sapiens
cagctcttcttg

SEQ ID NO: 1631796 - DNA, 21 bp, Homo sapiens
cagctcttgcccttccctgtc

SEQ ID NO: 1631797 - DNA, 23 bp, Homo sapiens
cagctcttgcccttccctgtccc

SEQ ID NO: 1631798 - DNA, 19 bp, Homo sapiens
cagctcttgctctcttgtg

SEQ ID NO: 1631799 - DNA, 23 bp, Homo sapiens
cagctctttccaaattaaaacaa

SEQ ID NO: 1631800 - DNA, 22 bp, Homo sapiens
cagctgaaacattccgaagagg

SEQ ID NO: 1631801 - DNA, 13 bp, Homo sapiens
cagctgaaattga

SEQ ID NO: 1631802 - DNA, 20 bp, Homo sapiens
cagctgaaattgaaaagtta

SEQ ID NO: 1631803 - DNA, 15 bp, Homo sapiens
cagctgaaggcagtg

SEQ ID NO: 1631804 - DNA, 17 bp, Homo sapiens
cagctgaaggcagtggc

SEQ ID NO: 1631805 - DNA, 18 bp, Homo sapiens
cagctgaaggcagtggca

SEQ ID NO: 1631806 - DNA, 19 bp, Homo sapiens
cagctgaaggcagtggcag

SEQ ID NO: 1631807 - DNA, 18 bp, Homo sapiens
cagctgactaaacttttt

SEQ ID NO: 1631808 - DNA, 15 bp, Homo sapiens
cagctgactgtggcc

SEQ ID NO: 1631809 - DNA, 20 bp, Homo sapiens
cagctgactgtggccccctc

SEQ ID NO: 1631810 - DNA, 15 bp, Homo sapiens
cagctgagagccctg

SEQ ID NO: 1631811 - DNA, 16 bp, Homo sapiens
cagctgagagccctgc

SEQ ID NO: 1631812 - DNA, 21 bp, Homo sapiens
cagctgagagccctgctgtgg

SEQ ID NO: 1631813 - DNA, 22 bp, Homo sapiens
cagctgagcacttagcaggcac

SEQ ID NO: 1631814 - DNA, 21 bp, Homo sapiens
cagctgagcttgagctcccct

SEQ ID NO: 1631815 - DNA, 23 bp, Homo sapiens
cagctgagcttgagctcccctgg

SEQ ID NO: 1631816 - DNA, 19 bp, Homo sapiens
cagctgaggtctcttgagg

SEQ ID NO: 1631817 - DNA, 19 bp, Homo sapiens
cagctgatattatggcaag

SEQ ID NO: 1631818 - DNA, 21 bp, Homo sapiens
cagctgatattatggcaagtg

SEQ ID NO: 1631819 - DNA, 19 bp, Homo sapiens
cagctgcaaggtactctgg

SEQ ID NO: 1631820 - DNA, 16 bp, Homo sapiens
cagctgcacctgccag

SEQ ID NO: 1631821 - DNA, 17 bp, Homo sapiens
cagctgcagctgggccc

SEQ ID NO: 1631822 - DNA, 22 bp, Homo sapiens
cagctgcaggggcctctgttcc

SEQ ID NO: 1631823 - DNA, 13 bp, Homo sapiens
cagctgccaagca

SEQ ID NO: 1631824 - DNA, 14 bp, Homo sapiens
cagctgccaagtgc

SEQ ID NO: 1631825 - DNA, 12 bp, Homo sapiens
cagctgcccaga

SEQ ID NO: 1631826 - DNA, 11 bp, Homo sapiens
cagctgcccat

SEQ ID NO: 1631827 - DNA, 14 bp, Homo sapiens
cagctgcccatccc

SEQ ID NO: 1631828 - DNA, 17 bp, Homo sapiens
cagctgcccctggcacc

SEQ ID NO: 1631829 - DNA, 20 bp, Homo sapiens
cagctgccctagctgacccc

SEQ ID NO: 1631830 - DNA, 15 bp, Homo sapiens
cagctgccctatggg

SEQ ID NO: 1631831 - DNA, 17 bp, Homo sapiens
cagctgcctcacttcct

SEQ ID NO: 1631832 - DNA, 21 bp, Homo sapiens
cagctgcctctgccactgact

SEQ ID NO: 1631833 - DNA, 15 bp, Homo sapiens
cagctgcctctgctc

SEQ ID NO: 1631834 - DNA, 17 bp, Homo sapiens
cagctgcctctgctccc

SEQ ID NO: 1631835 - DNA, 20 bp, Homo sapiens
cagctgcctctgctccctct

SEQ ID NO: 1631836 - DNA, 14 bp, Homo sapiens
cagctgcctgggcc

SEQ ID NO: 1631837 - DNA, 15 bp, Homo sapiens
cagctgcctgggccc

SEQ ID NO: 1631838 - DNA, 10 bp, Homo sapiens
cagctgcctt

SEQ ID NO: 1631839 - DNA, 23 bp, Homo sapiens
cagctgccttttaagaggtctta

SEQ ID NO: 1631840 - DNA, 18 bp, Homo sapiens
cagctgctatccccatct

SEQ ID NO: 1631841 - DNA, 23 bp, Homo sapiens
cagctgctatccccatctccctg

SEQ ID NO: 1631842 - DNA, 20 bp, Homo sapiens
cagctgctatttattttcct

SEQ ID NO: 1631843 - DNA, 18 bp, Homo sapiens
cagctgctccccaggcca

SEQ ID NO: 1631844 - DNA, 14 bp, Homo sapiens
cagctgctctgccc

SEQ ID NO: 1631845 - DNA, 15 bp, Homo sapiens
gtgacgcccagctcc

SEQ ID NO: 1631846 - DNA, 16 bp, Homo sapiens
gtgacgtgcactgtga

SEQ ID NO: 1631847 - DNA, 15 bp, Homo sapiens
gtgactcacccaagc

SEQ ID NO: 1631848 - DNA, 12 bp, Homo sapiens
gtgactcctgct

SEQ ID NO: 1631849 - DNA, 16 bp, Homo sapiens
gtgactcctgctggta

SEQ ID NO: 1631850 - DNA, 22 bp, Homo sapiens
gtgactcctgctggtacctgcc

SEQ ID NO: 1631851 - DNA, 14 bp, Homo sapiens
gtgactcctgttgc

SEQ ID NO: 1631852 - DNA, 19 bp, Homo sapiens
gtgactctagcaaggctca

SEQ ID NO: 1631853 - DNA, 13 bp, Homo sapiens
gtgactctgggca

SEQ ID NO: 1631854 - DNA, 10 bp, Homo sapiens
gtgactgaaa

SEQ ID NO: 1631855 - DNA, 19 bp, Homo sapiens
gtgactgaaaccattttcc

SEQ ID NO: 1631856 - DNA, 22 bp, Homo sapiens
gtgactgaaggggcacaccact

SEQ ID NO: 1631857 - DNA, 16 bp, Homo sapiens
gtgactgccccaactc

SEQ ID NO: 1631858 - DNA, 18 bp, Homo sapiens
gtgactgtgtaactttct

SEQ ID NO: 1631859 - DNA, 22 bp, Homo sapiens
gtgactgtgtaactttctctta

SEQ ID NO: 1631860 - DNA, 13 bp, Homo sapiens
gtgacttctgaga

SEQ ID NO: 1631861 - DNA, 12 bp, Homo sapiens
gtcccccctgag

SEQ ID NO: 1631862 - DNA, 15 bp, Homo sapiens
gtcccccctgagtgg

SEQ ID NO: 1631863 - DNA, 20 bp, Homo sapiens
gtcccccctgagtgggctgg

SEQ ID NO: 1631864 - DNA, 16 bp, Homo sapiens
gtcccccgactgcctg

SEQ ID NO: 1631865 - DNA, 22 bp, Homo sapiens
gtcccccgactgcctgtctcca

SEQ ID NO: 1631866 - DNA, 15 bp, Homo sapiens
gtcccccgccgcgcc

SEQ ID NO: 1631867 - DNA, 22 bp, Homo sapiens
gtcccccgccgcgccagtcccc

SEQ ID NO: 1631868 - DNA, 22 bp, Homo sapiens
gtccccctggggcttctcctga

SEQ ID NO: 1631869 - DNA, 17 bp, Homo sapiens
gtccccgagtgcctagg

SEQ ID NO: 1631870 - DNA, 15 bp, Homo sapiens
gtccccgctgctgtg

SEQ ID NO: 1631871 - DNA, 15 bp, Homo sapiens
gtcccctcccatctg

SEQ ID NO: 1631872 - DNA, 16 bp, Homo sapiens
gtcccctcccatctgg

SEQ ID NO: 1631873 - DNA, 22 bp, Homo sapiens
gtcccctccccggccctaccag

SEQ ID NO: 1631874 - DNA, 17 bp, Homo sapiens
gtcccctccgccgtgcc

SEQ ID NO: 1631875 - DNA, 15 bp, Homo sapiens
gtcccctctctctgg

SEQ ID NO: 1631876 - DNA, 23 bp, Homo sapiens
gtcccctctgtcatcactccctg

SEQ ID NO: 1631877 - DNA, 20 bp, Homo sapiens
gtcccctctgtgcttcgact

SEQ ID NO: 1631878 - DNA, 17 bp, Homo sapiens
gtcccctgagttggagc

SEQ ID NO: 1631879 - DNA, 15 bp, Homo sapiens
gtcccctgtcccacc

SEQ ID NO: 1631880 - DNA, 19 bp, Homo sapiens
gtcccctgtcccaccaact

SEQ ID NO: 1631881 - DNA, 20 bp, Homo sapiens
gtcccctgtcccaccaactc

SEQ ID NO: 1631882 - DNA, 13 bp, Homo sapiens
gtccccttctgtg

SEQ ID NO: 1631883 - DNA, 14 bp, Homo sapiens
gtccccttctgtgt

SEQ ID NO: 1631884 - DNA, 22 bp, Homo sapiens
gtccccttttcttttctaccct

SEQ ID NO: 1631885 - DNA, 15 bp, Homo sapiens
gtcccgatgcctccc

SEQ ID NO: 1631886 - DNA, 22 bp, Homo sapiens
gtcccgccttcctcctccacag

SEQ ID NO: 1631887 - DNA, 14 bp, Homo sapiens
gtcccgcggtgctg

SEQ ID NO: 1631888 - DNA, 15 bp, Homo sapiens
gtcccgcggtgctga

SEQ ID NO: 1631889 - DNA, 16 bp, Homo sapiens
gtcccggccagctctg

SEQ ID NO: 1631890 - DNA, 19 bp, Homo sapiens
gtcccggccagctctggag

SEQ ID NO: 1631891 - DNA, 15 bp, Homo sapiens
gtcccggccgcgccg

SEQ ID NO: 1631892 - DNA, 19 bp, Homo sapiens
gtcccgtcaggacgttgag

SEQ ID NO: 1631893 - DNA, 21 bp, Homo sapiens
gtccctaccccatggtgctag

SEQ ID NO: 1631894 - DNA, 21 bp, Homo sapiens
gtccctaccgagtctcttctc

SEQ ID NO: 1631895 - DNA, 22 bp, Homo sapiens
gtccctaccgagtctcttctcc

SEQ ID NO: 1631896 - DNA, 23 bp, Homo sapiens
gtccctaccgagtctcttctcca

SEQ ID NO: 1631897 - DNA, 14 bp, Homo sapiens
gtccctcccaggtc

SEQ ID NO: 1631898 - DNA, 18 bp, Homo sapiens
gtctataatggaaacatt

SEQ ID NO: 1631899 - DNA, 19 bp, Homo sapiens
gtctataatggaaacattt

SEQ ID NO: 1631900 - DNA, 22 bp, Homo sapiens
gtctataatggaaacatttaca

SEQ ID NO: 1631901 - DNA, 13 bp, Homo sapiens
gtctatatataca

SEQ ID NO: 1631902 - DNA, 9 bp, Homo sapiens
gtctatgaa

SEQ ID NO: 1631903 - DNA, 18 bp, Homo sapiens
gtctatgaagttgctgtt

SEQ ID NO: 1631904 - DNA, 22 bp, Homo sapiens
gtctatgaagttgctgtttatt

SEQ ID NO: 1631905 - DNA, 18 bp, Homo sapiens
gtctatgtcgagagctgg

SEQ ID NO: 1631906 - DNA, 15 bp, Homo sapiens
gtctatgttcaaaga

SEQ ID NO: 1631907 - DNA, 16 bp, Homo sapiens
gtctatgttcaaagac

SEQ ID NO: 1631908 - DNA, 14 bp, Homo sapiens
gtctattatcacat

SEQ ID NO: 1631909 - DNA, 13 bp, Homo sapiens
gtctattcagctt

SEQ ID NO: 1631910 - DNA, 17 bp, Homo sapiens
gtctattctgagccttg

SEQ ID NO: 1631911 - DNA, 21 bp, Homo sapiens
gtctatttccactgaacaaaa

SEQ ID NO: 1631912 - DNA, 18 bp, Homo sapiens
gtctattttgtatatttg

SEQ ID NO: 1631913 - DNA, 17 bp, Homo sapiens
gtctcaaaataaagcaa

SEQ ID NO: 1631914 - DNA, 16 bp, Homo sapiens
gtctcaaactcctgac

SEQ ID NO: 1631915 - DNA, 16 bp, Homo sapiens
gtctcaaactcctggg

SEQ ID NO: 1631916 - DNA, 14 bp, Homo sapiens
gtctcaaaggccag

SEQ ID NO: 1631917 - DNA, 20 bp, Homo sapiens
gtctcaagggtggcaggtca

SEQ ID NO: 1631918 - DNA, 14 bp, Homo sapiens
gtctcacagagaag

SEQ ID NO: 1631919 - DNA, 21 bp, Homo sapiens
gtctcactacttgaccattct

SEQ ID NO: 1631920 - DNA, 16 bp, Homo sapiens
gtctcactcgttctgt

SEQ ID NO: 1631921 - DNA, 15 bp, Homo sapiens
gtctcactgcttgaa

SEQ ID NO: 1631922 - DNA, 11 bp, Homo sapiens
gtctcagaaga

SEQ ID NO: 1631923 - DNA, 13 bp, Homo sapiens
gtctcagaagagg

SEQ ID NO: 1631924 - DNA, 13 bp, Homo sapiens
gtctcagaatcta

SEQ ID NO: 1631925 - DNA, 14 bp, Homo sapiens
gtctcagagaccag

SEQ ID NO: 1631926 - DNA, 17 bp, Homo sapiens
gtctcagcctcctgagt

SEQ ID NO: 1631927 - DNA, 22 bp, Homo sapiens
gtctcagcctctgccagcgcca

SEQ ID NO: 1631928 - DNA, 12 bp, Homo sapiens
gtctcagctgct

SEQ ID NO: 1631929 - DNA, 15 bp, Homo sapiens
gtctcaggacctagg

SEQ ID NO: 1631930 - DNA, 23 bp, Homo sapiens
gtctcaggcagcaccacactggg

SEQ ID NO: 1631931 - DNA, 20 bp, Homo sapiens
gtctcaggtttgttttgtga

SEQ ID NO: 1631932 - DNA, 18 bp, Homo sapiens
gtctcataggttaaaaaa

SEQ ID NO: 1631933 - DNA, 12 bp, Homo sapiens
gtctcatctctt

SEQ ID NO: 1631934 - DNA, 19 bp, Homo sapiens
gtctcattccgttgtctgt

SEQ ID NO: 1631935 - DNA, 18 bp, Homo sapiens
gtctcattcgcctttgtc

SEQ ID NO: 1631936 - DNA, 19 bp, Homo sapiens
gtctcattcgcctttgtct

SEQ ID NO: 1631937 - DNA, 20 bp, Homo sapiens
gtctcattcgcctttgtctt

SEQ ID NO: 1631938 - DNA, 21 bp, Homo sapiens
gtctcattcgcctttgtcttg

SEQ ID NO: 1631939 - DNA, 18 bp, Homo sapiens
gtctcattttgtccatgt

SEQ ID NO: 1631940 - DNA, 23 bp, Homo sapiens
gtctcattttgtccatgtccccc

SEQ ID NO: 1631941 - DNA, 23 bp, Homo sapiens
gtctccacctacacccctgtgct

SEQ ID NO: 1631942 - DNA, 23 bp, Homo sapiens
gtctccactaaatgagctcctgc

SEQ ID NO: 1631943 - DNA, 10 bp, Homo sapiens
gtctccagct

SEQ ID NO: 1631944 - DNA, 16 bp, Homo sapiens
gtctccagctgcctgg

SEQ ID NO: 1631945 - DNA, 15 bp, Homo sapiens
gtctccaggccatga

SEQ ID NO: 1631946 - DNA, 22 bp, Homo sapiens
gtctccagggccccccaactgt

SEQ ID NO: 1631947 - DNA, 20 bp, Homo sapiens
gtctccaggggcctgcagaa

SEQ ID NO: 1631948 - DNA, 15 bp, Homo sapiens
gtctccaggggctgc

SEQ ID NO: 1631949 - DNA, 19 bp, Homo sapiens
gtctccaggggctgcttcc

SEQ ID NO: 1631950 - DNA, 21 bp, Homo sapiens
gtctccaggggctgcttcctc

SEQ ID NO: 1631951 - DNA, 21 bp, Homo sapiens
gtctccagtatccactttgca

SEQ ID NO: 1631952 - DNA, 18 bp, Homo sapiens
gtctccatatcagctctc

SEQ ID NO: 1631953 - DNA, 23 bp, Homo sapiens
gtctccatgaagagcttgtgtcc

SEQ ID NO: 1631954 - DNA, 17 bp, Homo sapiens
gtctcccaggccccctg

SEQ ID NO: 1631955 - DNA, 18 bp, Homo sapiens
gtctccccatgtgcctgc

SEQ ID NO: 1631956 - DNA, 21 bp, Homo sapiens
gtctccctctcctgcctactc

SEQ ID NO: 1631957 - DNA, 16 bp, Homo sapiens
gtctccctgcacagcc

SEQ ID NO: 1631958 - DNA, 18 bp, Homo sapiens
gtctccctgcacagcctc

SEQ ID NO: 1631959 - DNA, 19 bp, Homo sapiens
gtctccctgcacagcctct

SEQ ID NO: 1631960 - DNA, 14 bp, Homo sapiens
gtctccctggctcc

SEQ ID NO: 1631961 - DNA, 21 bp, Homo sapiens
gtctccctggtggggtgtgca

SEQ ID NO: 1631962 - DNA, 17 bp, Homo sapiens
gtctcctaaaactggga

SEQ ID NO: 1631963 - DNA, 20 bp, Homo sapiens
gtctcctaagctggagtgca

SEQ ID NO: 1631964 - DNA, 16 bp, Homo sapiens
gtctcctactgaggat

SEQ ID NO: 1631965 - DNA, 13 bp, Homo sapiens
gtctcctcccagc

SEQ ID NO: 1631966 - DNA, 16 bp, Homo sapiens
gtctcctcccagcggc

SEQ ID NO: 1631967 - DNA, 14 bp, Homo sapiens
gtctcctccccttc

SEQ ID NO: 1631968 - DNA, 20 bp, Homo sapiens
gtctcctcctcgaagccatg

SEQ ID NO: 1631969 - DNA, 16 bp, Homo sapiens
gtctcctctctgagac

SEQ ID NO: 1631970 - DNA, 17 bp, Homo sapiens
gtctcctctcttggcat

SEQ ID NO: 1631971 - DNA, 23 bp, Homo sapiens
gtctcctggaccttgacagagca

SEQ ID NO: 1631972 - DNA, 21 bp, Homo sapiens
gtctcctgtgcccacatccca

SEQ ID NO: 1631973 - DNA, 22 bp, Homo sapiens
gtctcctgtgcccacatcccag

SEQ ID NO: 1631974 - DNA, 18 bp, Homo sapiens
gtctccttactctgagcc

SEQ ID NO: 1631975 - DNA, 21 bp, Homo sapiens
gtctccttactctgagcccag

SEQ ID NO: 1631976 - DNA, 23 bp, Homo sapiens
gtctccttactctgagcccaggc

SEQ ID NO: 1631977 - DNA, 14 bp, Homo sapiens
gtctccttcagcac

SEQ ID NO: 1631978 - DNA, 20 bp, Homo sapiens
gtctccttcagcacggcgtg

SEQ ID NO: 1631979 - DNA, 16 bp, Homo sapiens
gtctcctttgcactga

SEQ ID NO: 1631980 - DNA, 20 bp, Homo sapiens
gtctcctttgcactgagggc

SEQ ID NO: 1631981 - DNA, 22 bp, Homo sapiens
gtctcctttgcactgagggcca

SEQ ID NO: 1631982 - DNA, 21 bp, Homo sapiens
cagatatttccatttcttcct

SEQ ID NO: 1631983 - DNA, 13 bp, Homo sapiens
cagatcactgcca

SEQ ID NO: 1631984 - DNA, 17 bp, Homo sapiens
cagatcagtcagagccc

SEQ ID NO: 1631985 - DNA, 15 bp, Homo sapiens
cagatcatccagaag

SEQ ID NO: 1631986 - DNA, 12 bp, Homo sapiens
cagatccagcct

SEQ ID NO: 1631987 - DNA, 13 bp, Homo sapiens
cagatccagcctg

SEQ ID NO: 1631988 - DNA, 18 bp, Homo sapiens
cagatccagcctggggtc

SEQ ID NO: 1631989 - DNA, 15 bp, Homo sapiens
cagatcccagctcac

SEQ ID NO: 1631990 - DNA, 23 bp, Homo sapiens
cagatcctgttacttgcttcagt

SEQ ID NO: 1631991 - DNA, 17 bp, Homo sapiens
cagatcgaaattggact

SEQ ID NO: 1631992 - DNA, 23 bp, Homo sapiens
cagatcgaaattggactgtcttt

SEQ ID NO: 1631993 - DNA, 22 bp, Homo sapiens
cagatctcatggaaactggcca

SEQ ID NO: 1631994 - DNA, 14 bp, Homo sapiens
cagatctcctggca

SEQ ID NO: 1631995 - DNA, 17 bp, Homo sapiens
cagatctgatcaagagt

SEQ ID NO: 1631996 - DNA, 14 bp, Homo sapiens
cagatctgcctggg

SEQ ID NO: 1631997 - DNA, 16 bp, Homo sapiens
cagatctgcctgggcc

SEQ ID NO: 1631998 - DNA, 18 bp, Homo sapiens
cagatctggaacctcagc

SEQ ID NO: 1631999 - DNA, 17 bp, Homo sapiens
cagatctggtcccttgc

SEQ ID NO: 1632000 - DNA, 20 bp, Homo sapiens
cagatctggtctagttaacc

SEQ ID NO: 1632001 - DNA, 16 bp, Homo sapiens
cagatctggtttctaa

SEQ ID NO: 1632002 - DNA, 23 bp, Homo sapiens
cagatctgtatatttttttctaa

SEQ ID NO: 1632003 - DNA, 20 bp, Homo sapiens
cagatctgtgccccatgcct

SEQ ID NO: 1632004 - DNA, 12 bp, Homo sapiens
cagatctgtttt

SEQ ID NO: 1632005 - DNA, 23 bp, Homo sapiens
cagatctgttttgtggtttggaa

SEQ ID NO: 1632006 - DNA, 23 bp, Homo sapiens
cagatcttccgtggtcagagtgc

SEQ ID NO: 1632007 - DNA, 14 bp, Homo sapiens
cagatcttgacagt

SEQ ID NO: 1632008 - DNA, 23 bp, Homo sapiens
cagatcttgacagtatatttgaa

SEQ ID NO: 1632009 - DNA, 20 bp, Homo sapiens
cagatctttcagaaatataa

SEQ ID NO: 1632010 - DNA, 12 bp, Homo sapiens
cagatctttctc

SEQ ID NO: 1632011 - DNA, 13 bp, Homo sapiens
cagatctttctct

SEQ ID NO: 1632012 - DNA, 15 bp, Homo sapiens
cagatctttctcttc

SEQ ID NO: 1632013 - DNA, 17 bp, Homo sapiens
cagatgaatgccgtgga

SEQ ID NO: 1632014 - DNA, 23 bp, Homo sapiens
cagatgactatgcagaggcctgg

SEQ ID NO: 1632015 - DNA, 16 bp, Homo sapiens
cagatgagcagaagct

SEQ ID NO: 1632016 - DNA, 18 bp, Homo sapiens
cagatgagcagtcacact

SEQ ID NO: 1632017 - DNA, 19 bp, Homo sapiens
cagatgagcagtcacactg

SEQ ID NO: 1632018 - DNA, 22 bp, Homo sapiens
cagatgagcagtcacactgtta

SEQ ID NO: 1632019 - DNA, 15 bp, Homo sapiens
cagatgcaatgtgct

SEQ ID NO: 1632020 - DNA, 14 bp, Homo sapiens
cagatgcaggacag

SEQ ID NO: 1632021 - DNA, 17 bp, Homo sapiens
cagatgcaggacaggag

SEQ ID NO: 1632022 - DNA, 18 bp, Homo sapiens
cagatgcaggacaggagg

SEQ ID NO: 1632023 - DNA, 20 bp, Homo sapiens
cagatgcaggacaggaggcg

SEQ ID NO: 1632024 - DNA, 22 bp, Homo sapiens
cagatgcaggacaggaggcggc

SEQ ID NO: 1632025 - DNA, 15 bp, Homo sapiens
cagatgcccagaggg

SEQ ID NO: 1632026 - DNA, 19 bp, Homo sapiens
cagatgcccagagggccca

SEQ ID NO: 1632027 - DNA, 20 bp, Homo sapiens
cagatgcccagagggcccag

SEQ ID NO: 1632028 - DNA, 13 bp, Homo sapiens
cagatgccccaga

SEQ ID NO: 1632029 - DNA, 16 bp, Homo sapiens
cagatgccccagagct

SEQ ID NO: 1632030 - DNA, 13 bp, Homo sapiens
cagatgcctcccc

SEQ ID NO: 1632031 - DNA, 20 bp, Homo sapiens
cagatgcctccccaagactg

SEQ ID NO: 1632032 - DNA, 15 bp, Homo sapiens
cagatgcctgcttga

SEQ ID NO: 1632033 - DNA, 12 bp, Homo sapiens
cagatgcctggg

SEQ ID NO: 1632034 - DNA, 14 bp, Homo sapiens
cagatgccttctag

SEQ ID NO: 1632035 - DNA, 22 bp, Homo sapiens
cagatgcgtcccaagatgttga

SEQ ID NO: 1632036 - DNA, 21 bp, Homo sapiens
cagatgctccaagattctaga

SEQ ID NO: 1632037 - DNA, 22 bp, Homo sapiens
cagatgctccaagattctagat

SEQ ID NO: 1632038 - DNA, 17 bp, Homo sapiens
cagatgctgtcattagt

SEQ ID NO: 1632039 - DNA, 18 bp, Homo sapiens
cagatggaaaaactgagg

SEQ ID NO: 1632040 - DNA, 21 bp, Homo sapiens
cagatggaagagataaacgac

SEQ ID NO: 1632041 - DNA, 21 bp, Homo sapiens
cagatggaatgctgtgttaaa

SEQ ID NO: 1632042 - DNA, 12 bp, Homo sapiens
cagatggagacc

SEQ ID NO: 1632043 - DNA, 20 bp, Homo sapiens
cagatgggaacagtaaagaa

SEQ ID NO: 1632044 - DNA, 16 bp, Homo sapiens
gtaaatggtgtacata

SEQ ID NO: 1632045 - DNA, 20 bp, Homo sapiens
gtaaatggtgtacataatgt

SEQ ID NO: 1632046 - DNA, 14 bp, Homo sapiens
gtaaattcagacaa

SEQ ID NO: 1632047 - DNA, 18 bp, Homo sapiens
gtaaattcagacaacatt

SEQ ID NO: 1632048 - DNA, 21 bp, Homo sapiens
gtaaattcagacaacattatg

SEQ ID NO: 1632049 - DNA, 16 bp, Homo sapiens
gtaaatttatgtgatg

SEQ ID NO: 1632050 - DNA, 15 bp, Homo sapiens
gtaaatttgtactat

SEQ ID NO: 1632051 - DNA, 15 bp, Homo sapiens
gtaacaaggtgtctt

SEQ ID NO: 1632052 - DNA, 19 bp, Homo sapiens
gtaacaatacaaatggatt

SEQ ID NO: 1632053 - DNA, 21 bp, Homo sapiens
gtaacaattgtgtagcctttt

SEQ ID NO: 1632054 - DNA, 15 bp, Homo sapiens
gtaacacagtattat

SEQ ID NO: 1632055 - DNA, 22 bp, Homo sapiens
gtaacacagtgccttcaataaa

SEQ ID NO: 1632056 - DNA, 20 bp, Homo sapiens
gtaacacgggaatcacaggt

SEQ ID NO: 1632057 - DNA, 20 bp, Homo sapiens
gtaacactagggccttggaa

SEQ ID NO: 1632058 - DNA, 15 bp, Homo sapiens
gtaacactcctctgc

SEQ ID NO: 1632059 - DNA, 16 bp, Homo sapiens
gtaacactgcaagaag

SEQ ID NO: 1632060 - DNA, 20 bp, Homo sapiens
gtaacagatatcagtgtctc

SEQ ID NO: 1632061 - DNA, 22 bp, Homo sapiens
gtaacaggaaaattttaaaaat

SEQ ID NO: 1632062 - DNA, 18 bp, Homo sapiens
gtaacagttcatgtttgc

SEQ ID NO: 1632063 - DNA, 20 bp, Homo sapiens
gtaacagttcatgtttgctt

SEQ ID NO: 1632064 - DNA, 18 bp, Homo sapiens
gtaacataactgcttctt

SEQ ID NO: 1632065 - DNA, 19 bp, Homo sapiens
gtaacataactgcttcttg

SEQ ID NO: 1632066 - DNA, 15 bp, Homo sapiens
gtaacatcaaagatt

SEQ ID NO: 1632067 - DNA, 19 bp, Homo sapiens
gtaacatcataattacatt

SEQ ID NO: 1632068 - DNA, 23 bp, Homo sapiens
gtaacatcataattacattccta

SEQ ID NO: 1632069 - DNA, 14 bp, Homo sapiens
gtaacatccaagcc

SEQ ID NO: 1632070 - DNA, 15 bp, Homo sapiens
gtaacatccaagcca

SEQ ID NO: 1632071 - DNA, 19 bp, Homo sapiens
gtaacatccaagccagagt

SEQ ID NO: 1632072 - DNA, 13 bp, Homo sapiens
gtaacatttctgt

SEQ ID NO: 1632073 - DNA, 13 bp, Homo sapiens
gtaaccaagctgt

SEQ ID NO: 1632074 - DNA, 16 bp, Homo sapiens
gtaacccctcctggct

SEQ ID NO: 1632075 - DNA, 18 bp, Homo sapiens
gtaacccctcctggctgt

SEQ ID NO: 1632076 - DNA, 21 bp, Homo sapiens
gtaaccgtaacccacccccaa

SEQ ID NO: 1632077 - DNA, 21 bp, Homo sapiens
gtaacgagggcaacagggagc

SEQ ID NO: 1632078 - DNA, 15 bp, Homo sapiens
gtaactaatttgtgg

SEQ ID NO: 1632079 - DNA, 20 bp, Homo sapiens
gtaactacaaagctttgcta

SEQ ID NO: 1632080 - DNA, 17 bp, Homo sapiens
gtaactactttttatac

SEQ ID NO: 1632081 - DNA, 19 bp, Homo sapiens
gtaactactttttatactc

SEQ ID NO: 1632082 - DNA, 19 bp, Homo sapiens
gtaactatttcttcagagt

SEQ ID NO: 1632083 - DNA, 19 bp, Homo sapiens
gtaactccagatagagaaa

SEQ ID NO: 1632084 - DNA, 13 bp, Homo sapiens
gtaactgacaact

SEQ ID NO: 1632085 - DNA, 15 bp, Homo sapiens
gtaactgagagaaag

SEQ ID NO: 1632086 - DNA, 17 bp, Homo sapiens
gtaatcatttatcttat

SEQ ID NO: 1632087 - DNA, 18 bp, Homo sapiens
gtaatcatttgtttacat

SEQ ID NO: 1632088 - DNA, 18 bp, Homo sapiens
gtaatccaggcacagctg

SEQ ID NO: 1632089 - DNA, 20 bp, Homo sapiens
gtaatcccagctacttggga

SEQ ID NO: 1632090 - DNA, 20 bp, Homo sapiens
gtaatcctattaaaacacag

SEQ ID NO: 1632091 - DNA, 22 bp, Homo sapiens
gtaatctatgaattctaagtga

SEQ ID NO: 1632092 - DNA, 21 bp, Homo sapiens
gtaatctcggaaggctgaggc

SEQ ID NO: 1632093 - DNA, 17 bp, Homo sapiens
gtaatctctctgcagct

SEQ ID NO: 1632094 - DNA, 18 bp, Homo sapiens
gtaatctctctgcagctg

SEQ ID NO: 1632095 - DNA, 13 bp, Homo sapiens
gtaatctttaaac

SEQ ID NO: 1632096 - DNA, 17 bp, Homo sapiens
gtaatctttacctgtat

SEQ ID NO: 1632097 - DNA, 22 bp, Homo sapiens
gtaatgacgtgtgtggctggga

SEQ ID NO: 1632098 - DNA, 18 bp, Homo sapiens
gtaatgacttagaaactg

SEQ ID NO: 1632099 - DNA, 15 bp, Homo sapiens
gtaatgatactgtgt

SEQ ID NO: 1632100 - DNA, 15 bp, Homo sapiens
gtaatgcagttttta

SEQ ID NO: 1632101 - DNA, 22 bp, Homo sapiens
gtaatgcagtttttaaaaacct

SEQ ID NO: 1632102 - DNA, 14 bp, Homo sapiens
gtaatgctgcactt

SEQ ID NO: 1632103 - DNA, 17 bp, Homo sapiens
gtaatgctgcacttcct

SEQ ID NO: 1632104 - DNA, 16 bp, Homo sapiens
gtaatgcttcaatcag

SEQ ID NO: 1632105 - DNA, 12 bp, Homo sapiens
gtaatgggcctg

SEQ ID NO: 1632106 - DNA, 16 bp, Homo sapiens
gtaatggtgtagaaca

SEQ ID NO: 1632107 - DNA, 16 bp, Homo sapiens
gtaatgtaaataaact

SEQ ID NO: 1632108 - DNA, 12 bp, Homo sapiens
gtaatgtcacca

SEQ ID NO: 1632109 - DNA, 22 bp, Homo sapiens
gtaatgtcaccaccttcccagc

SEQ ID NO: 1632110 - DNA, 16 bp, Homo sapiens
gtaatgtgaataaatt

SEQ ID NO: 1632111 - DNA, 21 bp, Homo sapiens
gtaattaagtactatgtatca

SEQ ID NO: 1632112 - DNA, 20 bp, Homo sapiens
gtaattatcgggaacagtgt

SEQ ID NO: 1632113 - DNA, 21 bp, Homo sapiens
gtaattatcgggaacagtgtt

SEQ ID NO: 1632114 - DNA, 22 bp, Homo sapiens
gtaattatcgggaacagtgttt

SEQ ID NO: 1632115 - DNA, 14 bp, Homo sapiens
gtaattcaagaaaa

SEQ ID NO: 1632116 - DNA, 12 bp, Homo sapiens
gtaattcattga

SEQ ID NO: 1632117 - DNA, 22 bp, Homo sapiens
gtaattcattgagcagttagct

SEQ ID NO: 1632118 - DNA, 13 bp, Homo sapiens
gtaattcctctcc

SEQ ID NO: 1632119 - DNA, 14 bp, Homo sapiens
gtaattccttctct

SEQ ID NO: 1632120 - DNA, 16 bp, Homo sapiens
gtaattctttctgtct

SEQ ID NO: 1632121 - DNA, 18 bp, Homo sapiens
gtaattctttctgtctcc

SEQ ID NO: 1632122 - DNA, 15 bp, Homo sapiens
gtaattgaacttatc

SEQ ID NO: 1632123 - DNA, 12 bp, Homo sapiens
gtaattgcttac

SEQ ID NO: 1632124 - DNA, 16 bp, Homo sapiens
gtaattggaatcttca

SEQ ID NO: 1632125 - DNA, 23 bp, Homo sapiens
gtaattggaatcttcacctcaga

SEQ ID NO: 1632126 - DNA, 18 bp, Homo sapiens
gtaattggtaattacctg

SEQ ID NO: 1632127 - DNA, 12 bp, Homo sapiens
gtaattgtacaa

SEQ ID NO: 1632128 - DNA, 18 bp, Homo sapiens
gtaattgtacaataaatt

SEQ ID NO: 1632129 - DNA, 21 bp, Homo sapiens
gtaattgtgtggattctttaa

SEQ ID NO: 1632130 - DNA, 16 bp, Homo sapiens
gtaattgttttggaat

SEQ ID NO: 1632131 - DNA, 14 bp, Homo sapiens
gtaattgtttttta

SEQ ID NO: 1632132 - DNA, 18 bp, Homo sapiens
cagagggcacatgaacag

SEQ ID NO: 1632133 - DNA, 20 bp, Homo sapiens
cagagggcacatgaacagct

SEQ ID NO: 1632134 - DNA, 16 bp, Homo sapiens
cagagggcagaggctg

SEQ ID NO: 1632135 - DNA, 16 bp, Homo sapiens
cagagggcatgctgaa

SEQ ID NO: 1632136 - DNA, 13 bp, Homo sapiens
cagagggccagca

SEQ ID NO: 1632137 - DNA, 15 bp, Homo sapiens
cagagggccagcagg

SEQ ID NO: 1632138 - DNA, 18 bp, Homo sapiens
cagagggccagcaggctc

SEQ ID NO: 1632139 - DNA, 23 bp, Homo sapiens
cagagggccattgaactctgaga

SEQ ID NO: 1632140 - DNA, 12 bp, Homo sapiens
cagagggctgga

SEQ ID NO: 1632141 - DNA, 13 bp, Homo sapiens
cagagggctggag

SEQ ID NO: 1632142 - DNA, 14 bp, Homo sapiens
cagagggctggagg

SEQ ID NO: 1632143 - DNA, 19 bp, Homo sapiens
cagaggggatggggataga

SEQ ID NO: 1632144 - DNA, 13 bp, Homo sapiens
cagaggggcagcc

SEQ ID NO: 1632145 - DNA, 14 bp, Homo sapiens
cagaggggcagccg

SEQ ID NO: 1632146 - DNA, 16 bp, Homo sapiens
cagaggggcagccgct

SEQ ID NO: 1632147 - DNA, 20 bp, Homo sapiens
cagaggggctccccgggtct

SEQ ID NO: 1632148 - DNA, 22 bp, Homo sapiens
cagagggggagtagccaagctg

SEQ ID NO: 1632149 - DNA, 16 bp, Homo sapiens
cagaggtaccctgggt

SEQ ID NO: 1632150 - DNA, 19 bp, Homo sapiens
cagaggtaggagaactggg

SEQ ID NO: 1632151 - DNA, 22 bp, Homo sapiens
cagaggtagtctcactgcttga

SEQ ID NO: 1632152 - DNA, 18 bp, Homo sapiens
cagaggtctccaaactga

SEQ ID NO: 1632153 - DNA, 13 bp, Homo sapiens
cagaggtctccca

SEQ ID NO: 1632154 - DNA, 14 bp, Homo sapiens
cagaggtctgtgct

SEQ ID NO: 1632155 - DNA, 19 bp, Homo sapiens
cagaggtgcaagacctagt

SEQ ID NO: 1632156 - DNA, 14 bp, Homo sapiens
cagaggtgcttcac

SEQ ID NO: 1632157 - DNA, 21 bp, Homo sapiens
cagaggtgcttcaccctgagt

SEQ ID NO: 1632158 - DNA, 14 bp, Homo sapiens
cagaggtggagcca

SEQ ID NO: 1632159 - DNA, 15 bp, Homo sapiens
cagaggtgggcaggt

SEQ ID NO: 1632160 - DNA, 16 bp, Homo sapiens
cagaggtgggcaggtg

SEQ ID NO: 1632161 - DNA, 19 bp, Homo sapiens
cagaggttatctgcctggc

SEQ ID NO: 1632162 - DNA, 20 bp, Homo sapiens
cagaggttatctgcctggcc

SEQ ID NO: 1632163 - DNA, 22 bp, Homo sapiens
cagaggttgcagtgagctgaga

SEQ ID NO: 1632164 - DNA, 21 bp, Homo sapiens
cagaggttgtagtgagccaag

SEQ ID NO: 1632165 - DNA, 22 bp, Homo sapiens
cagagtatgtttttaagtgtat

SEQ ID NO: 1632166 - DNA, 17 bp, Homo sapiens
cagagtcagaggagaag

SEQ ID NO: 1632167 - DNA, 18 bp, Homo sapiens
cagagtcagaggagaaga

SEQ ID NO: 1632168 - DNA, 15 bp, Homo sapiens
cagagtcagccagga

SEQ ID NO: 1632169 - DNA, 17 bp, Homo sapiens
cagagtcagccaggacc

SEQ ID NO: 1632170 - DNA, 21 bp, Homo sapiens
cagagtccatttcccacatct

SEQ ID NO: 1632171 - DNA, 23 bp, Homo sapiens
cagagtccttagtggaggggttt

SEQ ID NO: 1632172 - DNA, 14 bp, Homo sapiens
cagagtcctttcca

SEQ ID NO: 1632173 - DNA, 23 bp, Homo sapiens
cagagtctcgctctgttgcccag

SEQ ID NO: 1632174 - DNA, 20 bp, Homo sapiens
cagagtctggtgaagctcac

SEQ ID NO: 1632175 - DNA, 15 bp, Homo sapiens
cagagtgacagtcat

SEQ ID NO: 1632176 - DNA, 19 bp, Homo sapiens
cagagtgacagtcataaat

SEQ ID NO: 1632177 - DNA, 11 bp, Homo sapiens
cagagtgccac

SEQ ID NO: 1632178 - DNA, 14 bp, Homo sapiens
cagagtgccactgc

SEQ ID NO: 1632179 - DNA, 17 bp, Homo sapiens
cagagtgctgaggccag

SEQ ID NO: 1632180 - DNA, 23 bp, Homo sapiens
cagagtgctgaggccagggctga

SEQ ID NO: 1632181 - DNA, 19 bp, Homo sapiens
cagagtggaaactcagccg

SEQ ID NO: 1632182 - DNA, 14 bp, Homo sapiens
cagagtggaatgct

SEQ ID NO: 1632183 - DNA, 17 bp, Homo sapiens
cagagtggactgcattt

SEQ ID NO: 1632184 - DNA, 12 bp, Homo sapiens
cagagtggaggc

SEQ ID NO: 1632185 - DNA, 18 bp, Homo sapiens
cagagtggcctccctgct

SEQ ID NO: 1632186 - DNA, 18 bp, Homo sapiens
cagagtggcctggccagg

SEQ ID NO: 1632187 - DNA, 22 bp, Homo sapiens
cagagtgggccccgggctggag

SEQ ID NO: 1632188 - DNA, 18 bp, Homo sapiens
cagagtggtcgagtgaca

SEQ ID NO: 1632189 - DNA, 15 bp, Homo sapiens
cagagtggtctttct

SEQ ID NO: 1632190 - DNA, 18 bp, Homo sapiens
cagagtgtggactctggt

SEQ ID NO: 1632191 - DNA, 20 bp, Homo sapiens
cagagtgtgggaagggagag

SEQ ID NO: 1632192 - DNA, 15 bp, Homo sapiens
cagagttaaaatgtt

SEQ ID NO: 1632193 - DNA, 16 bp, Homo sapiens
cagagttaaaatgttt

SEQ ID NO: 1632194 - DNA, 22 bp, Homo sapiens
cagagttaaaatgtttactgta

SEQ ID NO: 1632195 - DNA, 23 bp, Homo sapiens
cagagttaaaatgtttactgtaa

SEQ ID NO: 1632196 - DNA, 20 bp, Homo sapiens
cagagttaaatatgcatctg

SEQ ID NO: 1632197 - DNA, 17 bp, Homo sapiens
cagagttaaatctcaaa

SEQ ID NO: 1632198 - DNA, 12 bp, Homo sapiens
cagagttacagt

SEQ ID NO: 1632199 - DNA, 17 bp, Homo sapiens
cagagttacagttctgt

SEQ ID NO: 1632200 - DNA, 12 bp, Homo sapiens
cagagttacttg

SEQ ID NO: 1632201 - DNA, 20 bp, Homo sapiens
ggggccttagggcactgggc

SEQ ID NO: 1632202 - DNA, 20 bp, Homo sapiens
ggggcgccctctctgctcct

SEQ ID NO: 1632203 - DNA, 20 bp, Homo sapiens
ggggcgctcaggacccaggc

SEQ ID NO: 1632204 - DNA, 14 bp, Homo sapiens
ggggcgctggccca

SEQ ID NO: 1632205 - DNA, 17 bp, Homo sapiens
ggggcgctggcccagcc

SEQ ID NO: 1632206 - DNA, 13 bp, Homo sapiens
ggggcgtccaggc

SEQ ID NO: 1632207 - DNA, 20 bp, Homo sapiens
ggggcgtgagacccagtgca

SEQ ID NO: 1632208 - DNA, 12 bp, Homo sapiens
ggggctccctct

SEQ ID NO: 1632209 - DNA, 23 bp, Homo sapiens
ggggctcctgaatatcagtcact

SEQ ID NO: 1632210 - DNA, 11 bp, Homo sapiens
ggggctcctgg

SEQ ID NO: 1632211 - DNA, 16 bp, Homo sapiens
ggggctctgccccagg

SEQ ID NO: 1632212 - DNA, 12 bp, Homo sapiens
ggggctctgcct

SEQ ID NO: 1632213 - DNA, 23 bp, Homo sapiens
ggggctctgccttctcaggcccc

SEQ ID NO: 1632214 - DNA, 12 bp, Homo sapiens
ggggctctggga

SEQ ID NO: 1632215 - DNA, 23 bp, Homo sapiens
ggggctgaattgccaggggcgag

SEQ ID NO: 1632216 - DNA, 22 bp, Homo sapiens
ggggctgctcagcctcatcctg

SEQ ID NO: 1632217 - DNA, 14 bp, Homo sapiens
ggggctgctcctcc

SEQ ID NO: 1632218 - DNA, 16 bp, Homo sapiens
ggggctgctcctccag

SEQ ID NO: 1632219 - DNA, 15 bp, Homo sapiens
ggggctgctggggca

SEQ ID NO: 1632220 - DNA, 16 bp, Homo sapiens
ggggctgcttcctcct

SEQ ID NO: 1632221 - DNA, 19 bp, Homo sapiens
ggggctgcttcctcctgga

SEQ ID NO: 1632222 - DNA, 12 bp, Homo sapiens
ggggctggggga

SEQ ID NO: 1632223 - DNA, 20 bp, Homo sapiens
ggggctgtcctgctgccctc

SEQ ID NO: 1632224 - DNA, 22 bp, Homo sapiens
ggggctgtcctgctgccctccc

SEQ ID NO: 1632225 - DNA, 20 bp, Homo sapiens
ggggcttgcccactgcctgc

SEQ ID NO: 1632226 - DNA, 13 bp, Homo sapiens
ggggctttctctt

SEQ ID NO: 1632227 - DNA, 11 bp, Homo sapiens
gggggagaggg

SEQ ID NO: 1632228 - DNA, 21 bp, Homo sapiens
gggggagcccagtgaagcctc

SEQ ID NO: 1632229 - DNA, 14 bp, Homo sapiens
gggggagggggagg

SEQ ID NO: 1632230 - DNA, 21 bp, Homo sapiens
gggggatgccactcctccctc

SEQ ID NO: 1632231 - DNA, 12 bp, Homo sapiens
gggggcagaggg

SEQ ID NO: 1632232 - DNA, 17 bp, Homo sapiens
gggggcatgggtggagg

SEQ ID NO: 1632233 - DNA, 18 bp, Homo sapiens
gggggccccgccagggct

SEQ ID NO: 1632234 - DNA, 12 bp, Homo sapiens
gggggccctgct

SEQ ID NO: 1632235 - DNA, 11 bp, Homo sapiens
gggggcctgtg

SEQ ID NO: 1632236 - DNA, 14 bp, Homo sapiens
gggggcgccctctc

SEQ ID NO: 1632237 - DNA, 22 bp, Homo sapiens
gggggctatagctacaggaagc

SEQ ID NO: 1632238 - DNA, 21 bp, Homo sapiens
gggggctatttctctccccac

SEQ ID NO: 1632239 - DNA, 14 bp, Homo sapiens
gggggctggtgcca

SEQ ID NO: 1632240 - DNA, 13 bp, Homo sapiens
gggggctgtgcca

SEQ ID NO: 1632241 - DNA, 17 bp, Homo sapiens
ggggggaaagaaaagga

SEQ ID NO: 1632242 - DNA, 13 bp, Homo sapiens
ggggggacagtgc

SEQ ID NO: 1632243 - DNA, 13 bp, Homo sapiens
gggggtcctctct

SEQ ID NO: 1632244 - DNA, 22 bp, Homo sapiens
gggggtcctctctgagtcaaat

SEQ ID NO: 1632245 - DNA, 23 bp, Homo sapiens
gggggtggccgctgagtggcagg

SEQ ID NO: 1632246 - DNA, 19 bp, Homo sapiens
gggggttgcagtggagagg

SEQ ID NO: 1632247 - DNA, 22 bp, Homo sapiens
ggggtaaaattccttagcttag

SEQ ID NO: 1632248 - DNA, 19 bp, Homo sapiens
ggggtacaggtttggggag

SEQ ID NO: 1632249 - DNA, 15 bp, Homo sapiens
ggggtcaggctccat

SEQ ID NO: 1632250 - DNA, 23 bp, Homo sapiens
ggggtcaggtgtcaggcccgtcg

SEQ ID NO: 1632251 - DNA, 14 bp, Homo sapiens
ggggtccaggcccg

SEQ ID NO: 1632252 - DNA, 13 bp, Homo sapiens
ggggtccagtgca

SEQ ID NO: 1632253 - DNA, 16 bp, Homo sapiens
ggggtccctagcagcc

SEQ ID NO: 1632254 - DNA, 22 bp, Homo sapiens
ggggtccgtcttcacactgcgc

SEQ ID NO: 1632255 - DNA, 23 bp, Homo sapiens
ggggtcctctctgagtcaaatcc

SEQ ID NO: 1632256 - DNA, 19 bp, Homo sapiens
ggggtcctggagcagacca

SEQ ID NO: 1632257 - DNA, 20 bp, Homo sapiens
ggggtctccctctcctgcct

SEQ ID NO: 1632258 - DNA, 22 bp, Homo sapiens
ggggtctccctctcctgcctac

SEQ ID NO: 1632259 - DNA, 13 bp, Homo sapiens
ggggtctccctgg

SEQ ID NO: 1632260 - DNA, 16 bp, Homo sapiens
ggggtctcctggacct

SEQ ID NO: 1632261 - DNA, 21 bp, Homo sapiens
ggggtctggagttgatctgga

SEQ ID NO: 1632262 - DNA, 20 bp, Homo sapiens
ggggtctgtgctgtgcctgc

SEQ ID NO: 1632263 - DNA, 12 bp, Homo sapiens
ggggtctttgtg

SEQ ID NO: 1632264 - DNA, 22 bp, Homo sapiens
ggggtctttgtgagagtgagct

SEQ ID NO: 1632265 - DNA, 23 bp, Homo sapiens
ggggtgccccctcctctcccatc

SEQ ID NO: 1632266 - DNA, 15 bp, Homo sapiens
ggggtgctgtggaca

SEQ ID NO: 1632267 - DNA, 13 bp, Homo sapiens
ggggtggggagct

SEQ ID NO: 1632268 - DNA, 17 bp, Homo sapiens
ggggtgggggatctggg

SEQ ID NO: 1632269 - DNA, 17 bp, Homo sapiens
ggggtgggggtggggag

SEQ ID NO: 1632270 - DNA, 22 bp, Homo sapiens
ggggtggttattggactccagg

SEQ ID NO: 1632271 - DNA, 19 bp, Homo sapiens
ggggtgtggctccttccca

SEQ ID NO: 1632272 - DNA, 16 bp, Homo sapiens
ggggtgttcttcttgg

SEQ ID NO: 1632273 - DNA, 20 bp, Homo sapiens
ggggtgtttgggaggctgcg

SEQ ID NO: 1632274 - DNA, 12 bp, Homo sapiens
ggggttcaagcc

SEQ ID NO: 1632275 - DNA, 16 bp, Homo sapiens
ggggttcagcccctcc

SEQ ID NO: 1632276 - DNA, 14 bp, Homo sapiens
ggggttcaggcccg

SEQ ID NO: 1632277 - DNA, 17 bp, Homo sapiens
ggggttccccacacagg

SEQ ID NO: 1632278 - DNA, 18 bp, Homo sapiens
ggggttcctcaaattttt

SEQ ID NO: 1632279 - DNA, 22 bp, Homo sapiens
gggtaaaattccttagcttaga

SEQ ID NO: 1632280 - DNA, 15 bp, Homo sapiens
gggtaagaggagcag

SEQ ID NO: 1632281 - DNA, 17 bp, Homo sapiens
gggtaagaggagcagag

SEQ ID NO: 1632282 - DNA, 14 bp, Homo sapiens
gggtaagccagagc

SEQ ID NO: 1632283 - DNA, 18 bp, Homo sapiens
gggtaagccagagcctgg

SEQ ID NO: 1632284 - DNA, 19 bp, Homo sapiens
gggtaagccagagcctggg

SEQ ID NO: 1632285 - DNA, 20 bp, Homo sapiens
gggtaattgtacaataaatt

SEQ ID NO: 1632286 - DNA, 17 bp, Homo sapiens
gggtacatttctctgag

SEQ ID NO: 1632287 - DNA, 16 bp, Homo sapiens
gggtagacttggagct

SEQ ID NO: 1632288 - DNA, 13 bp, Homo sapiens
gggtagcagctgg

SEQ ID NO: 1632289 - DNA, 15 bp, Homo sapiens
gggtagcagctggac

SEQ ID NO: 1632290 - DNA, 17 bp, Homo sapiens
gggtagcagctggacta

SEQ ID NO: 1632291 - DNA, 22 bp, Homo sapiens
gggtagggtaaatcagtaagag

SEQ ID NO: 1632292 - DNA, 15 bp, Homo sapiens
gggtatcccctgcct

SEQ ID NO: 1632293 - DNA, 16 bp, Homo sapiens
gggtatcccctgcctc

SEQ ID NO: 1632294 - DNA, 18 bp, Homo sapiens
gggtatttttataacaat

SEQ ID NO: 1632295 - DNA, 21 bp, Homo sapiens
gggtcaaagacagaatggtgg

SEQ ID NO: 1632296 - DNA, 20 bp, Homo sapiens
gggtcagccatttttaatga

SEQ ID NO: 1632297 - DNA, 14 bp, Homo sapiens
gggtcagcccagca

SEQ ID NO: 1632298 - DNA, 22 bp, Homo sapiens
gggtcagcccagcacctgctcc

SEQ ID NO: 1632299 - DNA, 21 bp, Homo sapiens
gggtcaggaggcactgctcat

SEQ ID NO: 1632300 - DNA, 16 bp, Homo sapiens
gggtcaggtgtcaggc

SEQ ID NO: 1632301 - DNA, 19 bp, Homo sapiens
gggtcaggtgtcaggcccg

SEQ ID NO: 1632302 - DNA, 17 bp, Homo sapiens
gggtcatttcagagccc

SEQ ID NO: 1632303 - DNA, 19 bp, Homo sapiens
gggcccacgtggttggggc

SEQ ID NO: 1632304 - DNA, 19 bp, Homo sapiens
cactgccctggcagcagca

SEQ ID NO: 1632305 - DNA, 15 bp, Homo sapiens
cactgccgcctactg

SEQ ID NO: 1632306 - DNA, 12 bp, Homo sapiens
cactgccgctgc

SEQ ID NO: 1632307 - DNA, 23 bp, Homo sapiens
cactgcctaggaggctggccaag

SEQ ID NO: 1632308 - DNA, 18 bp, Homo sapiens
cactgcctctccctggcc

SEQ ID NO: 1632309 - DNA, 20 bp, Homo sapiens
cactgcctctccctggccct

SEQ ID NO: 1632310 - DNA, 13 bp, Homo sapiens
cactgcctgcaga

SEQ ID NO: 1632311 - DNA, 20 bp, Homo sapiens
cactgcctgcatgagctggc

SEQ ID NO: 1632312 - DNA, 14 bp, Homo sapiens
cactgcctgcctcc

SEQ ID NO: 1632313 - DNA, 17 bp, Homo sapiens
cactgcctgcctcccct

SEQ ID NO: 1632314 - DNA, 13 bp, Homo sapiens
cactgcctgggct

SEQ ID NO: 1632315 - DNA, 20 bp, Homo sapiens
cactgccttcgatacaccgg

SEQ ID NO: 1632316 - DNA, 22 bp, Homo sapiens
cactgccttcgatacaccgggc

SEQ ID NO: 1632317 - DNA, 18 bp, Homo sapiens
cactgccttcgcttcttg

SEQ ID NO: 1632318 - DNA, 12 bp, Homo sapiens
cactgccttttt

SEQ ID NO: 1632319 - DNA, 15 bp, Homo sapiens
cactgcgcaggtctc

SEQ ID NO: 1632320 - DNA, 18 bp, Homo sapiens
cactgcggaagccaaagg

SEQ ID NO: 1632321 - DNA, 17 bp, Homo sapiens
cactgcgggagctctgt

SEQ ID NO: 1632322 - DNA, 22 bp, Homo sapiens
cactgctcaagaagacatggag

SEQ ID NO: 1632323 - DNA, 15 bp, Homo sapiens
cactgctctcagcct

SEQ ID NO: 1632324 - DNA, 16 bp, Homo sapiens
cactgctctcagcctc

SEQ ID NO: 1632325 - DNA, 18 bp, Homo sapiens
cactgctctcagcctccc

SEQ ID NO: 1632326 - DNA, 14 bp, Homo sapiens
cactgctgcaccag

SEQ ID NO: 1632327 - DNA, 13 bp, Homo sapiens
cactgctgctgcc

SEQ ID NO: 1632328 - DNA, 13 bp, Homo sapiens
cactgctggctgc

SEQ ID NO: 1632329 - DNA, 18 bp, Homo sapiens
cactgctgttaaagacat

SEQ ID NO: 1632330 - DNA, 16 bp, Homo sapiens
cactgctgttcctgct

SEQ ID NO: 1632331 - DNA, 22 bp, Homo sapiens
cactgctgttcctgctccatga

SEQ ID NO: 1632332 - DNA, 15 bp, Homo sapiens
cactgcttcccactg

SEQ ID NO: 1632333 - DNA, 19 bp, Homo sapiens
cactgcttctcttttgaaa

SEQ ID NO: 1632334 - DNA, 22 bp, Homo sapiens
cactgctttgcaccgtggtcag

SEQ ID NO: 1632335 - DNA, 24 bp, Homo sapiens
cactggaaaggggagagcctgctg

SEQ ID NO: 1632336 - DNA, 17 bp, Homo sapiens
cactggaacatggctag

SEQ ID NO: 1632337 - DNA, 17 bp, Homo sapiens
cactggaaccacctgga

SEQ ID NO: 1632338 - DNA, 15 bp, Homo sapiens
cactggaagatttat

SEQ ID NO: 1632339 - DNA, 11 bp, Homo sapiens
cactggaatat

SEQ ID NO: 1632340 - DNA, 16 bp, Homo sapiens
cactggaccactgggc

SEQ ID NO: 1632341 - DNA, 15 bp, Homo sapiens
cactggactgcatgg

SEQ ID NO: 1632342 - DNA, 16 bp, Homo sapiens
cactggactgcatggg

SEQ ID NO: 1632343 - DNA, 11 bp, Homo sapiens
cactggagccc

SEQ ID NO: 1632344 - DNA, 17 bp, Homo sapiens
cactggaggggcccacc

SEQ ID NO: 1632345 - DNA, 23 bp, Homo sapiens
cactggagtgcagggaggagagg

SEQ ID NO: 1632346 - DNA, 23 bp, Homo sapiens
cactggattataagttctatttt

SEQ ID NO: 1632347 - DNA, 16 bp, Homo sapiens
cactggcaatgaaaaa

SEQ ID NO: 1632348 - DNA, 13 bp, Homo sapiens
cactggcagcctg

SEQ ID NO: 1632349 - DNA, 16 bp, Homo sapiens
cactggcagcctgcac

SEQ ID NO: 1632350 - DNA, 22 bp, Homo sapiens
cactggccaccaggctggcgca

SEQ ID NO: 1632351 - DNA, 24 bp, Homo sapiens
cactggccaccaggctggcgcagc

SEQ ID NO: 1632352 - DNA, 14 bp, Homo sapiens
cactggccagagag

SEQ ID NO: 1632353 - DNA, 16 bp, Homo sapiens
cactggccagagaggg

SEQ ID NO: 1632354 - DNA, 17 bp, Homo sapiens
cactggccagagagggc

SEQ ID NO: 1632355 - DNA, 19 bp, Homo sapiens
cactggccagagagggccc

SEQ ID NO: 1632356 - DNA, 23 bp, Homo sapiens
cactggccagagagggcccagct

SEQ ID NO: 1632357 - DNA, 24 bp, Homo sapiens
cactggcccctcaaatcgtccagc

SEQ ID NO: 1632358 - DNA, 13 bp, Homo sapiens
cactggcctgggt

SEQ ID NO: 1632359 - DNA, 21 bp, Homo sapiens
cactggcctgggtctccctgg

SEQ ID NO: 1632360 - DNA, 21 bp, Homo sapiens
cactggcgaagatggtctcca

SEQ ID NO: 1632361 - DNA, 14 bp, Homo sapiens
cactggcgccttct

SEQ ID NO: 1632362 - DNA, 11 bp, Homo sapiens
cactggctctc

SEQ ID NO: 1632363 - DNA, 12 bp, Homo sapiens
cactggctctcc

SEQ ID NO: 1632364 - DNA, 14 bp, Homo sapiens
cactggctctccaa

SEQ ID NO: 1632365 - DNA, 18 bp, Homo sapiens
cactggctctccaagtgc

SEQ ID NO: 1632366 - DNA, 19 bp, Homo sapiens
cactggctctccaagtgcc

SEQ ID NO: 1632367 - DNA, 21 bp, Homo sapiens
cactggctctccaagtgccag

SEQ ID NO: 1632368 - DNA, 14 bp, Homo sapiens
cactggctggcctg

SEQ ID NO: 1632369 - DNA, 15 bp, Homo sapiens
cactggctggggcag

SEQ ID NO: 1632370 - DNA, 20 bp, Homo sapiens
cactggctggggcagagggg

SEQ ID NO: 1632371 - DNA, 22 bp, Homo sapiens
cactggctggggcagaggggca

SEQ ID NO: 1632372 - DNA, 20 bp, Homo sapiens
cactggcttgaaggactgca

SEQ ID NO: 1632373 - DNA, 22 bp, Homo sapiens
cactggcttggaacaccttggg

SEQ ID NO: 1632374 - DNA, 18 bp, Homo sapiens
cactgggaagaagcaagg

SEQ ID NO: 1632375 - DNA, 15 bp, Homo sapiens
cactgggcacctgcg

SEQ ID NO: 1632376 - DNA, 22 bp, Homo sapiens
cactgggcagcaaggctgctgc

SEQ ID NO: 1632377 - DNA, 23 bp, Homo sapiens
cactgggcagcaaggctgctgcc

SEQ ID NO: 1632378 - DNA, 20 bp, Homo sapiens
cactgggccagccctgcagc

SEQ ID NO: 1632379 - DNA, 22 bp, Homo sapiens
cactgggccataatgttgcttc

SEQ ID NO: 1632380 - DNA, 20 bp, Homo sapiens
cactgggcctggagccctgg

SEQ ID NO: 1632381 - DNA, 13 bp, Homo sapiens
cactgggctgggt

SEQ ID NO: 1632382 - DNA, 14 bp, Homo sapiens
cactgggctgggtt

SEQ ID NO: 1632383 - DNA, 23 bp, Homo sapiens
cactggggactttatttatttct

SEQ ID NO: 1632384 - DNA, 22 bp, Homo sapiens
cactggggagcccgtctcagtg

SEQ ID NO: 1632385 - DNA, 14 bp, Homo sapiens
cactggggcacttg

SEQ ID NO: 1632386 - DNA, 14 bp, Homo sapiens
cactgggggagggg

SEQ ID NO: 1632387 - DNA, 18 bp, Homo sapiens
cactgggggaggggacat

SEQ ID NO: 1632388 - DNA, 18 bp, Homo sapiens
cactggggtcctggggcc

SEQ ID NO: 1632389 - DNA, 17 bp, Homo sapiens
cactgggtctcactcct

SEQ ID NO: 1632390 - DNA, 15 bp, Homo sapiens
cactgggtggggtga

SEQ ID NO: 1632391 - DNA, 21 bp, Homo sapiens
cactgggtggggtgaggacca

SEQ ID NO: 1632392 - DNA, 15 bp, Homo sapiens
cactgggtggtggcc

SEQ ID NO: 1632393 - DNA, 18 bp, Homo sapiens
cactggtctaatgtttgt

SEQ ID NO: 1632394 - DNA, 20 bp, Homo sapiens
cactggtgtgaactcaccct

SEQ ID NO: 1632395 - DNA, 20 bp, Homo sapiens
cactggttaaaataaagcct

SEQ ID NO: 1632396 - DNA, 20 bp, Homo sapiens
cactggttgcacttatgatt

SEQ ID NO: 1632397 - DNA, 13 bp, Homo sapiens
cactgtaaaatga

SEQ ID NO: 1632398 - DNA, 15 bp, Homo sapiens
cactgtaaagacaaa

SEQ ID NO: 1632399 - DNA, 19 bp, Homo sapiens
cactgtaaagacaaataaa

SEQ ID NO: 1632400 - DNA, 15 bp, Homo sapiens
cactgtaagtttatt

SEQ ID NO: 1632401 - DNA, 11 bp, Homo sapiens
cactgtaatga

SEQ ID NO: 1632402 - DNA, 21 bp, Homo sapiens
cactgtaatgaggaaaaaatg

SEQ ID NO: 1632403 - DNA, 20 bp, Homo sapiens
cactgtacccagtctcaaag

SEQ ID NO: 1632404 - DNA, 14 bp, Homo sapiens
cactgtactgcatg

SEQ ID NO: 1632405 - DNA, 20 bp, Homo sapiens
cactgtagttctaagactca

SEQ ID NO: 1632406 - DNA, 19 bp, Homo sapiens
cactgtagtttagttctgt

SEQ ID NO: 1632407 - DNA, 19 bp, Homo sapiens
cactgtagtttttgaaaat

SEQ ID NO: 1632408 - DNA, 23 bp, Homo sapiens
cactgtagtttttgaaaattatg

SEQ ID NO: 1632409 - DNA, 13 bp, Homo sapiens
cactgtatataaa

SEQ ID NO: 1632410 - DNA, 17 bp, Homo sapiens
cactgtatataaacata

SEQ ID NO: 1632411 - DNA, 20 bp, Homo sapiens
cactgtatataaacatattt

SEQ ID NO: 1632412 - DNA, 22 bp, Homo sapiens
cactgtatctaaaaaataactg

SEQ ID NO: 1632413 - DNA, 22 bp, Homo sapiens
cactgtatgatttataaacaga

SEQ ID NO: 1632414 - DNA, 23 bp, Homo sapiens
cactgtattagagcgccagctcc

SEQ ID NO: 1632415 - DNA, 14 bp, Homo sapiens
cactgtcactgccg

SEQ ID NO: 1632416 - DNA, 15 bp, Homo sapiens
cactgtcaggaatgg

SEQ ID NO: 1632417 - DNA, 21 bp, Homo sapiens
gggtccgtcttcacactgcgc

SEQ ID NO: 1632418 - DNA, 18 bp, Homo sapiens
gggtcctctagcccactc

SEQ ID NO: 1632419 - DNA, 22 bp, Homo sapiens
gggtcctctagcccactccctg

SEQ ID NO: 1632420 - DNA, 20 bp, Homo sapiens
gggtcctctctgagtcaaat

SEQ ID NO: 1632421 - DNA, 19 bp, Homo sapiens
gggtcctcttctgggcctg

SEQ ID NO: 1632422 - DNA, 18 bp, Homo sapiens
gggtcctggctcctgagg

SEQ ID NO: 1632423 - DNA, 19 bp, Homo sapiens
gggtccttttgacactgct

SEQ ID NO: 1632424 - DNA, 23 bp, Homo sapiens
gggtcggaacccaagcttagaac

SEQ ID NO: 1632425 - DNA, 14 bp, Homo sapiens
gggtcggctgacca

SEQ ID NO: 1632426 - DNA, 15 bp, Homo sapiens
gggtcggctgaccat

SEQ ID NO: 1632427 - DNA, 20 bp, Homo sapiens
gggtcggctgaccatgctca

SEQ ID NO: 1632428 - DNA, 20 bp, Homo sapiens
gggtcgtcaccacctctcct

SEQ ID NO: 1632429 - DNA, 19 bp, Homo sapiens
gggtctccctctcctgcct

SEQ ID NO: 1632430 - DNA, 22 bp, Homo sapiens
gggtctccctggctccctcctc

SEQ ID NO: 1632431 - DNA, 19 bp, Homo sapiens
gggtctcgaactcctggcc

SEQ ID NO: 1632432 - DNA, 19 bp, Homo sapiens
gggtctcgcagcctgaagc

SEQ ID NO: 1632433 - DNA, 21 bp, Homo sapiens
gggtctctcatttttttaatt

SEQ ID NO: 1632434 - DNA, 17 bp, Homo sapiens
gggtctctctccaggtc

SEQ ID NO: 1632435 - DNA, 19 bp, Homo sapiens
gggtctctctccaggtcag

SEQ ID NO: 1632436 - DNA, 23 bp, Homo sapiens
gggtctgaaggaatagccagaga

SEQ ID NO: 1632437 - DNA, 18 bp, Homo sapiens
gggtctgcgcttggtctt

SEQ ID NO: 1632438 - DNA, 19 bp, Homo sapiens
gggtctgctctttctctgc

SEQ ID NO: 1632439 - DNA, 22 bp, Homo sapiens
gggtctgctctttctctgccag

SEQ ID NO: 1632440 - DNA, 22 bp, Homo sapiens
gggtcttgggctactggcagct

SEQ ID NO: 1632441 - DNA, 14 bp, Homo sapiens
gggtgaacagctgg

SEQ ID NO: 1632442 - DNA, 16 bp, Homo sapiens
gggtgaactgcaaagc

SEQ ID NO: 1632443 - DNA, 23 bp, Homo sapiens
gggtgaataataaaagtatatat

SEQ ID NO: 1632444 - DNA, 14 bp, Homo sapiens
gggtgaccaggtcc

SEQ ID NO: 1632445 - DNA, 16 bp, Homo sapiens
gggtgacgcccagctc

SEQ ID NO: 1632446 - DNA, 17 bp, Homo sapiens
gggtgacgcccagctcc

SEQ ID NO: 1632447 - DNA, 13 bp, Homo sapiens
gggtgagagagga

SEQ ID NO: 1632448 - DNA, 23 bp, Homo sapiens
gggtgagcagggtcaagcctctt

SEQ ID NO: 1632449 - DNA, 17 bp, Homo sapiens
gggtgattcctcccagg

SEQ ID NO: 1632450 - DNA, 15 bp, Homo sapiens
gggtgcacccacctg

SEQ ID NO: 1632451 - DNA, 14 bp, Homo sapiens
gggtgcacccactc

SEQ ID NO: 1632452 - DNA, 13 bp, Homo sapiens
gggtgcagccctc

SEQ ID NO: 1632453 - DNA, 17 bp, Homo sapiens
gggtgccaagtcctagc

SEQ ID NO: 1632454 - DNA, 21 bp, Homo sapiens
gggtgccccccttgccagaca

SEQ ID NO: 1632455 - DNA, 18 bp, Homo sapiens
gggtgcccgtatccagag

SEQ ID NO: 1632456 - DNA, 15 bp, Homo sapiens
gggtgccctctcagg

SEQ ID NO: 1632457 - DNA, 21 bp, Homo sapiens
gggtgccgctctctctgaggg

SEQ ID NO: 1632458 - DNA, 16 bp, Homo sapiens
gggtgccgctgtctct

SEQ ID NO: 1632459 - DNA, 21 bp, Homo sapiens
gggtgccgctttctctgaggg

SEQ ID NO: 1632460 - DNA, 12 bp, Homo sapiens
gggtgctgctct

SEQ ID NO: 1632461 - DNA, 17 bp, Homo sapiens
gggtgctggcccccagg

SEQ ID NO: 1632462 - DNA, 14 bp, Homo sapiens
gggtgctgtggaca

SEQ ID NO: 1632463 - DNA, 21 bp, Homo sapiens
gggtgcttttatagaggctag

SEQ ID NO: 1632464 - DNA, 17 bp, Homo sapiens
gggtggaagtgcccagc

SEQ ID NO: 1632465 - DNA, 18 bp, Homo sapiens
gggtggaagtgcccagcc

SEQ ID NO: 1632466 - DNA, 14 bp, Homo sapiens
gggtggagaagtgt

SEQ ID NO: 1632467 - DNA, 13 bp, Homo sapiens
gggtggagtcagg

SEQ ID NO: 1632468 - DNA, 17 bp, Homo sapiens
gggtggcacctcctgag

SEQ ID NO: 1632469 - DNA, 16 bp, Homo sapiens
gggtggcaggtcactg

SEQ ID NO: 1632470 - DNA, 16 bp, Homo sapiens
gggtggcccagagcct

SEQ ID NO: 1632471 - DNA, 23 bp, Homo sapiens
gggtggcccctgctgtctctctg

SEQ ID NO: 1632472 - DNA, 13 bp, Homo sapiens
gggtggcggtgga

SEQ ID NO: 1632473 - DNA, 19 bp, Homo sapiens
gggtggctttaattgtata

SEQ ID NO: 1632474 - DNA, 11 bp, Homo sapiens
gggtgggaaga

SEQ ID NO: 1632475 - DNA, 16 bp, Homo sapiens
gggtgggaagaaagaa

SEQ ID NO: 1632476 - DNA, 20 bp, Homo sapiens
gggtgggattttttcccttt

SEQ ID NO: 1632477 - DNA, 11 bp, Homo sapiens
gggtgggcctc

SEQ ID NO: 1632478 - DNA, 13 bp, Homo sapiens
gggtgggcctcgg

SEQ ID NO: 1632479 - DNA, 13 bp, Homo sapiens
gggtgggcctggc

SEQ ID NO: 1632480 - DNA, 14 bp, Homo sapiens
gggtgggcctggcc

SEQ ID NO: 1632481 - DNA, 15 bp, Homo sapiens
gggtgggcctggcct

SEQ ID NO: 1632482 - DNA, 20 bp, Homo sapiens
gggtgggcctggcctgagct

SEQ ID NO: 1632483 - DNA, 11 bp, Homo sapiens
gggtggggagc

SEQ ID NO: 1632484 - DNA, 12 bp, Homo sapiens
gggtggggctgc

SEQ ID NO: 1632485 - DNA, 10 bp, Homo sapiens
gggtgggggt

SEQ ID NO: 1632486 - DNA, 16 bp, Homo sapiens
gggtggggtagggctg

SEQ ID NO: 1632487 - DNA, 12 bp, Homo sapiens
gggtggggtgga

SEQ ID NO: 1632488 - DNA, 14 bp, Homo sapiens
gggtggtggacagg

SEQ ID NO: 1632489 - DNA, 12 bp, Homo sapiens
gggtggtgggga

SEQ ID NO: 1632490 - DNA, 13 bp, Homo sapiens
gggtggtgtcaga

SEQ ID NO: 1632491 - DNA, 16 bp, Homo sapiens
gggtgtaacttcctgc

SEQ ID NO: 1632492 - DNA, 22 bp, Homo sapiens
gggtgtaacttcctgctgcacc

SEQ ID NO: 1632493 - DNA, 19 bp, Homo sapiens
gggtgtaggggccacctcc

SEQ ID NO: 1632494 - DNA, 22 bp, Homo sapiens
gggtgtatagtgttcacaaact

SEQ ID NO: 1632495 - DNA, 19 bp, Homo sapiens
gggtgtccccgctgctgtg

SEQ ID NO: 1632496 - DNA, 22 bp, Homo sapiens
gggtgtcctgcctgtctgcccc

SEQ ID NO: 1632497 - DNA, 21 bp, Homo sapiens
gggtgtcttgggcagagctgg

SEQ ID NO: 1632498 - DNA, 15 bp, Homo sapiens
gggtgtgagtggcat

SEQ ID NO: 1632499 - DNA, 12 bp, Homo sapiens
gggtgtgccctt

SEQ ID NO: 1632500 - DNA, 12 bp, Homo sapiens
gggtgtggccag

SEQ ID NO: 1632501 - DNA, 16 bp, Homo sapiens
gggtgtggggtggggt

SEQ ID NO: 1632502 - DNA, 19 bp, Homo sapiens
gggtgtggtatgagggggt

SEQ ID NO: 1632503 - DNA, 14 bp, Homo sapiens
gggttaaatatttt

SEQ ID NO: 1632504 - DNA, 22 bp, Homo sapiens
gggttaaatattttgctaactg

SEQ ID NO: 1632505 - DNA, 17 bp, Homo sapiens
gggttaacttggtcaga

SEQ ID NO: 1632506 - DNA, 14 bp, Homo sapiens
gggttaaggcctga

SEQ ID NO: 1632507 - DNA, 12 bp, Homo sapiens
gggttacaaact

SEQ ID NO: 1632508 - DNA, 18 bp, Homo sapiens
gggttaggaatctcttca

SEQ ID NO: 1632509 - DNA, 22 bp, Homo sapiens
gggttcacttgccatgcaggaa

SEQ ID NO: 1632510 - DNA, 20 bp, Homo sapiens
gggttcagcccctcctctgc

SEQ ID NO: 1632511 - DNA, 22 bp, Homo sapiens
gggttcagcccctcctctgcca

SEQ ID NO: 1632512 - DNA, 13 bp, Homo sapiens
gggttcaggggac

SEQ ID NO: 1632513 - DNA, 13 bp, Homo sapiens
gggttcatttgtg

SEQ ID NO: 1632514 - DNA, 20 bp, Homo sapiens
gggttccccacacagggcac

SEQ ID NO: 1632515 - DNA, 22 bp, Homo sapiens
gggttccccacacagggcactg

SEQ ID NO: 1632516 - DNA, 14 bp, Homo sapiens
ggtattagaaagtg

SEQ ID NO: 1632517 - DNA, 17 bp, Homo sapiens
ggtattagcaaagcaaa

SEQ ID NO: 1632518 - DNA, 19 bp, Homo sapiens
ggtattccttttgtgtaca

SEQ ID NO: 1632519 - DNA, 21 bp, Homo sapiens
ggtattgcagagaagatttta

SEQ ID NO: 1632520 - DNA, 14 bp, Homo sapiens
ggtatttctccagt

SEQ ID NO: 1632521 - DNA, 22 bp, Homo sapiens
ggtatttttattcatgtgaagt

SEQ ID NO: 1632522 - DNA, 16 bp, Homo sapiens
ggtattttttcctttt

SEQ ID NO: 1632523 - DNA, 14 bp, Homo sapiens
ggtcaaaggaagac

SEQ ID NO: 1632524 - DNA, 16 bp, Homo sapiens
ggtcaaatgctagaaa

SEQ ID NO: 1632525 - DNA, 19 bp, Homo sapiens
ggtcaacatggtgaaaccc

SEQ ID NO: 1632526 - DNA, 18 bp, Homo sapiens
ggtcaacttgacaccact

SEQ ID NO: 1632527 - DNA, 19 bp, Homo sapiens
ggtcaagaaacagccagca

SEQ ID NO: 1632528 - DNA, 14 bp, Homo sapiens
ggtcaagcccagaa

SEQ ID NO: 1632529 - DNA, 14 bp, Homo sapiens
ggtcaataaactta

SEQ ID NO: 1632530 - DNA, 13 bp, Homo sapiens
ggtcacaacttga

SEQ ID NO: 1632531 - DNA, 19 bp, Homo sapiens
ggtcaccagctgctgtgcc

SEQ ID NO: 1632532 - DNA, 21 bp, Homo sapiens
ggtcactcgtggtgaggctga

SEQ ID NO: 1632533 - DNA, 22 bp, Homo sapiens
ggtcactcgtggtgaggctgac

SEQ ID NO: 1632534 - DNA, 18 bp, Homo sapiens
ggtcactctgccctctgc

SEQ ID NO: 1632535 - DNA, 21 bp, Homo sapiens
ggtcactctgccctctgctgc

SEQ ID NO: 1632536 - DNA, 24 bp, Homo sapiens
ggtcactctgccctctgctgctgc

SEQ ID NO: 1632537 - DNA, 21 bp, Homo sapiens
cacttgtgtgtgggctgtgag

SEQ ID NO: 1632538 - DNA, 16 bp, Homo sapiens
cacttgttccagctct

SEQ ID NO: 1632539 - DNA, 17 bp, Homo sapiens
cacttgttccagctctt

SEQ ID NO: 1632540 - DNA, 18 bp, Homo sapiens
cacttgtttgcactgtgt

SEQ ID NO: 1632541 - DNA, 19 bp, Homo sapiens
cactttaatggcctggagg

SEQ ID NO: 1632542 - DNA, 20 bp, Homo sapiens
cactttaattaccaacctgt

SEQ ID NO: 1632543 - DNA, 14 bp, Homo sapiens
cactttacccacct

SEQ ID NO: 1632544 - DNA, 20 bp, Homo sapiens
cactttacctgcaggctcca

SEQ ID NO: 1632545 - DNA, 16 bp, Homo sapiens
cactttagatgctgat

SEQ ID NO: 1632546 - DNA, 18 bp, Homo sapiens
cactttataagtcattgt

SEQ ID NO: 1632547 - DNA, 13 bp, Homo sapiens
cactttattgcta

SEQ ID NO: 1632548 - DNA, 12 bp, Homo sapiens
cactttcacgtg

SEQ ID NO: 1632549 - DNA, 23 bp, Homo sapiens
cactttccactccctgcttagga

SEQ ID NO: 1632550 - DNA, 13 bp, Homo sapiens
cactttccatctc

SEQ ID NO: 1632551 - DNA, 13 bp, Homo sapiens
cactttcccaccc

SEQ ID NO: 1632552 - DNA, 17 bp, Homo sapiens
cactttcccccttcccg

SEQ ID NO: 1632553 - DNA, 18 bp, Homo sapiens
cactttcccttgtgtcaa

SEQ ID NO: 1632554 - DNA, 17 bp, Homo sapiens
cactttctaatgtttct

SEQ ID NO: 1632555 - DNA, 14 bp, Homo sapiens
cactttctggcaaa

SEQ ID NO: 1632556 - DNA, 14 bp, Homo sapiens
cactttgaaaagtt

SEQ ID NO: 1632557 - DNA, 20 bp, Homo sapiens
cactttgaagcaaatacaat

SEQ ID NO: 1632558 - DNA, 15 bp, Homo sapiens
cactttgacacccag

SEQ ID NO: 1632559 - DNA, 20 bp, Homo sapiens
cactttgccatttgcttgta

SEQ ID NO: 1632560 - DNA, 20 bp, Homo sapiens
cactttggaagtttgtgttc

SEQ ID NO: 1632561 - DNA, 16 bp, Homo sapiens
cactttggcttaaagc

SEQ ID NO: 1632562 - DNA, 21 bp, Homo sapiens
cactttggcttctcctgtgac

SEQ ID NO: 1632563 - DNA, 18 bp, Homo sapiens
cactttgtaatttttgct

SEQ ID NO: 1632564 - DNA, 15 bp, Homo sapiens
cactttgtattactt

SEQ ID NO: 1632565 - DNA, 20 bp, Homo sapiens
cactttgtttcgtggggagg

SEQ ID NO: 1632566 - DNA, 15 bp, Homo sapiens
cacttttagaaatgc

SEQ ID NO: 1632567 - DNA, 16 bp, Homo sapiens
cacttttcctccctca

SEQ ID NO: 1632568 - DNA, 14 bp, Homo sapiens
cacttttttaaata

SEQ ID NO: 1632569 - DNA, 21 bp, Homo sapiens
cacttttttgagtggatgatg

SEQ ID NO: 1632570 - DNA, 18 bp, Homo sapiens
cactttttttctttttct

SEQ ID NO: 1632571 - DNA, 15 bp, Homo sapiens
cagaaaaaggcagtg

SEQ ID NO: 1632572 - DNA, 21 bp, Homo sapiens
cagaaaaataacttcaagcaa

SEQ ID NO: 1632573 - DNA, 21 bp, Homo sapiens
cagaaaacaacttggcatttc

SEQ ID NO: 1632574 - DNA, 14 bp, Homo sapiens
cagaaaaccccagc

SEQ ID NO: 1632575 - DNA, 20 bp, Homo sapiens
cagaaaacccttgggccaga

SEQ ID NO: 1632576 - DNA, 22 bp, Homo sapiens
cagaaaacccttgggccagaag

SEQ ID NO: 1632577 - DNA, 22 bp, Homo sapiens
cagaaaacctctcctgacccct

SEQ ID NO: 1632578 - DNA, 19 bp, Homo sapiens
cagaaaagaggagaccctg

SEQ ID NO: 1632579 - DNA, 19 bp, Homo sapiens
cagaaaagcacctgccgac

SEQ ID NO: 1632580 - DNA, 18 bp, Homo sapiens
cagaaaataaaatattca

SEQ ID NO: 1632581 - DNA, 21 bp, Homo sapiens
cagaaaataaggcacccatct

SEQ ID NO: 1632582 - DNA, 20 bp, Homo sapiens
cagaaaatatgtattaacac

SEQ ID NO: 1632583 - DNA, 22 bp, Homo sapiens
cagaaaatatgtattaacacta

SEQ ID NO: 1632584 - DNA, 16 bp, Homo sapiens
cagaaaatatttaata

SEQ ID NO: 1632585 - DNA, 19 bp, Homo sapiens
cagaaacacccctctgtct

SEQ ID NO: 1632586 - DNA, 15 bp, Homo sapiens
cagaaacactgcctt

SEQ ID NO: 1632587 - DNA, 21 bp, Homo sapiens
cagaaacactgcctttttatt

SEQ ID NO: 1632588 - DNA, 18 bp, Homo sapiens
cagaaacaggtgcatctg

SEQ ID NO: 1632589 - DNA, 19 bp, Homo sapiens
cagaaacatcagttactct

SEQ ID NO: 1632590 - DNA, 16 bp, Homo sapiens
cagaaacatctctggc

SEQ ID NO: 1632591 - DNA, 12 bp, Homo sapiens
cagaaacatgaa

SEQ ID NO: 1632592 - DNA, 15 bp, Homo sapiens
cagaaaccagttatg

SEQ ID NO: 1632593 - DNA, 15 bp, Homo sapiens
cagaaaccattctag

SEQ ID NO: 1632594 - DNA, 15 bp, Homo sapiens
cagaaacgtgttaaa

SEQ ID NO: 1632595 - DNA, 20 bp, Homo sapiens
cagaaacgtgttaaaggttt

SEQ ID NO: 1632596 - DNA, 14 bp, Homo sapiens
cagaaactcctgtt

SEQ ID NO: 1632597 - DNA, 23 bp, Homo sapiens
cagaaactcctgtttctccttag

SEQ ID NO: 1632598 - DNA, 20 bp, Homo sapiens
cagaaacttgtgaagtggaa

SEQ ID NO: 1632599 - DNA, 12 bp, Homo sapiens
cagaaagagctc

SEQ ID NO: 1632600 - DNA, 15 bp, Homo sapiens
cagaaagagggacaa

SEQ ID NO: 1632601 - DNA, 21 bp, Homo sapiens
cagaaagagggacaagagggt

SEQ ID NO: 1632602 - DNA, 18 bp, Homo sapiens
cagaaagatacagacatt

SEQ ID NO: 1632603 - DNA, 21 bp, Homo sapiens
cagaaagcactacaatcatgg

SEQ ID NO: 1632604 - DNA, 21 bp, Homo sapiens
cagaaagcaggagcagctgtg

SEQ ID NO: 1632605 - DNA, 22 bp, Homo sapiens
cagaaagcatccctcacccatc

SEQ ID NO: 1632606 - DNA, 11 bp, Homo sapiens
cagaaagcctc

SEQ ID NO: 1632607 - DNA, 20 bp, Homo sapiens
cagaaagcctccgctgggct

SEQ ID NO: 1632608 - DNA, 17 bp, Homo sapiens
cagaaagcctctctctc

SEQ ID NO: 1632609 - DNA, 19 bp, Homo sapiens
cagaaagcctctctctccc

SEQ ID NO: 1632610 - DNA, 14 bp, Homo sapiens
cagaaagctgcctg

SEQ ID NO: 1632611 - DNA, 12 bp, Homo sapiens
cagaaaggagac

SEQ ID NO: 1632612 - DNA, 16 bp, Homo sapiens
cagaaaggatatttaa

SEQ ID NO: 1632613 - DNA, 12 bp, Homo sapiens
cagaaaggattt

SEQ ID NO: 1632614 - DNA, 19 bp, Homo sapiens
cagaaaggtctctggaggg

SEQ ID NO: 1632615 - DNA, 14 bp, Homo sapiens
cagaaagtgcctga

SEQ ID NO: 1632616 - DNA, 15 bp, Homo sapiens
cagaaagtgcctgac

SEQ ID NO: 1632617 - DNA, 19 bp, Homo sapiens
cagaaagtgcctgacacac

SEQ ID NO: 1632618 - DNA, 22 bp, Homo sapiens
cagaaagtggccatgccaccct

SEQ ID NO: 1632619 - DNA, 11 bp, Homo sapiens
cagaaagttat

SEQ ID NO: 1632620 - DNA, 16 bp, Homo sapiens
cagaaagttattgata

SEQ ID NO: 1632621 - DNA, 21 bp, Homo sapiens
cagaaagttggaaaggaaaaa

SEQ ID NO: 1632622 - DNA, 23 bp, Homo sapiens
cagaaagttggaaaggaaaaaag

SEQ ID NO: 1632623 - DNA, 23 bp, Homo sapiens
cagaaataaaatttgataaacat

SEQ ID NO: 1632624 - DNA, 20 bp, Homo sapiens
cagaaataaagttggtgaca

SEQ ID NO: 1632625 - DNA, 20 bp, Homo sapiens
cagaaataatctgacactac

SEQ ID NO: 1632626 - DNA, 11 bp, Homo sapiens
cagaaatacaa

SEQ ID NO: 1632627 - DNA, 14 bp, Homo sapiens
cagaaatacaattt

SEQ ID NO: 1632628 - DNA, 17 bp, Homo sapiens
cagaaatactgctctga

SEQ ID NO: 1632629 - DNA, 14 bp, Homo sapiens
cagaaatagacaaa

SEQ ID NO: 1632630 - DNA, 21 bp, Homo sapiens
ggtcctcagagaatttctacc

SEQ ID NO: 1632631 - DNA, 23 bp, Homo sapiens
ggtcctccatcccaacagccatg

SEQ ID NO: 1632632 - DNA, 16 bp, Homo sapiens
ggtcctccctcccaag

SEQ ID NO: 1632633 - DNA, 21 bp, Homo sapiens
ggtcctcctatctccctggct

SEQ ID NO: 1632634 - DNA, 21 bp, Homo sapiens
ggtcctctcagttctctccct

SEQ ID NO: 1632635 - DNA, 22 bp, Homo sapiens
ggtcctctctgagtcaaatcca

SEQ ID NO: 1632636 - DNA, 18 bp, Homo sapiens
ggtcctgaagaattaaga

SEQ ID NO: 1632637 - DNA, 11 bp, Homo sapiens
ggtcctgcagg

SEQ ID NO: 1632638 - DNA, 16 bp, Homo sapiens
ggtcctgctccgctgc

SEQ ID NO: 1632639 - DNA, 18 bp, Homo sapiens
ggtcctgctccgctgcct

SEQ ID NO: 1632640 - DNA, 22 bp, Homo sapiens
ggtcctgctccgctgcctggaa

SEQ ID NO: 1632641 - DNA, 17 bp, Homo sapiens
ggtcctggagcagacca

SEQ ID NO: 1632642 - DNA, 15 bp, Homo sapiens
ggtcctggctgcact

SEQ ID NO: 1632643 - DNA, 23 bp, Homo sapiens
ggtcctgggcaggtgggagctga

SEQ ID NO: 1632644 - DNA, 14 bp, Homo sapiens
ggtcctggggcctc

SEQ ID NO: 1632645 - DNA, 15 bp, Homo sapiens
ggtcctgtccccgca

SEQ ID NO: 1632646 - DNA, 22 bp, Homo sapiens
ggtcctgttaacgtcatctcag

SEQ ID NO: 1632647 - DNA, 22 bp, Homo sapiens
ggtccttcctttaggtctggtt

SEQ ID NO: 1632648 - DNA, 17 bp, Homo sapiens
ggtccttgatgccagag

SEQ ID NO: 1632649 - DNA, 22 bp, Homo sapiens
ggtccttgatgccagagggcca

SEQ ID NO: 1632650 - DNA, 22 bp, Homo sapiens
ggtcctttacactcaggctttc

SEQ ID NO: 1632651 - DNA, 13 bp, Homo sapiens
ggtcctttagaaa

SEQ ID NO: 1632652 - DNA, 18 bp, Homo sapiens
ggtccttttgacactgct

SEQ ID NO: 1632653 - DNA, 18 bp, Homo sapiens
ggtcgcagctaccctcag

SEQ ID NO: 1632654 - DNA, 21 bp, Homo sapiens
ggtcgcagctaccctcagcct

SEQ ID NO: 1632655 - DNA, 12 bp, Homo sapiens
cagaacagccgc

SEQ ID NO: 1632656 - DNA, 17 bp, Homo sapiens
cagaacagccgctcctg

SEQ ID NO: 1632657 - DNA, 20 bp, Homo sapiens
cagaacagccgctcctgtct

SEQ ID NO: 1632658 - DNA, 12 bp, Homo sapiens
cagaacagctga

SEQ ID NO: 1632659 - DNA, 20 bp, Homo sapiens
cagaacatacactgtgaact

SEQ ID NO: 1632660 - DNA, 15 bp, Homo sapiens
cagaacatactgatt

SEQ ID NO: 1632661 - DNA, 21 bp, Homo sapiens
cagaacattcagctctggaga

SEQ ID NO: 1632662 - DNA, 23 bp, Homo sapiens
cagaacattcagctctggagaac

SEQ ID NO: 1632663 - DNA, 15 bp, Homo sapiens
cagaaccaaatcttt

SEQ ID NO: 1632664 - DNA, 23 bp, Homo sapiens
cagaacccacataaaagccccag

SEQ ID NO: 1632665 - DNA, 16 bp, Homo sapiens
cagaacccccaggtgg

SEQ ID NO: 1632666 - DNA, 17 bp, Homo sapiens
cagaaccctatccagtg

SEQ ID NO: 1632667 - DNA, 12 bp, Homo sapiens
cagaacctcttc

SEQ ID NO: 1632668 - DNA, 13 bp, Homo sapiens
cagaacctgcaca

SEQ ID NO: 1632669 - DNA, 17 bp, Homo sapiens
cagaacctgcacacagg

SEQ ID NO: 1632670 - DNA, 19 bp, Homo sapiens
cagaacctgcacacaggac

SEQ ID NO: 1632671 - DNA, 14 bp, Homo sapiens
cagaacctgtcctt

SEQ ID NO: 1632672 - DNA, 13 bp, Homo sapiens
cagaactacttct

SEQ ID NO: 1632673 - DNA, 18 bp, Homo sapiens
cagaactcactggggcct

SEQ ID NO: 1632674 - DNA, 16 bp, Homo sapiens
cagaactcctgtgtgt

SEQ ID NO: 1632675 - DNA, 13 bp, Homo sapiens
cagaactggactc

SEQ ID NO: 1632676 - DNA, 18 bp, Homo sapiens
cagaactgttggctgctc

SEQ ID NO: 1632677 - DNA, 17 bp, Homo sapiens
cagaacttcacagtgac

SEQ ID NO: 1632678 - DNA, 19 bp, Homo sapiens
cagaacttcagaaagactt

SEQ ID NO: 1632679 - DNA, 16 bp, Homo sapiens
cagaacttgaatgtgt

SEQ ID NO: 1632680 - DNA, 14 bp, Homo sapiens
cagaacttgctgct

SEQ ID NO: 1632681 - DNA, 18 bp, Homo sapiens
cagaacttgctgctgtct

SEQ ID NO: 1632682 - DNA, 18 bp, Homo sapiens
cagaagaagagaagctgc

SEQ ID NO: 1632683 - DNA, 19 bp, Homo sapiens
cagaagaagagaagctgct

SEQ ID NO: 1632684 - DNA, 15 bp, Homo sapiens
cagaagaatattcag

SEQ ID NO: 1632685 - DNA, 19 bp, Homo sapiens
cagaagaattgaacccagg

SEQ ID NO: 1632686 - DNA, 20 bp, Homo sapiens
cagaagaattgaacccagga

SEQ ID NO: 1632687 - DNA, 21 bp, Homo sapiens
cagaagagagtggggcctgcc

SEQ ID NO: 1632688 - DNA, 21 bp, Homo sapiens
cagaagagatgggcttgtttt

SEQ ID NO: 1632689 - DNA, 21 bp, Homo sapiens
cagaagagcttgtcagcaaga

SEQ ID NO: 1632690 - DNA, 19 bp, Homo sapiens
cagaagaggttgggcttcc

SEQ ID NO: 1632691 - DNA, 17 bp, Homo sapiens
cagaagatgccagcttc

SEQ ID NO: 1632692 - DNA, 22 bp, Homo sapiens
cagaagcaagggggtgatgtag

SEQ ID NO: 1632693 - DNA, 22 bp, Homo sapiens
cagaagcatattttgctggttt

SEQ ID NO: 1632694 - DNA, 18 bp, Homo sapiens
cagaagcattgcctggac

SEQ ID NO: 1632695 - DNA, 21 bp, Homo sapiens
cagaagcattgcctggactga

SEQ ID NO: 1632696 - DNA, 23 bp, Homo sapiens
cagaagccaatctacaatctctt

SEQ ID NO: 1632697 - DNA, 21 bp, Homo sapiens
cagaagcctccaagcctgcct

SEQ ID NO: 1632698 - DNA, 19 bp, Homo sapiens
cagaagcctctggctagag

SEQ ID NO: 1632699 - DNA, 19 bp, Homo sapiens
cagaagcctgaggctggga

SEQ ID NO: 1632700 - DNA, 15 bp, Homo sapiens
cagaagctctcgatg

SEQ ID NO: 1632701 - DNA, 20 bp, Homo sapiens
cagaagctcttactctttcc

SEQ ID NO: 1632702 - DNA, 12 bp, Homo sapiens
cagaagctgctc

SEQ ID NO: 1632703 - DNA, 16 bp, Homo sapiens
cagaagcttctgccca

SEQ ID NO: 1632704 - DNA, 18 bp, Homo sapiens
cagaaggaatctgtgcag

SEQ ID NO: 1632705 - DNA, 21 bp, Homo sapiens
cagaaggaatggtgcgtggct

SEQ ID NO: 1632706 - DNA, 18 bp, Homo sapiens
cagaaggagaaggaagga

SEQ ID NO: 1632707 - DNA, 13 bp, Homo sapiens
cagaaggagggca

SEQ ID NO: 1632708 - DNA, 17 bp, Homo sapiens
cagaaggatcttcatct

SEQ ID NO: 1632709 - DNA, 13 bp, Homo sapiens
cagaaggcaggga

SEQ ID NO: 1632710 - DNA, 14 bp, Homo sapiens
cagaaggccaagag

SEQ ID NO: 1632711 - DNA, 14 bp, Homo sapiens
cagaaggccagccg

SEQ ID NO: 1632712 - DNA, 17 bp, Homo sapiens
cagaaggccccagagag

SEQ ID NO: 1632713 - DNA, 20 bp, Homo sapiens
cagaaggccccagagagacc

SEQ ID NO: 1632714 - DNA, 14 bp, Homo sapiens
cagaaggtaggggc

SEQ ID NO: 1632715 - DNA, 15 bp, Homo sapiens
cagaaggtctgtttt

SEQ ID NO: 1632716 - DNA, 15 bp, Homo sapiens
cagaagtaccagact

SEQ ID NO: 1632717 - DNA, 20 bp, Homo sapiens
cagaagtcatcttgctacca

SEQ ID NO: 1632718 - DNA, 22 bp, Homo sapiens
cagaagtcatcttgctaccagt

SEQ ID NO: 1632719 - DNA, 18 bp, Homo sapiens
cagaagtcatgaagccca

SEQ ID NO: 1632720 - DNA, 20 bp, Homo sapiens
cagaagtcctccctcctgca

SEQ ID NO: 1632721 - DNA, 22 bp, Homo sapiens
cagaagtcctccctcctgcagg

SEQ ID NO: 1632722 - DNA, 17 bp, Homo sapiens
cagaagtgagctttgct

SEQ ID NO: 1632723 - DNA, 18 bp, Homo sapiens
cagaagtgagctttgctg

SEQ ID NO: 1632724 - DNA, 20 bp, Homo sapiens
cagaagtgagctttgctgct

SEQ ID NO: 1632725 - DNA, 18 bp, Homo sapiens
cagaagttagtttgtata

SEQ ID NO: 1632726 - DNA, 22 bp, Homo sapiens
cagaataaagttctgagtgttt

SEQ ID NO: 1632727 - DNA, 23 bp, Homo sapiens
cagaataatgaatggactcaaac

SEQ ID NO: 1632728 - DNA, 16 bp, Homo sapiens
cagaatacggaagagc

SEQ ID NO: 1632729 - DNA, 17 bp, Homo sapiens
cagaatacggaagagca

SEQ ID NO: 1632730 - DNA, 21 bp, Homo sapiens
cagaatactgggttcttagtt

SEQ ID NO: 1632731 - DNA, 14 bp, Homo sapiens
cagaatactggtct

SEQ ID NO: 1632732 - DNA, 19 bp, Homo sapiens
cagaatacttgactcattt

SEQ ID NO: 1632733 - DNA, 16 bp, Homo sapiens
cagaataggaaaacat

SEQ ID NO: 1632734 - DNA, 12 bp, Homo sapiens
cagaatatgttt

SEQ ID NO: 1632735 - DNA, 13 bp, Homo sapiens
cagaatatgtttc

SEQ ID NO: 1632736 - DNA, 22 bp, Homo sapiens
cagaatattgctaggttttgct

SEQ ID NO: 1632737 - DNA, 17 bp, Homo sapiens
cagaatatttctattga

SEQ ID NO: 1632738 - DNA, 13 bp, Homo sapiens
cagaatattttta

SEQ ID NO: 1632739 - DNA, 17 bp, Homo sapiens
cagaatccataaatgtg

SEQ ID NO: 1632740 - DNA, 18 bp, Homo sapiens
cagaatcccttaacagtt

SEQ ID NO: 1632741 - DNA, 16 bp, Homo sapiens
cagaatctaaacgtgg

SEQ ID NO: 1632742 - DNA, 20 bp, Homo sapiens
cagaatctaaacgtggtcac

SEQ ID NO: 1632743 - DNA, 23 bp, Homo sapiens
cagaatctaaacgtggtcacctt

SEQ ID NO: 1632744 - DNA, 18 bp, Homo sapiens
ggtgatgtttccagctgc

SEQ ID NO: 1632745 - DNA, 22 bp, Homo sapiens
ggtgatgtttccagctgccaag

SEQ ID NO: 1632746 - DNA, 14 bp, Homo sapiens
ggtgattcaccaaa

SEQ ID NO: 1632747 - DNA, 15 bp, Homo sapiens
ggtgcaaattcattt

SEQ ID NO: 1632748 - DNA, 16 bp, Homo sapiens
ggtgcaacccttaccc

SEQ ID NO: 1632749 - DNA, 13 bp, Homo sapiens
ggtgcaatttcaa

SEQ ID NO: 1632750 - DNA, 23 bp, Homo sapiens
ggtgcacaggcctctgcctgctg

SEQ ID NO: 1632751 - DNA, 15 bp, Homo sapiens
ggtgcacccacctgt

SEQ ID NO: 1632752 - DNA, 19 bp, Homo sapiens
ggtgcacccactcaccagg

SEQ ID NO: 1632753 - DNA, 20 bp, Homo sapiens
ggtgcacgcaggcacagcag

SEQ ID NO: 1632754 - DNA, 22 bp, Homo sapiens
ggtgcagaggtaccctgggtgt

SEQ ID NO: 1632755 - DNA, 18 bp, Homo sapiens
ggtgcatgccgggaccat

SEQ ID NO: 1632756 - DNA, 15 bp, Homo sapiens
ggtgcattgctgtgt

SEQ ID NO: 1632757 - DNA, 17 bp, Homo sapiens
ggtgcattgctgtgtga

SEQ ID NO: 1632758 - DNA, 17 bp, Homo sapiens
ggtgccaccaccctgcc

SEQ ID NO: 1632759 - DNA, 21 bp, Homo sapiens
ggtgccaccaccctgcccccc

SEQ ID NO: 1632760 - DNA, 16 bp, Homo sapiens
ggtgccactccctgag

SEQ ID NO: 1632761 - DNA, 18 bp, Homo sapiens
ggtgccactccctgagct

SEQ ID NO: 1632762 - DNA, 16 bp, Homo sapiens
ggtgccactttaccca

SEQ ID NO: 1632763 - DNA, 19 bp, Homo sapiens
ggtgccactttacccacct

SEQ ID NO: 1632764 - DNA, 15 bp, Homo sapiens
ggtgccagccttcct

SEQ ID NO: 1632765 - DNA, 18 bp, Homo sapiens
ggtgccatgcctgctccc

SEQ ID NO: 1632766 - DNA, 19 bp, Homo sapiens
ggtgccatgcctgctccct

SEQ ID NO: 1632767 - DNA, 22 bp, Homo sapiens
ggtgccatgcctgctccctgtc

SEQ ID NO: 1632768 - DNA, 22 bp, Homo sapiens
ggtgccatttctgaactgttac

SEQ ID NO: 1632769 - DNA, 18 bp, Homo sapiens
ggtgcccaagccagaggc

SEQ ID NO: 1632770 - DNA, 22 bp, Homo sapiens
ggtgcccaagccagaggctggg

SEQ ID NO: 1632771 - DNA, 12 bp, Homo sapiens
ggtgcccagggc

SEQ ID NO: 1632772 - DNA, 17 bp, Homo sapiens
cagaattttaatgtgaa

SEQ ID NO: 1632773 - DNA, 23 bp, Homo sapiens
cagaattttaatgtgaagacatt

SEQ ID NO: 1632774 - DNA, 21 bp, Homo sapiens
cagaattttaggaacttcaga

SEQ ID NO: 1632775 - DNA, 19 bp, Homo sapiens
cagacaaaaacagcctcac

SEQ ID NO: 1632776 - DNA, 17 bp, Homo sapiens
cagacaaaatttgagaa

SEQ ID NO: 1632777 - DNA, 14 bp, Homo sapiens
cagacaaagccctg

SEQ ID NO: 1632778 - DNA, 15 bp, Homo sapiens
cagacaaagccctgt

SEQ ID NO: 1632779 - DNA, 16 bp, Homo sapiens
cagacaaagccctgtc

SEQ ID NO: 1632780 - DNA, 22 bp, Homo sapiens
cagacaaatgtggttacacact

SEQ ID NO: 1632781 - DNA, 22 bp, Homo sapiens
cagacaacagaagtcatgaagc

SEQ ID NO: 1632782 - DNA, 11 bp, Homo sapiens
cagacaacatt

SEQ ID NO: 1632783 - DNA, 18 bp, Homo sapiens
cagacaacattatgatct

SEQ ID NO: 1632784 - DNA, 17 bp, Homo sapiens
cagacaagagctgctgt

SEQ ID NO: 1632785 - DNA, 18 bp, Homo sapiens
cagacaagagctgctgtc

SEQ ID NO: 1632786 - DNA, 17 bp, Homo sapiens
cagacaagcactatttt

SEQ ID NO: 1632787 - DNA, 15 bp, Homo sapiens
cagacaaggttctgc

SEQ ID NO: 1632788 - DNA, 15 bp, Homo sapiens
cagacaattccattc

SEQ ID NO: 1632789 - DNA, 12 bp, Homo sapiens
cagacacacaca

SEQ ID NO: 1632790 - DNA, 14 bp, Homo sapiens
cagacacacacaca

SEQ ID NO: 1632791 - DNA, 16 bp, Homo sapiens
cagacacacacacgca

SEQ ID NO: 1632792 - DNA, 21 bp, Homo sapiens
cagacacacacacgcacgcac

SEQ ID NO: 1632793 - DNA, 23 bp, Homo sapiens
cagacacaccgcggccaggcacc

SEQ ID NO: 1632794 - DNA, 23 bp, Homo sapiens
cagacaccgtttgtcccccgggg

SEQ ID NO: 1632795 - DNA, 22 bp, Homo sapiens
cagacacctgttcacagaaaaa

SEQ ID NO: 1632796 - DNA, 19 bp, Homo sapiens
cagacacgctcgcgggcag

SEQ ID NO: 1632797 - DNA, 20 bp, Homo sapiens
cagacacgctcgcgggcagc

SEQ ID NO: 1632798 - DNA, 18 bp, Homo sapiens
cagacactaagttatagt

SEQ ID NO: 1632799 - DNA, 21 bp, Homo sapiens
cagacactaagttatagtata

SEQ ID NO: 1632800 - DNA, 19 bp, Homo sapiens
cagacactacatatctaaa

SEQ ID NO: 1632801 - DNA, 14 bp, Homo sapiens
cagacactctgctc

SEQ ID NO: 1632802 - DNA, 22 bp, Homo sapiens
cagacacttcatggaccaagaa

SEQ ID NO: 1632803 - DNA, 15 bp, Homo sapiens
cagacactttggaag

SEQ ID NO: 1632804 - DNA, 19 bp, Homo sapiens
cagacactttggaagtttg

SEQ ID NO: 1632805 - DNA, 14 bp, Homo sapiens
cagacagacacaca

SEQ ID NO: 1632806 - DNA, 15 bp, Homo sapiens
cagacagacacacac

SEQ ID NO: 1632807 - DNA, 16 bp, Homo sapiens
cagacagacacacaca

SEQ ID NO: 1632808 - DNA, 14 bp, Homo sapiens
cagacagagccagg

SEQ ID NO: 1632809 - DNA, 17 bp, Homo sapiens
cagacagagccaggaga

SEQ ID NO: 1632810 - DNA, 13 bp, Homo sapiens
cagacagcagctc

SEQ ID NO: 1632811 - DNA, 16 bp, Homo sapiens
cagacagcagctcagg

SEQ ID NO: 1632812 - DNA, 19 bp, Homo sapiens
cagacagcagctcaggcac

SEQ ID NO: 1632813 - DNA, 13 bp, Homo sapiens
cagacagcttgac

SEQ ID NO: 1632814 - DNA, 14 bp, Homo sapiens
cagacagcttgact

SEQ ID NO: 1632815 - DNA, 20 bp, Homo sapiens
cagacaggccatgtgagcca

SEQ ID NO: 1632816 - DNA, 21 bp, Homo sapiens
cagacaggccatgtgagccac

SEQ ID NO: 1632817 - DNA, 22 bp, Homo sapiens
cagacaggctcttagcagcttc

SEQ ID NO: 1632818 - DNA, 22 bp, Homo sapiens
cagacatagaagagccaagagt

SEQ ID NO: 1632819 - DNA, 17 bp, Homo sapiens
cagacatccaaactaaa

SEQ ID NO: 1632820 - DNA, 22 bp, Homo sapiens
cagacatccaaactaaaaggaa

SEQ ID NO: 1632821 - DNA, 16 bp, Homo sapiens
cagacatggtgtctca

SEQ ID NO: 1632822 - DNA, 19 bp, Homo sapiens
cagacatggtgtctcacac

SEQ ID NO: 1632823 - DNA, 22 bp, Homo sapiens
cagacatgtggtgggacaggga

SEQ ID NO: 1632824 - DNA, 18 bp, Homo sapiens
cagacattcaatgaatta

SEQ ID NO: 1632825 - DNA, 14 bp, Homo sapiens
cagacattggcacc

SEQ ID NO: 1632826 - DNA, 21 bp, Homo sapiens
cagacattttcactggaagat

SEQ ID NO: 1632827 - DNA, 20 bp, Homo sapiens
cagacattttgtgtgagact

SEQ ID NO: 1632828 - DNA, 19 bp, Homo sapiens
cagaccaataaatttgtaa

SEQ ID NO: 1632829 - DNA, 20 bp, Homo sapiens
cagaccacatctttatctgt

SEQ ID NO: 1632830 - DNA, 22 bp, Homo sapiens
cagaccaccccgcctgccctca

SEQ ID NO: 1632831 - DNA, 13 bp, Homo sapiens
cagaccacttgcc

SEQ ID NO: 1632832 - DNA, 17 bp, Homo sapiens
cagaccacttgccacgc

SEQ ID NO: 1632833 - DNA, 18 bp, Homo sapiens
cagaccacttgccacgct

SEQ ID NO: 1632834 - DNA, 17 bp, Homo sapiens
cagaccaggaaaggctt

SEQ ID NO: 1632835 - DNA, 20 bp, Homo sapiens
cagaccaggaaaggcttggc

SEQ ID NO: 1632836 - DNA, 16 bp, Homo sapiens
cagaccataatgttac

SEQ ID NO: 1632837 - DNA, 23 bp, Homo sapiens
cagaccatgaagtaaattatgta

SEQ ID NO: 1632838 - DNA, 23 bp, Homo sapiens
cagacccactcccaaagctcaga

SEQ ID NO: 1632839 - DNA, 12 bp, Homo sapiens
cagacccagaga

SEQ ID NO: 1632840 - DNA, 12 bp, Homo sapiens
cagaccccagcg

SEQ ID NO: 1632841 - DNA, 14 bp, Homo sapiens
cagaccccagcggc

SEQ ID NO: 1632842 - DNA, 16 bp, Homo sapiens
cagaccccagcggctg

SEQ ID NO: 1632843 - DNA, 13 bp, Homo sapiens
cagacccctctgg

SEQ ID NO: 1632844 - DNA, 16 bp, Homo sapiens
cagacccctctggcca

SEQ ID NO: 1632845 - DNA, 22 bp, Homo sapiens
cagacccctggcttttcactgc

SEQ ID NO: 1632846 - DNA, 13 bp, Homo sapiens
cagacccctggga

SEQ ID NO: 1632847 - DNA, 17 bp, Homo sapiens
cagacccctgggagctt

SEQ ID NO: 1632848 - DNA, 20 bp, Homo sapiens
cagacccctgggagcttccg

SEQ ID NO: 1632849 - DNA, 16 bp, Homo sapiens
cagaccccttcagcca

SEQ ID NO: 1632850 - DNA, 15 bp, Homo sapiens
cagaccctaccccac

SEQ ID NO: 1632851 - DNA, 14 bp, Homo sapiens
cagaccctctgccg

SEQ ID NO: 1632852 - DNA, 12 bp, Homo sapiens
cagaccctgcct

SEQ ID NO: 1632853 - DNA, 11 bp, Homo sapiens
cagaccctgga

SEQ ID NO: 1632854 - DNA, 13 bp, Homo sapiens
cagaccctggagg

SEQ ID NO: 1632855 - DNA, 19 bp, Homo sapiens
cagaccctggaggccccaa

SEQ ID NO: 1632856 - DNA, 22 bp, Homo sapiens
cagaccctggaggccccaaccc

SEQ ID NO: 1632857 - DNA, 15 bp, Homo sapiens
cagacctaagccctg

SEQ ID NO: 1632858 - DNA, 16 bp, Homo sapiens
ggttaatatgtctttt

SEQ ID NO: 1632859 - DNA, 21 bp, Homo sapiens
ggttaatttttcctgcatgtt

SEQ ID NO: 1632860 - DNA, 16 bp, Homo sapiens
ggttacagagacctat

SEQ ID NO: 1632861 - DNA, 19 bp, Homo sapiens
ggttacaggaaggcaggag

SEQ ID NO: 1632862 - DNA, 15 bp, Homo sapiens
ggttacttcttctct

SEQ ID NO: 1632863 - DNA, 14 bp, Homo sapiens
ggttagaaaggcag

SEQ ID NO: 1632864 - DNA, 14 bp, Homo sapiens
ggttagatatagag

SEQ ID NO: 1632865 - DNA, 13 bp, Homo sapiens
ggttagggagggg

SEQ ID NO: 1632866 - DNA, 21 bp, Homo sapiens
ggttaggggttcattctcccg

SEQ ID NO: 1632867 - DNA, 22 bp, Homo sapiens
ggttatagccctgccctcccaa

SEQ ID NO: 1632868 - DNA, 14 bp, Homo sapiens
ggttatctctgtgt

SEQ ID NO: 1632869 - DNA, 14 bp, Homo sapiens
ggttatctgcctgg

SEQ ID NO: 1632870 - DNA, 18 bp, Homo sapiens
ggttatctgcctggcctg

SEQ ID NO: 1632871 - DNA, 23 bp, Homo sapiens
ggttatctgcctggcctggctcc

SEQ ID NO: 1632872 - DNA, 13 bp, Homo sapiens
ggttatgatgtca

SEQ ID NO: 1632873 - DNA, 15 bp, Homo sapiens
ggttatgtcagcagc

SEQ ID NO: 1632874 - DNA, 19 bp, Homo sapiens
ggttattttaaatataaat

SEQ ID NO: 1632875 - DNA, 14 bp, Homo sapiens
ggttcaagcccagg

SEQ ID NO: 1632876 - DNA, 15 bp, Homo sapiens
ggttcaagcccaggc

SEQ ID NO: 1632877 - DNA, 19 bp, Homo sapiens
ggttcacacagcccagttc

SEQ ID NO: 1632878 - DNA, 12 bp, Homo sapiens
ggttcaccagcc

SEQ ID NO: 1632879 - DNA, 14 bp, Homo sapiens
ggttcaccagcctc

SEQ ID NO: 1632880 - DNA, 20 bp, Homo sapiens
ggttcaccatgttgcccagg

SEQ ID NO: 1632881 - DNA, 15 bp, Homo sapiens
ggttcacctgtgact

SEQ ID NO: 1632882 - DNA, 15 bp, Homo sapiens
ggttcactaaagcag

SEQ ID NO: 1632883 - DNA, 22 bp, Homo sapiens
ggttcacttgccatgcaggaag

SEQ ID NO: 1632884 - DNA, 18 bp, Homo sapiens
ggttcagaaatgctgcct

SEQ ID NO: 1632885 - DNA, 18 bp, Homo sapiens
ggttcagaattaaacttt

SEQ ID NO: 1632886 - DNA, 17 bp, Homo sapiens
ggttcagacccctgcct

SEQ ID NO: 1632887 - DNA, 16 bp, Homo sapiens
ggttcagcccctcctc

SEQ ID NO: 1632888 - DNA, 17 bp, Homo sapiens
ggttcagcccctcctct

SEQ ID NO: 1632889 - DNA, 20 bp, Homo sapiens
ggttcagcccctcctctgcc

SEQ ID NO: 1632890 - DNA, 22 bp, Homo sapiens
ggttcagcccctcctctgccac

SEQ ID NO: 1632891 - DNA, 14 bp, Homo sapiens
ggttcatcagtgtt

SEQ ID NO: 1632892 - DNA, 15 bp, Homo sapiens
ggttcatcagtgtta

SEQ ID NO: 1632893 - DNA, 23 bp, Homo sapiens
ggttccaaattatcctggtcttt

SEQ ID NO: 1632894 - DNA, 22 bp, Homo sapiens
ggttccagaacagccctcggcc

SEQ ID NO: 1632895 - DNA, 23 bp, Homo sapiens
ggctgccccaggccggagcccag

SEQ ID NO: 1632896 - DNA, 23 bp, Homo sapiens
ggctgcccctaatctctgtagga

SEQ ID NO: 1632897 - DNA, 13 bp, Homo sapiens
ggctgcccctctc

SEQ ID NO: 1632898 - DNA, 15 bp, Homo sapiens
ggctgcccctctcac

SEQ ID NO: 1632899 - DNA, 12 bp, Homo sapiens
ggctgccctgcc

SEQ ID NO: 1632900 - DNA, 11 bp, Homo sapiens
ggctgccctgg

SEQ ID NO: 1632901 - DNA, 12 bp, Homo sapiens
ggctgccctggc

SEQ ID NO: 1632902 - DNA, 14 bp, Homo sapiens
ggctgccctggccc

SEQ ID NO: 1632903 - DNA, 16 bp, Homo sapiens
ggctgccctggccctg

SEQ ID NO: 1632904 - DNA, 17 bp, Homo sapiens
ggctgccctggccctga

SEQ ID NO: 1632905 - DNA, 22 bp, Homo sapiens
ggctgccctggccctgaggtgt

SEQ ID NO: 1632906 - DNA, 16 bp, Homo sapiens
ggctgccctggtgctg

SEQ ID NO: 1632907 - DNA, 19 bp, Homo sapiens
ggctgccctggtgctgcca

SEQ ID NO: 1632908 - DNA, 16 bp, Homo sapiens
ggctgcccttgggcca

SEQ ID NO: 1632909 - DNA, 19 bp, Homo sapiens
ggctgcccttgttgcctgc

SEQ ID NO: 1632910 - DNA, 22 bp, Homo sapiens
ggctgccgagacagaccctctg

SEQ ID NO: 1632911 - DNA, 19 bp, Homo sapiens
ggcttcactgaccagcggc

SEQ ID NO: 1632912 - DNA, 18 bp, Homo sapiens
ggcttcattccggactgg

SEQ ID NO: 1632913 - DNA, 14 bp, Homo sapiens
ggcttcccgctcag

SEQ ID NO: 1632914 - DNA, 15 bp, Homo sapiens
ggcttcccgctcagc

SEQ ID NO: 1632915 - DNA, 17 bp, Homo sapiens
ggcttcccgctcagccc

SEQ ID NO: 1632916 - DNA, 20 bp, Homo sapiens
ggcttccctgacttgcttta

SEQ ID NO: 1632917 - DNA, 12 bp, Homo sapiens
ggcttccctgga

SEQ ID NO: 1632918 - DNA, 22 bp, Homo sapiens
ggcttccctggaagctctccga

SEQ ID NO: 1632919 - DNA, 16 bp, Homo sapiens
ggcttcccttctcccc

SEQ ID NO: 1632920 - DNA, 19 bp, Homo sapiens
ggcttcccttctccccagc

SEQ ID NO: 1632921 - DNA, 21 bp, Homo sapiens
ggcttcccttctccccagcca

SEQ ID NO: 1632922 - DNA, 19 bp, Homo sapiens
ggcttcctccgtccaccca

SEQ ID NO: 1632923 - DNA, 20 bp, Homo sapiens
ggcttcctccgtccacccag

SEQ ID NO: 1632924 - DNA, 21 bp, Homo sapiens
ggcttcctccgtccacccagg

SEQ ID NO: 1632925 - DNA, 19 bp, Homo sapiens
ggcttcctgcgtcctcctc

SEQ ID NO: 1632926 - DNA, 21 bp, Homo sapiens
ggcttcctgggtcctgcctgg

SEQ ID NO: 1632927 - DNA, 12 bp, Homo sapiens
ggcttcctgtcc

SEQ ID NO: 1632928 - DNA, 22 bp, Homo sapiens
ggcttcggaacacggagtggcc

SEQ ID NO: 1632929 - DNA, 16 bp, Homo sapiens
ggcttctccgccagcc

SEQ ID NO: 1632930 - DNA, 12 bp, Homo sapiens
ggcttctccttc

SEQ ID NO: 1632931 - DNA, 21 bp, Homo sapiens
ggcttctccttctccttccca

SEQ ID NO: 1632932 - DNA, 13 bp, Homo sapiens
ggcttctctcttt

SEQ ID NO: 1632933 - DNA, 15 bp, Homo sapiens
ggcttctgcaccctc

SEQ ID NO: 1632934 - DNA, 16 bp, Homo sapiens
ggcttctgcaccctcc

SEQ ID NO: 1632935 - DNA, 21 bp, Homo sapiens
ggcttctgcaccctccaccct

SEQ ID NO: 1632936 - DNA, 16 bp, Homo sapiens
ggcttctggagccctt

SEQ ID NO: 1632937 - DNA, 18 bp, Homo sapiens
ggcttctggagcccttgg

SEQ ID NO: 1632938 - DNA, 13 bp, Homo sapiens
ggcttctgtgcac

SEQ ID NO: 1632939 - DNA, 15 bp, Homo sapiens
ggcttgaagccaaag

SEQ ID NO: 1632940 - DNA, 16 bp, Homo sapiens
ggcttgaagccaaaga

SEQ ID NO: 1632941 - DNA, 21 bp, Homo sapiens
ggcttgacacctgtcttgaat

SEQ ID NO: 1632942 - DNA, 14 bp, Homo sapiens
ggcttgactggatg

SEQ ID NO: 1632943 - DNA, 17 bp, Homo sapiens
ggcttgccccactctgc

SEQ ID NO: 1632944 - DNA, 23 bp, Homo sapiens
ggcttgccccactctgcctgcct

SEQ ID NO: 1632945 - DNA, 16 bp, Homo sapiens
ggcttgctccagggtc

SEQ ID NO: 1632946 - DNA, 18 bp, Homo sapiens
ggcttgcttgccgagcct

SEQ ID NO: 1632947 - DNA, 22 bp, Homo sapiens
ggcttggacttcctggggcccc

SEQ ID NO: 1632948 - DNA, 13 bp, Homo sapiens
ggcttggcccagc

SEQ ID NO: 1632949 - DNA, 14 bp, Homo sapiens
ggcttggcctgctg

SEQ ID NO: 1632950 - DNA, 15 bp, Homo sapiens
ggcttggcctgctgt

SEQ ID NO: 1632951 - DNA, 15 bp, Homo sapiens
ggcttgggccctgca

SEQ ID NO: 1632952 - DNA, 22 bp, Homo sapiens
ggcttggggattgtacacggga

SEQ ID NO: 1632953 - DNA, 15 bp, Homo sapiens
ggcttggggcttcct

SEQ ID NO: 1632954 - DNA, 17 bp, Homo sapiens
ggcttgtaactccacca

SEQ ID NO: 1632955 - DNA, 15 bp, Homo sapiens
ggcttgtacattttt

SEQ ID NO: 1632956 - DNA, 17 bp, Homo sapiens
ggcttgtttacctttct

SEQ ID NO: 1632957 - DNA, 14 bp, Homo sapiens
ggctttaaaattct

SEQ ID NO: 1632958 - DNA, 13 bp, Homo sapiens
ggctttaattgta

SEQ ID NO: 1632959 - DNA, 22 bp, Homo sapiens
ggctttatgataatagattctc

SEQ ID NO: 1632960 - DNA, 16 bp, Homo sapiens
ggctttcactgctgag

SEQ ID NO: 1632961 - DNA, 17 bp, Homo sapiens
ggctttcccaggagaaa

SEQ ID NO: 1632962 - DNA, 14 bp, Homo sapiens
ggctttctggggcc

SEQ ID NO: 1632963 - DNA, 18 bp, Homo sapiens
ggctttgcccacccctca

SEQ ID NO: 1632964 - DNA, 23 bp, Homo sapiens
ggctttgcccacccctcactccc

SEQ ID NO: 1632965 - DNA, 12 bp, Homo sapiens
ggctttgcctct

SEQ ID NO: 1632966 - DNA, 19 bp, Homo sapiens
ggctttgcctcttctttgt

SEQ ID NO: 1632967 - DNA, 19 bp, Homo sapiens
ggctttgggatgggaggcc

SEQ ID NO: 1632968 - DNA, 21 bp, Homo sapiens
ggctttgggtggctcactact

SEQ ID NO: 1632969 - DNA, 18 bp, Homo sapiens
ggctttgtccctcccccg

SEQ ID NO: 1632970 - DNA, 13 bp, Homo sapiens
ggcttttaagaaa

SEQ ID NO: 1632971 - DNA, 13 bp, Homo sapiens
ggcttttcactgc

SEQ ID NO: 1632972 - DNA, 15 bp, Homo sapiens
ggcttttcactgctg

SEQ ID NO: 1632973 - DNA, 19 bp, Homo sapiens
ggcttttcactgctggctg

SEQ ID NO: 1632974 - DNA, 20 bp, Homo sapiens
ggcttttcccaccagctccc

SEQ ID NO: 1632975 - DNA, 18 bp, Homo sapiens
ggcttttcttacccagat

SEQ ID NO: 1632976 - DNA, 23 bp, Homo sapiens
ggcttttcttacccagattgtgt

SEQ ID NO: 1632977 - DNA, 15 bp, Homo sapiens
ggctttttctgccac

SEQ ID NO: 1632978 - DNA, 17 bp, Homo sapiens
ggctttttgttcagaat

SEQ ID NO: 1632979 - DNA, 16 bp, Homo sapiens
ggctttttttttctct

SEQ ID NO: 1632980 - DNA, 20 bp, Homo sapiens
gggaaaaaacttaaaaatta

SEQ ID NO: 1632981 - DNA, 20 bp, Homo sapiens
gggaaaaactttggaaccag

SEQ ID NO: 1632982 - DNA, 17 bp, Homo sapiens
gggaaaagaccagggct

SEQ ID NO: 1632983 - DNA, 13 bp, Homo sapiens
gggaaaatatttc

SEQ ID NO: 1632984 - DNA, 20 bp, Homo sapiens
gggaaaatggccatgcagga

SEQ ID NO: 1632985 - DNA, 15 bp, Homo sapiens
gggaaaccctggagc

SEQ ID NO: 1632986 - DNA, 21 bp, Homo sapiens
gggaaaccctggagccatccc

SEQ ID NO: 1632987 - DNA, 14 bp, Homo sapiens
gggaaaccttggag

SEQ ID NO: 1632988 - DNA, 15 bp, Homo sapiens
gggaaactgggaaac

SEQ ID NO: 1632989 - DNA, 17 bp, Homo sapiens
gggaaagaaaaggattt

SEQ ID NO: 1632990 - DNA, 18 bp, Homo sapiens
gggaaagacactgcctgg

SEQ ID NO: 1632991 - DNA, 15 bp, Homo sapiens
gggaaaggatatttt

SEQ ID NO: 1632992 - DNA, 17 bp, Homo sapiens
gggaaagggctggctgc

SEQ ID NO: 1632993 - DNA, 21 bp, Homo sapiens
gggaaagggctggctgcaatt

SEQ ID NO: 1632994 - DNA, 17 bp, Homo sapiens
gggaaaggggacaagga

SEQ ID NO: 1632995 - DNA, 23 bp, Homo sapiens
gggaaagtcagctttcagagcca

SEQ ID NO: 1632996 - DNA, 23 bp, Homo sapiens
gggaaagtgtgagctcttccctt

SEQ ID NO: 1632997 - DNA, 17 bp, Homo sapiens
gggaacacagctacaac

SEQ ID NO: 1632998 - DNA, 19 bp, Homo sapiens
gggaacagacaacagaagt

SEQ ID NO: 1632999 - DNA, 14 bp, Homo sapiens
gggaacagccccag

SEQ ID NO: 1633000 - DNA, 15 bp, Homo sapiens
gggaacagccccagg

SEQ ID NO: 1633001 - DNA, 15 bp, Homo sapiens
gggaacatgccccct

SEQ ID NO: 1633002 - DNA, 20 bp, Homo sapiens
gggaacatggctggcctggt

SEQ ID NO: 1633003 - DNA, 21 bp, Homo sapiens
gggaacatggctggcctggta

SEQ ID NO: 1633004 - DNA, 16 bp, Homo sapiens
gggaaccccgcagccc

SEQ ID NO: 1633005 - DNA, 18 bp, Homo sapiens
gggaacgtgactgcccca

SEQ ID NO: 1633006 - DNA, 13 bp, Homo sapiens
gggaactcctgga

SEQ ID NO: 1633007 - DNA, 17 bp, Homo sapiens
gggaactttctggactc

SEQ ID NO: 1633008 - DNA, 11 bp, Homo sapiens
gggaagacagt

SEQ ID NO: 1633009 - DNA, 12 bp, Homo sapiens
gggaagacagtg

SEQ ID NO: 1633010 - DNA, 18 bp, Homo sapiens
gggaagactcaggagtct

SEQ ID NO: 1633011 - DNA, 18 bp, Homo sapiens
gggaagagacagcccagg

SEQ ID NO: 1633012 - DNA, 12 bp, Homo sapiens
gggaagagctcc

SEQ ID NO: 1633013 - DNA, 12 bp, Homo sapiens
gggaagaggcct

SEQ ID NO: 1633014 - DNA, 18 bp, Homo sapiens
gggaagaggggctggggc

SEQ ID NO: 1633015 - DNA, 22 bp, Homo sapiens
gggaagataggctctgcacaga

SEQ ID NO: 1633016 - DNA, 20 bp, Homo sapiens
cactactcctctgcagtgcc

SEQ ID NO: 1633017 - DNA, 17 bp, Homo sapiens
cactactgctaaatcct

SEQ ID NO: 1633018 - DNA, 17 bp, Homo sapiens
cactagaaattgggcag

SEQ ID NO: 1633019 - DNA, 15 bp, Homo sapiens
cactagaactctcca

SEQ ID NO: 1633020 - DNA, 13 bp, Homo sapiens
cactagaagaaaa

SEQ ID NO: 1633021 - DNA, 12 bp, Homo sapiens
cactagagggcc

SEQ ID NO: 1633022 - DNA, 18 bp, Homo sapiens
cactagagggcccatcag

SEQ ID NO: 1633023 - DNA, 22 bp, Homo sapiens
cactagagggcccatcaggcag

SEQ ID NO: 1633024 - DNA, 16 bp, Homo sapiens
cactagccagacactc

SEQ ID NO: 1633025 - DNA, 20 bp, Homo sapiens
cactaggaatcccagaggtg

SEQ ID NO: 1633026 - DNA, 22 bp, Homo sapiens
gggaagggagcaccagatgaca

SEQ ID NO: 1633027 - DNA, 16 bp, Homo sapiens
gggaagtcgaggctgc

SEQ ID NO: 1633028 - DNA, 20 bp, Homo sapiens
gggaagtcgggcatggtggc

SEQ ID NO: 1633029 - DNA, 14 bp, Homo sapiens
gggaagtgaggccc

SEQ ID NO: 1633030 - DNA, 18 bp, Homo sapiens
gggaatccaagcctccac

SEQ ID NO: 1633031 - DNA, 22 bp, Homo sapiens
gggaatccaagcctccacagcg

SEQ ID NO: 1633032 - DNA, 11 bp, Homo sapiens
gggaatgaggc

SEQ ID NO: 1633033 - DNA, 15 bp, Homo sapiens
gggaatgcagcagga

SEQ ID NO: 1633034 - DNA, 18 bp, Homo sapiens
gggaatggatggggagaa

SEQ ID NO: 1633035 - DNA, 12 bp, Homo sapiens
gggaatgggaga

SEQ ID NO: 1633036 - DNA, 22 bp, Homo sapiens
gggaatgggggagagaagggaa

SEQ ID NO: 1633037 - DNA, 21 bp, Homo sapiens
gggaatgtggtagtacccagg

SEQ ID NO: 1633038 - DNA, 17 bp, Homo sapiens
gggaatgttccctgcac

SEQ ID NO: 1633039 - DNA, 23 bp, Homo sapiens
gggaatgttccctgcaccctgga

SEQ ID NO: 1633040 - DNA, 16 bp, Homo sapiens
gggacaaagaggcctt

SEQ ID NO: 1633041 - DNA, 18 bp, Homo sapiens
gggacaagggattctggg

SEQ ID NO: 1633042 - DNA, 20 bp, Homo sapiens
gggacaccaagccttggctc

SEQ ID NO: 1633043 - DNA, 17 bp, Homo sapiens
gggacaccagagctgcc

SEQ ID NO: 1633044 - DNA, 16 bp, Homo sapiens
gggacactgggcagca

SEQ ID NO: 1633045 - DNA, 17 bp, Homo sapiens
gggacagaggccccagc

SEQ ID NO: 1633046 - DNA, 19 bp, Homo sapiens
gggacagaggccccagcct

SEQ ID NO: 1633047 - DNA, 20 bp, Homo sapiens
gggacagaggccccagcctc

SEQ ID NO: 1633048 - DNA, 16 bp, Homo sapiens
gggacagcagcctccc

SEQ ID NO: 1633049 - DNA, 12 bp, Homo sapiens
gggacagcccac

SEQ ID NO: 1633050 - DNA, 14 bp, Homo sapiens
gggacagcttcctc

SEQ ID NO: 1633051 - DNA, 20 bp, Homo sapiens
gggacaggatctataggcag

SEQ ID NO: 1633052 - DNA, 18 bp, Homo sapiens
gggacaggctgaagagag

SEQ ID NO: 1633053 - DNA, 16 bp, Homo sapiens
gggacagttggcagag

SEQ ID NO: 1633054 - DNA, 19 bp, Homo sapiens
gggacagttggcagagaag

SEQ ID NO: 1633055 - DNA, 22 bp, Homo sapiens
gggacatcacagggtgggcctc

SEQ ID NO: 1633056 - DNA, 17 bp, Homo sapiens
gggacatttcttcccca

SEQ ID NO: 1633057 - DNA, 19 bp, Homo sapiens
gggacattttctggattct

SEQ ID NO: 1633058 - DNA, 18 bp, Homo sapiens
gggaccaaccctggggaa

SEQ ID NO: 1633059 - DNA, 12 bp, Homo sapiens
gggaccaaggca

SEQ ID NO: 1633060 - DNA, 21 bp, Homo sapiens
gggaccacagctgctggccag

SEQ ID NO: 1633061 - DNA, 23 bp, Homo sapiens
gggaccacagctgctggccaggg

SEQ ID NO: 1633062 - DNA, 17 bp, Homo sapiens
gggaccaccctgagccg

SEQ ID NO: 1633063 - DNA, 12 bp, Homo sapiens
gggaccagagcc

SEQ ID NO: 1633064 - DNA, 22 bp, Homo sapiens
gggaccagagccagatgcagga

SEQ ID NO: 1633065 - DNA, 14 bp, Homo sapiens
gggaccagccaaga

SEQ ID NO: 1633066 - DNA, 17 bp, Homo sapiens
gggacccacctccccct

SEQ ID NO: 1633067 - DNA, 16 bp, Homo sapiens
gggacccaggtgtgcc

SEQ ID NO: 1633068 - DNA, 18 bp, Homo sapiens
gggacccaggtgtgcctg

SEQ ID NO: 1633069 - DNA, 12 bp, Homo sapiens
gggacccagtgc

SEQ ID NO: 1633070 - DNA, 20 bp, Homo sapiens
gggacccatagatcttctga

SEQ ID NO: 1633071 - DNA, 23 bp, Homo sapiens
gggacccccgtggggcagggagc

SEQ ID NO: 1633072 - DNA, 23 bp, Homo sapiens
gggaccccctcaccatccagtgg

SEQ ID NO: 1633073 - DNA, 23 bp, Homo sapiens
gggaccctgtgacatggtgcctg

SEQ ID NO: 1633074 - DNA, 18 bp, Homo sapiens
gggacctgccaggcaggg

SEQ ID NO: 1633075 - DNA, 20 bp, Homo sapiens
gggacgacgctgactgccct

SEQ ID NO: 1633076 - DNA, 22 bp, Homo sapiens
gggacgttcgtggtcctgcgct

SEQ ID NO: 1633077 - DNA, 22 bp, Homo sapiens
gggacgtttctggaactgtctg

SEQ ID NO: 1633078 - DNA, 20 bp, Homo sapiens
gggactacccatagacatga

SEQ ID NO: 1633079 - DNA, 22 bp, Homo sapiens
gggactcagccttcagacagag

SEQ ID NO: 1633080 - DNA, 13 bp, Homo sapiens
gggactcagggac

SEQ ID NO: 1633081 - DNA, 21 bp, Homo sapiens
gggactccatgctccttgaga

SEQ ID NO: 1633082 - DNA, 18 bp, Homo sapiens
gggactctcctcctcccc

SEQ ID NO: 1633083 - DNA, 13 bp, Homo sapiens
gggactgagccag

SEQ ID NO: 1633084 - DNA, 17 bp, Homo sapiens
gggactgagccagtccc

SEQ ID NO: 1633085 - DNA, 19 bp, Homo sapiens
gggactgagccagtcccag

SEQ ID NO: 1633086 - DNA, 21 bp, Homo sapiens
gggactgatgtcatcttgagc

SEQ ID NO: 1633087 - DNA, 21 bp, Homo sapiens
gggactgctacctctgagaag

SEQ ID NO: 1633088 - DNA, 23 bp, Homo sapiens
gggactggacagctttgctccgc

SEQ ID NO: 1633089 - DNA, 12 bp, Homo sapiens
gggactgggttt

SEQ ID NO: 1633090 - DNA, 12 bp, Homo sapiens
gggactgtctca

SEQ ID NO: 1633091 - DNA, 14 bp, Homo sapiens
gggacttgtgtctg

SEQ ID NO: 1633092 - DNA, 16 bp, Homo sapiens
gggactttccttccct

SEQ ID NO: 1633093 - DNA, 23 bp, Homo sapiens
gggactttgctgatttcccctct

SEQ ID NO: 1633094 - DNA, 22 bp, Homo sapiens
gggactttgctggtgtagtctt

SEQ ID NO: 1633095 - DNA, 18 bp, Homo sapiens
gggagaaaatccaggtca

SEQ ID NO: 1633096 - DNA, 13 bp, Homo sapiens
gggagaaagcaat

SEQ ID NO: 1633097 - DNA, 19 bp, Homo sapiens
gggagaaagtaggccgctg

SEQ ID NO: 1633098 - DNA, 22 bp, Homo sapiens
gggagaagaaaggtgagtttga

SEQ ID NO: 1633099 - DNA, 18 bp, Homo sapiens
gggagaaggaagggcaga

SEQ ID NO: 1633100 - DNA, 23 bp, Homo sapiens
gggagaaggtctccaagggaggg

SEQ ID NO: 1633101 - DNA, 22 bp, Homo sapiens
gggagaatgtcagtatgtggaa

SEQ ID NO: 1633102 - DNA, 18 bp, Homo sapiens
gggagacagcagcctgta

SEQ ID NO: 1633103 - DNA, 18 bp, Homo sapiens
gggagacttgttctagag

SEQ ID NO: 1633104 - DNA, 23 bp, Homo sapiens
gggagagagagagagagaggaca

SEQ ID NO: 1633105 - DNA, 15 bp, Homo sapiens
gggagagccagctcc

SEQ ID NO: 1633106 - DNA, 22 bp, Homo sapiens
gggagagctgagccagttgtcc

SEQ ID NO: 1633107 - DNA, 16 bp, Homo sapiens
gggagaggtcaccagc

SEQ ID NO: 1633108 - DNA, 19 bp, Homo sapiens
gggagatggagttcttgtg

SEQ ID NO: 1633109 - DNA, 22 bp, Homo sapiens
gggagatggtcagtgtggagag

SEQ ID NO: 1633110 - DNA, 14 bp, Homo sapiens
gggagcactgttca

SEQ ID NO: 1633111 - DNA, 22 bp, Homo sapiens
gggagcacttgcgtcctgcaga

SEQ ID NO: 1633112 - DNA, 11 bp, Homo sapiens
gggagcagtgt

SEQ ID NO: 1633113 - DNA, 19 bp, Homo sapiens
gggagcagttttcccctgg

SEQ ID NO: 1633114 - DNA, 13 bp, Homo sapiens
gggagccagctgc

SEQ ID NO: 1633115 - DNA, 17 bp, Homo sapiens
gggagccagctgcttga

SEQ ID NO: 1633116 - DNA, 12 bp, Homo sapiens
gggagccccagg

SEQ ID NO: 1633117 - DNA, 16 bp, Homo sapiens
gggagccccagggtct

SEQ ID NO: 1633118 - DNA, 22 bp, Homo sapiens
gggagcccctcctctgagcagc

SEQ ID NO: 1633119 - DNA, 22 bp, Homo sapiens
gggagccgagggcgtcagagag

SEQ ID NO: 1633120 - DNA, 12 bp, Homo sapiens
gggagcctagct

SEQ ID NO: 1633121 - DNA, 22 bp, Homo sapiens
gggagcctttggttctggccag

SEQ ID NO: 1633122 - DNA, 16 bp, Homo sapiens
gggagctctggggaca

SEQ ID NO: 1633123 - DNA, 23 bp, Homo sapiens
gggagctgggagaccctccccac

SEQ ID NO: 1633124 - DNA, 17 bp, Homo sapiens
gggagctttgggtgacc

SEQ ID NO: 1633125 - DNA, 12 bp, Homo sapiens
gggaggaaaaaa

SEQ ID NO: 1633126 - DNA, 14 bp, Homo sapiens
gggaggaaaaaaga

SEQ ID NO: 1633127 - DNA, 16 bp, Homo sapiens
gggaggaaaaaagaac

SEQ ID NO: 1633128 - DNA, 16 bp, Homo sapiens
gggaggaaaagaaaag

SEQ ID NO: 1633129 - DNA, 21 bp, Homo sapiens
gggaggaaagggcctggccag

SEQ ID NO: 1633130 - DNA, 22 bp, Homo sapiens
gggaggaaggcctttcttctgt

SEQ ID NO: 1633131 - DNA, 11 bp, Homo sapiens
gggaggaaggg

SEQ ID NO: 1633132 - DNA, 13 bp, Homo sapiens
gggaggacccggg

SEQ ID NO: 1633133 - DNA, 12 bp, Homo sapiens
gggaggactccg

SEQ ID NO: 1633134 - DNA, 16 bp, Homo sapiens
cactcgagaccatcct

SEQ ID NO: 1633135 - DNA, 15 bp, Homo sapiens
cactcgcccgcccac

SEQ ID NO: 1633136 - DNA, 16 bp, Homo sapiens
cactcgcccgcccact

SEQ ID NO: 1633137 - DNA, 22 bp, Homo sapiens
cactcgcccgcccactgtcctg

SEQ ID NO: 1633138 - DNA, 23 bp, Homo sapiens
cactcgcccgcccactgtcctgg

SEQ ID NO: 1633139 - DNA, 17 bp, Homo sapiens
cactcgctgttatcaaa

SEQ ID NO: 1633140 - DNA, 18 bp, Homo sapiens
gggaggatacagaggaga

SEQ ID NO: 1633141 - DNA, 22 bp, Homo sapiens
gggaggatcactggagcccagg

SEQ ID NO: 1633142 - DNA, 23 bp, Homo sapiens
gggaggatcactggagcccagga

SEQ ID NO: 1633143 - DNA, 12 bp, Homo sapiens
gggaggcacact

SEQ ID NO: 1633144 - DNA, 20 bp, Homo sapiens
gggaggcagaggttgcagtg

SEQ ID NO: 1633145 - DNA, 13 bp, Homo sapiens
gggaggccaagga

SEQ ID NO: 1633146 - DNA, 16 bp, Homo sapiens
gggaggccgggcggtc

SEQ ID NO: 1633147 - DNA, 17 bp, Homo sapiens
gggaggcgatgccagcc

SEQ ID NO: 1633148 - DNA, 18 bp, Homo sapiens
gggaggcgtggagggtga

SEQ ID NO: 1633149 - DNA, 10 bp, Homo sapiens
gggaggctga

SEQ ID NO: 1633150 - DNA, 14 bp, Homo sapiens
gggaggctgaggcg

SEQ ID NO: 1633151 - DNA, 21 bp, Homo sapiens
gggagggaccgcgcaggctcc

SEQ ID NO: 1633152 - DNA, 11 bp, Homo sapiens
gggagggaggg

SEQ ID NO: 1633153 - DNA, 22 bp, Homo sapiens
gggagggattctggttccaggg

SEQ ID NO: 1633154 - DNA, 21 bp, Homo sapiens
gggagggcggcaggggcctgg

SEQ ID NO: 1633155 - DNA, 16 bp, Homo sapiens
gggaggggaaaagcat

SEQ ID NO: 1633156 - DNA, 13 bp, Homo sapiens
gggaggggcaggc

SEQ ID NO: 1633157 - DNA, 16 bp, Homo sapiens
gggaggggcaggctga

SEQ ID NO: 1633158 - DNA, 19 bp, Homo sapiens
gggaggggcctagggagcc

SEQ ID NO: 1633159 - DNA, 10 bp, Homo sapiens
gggaggggcg

SEQ ID NO: 1633160 - DNA, 20 bp, Homo sapiens
gggagggggtgggggatctg

SEQ ID NO: 1633161 - DNA, 22 bp, Homo sapiens
gggaggggtaaaattccttagc

SEQ ID NO: 1633162 - DNA, 16 bp, Homo sapiens
gggagggttcccctgg

SEQ ID NO: 1633163 - DNA, 23 bp, Homo sapiens
gggaggtagaaggggaggacact

SEQ ID NO: 1633164 - DNA, 16 bp, Homo sapiens
gggaggtccaagcaga

SEQ ID NO: 1633165 - DNA, 16 bp, Homo sapiens
gggagtcccctccccg

SEQ ID NO: 1633166 - DNA, 15 bp, Homo sapiens
gggagtcccgtcagg

SEQ ID NO: 1633167 - DNA, 15 bp, Homo sapiens
gggagtgtgggctgc

SEQ ID NO: 1633168 - DNA, 18 bp, Homo sapiens
gggagtgtgggctgccct

SEQ ID NO: 1633169 - DNA, 21 bp, Homo sapiens
gggagtgtggtttctttttga

SEQ ID NO: 1633170 - DNA, 11 bp, Homo sapiens
gggagtgtgta

SEQ ID NO: 1633171 - DNA, 18 bp, Homo sapiens
gggagttagggagagaga

SEQ ID NO: 1633172 - DNA, 16 bp, Homo sapiens
gggataaactgagcct

SEQ ID NO: 1633173 - DNA, 16 bp, Homo sapiens
gggataagagtgtgag

SEQ ID NO: 1633174 - DNA, 13 bp, Homo sapiens
gggatagatgtgt

SEQ ID NO: 1633175 - DNA, 22 bp, Homo sapiens
gggatagtgttctgctcctgct

SEQ ID NO: 1633176 - DNA, 23 bp, Homo sapiens
gggatagtgttctgctcctgctt

SEQ ID NO: 1633177 - DNA, 14 bp, Homo sapiens
gggatatggctgcc

SEQ ID NO: 1633178 - DNA, 13 bp, Homo sapiens
gggatattgcctt

SEQ ID NO: 1633179 - DNA, 14 bp, Homo sapiens
gggatcacagggcc

SEQ ID NO: 1633180 - DNA, 14 bp, Homo sapiens
gggatccagccact

SEQ ID NO: 1633181 - DNA, 14 bp, Homo sapiens
gggatcctccacag

SEQ ID NO: 1633182 - DNA, 17 bp, Homo sapiens
gggatcctccacagaga

SEQ ID NO: 1633183 - DNA, 18 bp, Homo sapiens
gggatcctccacagagag

SEQ ID NO: 1633184 - DNA, 12 bp, Homo sapiens
gggatctgaaat

SEQ ID NO: 1633185 - DNA, 23 bp, Homo sapiens
gggatctgagctcccacctccct

SEQ ID NO: 1633186 - DNA, 13 bp, Homo sapiens
gggatcttcccac

SEQ ID NO: 1633187 - DNA, 16 bp, Homo sapiens
gggatcttcccacagg

SEQ ID NO: 1633188 - DNA, 23 bp, Homo sapiens
gggatcttcccacaggagggcca

SEQ ID NO: 1633189 - DNA, 19 bp, Homo sapiens
gggatgactaaaatattta

SEQ ID NO: 1633190 - DNA, 18 bp, Homo sapiens
gggatgcggatcctgctg

SEQ ID NO: 1633191 - DNA, 22 bp, Homo sapiens
gggatgctgctccgcccgctcc

SEQ ID NO: 1633192 - DNA, 16 bp, Homo sapiens
gggatgctgggctggg

SEQ ID NO: 1633193 - DNA, 15 bp, Homo sapiens
gggatggagaaagaa

SEQ ID NO: 1633194 - DNA, 15 bp, Homo sapiens
gggatggaggagaag

SEQ ID NO: 1633195 - DNA, 19 bp, Homo sapiens
gggatggtaagagaaaaga

SEQ ID NO: 1633196 - DNA, 12 bp, Homo sapiens
gggatgtcctct

SEQ ID NO: 1633197 - DNA, 15 bp, Homo sapiens
gggatgtggagtgag

SEQ ID NO: 1633198 - DNA, 13 bp, Homo sapiens
gggatgttctggc

SEQ ID NO: 1633199 - DNA, 15 bp, Homo sapiens
gggattaagggcaaa

SEQ ID NO: 1633200 - DNA, 18 bp, Homo sapiens
gggattatgggtcacagg

SEQ ID NO: 1633201 - DNA, 20 bp, Homo sapiens
gggattatgggtcacaggaa

SEQ ID NO: 1633202 - DNA, 13 bp, Homo sapiens
gggattcctgacc

SEQ ID NO: 1633203 - DNA, 19 bp, Homo sapiens
gggattcctgacccaggcc

SEQ ID NO: 1633204 - DNA, 18 bp, Homo sapiens
gggattgaagggtcctgc

SEQ ID NO: 1633205 - DNA, 14 bp, Homo sapiens
gggattgctgaggc

SEQ ID NO: 1633206 - DNA, 15 bp, Homo sapiens
gggattgctgccact

SEQ ID NO: 1633207 - DNA, 19 bp, Homo sapiens
gggatttcttcgctgctct

SEQ ID NO: 1633208 - DNA, 12 bp, Homo sapiens
gggatttgagat

SEQ ID NO: 1633209 - DNA, 23 bp, Homo sapiens
gggattttttccctttttatgtg

SEQ ID NO: 1633210 - DNA, 21 bp, Homo sapiens
gggcaaaggtttgaagacaca

SEQ ID NO: 1633211 - DNA, 21 bp, Homo sapiens
gggcaaatgacatgcactgac

SEQ ID NO: 1633212 - DNA, 22 bp, Homo sapiens
gggcaacagagcaagatcctgt

SEQ ID NO: 1633213 - DNA, 15 bp, Homo sapiens
gggcaacgaagaaaa

SEQ ID NO: 1633214 - DNA, 17 bp, Homo sapiens
gggcaacgaagaaaaaa

SEQ ID NO: 1633215 - DNA, 23 bp, Homo sapiens
gggcaagacctcttccctctggg

SEQ ID NO: 1633216 - DNA, 15 bp, Homo sapiens
gggcaagagaggctg

SEQ ID NO: 1633217 - DNA, 22 bp, Homo sapiens
gggcaagagatgggacaagcag

SEQ ID NO: 1633218 - DNA, 20 bp, Homo sapiens
gggcaagctaggccccagag

SEQ ID NO: 1633219 - DNA, 24 bp, Homo sapiens
gggcaagtccctgactctctgtga

SEQ ID NO: 1633220 - DNA, 14 bp, Homo sapiens
gggcacaccactgc

SEQ ID NO: 1633221 - DNA, 18 bp, Homo sapiens
gggcacaccactgccctg

SEQ ID NO: 1633222 - DNA, 23 bp, Homo sapiens
gggcacaccactgccctgcctgc

SEQ ID NO: 1633223 - DNA, 21 bp, Homo sapiens
gggcacacccctggggctgag

SEQ ID NO: 1633224 - DNA, 9 bp, Homo sapiens
gggcacagg

SEQ ID NO: 1633225 - DNA, 22 bp, Homo sapiens
gggcacagggcaccagaggccg

SEQ ID NO: 1633226 - DNA, 19 bp, Homo sapiens
gggcacattaactccctcc

SEQ ID NO: 1633227 - DNA, 20 bp, Homo sapiens
gggcacattaactccctcca

SEQ ID NO: 1633228 - DNA, 12 bp, Homo sapiens
gggcacattgcc

SEQ ID NO: 1633229 - DNA, 14 bp, Homo sapiens
gggcaccagaggcc

SEQ ID NO: 1633230 - DNA, 18 bp, Homo sapiens
gggcaccaggggtttctc

SEQ ID NO: 1633231 - DNA, 16 bp, Homo sapiens
gggcacccacctccac

SEQ ID NO: 1633232 - DNA, 19 bp, Homo sapiens
gggcacctgcgcacaggtg

SEQ ID NO: 1633233 - DNA, 20 bp, Homo sapiens
gggcacggcgggatcctcca

SEQ ID NO: 1633234 - DNA, 23 bp, Homo sapiens
gggcactccgcgccgatgccacc

SEQ ID NO: 1633235 - DNA, 15 bp, Homo sapiens
gggcagaaagtggcc

SEQ ID NO: 1633236 - DNA, 22 bp, Homo sapiens
gggcagaacagccgctcctgtc

SEQ ID NO: 1633237 - DNA, 21 bp, Homo sapiens
gggcagaagactagaggccag

SEQ ID NO: 1633238 - DNA, 22 bp, Homo sapiens
gggcagactgtgaacttgactg

SEQ ID NO: 1633239 - DNA, 19 bp, Homo sapiens
gggcagagccatgggcctg

SEQ ID NO: 1633240 - DNA, 20 bp, Homo sapiens
gggcagagccatgggcctgg

SEQ ID NO: 1633241 - DNA, 19 bp, Homo sapiens
gggcagagctggctctgag

SEQ ID NO: 1633242 - DNA, 21 bp, Homo sapiens
gggcagaggaatgtagggcct

SEQ ID NO: 1633243 - DNA, 16 bp, Homo sapiens
gggcagaggctggagg

SEQ ID NO: 1633244 - DNA, 21 bp, Homo sapiens
gggcagaggctggaggcaggg

SEQ ID NO: 1633245 - DNA, 12 bp, Homo sapiens
gggcagagggaa

SEQ ID NO: 1633246 - DNA, 22 bp, Homo sapiens
gggcagagggaatgttccctgc

SEQ ID NO: 1633247 - DNA, 23 bp, Homo sapiens
gggcagagggaatgttccctgca

SEQ ID NO: 1633248 - DNA, 20 bp, Homo sapiens
gggcagagggcagaggctgg

SEQ ID NO: 1633249 - DNA, 14 bp, Homo sapiens
gggcagagggctgg

SEQ ID NO: 1633250 - DNA, 13 bp, Homo sapiens
gggcagcaaggcc

SEQ ID NO: 1633251 - DNA, 14 bp, Homo sapiens
gggcagcaaggcct

SEQ ID NO: 1633252 - DNA, 20 bp, Homo sapiens
ggcctggcttgctccagggt

SEQ ID NO: 1633253 - DNA, 22 bp, Homo sapiens
ggcctgggacccagctactctg

SEQ ID NO: 1633254 - DNA, 21 bp, Homo sapiens
ggcctgggagggttcccctgg

SEQ ID NO: 1633255 - DNA, 23 bp, Homo sapiens
ggcctgggcagagggcctggacc

SEQ ID NO: 1633256 - DNA, 16 bp, Homo sapiens
ggcctgggcctcatgg

SEQ ID NO: 1633257 - DNA, 18 bp, Homo sapiens
ggcctgggcctcctggga

SEQ ID NO: 1633258 - DNA, 12 bp, Homo sapiens
ggcctgggcctg

SEQ ID NO: 1633259 - DNA, 20 bp, Homo sapiens
ggcctgggggacccctggct

SEQ ID NO: 1633260 - DNA, 19 bp, Homo sapiens
ggcctgggggcagtgactg

SEQ ID NO: 1633261 - DNA, 16 bp, Homo sapiens
ggcctgggtctccctg

SEQ ID NO: 1633262 - DNA, 18 bp, Homo sapiens
ggcctgtcccttgcctct

SEQ ID NO: 1633263 - DNA, 19 bp, Homo sapiens
ggcctgtctcatcttctga

SEQ ID NO: 1633264 - DNA, 14 bp, Homo sapiens
ggcctgtgcagcag

SEQ ID NO: 1633265 - DNA, 19 bp, Homo sapiens
ggcctgtgcagcagcccag

SEQ ID NO: 1633266 - DNA, 17 bp, Homo sapiens
ggcctgtgctgcatgcg

SEQ ID NO: 1633267 - DNA, 18 bp, Homo sapiens
ggcctgtggcacagccct

SEQ ID NO: 1633268 - DNA, 19 bp, Homo sapiens
ggcctgtggcacagccctg

SEQ ID NO: 1633269 - DNA, 17 bp, Homo sapiens
ggcctgtggggagccga

SEQ ID NO: 1633270 - DNA, 18 bp, Homo sapiens
ggcctgtgggtctctgaa

SEQ ID NO: 1633271 - DNA, 20 bp, Homo sapiens
ggcctgtgggtctctgaagg

SEQ ID NO: 1633272 - DNA, 19 bp, Homo sapiens
ggcctgtgtccagcagctg

SEQ ID NO: 1633273 - DNA, 14 bp, Homo sapiens
ggcctgttccctag

SEQ ID NO: 1633274 - DNA, 22 bp, Homo sapiens
ggcctgttccctagagagaata

SEQ ID NO: 1633275 - DNA, 21 bp, Homo sapiens
ggcctgttgctatagagccta

SEQ ID NO: 1633276 - DNA, 12 bp, Homo sapiens
ggcctgtttgat

SEQ ID NO: 1633277 - DNA, 22 bp, Homo sapiens
ggcctgtttgatgtatgtgtga

SEQ ID NO: 1633278 - DNA, 23 bp, Homo sapiens
ggccttaaaaggggcccaagccc

SEQ ID NO: 1633279 - DNA, 16 bp, Homo sapiens
ggcgtgggacgtggtc

SEQ ID NO: 1633280 - DNA, 18 bp, Homo sapiens
ggcgtgggacgtggtcag

SEQ ID NO: 1633281 - DNA, 18 bp, Homo sapiens
ggcgtgggagccagcctc

SEQ ID NO: 1633282 - DNA, 16 bp, Homo sapiens
ggcgtggtggcgggca

SEQ ID NO: 1633283 - DNA, 21 bp, Homo sapiens
ggcgtggtgtgtccctggaca

SEQ ID NO: 1633284 - DNA, 22 bp, Homo sapiens
ggcgtgtatctggtatatgtaa

SEQ ID NO: 1633285 - DNA, 21 bp, Homo sapiens
ggcgtgtgcatagcgtcctgc

SEQ ID NO: 1633286 - DNA, 13 bp, Homo sapiens
ggcgtgtgtgaca

SEQ ID NO: 1633287 - DNA, 18 bp, Homo sapiens
ggcgttgggagcctagct

SEQ ID NO: 1633288 - DNA, 22 bp, Homo sapiens
ggctaagatgagatttgccagc

SEQ ID NO: 1633289 - DNA, 19 bp, Homo sapiens
ggctaataaactgtattaa

SEQ ID NO: 1633290 - DNA, 22 bp, Homo sapiens
ggctaataaactgtattaaatc

SEQ ID NO: 1633291 - DNA, 16 bp, Homo sapiens
ggctaatgtactgcat

SEQ ID NO: 1633292 - DNA, 15 bp, Homo sapiens
ggctaattaaataaa

SEQ ID NO: 1633293 - DNA, 14 bp, Homo sapiens
ggctaccatctgca

SEQ ID NO: 1633294 - DNA, 17 bp, Homo sapiens
ggctaccatctgcatgg

SEQ ID NO: 1633295 - DNA, 13 bp, Homo sapiens
ggctacgcctctt

SEQ ID NO: 1633296 - DNA, 20 bp, Homo sapiens
ggctacgttttggttctatg

SEQ ID NO: 1633297 - DNA, 19 bp, Homo sapiens
ggctactctcctcggcccc

SEQ ID NO: 1633298 - DNA, 14 bp, Homo sapiens
ggctactggcagct

SEQ ID NO: 1633299 - DNA, 21 bp, Homo sapiens
ggctagagccgaggggagaga

SEQ ID NO: 1633300 - DNA, 22 bp, Homo sapiens
ggctagagccgaggggagagag

SEQ ID NO: 1633301 - DNA, 18 bp, Homo sapiens
ggctagaggccagcccca

SEQ ID NO: 1633302 - DNA, 20 bp, Homo sapiens
ggctagaggccagccccacc

SEQ ID NO: 1633303 - DNA, 13 bp, Homo sapiens
ggctagagtcctc

SEQ ID NO: 1633304 - DNA, 14 bp, Homo sapiens
ggctagagtcctca

SEQ ID NO: 1633305 - DNA, 18 bp, Homo sapiens
ggctagagtcctcactcc

SEQ ID NO: 1633306 - DNA, 22 bp, Homo sapiens
ggctagcttctgcttttctgcc

SEQ ID NO: 1633307 - DNA, 16 bp, Homo sapiens
ggctaggagttcatag

SEQ ID NO: 1633308 - DNA, 20 bp, Homo sapiens
ggctagtgtgagtggcagcc

SEQ ID NO: 1633309 - DNA, 21 bp, Homo sapiens
ggctagtgtgagtggcagcca

SEQ ID NO: 1633310 - DNA, 20 bp, Homo sapiens
ggctatacctggggacttga

SEQ ID NO: 1633311 - DNA, 23 bp, Homo sapiens
ggctataggtgctacaaaaacac

SEQ ID NO: 1633312 - DNA, 11 bp, Homo sapiens
ggctatattcc

SEQ ID NO: 1633313 - DNA, 15 bp, Homo sapiens
ggctattatttattg

SEQ ID NO: 1633314 - DNA, 21 bp, Homo sapiens
ggctattgaagatgctgcctg

SEQ ID NO: 1633315 - DNA, 16 bp, Homo sapiens
ggctatttctgtgtcc

SEQ ID NO: 1633316 - DNA, 13 bp, Homo sapiens
ggctatttgttca

SEQ ID NO: 1633317 - DNA, 17 bp, Homo sapiens
ggctcacaaggcccagg

SEQ ID NO: 1633318 - DNA, 18 bp, Homo sapiens
ggctcacaaggcccagga

SEQ ID NO: 1633319 - DNA, 18 bp, Homo sapiens
ggctcacacacctgtagc

SEQ ID NO: 1633320 - DNA, 14 bp, Homo sapiens
ggctcacactgaga

SEQ ID NO: 1633321 - DNA, 15 bp, Homo sapiens
ggctcacactgagaa

SEQ ID NO: 1633322 - DNA, 13 bp, Homo sapiens
ggctcacgcctgt

SEQ ID NO: 1633323 - DNA, 23 bp, Homo sapiens
ggctcacgcctgtaatcccagca

SEQ ID NO: 1633324 - DNA, 14 bp, Homo sapiens
ggctcactcagcca

SEQ ID NO: 1633325 - DNA, 19 bp, Homo sapiens
ggctcactgaaacctctgc

SEQ ID NO: 1633326 - DNA, 20 bp, Homo sapiens
ggctcactgccaggccagcc

SEQ ID NO: 1633327 - DNA, 12 bp, Homo sapiens
ggctcactggca

SEQ ID NO: 1633328 - DNA, 13 bp, Homo sapiens
ggctcactgtgct

SEQ ID NO: 1633329 - DNA, 13 bp, Homo sapiens
ggctcagaaggaa

SEQ ID NO: 1633330 - DNA, 14 bp, Homo sapiens
ggctcagagtgggg

SEQ ID NO: 1633331 - DNA, 13 bp, Homo sapiens
ggctcagcctggt

SEQ ID NO: 1633332 - DNA, 21 bp, Homo sapiens
ggctcagctcggggagcctta

SEQ ID NO: 1633333 - DNA, 12 bp, Homo sapiens
ggctcagggtgg

SEQ ID NO: 1633334 - DNA, 16 bp, Homo sapiens
ggctcagggttggcca

SEQ ID NO: 1633335 - DNA, 16 bp, Homo sapiens
ggctcaggtcacataa

SEQ ID NO: 1633336 - DNA, 15 bp, Homo sapiens
ggctcagtctcagga

SEQ ID NO: 1633337 - DNA, 17 bp, Homo sapiens
ggctcatgcctgtaatc

SEQ ID NO: 1633338 - DNA, 22 bp, Homo sapiens
ggctcatggcgtaatgggcctg

SEQ ID NO: 1633339 - DNA, 16 bp, Homo sapiens
ggctcatttaaaacag

SEQ ID NO: 1633340 - DNA, 16 bp, Homo sapiens
ggctccacacagcagt

SEQ ID NO: 1633341 - DNA, 22 bp, Homo sapiens
ggctccactcttgatctctctt

SEQ ID NO: 1633342 - DNA, 14 bp, Homo sapiens
ggctccagaaatgt

SEQ ID NO: 1633343 - DNA, 14 bp, Homo sapiens
ggctccagcatcca

SEQ ID NO: 1633344 - DNA, 14 bp, Homo sapiens
ggctccatgcacct

SEQ ID NO: 1633345 - DNA, 19 bp, Homo sapiens
ggctccatgcacctccctt

SEQ ID NO: 1633346 - DNA, 19 bp, Homo sapiens
ggctcccacaggcccttcc

SEQ ID NO: 1633347 - DNA, 20 bp, Homo sapiens
ggctcccacaggcccttcct

SEQ ID NO: 1633348 - DNA, 20 bp, Homo sapiens
ggctcccaggggtctccctg

SEQ ID NO: 1633349 - DNA, 21 bp, Homo sapiens
ggctcccaggggtctccctgg

SEQ ID NO: 1633350 - DNA, 19 bp, Homo sapiens
ggctcccatgaccatactg

SEQ ID NO: 1633351 - DNA, 21 bp, Homo sapiens
ggctcccatgggctgagtggg

SEQ ID NO: 1633352 - DNA, 19 bp, Homo sapiens
ggctcccatgtgagtccct

SEQ ID NO: 1633353 - DNA, 15 bp, Homo sapiens
ggctcccattcactc

SEQ ID NO: 1633354 - DNA, 18 bp, Homo sapiens
ggctcccattcactcttc

SEQ ID NO: 1633355 - DNA, 22 bp, Homo sapiens
ggctcccattcactcttccaga

SEQ ID NO: 1633356 - DNA, 13 bp, Homo sapiens
ggctccccacgag

SEQ ID NO: 1633357 - DNA, 22 bp, Homo sapiens
ggctccccacgagtcacctgca

SEQ ID NO: 1633358 - DNA, 21 bp, Homo sapiens
ggctccccatgtgtcctggtt

SEQ ID NO: 1633359 - DNA, 13 bp, Homo sapiens
ggctccccgcctc

SEQ ID NO: 1633360 - DNA, 20 bp, Homo sapiens
ggctcccctcccaggggagc

SEQ ID NO: 1633361 - DNA, 16 bp, Homo sapiens
ggctccctcctccagg

SEQ ID NO: 1633362 - DNA, 15 bp, Homo sapiens
ggctccctctctggt

SEQ ID NO: 1633363 - DNA, 13 bp, Homo sapiens
ggctccctgcccc

SEQ ID NO: 1633364 - DNA, 20 bp, Homo sapiens
ggctcctacctgtctgctgc

SEQ ID NO: 1633365 - DNA, 17 bp, Homo sapiens
ggctcctcccggtgccc

SEQ ID NO: 1633366 - DNA, 12 bp, Homo sapiens
ggctcctccttg

SEQ ID NO: 1633367 - DNA, 15 bp, Homo sapiens
ggctcctgagtgtca

SEQ ID NO: 1633368 - DNA, 9 bp, Homo sapiens
ggctcctgc

SEQ ID NO: 1633369 - DNA, 17 bp, Homo sapiens
ggctcctggaaccaatc

SEQ ID NO: 1633370 - DNA, 14 bp, Homo sapiens
ggctcctggctgcc

SEQ ID NO: 1633371 - DNA, 17 bp, Homo sapiens
ggctcctggctgccagg

SEQ ID NO: 1633372 - DNA, 20 bp, Homo sapiens
cacctgcctccaccagcaag

SEQ ID NO: 1633373 - DNA, 18 bp, Homo sapiens
cacctgcctgcagagcag

SEQ ID NO: 1633374 - DNA, 13 bp, Homo sapiens
cacctgcctggtg

SEQ ID NO: 1633375 - DNA, 23 bp, Homo sapiens
cacctgcctggtgcattgctgtg

SEQ ID NO: 1633376 - DNA, 11 bp, Homo sapiens
cacctgctcca

SEQ ID NO: 1633377 - DNA, 13 bp, Homo sapiens
cacctgctccaga

SEQ ID NO: 1633378 - DNA, 15 bp, Homo sapiens
cacctgctccagaag

SEQ ID NO: 1633379 - DNA, 12 bp, Homo sapiens
cacctgctccca

SEQ ID NO: 1633380 - DNA, 16 bp, Homo sapiens
cacctgctcttcccag

SEQ ID NO: 1633381 - DNA, 22 bp, Homo sapiens
cacctgctgagagacccaagga

SEQ ID NO: 1633382 - DNA, 16 bp, Homo sapiens
cacctgctgcgtcccc

SEQ ID NO: 1633383 - DNA, 22 bp, Homo sapiens
cacctgctgcgtccccactccc

SEQ ID NO: 1633384 - DNA, 23 bp, Homo sapiens
cacctgctggttgttgccaggtt

SEQ ID NO: 1633385 - DNA, 13 bp, Homo sapiens
cacctgcttctga

SEQ ID NO: 1633386 - DNA, 14 bp, Homo sapiens
cacctgcttctgaa

SEQ ID NO: 1633387 - DNA, 19 bp, Homo sapiens
cacctggacgaagagcagg

SEQ ID NO: 1633388 - DNA, 10 bp, Homo sapiens
cacctggaga

SEQ ID NO: 1633389 - DNA, 19 bp, Homo sapiens
cacctggaggggcaccagg

SEQ ID NO: 1633390 - DNA, 23 bp, Homo sapiens
cacctggcatcgcaccattctga

SEQ ID NO: 1633391 - DNA, 14 bp, Homo sapiens
cacctggccacctg

SEQ ID NO: 1633392 - DNA, 17 bp, Homo sapiens
cacctggccacctgagg

SEQ ID NO: 1633393 - DNA, 20 bp, Homo sapiens
cacctggccccatgtctctc

SEQ ID NO: 1633394 - DNA, 14 bp, Homo sapiens
ggccctggccagga

SEQ ID NO: 1633395 - DNA, 12 bp, Homo sapiens
ggccctggccct

SEQ ID NO: 1633396 - DNA, 17 bp, Homo sapiens
ggccctggcctcccctg

SEQ ID NO: 1633397 - DNA, 14 bp, Homo sapiens
ggccctggcctgct

SEQ ID NO: 1633398 - DNA, 17 bp, Homo sapiens
ggccctggcctgctggg

SEQ ID NO: 1633399 - DNA, 13 bp, Homo sapiens
ggccctggctccc

SEQ ID NO: 1633400 - DNA, 18 bp, Homo sapiens
ggccctggcttggaggct

SEQ ID NO: 1633401 - DNA, 16 bp, Homo sapiens
ggccctgggctgatgg

SEQ ID NO: 1633402 - DNA, 13 bp, Homo sapiens
ggccctgggctgg

SEQ ID NO: 1633403 - DNA, 22 bp, Homo sapiens
ggccctggggatcttcccacag

SEQ ID NO: 1633404 - DNA, 15 bp, Homo sapiens
ggccctggtcctggc

SEQ ID NO: 1633405 - DNA, 15 bp, Homo sapiens
ggccctggtgtcagg

SEQ ID NO: 1633406 - DNA, 17 bp, Homo sapiens
ggccctggttcctgctg

SEQ ID NO: 1633407 - DNA, 16 bp, Homo sapiens
ggccctgtgcctgggc

SEQ ID NO: 1633408 - DNA, 13 bp, Homo sapiens
ggccctgtggagt

SEQ ID NO: 1633409 - DNA, 20 bp, Homo sapiens
ggccctgtggagtccagctc

SEQ ID NO: 1633410 - DNA, 15 bp, Homo sapiens
ggccctgtggcagga

SEQ ID NO: 1633411 - DNA, 18 bp, Homo sapiens
ggccctgttccctggagt

SEQ ID NO: 1633412 - DNA, 21 bp, Homo sapiens
ggcccttcagtctgctccacc

SEQ ID NO: 1633413 - DNA, 22 bp, Homo sapiens
ggcccttcccattctgccccag

SEQ ID NO: 1633414 - DNA, 15 bp, Homo sapiens
ggcccttcccctccc

SEQ ID NO: 1633415 - DNA, 20 bp, Homo sapiens
ggcccttcccctcccccact

SEQ ID NO: 1633416 - DNA, 23 bp, Homo sapiens
ggcccttctgactgtttatttaa

SEQ ID NO: 1633417 - DNA, 19 bp, Homo sapiens
ggcccttgggccacgctct

SEQ ID NO: 1633418 - DNA, 16 bp, Homo sapiens
ggcccttggggcctgg

SEQ ID NO: 1633419 - DNA, 15 bp, Homo sapiens
ggcccttgtcctgcc

SEQ ID NO: 1633420 - DNA, 19 bp, Homo sapiens
ggcccttgtcctgccagct

SEQ ID NO: 1633421 - DNA, 21 bp, Homo sapiens
ggcccttgtcctgccagctgc

SEQ ID NO: 1633422 - DNA, 11 bp, Homo sapiens
ggccctttggc

SEQ ID NO: 1633423 - DNA, 16 bp, Homo sapiens
ggccctttttcccttc

SEQ ID NO: 1633424 - DNA, 22 bp, Homo sapiens
ggccctttttcccttccctcct

SEQ ID NO: 1633425 - DNA, 17 bp, Homo sapiens
ggccgaagccccttgga

SEQ ID NO: 1633426 - DNA, 18 bp, Homo sapiens
ggccgaagccccttggag

SEQ ID NO: 1633427 - DNA, 20 bp, Homo sapiens
ggccgaagccccttggagag

SEQ ID NO: 1633428 - DNA, 15 bp, Homo sapiens
ggccgaagctctggc

SEQ ID NO: 1633429 - DNA, 17 bp, Homo sapiens
ggccgaagctctggctg

SEQ ID NO: 1633430 - DNA, 18 bp, Homo sapiens
ggccgaaggtgcctcaga

SEQ ID NO: 1633431 - DNA, 14 bp, Homo sapiens
ggccgaccaggctg

SEQ ID NO: 1633432 - DNA, 23 bp, Homo sapiens
ggccgaccaggctggacaccctc

SEQ ID NO: 1633433 - DNA, 18 bp, Homo sapiens
ggccgagcggtggccccg

SEQ ID NO: 1633434 - DNA, 12 bp, Homo sapiens
ggccgaggccca

SEQ ID NO: 1633435 - DNA, 16 bp, Homo sapiens
ggccgaggcccagcgg

SEQ ID NO: 1633436 - DNA, 19 bp, Homo sapiens
ggccgaggcccagcgggca

SEQ ID NO: 1633437 - DNA, 21 bp, Homo sapiens
ggccgaggcccagcgggcaga

SEQ ID NO: 1633438 - DNA, 12 bp, Homo sapiens
ggccgaggcggg

SEQ ID NO: 1633439 - DNA, 14 bp, Homo sapiens
ggccgaggcgggtg

SEQ ID NO: 1633440 - DNA, 18 bp, Homo sapiens
ggccgagggtcctggctc

SEQ ID NO: 1633441 - DNA, 15 bp, Homo sapiens
ggccgaggtgggcag

SEQ ID NO: 1633442 - DNA, 17 bp, Homo sapiens
ggccgcacgcctctccc

SEQ ID NO: 1633443 - DNA, 21 bp, Homo sapiens
ggccgcagctcttgcccttcc

SEQ ID NO: 1633444 - DNA, 17 bp, Homo sapiens
ggccgccacggcctggc

SEQ ID NO: 1633445 - DNA, 22 bp, Homo sapiens
ggccgccacggcctggctggtg

SEQ ID NO: 1633446 - DNA, 17 bp, Homo sapiens
ggccgccagcgtgtgga

SEQ ID NO: 1633447 - DNA, 22 bp, Homo sapiens
ggccgccccctgccccccagcc

SEQ ID NO: 1633448 - DNA, 21 bp, Homo sapiens
ggccgcccgggcccagaggag

SEQ ID NO: 1633449 - DNA, 14 bp, Homo sapiens
ggccgcctggcagg

SEQ ID NO: 1633450 - DNA, 14 bp, Homo sapiens
ggccgcgagaggcc

SEQ ID NO: 1633451 - DNA, 16 bp, Homo sapiens
ggccgcgccctttccc

SEQ ID NO: 1633452 - DNA, 14 bp, Homo sapiens
ggccgctagaggcc

SEQ ID NO: 1633453 - DNA, 18 bp, Homo sapiens
ggccgctagaggcctgag

SEQ ID NO: 1633454 - DNA, 19 bp, Homo sapiens
ggccgctagaggcctgagg

SEQ ID NO: 1633455 - DNA, 21 bp, Homo sapiens
ggccgctagaggcctgaggat

SEQ ID NO: 1633456 - DNA, 19 bp, Homo sapiens
ggccgctccaccagcatca

SEQ ID NO: 1633457 - DNA, 21 bp, Homo sapiens
ggccgctcttcccccatgtgc

SEQ ID NO: 1633458 - DNA, 17 bp, Homo sapiens
ggccgctgagtggcagg

SEQ ID NO: 1633459 - DNA, 18 bp, Homo sapiens
ggccgctgctttgcgctg

SEQ ID NO: 1633460 - DNA, 20 bp, Homo sapiens
ggccgctgctttgcgctggt

SEQ ID NO: 1633461 - DNA, 17 bp, Homo sapiens
ggccggacgcaggtgct

SEQ ID NO: 1633462 - DNA, 16 bp, Homo sapiens
ggccggacgcatctca

SEQ ID NO: 1633463 - DNA, 14 bp, Homo sapiens
ggccggagcccaga

SEQ ID NO: 1633464 - DNA, 13 bp, Homo sapiens
ggccggccctggc

SEQ ID NO: 1633465 - DNA, 14 bp, Homo sapiens
ggccggccctggct

SEQ ID NO: 1633466 - DNA, 22 bp, Homo sapiens
ggccggcttctgcctggggtgc

SEQ ID NO: 1633467 - DNA, 15 bp, Homo sapiens
ggccgggcacagtgg

SEQ ID NO: 1633468 - DNA, 20 bp, Homo sapiens
ggccgggccctctgtagctc

SEQ ID NO: 1633469 - DNA, 23 bp, Homo sapiens
ggccgggctgtagatcaggtttg

SEQ ID NO: 1633470 - DNA, 20 bp, Homo sapiens
ggccgggcttgggccctgca

SEQ ID NO: 1633471 - DNA, 14 bp, Homo sapiens
ggccgtaccccacc

SEQ ID NO: 1633472 - DNA, 20 bp, Homo sapiens
ggccgtaggggctcctgagt

SEQ ID NO: 1633473 - DNA, 14 bp, Homo sapiens
ggccgtcctcccgg

SEQ ID NO: 1633474 - DNA, 20 bp, Homo sapiens
ggccgtcctcccgggccctc

SEQ ID NO: 1633475 - DNA, 21 bp, Homo sapiens
ggccgtcctcccgggccctcc

SEQ ID NO: 1633476 - DNA, 16 bp, Homo sapiens
ggccgtgggggttgag

SEQ ID NO: 1633477 - DNA, 13 bp, Homo sapiens
ggccgtgtcccgc

SEQ ID NO: 1633478 - DNA, 18 bp, Homo sapiens
ggccgttccccttggctt

SEQ ID NO: 1633479 - DNA, 22 bp, Homo sapiens
ggccgttccccttggcttcctc

SEQ ID NO: 1633480 - DNA, 16 bp, Homo sapiens
ggcctaaaagtaaaca

SEQ ID NO: 1633481 - DNA, 14 bp, Homo sapiens
ggcctaagacatgt

SEQ ID NO: 1633482 - DNA, 23 bp, Homo sapiens
ggcctaatctcatacctctgacc

SEQ ID NO: 1633483 - DNA, 13 bp, Homo sapiens
ggcctagactctg

SEQ ID NO: 1633484 - DNA, 18 bp, Homo sapiens
ggcctagactctgtctac

SEQ ID NO: 1633485 - DNA, 16 bp, Homo sapiens
ggcctagcaggcacag

SEQ ID NO: 1633486 - DNA, 19 bp, Homo sapiens
ggcctagcaggcacaggac

SEQ ID NO: 1633487 - DNA, 15 bp, Homo sapiens
ggcctaggattctaa

SEQ ID NO: 1633488 - DNA, 15 bp, Homo sapiens
ggcctaggcacctcc

SEQ ID NO: 1633489 - DNA, 17 bp, Homo sapiens
ggcctaggggccagggc

SEQ ID NO: 1633490 - DNA, 22 bp, Homo sapiens
ggcctataaaattaaatgcctt

SEQ ID NO: 1633491 - DNA, 21 bp, Homo sapiens
ggcctatgcacatatggactc

SEQ ID NO: 1633492 - DNA, 14 bp, Homo sapiens
ggcctatgtggtct

SEQ ID NO: 1633493 - DNA, 19 bp, Homo sapiens
ggcctcaaaggcccgctct

SEQ ID NO: 1633494 - DNA, 22 bp, Homo sapiens
ggcctcaaagttggggcaggct

SEQ ID NO: 1633495 - DNA, 17 bp, Homo sapiens
ggcctcacccacccctg

SEQ ID NO: 1633496 - DNA, 19 bp, Homo sapiens
ggcctcactggctggggca

SEQ ID NO: 1633497 - DNA, 10 bp, Homo sapiens
ggcctcagaa

SEQ ID NO: 1633498 - DNA, 17 bp, Homo sapiens
ggcctcagggcgctcag

SEQ ID NO: 1633499 - DNA, 19 bp, Homo sapiens
ggcctcagggcgctcagac

SEQ ID NO: 1633500 - DNA, 22 bp, Homo sapiens
ggcctcagggcgctcagacggc

SEQ ID NO: 1633501 - DNA, 17 bp, Homo sapiens
ggcctcaggtgctgtcc

SEQ ID NO: 1633502 - DNA, 18 bp, Homo sapiens
ggcctcaggtgctgtcca

SEQ ID NO: 1633503 - DNA, 20 bp, Homo sapiens
ggcctcagttcccagctccc

SEQ ID NO: 1633504 - DNA, 15 bp, Homo sapiens
ggcctcatccctcgg

SEQ ID NO: 1633505 - DNA, 18 bp, Homo sapiens
ggcctcatgctggaggga

SEQ ID NO: 1633506 - DNA, 19 bp, Homo sapiens
ggcctccaacgcccctgtg

SEQ ID NO: 1633507 - DNA, 21 bp, Homo sapiens
ggcctccactcccccacctga

SEQ ID NO: 1633508 - DNA, 13 bp, Homo sapiens
ggcctccagcctc

SEQ ID NO: 1633509 - DNA, 17 bp, Homo sapiens
gaaccaagcttcagagc

SEQ ID NO: 1633510 - DNA, 22 bp, Homo sapiens
gaaccaagcttcagagcctagc

SEQ ID NO: 1633511 - DNA, 23 bp, Homo sapiens
gaaccaagcttcagagcctagcc

SEQ ID NO: 1633512 - DNA, 17 bp, Homo sapiens
gaaccaaggcagcctcc

SEQ ID NO: 1633513 - DNA, 20 bp, Homo sapiens
gaaccaaggcagcctccaga

SEQ ID NO: 1633514 - DNA, 23 bp, Homo sapiens
gaaccaaggcagcctccagagcc

SEQ ID NO: 1633515 - DNA, 24 bp, Homo sapiens
gaaccaagtggaccttgagaccac

SEQ ID NO: 1633516 - DNA, 16 bp, Homo sapiens
gaaccactgcttctct

SEQ ID NO: 1633517 - DNA, 18 bp, Homo sapiens
gaaccactgcttctcttt

SEQ ID NO: 1633518 - DNA, 13 bp, Homo sapiens
gaaccagagccac

SEQ ID NO: 1633519 - DNA, 17 bp, Homo sapiens
gaaccagccggggcctt

SEQ ID NO: 1633520 - DNA, 21 bp, Homo sapiens
gaaccaggaaatggaacccca

SEQ ID NO: 1633521 - DNA, 21 bp, Homo sapiens
gaaccatagttactgtaaaat

SEQ ID NO: 1633522 - DNA, 20 bp, Homo sapiens
gaaccatcattataaacgtg

SEQ ID NO: 1633523 - DNA, 22 bp, Homo sapiens
gaacccacataaaagccccagc

SEQ ID NO: 1633524 - DNA, 17 bp, Homo sapiens
gaacccaccaaccagaa

SEQ ID NO: 1633525 - DNA, 14 bp, Homo sapiens
gaacccacctgctg

SEQ ID NO: 1633526 - DNA, 17 bp, Homo sapiens
gaacccagactcagaca

SEQ ID NO: 1633527 - DNA, 15 bp, Homo sapiens
gaaccccagaggcag

SEQ ID NO: 1633528 - DNA, 14 bp, Homo sapiens
gaaccccgcagccc

SEQ ID NO: 1633529 - DNA, 14 bp, Homo sapiens
gaacccctggccag

SEQ ID NO: 1633530 - DNA, 15 bp, Homo sapiens
gaacccctggccagc

SEQ ID NO: 1633531 - DNA, 18 bp, Homo sapiens
gaacccgggggacagagg

SEQ ID NO: 1633532 - DNA, 20 bp, Homo sapiens
gaacccggtgctccctctgt

SEQ ID NO: 1633533 - DNA, 17 bp, Homo sapiens
gaaccctagctgtgtca

SEQ ID NO: 1633534 - DNA, 20 bp, Homo sapiens
gaaccctatacttggtttgc

SEQ ID NO: 1633535 - DNA, 14 bp, Homo sapiens
gaaccctgagcagg

SEQ ID NO: 1633536 - DNA, 13 bp, Homo sapiens
gaaccctgtgctg

SEQ ID NO: 1633537 - DNA, 23 bp, Homo sapiens
gaaccctgtgctggtgtcctgac

SEQ ID NO: 1633538 - DNA, 22 bp, Homo sapiens
gaacccttgcatccattgttgt

SEQ ID NO: 1633539 - DNA, 17 bp, Homo sapiens
gaaccgagcaaagatca

SEQ ID NO: 1633540 - DNA, 13 bp, Homo sapiens
gaaccgcacagct

SEQ ID NO: 1633541 - DNA, 20 bp, Homo sapiens
gaacctaactccccacccca

SEQ ID NO: 1633542 - DNA, 20 bp, Homo sapiens
gaacctacagactccatctc

SEQ ID NO: 1633543 - DNA, 19 bp, Homo sapiens
gaacctacagttttaactg

SEQ ID NO: 1633544 - DNA, 20 bp, Homo sapiens
gaacctaccagttggccatg

SEQ ID NO: 1633545 - DNA, 19 bp, Homo sapiens
gaacctagtactctctgct

SEQ ID NO: 1633546 - DNA, 20 bp, Homo sapiens
gaacctagtactctctgctc

SEQ ID NO: 1633547 - DNA, 15 bp, Homo sapiens
gaacctattttcatt

SEQ ID NO: 1633548 - DNA, 18 bp, Homo sapiens
gaacctattttcatttgt

SEQ ID NO: 1633549 - DNA, 12 bp, Homo sapiens
gaacctcagcct

SEQ ID NO: 1633550 - DNA, 13 bp, Homo sapiens
gaacctcagcctg

SEQ ID NO: 1633551 - DNA, 21 bp, Homo sapiens
aggctagtcttgaatttctga

SEQ ID NO: 1633552 - DNA, 16 bp, Homo sapiens
aggctatgagtgggat

SEQ ID NO: 1633553 - DNA, 22 bp, Homo sapiens
aggctatggggtaggagaaaag

SEQ ID NO: 1633554 - DNA, 16 bp, Homo sapiens
aggctatgtataaaat

SEQ ID NO: 1633555 - DNA, 17 bp, Homo sapiens
aggctatgtataaaata

SEQ ID NO: 1633556 - DNA, 18 bp, Homo sapiens
aggctattattttcactg

SEQ ID NO: 1633557 - DNA, 13 bp, Homo sapiens
aggctcactgcca

SEQ ID NO: 1633558 - DNA, 16 bp, Homo sapiens
aggctcactgccaggc

SEQ ID NO: 1633559 - DNA, 19 bp, Homo sapiens
aggctcactgccaggccag

SEQ ID NO: 1633560 - DNA, 21 bp, Homo sapiens
aggctcactgccaggccagcc

SEQ ID NO: 1633561 - DNA, 17 bp, Homo sapiens
aggctcagtctcaggag

SEQ ID NO: 1633562 - DNA, 18 bp, Homo sapiens
aggctcagtggtgggaga

SEQ ID NO: 1633563 - DNA, 22 bp, Homo sapiens
aggctcatctttctgcccggct

SEQ ID NO: 1633564 - DNA, 15 bp, Homo sapiens
aggctcatttaaaac

SEQ ID NO: 1633565 - DNA, 16 bp, Homo sapiens
aggctcatttaaaaca

SEQ ID NO: 1633566 - DNA, 17 bp, Homo sapiens
aggctcatttaaaacag

SEQ ID NO: 1633567 - DNA, 18 bp, Homo sapiens
aggctcatttaaaacagg

SEQ ID NO: 1633568 - DNA, 22 bp, Homo sapiens
aggctccatgcacctcccttcc

SEQ ID NO: 1633569 - DNA, 22 bp, Homo sapiens
aggctcccatgtgagtccctgt

SEQ ID NO: 1633570 - DNA, 13 bp, Homo sapiens
aggctccccgcct

SEQ ID NO: 1633571 - DNA, 21 bp, Homo sapiens
aggctcctacctgtctgctgc

SEQ ID NO: 1633572 - DNA, 22 bp, Homo sapiens
aggctcctacctgtctgctgcc

SEQ ID NO: 1633573 - DNA, 23 bp, Homo sapiens
aggctcctacctgtctgctgcca

SEQ ID NO: 1633574 - DNA, 12 bp, Homo sapiens
aggctcctcctt

SEQ ID NO: 1633575 - DNA, 14 bp, Homo sapiens
aggctcctccttgc

SEQ ID NO: 1633576 - DNA, 19 bp, Homo sapiens
aggctcctccttgcccaga

SEQ ID NO: 1633577 - DNA, 17 bp, Homo sapiens
aggctcctggctgtgcc

SEQ ID NO: 1633578 - DNA, 20 bp, Homo sapiens
aggctcctggctgtgcccag

SEQ ID NO: 1633579 - DNA, 22 bp, Homo sapiens
aggctcctgttttgcacagcca

SEQ ID NO: 1633580 - DNA, 13 bp, Homo sapiens
aggctccttcctg

SEQ ID NO: 1633581 - DNA, 15 bp, Homo sapiens
aggctccttcctgtc

SEQ ID NO: 1633582 - DNA, 19 bp, Homo sapiens
aggctctatgagtctagat

SEQ ID NO: 1633583 - DNA, 15 bp, Homo sapiens
aggctctcaccccca

SEQ ID NO: 1633584 - DNA, 22 bp, Homo sapiens
aggctctcactaccgtggacca

SEQ ID NO: 1633585 - DNA, 20 bp, Homo sapiens
aggctctcgctgccctgtgg

SEQ ID NO: 1633586 - DNA, 23 bp, Homo sapiens
aggctctctctttctagaggtgc

SEQ ID NO: 1633587 - DNA, 18 bp, Homo sapiens
aggctctgaaagccagct

SEQ ID NO: 1633588 - DNA, 19 bp, Homo sapiens
aggctctgagagtctagat

SEQ ID NO: 1633589 - DNA, 22 bp, Homo sapiens
aggctctgagagtctagattct

SEQ ID NO: 1633590 - DNA, 23 bp, Homo sapiens
aggctctgagagtctagattctc

SEQ ID NO: 1633591 - DNA, 16 bp, Homo sapiens
aggctctgaggggcac

SEQ ID NO: 1633592 - DNA, 17 bp, Homo sapiens
aggctctgaggggcacg

SEQ ID NO: 1633593 - DNA, 13 bp, Homo sapiens
aggctctgcacag

SEQ ID NO: 1633594 - DNA, 22 bp, Homo sapiens
aggctctgcacagacaagcagc

SEQ ID NO: 1633595 - DNA, 23 bp, Homo sapiens
aggctctgcacagacaagcagcc

SEQ ID NO: 1633596 - DNA, 11 bp, Homo sapiens
aggctctgccc

SEQ ID NO: 1633597 - DNA, 17 bp, Homo sapiens
aggctctgccctgccct

SEQ ID NO: 1633598 - DNA, 12 bp, Homo sapiens
aggctctgggct

SEQ ID NO: 1633599 - DNA, 16 bp, Homo sapiens
aggctctgggctcagg

SEQ ID NO: 1633600 - DNA, 19 bp, Homo sapiens
aggctctgggctcagggct

SEQ ID NO: 1633601 - DNA, 18 bp, Homo sapiens
aggctcttaagcagcatg

SEQ ID NO: 1633602 - DNA, 19 bp, Homo sapiens
aggctcttaagcagcatgg

SEQ ID NO: 1633603 - DNA, 18 bp, Homo sapiens
aggctcttcctggacctg

SEQ ID NO: 1633604 - DNA, 20 bp, Homo sapiens
aggctcttcctggacctgag

SEQ ID NO: 1633605 - DNA, 13 bp, Homo sapiens
aggctgaaaagaa

SEQ ID NO: 1633606 - DNA, 13 bp, Homo sapiens
aggctgaaagagg

SEQ ID NO: 1633607 - DNA, 16 bp, Homo sapiens
aggctgaaagaggcca

SEQ ID NO: 1633608 - DNA, 19 bp, Homo sapiens
aggctgaagagagggacag

SEQ ID NO: 1633609 - DNA, 22 bp, Homo sapiens
aggctgaccaagagagaaagaa

SEQ ID NO: 1633610 - DNA, 16 bp, Homo sapiens
aggctgacgtgtgagg

SEQ ID NO: 1633611 - DNA, 21 bp, Homo sapiens
aggctgagaactcgttcacct

SEQ ID NO: 1633612 - DNA, 20 bp, Homo sapiens
aggctgagaaggaacaggga

SEQ ID NO: 1633613 - DNA, 17 bp, Homo sapiens
aggctgagactgcggga

SEQ ID NO: 1633614 - DNA, 23 bp, Homo sapiens
aggctgagagccagatgcctccc

SEQ ID NO: 1633615 - DNA, 14 bp, Homo sapiens
aggctgagccatga

SEQ ID NO: 1633616 - DNA, 18 bp, Homo sapiens
aggctgaggcaagagaat

SEQ ID NO: 1633617 - DNA, 17 bp, Homo sapiens
aggctgaggcagaagaa

SEQ ID NO: 1633618 - DNA, 17 bp, Homo sapiens
aggctgaggcaggagaa

SEQ ID NO: 1633619 - DNA, 15 bp, Homo sapiens
aggctgaggcctgga

SEQ ID NO: 1633620 - DNA, 17 bp, Homo sapiens
aggctgaggcctggact

SEQ ID NO: 1633621 - DNA, 17 bp, Homo sapiens
aggctgagtgagccaca

SEQ ID NO: 1633622 - DNA, 18 bp, Homo sapiens
aggctgagtgagccacag

SEQ ID NO: 1633623 - DNA, 22 bp, Homo sapiens
aggctgagtgagccacagacca

SEQ ID NO: 1633624 - DNA, 19 bp, Homo sapiens
aggctgcaatgagccatga

SEQ ID NO: 1633625 - DNA, 14 bp, Homo sapiens
aggctgcacagcat

SEQ ID NO: 1633626 - DNA, 13 bp, Homo sapiens
aggctgcactgca

SEQ ID NO: 1633627 - DNA, 20 bp, Homo sapiens
aggctgcagagctgacccag

SEQ ID NO: 1633628 - DNA, 21 bp, Homo sapiens
aggctgcagaggcacctcaac

SEQ ID NO: 1633629 - DNA, 20 bp, Homo sapiens
aggctgcagccgtggtccaa

SEQ ID NO: 1633630 - DNA, 15 bp, Homo sapiens
aggctgcagcctcca

SEQ ID NO: 1633631 - DNA, 17 bp, Homo sapiens
aggctgcagcctccact

SEQ ID NO: 1633632 - DNA, 15 bp, Homo sapiens
aggctgcagcgagct

SEQ ID NO: 1633633 - DNA, 18 bp, Homo sapiens
aggctgcagtcagccctg

SEQ ID NO: 1633634 - DNA, 21 bp, Homo sapiens
aggctgcagtcagtcatgatg

SEQ ID NO: 1633635 - DNA, 17 bp, Homo sapiens
aggctgcatgctctgga

SEQ ID NO: 1633636 - DNA, 19 bp, Homo sapiens
aggctgcatgctctggaag

SEQ ID NO: 1633637 - DNA, 17 bp, Homo sapiens
aggctgccaaggccaga

SEQ ID NO: 1633638 - DNA, 19 bp, Homo sapiens
aggctgccccaggccggag

SEQ ID NO: 1633639 - DNA, 16 bp, Homo sapiens
aggctgcctcagccag

SEQ ID NO: 1633640 - DNA, 22 bp, Homo sapiens
aggctgcctcagccagtggcac

SEQ ID NO: 1633641 - DNA, 23 bp, Homo sapiens
aggctgcctcagccagtggcaca

SEQ ID NO: 1633642 - DNA, 17 bp, Homo sapiens
aggctgcctcctgccct

SEQ ID NO: 1633643 - DNA, 18 bp, Homo sapiens
aggctgcctcggactcca

SEQ ID NO: 1633644 - DNA, 18 bp, Homo sapiens
aggctgcctctcccatca

SEQ ID NO: 1633645 - DNA, 12 bp, Homo sapiens
aggctgctgcca

SEQ ID NO: 1633646 - DNA, 22 bp, Homo sapiens
aggctgcttcccagaggagcag

SEQ ID NO: 1633647 - DNA, 18 bp, Homo sapiens
aggctggacaccctctgc

SEQ ID NO: 1633648 - DNA, 20 bp, Homo sapiens
aggctggacaccctctgccg

SEQ ID NO: 1633649 - DNA, 15 bp, Homo sapiens
aggctggaggaaggg

SEQ ID NO: 1633650 - DNA, 13 bp, Homo sapiens
aggctggaggcag

SEQ ID NO: 1633651 - DNA, 14 bp, Homo sapiens
aggctggaggcagg

SEQ ID NO: 1633652 - DNA, 16 bp, Homo sapiens
aggctggaggcagggc

SEQ ID NO: 1633653 - DNA, 23 bp, Homo sapiens
aggctggaggcagggccttgccc

SEQ ID NO: 1633654 - DNA, 20 bp, Homo sapiens
aggctggagtgcagtggcgt

SEQ ID NO: 1633655 - DNA, 15 bp, Homo sapiens
aggctggcaggtatg

SEQ ID NO: 1633656 - DNA, 21 bp, Homo sapiens
aggctggccagtccaggctgc

SEQ ID NO: 1633657 - DNA, 21 bp, Homo sapiens
aggctggcctatgtggtctaa

SEQ ID NO: 1633658 - DNA, 14 bp, Homo sapiens
aggctggcgcagcc

SEQ ID NO: 1633659 - DNA, 19 bp, Homo sapiens
aggctggcgcagccaaggc

SEQ ID NO: 1633660 - DNA, 18 bp, Homo sapiens
aggctgggccatgtccaa

SEQ ID NO: 1633661 - DNA, 22 bp, Homo sapiens
aggctgggcctcccctgggcag

SEQ ID NO: 1633662 - DNA, 17 bp, Homo sapiens
aggctggtaagagaagt

SEQ ID NO: 1633663 - DNA, 19 bp, Homo sapiens
aggctggtaagagaagtga

SEQ ID NO: 1633664 - DNA, 19 bp, Homo sapiens
aggctggtacaacggaggc

SEQ ID NO: 1633665 - DNA, 21 bp, Homo sapiens
aggctggtacaacggaggcct

SEQ ID NO: 1633666 - DNA, 17 bp, Homo sapiens
gaacctcagcctggcca

SEQ ID NO: 1633667 - DNA, 19 bp, Homo sapiens
gaacctcagcctggccaga

SEQ ID NO: 1633668 - DNA, 15 bp, Homo sapiens
gaacctcatccagct

SEQ ID NO: 1633669 - DNA, 20 bp, Homo sapiens
gaacctgcaagccttctaaa

SEQ ID NO: 1633670 - DNA, 22 bp, Homo sapiens
gaacctgcacacaggacagcgg

SEQ ID NO: 1633671 - DNA, 23 bp, Homo sapiens
gaacctgggaaagagatttaaac

SEQ ID NO: 1633672 - DNA, 16 bp, Homo sapiens
gaacctgtcctaagga

SEQ ID NO: 1633673 - DNA, 12 bp, Homo sapiens
gaacctgtcctt

SEQ ID NO: 1633674 - DNA, 16 bp, Homo sapiens
gaacgaaaatgaaagc

SEQ ID NO: 1633675 - DNA, 22 bp, Homo sapiens
gaacgagcactggccagagagg

SEQ ID NO: 1633676 - DNA, 12 bp, Homo sapiens
gaacgagcagcc

SEQ ID NO: 1633677 - DNA, 14 bp, Homo sapiens
gaacgagcagccca

SEQ ID NO: 1633678 - DNA, 18 bp, Homo sapiens
gaacgagcagcccagggc

SEQ ID NO: 1633679 - DNA, 19 bp, Homo sapiens
gaacgagcagcccagggcc

SEQ ID NO: 1633680 - DNA, 18 bp, Homo sapiens
gaacgatttagaaagaag

SEQ ID NO: 1633681 - DNA, 16 bp, Homo sapiens
gaacgcagaagaaagg

SEQ ID NO: 1633682 - DNA, 21 bp, Homo sapiens
gaacgctcttagctttctcag

SEQ ID NO: 1633683 - DNA, 15 bp, Homo sapiens
gaacggggagaaaag

SEQ ID NO: 1633684 - DNA, 22 bp, Homo sapiens
gaacgtgactgccccaactcct

SEQ ID NO: 1633685 - DNA, 13 bp, Homo sapiens
gaacgtgcttctt

SEQ ID NO: 1633686 - DNA, 18 bp, Homo sapiens
gaacgttttcttctttcc

SEQ ID NO: 1633687 - DNA, 19 bp, Homo sapiens
gaacgttttcttctttccc

SEQ ID NO: 1633688 - DNA, 17 bp, Homo sapiens
gaactaaactcatttat

SEQ ID NO: 1633689 - DNA, 15 bp, Homo sapiens
gaactaataaaagca

SEQ ID NO: 1633690 - DNA, 15 bp, Homo sapiens
gaactacatatttgt

SEQ ID NO: 1633691 - DNA, 18 bp, Homo sapiens
gaactagccaaaccagga

SEQ ID NO: 1633692 - DNA, 16 bp, Homo sapiens
gaactagggaagctca

SEQ ID NO: 1633693 - DNA, 15 bp, Homo sapiens
gaactatgctaattt

SEQ ID NO: 1633694 - DNA, 15 bp, Homo sapiens
gaactattggagggt

SEQ ID NO: 1633695 - DNA, 16 bp, Homo sapiens
gaactcaaatggggcc

SEQ ID NO: 1633696 - DNA, 20 bp, Homo sapiens
gaactcaaatggggccagat

SEQ ID NO: 1633697 - DNA, 22 bp, Homo sapiens
gaactcaaatggggccagatcc

SEQ ID NO: 1633698 - DNA, 23 bp, Homo sapiens
gaactcaaatggggccagatcca

SEQ ID NO: 1633699 - DNA, 15 bp, Homo sapiens
gaactcaactttgac

SEQ ID NO: 1633700 - DNA, 13 bp, Homo sapiens
gaactcaagctgc

SEQ ID NO: 1633701 - DNA, 21 bp, Homo sapiens
gaactcaatctccagggctcc

SEQ ID NO: 1633702 - DNA, 16 bp, Homo sapiens
gaactcaccctgggag

SEQ ID NO: 1633703 - DNA, 16 bp, Homo sapiens
gaactcactctgggct

SEQ ID NO: 1633704 - DNA, 17 bp, Homo sapiens
gaactcactctgggctg

SEQ ID NO: 1633705 - DNA, 14 bp, Homo sapiens
gaactcactggggc

SEQ ID NO: 1633706 - DNA, 14 bp, Homo sapiens
gaactcagatccag

SEQ ID NO: 1633707 - DNA, 16 bp, Homo sapiens
gaactcagatccaggg

SEQ ID NO: 1633708 - DNA, 21 bp, Homo sapiens
gaactcagatccagggacaga

SEQ ID NO: 1633709 - DNA, 20 bp, Homo sapiens
gaactcagcacattcgggac

SEQ ID NO: 1633710 - DNA, 21 bp, Homo sapiens
gaactcagcagttgacatcca

SEQ ID NO: 1633711 - DNA, 22 bp, Homo sapiens
gaactcattcctgcctgtctcc

SEQ ID NO: 1633712 - DNA, 22 bp, Homo sapiens
gaactccaccgaccaactgccc

SEQ ID NO: 1633713 - DNA, 23 bp, Homo sapiens
gaactccaccgaccaactgccct

SEQ ID NO: 1633714 - DNA, 17 bp, Homo sapiens
gaactccaggccctcct

SEQ ID NO: 1633715 - DNA, 23 bp, Homo sapiens
gaactccaggccctcctctccca

SEQ ID NO: 1633716 - DNA, 14 bp, Homo sapiens
gaactccatacagc

SEQ ID NO: 1633717 - DNA, 17 bp, Homo sapiens
gaactcctgccatagtc

SEQ ID NO: 1633718 - DNA, 20 bp, Homo sapiens
gaactcctggaaatatcagt

SEQ ID NO: 1633719 - DNA, 11 bp, Homo sapiens
gaactcctggc

SEQ ID NO: 1633720 - DNA, 15 bp, Homo sapiens
gaactcgcctcagcc

SEQ ID NO: 1633721 - DNA, 21 bp, Homo sapiens
gaactctaaccagtgtacagg

SEQ ID NO: 1633722 - DNA, 11 bp, Homo sapiens
gaactctgaca

SEQ ID NO: 1633723 - DNA, 19 bp, Homo sapiens
gaactctgacaagggctga

SEQ ID NO: 1633724 - DNA, 14 bp, Homo sapiens
gaactctggtggca

SEQ ID NO: 1633725 - DNA, 19 bp, Homo sapiens
gaactctggtggcacagga

SEQ ID NO: 1633726 - DNA, 13 bp, Homo sapiens
gaactcttcagaa

SEQ ID NO: 1633727 - DNA, 12 bp, Homo sapiens
gaactgaacacc

SEQ ID NO: 1633728 - DNA, 23 bp, Homo sapiens
gaactgaacaccattgaaggctt

SEQ ID NO: 1633729 - DNA, 23 bp, Homo sapiens
gaactgaagtttccgcccccgcc

SEQ ID NO: 1633730 - DNA, 23 bp, Homo sapiens
gaactgaggagatgaccagggat

SEQ ID NO: 1633731 - DNA, 15 bp, Homo sapiens
gaactgaggccttgt

SEQ ID NO: 1633732 - DNA, 13 bp, Homo sapiens
gaactgcaaagct

SEQ ID NO: 1633733 - DNA, 19 bp, Homo sapiens
gaactgcaaagctttggct

SEQ ID NO: 1633734 - DNA, 17 bp, Homo sapiens
gaactgcaggccctggc

SEQ ID NO: 1633735 - DNA, 23 bp, Homo sapiens
gaactgcaggccctggcctcccc

SEQ ID NO: 1633736 - DNA, 21 bp, Homo sapiens
gaactgcatatgtttcgctga

SEQ ID NO: 1633737 - DNA, 15 bp, Homo sapiens
gaactgcatggacct

SEQ ID NO: 1633738 - DNA, 23 bp, Homo sapiens
gaactgcatggacctaacattcg

SEQ ID NO: 1633739 - DNA, 21 bp, Homo sapiens
gaactgcttttcctcaagcaa

SEQ ID NO: 1633740 - DNA, 23 bp, Homo sapiens
gaactgcttttcctcaagcaata

SEQ ID NO: 1633741 - DNA, 14 bp, Homo sapiens
gaactggactcagg

SEQ ID NO: 1633742 - DNA, 23 bp, Homo sapiens
gaactggactcaggatgcccagg

SEQ ID NO: 1633743 - DNA, 17 bp, Homo sapiens
gaactggcttgtacatt

SEQ ID NO: 1633744 - DNA, 23 bp, Homo sapiens
gaactgggagtccagggagggag

SEQ ID NO: 1633745 - DNA, 16 bp, Homo sapiens
gaactgggctgggcct

SEQ ID NO: 1633746 - DNA, 22 bp, Homo sapiens
gaactggggttcaagcccaggc

SEQ ID NO: 1633747 - DNA, 22 bp, Homo sapiens
gaactgggttctttggaagcag

SEQ ID NO: 1633748 - DNA, 15 bp, Homo sapiens
gaactgtacattgtg

SEQ ID NO: 1633749 - DNA, 16 bp, Homo sapiens
gaactgtacattgtga

SEQ ID NO: 1633750 - DNA, 19 bp, Homo sapiens
gaactgtacattgtgagct

SEQ ID NO: 1633751 - DNA, 23 bp, Homo sapiens
gaactgtactgttttctgggcca

SEQ ID NO: 1633752 - DNA, 18 bp, Homo sapiens
gaactgtcccacaaaata

SEQ ID NO: 1633753 - DNA, 14 bp, Homo sapiens
gaactgtcccagct

SEQ ID NO: 1633754 - DNA, 23 bp, Homo sapiens
gaactgtctgaatattctagaac

SEQ ID NO: 1633755 - DNA, 16 bp, Homo sapiens
gaactgtgccacaatg

SEQ ID NO: 1633756 - DNA, 16 bp, Homo sapiens
gaactgttcatttcca

SEQ ID NO: 1633757 - DNA, 19 bp, Homo sapiens
gaacttaagtctcgaatgt

SEQ ID NO: 1633758 - DNA, 18 bp, Homo sapiens
gaacttacacttggagcc

SEQ ID NO: 1633759 - DNA, 21 bp, Homo sapiens
gaacttacacttggagcccgt

SEQ ID NO: 1633760 - DNA, 13 bp, Homo sapiens
gaacttcagaaag

SEQ ID NO: 1633761 - DNA, 18 bp, Homo sapiens
gaacttcagaaagacttg

SEQ ID NO: 1633762 - DNA, 22 bp, Homo sapiens
gaacttcaggtgtgactctagc

SEQ ID NO: 1633763 - DNA, 21 bp, Homo sapiens
gaacttgcagctgatgttgga

SEQ ID NO: 1633764 - DNA, 23 bp, Homo sapiens
gaacttgcattgtgattggcctg

SEQ ID NO: 1633765 - DNA, 13 bp, Homo sapiens
gaacttgctgctg

SEQ ID NO: 1633766 - DNA, 22 bp, Homo sapiens
gaacttgctgctgagtgcacca

SEQ ID NO: 1633767 - DNA, 15 bp, Homo sapiens
gaacttgctgctgtc

SEQ ID NO: 1633768 - DNA, 22 bp, Homo sapiens
gaacttggggagttaagacctg

SEQ ID NO: 1633769 - DNA, 19 bp, Homo sapiens
gaactttaaagctcaggag

SEQ ID NO: 1633770 - DNA, 21 bp, Homo sapiens
gaactttaaagctcaggaggg

SEQ ID NO: 1633771 - DNA, 13 bp, Homo sapiens
gaactttcatttt

SEQ ID NO: 1633772 - DNA, 14 bp, Homo sapiens
gaactttcattttt

SEQ ID NO: 1633773 - DNA, 23 bp, Homo sapiens
gaactttcatttttttccaggct

SEQ ID NO: 1633774 - DNA, 14 bp, Homo sapiens
gaactttttcctgg

SEQ ID NO: 1633775 - DNA, 16 bp, Homo sapiens
gaagaaaaaaaataac

SEQ ID NO: 1633776 - DNA, 17 bp, Homo sapiens
gaagaaaaaaaataaca

SEQ ID NO: 1633777 - DNA, 18 bp, Homo sapiens
gaagaaaaataaaatttc

SEQ ID NO: 1633778 - DNA, 13 bp, Homo sapiens
gaagaaaataacc

SEQ ID NO: 1633779 - DNA, 17 bp, Homo sapiens
gaagaaaatacttaaat

SEQ ID NO: 1633780 - DNA, 18 bp, Homo sapiens
gaagaaaattgctgtgcc

SEQ ID NO: 1633781 - DNA, 15 bp, Homo sapiens
aggctggtggccttg

SEQ ID NO: 1633782 - DNA, 21 bp, Homo sapiens
aggctggttttgatggctggg

SEQ ID NO: 1633783 - DNA, 15 bp, Homo sapiens
aggctgtaactactt

SEQ ID NO: 1633784 - DNA, 22 bp, Homo sapiens
aggctgtagaaaggggagaatg

SEQ ID NO: 1633785 - DNA, 18 bp, Homo sapiens
aggctgtattttctttta

SEQ ID NO: 1633786 - DNA, 20 bp, Homo sapiens
aggctgtattttcttttata

SEQ ID NO: 1633787 - DNA, 15 bp, Homo sapiens
aggctgtcctgtaca

SEQ ID NO: 1633788 - DNA, 16 bp, Homo sapiens
aggctgtcctgtacat

SEQ ID NO: 1633789 - DNA, 22 bp, Homo sapiens
aggctgtcttctcaggctctgc

SEQ ID NO: 1633790 - DNA, 13 bp, Homo sapiens
aggctgtgggact

SEQ ID NO: 1633791 - DNA, 23 bp, Homo sapiens
aggctgttaaatacaggaaacag

SEQ ID NO: 1633792 - DNA, 16 bp, Homo sapiens
aggctgttctgcactg

SEQ ID NO: 1633793 - DNA, 14 bp, Homo sapiens
aggcttagtttgtg

SEQ ID NO: 1633794 - DNA, 19 bp, Homo sapiens
aggcttcaaaatgttatct

SEQ ID NO: 1633795 - DNA, 17 bp, Homo sapiens
aggcttcacgccgggag

SEQ ID NO: 1633796 - DNA, 20 bp, Homo sapiens
aggcttcagcatatttatag

SEQ ID NO: 1633797 - DNA, 20 bp, Homo sapiens
aggcttccctgacttgcttt

SEQ ID NO: 1633798 - DNA, 10 bp, Homo sapiens
aggcttcctg

SEQ ID NO: 1633799 - DNA, 21 bp, Homo sapiens
aggcttcctgcgtcctcctca

SEQ ID NO: 1633800 - DNA, 14 bp, Homo sapiens
aggcttcctgggtc

SEQ ID NO: 1633801 - DNA, 14 bp, Homo sapiens
aggcttcctggtga

SEQ ID NO: 1633802 - DNA, 13 bp, Homo sapiens
aggcttccttggc

SEQ ID NO: 1633803 - DNA, 21 bp, Homo sapiens
aggcttctatgtccaacagag

SEQ ID NO: 1633804 - DNA, 16 bp, Homo sapiens
aggcttctcacggcga

SEQ ID NO: 1633805 - DNA, 15 bp, Homo sapiens
aggcttctccgccag

SEQ ID NO: 1633806 - DNA, 22 bp, Homo sapiens
aggcttcttcagatcagtgctt

SEQ ID NO: 1633807 - DNA, 23 bp, Homo sapiens
aggcttcttcagatcagtgcttg

SEQ ID NO: 1633808 - DNA, 23 bp, Homo sapiens
aggctttgggaacactggcctgg

SEQ ID NO: 1633809 - DNA, 15 bp, Homo sapiens
aggctttgggtggct

SEQ ID NO: 1633810 - DNA, 22 bp, Homo sapiens
aggctttgggtggctcactact

SEQ ID NO: 1633811 - DNA, 15 bp, Homo sapiens
aggcttttcactgcc

SEQ ID NO: 1633812 - DNA, 20 bp, Homo sapiens
aggcttttctgcctgctcct

SEQ ID NO: 1633813 - DNA, 17 bp, Homo sapiens
agggaaaccttggagag

SEQ ID NO: 1633814 - DNA, 18 bp, Homo sapiens
agggaaaccttggagagg

SEQ ID NO: 1633815 - DNA, 19 bp, Homo sapiens
agggaaaccttggagagga

SEQ ID NO: 1633816 - DNA, 16 bp, Homo sapiens
agggaaactattgtcc

SEQ ID NO: 1633817 - DNA, 16 bp, Homo sapiens
agggaaactgccagca

SEQ ID NO: 1633818 - DNA, 22 bp, Homo sapiens
agggaaaggctctgaaagccag

SEQ ID NO: 1633819 - DNA, 15 bp, Homo sapiens
agggaaatatcattt

SEQ ID NO: 1633820 - DNA, 19 bp, Homo sapiens
agggaaatctgtaaagcca

SEQ ID NO: 1633821 - DNA, 14 bp, Homo sapiens
agggaaatgaaaga

SEQ ID NO: 1633822 - DNA, 18 bp, Homo sapiens
agggaacagacaggagaa

SEQ ID NO: 1633823 - DNA, 14 bp, Homo sapiens
agggaactagaggt

SEQ ID NO: 1633824 - DNA, 15 bp, Homo sapiens
agggaactagataac

SEQ ID NO: 1633825 - DNA, 18 bp, Homo sapiens
agggaagaaggaggaatg

SEQ ID NO: 1633826 - DNA, 19 bp, Homo sapiens
agggaagagacagcccagg

SEQ ID NO: 1633827 - DNA, 12 bp, Homo sapiens
agggaagagggc

SEQ ID NO: 1633828 - DNA, 14 bp, Homo sapiens
agggaagagtgcat

SEQ ID NO: 1633829 - DNA, 12 bp, Homo sapiens
agggaagcccag

SEQ ID NO: 1633830 - DNA, 13 bp, Homo sapiens
agggaagcccagc

SEQ ID NO: 1633831 - DNA, 12 bp, Homo sapiens
agggaagctggc

SEQ ID NO: 1633832 - DNA, 17 bp, Homo sapiens
agggaagctggcctgag

SEQ ID NO: 1633833 - DNA, 23 bp, Homo sapiens
agggaagctggcctgagagggga

SEQ ID NO: 1633834 - DNA, 14 bp, Homo sapiens
agggaaggacagga

SEQ ID NO: 1633835 - DNA, 14 bp, Homo sapiens
agggaaggatttaa

SEQ ID NO: 1633836 - DNA, 15 bp, Homo sapiens
agggaaggatttaag

SEQ ID NO: 1633837 - DNA, 16 bp, Homo sapiens
agggaaggcctgactt

SEQ ID NO: 1633838 - DNA, 17 bp, Homo sapiens
agggaagggtttctcta

SEQ ID NO: 1633839 - DNA, 17 bp, Homo sapiens
agggaaggtggaccaga

SEQ ID NO: 1633840 - DNA, 15 bp, Homo sapiens
agggaaggtggggcc

SEQ ID NO: 1633841 - DNA, 22 bp, Homo sapiens
agggaaggtggggccctgcccc

SEQ ID NO: 1633842 - DNA, 14 bp, Homo sapiens
agggaaggttcttc

SEQ ID NO: 1633843 - DNA, 16 bp, Homo sapiens
agggaagtgaggccca

SEQ ID NO: 1633844 - DNA, 16 bp, Homo sapiens
agggaatgcaatcctt

SEQ ID NO: 1633845 - DNA, 14 bp, Homo sapiens
agggaatgcagcag

SEQ ID NO: 1633846 - DNA, 18 bp, Homo sapiens
agggaatgttccctgcac

SEQ ID NO: 1633847 - DNA, 22 bp, Homo sapiens
agggaattaaaaagaagatgaa

SEQ ID NO: 1633848 - DNA, 13 bp, Homo sapiens
agggaattgctca

SEQ ID NO: 1633849 - DNA, 23 bp, Homo sapiens
agggacacgggcagcctggctcc

SEQ ID NO: 1633850 - DNA, 10 bp, Homo sapiens
agggacagag

SEQ ID NO: 1633851 - DNA, 21 bp, Homo sapiens
gaagagcaggtgactgtgctg

SEQ ID NO: 1633852 - DNA, 18 bp, Homo sapiens
gaagagccaaagaatatt

SEQ ID NO: 1633853 - DNA, 10 bp, Homo sapiens
gaagagccac

SEQ ID NO: 1633854 - DNA, 20 bp, Homo sapiens
gaagagccacctgcaagatg

SEQ ID NO: 1633855 - DNA, 22 bp, Homo sapiens
gaagagccacctgcaagatgga

SEQ ID NO: 1633856 - DNA, 16 bp, Homo sapiens
gaagagccggtggtgc

SEQ ID NO: 1633857 - DNA, 17 bp, Homo sapiens
gaagagctattatataa

SEQ ID NO: 1633858 - DNA, 12 bp, Homo sapiens
gaagagctcccc

SEQ ID NO: 1633859 - DNA, 16 bp, Homo sapiens
gaagagctcccctcca

SEQ ID NO: 1633860 - DNA, 19 bp, Homo sapiens
gaagagctcccctccacag

SEQ ID NO: 1633861 - DNA, 20 bp, Homo sapiens
gaagagctgttcacagccag

SEQ ID NO: 1633862 - DNA, 23 bp, Homo sapiens
gaagagctgttcacagccagact

SEQ ID NO: 1633863 - DNA, 17 bp, Homo sapiens
gaagagcttgcacagcc

SEQ ID NO: 1633864 - DNA, 22 bp, Homo sapiens
gaagagcttgtgtcctgtcctt

SEQ ID NO: 1633865 - DNA, 17 bp, Homo sapiens
gaagaggaaaaggctgg

SEQ ID NO: 1633866 - DNA, 12 bp, Homo sapiens
gaagaggaacca

SEQ ID NO: 1633867 - DNA, 22 bp, Homo sapiens
gaagaggcccactagagggccc

SEQ ID NO: 1633868 - DNA, 15 bp, Homo sapiens
gaagaggcgggccag

SEQ ID NO: 1633869 - DNA, 16 bp, Homo sapiens
gaagagggcccagccc

SEQ ID NO: 1633870 - DNA, 16 bp, Homo sapiens
gaagaggggtggtggg

SEQ ID NO: 1633871 - DNA, 22 bp, Homo sapiens
gaagaggttgggcttccatgcc

SEQ ID NO: 1633872 - DNA, 17 bp, Homo sapiens
gaagagtaaacaggaaa

SEQ ID NO: 1633873 - DNA, 20 bp, Homo sapiens
gaagagtatttttgacagaa

SEQ ID NO: 1633874 - DNA, 14 bp, Homo sapiens
gaagagtgaaatac

SEQ ID NO: 1633875 - DNA, 18 bp, Homo sapiens
gaagagtgggtttcacaa

SEQ ID NO: 1633876 - DNA, 18 bp, Homo sapiens
gaagagttacaataaagt

SEQ ID NO: 1633877 - DNA, 20 bp, Homo sapiens
gaagagttacaataaagttt

SEQ ID NO: 1633878 - DNA, 20 bp, Homo sapiens
gaagagtttttgtgatgggg

SEQ ID NO: 1633879 - DNA, 23 bp, Homo sapiens
gaagataatgttctttaatgttg

SEQ ID NO: 1633880 - DNA, 18 bp, Homo sapiens
gaagataggctctgcaca

SEQ ID NO: 1633881 - DNA, 17 bp, Homo sapiens
gaagatcagatgcaatt

SEQ ID NO: 1633882 - DNA, 14 bp, Homo sapiens
gaagatctaaactt

SEQ ID NO: 1633883 - DNA, 15 bp, Homo sapiens
gaagatgaatggtct

SEQ ID NO: 1633884 - DNA, 23 bp, Homo sapiens
gaagatgatttcagttcatcaaa

SEQ ID NO: 1633885 - DNA, 22 bp, Homo sapiens
gaagatgctccagcaacacagc

SEQ ID NO: 1633886 - DNA, 19 bp, Homo sapiens
gaagatgctgcctgtattt

SEQ ID NO: 1633887 - DNA, 15 bp, Homo sapiens
gaagatgctgtaaat

SEQ ID NO: 1633888 - DNA, 22 bp, Homo sapiens
gaagatggtccgtgcccaggcc

SEQ ID NO: 1633889 - DNA, 16 bp, Homo sapiens
gaagatgtgaaattca

SEQ ID NO: 1633890 - DNA, 15 bp, Homo sapiens
gaagatgtttcaaaa

SEQ ID NO: 1633891 - DNA, 15 bp, Homo sapiens
gaagattaggcacac

SEQ ID NO: 1633892 - DNA, 17 bp, Homo sapiens
gaagattaggcacacag

SEQ ID NO: 1633893 - DNA, 19 bp, Homo sapiens
gaagattaggcacacagat

SEQ ID NO: 1633894 - DNA, 13 bp, Homo sapiens
gaagattctaaaa

SEQ ID NO: 1633895 - DNA, 21 bp, Homo sapiens
gaagcaaacaagcttgatttt

SEQ ID NO: 1633896 - DNA, 19 bp, Homo sapiens
gaagcaagacacgtggcct

SEQ ID NO: 1633897 - DNA, 22 bp, Homo sapiens
gaagcaagaggcaagctgaaat

SEQ ID NO: 1633898 - DNA, 14 bp, Homo sapiens
gaagcaaggctggg

SEQ ID NO: 1633899 - DNA, 20 bp, Homo sapiens
agggagacggtttccaggga

SEQ ID NO: 1633900 - DNA, 11 bp, Homo sapiens
agggagagaga

SEQ ID NO: 1633901 - DNA, 15 bp, Homo sapiens
agggagagagaagca

SEQ ID NO: 1633902 - DNA, 18 bp, Homo sapiens
agggagagagaagcaggc

SEQ ID NO: 1633903 - DNA, 19 bp, Homo sapiens
agggagagagaagcaggca

SEQ ID NO: 1633904 - DNA, 15 bp, Homo sapiens
agggagagccagctc

SEQ ID NO: 1633905 - DNA, 14 bp, Homo sapiens
agggagagcggggc

SEQ ID NO: 1633906 - DNA, 16 bp, Homo sapiens
agggagagctgagcca

SEQ ID NO: 1633907 - DNA, 20 bp, Homo sapiens
agggagaggtcaccagctgc

SEQ ID NO: 1633908 - DNA, 15 bp, Homo sapiens
agggagcaagacaga

SEQ ID NO: 1633909 - DNA, 17 bp, Homo sapiens
agggagcaagacagaga

SEQ ID NO: 1633910 - DNA, 17 bp, Homo sapiens
agggagcacctgtctgg

SEQ ID NO: 1633911 - DNA, 14 bp, Homo sapiens
agggagcagccccc

SEQ ID NO: 1633912 - DNA, 14 bp, Homo sapiens
agggagcagtggct

SEQ ID NO: 1633913 - DNA, 17 bp, Homo sapiens
agggagccatttgagag

SEQ ID NO: 1633914 - DNA, 21 bp, Homo sapiens
agggagccggcggcctctcga

SEQ ID NO: 1633915 - DNA, 13 bp, Homo sapiens
agggagctgggac

SEQ ID NO: 1633916 - DNA, 15 bp, Homo sapiens
agggagctgggcccg

SEQ ID NO: 1633917 - DNA, 19 bp, Homo sapiens
agggaggaaggcctttctt

SEQ ID NO: 1633918 - DNA, 21 bp, Homo sapiens
agggaggaaggcctttcttct

SEQ ID NO: 1633919 - DNA, 15 bp, Homo sapiens
agggaggaggccacc

SEQ ID NO: 1633920 - DNA, 17 bp, Homo sapiens
agggaggaggccacctc

SEQ ID NO: 1633921 - DNA, 14 bp, Homo sapiens
agggaggagtggag

SEQ ID NO: 1633922 - DNA, 16 bp, Homo sapiens
agggaggagtggaggt

SEQ ID NO: 1633923 - DNA, 22 bp, Homo sapiens
agggaggcaacactgctgtcca

SEQ ID NO: 1633924 - DNA, 20 bp, Homo sapiens
agggaggcgggggctgccct

SEQ ID NO: 1633925 - DNA, 17 bp, Homo sapiens
agggaggctgggcgggt

SEQ ID NO: 1633926 - DNA, 12 bp, Homo sapiens
agggagggagtt

SEQ ID NO: 1633927 - DNA, 17 bp, Homo sapiens
agggagggcagttttct

SEQ ID NO: 1633928 - DNA, 21 bp, Homo sapiens
agggaggggaaaagcattttt

SEQ ID NO: 1633929 - DNA, 12 bp, Homo sapiens
agggaggggact

SEQ ID NO: 1633930 - DNA, 19 bp, Homo sapiens
agggaggggccggccctgt

SEQ ID NO: 1633931 - DNA, 24 bp, Homo sapiens
agggagggggcgctcaggacccag

SEQ ID NO: 1633932 - DNA, 18 bp, Homo sapiens
agggagggtgcagccctc

SEQ ID NO: 1633933 - DNA, 13 bp, Homo sapiens
agggaggtttgtg

SEQ ID NO: 1633934 - DNA, 15 bp, Homo sapiens
agggagtacctgctg

SEQ ID NO: 1633935 - DNA, 19 bp, Homo sapiens
agggagtacctgctgcccc

SEQ ID NO: 1633936 - DNA, 22 bp, Homo sapiens
agggagtaggctgtattttctt

SEQ ID NO: 1633937 - DNA, 14 bp, Homo sapiens
agggagtcccctcc

SEQ ID NO: 1633938 - DNA, 17 bp, Homo sapiens
agggagtgtctgcagtc

SEQ ID NO: 1633939 - DNA, 16 bp, Homo sapiens
agggagttagggagag

SEQ ID NO: 1633940 - DNA, 18 bp, Homo sapiens
agggagttagggagagag

SEQ ID NO: 1633941 - DNA, 20 bp, Homo sapiens
agggagttcatctggagggt

SEQ ID NO: 1633942 - DNA, 21 bp, Homo sapiens
agggagtttaatacaggaaat

SEQ ID NO: 1633943 - DNA, 16 bp, Homo sapiens
agggagttttgtctgt

SEQ ID NO: 1633944 - DNA, 21 bp, Homo sapiens
agggagttttgtctgtctccc

SEQ ID NO: 1633945 - DNA, 20 bp, Homo sapiens
agggataaagaaaaaaatac

SEQ ID NO: 1633946 - DNA, 14 bp, Homo sapiens
agggatacactgaa

SEQ ID NO: 1633947 - DNA, 13 bp, Homo sapiens
agggatataaaat

SEQ ID NO: 1633948 - DNA, 14 bp, Homo sapiens
agggatataaaatg

SEQ ID NO: 1633949 - DNA, 16 bp, Homo sapiens
agggatatatatatat

SEQ ID NO: 1633950 - DNA, 14 bp, Homo sapiens
agggatattgcctt

SEQ ID NO: 1633951 - DNA, 19 bp, Homo sapiens
agggatattgccttatttg

SEQ ID NO: 1633952 - DNA, 13 bp, Homo sapiens
agggatcacaggg

SEQ ID NO: 1633953 - DNA, 22 bp, Homo sapiens
agggatcacagggccccagaag

SEQ ID NO: 1633954 - DNA, 20 bp, Homo sapiens
agggatccctaactgttccc

SEQ ID NO: 1633955 - DNA, 19 bp, Homo sapiens
agggatctctctacaagag

SEQ ID NO: 1633956 - DNA, 15 bp, Homo sapiens
agggatgaacttttt

SEQ ID NO: 1633957 - DNA, 15 bp, Homo sapiens
agggatgactaaaat

SEQ ID NO: 1633958 - DNA, 22 bp, Homo sapiens
agggatgactaaaatatttatt

SEQ ID NO: 1633959 - DNA, 16 bp, Homo sapiens
agggatgctgcctgag

SEQ ID NO: 1633960 - DNA, 19 bp, Homo sapiens
agggatgctgcctgagtca

SEQ ID NO: 1633961 - DNA, 15 bp, Homo sapiens
agggatgctgctccg

SEQ ID NO: 1633962 - DNA, 22 bp, Homo sapiens
agggatgctgctccgcccgctc

SEQ ID NO: 1633963 - DNA, 14 bp, Homo sapiens
agggatgctgggct

SEQ ID NO: 1633964 - DNA, 13 bp, Homo sapiens
agggatggagaaa

SEQ ID NO: 1633965 - DNA, 14 bp, Homo sapiens
agggatggagaaag

SEQ ID NO: 1633966 - DNA, 17 bp, Homo sapiens
gaagctaaaaggaaaag

SEQ ID NO: 1633967 - DNA, 13 bp, Homo sapiens
gaagctaattgta

SEQ ID NO: 1633968 - DNA, 22 bp, Homo sapiens
gaagctagacacatgaaggtaa

SEQ ID NO: 1633969 - DNA, 12 bp, Homo sapiens
gaagctcagcct

SEQ ID NO: 1633970 - DNA, 23 bp, Homo sapiens
gaagctcagccttctcctcccaa

SEQ ID NO: 1633971 - DNA, 21 bp, Homo sapiens
gaagctcctctccccagccca

SEQ ID NO: 1633972 - DNA, 13 bp, Homo sapiens
gaagctcctgcta

SEQ ID NO: 1633973 - DNA, 19 bp, Homo sapiens
gaagctctccgagctctgg

SEQ ID NO: 1633974 - DNA, 13 bp, Homo sapiens
gaagctctgaagt

SEQ ID NO: 1633975 - DNA, 15 bp, Homo sapiens
gaagctctgaagtca

SEQ ID NO: 1633976 - DNA, 15 bp, Homo sapiens
gaagctgatccagtt

SEQ ID NO: 1633977 - DNA, 18 bp, Homo sapiens
gaagctgcatccagaggc

SEQ ID NO: 1633978 - DNA, 14 bp, Homo sapiens
gaagctgctgacca

SEQ ID NO: 1633979 - DNA, 22 bp, Homo sapiens
gaagctgctgaccaattgtgct

SEQ ID NO: 1633980 - DNA, 12 bp, Homo sapiens
gaagctgctgca

SEQ ID NO: 1633981 - DNA, 14 bp, Homo sapiens
gaagctgctgcagc

SEQ ID NO: 1633982 - DNA, 13 bp, Homo sapiens
gaagctggagcag

SEQ ID NO: 1633983 - DNA, 23 bp, Homo sapiens
gaagctgtactcagagcagagca

SEQ ID NO: 1633984 - DNA, 20 bp, Homo sapiens
gaagctgtgtccttgcacct

SEQ ID NO: 1633985 - DNA, 16 bp, Homo sapiens
gaagctgttgggagaa

SEQ ID NO: 1633986 - DNA, 20 bp, Homo sapiens
gaagctgttgggagaaagca

SEQ ID NO: 1633987 - DNA, 16 bp, Homo sapiens
gaagctgttgtgtgag

SEQ ID NO: 1633988 - DNA, 17 bp, Homo sapiens
gaagcttccacaaaatt

SEQ ID NO: 1633989 - DNA, 23 bp, Homo sapiens
gaagcttggcttcctcttcttgt

SEQ ID NO: 1633990 - DNA, 12 bp, Homo sapiens
gaagctttacca

SEQ ID NO: 1633991 - DNA, 15 bp, Homo sapiens
gaagctttgagttga

SEQ ID NO: 1633992 - DNA, 12 bp, Homo sapiens
gaaggaaaagaa

SEQ ID NO: 1633993 - DNA, 15 bp, Homo sapiens
gaaggaaaagcaaga

SEQ ID NO: 1633994 - DNA, 14 bp, Homo sapiens
gaaggaaaatgata

SEQ ID NO: 1633995 - DNA, 14 bp, Homo sapiens
gaaggaaagctata

SEQ ID NO: 1633996 - DNA, 14 bp, Homo sapiens
gaaggaacaaagac

SEQ ID NO: 1633997 - DNA, 18 bp, Homo sapiens
gaaggaagatcttgagag

SEQ ID NO: 1633998 - DNA, 21 bp, Homo sapiens
gaaggaagatcttgagagctg

SEQ ID NO: 1633999 - DNA, 13 bp, Homo sapiens
gaaggaaggaggg

SEQ ID NO: 1634000 - DNA, 18 bp, Homo sapiens
gaaggaatagccagagag

SEQ ID NO: 1634001 - DNA, 19 bp, Homo sapiens
gaaggaatgtcagggccag

SEQ ID NO: 1634002 - DNA, 22 bp, Homo sapiens
gaaggacccggaggggcctggc

SEQ ID NO: 1634003 - DNA, 15 bp, Homo sapiens
gaaggactgaactcc

SEQ ID NO: 1634004 - DNA, 22 bp, Homo sapiens
gaaggactggtgcgacccccca

SEQ ID NO: 1634005 - DNA, 16 bp, Homo sapiens
gaaggagaaggaagga

SEQ ID NO: 1634006 - DNA, 17 bp, Homo sapiens
gaaggagaagtaagagg

SEQ ID NO: 1634007 - DNA, 15 bp, Homo sapiens
gaaggagactcacct

SEQ ID NO: 1634008 - DNA, 20 bp, Homo sapiens
gaaggagactcacctctgcc

SEQ ID NO: 1634009 - DNA, 22 bp, Homo sapiens
gaaggagactcacctctgcctc

SEQ ID NO: 1634010 - DNA, 20 bp, Homo sapiens
gaaggagagcaagaaggaaa

SEQ ID NO: 1634011 - DNA, 13 bp, Homo sapiens
gaaggagggcaga

SEQ ID NO: 1634012 - DNA, 20 bp, Homo sapiens
gaaggagggcagagccatgg

SEQ ID NO: 1634013 - DNA, 17 bp, Homo sapiens
gaaggataaagccactt

SEQ ID NO: 1634014 - DNA, 13 bp, Homo sapiens
gaaggatttgtgt

SEQ ID NO: 1634015 - DNA, 19 bp, Homo sapiens
gaaggcaaaaactgtactg

SEQ ID NO: 1634016 - DNA, 15 bp, Homo sapiens
gaaggcaaatataag

SEQ ID NO: 1634017 - DNA, 16 bp, Homo sapiens
gaaggcaacctggaag

SEQ ID NO: 1634018 - DNA, 14 bp, Homo sapiens
gaaggcaagagggg

SEQ ID NO: 1634019 - DNA, 13 bp, Homo sapiens
agggcattgctca

SEQ ID NO: 1634020 - DNA, 16 bp, Homo sapiens
agggccaaagcacagc

SEQ ID NO: 1634021 - DNA, 17 bp, Homo sapiens
agggccaaagcacagct

SEQ ID NO: 1634022 - DNA, 19 bp, Homo sapiens
agggccaaagcacagctgg

SEQ ID NO: 1634023 - DNA, 21 bp, Homo sapiens
agggccaagagatctgtgtgg

SEQ ID NO: 1634024 - DNA, 17 bp, Homo sapiens
agggccacgctccagct

SEQ ID NO: 1634025 - DNA, 15 bp, Homo sapiens
agggccacgtgccag

SEQ ID NO: 1634026 - DNA, 21 bp, Homo sapiens
agggccactcaacagagagga

SEQ ID NO: 1634027 - DNA, 18 bp, Homo sapiens
agggccactctgcctctg

SEQ ID NO: 1634028 - DNA, 17 bp, Homo sapiens
agggccagaaggagggc

SEQ ID NO: 1634029 - DNA, 19 bp, Homo sapiens
agggccagaaggagggcag

SEQ ID NO: 1634030 - DNA, 21 bp, Homo sapiens
agggccagaaggagggcagag

SEQ ID NO: 1634031 - DNA, 13 bp, Homo sapiens
agggccagactgg

SEQ ID NO: 1634032 - DNA, 17 bp, Homo sapiens
agggccagactggaaga

SEQ ID NO: 1634033 - DNA, 12 bp, Homo sapiens
agggccagagcc

SEQ ID NO: 1634034 - DNA, 15 bp, Homo sapiens
agggccagagccagg

SEQ ID NO: 1634035 - DNA, 12 bp, Homo sapiens
agggccagcagg

SEQ ID NO: 1634036 - DNA, 14 bp, Homo sapiens
agggccagcaggct

SEQ ID NO: 1634037 - DNA, 12 bp, Homo sapiens
agggccagggcc

SEQ ID NO: 1634038 - DNA, 15 bp, Homo sapiens
agggccagggccctg

SEQ ID NO: 1634039 - DNA, 22 bp, Homo sapiens
agggccagggccctgcagaggg

SEQ ID NO: 1634040 - DNA, 18 bp, Homo sapiens
agggccaggtgcagacct

SEQ ID NO: 1634041 - DNA, 22 bp, Homo sapiens
agggccaggtgcagaccttggg

SEQ ID NO: 1634042 - DNA, 19 bp, Homo sapiens
agggccagtcctgcctggc

SEQ ID NO: 1634043 - DNA, 23 bp, Homo sapiens
agggccagtcctgcctggccagg

SEQ ID NO: 1634044 - DNA, 22 bp, Homo sapiens
agggccatacttttgagagggg

SEQ ID NO: 1634045 - DNA, 14 bp, Homo sapiens
agggccatccactg

SEQ ID NO: 1634046 - DNA, 15 bp, Homo sapiens
agggccatccactgt

SEQ ID NO: 1634047 - DNA, 23 bp, Homo sapiens
agggccatctgactgccaagcca

SEQ ID NO: 1634048 - DNA, 19 bp, Homo sapiens
agggccatgctgaggcctg

SEQ ID NO: 1634049 - DNA, 16 bp, Homo sapiens
agggccatggctcagg

SEQ ID NO: 1634050 - DNA, 21 bp, Homo sapiens
agggccatggctcagggtggt

SEQ ID NO: 1634051 - DNA, 19 bp, Homo sapiens
agggcccaagtccctgttt

SEQ ID NO: 1634052 - DNA, 22 bp, Homo sapiens
agggcccaagtccctgttttct

SEQ ID NO: 1634053 - DNA, 15 bp, Homo sapiens
agggcccacacctgg

SEQ ID NO: 1634054 - DNA, 11 bp, Homo sapiens
agggcccagac

SEQ ID NO: 1634055 - DNA, 17 bp, Homo sapiens
agggcccagaccctggg

SEQ ID NO: 1634056 - DNA, 13 bp, Homo sapiens
agggcccagagcc

SEQ ID NO: 1634057 - DNA, 21 bp, Homo sapiens
agggcccagagcccagctcca

SEQ ID NO: 1634058 - DNA, 18 bp, Homo sapiens
agggcccagccaggagca

SEQ ID NO: 1634059 - DNA, 12 bp, Homo sapiens
agggcccagccc

SEQ ID NO: 1634060 - DNA, 14 bp, Homo sapiens
agggcccagcccag

SEQ ID NO: 1634061 - DNA, 13 bp, Homo sapiens
agggcccagctgt

SEQ ID NO: 1634062 - DNA, 19 bp, Homo sapiens
agggcccagctgtagccat

SEQ ID NO: 1634063 - DNA, 18 bp, Homo sapiens
agggccccagaaggcagg

SEQ ID NO: 1634064 - DNA, 14 bp, Homo sapiens
agggccccagcact

SEQ ID NO: 1634065 - DNA, 14 bp, Homo sapiens
agggccccaggggc

SEQ ID NO: 1634066 - DNA, 15 bp, Homo sapiens
agggccccaggggca

SEQ ID NO: 1634067 - DNA, 19 bp, Homo sapiens
agggcccctcaccctgcct

SEQ ID NO: 1634068 - DNA, 19 bp, Homo sapiens
agggcccctccctctgccc

SEQ ID NO: 1634069 - DNA, 13 bp, Homo sapiens
agggcccctctgc

SEQ ID NO: 1634070 - DNA, 15 bp, Homo sapiens
agggcccctctgccc

SEQ ID NO: 1634071 - DNA, 16 bp, Homo sapiens
agggcccctctgccca

SEQ ID NO: 1634072 - DNA, 21 bp, Homo sapiens
agggcccctctgcccagcttg

SEQ ID NO: 1634073 - DNA, 17 bp, Homo sapiens
agggcccgcagtgctgg

SEQ ID NO: 1634074 - DNA, 19 bp, Homo sapiens
agggcccgcagtgctggga

SEQ ID NO: 1634075 - DNA, 16 bp, Homo sapiens
agggcccggccacacc

SEQ ID NO: 1634076 - DNA, 13 bp, Homo sapiens
agggccctacctg

SEQ ID NO: 1634077 - DNA, 13 bp, Homo sapiens
agggccctaggcc

SEQ ID NO: 1634078 - DNA, 11 bp, Homo sapiens
agggccctggc

SEQ ID NO: 1634079 - DNA, 20 bp, Homo sapiens
agggccctgtggagtccagc

SEQ ID NO: 1634080 - DNA, 22 bp, Homo sapiens
agggccctgtggagtccagctc

SEQ ID NO: 1634081 - DNA, 14 bp, Homo sapiens
agggccctttcatc

SEQ ID NO: 1634082 - DNA, 20 bp, Homo sapiens
agggccgactaagagaagtt

SEQ ID NO: 1634083 - DNA, 16 bp, Homo sapiens
agggccgcccgctccc

SEQ ID NO: 1634084 - DNA, 15 bp, Homo sapiens
agggccgcgagaggc

SEQ ID NO: 1634085 - DNA, 18 bp, Homo sapiens
agggccgcggccgcccgc

SEQ ID NO: 1634086 - DNA, 19 bp, Homo sapiens
agggccggggatggatctt

SEQ ID NO: 1634087 - DNA, 17 bp, Homo sapiens
agggccgtgcccttgcc

SEQ ID NO: 1634088 - DNA, 20 bp, Homo sapiens
agggcctcaaaggcccgctc

SEQ ID NO: 1634089 - DNA, 13 bp, Homo sapiens
agggcctccaggg

SEQ ID NO: 1634090 - DNA, 19 bp, Homo sapiens
agggcctctccaaccactg

SEQ ID NO: 1634091 - DNA, 14 bp, Homo sapiens
agggcctctgcctg

SEQ ID NO: 1634092 - DNA, 17 bp, Homo sapiens
agggcctgagcagctgg

SEQ ID NO: 1634093 - DNA, 23 bp, Homo sapiens
agggcctgcagtgattcagcagg

SEQ ID NO: 1634094 - DNA, 13 bp, Homo sapiens
agggcctgctgga

SEQ ID NO: 1634095 - DNA, 15 bp, Homo sapiens
agggcctgctggagg

SEQ ID NO: 1634096 - DNA, 19 bp, Homo sapiens
agggcctgctggaggcctc

SEQ ID NO: 1634097 - DNA, 12 bp, Homo sapiens
agggcctggagc

SEQ ID NO: 1634098 - DNA, 14 bp, Homo sapiens
agggcctggagccc

SEQ ID NO: 1634099 - DNA, 17 bp, Homo sapiens
agggcctggagccccat

SEQ ID NO: 1634100 - DNA, 23 bp, Homo sapiens
agggcctggccagtcctggtcct

SEQ ID NO: 1634101 - DNA, 17 bp, Homo sapiens
agggcctggtccctggg

SEQ ID NO: 1634102 - DNA, 21 bp, Homo sapiens
agggcctggtccctgggagga

SEQ ID NO: 1634103 - DNA, 18 bp, Homo sapiens
agggcctgtgggagcctg

SEQ ID NO: 1634104 - DNA, 15 bp, Homo sapiens
agggccttgcccaga

SEQ ID NO: 1634105 - DNA, 20 bp, Homo sapiens
agggccttttctggcaccgc

SEQ ID NO: 1634106 - DNA, 15 bp, Homo sapiens
agggccttttctgtg

SEQ ID NO: 1634107 - DNA, 12 bp, Homo sapiens
agggcgctcaga

SEQ ID NO: 1634108 - DNA, 15 bp, Homo sapiens
agggcgctcagacgg

SEQ ID NO: 1634109 - DNA, 15 bp, Homo sapiens
agggcggcaggggcc

SEQ ID NO: 1634110 - DNA, 18 bp, Homo sapiens
agggcgggcagagggctg

SEQ ID NO: 1634111 - DNA, 23 bp, Homo sapiens
agggcgttctaggtaggaagagc

SEQ ID NO: 1634112 - DNA, 21 bp, Homo sapiens
agggctaagagctagcgctgc

SEQ ID NO: 1634113 - DNA, 21 bp, Homo sapiens
agggctaattatatattttgt

SEQ ID NO: 1634114 - DNA, 20 bp, Homo sapiens
agggctagtagaactggatc

SEQ ID NO: 1634115 - DNA, 23 bp, Homo sapiens
agggctagtcttcccttacctca

SEQ ID NO: 1634116 - DNA, 22 bp, Homo sapiens
agggctagtgacttgtgtccca

SEQ ID NO: 1634117 - DNA, 14 bp, Homo sapiens
agggctatggcaag

SEQ ID NO: 1634118 - DNA, 13 bp, Homo sapiens
agggctccagcat

SEQ ID NO: 1634119 - DNA, 18 bp, Homo sapiens
agggctccagcatccagc

SEQ ID NO: 1634120 - DNA, 13 bp, Homo sapiens
agggctcccaggg

SEQ ID NO: 1634121 - DNA, 22 bp, Homo sapiens
agggctcccaggggtctccctg

SEQ ID NO: 1634122 - DNA, 11 bp, Homo sapiens
agggctcctgc

SEQ ID NO: 1634123 - DNA, 21 bp, Homo sapiens
agggctcctgtggcagctgcc

SEQ ID NO: 1634124 - DNA, 18 bp, Homo sapiens
agggctcgaggggtgggc

SEQ ID NO: 1634125 - DNA, 21 bp, Homo sapiens
agggctctgatattccatgaa

SEQ ID NO: 1634126 - DNA, 19 bp, Homo sapiens
agggctctgatctaacaaa

SEQ ID NO: 1634127 - DNA, 20 bp, Homo sapiens
agggctctgatctaacaaaa

SEQ ID NO: 1634128 - DNA, 14 bp, Homo sapiens
agggctctgcagca

SEQ ID NO: 1634129 - DNA, 16 bp, Homo sapiens
agggctctgcaggcca

SEQ ID NO: 1634130 - DNA, 14 bp, Homo sapiens
agggctctgtttgt

SEQ ID NO: 1634131 - DNA, 16 bp, Homo sapiens
agggctgacctgcctc

SEQ ID NO: 1634132 - DNA, 23 bp, Homo sapiens
agggctgacctgcctctcacaca

SEQ ID NO: 1634133 - DNA, 20 bp, Homo sapiens
agggctgatggattccaaac

SEQ ID NO: 1634134 - DNA, 13 bp, Homo sapiens
agggctgcagtca

SEQ ID NO: 1634135 - DNA, 20 bp, Homo sapiens
agggctgccttctggccttg

SEQ ID NO: 1634136 - DNA, 14 bp, Homo sapiens
gaaggcacccgccc

SEQ ID NO: 1634137 - DNA, 21 bp, Homo sapiens
gaaggcacccgccctttcctt

SEQ ID NO: 1634138 - DNA, 13 bp, Homo sapiens
gaaggcagagaaa

SEQ ID NO: 1634139 - DNA, 14 bp, Homo sapiens
gaaggcagctgctc

SEQ ID NO: 1634140 - DNA, 21 bp, Homo sapiens
gaaggcagggggaaggtgggg

SEQ ID NO: 1634141 - DNA, 16 bp, Homo sapiens
gaaggcagtctgaacc

SEQ ID NO: 1634142 - DNA, 13 bp, Homo sapiens
gaaggcagtggca

SEQ ID NO: 1634143 - DNA, 21 bp, Homo sapiens
gaaggcagtggcaggggagca

SEQ ID NO: 1634144 - DNA, 15 bp, Homo sapiens
gaaggcatgagaaag

SEQ ID NO: 1634145 - DNA, 16 bp, Homo sapiens
gaaggcatgagaaaga

SEQ ID NO: 1634146 - DNA, 23 bp, Homo sapiens
gaaggcatttgcagggtcctctt

SEQ ID NO: 1634147 - DNA, 22 bp, Homo sapiens
gaaggccacctcccactcctgc

SEQ ID NO: 1634148 - DNA, 16 bp, Homo sapiens
gaaggccagcaacatt

SEQ ID NO: 1634149 - DNA, 21 bp, Homo sapiens
gaaggccagccctccctggct

SEQ ID NO: 1634150 - DNA, 17 bp, Homo sapiens
gaaggccccagagagac

SEQ ID NO: 1634151 - DNA, 16 bp, Homo sapiens
gaaggccccttccctg

SEQ ID NO: 1634152 - DNA, 17 bp, Homo sapiens
gaaggccccttccctgg

SEQ ID NO: 1634153 - DNA, 16 bp, Homo sapiens
gaaggccctgtgccct

SEQ ID NO: 1634154 - DNA, 21 bp, Homo sapiens
gaaggcctcttgtgctcacgc

SEQ ID NO: 1634155 - DNA, 13 bp, Homo sapiens
gaaggcctgactt

SEQ ID NO: 1634156 - DNA, 20 bp, Homo sapiens
gaaggccttacagaaaattg

SEQ ID NO: 1634157 - DNA, 12 bp, Homo sapiens
gaaggcgaggag

SEQ ID NO: 1634158 - DNA, 20 bp, Homo sapiens
gaaggctaagcatggcctgg

SEQ ID NO: 1634159 - DNA, 21 bp, Homo sapiens
gaaggctaagcatggcctgga

SEQ ID NO: 1634160 - DNA, 14 bp, Homo sapiens
gaaggcttctctcc

SEQ ID NO: 1634161 - DNA, 23 bp, Homo sapiens
gaaggcttctctccacagtgttg

SEQ ID NO: 1634162 - DNA, 19 bp, Homo sapiens
gaaggcttttggtctccct

SEQ ID NO: 1634163 - DNA, 23 bp, Homo sapiens
gaagggaattgctcagagaagga

SEQ ID NO: 1634164 - DNA, 17 bp, Homo sapiens
gaagggaatttggctca

SEQ ID NO: 1634165 - DNA, 21 bp, Homo sapiens
gaagggacagctgctgggacc

SEQ ID NO: 1634166 - DNA, 15 bp, Homo sapiens
gaagggaccaaggca

SEQ ID NO: 1634167 - DNA, 15 bp, Homo sapiens
gaagggacttttatt

SEQ ID NO: 1634168 - DNA, 11 bp, Homo sapiens
gaagggagaaa

SEQ ID NO: 1634169 - DNA, 16 bp, Homo sapiens
gaagggagaagaaagg

SEQ ID NO: 1634170 - DNA, 23 bp, Homo sapiens
gaagggagagggcctctgcctgg

SEQ ID NO: 1634171 - DNA, 13 bp, Homo sapiens
gaagggagggtgg

SEQ ID NO: 1634172 - DNA, 13 bp, Homo sapiens
gaagggaggtggc

SEQ ID NO: 1634173 - DNA, 13 bp, Homo sapiens
gaagggcaagaaa

SEQ ID NO: 1634174 - DNA, 13 bp, Homo sapiens
gaagggcaagttt

SEQ ID NO: 1634175 - DNA, 23 bp, Homo sapiens
gaagggcaggaaggagagcctgc

SEQ ID NO: 1634176 - DNA, 19 bp, Homo sapiens
gaagggcagggctgaggcc

SEQ ID NO: 1634177 - DNA, 10 bp, Homo sapiens
gaagggccag

SEQ ID NO: 1634178 - DNA, 14 bp, Homo sapiens
gaagggccagagcc

SEQ ID NO: 1634179 - DNA, 16 bp, Homo sapiens
gaagggccagtcctgc

SEQ ID NO: 1634180 - DNA, 20 bp, Homo sapiens
gaagggccagtcctgcctgg

SEQ ID NO: 1634181 - DNA, 14 bp, Homo sapiens
gaagggccagtctg

SEQ ID NO: 1634182 - DNA, 19 bp, Homo sapiens
gaagggccagtctgggctg

SEQ ID NO: 1634183 - DNA, 22 bp, Homo sapiens
gaagggctgcatgatgtttgcc

SEQ ID NO: 1634184 - DNA, 19 bp, Homo sapiens
gaaggggaaaaatgggaaa

SEQ ID NO: 1634185 - DNA, 20 bp, Homo sapiens
gaaggggaaaaatgggaaat

SEQ ID NO: 1634186 - DNA, 13 bp, Homo sapiens
gaaggggcacacc

SEQ ID NO: 1634187 - DNA, 22 bp, Homo sapiens
gaaggggcacaccactgccctg

SEQ ID NO: 1634188 - DNA, 22 bp, Homo sapiens
gaaggggccccggggctggcaa

SEQ ID NO: 1634189 - DNA, 23 bp, Homo sapiens
gaaggggccccggggctggcaag

SEQ ID NO: 1634190 - DNA, 22 bp, Homo sapiens
gaaggggcctcaccgagtgggg

SEQ ID NO: 1634191 - DNA, 14 bp, Homo sapiens
gaagggggccgcca

SEQ ID NO: 1634192 - DNA, 18 bp, Homo sapiens
gaaggggggttgcagtgg

SEQ ID NO: 1634193 - DNA, 16 bp, Homo sapiens
gaagggtcctgccggt

SEQ ID NO: 1634194 - DNA, 21 bp, Homo sapiens
gaagggtctctctccaggtca

SEQ ID NO: 1634195 - DNA, 14 bp, Homo sapiens
gaagggtttctcta

SEQ ID NO: 1634196 - DNA, 20 bp, Homo sapiens
aggggcacaccactgccctg

SEQ ID NO: 1634197 - DNA, 22 bp, Homo sapiens
aggggcacgccctcctcagcga

SEQ ID NO: 1634198 - DNA, 12 bp, Homo sapiens
aggggcagcagg

SEQ ID NO: 1634199 - DNA, 19 bp, Homo sapiens
aggggcagccacaccactg

SEQ ID NO: 1634200 - DNA, 13 bp, Homo sapiens
aggggcagccctt

SEQ ID NO: 1634201 - DNA, 17 bp, Homo sapiens
aggggcagcctgtgcct

SEQ ID NO: 1634202 - DNA, 20 bp, Homo sapiens
aggggcagcgcatgtgtgca

SEQ ID NO: 1634203 - DNA, 17 bp, Homo sapiens
aggggcaggcctgggac

SEQ ID NO: 1634204 - DNA, 18 bp, Homo sapiens
aggggcaggcctgggacc

SEQ ID NO: 1634205 - DNA, 12 bp, Homo sapiens
aggggcaggctg

SEQ ID NO: 1634206 - DNA, 13 bp, Homo sapiens
aggggcaggctga

SEQ ID NO: 1634207 - DNA, 11 bp, Homo sapiens
aggggcaggga

SEQ ID NO: 1634208 - DNA, 13 bp, Homo sapiens
aggggcagggaag

SEQ ID NO: 1634209 - DNA, 17 bp, Homo sapiens
aggggcatctgcccctc

SEQ ID NO: 1634210 - DNA, 22 bp, Homo sapiens
aggggcatgtattggcctggag

SEQ ID NO: 1634211 - DNA, 11 bp, Homo sapiens
aggggccacct

SEQ ID NO: 1634212 - DNA, 13 bp, Homo sapiens
aggggccacctcc

SEQ ID NO: 1634213 - DNA, 14 bp, Homo sapiens
aggggccacctcct

SEQ ID NO: 1634214 - DNA, 18 bp, Homo sapiens
aggggccacctcctcccc

SEQ ID NO: 1634215 - DNA, 20 bp, Homo sapiens
aggggccccggggctggcaa

SEQ ID NO: 1634216 - DNA, 14 bp, Homo sapiens
aggggccctcactc

SEQ ID NO: 1634217 - DNA, 13 bp, Homo sapiens
aggggccggccct

SEQ ID NO: 1634218 - DNA, 12 bp, Homo sapiens
aggggcctaggg

SEQ ID NO: 1634219 - DNA, 15 bp, Homo sapiens
aggggcctctgttcc

SEQ ID NO: 1634220 - DNA, 20 bp, Homo sapiens
aggggcctctgttcctttct

SEQ ID NO: 1634221 - DNA, 13 bp, Homo sapiens
aggggcctgcaga

SEQ ID NO: 1634222 - DNA, 12 bp, Homo sapiens
aggggcctggag

SEQ ID NO: 1634223 - DNA, 22 bp, Homo sapiens
aggggcctggagatcctcctgc

SEQ ID NO: 1634224 - DNA, 13 bp, Homo sapiens
aggggcctggagg

SEQ ID NO: 1634225 - DNA, 17 bp, Homo sapiens
aggggccttagggcact

SEQ ID NO: 1634226 - DNA, 19 bp, Homo sapiens
aggggccttagggcactgg

SEQ ID NO: 1634227 - DNA, 13 bp, Homo sapiens
aggggcgctggcc

SEQ ID NO: 1634228 - DNA, 14 bp, Homo sapiens
aggggcgctggccc

SEQ ID NO: 1634229 - DNA, 16 bp, Homo sapiens
aggggctcctgagtgt

SEQ ID NO: 1634230 - DNA, 11 bp, Homo sapiens
aggggctctgc

SEQ ID NO: 1634231 - DNA, 13 bp, Homo sapiens
aggggctgctggg

SEQ ID NO: 1634232 - DNA, 15 bp, Homo sapiens
aggggctgcttcctc

SEQ ID NO: 1634233 - DNA, 20 bp, Homo sapiens
aggggctgcttcctcctgga

SEQ ID NO: 1634234 - DNA, 21 bp, Homo sapiens
aggggctgcttcctcctggaa

SEQ ID NO: 1634235 - DNA, 18 bp, Homo sapiens
aggggctggggacttgtg

SEQ ID NO: 1634236 - DNA, 12 bp, Homo sapiens
aggggctggggc

SEQ ID NO: 1634237 - DNA, 13 bp, Homo sapiens
aggggctggggca

SEQ ID NO: 1634238 - DNA, 23 bp, Homo sapiens
aggggcttgagaaggttactgag

SEQ ID NO: 1634239 - DNA, 13 bp, Homo sapiens
aggggctttctct

SEQ ID NO: 1634240 - DNA, 15 bp, Homo sapiens
aggggctttctcttc

SEQ ID NO: 1634241 - DNA, 17 bp, Homo sapiens
aggggctttctggagag

SEQ ID NO: 1634242 - DNA, 17 bp, Homo sapiens
agggggaaaaggtggga

SEQ ID NO: 1634243 - DNA, 11 bp, Homo sapiens
agggggagaag

SEQ ID NO: 1634244 - DNA, 20 bp, Homo sapiens
agggggagggggttacaaac

SEQ ID NO: 1634245 - DNA, 20 bp, Homo sapiens
agggggatccgactgctttg

SEQ ID NO: 1634246 - DNA, 16 bp, Homo sapiens
agggggatgccactcc

SEQ ID NO: 1634247 - DNA, 13 bp, Homo sapiens
agggggccccgcc

SEQ ID NO: 1634248 - DNA, 23 bp, Homo sapiens
agggggccccgccagggctgggg

SEQ ID NO: 1634249 - DNA, 14 bp, Homo sapiens
agggggccctgcta

SEQ ID NO: 1634250 - DNA, 11 bp, Homo sapiens
agggggctctc

SEQ ID NO: 1634251 - DNA, 22 bp, Homo sapiens
agggggctctccaaaggggctg

SEQ ID NO: 1634252 - DNA, 16 bp, Homo sapiens
agggggctctgcccca

SEQ ID NO: 1634253 - DNA, 17 bp, Homo sapiens
agggggctctgccccag

SEQ ID NO: 1634254 - DNA, 18 bp, Homo sapiens
agggggctctgccccagg

SEQ ID NO: 1634255 - DNA, 17 bp, Homo sapiens
gaagtgaataactgcaa

SEQ ID NO: 1634256 - DNA, 18 bp, Homo sapiens
gaagtgaatctgattgca

SEQ ID NO: 1634257 - DNA, 13 bp, Homo sapiens
gaagtgagaagat

SEQ ID NO: 1634258 - DNA, 13 bp, Homo sapiens
gaagtgagagaaa

SEQ ID NO: 1634259 - DNA, 15 bp, Homo sapiens
gaagtgaggcccaag

SEQ ID NO: 1634260 - DNA, 17 bp, Homo sapiens
gaagtgcacaggagcca

SEQ ID NO: 1634261 - DNA, 18 bp, Homo sapiens
gaagtgcacaggagccaa

SEQ ID NO: 1634262 - DNA, 13 bp, Homo sapiens
gaagtgcccagcc

SEQ ID NO: 1634263 - DNA, 20 bp, Homo sapiens
gaagtgcccagcccctgccc

SEQ ID NO: 1634264 - DNA, 14 bp, Homo sapiens
gaagtgctccctgg

SEQ ID NO: 1634265 - DNA, 17 bp, Homo sapiens
gaagtgctccctggagg

SEQ ID NO: 1634266 - DNA, 18 bp, Homo sapiens
gaagtgctccctggaggc

SEQ ID NO: 1634267 - DNA, 20 bp, Homo sapiens
gaagtgctccctggaggcac

SEQ ID NO: 1634268 - DNA, 18 bp, Homo sapiens
gaagtgctcttggctgac

SEQ ID NO: 1634269 - DNA, 22 bp, Homo sapiens
gaagtgctcttggctgacccct

SEQ ID NO: 1634270 - DNA, 18 bp, Homo sapiens
gaagtgctgtttattaat

SEQ ID NO: 1634271 - DNA, 18 bp, Homo sapiens
gaagtgcttgatatgtaa

SEQ ID NO: 1634272 - DNA, 16 bp, Homo sapiens
gaagtggaccaggaca

SEQ ID NO: 1634273 - DNA, 22 bp, Homo sapiens
gaagtggaccaggacaggacca

SEQ ID NO: 1634274 - DNA, 23 bp, Homo sapiens
gaagtggagacagtcctttccca

SEQ ID NO: 1634275 - DNA, 15 bp, Homo sapiens
gaagtggctggtaga

SEQ ID NO: 1634276 - DNA, 19 bp, Homo sapiens
gaagtggctggtagaaaaa

SEQ ID NO: 1634277 - DNA, 20 bp, Homo sapiens
gaagtggctggtagaaaaag

SEQ ID NO: 1634278 - DNA, 19 bp, Homo sapiens
gaagtgggccaggacaggc

SEQ ID NO: 1634279 - DNA, 14 bp, Homo sapiens
gaagtgggtgccct

SEQ ID NO: 1634280 - DNA, 15 bp, Homo sapiens
gaagtggtttgtaga

SEQ ID NO: 1634281 - DNA, 17 bp, Homo sapiens
gaagtgtaacagctgag

SEQ ID NO: 1634282 - DNA, 14 bp, Homo sapiens
gaagtgtataatat

SEQ ID NO: 1634283 - DNA, 20 bp, Homo sapiens
gaagtgtccgagaactaaag

SEQ ID NO: 1634284 - DNA, 18 bp, Homo sapiens
gaagtgttcaagaaataa

SEQ ID NO: 1634285 - DNA, 15 bp, Homo sapiens
gaagttaaagggaag

SEQ ID NO: 1634286 - DNA, 21 bp, Homo sapiens
gaagttaaagggaagaaaaca

SEQ ID NO: 1634287 - DNA, 15 bp, Homo sapiens
gaagttaacagagac

SEQ ID NO: 1634288 - DNA, 20 bp, Homo sapiens
gaagttactttatgtttgtc

SEQ ID NO: 1634289 - DNA, 17 bp, Homo sapiens
gaagttagtttgtatat

SEQ ID NO: 1634290 - DNA, 20 bp, Homo sapiens
gaagttatgtgtatgtgagt

SEQ ID NO: 1634291 - DNA, 22 bp, Homo sapiens
gaagttgattcttatttgatgg

SEQ ID NO: 1634292 - DNA, 17 bp, Homo sapiens
gaagttgcagtgagctg

SEQ ID NO: 1634293 - DNA, 13 bp, Homo sapiens
gaagtttgtagcc

SEQ ID NO: 1634294 - DNA, 22 bp, Homo sapiens
gaagtttgttatagatttagct

SEQ ID NO: 1634295 - DNA, 23 bp, Homo sapiens
gaagttttcaggacttggtctga

SEQ ID NO: 1634296 - DNA, 12 bp, Homo sapiens
gaagttttgcat

SEQ ID NO: 1634297 - DNA, 12 bp, Homo sapiens
gaagttttgcta

SEQ ID NO: 1634298 - DNA, 18 bp, Homo sapiens
gaagttttggagagggaa

SEQ ID NO: 1634299 - DNA, 18 bp, Homo sapiens
gaataaaatctgctgcac

SEQ ID NO: 1634300 - DNA, 23 bp, Homo sapiens
gaataaacattaattttgtgcat

SEQ ID NO: 1634301 - DNA, 17 bp, Homo sapiens
gaataaaggcagttttc

SEQ ID NO: 1634302 - DNA, 13 bp, Homo sapiens
gaataaagttctg

SEQ ID NO: 1634303 - DNA, 20 bp, Homo sapiens
gaataaagttctgagtgttt

SEQ ID NO: 1634304 - DNA, 16 bp, Homo sapiens
gaataaagttgaagct

SEQ ID NO: 1634305 - DNA, 14 bp, Homo sapiens
gaataaagttgcag

SEQ ID NO: 1634306 - DNA, 17 bp, Homo sapiens
gaataaattatggcatt

SEQ ID NO: 1634307 - DNA, 21 bp, Homo sapiens
gaataaattatggcatttcta

SEQ ID NO: 1634308 - DNA, 23 bp, Homo sapiens
gaataaattatggcatttctatt

SEQ ID NO: 1634309 - DNA, 18 bp, Homo sapiens
gaataaattggattattt

SEQ ID NO: 1634310 - DNA, 20 bp, Homo sapiens
gaataaattggattattttc

SEQ ID NO: 1634311 - DNA, 12 bp, Homo sapiens
gaataacactgc

SEQ ID NO: 1634312 - DNA, 14 bp, Homo sapiens
agggtcctggctcc

SEQ ID NO: 1634313 - DNA, 16 bp, Homo sapiens
agggtcctggctcctg

SEQ ID NO: 1634314 - DNA, 23 bp, Homo sapiens
agggtcctgtcgaaggggaggca

SEQ ID NO: 1634315 - DNA, 15 bp, Homo sapiens
agggtcgaaagctct

SEQ ID NO: 1634316 - DNA, 17 bp, Homo sapiens
agggtcggaacccaagc

SEQ ID NO: 1634317 - DNA, 22 bp, Homo sapiens
agggtcggaacccaagcttaga

SEQ ID NO: 1634318 - DNA, 19 bp, Homo sapiens
agggtctagggagagaccc

SEQ ID NO: 1634319 - DNA, 19 bp, Homo sapiens
agggtctcgaactcctggc

SEQ ID NO: 1634320 - DNA, 21 bp, Homo sapiens
agggtctcgaactcctggcct

SEQ ID NO: 1634321 - DNA, 21 bp, Homo sapiens
agggtctgctctttctctgcc

SEQ ID NO: 1634322 - DNA, 22 bp, Homo sapiens
agggtctgctctttctctgcca

SEQ ID NO: 1634323 - DNA, 23 bp, Homo sapiens
agggtctgctctttctctgccag

SEQ ID NO: 1634324 - DNA, 13 bp, Homo sapiens
agggtctggagaa

SEQ ID NO: 1634325 - DNA, 19 bp, Homo sapiens
agggtctggagaagcagtg

SEQ ID NO: 1634326 - DNA, 12 bp, Homo sapiens
agggtctgggac

SEQ ID NO: 1634327 - DNA, 13 bp, Homo sapiens
agggtctgggatc

SEQ ID NO: 1634328 - DNA, 19 bp, Homo sapiens
agggtctgtttggactgca

SEQ ID NO: 1634329 - DNA, 15 bp, Homo sapiens
agggtcttccctacc

SEQ ID NO: 1634330 - DNA, 23 bp, Homo sapiens
agggtcttgggctactggcagct

SEQ ID NO: 1634331 - DNA, 21 bp, Homo sapiens
agggtctttctcaaagaaata

SEQ ID NO: 1634332 - DNA, 18 bp, Homo sapiens
agggtctttggtgttttt

SEQ ID NO: 1634333 - DNA, 17 bp, Homo sapiens
agggtgaaggaggtcag

SEQ ID NO: 1634334 - DNA, 14 bp, Homo sapiens
agggtgacgcccag

SEQ ID NO: 1634335 - DNA, 15 bp, Homo sapiens
agggtgacgcccagc

SEQ ID NO: 1634336 - DNA, 17 bp, Homo sapiens
agggtgacgcccagctc

SEQ ID NO: 1634337 - DNA, 21 bp, Homo sapiens
agggtgatgggaaagcattgt

SEQ ID NO: 1634338 - DNA, 17 bp, Homo sapiens
agggtgccctttggggt

SEQ ID NO: 1634339 - DNA, 21 bp, Homo sapiens
agggtgccctttggggtcccg

SEQ ID NO: 1634340 - DNA, 20 bp, Homo sapiens
agggtggaccccctgagtca

SEQ ID NO: 1634341 - DNA, 14 bp, Homo sapiens
agggtggacttcag

SEQ ID NO: 1634342 - DNA, 20 bp, Homo sapiens
agggtggcaggtcactgtca

SEQ ID NO: 1634343 - DNA, 19 bp, Homo sapiens
agggtggcctgttccctag

SEQ ID NO: 1634344 - DNA, 20 bp, Homo sapiens
agggtggcctgttccctaga

SEQ ID NO: 1634345 - DNA, 16 bp, Homo sapiens
agggtggctttaattg

SEQ ID NO: 1634346 - DNA, 12 bp, Homo sapiens
agggtgggaagg

SEQ ID NO: 1634347 - DNA, 18 bp, Homo sapiens
agggtgggatggaggaga

SEQ ID NO: 1634348 - DNA, 18 bp, Homo sapiens
agggtgggctctgaccca

SEQ ID NO: 1634349 - DNA, 17 bp, Homo sapiens
agggtgggggagggagg

SEQ ID NO: 1634350 - DNA, 18 bp, Homo sapiens
agggtgggggagggaggt

SEQ ID NO: 1634351 - DNA, 12 bp, Homo sapiens
agggtggggggt

SEQ ID NO: 1634352 - DNA, 23 bp, Homo sapiens
agggtggtgctgggactgagcca

SEQ ID NO: 1634353 - DNA, 21 bp, Homo sapiens
agggtgtaggggccacctcct

SEQ ID NO: 1634354 - DNA, 19 bp, Homo sapiens
agggtgtgtgttcaccttc

SEQ ID NO: 1634355 - DNA, 20 bp, Homo sapiens
agggtgtgtttgaaatcatc

SEQ ID NO: 1634356 - DNA, 16 bp, Homo sapiens
agggtgttctggcttt

SEQ ID NO: 1634357 - DNA, 17 bp, Homo sapiens
agggtgtttgcagctgt

SEQ ID NO: 1634358 - DNA, 13 bp, Homo sapiens
agggtgttttaaa

SEQ ID NO: 1634359 - DNA, 15 bp, Homo sapiens
agggttaaggcctga

SEQ ID NO: 1634360 - DNA, 20 bp, Homo sapiens
agggttacagagacctatgt

SEQ ID NO: 1634361 - DNA, 13 bp, Homo sapiens
agggttagggagg

SEQ ID NO: 1634362 - DNA, 18 bp, Homo sapiens
agggttcaaaatgtctgt

SEQ ID NO: 1634363 - DNA, 18 bp, Homo sapiens
agggttcagagactcagg

SEQ ID NO: 1634364 - DNA, 14 bp, Homo sapiens
agggttctgccctg

SEQ ID NO: 1634365 - DNA, 19 bp, Homo sapiens
agggttctgctcggcttct

SEQ ID NO: 1634366 - DNA, 21 bp, Homo sapiens
agggttctggtgtttggtttc

SEQ ID NO: 1634367 - DNA, 22 bp, Homo sapiens
agggttgaagacggaaaacaat

SEQ ID NO: 1634368 - DNA, 20 bp, Homo sapiens
agggttggggggtgccggca

SEQ ID NO: 1634369 - DNA, 21 bp, Homo sapiens
agggttgttaatggtgcaaat

SEQ ID NO: 1634370 - DNA, 16 bp, Homo sapiens
agggtttaatagactg

SEQ ID NO: 1634371 - DNA, 21 bp, Homo sapiens
agggtttcaccatgttggcca

SEQ ID NO: 1634372 - DNA, 17 bp, Homo sapiens
agggtttcgactggtcc

SEQ ID NO: 1634373 - DNA, 19 bp, Homo sapiens
gaatcagatcatttcaaaa

SEQ ID NO: 1634374 - DNA, 23 bp, Homo sapiens
gaatcaggaatattttccaaaga

SEQ ID NO: 1634375 - DNA, 19 bp, Homo sapiens
gaatcatatgattctgctt

SEQ ID NO: 1634376 - DNA, 17 bp, Homo sapiens
gaatcatgtttctttga

SEQ ID NO: 1634377 - DNA, 19 bp, Homo sapiens
gaatccaaatctgtcctct

SEQ ID NO: 1634378 - DNA, 17 bp, Homo sapiens
gaatccaagcctccaca

SEQ ID NO: 1634379 - DNA, 17 bp, Homo sapiens
gaatccaggaggcagtg

SEQ ID NO: 1634380 - DNA, 16 bp, Homo sapiens
gaatccagtttctttc

SEQ ID NO: 1634381 - DNA, 15 bp, Homo sapiens
gaatccataaatgtg

SEQ ID NO: 1634382 - DNA, 19 bp, Homo sapiens
gaatccataaatgtgttcc

SEQ ID NO: 1634383 - DNA, 20 bp, Homo sapiens
gaatccataaatgtgttcct

SEQ ID NO: 1634384 - DNA, 13 bp, Homo sapiens
gaatccatgcttg

SEQ ID NO: 1634385 - DNA, 17 bp, Homo sapiens
gaatccattggagaagc

SEQ ID NO: 1634386 - DNA, 15 bp, Homo sapiens
gaatcccaagaccca

SEQ ID NO: 1634387 - DNA, 14 bp, Homo sapiens
gaatcccacattag

SEQ ID NO: 1634388 - DNA, 18 bp, Homo sapiens
gaatcccacccacatgtg

SEQ ID NO: 1634389 - DNA, 16 bp, Homo sapiens
gaatcccactgtatga

SEQ ID NO: 1634390 - DNA, 19 bp, Homo sapiens
gaatccccaacatgcactg

SEQ ID NO: 1634391 - DNA, 19 bp, Homo sapiens
gaatccctgggagcgcctg

SEQ ID NO: 1634392 - DNA, 22 bp, Homo sapiens
gaatccctttgcacctgagacc

SEQ ID NO: 1634393 - DNA, 20 bp, Homo sapiens
gaatcctaggctccacccca

SEQ ID NO: 1634394 - DNA, 19 bp, Homo sapiens
gaatcctcagttggaatca

SEQ ID NO: 1634395 - DNA, 10 bp, Homo sapiens
gaatcctcct

SEQ ID NO: 1634396 - DNA, 12 bp, Homo sapiens
gaatcctggcaa

SEQ ID NO: 1634397 - DNA, 14 bp, Homo sapiens
gaatcctttacatt

SEQ ID NO: 1634398 - DNA, 13 bp, Homo sapiens
gaatcctttgaga

SEQ ID NO: 1634399 - DNA, 14 bp, Homo sapiens
gaatcgaagtgttt

SEQ ID NO: 1634400 - DNA, 16 bp, Homo sapiens
gaatcgatttcctccc

SEQ ID NO: 1634401 - DNA, 15 bp, Homo sapiens
gaatcgcagctgtgg

SEQ ID NO: 1634402 - DNA, 16 bp, Homo sapiens
gaatcgcagctgtggg

SEQ ID NO: 1634403 - DNA, 14 bp, Homo sapiens
gaatcggctgggga

SEQ ID NO: 1634404 - DNA, 14 bp, Homo sapiens
gaatctagaaatgt

SEQ ID NO: 1634405 - DNA, 18 bp, Homo sapiens
gaatctagggagggggaa

SEQ ID NO: 1634406 - DNA, 13 bp, Homo sapiens
gaatctatattta

SEQ ID NO: 1634407 - DNA, 15 bp, Homo sapiens
gaatctatgccaaag

SEQ ID NO: 1634408 - DNA, 22 bp, Homo sapiens
gaatctatgccaaagatcactt

SEQ ID NO: 1634409 - DNA, 21 bp, Homo sapiens
gaatctattatactgtattaa

SEQ ID NO: 1634410 - DNA, 16 bp, Homo sapiens
gaatctcaatgtacat

SEQ ID NO: 1634411 - DNA, 19 bp, Homo sapiens
gaatctcatccctcaactg

SEQ ID NO: 1634412 - DNA, 18 bp, Homo sapiens
gaatctcttcatgcttga

SEQ ID NO: 1634413 - DNA, 15 bp, Homo sapiens
gaatctgtgcagatg

SEQ ID NO: 1634414 - DNA, 16 bp, Homo sapiens
gaatctgtgcagatga

SEQ ID NO: 1634415 - DNA, 23 bp, Homo sapiens
gaatctgtgcagatgagcagtca

SEQ ID NO: 1634416 - DNA, 19 bp, Homo sapiens
gaatctgtgggtctgggag

SEQ ID NO: 1634417 - DNA, 15 bp, Homo sapiens
gaatctgtttctctg

SEQ ID NO: 1634418 - DNA, 18 bp, Homo sapiens
gaatctgtttctctgctg

SEQ ID NO: 1634419 - DNA, 17 bp, Homo sapiens
gaatcttcacctcagag

SEQ ID NO: 1634420 - DNA, 19 bp, Homo sapiens
gaatcttgactttctgatt

SEQ ID NO: 1634421 - DNA, 20 bp, Homo sapiens
gaatcttgttttgaaaataa

SEQ ID NO: 1634422 - DNA, 15 bp, Homo sapiens
gaatgaaaaaacagt

SEQ ID NO: 1634423 - DNA, 12 bp, Homo sapiens
gaatgaaaataa

SEQ ID NO: 1634424 - DNA, 22 bp, Homo sapiens
gaatgaaaatgcagtcctgagg

SEQ ID NO: 1634425 - DNA, 23 bp, Homo sapiens
gaatgaaatcctgcttcagtgta

SEQ ID NO: 1634426 - DNA, 13 bp, Homo sapiens
aggtcaccagctg

SEQ ID NO: 1634427 - DNA, 15 bp, Homo sapiens
aggtcaccagctgct

SEQ ID NO: 1634428 - DNA, 17 bp, Homo sapiens
aggtcaccagctgctgt

SEQ ID NO: 1634429 - DNA, 14 bp, Homo sapiens
aggtcaccagggga

SEQ ID NO: 1634430 - DNA, 22 bp, Homo sapiens
aggtcaccaggggaggagcctg

SEQ ID NO: 1634431 - DNA, 23 bp, Homo sapiens
aggtcactccaccatccccaccc

SEQ ID NO: 1634432 - DNA, 18 bp, Homo sapiens
aggtcactcctggggcct

SEQ ID NO: 1634433 - DNA, 19 bp, Homo sapiens
aggtcactcgtggtgaggc

SEQ ID NO: 1634434 - DNA, 21 bp, Homo sapiens
aggtcactggaaaggggagag

SEQ ID NO: 1634435 - DNA, 15 bp, Homo sapiens
aggtcactgtcactg

SEQ ID NO: 1634436 - DNA, 23 bp, Homo sapiens
aggtcactttttttttttttccc

SEQ ID NO: 1634437 - DNA, 16 bp, Homo sapiens
aggtcagcatgtctat

SEQ ID NO: 1634438 - DNA, 20 bp, Homo sapiens
aggtcagcccgtttcagaag

SEQ ID NO: 1634439 - DNA, 12 bp, Homo sapiens
aggtcagcctgg

SEQ ID NO: 1634440 - DNA, 12 bp, Homo sapiens
aggtcaggaaac

SEQ ID NO: 1634441 - DNA, 17 bp, Homo sapiens
aggtcaggatgcacatt

SEQ ID NO: 1634442 - DNA, 16 bp, Homo sapiens
aggtcagttgtaataa

SEQ ID NO: 1634443 - DNA, 16 bp, Homo sapiens
aggtcatattaatata

SEQ ID NO: 1634444 - DNA, 16 bp, Homo sapiens
aggtcatcagatgcct

SEQ ID NO: 1634445 - DNA, 19 bp, Homo sapiens
aggtcatcagatgcctgct

SEQ ID NO: 1634446 - DNA, 18 bp, Homo sapiens
aggtccaagggccatact

SEQ ID NO: 1634447 - DNA, 20 bp, Homo sapiens
aggtccacaggtctagacta

SEQ ID NO: 1634448 - DNA, 13 bp, Homo sapiens
aggtccagctctg

SEQ ID NO: 1634449 - DNA, 14 bp, Homo sapiens
aggtccagctctgg

SEQ ID NO: 1634450 - DNA, 15 bp, Homo sapiens
aggtccagctgggcc

SEQ ID NO: 1634451 - DNA, 19 bp, Homo sapiens
aggtccagctgggcctcct

SEQ ID NO: 1634452 - DNA, 23 bp, Homo sapiens
aggtccagctgggcctcctgcct

SEQ ID NO: 1634453 - DNA, 24 bp, Homo sapiens
aggtccagctgggcctcctgcctc

SEQ ID NO: 1634454 - DNA, 18 bp, Homo sapiens
aggtccattcattaatta

SEQ ID NO: 1634455 - DNA, 11 bp, Homo sapiens
aggtcccaggc

SEQ ID NO: 1634456 - DNA, 14 bp, Homo sapiens
aggtcccatgctcc

SEQ ID NO: 1634457 - DNA, 19 bp, Homo sapiens
aggtcccatgctccacccg

SEQ ID NO: 1634458 - DNA, 17 bp, Homo sapiens
aggtcccccgactgcct

SEQ ID NO: 1634459 - DNA, 13 bp, Homo sapiens
aggtcccggccag

SEQ ID NO: 1634460 - DNA, 14 bp, Homo sapiens
aggtcccggccagc

SEQ ID NO: 1634461 - DNA, 19 bp, Homo sapiens
aggtcccggccagctctgg

SEQ ID NO: 1634462 - DNA, 20 bp, Homo sapiens
aggtcccggccagctctgga

SEQ ID NO: 1634463 - DNA, 20 bp, Homo sapiens
aggtccctggaccagcctcc

SEQ ID NO: 1634464 - DNA, 19 bp, Homo sapiens
aggtccctttcatttgcta

SEQ ID NO: 1634465 - DNA, 18 bp, Homo sapiens
aggtccggtgttctaaga

SEQ ID NO: 1634466 - DNA, 20 bp, Homo sapiens
aggtcctcacttctgtctcc

SEQ ID NO: 1634467 - DNA, 16 bp, Homo sapiens
aggtcctcagaaagtg

SEQ ID NO: 1634468 - DNA, 19 bp, Homo sapiens
aggtcctgctccgctgcct

SEQ ID NO: 1634469 - DNA, 21 bp, Homo sapiens
aggtcctgctccgctgcctgg

SEQ ID NO: 1634470 - DNA, 23 bp, Homo sapiens
aggtcctgctccgctgcctggaa

SEQ ID NO: 1634471 - DNA, 16 bp, Homo sapiens
aggtccttctgctgga

SEQ ID NO: 1634472 - DNA, 20 bp, Homo sapiens
aggtcgcagctaccctcagc

SEQ ID NO: 1634473 - DNA, 16 bp, Homo sapiens
aggtcggagtgcctgg

SEQ ID NO: 1634474 - DNA, 13 bp, Homo sapiens
aggtctcactgct

SEQ ID NO: 1634475 - DNA, 17 bp, Homo sapiens
aggtctcatctcttcag

SEQ ID NO: 1634476 - DNA, 22 bp, Homo sapiens
aggtctcatctcttcaggttct

SEQ ID NO: 1634477 - DNA, 18 bp, Homo sapiens
aggtctccaggggcctgc

SEQ ID NO: 1634478 - DNA, 23 bp, Homo sapiens
aggtctccttactctgagcccag

SEQ ID NO: 1634479 - DNA, 14 bp, Homo sapiens
aggtctctccactg

SEQ ID NO: 1634480 - DNA, 22 bp, Homo sapiens
aggtctctccactgctctcagc

SEQ ID NO: 1634481 - DNA, 13 bp, Homo sapiens
aggtctctgggag

SEQ ID NO: 1634482 - DNA, 19 bp, Homo sapiens
aggtctctgggagcccaga

SEQ ID NO: 1634483 - DNA, 13 bp, Homo sapiens
aggtctgaaatgg

SEQ ID NO: 1634484 - DNA, 15 bp, Homo sapiens
aggtctgaaatggag

SEQ ID NO: 1634485 - DNA, 12 bp, Homo sapiens
aggtctgagccc

SEQ ID NO: 1634486 - DNA, 15 bp, Homo sapiens
aggtctgagccctgg

SEQ ID NO: 1634487 - DNA, 20 bp, Homo sapiens
aggtctgattggctgcttaa

SEQ ID NO: 1634488 - DNA, 20 bp, Homo sapiens
aggtctggaaggtctgatct

SEQ ID NO: 1634489 - DNA, 19 bp, Homo sapiens
aggtctggctgagcccctg

SEQ ID NO: 1634490 - DNA, 21 bp, Homo sapiens
aggtctggctgagcccctggg

SEQ ID NO: 1634491 - DNA, 19 bp, Homo sapiens
gaatggtgattttaaatgt

SEQ ID NO: 1634492 - DNA, 19 bp, Homo sapiens
gaatggtgtgaacccggga

SEQ ID NO: 1634493 - DNA, 22 bp, Homo sapiens
gaatggtgttttgtcagacttc

SEQ ID NO: 1634494 - DNA, 16 bp, Homo sapiens
gaatggttccatgcct

SEQ ID NO: 1634495 - DNA, 23 bp, Homo sapiens
gaatgtaaaacagagccattccc

SEQ ID NO: 1634496 - DNA, 18 bp, Homo sapiens
gaatgtaaagttacactg

SEQ ID NO: 1634497 - DNA, 18 bp, Homo sapiens
gaatgtaactgctgaaaa

SEQ ID NO: 1634498 - DNA, 22 bp, Homo sapiens
gaatgtaaggtatatcattcta

SEQ ID NO: 1634499 - DNA, 15 bp, Homo sapiens
gaatgtaattggaat

SEQ ID NO: 1634500 - DNA, 16 bp, Homo sapiens
gaatgtaattggaatc

SEQ ID NO: 1634501 - DNA, 17 bp, Homo sapiens
gaatgtagtttgaggaa

SEQ ID NO: 1634502 - DNA, 22 bp, Homo sapiens
gaatgtagtttgaggaaatttg

SEQ ID NO: 1634503 - DNA, 15 bp, Homo sapiens
gaatgtatcaggaaa

SEQ ID NO: 1634504 - DNA, 13 bp, Homo sapiens
gaatgtatttatt

SEQ ID NO: 1634505 - DNA, 22 bp, Homo sapiens
gaatgtattttcatagatgtgt

SEQ ID NO: 1634506 - DNA, 18 bp, Homo sapiens
gaatgtcagtatgtggaa

SEQ ID NO: 1634507 - DNA, 17 bp, Homo sapiens
gaatgtccccattctat

SEQ ID NO: 1634508 - DNA, 15 bp, Homo sapiens
gaatgtccttattct

SEQ ID NO: 1634509 - DNA, 18 bp, Homo sapiens
gaatgtgctggtgaacac

SEQ ID NO: 1634510 - DNA, 20 bp, Homo sapiens
gaatgtggtaagtggaggaa

SEQ ID NO: 1634511 - DNA, 22 bp, Homo sapiens
gaatgtggttacttcctactgt

SEQ ID NO: 1634512 - DNA, 17 bp, Homo sapiens
gaatgtgtgtgtgtggc

SEQ ID NO: 1634513 - DNA, 21 bp, Homo sapiens
gaatgtgtgtgtgtggcaggg

SEQ ID NO: 1634514 - DNA, 16 bp, Homo sapiens
gaatgtgttcttttct

SEQ ID NO: 1634515 - DNA, 16 bp, Homo sapiens
gaatgttactaaattt

SEQ ID NO: 1634516 - DNA, 22 bp, Homo sapiens
gaatgttatatcatcaatactt

SEQ ID NO: 1634517 - DNA, 15 bp, Homo sapiens
gaatgttccctgcac

SEQ ID NO: 1634518 - DNA, 20 bp, Homo sapiens
gaatgttccctgcaccctgg

SEQ ID NO: 1634519 - DNA, 22 bp, Homo sapiens
gaatgttcctgcctccttgata

SEQ ID NO: 1634520 - DNA, 21 bp, Homo sapiens
gaatgtttacactctttgtaa

SEQ ID NO: 1634521 - DNA, 16 bp, Homo sapiens
gaattaaaaagaagat

SEQ ID NO: 1634522 - DNA, 22 bp, Homo sapiens
gaattaaagtggaccaataggg

SEQ ID NO: 1634523 - DNA, 20 bp, Homo sapiens
gaattaaataaacccttcct

SEQ ID NO: 1634524 - DNA, 21 bp, Homo sapiens
gaattaaatcctccagctttt

SEQ ID NO: 1634525 - DNA, 21 bp, Homo sapiens
gaattaactataacaatcact

SEQ ID NO: 1634526 - DNA, 18 bp, Homo sapiens
gaattaattaatttggag

SEQ ID NO: 1634527 - DNA, 15 bp, Homo sapiens
gaattaatttctaaa

SEQ ID NO: 1634528 - DNA, 22 bp, Homo sapiens
gaattacatgtaaaacattatc

SEQ ID NO: 1634529 - DNA, 20 bp, Homo sapiens
gaattaccattaattacata

SEQ ID NO: 1634530 - DNA, 16 bp, Homo sapiens
gaattagagaagctga

SEQ ID NO: 1634531 - DNA, 18 bp, Homo sapiens
gaattagagaagctgaaa

SEQ ID NO: 1634532 - DNA, 17 bp, Homo sapiens
gaattagatttctatag

SEQ ID NO: 1634533 - DNA, 16 bp, Homo sapiens
gaattaggctgtaact

SEQ ID NO: 1634534 - DNA, 17 bp, Homo sapiens
gaattaggctgtaacta

SEQ ID NO: 1634535 - DNA, 21 bp, Homo sapiens
gaattataacagttatatttt

SEQ ID NO: 1634536 - DNA, 14 bp, Homo sapiens
gaattataactgta

SEQ ID NO: 1634537 - DNA, 16 bp, Homo sapiens
gaattatataattttc

SEQ ID NO: 1634538 - DNA, 22 bp, Homo sapiens
gaattatatatttctaactata

SEQ ID NO: 1634539 - DNA, 14 bp, Homo sapiens
gaattatctaattt

SEQ ID NO: 1634540 - DNA, 16 bp, Homo sapiens
aggcagggaggggact

SEQ ID NO: 1634541 - DNA, 24 bp, Homo sapiens
aggcagggcaaatgacatgcactg

SEQ ID NO: 1634542 - DNA, 16 bp, Homo sapiens
aggcagggcagaggga

SEQ ID NO: 1634543 - DNA, 21 bp, Homo sapiens
aggcagggccttgcccagaga

SEQ ID NO: 1634544 - DNA, 22 bp, Homo sapiens
aggcagggccttgcccagagat

SEQ ID NO: 1634545 - DNA, 23 bp, Homo sapiens
aggcagggccttgcccagagatg

SEQ ID NO: 1634546 - DNA, 21 bp, Homo sapiens
aggcagggctgggccaggtct

SEQ ID NO: 1634547 - DNA, 18 bp, Homo sapiens
aggcaggggacaagggag

SEQ ID NO: 1634548 - DNA, 21 bp, Homo sapiens
aggcaggggctctgcttcctc

SEQ ID NO: 1634549 - DNA, 16 bp, Homo sapiens
aggcagggggccctgc

SEQ ID NO: 1634550 - DNA, 20 bp, Homo sapiens
aggcagggggtgaggggcag

SEQ ID NO: 1634551 - DNA, 17 bp, Homo sapiens
aggcaggggtcctgcag

SEQ ID NO: 1634552 - DNA, 19 bp, Homo sapiens
aggcaggggtcctgcaggt

SEQ ID NO: 1634553 - DNA, 15 bp, Homo sapiens
aggcaggggtggggg

SEQ ID NO: 1634554 - DNA, 19 bp, Homo sapiens
aggcaggggtgggggtgga

SEQ ID NO: 1634555 - DNA, 23 bp, Homo sapiens
aggcaggggtgggggtggaggct

SEQ ID NO: 1634556 - DNA, 23 bp, Homo sapiens
aggcaggtctgcaagggcccaga

SEQ ID NO: 1634557 - DNA, 17 bp, Homo sapiens
aggcaggtgcctccagg

SEQ ID NO: 1634558 - DNA, 21 bp, Homo sapiens
aggcaggtttgccagtgaaga

SEQ ID NO: 1634559 - DNA, 22 bp, Homo sapiens
aggcaggtttgccagtgaagac

SEQ ID NO: 1634560 - DNA, 19 bp, Homo sapiens
aggcagtaataaaaagatt

SEQ ID NO: 1634561 - DNA, 19 bp, Homo sapiens
aggcagtattttgtgtcct

SEQ ID NO: 1634562 - DNA, 20 bp, Homo sapiens
aggcagtcgggggctggcct

SEQ ID NO: 1634563 - DNA, 23 bp, Homo sapiens
aggcagtcgggggctggcctagg

SEQ ID NO: 1634564 - DNA, 21 bp, Homo sapiens
aggcagtctctatattatgtc

SEQ ID NO: 1634565 - DNA, 15 bp, Homo sapiens
aggcagtctgaaccc

SEQ ID NO: 1634566 - DNA, 16 bp, Homo sapiens
aggcagtctgaaccct

SEQ ID NO: 1634567 - DNA, 15 bp, Homo sapiens
aggcagtctttgctc

SEQ ID NO: 1634568 - DNA, 24 bp, Homo sapiens
aggcagtgatgacttgctgtccag

SEQ ID NO: 1634569 - DNA, 14 bp, Homo sapiens
aggcagtggcaggg

SEQ ID NO: 1634570 - DNA, 17 bp, Homo sapiens
aggcagtggcaggggag

SEQ ID NO: 1634571 - DNA, 20 bp, Homo sapiens
aggcagtggcaggggagcag

SEQ ID NO: 1634572 - DNA, 16 bp, Homo sapiens
aggcagtggctagtgg

SEQ ID NO: 1634573 - DNA, 14 bp, Homo sapiens
aggcagttctagaa

SEQ ID NO: 1634574 - DNA, 12 bp, Homo sapiens
aggcagttttct

SEQ ID NO: 1634575 - DNA, 18 bp, Homo sapiens
aggcataggcctgggtgc

SEQ ID NO: 1634576 - DNA, 22 bp, Homo sapiens
aggcatatcttctatatctgaa

SEQ ID NO: 1634577 - DNA, 12 bp, Homo sapiens
aggcatcaggaa

SEQ ID NO: 1634578 - DNA, 19 bp, Homo sapiens
aggcatcagtccctatgta

SEQ ID NO: 1634579 - DNA, 16 bp, Homo sapiens
aggcatcatgcagagt

SEQ ID NO: 1634580 - DNA, 16 bp, Homo sapiens
aggcatccaggccagg

SEQ ID NO: 1634581 - DNA, 13 bp, Homo sapiens
aggcatcccaggg

SEQ ID NO: 1634582 - DNA, 16 bp, Homo sapiens
aggcatcccaggggac

SEQ ID NO: 1634583 - DNA, 17 bp, Homo sapiens
aggcatcccaggggacc

SEQ ID NO: 1634584 - DNA, 17 bp, Homo sapiens
aggcatccttgtctttt

SEQ ID NO: 1634585 - DNA, 19 bp, Homo sapiens
aggcatctacacagcctgg

SEQ ID NO: 1634586 - DNA, 20 bp, Homo sapiens
aggcatctacacagcctgga

SEQ ID NO: 1634587 - DNA, 14 bp, Homo sapiens
aggcatctgcaccc

SEQ ID NO: 1634588 - DNA, 14 bp, Homo sapiens
aggcatcttttcta

SEQ ID NO: 1634589 - DNA, 20 bp, Homo sapiens
aggcatgactaatgcttttt

SEQ ID NO: 1634590 - DNA, 18 bp, Homo sapiens
aggcatgcctctgatatg

SEQ ID NO: 1634591 - DNA, 23 bp, Homo sapiens
aggcatgcctctgatatgggact

SEQ ID NO: 1634592 - DNA, 22 bp, Homo sapiens
aggcatggggcatgtcctttcc

SEQ ID NO: 1634593 - DNA, 20 bp, Homo sapiens
aggcatggtcccttaaggca

SEQ ID NO: 1634594 - DNA, 15 bp, Homo sapiens
aggcatgtcccaccc

SEQ ID NO: 1634595 - DNA, 16 bp, Homo sapiens
aggcatgtcccaccca

SEQ ID NO: 1634596 - DNA, 14 bp, Homo sapiens
aggcatgtcctgga

SEQ ID NO: 1634597 - DNA, 15 bp, Homo sapiens
aggcatgtcttacgt

SEQ ID NO: 1634598 - DNA, 18 bp, Homo sapiens
aggcatgttcccagaaag

SEQ ID NO: 1634599 - DNA, 13 bp, Homo sapiens
aggcattaatgtt

SEQ ID NO: 1634600 - DNA, 21 bp, Homo sapiens
aggcattaatgtttctatctg

SEQ ID NO: 1634601 - DNA, 17 bp, Homo sapiens
aggcattcggggaagct

SEQ ID NO: 1634602 - DNA, 14 bp, Homo sapiens
aggcattggatatt

SEQ ID NO: 1634603 - DNA, 11 bp, Homo sapiens
aggcatttgtt

SEQ ID NO: 1634604 - DNA, 13 bp, Homo sapiens
aggccaaaaaaat

SEQ ID NO: 1634605 - DNA, 15 bp, Homo sapiens
aggccaaaatcaaga

SEQ ID NO: 1634606 - DNA, 17 bp, Homo sapiens
aggccaaaatcaagagt

SEQ ID NO: 1634607 - DNA, 15 bp, Homo sapiens
aggccaaagataaaa

SEQ ID NO: 1634608 - DNA, 16 bp, Homo sapiens
aggccaaaggctggtg

SEQ ID NO: 1634609 - DNA, 17 bp, Homo sapiens
aggccaagagcagaggc

SEQ ID NO: 1634610 - DNA, 20 bp, Homo sapiens
aggccaagagcagaggcagc

SEQ ID NO: 1634611 - DNA, 18 bp, Homo sapiens
aggccaagtcaggccctt

SEQ ID NO: 1634612 - DNA, 19 bp, Homo sapiens
aggccaagtctaatgaaga

SEQ ID NO: 1634613 - DNA, 17 bp, Homo sapiens
aggccacattgctggct

SEQ ID NO: 1634614 - DNA, 18 bp, Homo sapiens
aggccacattgctggctg

SEQ ID NO: 1634615 - DNA, 21 bp, Homo sapiens
aggccaccattataatttata

SEQ ID NO: 1634616 - DNA, 21 bp, Homo sapiens
aggccacccccatggaagcaa

SEQ ID NO: 1634617 - DNA, 20 bp, Homo sapiens
aggccaccccctatcctctg

SEQ ID NO: 1634618 - DNA, 14 bp, Homo sapiens
aggccaccgggaca

SEQ ID NO: 1634619 - DNA, 18 bp, Homo sapiens
aggccaccgggacagacc

SEQ ID NO: 1634620 - DNA, 14 bp, Homo sapiens
aggccacctcccac

SEQ ID NO: 1634621 - DNA, 16 bp, Homo sapiens
aggccacctcccactc

SEQ ID NO: 1634622 - DNA, 21 bp, Homo sapiens
aggccacctcccactcctgct

SEQ ID NO: 1634623 - DNA, 22 bp, Homo sapiens
aggccacctcccactcctgctg

SEQ ID NO: 1634624 - DNA, 14 bp, Homo sapiens
aggccacctcccca

SEQ ID NO: 1634625 - DNA, 17 bp, Homo sapiens
aggccacctccccagca

SEQ ID NO: 1634626 - DNA, 15 bp, Homo sapiens
aggccactgtggcca

SEQ ID NO: 1634627 - DNA, 18 bp, Homo sapiens
aggccactgtggccagag

SEQ ID NO: 1634628 - DNA, 20 bp, Homo sapiens
aggccactgtggccagagct

SEQ ID NO: 1634629 - DNA, 22 bp, Homo sapiens
aggccactgtggccagagctgg

SEQ ID NO: 1634630 - DNA, 22 bp, Homo sapiens
aggccagacatggtgtctcaca

SEQ ID NO: 1634631 - DNA, 22 bp, Homo sapiens
aggccagaggcccccagcccag

SEQ ID NO: 1634632 - DNA, 15 bp, Homo sapiens
aggccagagggcagt

SEQ ID NO: 1634633 - DNA, 16 bp, Homo sapiens
aggccagagtggcctg

SEQ ID NO: 1634634 - DNA, 21 bp, Homo sapiens
aggccagagtggcctggccag

SEQ ID NO: 1634635 - DNA, 14 bp, Homo sapiens
aggccagcaacatt

SEQ ID NO: 1634636 - DNA, 13 bp, Homo sapiens
aggccagcaacgc

SEQ ID NO: 1634637 - DNA, 17 bp, Homo sapiens
aggccagcaacgcttgt

SEQ ID NO: 1634638 - DNA, 12 bp, Homo sapiens
aggccagcccag

SEQ ID NO: 1634639 - DNA, 13 bp, Homo sapiens
aggccagcccagc

SEQ ID NO: 1634640 - DNA, 14 bp, Homo sapiens
aggccagcccagcc

SEQ ID NO: 1634641 - DNA, 15 bp, Homo sapiens
aggccagcccagcca

SEQ ID NO: 1634642 - DNA, 16 bp, Homo sapiens
aggccagcccagccag

SEQ ID NO: 1634643 - DNA, 17 bp, Homo sapiens
aggccagcccagccagg

SEQ ID NO: 1634644 - DNA, 18 bp, Homo sapiens
aggccagcccagccaggc

SEQ ID NO: 1634645 - DNA, 19 bp, Homo sapiens
aggccagcccagccaggcc

SEQ ID NO: 1634646 - DNA, 14 bp, Homo sapiens
aggccagccccacc

SEQ ID NO: 1634647 - DNA, 17 bp, Homo sapiens
aggccagccccacccag

SEQ ID NO: 1634648 - DNA, 18 bp, Homo sapiens
aggccagccccacccagg

SEQ ID NO: 1634649 - DNA, 21 bp, Homo sapiens
aggccagccccacccaggagg

SEQ ID NO: 1634650 - DNA, 16 bp, Homo sapiens
aggccagcccggacct

SEQ ID NO: 1634651 - DNA, 20 bp, Homo sapiens
aggccagccctccctggctg

SEQ ID NO: 1634652 - DNA, 11 bp, Homo sapiens
aggccagcctc

SEQ ID NO: 1634653 - DNA, 14 bp, Homo sapiens
aggccagcctccga

SEQ ID NO: 1634654 - DNA, 18 bp, Homo sapiens
aggccagcctccgagagg

SEQ ID NO: 1634655 - DNA, 13 bp, Homo sapiens
aggccagcctggc

SEQ ID NO: 1634656 - DNA, 20 bp, Homo sapiens
ctttgttatttttgtttctt

SEQ ID NO: 1634657 - DNA, 18 bp, Homo sapiens
ctttgttcatagcccagt

SEQ ID NO: 1634658 - DNA, 13 bp, Homo sapiens
ctttgttctgttt

SEQ ID NO: 1634659 - DNA, 17 bp, Homo sapiens
ctttgttgaactgttag

SEQ ID NO: 1634660 - DNA, 18 bp, Homo sapiens
ctttgttgatttagatga

SEQ ID NO: 1634661 - DNA, 21 bp, Homo sapiens
ctttgttgcaagatgtgaatt

SEQ ID NO: 1634662 - DNA, 14 bp, Homo sapiens
ctttgtttagcctg

SEQ ID NO: 1634663 - DNA, 13 bp, Homo sapiens
ctttgtttctttt

SEQ ID NO: 1634664 - DNA, 22 bp, Homo sapiens
ctttgtttctttttacagcatt

SEQ ID NO: 1634665 - DNA, 15 bp, Homo sapiens
ctttgtttgttcttg

SEQ ID NO: 1634666 - DNA, 15 bp, Homo sapiens
ctttgttttatttta

SEQ ID NO: 1634667 - DNA, 20 bp, Homo sapiens
ctttgttttctgactaatta

SEQ ID NO: 1634668 - DNA, 18 bp, Homo sapiens
ctttgttttttgttggag

SEQ ID NO: 1634669 - DNA, 15 bp, Homo sapiens
cttttaaaaaaattt

SEQ ID NO: 1634670 - DNA, 18 bp, Homo sapiens
cttttaaaaacataacat

SEQ ID NO: 1634671 - DNA, 22 bp, Homo sapiens
cttttaaaaatgtttggtttca

SEQ ID NO: 1634672 - DNA, 19 bp, Homo sapiens
cttttaaaatgcaatgtaa

SEQ ID NO: 1634673 - DNA, 20 bp, Homo sapiens
cttttaaaatgtagaaactt

SEQ ID NO: 1634674 - DNA, 17 bp, Homo sapiens
cttttaaaattcaaaag

SEQ ID NO: 1634675 - DNA, 13 bp, Homo sapiens
cttttaaactgtg

SEQ ID NO: 1634676 - DNA, 15 bp, Homo sapiens
cttttaaactgtgta

SEQ ID NO: 1634677 - DNA, 22 bp, Homo sapiens
cttttaaatgattgaattatat

SEQ ID NO: 1634678 - DNA, 22 bp, Homo sapiens
cttttaactgttgtagaagaca

SEQ ID NO: 1634679 - DNA, 13 bp, Homo sapiens
cttttaagaaaca

SEQ ID NO: 1634680 - DNA, 14 bp, Homo sapiens
cttttaaggataaa

SEQ ID NO: 1634681 - DNA, 17 bp, Homo sapiens
cttttaagtgccttgga

SEQ ID NO: 1634682 - DNA, 22 bp, Homo sapiens
cttttaataaacttttttttga

SEQ ID NO: 1634683 - DNA, 15 bp, Homo sapiens
cttttaatcagtgaa

SEQ ID NO: 1634684 - DNA, 16 bp, Homo sapiens
cttttaatcagtgaag

SEQ ID NO: 1634685 - DNA, 16 bp, Homo sapiens
cttttaattaatgaaa

SEQ ID NO: 1634686 - DNA, 19 bp, Homo sapiens
cttttaattaatgaaatat

SEQ ID NO: 1634687 - DNA, 12 bp, Homo sapiens
cttttaattcat

SEQ ID NO: 1634688 - DNA, 17 bp, Homo sapiens
cttttaattgaaattaa

SEQ ID NO: 1634689 - DNA, 19 bp, Homo sapiens
cttttaattgaaattaact

SEQ ID NO: 1634690 - DNA, 12 bp, Homo sapiens
cttttacattgt

SEQ ID NO: 1634691 - DNA, 19 bp, Homo sapiens
cttttaccagtttctttgt

SEQ ID NO: 1634692 - DNA, 21 bp, Homo sapiens
cttttaccttttttttttctt

SEQ ID NO: 1634693 - DNA, 14 bp, Homo sapiens
cttttactctgcct

SEQ ID NO: 1634694 - DNA, 17 bp, Homo sapiens
cttttagaaatgcatat

SEQ ID NO: 1634695 - DNA, 17 bp, Homo sapiens
cttttagacaactagat

SEQ ID NO: 1634696 - DNA, 14 bp, Homo sapiens
cttttaggaaaatc

SEQ ID NO: 1634697 - DNA, 20 bp, Homo sapiens
cttttaggaaaatcactttg

SEQ ID NO: 1634698 - DNA, 17 bp, Homo sapiens
cttttaggacccttccc

SEQ ID NO: 1634699 - DNA, 16 bp, Homo sapiens
cttttaggccaaaaaa

SEQ ID NO: 1634700 - DNA, 14 bp, Homo sapiens
cttttataaagcat

SEQ ID NO: 1634701 - DNA, 16 bp, Homo sapiens
cttttataaagcatgt

SEQ ID NO: 1634702 - DNA, 21 bp, Homo sapiens
cttttataattctcattaaaa

SEQ ID NO: 1634703 - DNA, 13 bp, Homo sapiens
cttttatatctgt

SEQ ID NO: 1634704 - DNA, 14 bp, Homo sapiens
cttttatatctgta

SEQ ID NO: 1634705 - DNA, 14 bp, Homo sapiens
cttttatatttgta

SEQ ID NO: 1634706 - DNA, 22 bp, Homo sapiens
cttttatcccaaagttgttgta

SEQ ID NO: 1634707 - DNA, 18 bp, Homo sapiens
cttttatgatgtatattt

SEQ ID NO: 1634708 - DNA, 18 bp, Homo sapiens
cttttatgcaaaaggttt

SEQ ID NO: 1634709 - DNA, 23 bp, Homo sapiens
cttttatttagggccttttctgt

SEQ ID NO: 1634710 - DNA, 20 bp, Homo sapiens
cttttattttacacagaaac

SEQ ID NO: 1634711 - DNA, 14 bp, Homo sapiens
cttttattttggaa

SEQ ID NO: 1634712 - DNA, 22 bp, Homo sapiens
cttttatttttatttctgactc

SEQ ID NO: 1634713 - DNA, 19 bp, Homo sapiens
cttttattttttaaatgta

SEQ ID NO: 1634714 - DNA, 23 bp, Homo sapiens
cttttattttttaaatgtaaaat

SEQ ID NO: 1634715 - DNA, 19 bp, Homo sapiens
cttttattttttcttttgt

SEQ ID NO: 1634716 - DNA, 23 bp, Homo sapiens
cttttattttttcttttgtaatt

SEQ ID NO: 1634717 - DNA, 15 bp, Homo sapiens
cttttcaatgacatt

SEQ ID NO: 1634718 - DNA, 13 bp, Homo sapiens
cttttcacactgt

SEQ ID NO: 1634719 - DNA, 18 bp, Homo sapiens
cttttcacactgtcttcc

SEQ ID NO: 1634720 - DNA, 19 bp, Homo sapiens
cttttcacactgtcttccc

SEQ ID NO: 1634721 - DNA, 20 bp, Homo sapiens
cttttcacatagctgtctag

SEQ ID NO: 1634722 - DNA, 21 bp, Homo sapiens
cttttcacattagataaatta

SEQ ID NO: 1634723 - DNA, 14 bp, Homo sapiens
cttttcaccaatga

SEQ ID NO: 1634724 - DNA, 19 bp, Homo sapiens
cttttcacgggaactctcc

SEQ ID NO: 1634725 - DNA, 18 bp, Homo sapiens
cttttcactgctggctgc

SEQ ID NO: 1634726 - DNA, 19 bp, Homo sapiens
cttttcactttattgctat

SEQ ID NO: 1634727 - DNA, 15 bp, Homo sapiens
cttttcatggaagtg

SEQ ID NO: 1634728 - DNA, 13 bp, Homo sapiens
cttttcatgtaga

SEQ ID NO: 1634729 - DNA, 15 bp, Homo sapiens
cttttcattagcagt

SEQ ID NO: 1634730 - DNA, 17 bp, Homo sapiens
cttttcattctctttta

SEQ ID NO: 1634731 - DNA, 22 bp, Homo sapiens
cttttccaaataaacatttttt

SEQ ID NO: 1634732 - DNA, 17 bp, Homo sapiens
cttttccaatatgtgat

SEQ ID NO: 1634733 - DNA, 19 bp, Homo sapiens
cttttccaggatcctgcag

SEQ ID NO: 1634734 - DNA, 20 bp, Homo sapiens
cttttcccaccttcaccttt

SEQ ID NO: 1634735 - DNA, 15 bp, Homo sapiens
cttttcccctttcct

SEQ ID NO: 1634736 - DNA, 22 bp, Homo sapiens
cttttcccctttcctgtcccac

SEQ ID NO: 1634737 - DNA, 22 bp, Homo sapiens
cttttccctctttggctcccct

SEQ ID NO: 1634738 - DNA, 15 bp, Homo sapiens
cttttccctgcttcc

SEQ ID NO: 1634739 - DNA, 18 bp, Homo sapiens
cttttccctgcttccagg

SEQ ID NO: 1634740 - DNA, 16 bp, Homo sapiens
cttttcccttgctgta

SEQ ID NO: 1634741 - DNA, 12 bp, Homo sapiens
cttttcctatcc

SEQ ID NO: 1634742 - DNA, 20 bp, Homo sapiens
cttttcctcaagcaataatt

SEQ ID NO: 1634743 - DNA, 15 bp, Homo sapiens
cttttcctcctccac

SEQ ID NO: 1634744 - DNA, 15 bp, Homo sapiens
cttttcctggtgctc

SEQ ID NO: 1634745 - DNA, 17 bp, Homo sapiens
cttttccttatttgcct

SEQ ID NO: 1634746 - DNA, 18 bp, Homo sapiens
cttttccttatttgcctt

SEQ ID NO: 1634747 - DNA, 20 bp, Homo sapiens
cttttccttatttgccttct

SEQ ID NO: 1634748 - DNA, 23 bp, Homo sapiens
cttttccttatttgccttctact

SEQ ID NO: 1634749 - DNA, 14 bp, Homo sapiens
cttttctaaatgtt

SEQ ID NO: 1634750 - DNA, 20 bp, Homo sapiens
cttttctaacagaaagcatg

SEQ ID NO: 1634751 - DNA, 13 bp, Homo sapiens
cttttctaagaaa

SEQ ID NO: 1634752 - DNA, 18 bp, Homo sapiens
cttttctaatgccttttg

SEQ ID NO: 1634753 - DNA, 16 bp, Homo sapiens
cttttctaccctagcc

SEQ ID NO: 1634754 - DNA, 17 bp, Homo sapiens
cttttctaccctagcca

SEQ ID NO: 1634755 - DNA, 18 bp, Homo sapiens
cttttctaccctagccat

SEQ ID NO: 1634756 - DNA, 18 bp, Homo sapiens
cttttctatttataagtg

SEQ ID NO: 1634757 - DNA, 16 bp, Homo sapiens
cttttctcctttacca

SEQ ID NO: 1634758 - DNA, 17 bp, Homo sapiens
cttttctcctttaccag

SEQ ID NO: 1634759 - DNA, 19 bp, Homo sapiens
cttttctcttttgctttct

SEQ ID NO: 1634760 - DNA, 18 bp, Homo sapiens
cttttctgagttcttgaa

SEQ ID NO: 1634761 - DNA, 12 bp, Homo sapiens
cttttctgcaga

SEQ ID NO: 1634762 - DNA, 14 bp, Homo sapiens
cttttctgccctgg

SEQ ID NO: 1634763 - DNA, 15 bp, Homo sapiens
cttttctgccctggc

SEQ ID NO: 1634764 - DNA, 19 bp, Homo sapiens
cttttctggaatgtaatca

SEQ ID NO: 1634765 - DNA, 13 bp, Homo sapiens
cttttctggagtt

SEQ ID NO: 1634766 - DNA, 12 bp, Homo sapiens
cttttctggcac

SEQ ID NO: 1634767 - DNA, 15 bp, Homo sapiens
cttttctggcaccgc

SEQ ID NO: 1634768 - DNA, 21 bp, Homo sapiens
cttttctggggaaagacactg

SEQ ID NO: 1634769 - DNA, 20 bp, Homo sapiens
cttttctggtgattctccag

SEQ ID NO: 1634770 - DNA, 13 bp, Homo sapiens
cttttctgtaatt

SEQ ID NO: 1634771 - DNA, 21 bp, Homo sapiens
cttttctgtcaccaaatttgt

SEQ ID NO: 1634772 - DNA, 22 bp, Homo sapiens
cttttctgtgccagacattgct

SEQ ID NO: 1634773 - DNA, 17 bp, Homo sapiens
aggccaggacgggccac

SEQ ID NO: 1634774 - DNA, 18 bp, Homo sapiens
aggccaggacgggccaca

SEQ ID NO: 1634775 - DNA, 19 bp, Homo sapiens
aggccaggacgggccacac

SEQ ID NO: 1634776 - DNA, 17 bp, Homo sapiens
aggccaggacgtctggg

SEQ ID NO: 1634777 - DNA, 19 bp, Homo sapiens
aggccagggagcagtggct

SEQ ID NO: 1634778 - DNA, 13 bp, Homo sapiens
aggccagggcagc

SEQ ID NO: 1634779 - DNA, 14 bp, Homo sapiens
aggccagggcagca

SEQ ID NO: 1634780 - DNA, 14 bp, Homo sapiens
aggccagggctcac

SEQ ID NO: 1634781 - DNA, 21 bp, Homo sapiens
aggccagggctcaccagctgg

SEQ ID NO: 1634782 - DNA, 16 bp, Homo sapiens
aggccagggctcctgt

SEQ ID NO: 1634783 - DNA, 20 bp, Homo sapiens
aggccagggctcctgtggca

SEQ ID NO: 1634784 - DNA, 22 bp, Homo sapiens
aggccaggggacccctgccagt

SEQ ID NO: 1634785 - DNA, 11 bp, Homo sapiens
aggccaggtcc

SEQ ID NO: 1634786 - DNA, 16 bp, Homo sapiens
aggccaggtccctgga

SEQ ID NO: 1634787 - DNA, 14 bp, Homo sapiens
aggccaggtgcagt

SEQ ID NO: 1634788 - DNA, 23 bp, Homo sapiens
aggccaggtgggaacggctgatg

SEQ ID NO: 1634789 - DNA, 15 bp, Homo sapiens
aggccatctcaggag

SEQ ID NO: 1634790 - DNA, 16 bp, Homo sapiens
aggccatctcaggaga

SEQ ID NO: 1634791 - DNA, 13 bp, Homo sapiens
aggccatgaaaaa

SEQ ID NO: 1634792 - DNA, 15 bp, Homo sapiens
aggccatggcagaat

SEQ ID NO: 1634793 - DNA, 18 bp, Homo sapiens
aggccatgggtggaaagt

SEQ ID NO: 1634794 - DNA, 14 bp, Homo sapiens
aggcccaaatgatg

SEQ ID NO: 1634795 - DNA, 15 bp, Homo sapiens
aggcccaaatgatgg

SEQ ID NO: 1634796 - DNA, 13 bp, Homo sapiens
aggcccaaggagc

SEQ ID NO: 1634797 - DNA, 15 bp, Homo sapiens
aggcccaaggctccc

SEQ ID NO: 1634798 - DNA, 10 bp, Homo sapiens
aggcccacca

SEQ ID NO: 1634799 - DNA, 17 bp, Homo sapiens
aggcccactagagggcc

SEQ ID NO: 1634800 - DNA, 19 bp, Homo sapiens
aggcccactagagggccca

SEQ ID NO: 1634801 - DNA, 20 bp, Homo sapiens
aggcccactagagggcccat

SEQ ID NO: 1634802 - DNA, 12 bp, Homo sapiens
aggcccactccc

SEQ ID NO: 1634803 - DNA, 21 bp, Homo sapiens
aggcccactccccagccccag

SEQ ID NO: 1634804 - DNA, 19 bp, Homo sapiens
aggcccagcattgctggtt

SEQ ID NO: 1634805 - DNA, 22 bp, Homo sapiens
aggcccagcattgctggttcta

SEQ ID NO: 1634806 - DNA, 17 bp, Homo sapiens
aggcccagccctcagaa

SEQ ID NO: 1634807 - DNA, 18 bp, Homo sapiens
aggcccagcgcggccagc

SEQ ID NO: 1634808 - DNA, 20 bp, Homo sapiens
aggcccagcgcggccagcgt

SEQ ID NO: 1634809 - DNA, 18 bp, Homo sapiens
aggcccagcgggcagatg

SEQ ID NO: 1634810 - DNA, 20 bp, Homo sapiens
aggcccaggagacctccagc

SEQ ID NO: 1634811 - DNA, 14 bp, Homo sapiens
aggcccaggcacca

SEQ ID NO: 1634812 - DNA, 23 bp, Homo sapiens
aggcccaggcaccaccaggagca

SEQ ID NO: 1634813 - DNA, 19 bp, Homo sapiens
aggcccagtgcatatgcaa

SEQ ID NO: 1634814 - DNA, 17 bp, Homo sapiens
aggcccagttcaccctg

SEQ ID NO: 1634815 - DNA, 21 bp, Homo sapiens
aggcccatctcaggtgccact

SEQ ID NO: 1634816 - DNA, 19 bp, Homo sapiens
aggccccaccggccaggcc

SEQ ID NO: 1634817 - DNA, 16 bp, Homo sapiens
aggccccactccttcc

SEQ ID NO: 1634818 - DNA, 13 bp, Homo sapiens
aggccccagaggc

SEQ ID NO: 1634819 - DNA, 20 bp, Homo sapiens
aggccccagaggccctggag

SEQ ID NO: 1634820 - DNA, 22 bp, Homo sapiens
aggccccagaggccctggaggt

SEQ ID NO: 1634821 - DNA, 18 bp, Homo sapiens
aggccccaggctgagagc

SEQ ID NO: 1634822 - DNA, 20 bp, Homo sapiens
aggcccccaaattgccttca

SEQ ID NO: 1634823 - DNA, 21 bp, Homo sapiens
aggcccccaaattgccttcag

SEQ ID NO: 1634824 - DNA, 18 bp, Homo sapiens
aggcccccagcccagggc

SEQ ID NO: 1634825 - DNA, 23 bp, Homo sapiens
aggcccccagcccagggctcctg

SEQ ID NO: 1634826 - DNA, 16 bp, Homo sapiens
aggccccccgcagcac

SEQ ID NO: 1634827 - DNA, 17 bp, Homo sapiens
aggccccccgcagcacc

SEQ ID NO: 1634828 - DNA, 20 bp, Homo sapiens
aggccccgatggactcctga

SEQ ID NO: 1634829 - DNA, 14 bp, Homo sapiens
aggccccgggcttc

SEQ ID NO: 1634830 - DNA, 22 bp, Homo sapiens
aggcccctaggtgcccagggcc

SEQ ID NO: 1634831 - DNA, 23 bp, Homo sapiens
aggcccctaggtgcccagggcca

SEQ ID NO: 1634832 - DNA, 15 bp, Homo sapiens
aggcccctcctagac

SEQ ID NO: 1634833 - DNA, 13 bp, Homo sapiens
aggcccctgagga

SEQ ID NO: 1634834 - DNA, 21 bp, Homo sapiens
aggcccctgaggactggagac

SEQ ID NO: 1634835 - DNA, 12 bp, Homo sapiens
aggcccctggcc

SEQ ID NO: 1634836 - DNA, 14 bp, Homo sapiens
aggcccctgggctc

SEQ ID NO: 1634837 - DNA, 20 bp, Homo sapiens
aggcccctgggctctcaccc

SEQ ID NO: 1634838 - DNA, 21 bp, Homo sapiens
aggcccctgggctctcaccca

SEQ ID NO: 1634839 - DNA, 22 bp, Homo sapiens
aggcccgcaccccggcctcagg

SEQ ID NO: 1634840 - DNA, 19 bp, Homo sapiens
aggcccgcatgcggcccag

SEQ ID NO: 1634841 - DNA, 18 bp, Homo sapiens
aggcccggctgagccccc

SEQ ID NO: 1634842 - DNA, 19 bp, Homo sapiens
aggcccggctgagcccccc

SEQ ID NO: 1634843 - DNA, 21 bp, Homo sapiens
aggcccgtcggagctgcctgc

SEQ ID NO: 1634844 - DNA, 16 bp, Homo sapiens
aggcccgtgggcgcaa

SEQ ID NO: 1634845 - DNA, 14 bp, Homo sapiens
aggccctcagtgag

SEQ ID NO: 1634846 - DNA, 23 bp, Homo sapiens
aggccctccctgttccccagaga

SEQ ID NO: 1634847 - DNA, 23 bp, Homo sapiens
aggccctcctctcccatccttga

SEQ ID NO: 1634848 - DNA, 15 bp, Homo sapiens
aggccctctgcctgc

SEQ ID NO: 1634849 - DNA, 18 bp, Homo sapiens
aggccctctgcctgcact

SEQ ID NO: 1634850 - DNA, 21 bp, Homo sapiens
aggccctctgcctgcactccc

SEQ ID NO: 1634851 - DNA, 23 bp, Homo sapiens
aggccctctgcctgcactccctg

SEQ ID NO: 1634852 - DNA, 15 bp, Homo sapiens
aggccctgagacagg

SEQ ID NO: 1634853 - DNA, 16 bp, Homo sapiens
aggccctgctgagtca

SEQ ID NO: 1634854 - DNA, 19 bp, Homo sapiens
aggccctgctttttttctt

SEQ ID NO: 1634855 - DNA, 21 bp, Homo sapiens
aggccctgctttttttcttaa

SEQ ID NO: 1634856 - DNA, 12 bp, Homo sapiens
aggccctggagg

SEQ ID NO: 1634857 - DNA, 13 bp, Homo sapiens
aggccctggaggt

SEQ ID NO: 1634858 - DNA, 12 bp, Homo sapiens
aggccctggttc

SEQ ID NO: 1634859 - DNA, 16 bp, Homo sapiens
aggccctgttccctgg

SEQ ID NO: 1634860 - DNA, 16 bp, Homo sapiens
aggcccttattttcaa

SEQ ID NO: 1634861 - DNA, 20 bp, Homo sapiens
aggcccttattttcaagaaa

SEQ ID NO: 1634862 - DNA, 13 bp, Homo sapiens
aggcccttcctct

SEQ ID NO: 1634863 - DNA, 18 bp, Homo sapiens
aggcccttgtcctgccag

SEQ ID NO: 1634864 - DNA, 19 bp, Homo sapiens
aggcccttgtcctgccagc

SEQ ID NO: 1634865 - DNA, 17 bp, Homo sapiens
aggccctttggcttctg

SEQ ID NO: 1634866 - DNA, 22 bp, Homo sapiens
aggccctttggcttctgatttt

SEQ ID NO: 1634867 - DNA, 14 bp, Homo sapiens
aggccgaagctctg

SEQ ID NO: 1634868 - DNA, 17 bp, Homo sapiens
aggccgaagctctggct

SEQ ID NO: 1634869 - DNA, 24 bp, Homo sapiens
aggccgaagctctggctgaaccct

SEQ ID NO: 1634870 - DNA, 18 bp, Homo sapiens
aggccgaaggtgcctcag

SEQ ID NO: 1634871 - DNA, 19 bp, Homo sapiens
aggccgaaggtgcctcaga

SEQ ID NO: 1634872 - DNA, 21 bp, Homo sapiens
aggccgaaggtgcctcagact

SEQ ID NO: 1634873 - DNA, 21 bp, Homo sapiens
aggccgaggaccaccagcagg

SEQ ID NO: 1634874 - DNA, 17 bp, Homo sapiens
aggccgaggtgggcaga

SEQ ID NO: 1634875 - DNA, 16 bp, Homo sapiens
aggccgagtggctgcc

SEQ ID NO: 1634876 - DNA, 17 bp, Homo sapiens
aggccgagtggctgccg

SEQ ID NO: 1634877 - DNA, 20 bp, Homo sapiens
aggccgcagctccattttct

SEQ ID NO: 1634878 - DNA, 13 bp, Homo sapiens
aggccgcagctct

SEQ ID NO: 1634879 - DNA, 18 bp, Homo sapiens
aggccgcagctcttgccc

SEQ ID NO: 1634880 - DNA, 22 bp, Homo sapiens
aggccgccagcgtgtggagcag

SEQ ID NO: 1634881 - DNA, 15 bp, Homo sapiens
aggccgccgtgacct

SEQ ID NO: 1634882 - DNA, 16 bp, Homo sapiens
aggccgccgtgaccta

SEQ ID NO: 1634883 - DNA, 16 bp, Homo sapiens
aggccgcgccctttcc

SEQ ID NO: 1634884 - DNA, 14 bp, Homo sapiens
aggccgctagaggc

SEQ ID NO: 1634885 - DNA, 20 bp, Homo sapiens
aggccgctgccccagccccg

SEQ ID NO: 1634886 - DNA, 18 bp, Homo sapiens
aggccggcagcgggcgga

SEQ ID NO: 1634887 - DNA, 21 bp, Homo sapiens
aggccgggccgaatcccctcc

SEQ ID NO: 1634888 - DNA, 23 bp, Homo sapiens
aggccgggcttgggccctgcaca

SEQ ID NO: 1634889 - DNA, 23 bp, Homo sapiens
cttttcttggaactgtcccagct

SEQ ID NO: 1634890 - DNA, 23 bp, Homo sapiens
cttttctttgaccagatctttct

SEQ ID NO: 1634891 - DNA, 18 bp, Homo sapiens
cttttctttttttcttta

SEQ ID NO: 1634892 - DNA, 22 bp, Homo sapiens
cttttgaaaagaccaagacttt

SEQ ID NO: 1634893 - DNA, 14 bp, Homo sapiens
cttttgaaagtaga

SEQ ID NO: 1634894 - DNA, 12 bp, Homo sapiens
cttttgaacttg

SEQ ID NO: 1634895 - DNA, 16 bp, Homo sapiens
cttttgaacttgtcac

SEQ ID NO: 1634896 - DNA, 19 bp, Homo sapiens
cttttgaatacatttgtat

SEQ ID NO: 1634897 - DNA, 20 bp, Homo sapiens
cttttgaatccatgcttggg

SEQ ID NO: 1634898 - DNA, 16 bp, Homo sapiens
cttttgacattttatt

SEQ ID NO: 1634899 - DNA, 23 bp, Homo sapiens
cttttgagtgtgtgtgtgcatgt

SEQ ID NO: 1634900 - DNA, 15 bp, Homo sapiens
cttttgataaattta

SEQ ID NO: 1634901 - DNA, 23 bp, Homo sapiens
cttttgatatgcatatttgttta

SEQ ID NO: 1634902 - DNA, 12 bp, Homo sapiens
cttttgcacccc

SEQ ID NO: 1634903 - DNA, 14 bp, Homo sapiens
cttttgcacccctc

SEQ ID NO: 1634904 - DNA, 15 bp, Homo sapiens
cttttgcacccctcc

SEQ ID NO: 1634905 - DNA, 17 bp, Homo sapiens
cttttgcacccctccca

SEQ ID NO: 1634906 - DNA, 23 bp, Homo sapiens
cttttgcatttctcttcctaaat

SEQ ID NO: 1634907 - DNA, 20 bp, Homo sapiens
cttttgcccttcacagtgtt

SEQ ID NO: 1634908 - DNA, 16 bp, Homo sapiens
cttttgcctgcaagag

SEQ ID NO: 1634909 - DNA, 16 bp, Homo sapiens
cttttgcctgcaggtc

SEQ ID NO: 1634910 - DNA, 15 bp, Homo sapiens
cttttgcctggctgt

SEQ ID NO: 1634911 - DNA, 16 bp, Homo sapiens
cttttgctagatggaa

SEQ ID NO: 1634912 - DNA, 15 bp, Homo sapiens
cttttgctctttttg

SEQ ID NO: 1634913 - DNA, 14 bp, Homo sapiens
cttttgctttaatt

SEQ ID NO: 1634914 - DNA, 18 bp, Homo sapiens
cttttgctttaattccat

SEQ ID NO: 1634915 - DNA, 18 bp, Homo sapiens
cttttggaagttttgcta

SEQ ID NO: 1634916 - DNA, 24 bp, Homo sapiens
cttttggaagttttgctagtgtgc

SEQ ID NO: 1634917 - DNA, 14 bp, Homo sapiens
cttttggaatgact

SEQ ID NO: 1634918 - DNA, 19 bp, Homo sapiens
cttttgggcctccttccca

SEQ ID NO: 1634919 - DNA, 22 bp, Homo sapiens
cttttggtctccttgggccctt

SEQ ID NO: 1634920 - DNA, 17 bp, Homo sapiens
cttttggtttgggggcg

SEQ ID NO: 1634921 - DNA, 13 bp, Homo sapiens
cttttgtaagaca

SEQ ID NO: 1634922 - DNA, 22 bp, Homo sapiens
cttttgtaattgtgtaaaaaat

SEQ ID NO: 1634923 - DNA, 23 bp, Homo sapiens
cttttgtactgaatttttttgta

SEQ ID NO: 1634924 - DNA, 15 bp, Homo sapiens
cttttgtagatggcg

SEQ ID NO: 1634925 - DNA, 22 bp, Homo sapiens
cttttgtagatggcgatgtgtt

SEQ ID NO: 1634926 - DNA, 20 bp, Homo sapiens
cttttgtagttttatttgta

SEQ ID NO: 1634927 - DNA, 21 bp, Homo sapiens
cttttgtagttttatttgtat

SEQ ID NO: 1634928 - DNA, 22 bp, Homo sapiens
cttttgtagttttatttgtatt

SEQ ID NO: 1634929 - DNA, 13 bp, Homo sapiens
cttttgtattaag

SEQ ID NO: 1634930 - DNA, 17 bp, Homo sapiens
cttttgtattaagaaag

SEQ ID NO: 1634931 - DNA, 14 bp, Homo sapiens
cttttgtcccagaa

SEQ ID NO: 1634932 - DNA, 15 bp, Homo sapiens
cttttgtccccaggg

SEQ ID NO: 1634933 - DNA, 13 bp, Homo sapiens
cttttgtgaatta

SEQ ID NO: 1634934 - DNA, 17 bp, Homo sapiens
cttttgtgatgaacata

SEQ ID NO: 1634935 - DNA, 19 bp, Homo sapiens
cttttgtgggtttctctgt

SEQ ID NO: 1634936 - DNA, 20 bp, Homo sapiens
cttttgtgggtttctctgtg

SEQ ID NO: 1634937 - DNA, 21 bp, Homo sapiens
cttttgtgggtttctctgtgc

SEQ ID NO: 1634938 - DNA, 18 bp, Homo sapiens
cttttgtgtaataagaaa

SEQ ID NO: 1634939 - DNA, 14 bp, Homo sapiens
cttttgtgtacagt

SEQ ID NO: 1634940 - DNA, 23 bp, Homo sapiens
cttttgtgtacagtgtgtaaagt

SEQ ID NO: 1634941 - DNA, 14 bp, Homo sapiens
cttttgttctagac

SEQ ID NO: 1634942 - DNA, 15 bp, Homo sapiens
cttttgttctagact

SEQ ID NO: 1634943 - DNA, 15 bp, Homo sapiens
cttttgttcttcccc

SEQ ID NO: 1634944 - DNA, 14 bp, Homo sapiens
cttttgttgtgact

SEQ ID NO: 1634945 - DNA, 21 bp, Homo sapiens
cttttgtttaaatataaatgt

SEQ ID NO: 1634946 - DNA, 15 bp, Homo sapiens
cttttgtttcttaag

SEQ ID NO: 1634947 - DNA, 19 bp, Homo sapiens
ctttttaaaaaactctttg

SEQ ID NO: 1634948 - DNA, 14 bp, Homo sapiens
ctttttaaaacaca

SEQ ID NO: 1634949 - DNA, 15 bp, Homo sapiens
ctttttaaatgtgaa

SEQ ID NO: 1634950 - DNA, 17 bp, Homo sapiens
ctttttaagaatatttt

SEQ ID NO: 1634951 - DNA, 16 bp, Homo sapiens
ctttttaatatgctta

SEQ ID NO: 1634952 - DNA, 14 bp, Homo sapiens
ctttttaattattt

SEQ ID NO: 1634953 - DNA, 16 bp, Homo sapiens
ctttttagaaagcatt

SEQ ID NO: 1634954 - DNA, 16 bp, Homo sapiens
ctttttagtaatttct

SEQ ID NO: 1634955 - DNA, 12 bp, Homo sapiens
ctttttatactc

SEQ ID NO: 1634956 - DNA, 13 bp, Homo sapiens
ctttttatactcc

SEQ ID NO: 1634957 - DNA, 18 bp, Homo sapiens
ctttttataggttttata

SEQ ID NO: 1634958 - DNA, 12 bp, Homo sapiens
ctttttatttat

SEQ ID NO: 1634959 - DNA, 19 bp, Homo sapiens
ctttttatttatatgtact

SEQ ID NO: 1634960 - DNA, 13 bp, Homo sapiens
ctttttatttgca

SEQ ID NO: 1634961 - DNA, 15 bp, Homo sapiens
ctttttatttgcatg

SEQ ID NO: 1634962 - DNA, 17 bp, Homo sapiens
ctttttcccctttctgt

SEQ ID NO: 1634963 - DNA, 16 bp, Homo sapiens
ctttttcccttccctc

SEQ ID NO: 1634964 - DNA, 18 bp, Homo sapiens
ctttttcccttccctcct

SEQ ID NO: 1634965 - DNA, 14 bp, Homo sapiens
ctttttctcagatc

SEQ ID NO: 1634966 - DNA, 22 bp, Homo sapiens
ctttttctccacactccactga

SEQ ID NO: 1634967 - DNA, 13 bp, Homo sapiens
ctttttctgttga

SEQ ID NO: 1634968 - DNA, 14 bp, Homo sapiens
ctttttcttaagaa

SEQ ID NO: 1634969 - DNA, 12 bp, Homo sapiens
ctttttcttccc

SEQ ID NO: 1634970 - DNA, 12 bp, Homo sapiens
ctttttctttat

SEQ ID NO: 1634971 - DNA, 18 bp, Homo sapiens
ctttttctttataaactt

SEQ ID NO: 1634972 - DNA, 17 bp, Homo sapiens
ctttttctttctttgtt

SEQ ID NO: 1634973 - DNA, 14 bp, Homo sapiens
ctttttctttttaa

SEQ ID NO: 1634974 - DNA, 21 bp, Homo sapiens
ctttttctttttttctttggt

SEQ ID NO: 1634975 - DNA, 16 bp, Homo sapiens
ctttttgaaagtaatt

SEQ ID NO: 1634976 - DNA, 18 bp, Homo sapiens
ctttttgaatctttaatt

SEQ ID NO: 1634977 - DNA, 22 bp, Homo sapiens
ctttttgattacagtgtagctt

SEQ ID NO: 1634978 - DNA, 18 bp, Homo sapiens
ctttttgctctaaaatat

SEQ ID NO: 1634979 - DNA, 12 bp, Homo sapiens
ctttttgcttct

SEQ ID NO: 1634980 - DNA, 15 bp, Homo sapiens
ctttttgcttctact

SEQ ID NO: 1634981 - DNA, 18 bp, Homo sapiens
ctttttgtactttggaac

SEQ ID NO: 1634982 - DNA, 13 bp, Homo sapiens
ctttttgtataaa

SEQ ID NO: 1634983 - DNA, 21 bp, Homo sapiens
ctttttgttctggtccttttt

SEQ ID NO: 1634984 - DNA, 22 bp, Homo sapiens
ctttttgttgttgttgttcttt

SEQ ID NO: 1634985 - DNA, 21 bp, Homo sapiens
cttttttaaggctctgtgcct

SEQ ID NO: 1634986 - DNA, 12 bp, Homo sapiens
cttttttaagtt

SEQ ID NO: 1634987 - DNA, 15 bp, Homo sapiens
cttttttatagctta

SEQ ID NO: 1634988 - DNA, 18 bp, Homo sapiens
cttttttatagcttaact

SEQ ID NO: 1634989 - DNA, 12 bp, Homo sapiens
cttttttatgtt

SEQ ID NO: 1634990 - DNA, 13 bp, Homo sapiens
cttttttatgtta

SEQ ID NO: 1634991 - DNA, 15 bp, Homo sapiens
cttttttcacaaatt

SEQ ID NO: 1634992 - DNA, 22 bp, Homo sapiens
cttttttcatggacactttgaa

SEQ ID NO: 1634993 - DNA, 23 bp, Homo sapiens
cttttttcttaaagcaaagtcac

SEQ ID NO: 1634994 - DNA, 20 bp, Homo sapiens
cttttttgaaataataaatc

SEQ ID NO: 1634995 - DNA, 18 bp, Homo sapiens
cttttttgataaagtttc

SEQ ID NO: 1634996 - DNA, 10 bp, Homo sapiens
cttttttgtc

SEQ ID NO: 1634997 - DNA, 19 bp, Homo sapiens
cttttttgtcccccaactt

SEQ ID NO: 1634998 - DNA, 16 bp, Homo sapiens
cttttttgtctatgaa

SEQ ID NO: 1634999 - DNA, 14 bp, Homo sapiens
cttttttgtgtatg

SEQ ID NO: 1635000 - DNA, 24 bp, Homo sapiens
cttttttgtgtatgtacttagctg

SEQ ID NO: 1635001 - DNA, 13 bp, Homo sapiens
cttttttgttttg

SEQ ID NO: 1635002 - DNA, 15 bp, Homo sapiens
ctttttttcttttct

SEQ ID NO: 1635003 - DNA, 16 bp, Homo sapiens
ctttttttgtatgtgt

SEQ ID NO: 1635004 - DNA, 23 bp, Homo sapiens
cttttttttgacagcttcctgtc

SEQ ID NO: 1635005 - DNA, 18 bp, Homo sapiens
ctttttttttaagttctt

SEQ ID NO: 1635006 - DNA, 21 bp, Homo sapiens
ctttttttttaagttcttatg

SEQ ID NO: 1635007 - DNA, 23 bp, Homo sapiens
ctttttttttatactgcacagtg

SEQ ID NO: 1635008 - DNA, 18 bp, Homo sapiens
ctttttttttctctttct

SEQ ID NO: 1635009 - DNA, 15 bp, Homo sapiens
gaaaaaaaaaaaagc

SEQ ID NO: 1635010 - DNA, 15 bp, Homo sapiens
gaaaaaaaaaacact

SEQ ID NO: 1635011 - DNA, 17 bp, Homo sapiens
gaaaaaaaaacagccac

SEQ ID NO: 1635012 - DNA, 13 bp, Homo sapiens
gaaaaaaaattat

SEQ ID NO: 1635013 - DNA, 18 bp, Homo sapiens
gaaaaaaacataaaaagc

SEQ ID NO: 1635014 - DNA, 16 bp, Homo sapiens
gaaaaaaaccacacaa

SEQ ID NO: 1635015 - DNA, 14 bp, Homo sapiens
gaaaaaaatactat

SEQ ID NO: 1635016 - DNA, 13 bp, Homo sapiens
gaaaaaagaacca

SEQ ID NO: 1635017 - DNA, 13 bp, Homo sapiens
gaaaaaagcaatt

SEQ ID NO: 1635018 - DNA, 17 bp, Homo sapiens
gaaaaaataacacacat

SEQ ID NO: 1635019 - DNA, 21 bp, Homo sapiens
gaaaaaataattgatttcaag

SEQ ID NO: 1635020 - DNA, 15 bp, Homo sapiens
gaaaaacaatcttat

SEQ ID NO: 1635021 - DNA, 18 bp, Homo sapiens
gaaaaacatctgaaagcc

SEQ ID NO: 1635022 - DNA, 13 bp, Homo sapiens
gaaaaacatgtca

SEQ ID NO: 1635023 - DNA, 23 bp, Homo sapiens
gaaaaactctgggaaataagaga

SEQ ID NO: 1635024 - DNA, 19 bp, Homo sapiens
gaaaaactgatcaaaaata

SEQ ID NO: 1635025 - DNA, 22 bp, Homo sapiens
gaaaaactgatcaaaaataaac

SEQ ID NO: 1635026 - DNA, 20 bp, Homo sapiens
gaaaaacttccatgaggcca

SEQ ID NO: 1635027 - DNA, 21 bp, Homo sapiens
gaaaaactttggaaccagact

SEQ ID NO: 1635028 - DNA, 14 bp, Homo sapiens
gaaaaagaaatgca

SEQ ID NO: 1635029 - DNA, 14 bp, Homo sapiens
gaaaaagcatgatg

SEQ ID NO: 1635030 - DNA, 20 bp, Homo sapiens
gaaaaagcatgatgggaaaa

SEQ ID NO: 1635031 - DNA, 21 bp, Homo sapiens
gaaaaagcatgatgggaaaat

SEQ ID NO: 1635032 - DNA, 17 bp, Homo sapiens
gaaaaagctgcttctta

SEQ ID NO: 1635033 - DNA, 23 bp, Homo sapiens
gaaaaagtacaatgaactgcttt

SEQ ID NO: 1635034 - DNA, 15 bp, Homo sapiens
gaaaaataacaacta

SEQ ID NO: 1635035 - DNA, 22 bp, Homo sapiens
gaaaaataccatgtctctaagc

SEQ ID NO: 1635036 - DNA, 16 bp, Homo sapiens
gaaaaatatcttggcc

SEQ ID NO: 1635037 - DNA, 17 bp, Homo sapiens
gaaaaatcatgggccag

SEQ ID NO: 1635038 - DNA, 20 bp, Homo sapiens
gaaaaatctcaattgaaagc

SEQ ID NO: 1635039 - DNA, 17 bp, Homo sapiens
gaaaaatgctccccaca

SEQ ID NO: 1635040 - DNA, 20 bp, Homo sapiens
gaaaaatgggagccaggagt

SEQ ID NO: 1635041 - DNA, 16 bp, Homo sapiens
gaaaaatgttaggaca

SEQ ID NO: 1635042 - DNA, 15 bp, Homo sapiens
gaaaaatgttcttta

SEQ ID NO: 1635043 - DNA, 20 bp, Homo sapiens
gaaaaattcagcaaaccatt

SEQ ID NO: 1635044 - DNA, 16 bp, Homo sapiens
gaaaaattggggagga

SEQ ID NO: 1635045 - DNA, 19 bp, Homo sapiens
gaaaaattggggaggaggg

SEQ ID NO: 1635046 - DNA, 15 bp, Homo sapiens
gaaaaatttttatgt

SEQ ID NO: 1635047 - DNA, 22 bp, Homo sapiens
gaaaacaaaaccaaaagttatt

SEQ ID NO: 1635048 - DNA, 15 bp, Homo sapiens
gaaaacaaagttcta

SEQ ID NO: 1635049 - DNA, 20 bp, Homo sapiens
gaaaacaacttggcatttct

SEQ ID NO: 1635050 - DNA, 23 bp, Homo sapiens
gaaaacaacttggcatttctata

SEQ ID NO: 1635051 - DNA, 18 bp, Homo sapiens
gaaaacacaataaaaaat

SEQ ID NO: 1635052 - DNA, 23 bp, Homo sapiens
gaaaacaccatggagatgaaatg

SEQ ID NO: 1635053 - DNA, 15 bp, Homo sapiens
gaaaacactgttatc

SEQ ID NO: 1635054 - DNA, 20 bp, Homo sapiens
gaaaacaggacttaaaatga

SEQ ID NO: 1635055 - DNA, 22 bp, Homo sapiens
gaaaacaggacttaaaatgaca

SEQ ID NO: 1635056 - DNA, 16 bp, Homo sapiens
gaaaacatgttaatga

SEQ ID NO: 1635057 - DNA, 20 bp, Homo sapiens
gaaaacattctgatttggaa

SEQ ID NO: 1635058 - DNA, 18 bp, Homo sapiens
gaaaacatttcaaagctg

SEQ ID NO: 1635059 - DNA, 18 bp, Homo sapiens
gaaaaccaagccgtggct

SEQ ID NO: 1635060 - DNA, 16 bp, Homo sapiens
gaaaaccacagtcagt

SEQ ID NO: 1635061 - DNA, 14 bp, Homo sapiens
gaaaacccagagag

SEQ ID NO: 1635062 - DNA, 15 bp, Homo sapiens
gaaaacccagagagg

SEQ ID NO: 1635063 - DNA, 16 bp, Homo sapiens
gaaaacgaagctcatt

SEQ ID NO: 1635064 - DNA, 22 bp, Homo sapiens
gaaaactgttctctttaaaata

SEQ ID NO: 1635065 - DNA, 15 bp, Homo sapiens
gaaaacttaataaaa

SEQ ID NO: 1635066 - DNA, 17 bp, Homo sapiens
gaaaacttttctcagat

SEQ ID NO: 1635067 - DNA, 14 bp, Homo sapiens
gaaaagaaagaaga

SEQ ID NO: 1635068 - DNA, 12 bp, Homo sapiens
gaaaagaagaaa

SEQ ID NO: 1635069 - DNA, 19 bp, Homo sapiens
gaaaagaagaaagtctatg

SEQ ID NO: 1635070 - DNA, 18 bp, Homo sapiens
gaaaagaatacagaaaga

SEQ ID NO: 1635071 - DNA, 22 bp, Homo sapiens
gaaaagaccctgagactccaga

SEQ ID NO: 1635072 - DNA, 18 bp, Homo sapiens
gaaaagactccaaagaaa

SEQ ID NO: 1635073 - DNA, 12 bp, Homo sapiens
gaaaagagaaac

SEQ ID NO: 1635074 - DNA, 20 bp, Homo sapiens
gaaaagataaagaccagaaa

SEQ ID NO: 1635075 - DNA, 19 bp, Homo sapiens
gaaaagcaacttcatttga

SEQ ID NO: 1635076 - DNA, 16 bp, Homo sapiens
gaaaagcacctgccga

SEQ ID NO: 1635077 - DNA, 17 bp, Homo sapiens
gaaaagcacctgccgac

SEQ ID NO: 1635078 - DNA, 19 bp, Homo sapiens
gaaaagcagtcccattcat

SEQ ID NO: 1635079 - DNA, 20 bp, Homo sapiens
gaaaagcagttcatgtctga

SEQ ID NO: 1635080 - DNA, 12 bp, Homo sapiens
gaaaagccaaag

SEQ ID NO: 1635081 - DNA, 15 bp, Homo sapiens
gaaaagccaaaggtc

SEQ ID NO: 1635082 - DNA, 17 bp, Homo sapiens
gaaaagcctgaactatt

SEQ ID NO: 1635083 - DNA, 22 bp, Homo sapiens
gaaaagctgccatttcccttct

SEQ ID NO: 1635084 - DNA, 22 bp, Homo sapiens
gaaaagctttgtttgttcttgt

SEQ ID NO: 1635085 - DNA, 19 bp, Homo sapiens
gaaaaggaaaaaaagcaaa

SEQ ID NO: 1635086 - DNA, 17 bp, Homo sapiens
gaaaaggagtcaagaac

SEQ ID NO: 1635087 - DNA, 19 bp, Homo sapiens
gaaaaggatcgaggcatgg

SEQ ID NO: 1635088 - DNA, 17 bp, Homo sapiens
gaaaaggatttaagcaa

SEQ ID NO: 1635089 - DNA, 17 bp, Homo sapiens
gaaaagggcactcccaa

SEQ ID NO: 1635090 - DNA, 22 bp, Homo sapiens
gaaaagggcggaagagttacaa

SEQ ID NO: 1635091 - DNA, 14 bp, Homo sapiens
gaaaagggtcttct

SEQ ID NO: 1635092 - DNA, 23 bp, Homo sapiens
gaaaaggtagcttacctgacaca

SEQ ID NO: 1635093 - DNA, 20 bp, Homo sapiens
gaaaaggtgtccttttcctt

SEQ ID NO: 1635094 - DNA, 21 bp, Homo sapiens
gaaaaggtgtccttttccttt

SEQ ID NO: 1635095 - DNA, 13 bp, Homo sapiens
gaaaaggttgaat

SEQ ID NO: 1635096 - DNA, 15 bp, Homo sapiens
gaaaaggttgttgtt

SEQ ID NO: 1635097 - DNA, 14 bp, Homo sapiens
gaaaagtacattta

SEQ ID NO: 1635098 - DNA, 21 bp, Homo sapiens
gaaaagtcaaagtgttgctgt

SEQ ID NO: 1635099 - DNA, 16 bp, Homo sapiens
gaaaagtgcaagtcca

SEQ ID NO: 1635100 - DNA, 17 bp, Homo sapiens
gaaaagtgcctgagctg

SEQ ID NO: 1635101 - DNA, 21 bp, Homo sapiens
gaaaagttagtattaaaatct

SEQ ID NO: 1635102 - DNA, 10 bp, Homo sapiens
gaaaagttca

SEQ ID NO: 1635103 - DNA, 12 bp, Homo sapiens
gaaaagttcata

SEQ ID NO: 1635104 - DNA, 20 bp, Homo sapiens
gaaaagttgaaatgtgtaat

SEQ ID NO: 1635105 - DNA, 21 bp, Homo sapiens
gaaaagttgaaatgtgtaatt

SEQ ID NO: 1635106 - DNA, 15 bp, Homo sapiens
gaaaataaaaagaga

SEQ ID NO: 1635107 - DNA, 15 bp, Homo sapiens
gaaaataaaacacac

SEQ ID NO: 1635108 - DNA, 23 bp, Homo sapiens
gaaaataaaatattcactctcca

SEQ ID NO: 1635109 - DNA, 17 bp, Homo sapiens
gaaaataaacagacaaa

SEQ ID NO: 1635110 - DNA, 17 bp, Homo sapiens
gaaaataaacatcagtt

SEQ ID NO: 1635111 - DNA, 13 bp, Homo sapiens
gaaaataactgaa

SEQ ID NO: 1635112 - DNA, 15 bp, Homo sapiens
gaaaataactgaatt

SEQ ID NO: 1635113 - DNA, 18 bp, Homo sapiens
gaaaataattttccaagt

SEQ ID NO: 1635114 - DNA, 21 bp, Homo sapiens
gaaaatacctattttatatga

SEQ ID NO: 1635115 - DNA, 17 bp, Homo sapiens
gaaaatacttaaatgtt

SEQ ID NO: 1635116 - DNA, 21 bp, Homo sapiens
gaaaatacttaaatgttatgt

SEQ ID NO: 1635117 - DNA, 19 bp, Homo sapiens
gaaaataggcaggaagccc

SEQ ID NO: 1635118 - DNA, 16 bp, Homo sapiens
gaaaatagtgtaagaa

SEQ ID NO: 1635119 - DNA, 21 bp, Homo sapiens
gaaaatagtgtaagaactgta

SEQ ID NO: 1635120 - DNA, 19 bp, Homo sapiens
gaaaatataatatttactg

SEQ ID NO: 1635121 - DNA, 22 bp, Homo sapiens
gaaaatataatatttactgtta

SEQ ID NO: 1635122 - DNA, 18 bp, Homo sapiens
ctttctcctttaattgta

SEQ ID NO: 1635123 - DNA, 13 bp, Homo sapiens
ctttctccttttt

SEQ ID NO: 1635124 - DNA, 15 bp, Homo sapiens
ctttctctcctggct

SEQ ID NO: 1635125 - DNA, 17 bp, Homo sapiens
ctttctctcctggctcg

SEQ ID NO: 1635126 - DNA, 11 bp, Homo sapiens
ctttctctctg

SEQ ID NO: 1635127 - DNA, 10 bp, Homo sapiens
ctttctctgg

SEQ ID NO: 1635128 - DNA, 15 bp, Homo sapiens
ctttctctgggctta

SEQ ID NO: 1635129 - DNA, 19 bp, Homo sapiens
ctttctctgggcttagggt

SEQ ID NO: 1635130 - DNA, 21 bp, Homo sapiens
ctttctctggtggtcttcctt

SEQ ID NO: 1635131 - DNA, 16 bp, Homo sapiens
ctttctcttccctgaa

SEQ ID NO: 1635132 - DNA, 13 bp, Homo sapiens
ctttctcttttcc

SEQ ID NO: 1635133 - DNA, 23 bp, Homo sapiens
ctttctcttttcccctttcctgt

SEQ ID NO: 1635134 - DNA, 22 bp, Homo sapiens
ctttctgaattggaagggaaaa

SEQ ID NO: 1635135 - DNA, 15 bp, Homo sapiens
ctttctgcagaaaca

SEQ ID NO: 1635136 - DNA, 23 bp, Homo sapiens
ctttctgcatgaccaaagtgata

SEQ ID NO: 1635137 - DNA, 12 bp, Homo sapiens
ctttctgcctgg

SEQ ID NO: 1635138 - DNA, 14 bp, Homo sapiens
ctttctgcctggag

SEQ ID NO: 1635139 - DNA, 13 bp, Homo sapiens
ctttctgctctgc

SEQ ID NO: 1635140 - DNA, 15 bp, Homo sapiens
ctttctgctctgcca

SEQ ID NO: 1635141 - DNA, 16 bp, Homo sapiens
ctttctggactcccac

SEQ ID NO: 1635142 - DNA, 15 bp, Homo sapiens
ctttctggcctgcct

SEQ ID NO: 1635143 - DNA, 12 bp, Homo sapiens
ctttctgggatg

SEQ ID NO: 1635144 - DNA, 23 bp, Homo sapiens
ctttctggggggatatttcctaa

SEQ ID NO: 1635145 - DNA, 18 bp, Homo sapiens
ctttctggtcccttcagt

SEQ ID NO: 1635146 - DNA, 20 bp, Homo sapiens
ctttctgtaggtttctctct

SEQ ID NO: 1635147 - DNA, 19 bp, Homo sapiens
ctttctgtccttttggcac

SEQ ID NO: 1635148 - DNA, 15 bp, Homo sapiens
ctttctgtctccctt

SEQ ID NO: 1635149 - DNA, 20 bp, Homo sapiens
ctttctgtctcccttctctc

SEQ ID NO: 1635150 - DNA, 13 bp, Homo sapiens
ctttctgtcttgt

SEQ ID NO: 1635151 - DNA, 15 bp, Homo sapiens
ctttctgtcttgtta

SEQ ID NO: 1635152 - DNA, 23 bp, Homo sapiens
ctttctgtggctaaacagatgta

SEQ ID NO: 1635153 - DNA, 14 bp, Homo sapiens
ctttcttcaccaag

SEQ ID NO: 1635154 - DNA, 11 bp, Homo sapiens
ctttcttcctc

SEQ ID NO: 1635155 - DNA, 16 bp, Homo sapiens
ctttcttcctcttctt

SEQ ID NO: 1635156 - DNA, 15 bp, Homo sapiens
ctttcttctagtatt

SEQ ID NO: 1635157 - DNA, 16 bp, Homo sapiens
ctttcttgctggctct

SEQ ID NO: 1635158 - DNA, 16 bp, Homo sapiens
ctttcttgctggttgt

SEQ ID NO: 1635159 - DNA, 21 bp, Homo sapiens
ctttcttgctggttgtcattt

SEQ ID NO: 1635160 - DNA, 14 bp, Homo sapiens
ctttcttggccagt

SEQ ID NO: 1635161 - DNA, 13 bp, Homo sapiens
ctttcttgggata

SEQ ID NO: 1635162 - DNA, 12 bp, Homo sapiens
ctttcttgtttg

SEQ ID NO: 1635163 - DNA, 15 bp, Homo sapiens
ctttcttgtttgtca

SEQ ID NO: 1635164 - DNA, 13 bp, Homo sapiens
ctttctttcttaa

SEQ ID NO: 1635165 - DNA, 21 bp, Homo sapiens
ctttctttgcaccaaagacat

SEQ ID NO: 1635166 - DNA, 14 bp, Homo sapiens
ctttctttgcctct

SEQ ID NO: 1635167 - DNA, 16 bp, Homo sapiens
ctttctttgcctctgc

SEQ ID NO: 1635168 - DNA, 19 bp, Homo sapiens
ctttctttggtaggtaaat

SEQ ID NO: 1635169 - DNA, 21 bp, Homo sapiens
ctttctttggtaggtaaatct

SEQ ID NO: 1635170 - DNA, 18 bp, Homo sapiens
ctttctttgtttctttct

SEQ ID NO: 1635171 - DNA, 23 bp, Homo sapiens
ctttctttgtttctttcttcctc

SEQ ID NO: 1635172 - DNA, 22 bp, Homo sapiens
ctttctttgttttattttaata

SEQ ID NO: 1635173 - DNA, 11 bp, Homo sapiens
ctttcttttct

SEQ ID NO: 1635174 - DNA, 22 bp, Homo sapiens
ctttcttttctaattcctgttg

SEQ ID NO: 1635175 - DNA, 16 bp, Homo sapiens
ctttcttttgataaat

SEQ ID NO: 1635176 - DNA, 13 bp, Homo sapiens
ctttgaaaagttg

SEQ ID NO: 1635177 - DNA, 17 bp, Homo sapiens
ctttgaaaagttggaag

SEQ ID NO: 1635178 - DNA, 19 bp, Homo sapiens
ctttgaaaagttggaagga

SEQ ID NO: 1635179 - DNA, 14 bp, Homo sapiens
ctttgaaagaagca

SEQ ID NO: 1635180 - DNA, 15 bp, Homo sapiens
ctttgaaagaagcaa

SEQ ID NO: 1635181 - DNA, 20 bp, Homo sapiens
ctttgaaaggttagagaata

SEQ ID NO: 1635182 - DNA, 15 bp, Homo sapiens
ctttgaaattgttta

SEQ ID NO: 1635183 - DNA, 16 bp, Homo sapiens
ctttgaacgtgcttct

SEQ ID NO: 1635184 - DNA, 18 bp, Homo sapiens
ctttgaacgtgcttcttt

SEQ ID NO: 1635185 - DNA, 19 bp, Homo sapiens
ctttgaacgtgcttctttg

SEQ ID NO: 1635186 - DNA, 17 bp, Homo sapiens
ctttgaagatagtttta

SEQ ID NO: 1635187 - DNA, 18 bp, Homo sapiens
ctttgaaggggcctcacc

SEQ ID NO: 1635188 - DNA, 18 bp, Homo sapiens
ctttgaatgcagaagcaa

SEQ ID NO: 1635189 - DNA, 16 bp, Homo sapiens
ctttgaatgcggccca

SEQ ID NO: 1635190 - DNA, 16 bp, Homo sapiens
ctttgacaattactca

SEQ ID NO: 1635191 - DNA, 21 bp, Homo sapiens
ctttgacaattcctagataaa

SEQ ID NO: 1635192 - DNA, 21 bp, Homo sapiens
ctttgacaattgggagctgcc

SEQ ID NO: 1635193 - DNA, 19 bp, Homo sapiens
ctttgaccagatctttctc

SEQ ID NO: 1635194 - DNA, 20 bp, Homo sapiens
ctttgacgtaattaaatcca

SEQ ID NO: 1635195 - DNA, 19 bp, Homo sapiens
ctttgactctataagcaaa

SEQ ID NO: 1635196 - DNA, 20 bp, Homo sapiens
ctttgactctataagcaaat

SEQ ID NO: 1635197 - DNA, 20 bp, Homo sapiens
ctttgactgtgattttatgt

SEQ ID NO: 1635198 - DNA, 15 bp, Homo sapiens
ctttgactttttgca

SEQ ID NO: 1635199 - DNA, 23 bp, Homo sapiens
ctttgagaactgcttctaagatg

SEQ ID NO: 1635200 - DNA, 19 bp, Homo sapiens
ctttgagaagccttcagct

SEQ ID NO: 1635201 - DNA, 22 bp, Homo sapiens
ctttgagaagccttcagctcca

SEQ ID NO: 1635202 - DNA, 17 bp, Homo sapiens
ctttgagactgggtctc

SEQ ID NO: 1635203 - DNA, 16 bp, Homo sapiens
ctttgagatctaaaaa

SEQ ID NO: 1635204 - DNA, 17 bp, Homo sapiens
ctttgagcctgggaaat

SEQ ID NO: 1635205 - DNA, 22 bp, Homo sapiens
ctttgagggtggaaggatggga

SEQ ID NO: 1635206 - DNA, 15 bp, Homo sapiens
ctttgaggttgcttt

SEQ ID NO: 1635207 - DNA, 21 bp, Homo sapiens
ctttgagtagatccatttcca

SEQ ID NO: 1635208 - DNA, 21 bp, Homo sapiens
ctttgagtgtcttaattaaaa

SEQ ID NO: 1635209 - DNA, 14 bp, Homo sapiens
ctttgataaaataa

SEQ ID NO: 1635210 - DNA, 18 bp, Homo sapiens
ctttgataacaaaaaata

SEQ ID NO: 1635211 - DNA, 22 bp, Homo sapiens
ctttgataacaaaaaataaatt

SEQ ID NO: 1635212 - DNA, 14 bp, Homo sapiens
ctttgatcatgaat

SEQ ID NO: 1635213 - DNA, 20 bp, Homo sapiens
ctttgatcatgaataactga

SEQ ID NO: 1635214 - DNA, 15 bp, Homo sapiens
ctttgatccttctga

SEQ ID NO: 1635215 - DNA, 16 bp, Homo sapiens
ctttgatccttctgag

SEQ ID NO: 1635216 - DNA, 17 bp, Homo sapiens
ctttgatccttctgagc

SEQ ID NO: 1635217 - DNA, 18 bp, Homo sapiens
ctttgatctacttgcctc

SEQ ID NO: 1635218 - DNA, 21 bp, Homo sapiens
ctttgatgattaattcacctt

SEQ ID NO: 1635219 - DNA, 16 bp, Homo sapiens
ctttgattctccttca

SEQ ID NO: 1635220 - DNA, 20 bp, Homo sapiens
ctttgattctccttcagccc

SEQ ID NO: 1635221 - DNA, 18 bp, Homo sapiens
ctttgattgcacattgtt

SEQ ID NO: 1635222 - DNA, 23 bp, Homo sapiens
ctttgcaaattcaagagcctccc

SEQ ID NO: 1635223 - DNA, 15 bp, Homo sapiens
ctttgcaagatgctt

SEQ ID NO: 1635224 - DNA, 15 bp, Homo sapiens
ctttgcaatccaaat

SEQ ID NO: 1635225 - DNA, 16 bp, Homo sapiens
ctttgcacatgtgacc

SEQ ID NO: 1635226 - DNA, 14 bp, Homo sapiens
ctttgcaccaaaga

SEQ ID NO: 1635227 - DNA, 15 bp, Homo sapiens
ctttgcactgagggc

SEQ ID NO: 1635228 - DNA, 23 bp, Homo sapiens
ctttgcactgagggccacactat

SEQ ID NO: 1635229 - DNA, 15 bp, Homo sapiens
ctttgcacttaaaaa

SEQ ID NO: 1635230 - DNA, 17 bp, Homo sapiens
ctttgcactttttctta

SEQ ID NO: 1635231 - DNA, 13 bp, Homo sapiens
ctttgcagcatac

SEQ ID NO: 1635232 - DNA, 22 bp, Homo sapiens
ctttgcagccggcacagggtct

SEQ ID NO: 1635233 - DNA, 13 bp, Homo sapiens
ctttgcaggctca

SEQ ID NO: 1635234 - DNA, 14 bp, Homo sapiens
aggcagcttctaag

SEQ ID NO: 1635235 - DNA, 23 bp, Homo sapiens
aggcaggaccttcgggctgtgcc

SEQ ID NO: 1635236 - DNA, 17 bp, Homo sapiens
aggcaggagccttcctt

SEQ ID NO: 1635237 - DNA, 17 bp, Homo sapiens
aggcaggcatggccctg

SEQ ID NO: 1635238 - DNA, 22 bp, Homo sapiens
aggcagggaaaggctctgaaag

SEQ ID NO: 1635239 - DNA, 23 bp, Homo sapiens
aggcagggagacggtttccaggg

SEQ ID NO: 1635240 - DNA, 20 bp, Homo sapiens
ctttgcccagggtcctgtgc

SEQ ID NO: 1635241 - DNA, 22 bp, Homo sapiens
ctttgcccagggtcctgtgcct

SEQ ID NO: 1635242 - DNA, 19 bp, Homo sapiens
ctttgcccccgacggctgt

SEQ ID NO: 1635243 - DNA, 11 bp, Homo sapiens
ctttgcctcaa

SEQ ID NO: 1635244 - DNA, 21 bp, Homo sapiens
ctttgcctcaactccaggatt

SEQ ID NO: 1635245 - DNA, 18 bp, Homo sapiens
ctttgcctctgcagtctc

SEQ ID NO: 1635246 - DNA, 13 bp, Homo sapiens
ctttgcctcttct

SEQ ID NO: 1635247 - DNA, 23 bp, Homo sapiens
ctttgcctcttctttgtgccttt

SEQ ID NO: 1635248 - DNA, 13 bp, Homo sapiens
ctttgccttctct

SEQ ID NO: 1635249 - DNA, 15 bp, Homo sapiens
ctttgccttcttttg

SEQ ID NO: 1635250 - DNA, 13 bp, Homo sapiens
ctttgccttgggc

SEQ ID NO: 1635251 - DNA, 23 bp, Homo sapiens
ctttgccttgggctgctcctcat

SEQ ID NO: 1635252 - DNA, 22 bp, Homo sapiens
ctttgcctttatctctgaggct

SEQ ID NO: 1635253 - DNA, 21 bp, Homo sapiens
ctttgctacaaatttatgcat

SEQ ID NO: 1635254 - DNA, 23 bp, Homo sapiens
ctttgctacaaatttatgcattt

SEQ ID NO: 1635255 - DNA, 21 bp, Homo sapiens
ctttgctagttggagtgcttg

SEQ ID NO: 1635256 - DNA, 18 bp, Homo sapiens
ctttgctcagtgtccagc

SEQ ID NO: 1635257 - DNA, 22 bp, Homo sapiens
ctttgctcagtgtccagcttcc

SEQ ID NO: 1635258 - DNA, 15 bp, Homo sapiens
ctttgctccgctccc

SEQ ID NO: 1635259 - DNA, 17 bp, Homo sapiens
ctttgctccgctcccac

SEQ ID NO: 1635260 - DNA, 20 bp, Homo sapiens
ctttgctccgctcccaccgc

SEQ ID NO: 1635261 - DNA, 14 bp, Homo sapiens
ctttgctctattaa

SEQ ID NO: 1635262 - DNA, 23 bp, Homo sapiens
ctttgctctattaagattggaaa

SEQ ID NO: 1635263 - DNA, 21 bp, Homo sapiens
ctttgctgcacaaacatgaaa

SEQ ID NO: 1635264 - DNA, 15 bp, Homo sapiens
ctttgctgcagagaa

SEQ ID NO: 1635265 - DNA, 19 bp, Homo sapiens
ctttgctgcagagatcaag

SEQ ID NO: 1635266 - DNA, 20 bp, Homo sapiens
ctttgctgcccaatccatta

SEQ ID NO: 1635267 - DNA, 14 bp, Homo sapiens
ctttgctgctgctt

SEQ ID NO: 1635268 - DNA, 15 bp, Homo sapiens
ctttgctggtgtagt

SEQ ID NO: 1635269 - DNA, 17 bp, Homo sapiens
ctttgctgtactcttgc

SEQ ID NO: 1635270 - DNA, 17 bp, Homo sapiens
ctttgctgtgaggctgt

SEQ ID NO: 1635271 - DNA, 21 bp, Homo sapiens
ctttgctgtgaggctgtcctg

SEQ ID NO: 1635272 - DNA, 19 bp, Homo sapiens
ctttgcttatgaatattta

SEQ ID NO: 1635273 - DNA, 22 bp, Homo sapiens
ctttgcttccgccactcagcca

SEQ ID NO: 1635274 - DNA, 14 bp, Homo sapiens
ctttgcttgagaat

SEQ ID NO: 1635275 - DNA, 17 bp, Homo sapiens
ctttgcttgagaatcct

SEQ ID NO: 1635276 - DNA, 13 bp, Homo sapiens
ctttgcttgcttt

SEQ ID NO: 1635277 - DNA, 18 bp, Homo sapiens
ctttgcttgctttgaagt

SEQ ID NO: 1635278 - DNA, 16 bp, Homo sapiens
ctttggaaatagcatg

SEQ ID NO: 1635279 - DNA, 18 bp, Homo sapiens
ctttggaacaagacagcc

SEQ ID NO: 1635280 - DNA, 15 bp, Homo sapiens
ctttggaaccagact

SEQ ID NO: 1635281 - DNA, 16 bp, Homo sapiens
ctttggaaccagactc

SEQ ID NO: 1635282 - DNA, 23 bp, Homo sapiens
ctttggaaccagactcttgcctg

SEQ ID NO: 1635283 - DNA, 17 bp, Homo sapiens
ctttggaagtttgtgtt

SEQ ID NO: 1635284 - DNA, 20 bp, Homo sapiens
ctttggacctaaatggcctc

SEQ ID NO: 1635285 - DNA, 16 bp, Homo sapiens
ctttggagtcccctca

SEQ ID NO: 1635286 - DNA, 18 bp, Homo sapiens
ctttggagtcccctcacc

SEQ ID NO: 1635287 - DNA, 14 bp, Homo sapiens
ctttggagttaaaa

SEQ ID NO: 1635288 - DNA, 17 bp, Homo sapiens
ctttggagttaaaatgc

SEQ ID NO: 1635289 - DNA, 16 bp, Homo sapiens
ctttggcaacatcttg

SEQ ID NO: 1635290 - DNA, 11 bp, Homo sapiens
ctttggcagtg

SEQ ID NO: 1635291 - DNA, 15 bp, Homo sapiens
ctttggcagtgtttt

SEQ ID NO: 1635292 - DNA, 19 bp, Homo sapiens
ctttggccccactttgaag

SEQ ID NO: 1635293 - DNA, 22 bp, Homo sapiens
ctttggcctggggtgcatctcc

SEQ ID NO: 1635294 - DNA, 13 bp, Homo sapiens
ctttggctgcagg

SEQ ID NO: 1635295 - DNA, 21 bp, Homo sapiens
ctttggctggtagcagcaggc

SEQ ID NO: 1635296 - DNA, 21 bp, Homo sapiens
ctttggcttctcctgtgaccc

SEQ ID NO: 1635297 - DNA, 15 bp, Homo sapiens
ctttgggaaaggaga

SEQ ID NO: 1635298 - DNA, 22 bp, Homo sapiens
ctttgggaaaggagaagttaag

SEQ ID NO: 1635299 - DNA, 13 bp, Homo sapiens
ctttgggccagac

SEQ ID NO: 1635300 - DNA, 18 bp, Homo sapiens
ctttgggcctctcctgcc

SEQ ID NO: 1635301 - DNA, 20 bp, Homo sapiens
ctttgggctgccctggtgct

SEQ ID NO: 1635302 - DNA, 17 bp, Homo sapiens
ctttgggctttgcaggc

SEQ ID NO: 1635303 - DNA, 19 bp, Homo sapiens
ctttgggctttgcaggctc

SEQ ID NO: 1635304 - DNA, 23 bp, Homo sapiens
ctttgggggaaacgggctccttc

SEQ ID NO: 1635305 - DNA, 17 bp, Homo sapiens
ctttggggggtgtgctg

SEQ ID NO: 1635306 - DNA, 18 bp, Homo sapiens
ctttggggggtgtgctga

SEQ ID NO: 1635307 - DNA, 17 bp, Homo sapiens
ctttggggttttttaat

SEQ ID NO: 1635308 - DNA, 22 bp, Homo sapiens
ctttgggtggctcactactgaa

SEQ ID NO: 1635309 - DNA, 14 bp, Homo sapiens
ctttggtagaaaag

SEQ ID NO: 1635310 - DNA, 23 bp, Homo sapiens
ctttggtgccaactggtgtttga

SEQ ID NO: 1635311 - DNA, 17 bp, Homo sapiens
ctttggtggagataaag

SEQ ID NO: 1635312 - DNA, 16 bp, Homo sapiens
ctttggttaaaaatgg

SEQ ID NO: 1635313 - DNA, 20 bp, Homo sapiens
ctttggttaaaaatggctca

SEQ ID NO: 1635314 - DNA, 18 bp, Homo sapiens
ctttggttccttctctgg

SEQ ID NO: 1635315 - DNA, 14 bp, Homo sapiens
ctttggttctaagg

SEQ ID NO: 1635316 - DNA, 16 bp, Homo sapiens
ctttggttctctccag

SEQ ID NO: 1635317 - DNA, 21 bp, Homo sapiens
ctttggtttgacaattttgtc

SEQ ID NO: 1635318 - DNA, 17 bp, Homo sapiens
ctttggttttgctgaga

SEQ ID NO: 1635319 - DNA, 23 bp, Homo sapiens
ctttggtttttttcttctgtatt

SEQ ID NO: 1635320 - DNA, 13 bp, Homo sapiens
ctttgtaaaaatc

SEQ ID NO: 1635321 - DNA, 19 bp, Homo sapiens
ctttgtaagacatttgtat

SEQ ID NO: 1635322 - DNA, 15 bp, Homo sapiens
ctttgtaagagcaaa

SEQ ID NO: 1635323 - DNA, 20 bp, Homo sapiens
ctttgtaatattttccataa

SEQ ID NO: 1635324 - DNA, 17 bp, Homo sapiens
ctttgtaatgtcaccac

SEQ ID NO: 1635325 - DNA, 16 bp, Homo sapiens
ctttgtaccatctgtc

SEQ ID NO: 1635326 - DNA, 14 bp, Homo sapiens
ctttgtagctccta

SEQ ID NO: 1635327 - DNA, 12 bp, Homo sapiens
ctttgtataaat

SEQ ID NO: 1635328 - DNA, 15 bp, Homo sapiens
ctttgtataatccca

SEQ ID NO: 1635329 - DNA, 13 bp, Homo sapiens
ctttgtatattac

SEQ ID NO: 1635330 - DNA, 18 bp, Homo sapiens
ctttgtatctttctttct

SEQ ID NO: 1635331 - DNA, 20 bp, Homo sapiens
ctttgtatgacagtgaagca

SEQ ID NO: 1635332 - DNA, 13 bp, Homo sapiens
ctttgtattactt

SEQ ID NO: 1635333 - DNA, 16 bp, Homo sapiens
ctttgtattctgtctt

SEQ ID NO: 1635334 - DNA, 19 bp, Homo sapiens
ctttgtattctgtcttcat

SEQ ID NO: 1635335 - DNA, 13 bp, Homo sapiens
ctttgtattttga

SEQ ID NO: 1635336 - DNA, 17 bp, Homo sapiens
ctttgtcccaccaactt

SEQ ID NO: 1635337 - DNA, 17 bp, Homo sapiens
ctttgtcctttttgtta

SEQ ID NO: 1635338 - DNA, 14 bp, Homo sapiens
ctttgtcttgtact

SEQ ID NO: 1635339 - DNA, 18 bp, Homo sapiens
ctttgtcttgtacttctg

SEQ ID NO: 1635340 - DNA, 19 bp, Homo sapiens
ctttgtcttgtacttctgt

SEQ ID NO: 1635341 - DNA, 20 bp, Homo sapiens
ctttgtcttgtacttctgtg

SEQ ID NO: 1635342 - DNA, 19 bp, Homo sapiens
ctttgtgagagtgagctgt

SEQ ID NO: 1635343 - DNA, 17 bp, Homo sapiens
ctttgtgattatttcac

SEQ ID NO: 1635344 - DNA, 22 bp, Homo sapiens
ctttgtgattcaatctgtaaac

SEQ ID NO: 1635345 - DNA, 23 bp, Homo sapiens
ctttgtgattcaatctgtaaact

SEQ ID NO: 1635346 - DNA, 16 bp, Homo sapiens
ctttgtgattccatgg

SEQ ID NO: 1635347 - DNA, 17 bp, Homo sapiens
ctttgtgcttggggcta

SEQ ID NO: 1635348 - DNA, 19 bp, Homo sapiens
cttcttgaatataaaaaat

SEQ ID NO: 1635349 - DNA, 13 bp, Homo sapiens
cttcttgcctctg

SEQ ID NO: 1635350 - DNA, 15 bp, Homo sapiens
cttcttgcctctgtg

SEQ ID NO: 1635351 - DNA, 20 bp, Homo sapiens
cttcttgcttctttctagaa

SEQ ID NO: 1635352 - DNA, 20 bp, Homo sapiens
cttcttggtcttatttatta

SEQ ID NO: 1635353 - DNA, 18 bp, Homo sapiens
cttcttggtttggggaga

SEQ ID NO: 1635354 - DNA, 20 bp, Homo sapiens
cttcttggtttggggagaaa

SEQ ID NO: 1635355 - DNA, 15 bp, Homo sapiens
cttcttgtttccttg

SEQ ID NO: 1635356 - DNA, 23 bp, Homo sapiens
cttctttactcggcgtgctcctt

SEQ ID NO: 1635357 - DNA, 15 bp, Homo sapiens
cttctttagcatttt

SEQ ID NO: 1635358 - DNA, 17 bp, Homo sapiens
cttctttattctgtgtt

SEQ ID NO: 1635359 - DNA, 23 bp, Homo sapiens
cttctttccatcaactcccaact

SEQ ID NO: 1635360 - DNA, 13 bp, Homo sapiens
cttctttccctgg

SEQ ID NO: 1635361 - DNA, 15 bp, Homo sapiens
cttctttccctggac

SEQ ID NO: 1635362 - DNA, 23 bp, Homo sapiens
cttctttccctggacaggcagcc

SEQ ID NO: 1635363 - DNA, 17 bp, Homo sapiens
cttctttctagagcagt

SEQ ID NO: 1635364 - DNA, 13 bp, Homo sapiens
cttctttgtgcct

SEQ ID NO: 1635365 - DNA, 15 bp, Homo sapiens
cttctttgtgccttt

SEQ ID NO: 1635366 - DNA, 18 bp, Homo sapiens
cttctttgtgcctttggc

SEQ ID NO: 1635367 - DNA, 16 bp, Homo sapiens
cttcttttgattatgt

SEQ ID NO: 1635368 - DNA, 15 bp, Homo sapiens
cttcttttggcttcc

SEQ ID NO: 1635369 - DNA, 16 bp, Homo sapiens
cttctttttaatctta

SEQ ID NO: 1635370 - DNA, 23 bp, Homo sapiens
cttctttttattttcttttgtaa

SEQ ID NO: 1635371 - DNA, 19 bp, Homo sapiens
cttcttttttcaaaagaaa

SEQ ID NO: 1635372 - DNA, 19 bp, Homo sapiens
cttgaaaagttcagggacc

SEQ ID NO: 1635373 - DNA, 13 bp, Homo sapiens
cttgtttgctatg

SEQ ID NO: 1635374 - DNA, 22 bp, Homo sapiens
cttgtttgctttgaaaatattt

SEQ ID NO: 1635375 - DNA, 19 bp, Homo sapiens
cttgtttggtagttagcca

SEQ ID NO: 1635376 - DNA, 13 bp, Homo sapiens
cttgtttgtcagc

SEQ ID NO: 1635377 - DNA, 21 bp, Homo sapiens
cttgtttgtcagcatctgacc

SEQ ID NO: 1635378 - DNA, 14 bp, Homo sapiens
cttgttttggacag

SEQ ID NO: 1635379 - DNA, 13 bp, Homo sapiens
cttgttttggatg

SEQ ID NO: 1635380 - DNA, 18 bp, Homo sapiens
cttgtttttattaattta

SEQ ID NO: 1635381 - DNA, 16 bp, Homo sapiens
cttgtttttgcacatg

SEQ ID NO: 1635382 - DNA, 20 bp, Homo sapiens
cttgttttttttttccactt

SEQ ID NO: 1635383 - DNA, 16 bp, Homo sapiens
ctttaaaaaagactga

SEQ ID NO: 1635384 - DNA, 22 bp, Homo sapiens
ctttaaaaaagactgaacatgt

SEQ ID NO: 1635385 - DNA, 23 bp, Homo sapiens
ctttaaaaaagactgaacatgtt

SEQ ID NO: 1635386 - DNA, 14 bp, Homo sapiens
ctttaaaaaggaaa

SEQ ID NO: 1635387 - DNA, 21 bp, Homo sapiens
ctttaaaaaggaaatttgttt

SEQ ID NO: 1635388 - DNA, 15 bp, Homo sapiens
ctttaaaacaagtgt

SEQ ID NO: 1635389 - DNA, 16 bp, Homo sapiens
ctttaaaagagagaga

SEQ ID NO: 1635390 - DNA, 16 bp, Homo sapiens
ctttaaaaggaaagaa

SEQ ID NO: 1635391 - DNA, 12 bp, Homo sapiens
ctttaaaattct

SEQ ID NO: 1635392 - DNA, 23 bp, Homo sapiens
ctttaaacctgtttttttttcat

SEQ ID NO: 1635393 - DNA, 23 bp, Homo sapiens
ctttaaactatgttcctaacaaa

SEQ ID NO: 1635394 - DNA, 14 bp, Homo sapiens
ctttaaagctcagg

SEQ ID NO: 1635395 - DNA, 17 bp, Homo sapiens
ctttaaagtacctgtag

SEQ ID NO: 1635396 - DNA, 16 bp, Homo sapiens
ctttaaagtatgaatc

SEQ ID NO: 1635397 - DNA, 13 bp, Homo sapiens
ctttaaatagata

SEQ ID NO: 1635398 - DNA, 18 bp, Homo sapiens
ctttaacagaaactttca

SEQ ID NO: 1635399 - DNA, 21 bp, Homo sapiens
ctttaactgccgtaatttaac

SEQ ID NO: 1635400 - DNA, 23 bp, Homo sapiens
ctttaactgccgtaatttaactt

SEQ ID NO: 1635401 - DNA, 23 bp, Homo sapiens
ctttaagacatactccttccatc

SEQ ID NO: 1635402 - DNA, 20 bp, Homo sapiens
ctttaagatatccatctttt

SEQ ID NO: 1635403 - DNA, 14 bp, Homo sapiens
ctttaagccaaaga

SEQ ID NO: 1635404 - DNA, 20 bp, Homo sapiens
ctttaagcctgcattcttaa

SEQ ID NO: 1635405 - DNA, 20 bp, Homo sapiens
ctttaaggggaggaaccaga

SEQ ID NO: 1635406 - DNA, 21 bp, Homo sapiens
ctttaagttaaatatgtagat

SEQ ID NO: 1635407 - DNA, 22 bp, Homo sapiens
ctttaataaatttaataaatat

SEQ ID NO: 1635408 - DNA, 22 bp, Homo sapiens
ctttaataacaaggagatttct

SEQ ID NO: 1635409 - DNA, 15 bp, Homo sapiens
ctttaatacaaaaag

SEQ ID NO: 1635410 - DNA, 13 bp, Homo sapiens
ctttaatatgagc

SEQ ID NO: 1635411 - DNA, 19 bp, Homo sapiens
ctttaatgagaatagaaac

SEQ ID NO: 1635412 - DNA, 20 bp, Homo sapiens
ctttaatgagtgcacctgcc

SEQ ID NO: 1635413 - DNA, 19 bp, Homo sapiens
ctttaattgctttaaatct

SEQ ID NO: 1635414 - DNA, 20 bp, Homo sapiens
ctttaattgctttaaatctt

SEQ ID NO: 1635415 - DNA, 16 bp, Homo sapiens
ctttaattttcttgtt

SEQ ID NO: 1635416 - DNA, 23 bp, Homo sapiens
ctttacaggaaaaaaaattctgt

SEQ ID NO: 1635417 - DNA, 19 bp, Homo sapiens
ctttacccacctagaacac

SEQ ID NO: 1635418 - DNA, 20 bp, Homo sapiens
ctttacccctcatccaaagt

SEQ ID NO: 1635419 - DNA, 14 bp, Homo sapiens
ctttacctgcaggc

SEQ ID NO: 1635420 - DNA, 17 bp, Homo sapiens
ctttacctgcaggctcc

SEQ ID NO: 1635421 - DNA, 17 bp, Homo sapiens
ctttacctgtgaagtgt

SEQ ID NO: 1635422 - DNA, 19 bp, Homo sapiens
ctttaccttctaaaagcca

SEQ ID NO: 1635423 - DNA, 16 bp, Homo sapiens
ctttacgcccatctca

SEQ ID NO: 1635424 - DNA, 22 bp, Homo sapiens
ctttacgcccatctcaggacac

SEQ ID NO: 1635425 - DNA, 22 bp, Homo sapiens
ctttacgtgtttaaaaaaaagc

SEQ ID NO: 1635426 - DNA, 14 bp, Homo sapiens
ctttactactgtgg

SEQ ID NO: 1635427 - DNA, 16 bp, Homo sapiens
ctttactcagcccagc

SEQ ID NO: 1635428 - DNA, 14 bp, Homo sapiens
ctttactccatcat

SEQ ID NO: 1635429 - DNA, 17 bp, Homo sapiens
ctttactcccttcctgg

SEQ ID NO: 1635430 - DNA, 15 bp, Homo sapiens
ctttactctctccga

SEQ ID NO: 1635431 - DNA, 10 bp, Homo sapiens
ctttactgta

SEQ ID NO: 1635432 - DNA, 14 bp, Homo sapiens
ctttactgtgctta

SEQ ID NO: 1635433 - DNA, 16 bp, Homo sapiens
ctttacttatctctca

SEQ ID NO: 1635434 - DNA, 14 bp, Homo sapiens
ctttagaactctag

SEQ ID NO: 1635435 - DNA, 24 bp, Homo sapiens
ctttagaactctagagagccttaa

SEQ ID NO: 1635436 - DNA, 15 bp, Homo sapiens
ctttagaagcctgca

SEQ ID NO: 1635437 - DNA, 18 bp, Homo sapiens
ctttagaatgagagtgtg

SEQ ID NO: 1635438 - DNA, 15 bp, Homo sapiens
ctttagatatttgcc

SEQ ID NO: 1635439 - DNA, 14 bp, Homo sapiens
ctttagatgctgat

SEQ ID NO: 1635440 - DNA, 22 bp, Homo sapiens
ctttagcatttttatgcagaca

SEQ ID NO: 1635441 - DNA, 14 bp, Homo sapiens
ctttagctgtgtta

SEQ ID NO: 1635442 - DNA, 15 bp, Homo sapiens
ctttagcttttcctt

SEQ ID NO: 1635443 - DNA, 14 bp, Homo sapiens
ctttaggatgtaaa

SEQ ID NO: 1635444 - DNA, 13 bp, Homo sapiens
ctttagtactcaa

SEQ ID NO: 1635445 - DNA, 21 bp, Homo sapiens
ctttagtactcaatgtttctg

SEQ ID NO: 1635446 - DNA, 13 bp, Homo sapiens
ctttagtataatt

SEQ ID NO: 1635447 - DNA, 20 bp, Homo sapiens
ctttagttagcatgcgcgct

SEQ ID NO: 1635448 - DNA, 19 bp, Homo sapiens
ctttagttaggtcattttt

SEQ ID NO: 1635449 - DNA, 17 bp, Homo sapiens
ctttagttctgctttct

SEQ ID NO: 1635450 - DNA, 12 bp, Homo sapiens
ctttataaactt

SEQ ID NO: 1635451 - DNA, 18 bp, Homo sapiens
ctttataaatccagtgac

SEQ ID NO: 1635452 - DNA, 18 bp, Homo sapiens
ctttataactaacatgtc

SEQ ID NO: 1635453 - DNA, 18 bp, Homo sapiens
ctttataaggttgtctgt

SEQ ID NO: 1635454 - DNA, 13 bp, Homo sapiens
ctttataattcta

SEQ ID NO: 1635455 - DNA, 19 bp, Homo sapiens
ctttataattctactttga

SEQ ID NO: 1635456 - DNA, 21 bp, Homo sapiens
ctttatagaaggaatttgtac

SEQ ID NO: 1635457 - DNA, 22 bp, Homo sapiens
ctttatatgaagaaaatcactt

SEQ ID NO: 1635458 - DNA, 21 bp, Homo sapiens
ctttatcaaagggtgaaaatt

SEQ ID NO: 1635459 - DNA, 20 bp, Homo sapiens
ctttatcacctcattctgaa

SEQ ID NO: 1635460 - DNA, 21 bp, Homo sapiens
ctttatcatgaatgcttttag

SEQ ID NO: 1635461 - DNA, 22 bp, Homo sapiens
ctttatctaatacctctgtgtg

SEQ ID NO: 1635462 - DNA, 16 bp, Homo sapiens
ctttatctctgaggct

SEQ ID NO: 1635463 - DNA, 17 bp, Homo sapiens
ctttatctctgaggcta

SEQ ID NO: 1635464 - DNA, 23 bp, Homo sapiens
ctttatctttccatgggagccag

SEQ ID NO: 1635465 - DNA, 22 bp, Homo sapiens
ctttatgaatgaaaaaacagtc

SEQ ID NO: 1635466 - DNA, 22 bp, Homo sapiens
ctttatgcaaatacaatcagcc

SEQ ID NO: 1635467 - DNA, 20 bp, Homo sapiens
ctttatgccggatgtgcttt

SEQ ID NO: 1635468 - DNA, 22 bp, Homo sapiens
ctttatgccggatgtgcttttc

SEQ ID NO: 1635469 - DNA, 21 bp, Homo sapiens
ctttatgggggggagggaggg

SEQ ID NO: 1635470 - DNA, 12 bp, Homo sapiens
ctttatgtgaat

SEQ ID NO: 1635471 - DNA, 17 bp, Homo sapiens
ctttatgtgaattttta

SEQ ID NO: 1635472 - DNA, 22 bp, Homo sapiens
ctttatgttgcggtgagaactc

SEQ ID NO: 1635473 - DNA, 19 bp, Homo sapiens
ctttattaatgttttcaaa

SEQ ID NO: 1635474 - DNA, 22 bp, Homo sapiens
ctttattaccccctccttcaga

SEQ ID NO: 1635475 - DNA, 15 bp, Homo sapiens
ctttattcacccctg

SEQ ID NO: 1635476 - DNA, 17 bp, Homo sapiens
ctttattcacccctgcc

SEQ ID NO: 1635477 - DNA, 18 bp, Homo sapiens
ctttattggctgagatat

SEQ ID NO: 1635478 - DNA, 13 bp, Homo sapiens
ctttattgtacag

SEQ ID NO: 1635479 - DNA, 24 bp, Homo sapiens
ctttattgtacagactgttttact

SEQ ID NO: 1635480 - DNA, 17 bp, Homo sapiens
ctttatttctagcagag

SEQ ID NO: 1635481 - DNA, 20 bp, Homo sapiens
ctttatttctagcagagtga

SEQ ID NO: 1635482 - DNA, 19 bp, Homo sapiens
ctgtgctgcatgcgacagc

SEQ ID NO: 1635483 - DNA, 21 bp, Homo sapiens
ctgtgctggaattccacaggg

SEQ ID NO: 1635484 - DNA, 18 bp, Homo sapiens
ctgtgctgggccagtggc

SEQ ID NO: 1635485 - DNA, 19 bp, Homo sapiens
ctgtgctgggccagtggct

SEQ ID NO: 1635486 - DNA, 13 bp, Homo sapiens
ctgtgctggggca

SEQ ID NO: 1635487 - DNA, 17 bp, Homo sapiens
ctgtgctggggcacggc

SEQ ID NO: 1635488 - DNA, 20 bp, Homo sapiens
ctgtgctggtgtcctgacca

SEQ ID NO: 1635489 - DNA, 13 bp, Homo sapiens
ctgtgctgtgcct

SEQ ID NO: 1635490 - DNA, 15 bp, Homo sapiens
ctgtgctgtgcctgc

SEQ ID NO: 1635491 - DNA, 18 bp, Homo sapiens
ctgtgcttcaattaataa

SEQ ID NO: 1635492 - DNA, 22 bp, Homo sapiens
ctgtgcttcgactactgctcct

SEQ ID NO: 1635493 - DNA, 16 bp, Homo sapiens
ctgtgcttgaaggccc

SEQ ID NO: 1635494 - DNA, 18 bp, Homo sapiens
ctgtgcttgaaggccctg

SEQ ID NO: 1635495 - DNA, 22 bp, Homo sapiens
ctgtgcttggatttgcatattt

SEQ ID NO: 1635496 - DNA, 12 bp, Homo sapiens
ctgtggaaagct

SEQ ID NO: 1635497 - DNA, 14 bp, Homo sapiens
ctgtggaaagctag

SEQ ID NO: 1635498 - DNA, 19 bp, Homo sapiens
ctgtggaaggcagagaaat

SEQ ID NO: 1635499 - DNA, 21 bp, Homo sapiens
ctgtggacaggatgaggacag

SEQ ID NO: 1635500 - DNA, 17 bp, Homo sapiens
ctgtggaccgtggacag

SEQ ID NO: 1635501 - DNA, 16 bp, Homo sapiens
ctgtggactgtcctga

SEQ ID NO: 1635502 - DNA, 22 bp, Homo sapiens
ctgtggactgtcctgaggagcc

SEQ ID NO: 1635503 - DNA, 20 bp, Homo sapiens
ctgtggagactttctgttac

SEQ ID NO: 1635504 - DNA, 16 bp, Homo sapiens
ctgtggagctgccaca

SEQ ID NO: 1635505 - DNA, 18 bp, Homo sapiens
ctgtggagctgccacaga

SEQ ID NO: 1635506 - DNA, 20 bp, Homo sapiens
ctgtggagctgccacagaga

SEQ ID NO: 1635507 - DNA, 17 bp, Homo sapiens
ctgtggaggattgctat

SEQ ID NO: 1635508 - DNA, 12 bp, Homo sapiens
ctgtggaggcct

SEQ ID NO: 1635509 - DNA, 17 bp, Homo sapiens
ctgtggaggcctgatgc

SEQ ID NO: 1635510 - DNA, 21 bp, Homo sapiens
ctgtggaggcctgatgctgcc

SEQ ID NO: 1635511 - DNA, 14 bp, Homo sapiens
ctgtggagtccagc

SEQ ID NO: 1635512 - DNA, 20 bp, Homo sapiens
ctgtggagtccagctctact

SEQ ID NO: 1635513 - DNA, 14 bp, Homo sapiens
ctgtggagttcctg

SEQ ID NO: 1635514 - DNA, 20 bp, Homo sapiens
ctgtggagttcctgctccgt

SEQ ID NO: 1635515 - DNA, 15 bp, Homo sapiens
ctgtggatcagagat

SEQ ID NO: 1635516 - DNA, 16 bp, Homo sapiens
ctgtggatgccagggc

SEQ ID NO: 1635517 - DNA, 16 bp, Homo sapiens
ctgtggattctatatt

SEQ ID NO: 1635518 - DNA, 17 bp, Homo sapiens
ctgtggattctatattt

SEQ ID NO: 1635519 - DNA, 12 bp, Homo sapiens
ctgtggcacaga

SEQ ID NO: 1635520 - DNA, 14 bp, Homo sapiens
ctgtggcacagccc

SEQ ID NO: 1635521 - DNA, 16 bp, Homo sapiens
ctgtggcacagccctg

SEQ ID NO: 1635522 - DNA, 17 bp, Homo sapiens
ctgtggcacagccctga

SEQ ID NO: 1635523 - DNA, 21 bp, Homo sapiens
ctgtggcacagccctgagtgt

SEQ ID NO: 1635524 - DNA, 16 bp, Homo sapiens
ctgtggcacttgcctg

SEQ ID NO: 1635525 - DNA, 18 bp, Homo sapiens
agcctgctgacagacact

SEQ ID NO: 1635526 - DNA, 11 bp, Homo sapiens
agcctgctgca

SEQ ID NO: 1635527 - DNA, 19 bp, Homo sapiens
agcctgctggaagcccagc

SEQ ID NO: 1635528 - DNA, 18 bp, Homo sapiens
agcctgctggcacccacc

SEQ ID NO: 1635529 - DNA, 13 bp, Homo sapiens
agcctgctggctg

SEQ ID NO: 1635530 - DNA, 19 bp, Homo sapiens
agcctgctggctgcggccc

SEQ ID NO: 1635531 - DNA, 20 bp, Homo sapiens
agcctggactctaagctgga

SEQ ID NO: 1635532 - DNA, 14 bp, Homo sapiens
agcctggactttgg

SEQ ID NO: 1635533 - DNA, 20 bp, Homo sapiens
agcctggatgccaaggagcc

SEQ ID NO: 1635534 - DNA, 23 bp, Homo sapiens
agcctggatgccaaggagcccct

SEQ ID NO: 1635535 - DNA, 17 bp, Homo sapiens
agcctggattccagcag

SEQ ID NO: 1635536 - DNA, 18 bp, Homo sapiens
agcctggattccagcagt

SEQ ID NO: 1635537 - DNA, 20 bp, Homo sapiens
agcctggattccagcagtga

SEQ ID NO: 1635538 - DNA, 18 bp, Homo sapiens
agcctggcaacagagcga

SEQ ID NO: 1635539 - DNA, 19 bp, Homo sapiens
agcctggcaacagagcgag

SEQ ID NO: 1635540 - DNA, 16 bp, Homo sapiens
agcctggccacgcagc

SEQ ID NO: 1635541 - DNA, 21 bp, Homo sapiens
agcctggccacgcagccagga

SEQ ID NO: 1635542 - DNA, 22 bp, Homo sapiens
agcctggccacgcagccaggac

SEQ ID NO: 1635543 - DNA, 23 bp, Homo sapiens
agcctggccacgcagccaggaca

SEQ ID NO: 1635544 - DNA, 23 bp, Homo sapiens
agcctggccggttaacatctttt

SEQ ID NO: 1635545 - DNA, 17 bp, Homo sapiens
agcctggctctgccccc

SEQ ID NO: 1635546 - DNA, 17 bp, Homo sapiens
agcctggctgcccatca

SEQ ID NO: 1635547 - DNA, 21 bp, Homo sapiens
agcctggcttctggagccctt

SEQ ID NO: 1635548 - DNA, 23 bp, Homo sapiens
agcctggcttctggagcccttgg

SEQ ID NO: 1635549 - DNA, 15 bp, Homo sapiens
agcctgggagcccag

SEQ ID NO: 1635550 - DNA, 18 bp, Homo sapiens
agcctgggcaacagagca

SEQ ID NO: 1635551 - DNA, 20 bp, Homo sapiens
agcctgggcaacagagcaag

SEQ ID NO: 1635552 - DNA, 13 bp, Homo sapiens
agcctgggccaga

SEQ ID NO: 1635553 - DNA, 11 bp, Homo sapiens
agcctgggccc

SEQ ID NO: 1635554 - DNA, 12 bp, Homo sapiens
agcctgggcccc

SEQ ID NO: 1635555 - DNA, 23 bp, Homo sapiens
agcctgggcgacaaaaacgaaac

SEQ ID NO: 1635556 - DNA, 22 bp, Homo sapiens
agcctgggcgtacagagcacat

SEQ ID NO: 1635557 - DNA, 16 bp, Homo sapiens
agcctgggctcctcca

SEQ ID NO: 1635558 - DNA, 14 bp, Homo sapiens
agcctggggacccc

SEQ ID NO: 1635559 - DNA, 23 bp, Homo sapiens
agcctggggaccccacttcagaa

SEQ ID NO: 1635560 - DNA, 17 bp, Homo sapiens
agcctggggcctgggga

SEQ ID NO: 1635561 - DNA, 17 bp, Homo sapiens
agcctggggctccctct

SEQ ID NO: 1635562 - DNA, 15 bp, Homo sapiens
agcctggggtctgga

SEQ ID NO: 1635563 - DNA, 12 bp, Homo sapiens
agcctgggtcac

SEQ ID NO: 1635564 - DNA, 11 bp, Homo sapiens
agcctggtggg

SEQ ID NO: 1635565 - DNA, 14 bp, Homo sapiens
agcctggtgggcct

SEQ ID NO: 1635566 - DNA, 21 bp, Homo sapiens
agcctggtgggcctcctctgt

SEQ ID NO: 1635567 - DNA, 19 bp, Homo sapiens
agcctgtaacactcctctg

SEQ ID NO: 1635568 - DNA, 17 bp, Homo sapiens
agcctgtaatcccagct

SEQ ID NO: 1635569 - DNA, 18 bp, Homo sapiens
agcctgtaatcccagcta

SEQ ID NO: 1635570 - DNA, 19 bp, Homo sapiens
agcctgtagggaactttct

SEQ ID NO: 1635571 - DNA, 17 bp, Homo sapiens
agcctgtcaccagagct

SEQ ID NO: 1635572 - DNA, 21 bp, Homo sapiens
agcctgtcaccagagcttctc

SEQ ID NO: 1635573 - DNA, 19 bp, Homo sapiens
agcctgtccaacatggtga

SEQ ID NO: 1635574 - DNA, 15 bp, Homo sapiens
agcctgtctttcagc

SEQ ID NO: 1635575 - DNA, 21 bp, Homo sapiens
agcctgtgattaacttgctta

SEQ ID NO: 1635576 - DNA, 17 bp, Homo sapiens
agcctgtgcctctggga

SEQ ID NO: 1635577 - DNA, 10 bp, Homo sapiens
agcctgtgcg

SEQ ID NO: 1635578 - DNA, 17 bp, Homo sapiens
agcctgtgcgtcccagc

SEQ ID NO: 1635579 - DNA, 11 bp, Homo sapiens
agcctgtggca

SEQ ID NO: 1635580 - DNA, 14 bp, Homo sapiens
agcctgtggcatct

SEQ ID NO: 1635581 - DNA, 18 bp, Homo sapiens
agcctgtggcggtgcctg

SEQ ID NO: 1635582 - DNA, 22 bp, Homo sapiens
agcctgtggcggtgcctgggtg

SEQ ID NO: 1635583 - DNA, 13 bp, Homo sapiens
agcctgtggcttg

SEQ ID NO: 1635584 - DNA, 19 bp, Homo sapiens
agcctgtggcttggagtgg

SEQ ID NO: 1635585 - DNA, 11 bp, Homo sapiens
agcctgtggga

SEQ ID NO: 1635586 - DNA, 17 bp, Homo sapiens
agcctgtgggagtagaa

SEQ ID NO: 1635587 - DNA, 19 bp, Homo sapiens
agcctgtggttacagtgca

SEQ ID NO: 1635588 - DNA, 14 bp, Homo sapiens
agcctgtgtgttct

SEQ ID NO: 1635589 - DNA, 17 bp, Homo sapiens
agcctgttccagaagga

SEQ ID NO: 1635590 - DNA, 13 bp, Homo sapiens
agccttaaaaata

SEQ ID NO: 1635591 - DNA, 18 bp, Homo sapiens
agccttaatcaggtcctc

SEQ ID NO: 1635592 - DNA, 18 bp, Homo sapiens
agccttaatttgcacagt

SEQ ID NO: 1635593 - DNA, 20 bp, Homo sapiens
agccttaatttttttttcat

SEQ ID NO: 1635594 - DNA, 14 bp, Homo sapiens
agccttaccacgca

SEQ ID NO: 1635595 - DNA, 20 bp, Homo sapiens
agccttacgacactttggtt

SEQ ID NO: 1635596 - DNA, 20 bp, Homo sapiens
agccttagctctcccaactc

SEQ ID NO: 1635597 - DNA, 18 bp, Homo sapiens
ctgtggtttcatgttagt

SEQ ID NO: 1635598 - DNA, 19 bp, Homo sapiens
ctgtggttttcccctccct

SEQ ID NO: 1635599 - DNA, 20 bp, Homo sapiens
ctgtgtaacatccaagccag

SEQ ID NO: 1635600 - DNA, 23 bp, Homo sapiens
ctgtgtaacatccaagccagagt

SEQ ID NO: 1635601 - DNA, 16 bp, Homo sapiens
ctgtgtaaccttgggt

SEQ ID NO: 1635602 - DNA, 21 bp, Homo sapiens
ctgtgtaagaagctgtgaata

SEQ ID NO: 1635603 - DNA, 17 bp, Homo sapiens
ctgtgtaagctcacatc

SEQ ID NO: 1635604 - DNA, 17 bp, Homo sapiens
ctgtgtaatctctgatt

SEQ ID NO: 1635605 - DNA, 19 bp, Homo sapiens
ctgtgtacataactgaaaa

SEQ ID NO: 1635606 - DNA, 22 bp, Homo sapiens
ctgtgtacataactgaaaatgt

SEQ ID NO: 1635607 - DNA, 20 bp, Homo sapiens
ctgtgtacctctagaatccc

SEQ ID NO: 1635608 - DNA, 16 bp, Homo sapiens
ctgtgtacttcccggg

SEQ ID NO: 1635609 - DNA, 11 bp, Homo sapiens
ctgtgtatgta

SEQ ID NO: 1635610 - DNA, 19 bp, Homo sapiens
ctgtgtattccaagacatg

SEQ ID NO: 1635611 - DNA, 16 bp, Homo sapiens
ctgtgtcagagcccag

SEQ ID NO: 1635612 - DNA, 22 bp, Homo sapiens
ctgtgtcagagcccagcccagg

SEQ ID NO: 1635613 - DNA, 14 bp, Homo sapiens
ctgtgtcatttctt

SEQ ID NO: 1635614 - DNA, 21 bp, Homo sapiens
ctgtgtccactgagactttcc

SEQ ID NO: 1635615 - DNA, 14 bp, Homo sapiens
ctgtgtccagcagc

SEQ ID NO: 1635616 - DNA, 16 bp, Homo sapiens
ctgtgtccagcagctg

SEQ ID NO: 1635617 - DNA, 21 bp, Homo sapiens
ctgtgtccatgcgctcagggc

SEQ ID NO: 1635618 - DNA, 17 bp, Homo sapiens
ctgtgtcccatgaccca

SEQ ID NO: 1635619 - DNA, 19 bp, Homo sapiens
ctgtgtcccatgacccacc

SEQ ID NO: 1635620 - DNA, 21 bp, Homo sapiens
ctgtgtcccatgacccacccc

SEQ ID NO: 1635621 - DNA, 22 bp, Homo sapiens
ctgtgtcccatgacccacccct

SEQ ID NO: 1635622 - DNA, 23 bp, Homo sapiens
ctgtgtcccccccagtgcaggga

SEQ ID NO: 1635623 - DNA, 18 bp, Homo sapiens
ctgtgtcctaaggcccat

SEQ ID NO: 1635624 - DNA, 15 bp, Homo sapiens
ctgtgtcctccacca

SEQ ID NO: 1635625 - DNA, 23 bp, Homo sapiens
ctgtgtcctgaaacgctcctttg

SEQ ID NO: 1635626 - DNA, 14 bp, Homo sapiens
ctgtgtccttgcac

SEQ ID NO: 1635627 - DNA, 18 bp, Homo sapiens
ctgtgtccttgcacctgc

SEQ ID NO: 1635628 - DNA, 22 bp, Homo sapiens
ctgtgtccttgcacctgcatcc

SEQ ID NO: 1635629 - DNA, 12 bp, Homo sapiens
ctgtgtctaaga

SEQ ID NO: 1635630 - DNA, 13 bp, Homo sapiens
ctgtgtctaagat

SEQ ID NO: 1635631 - DNA, 18 bp, Homo sapiens
ctgtgtctgccaaacaca

SEQ ID NO: 1635632 - DNA, 16 bp, Homo sapiens
ctgtgtcttcattttc

SEQ ID NO: 1635633 - DNA, 20 bp, Homo sapiens
ctgtgtctttcacagctcct

SEQ ID NO: 1635634 - DNA, 12 bp, Homo sapiens
ctgtgtgaaata

SEQ ID NO: 1635635 - DNA, 21 bp, Homo sapiens
ctgtgtgaaataccagtgtgg

SEQ ID NO: 1635636 - DNA, 13 bp, Homo sapiens
ctgtgtgaactat

SEQ ID NO: 1635637 - DNA, 21 bp, Homo sapiens
ctgtgtgaactattgagaaga

SEQ ID NO: 1635638 - DNA, 16 bp, Homo sapiens
ctgtgtgaatccagga

SEQ ID NO: 1635639 - DNA, 19 bp, Homo sapiens
ctgtgtgaatccaggaggc

SEQ ID NO: 1635640 - DNA, 20 bp, Homo sapiens
ctgtgtgaccctgggcaagt

SEQ ID NO: 1635641 - DNA, 17 bp, Homo sapiens
ctgtgtgagtgagcaca

SEQ ID NO: 1635642 - DNA, 9 bp, Homo sapiens
ctgtgtgca

SEQ ID NO: 1635643 - DNA, 13 bp, Homo sapiens
ctgtgtgcaggtt

SEQ ID NO: 1635644 - DNA, 19 bp, Homo sapiens
ctgtctatatcataactat

SEQ ID NO: 1635645 - DNA, 19 bp, Homo sapiens
ctgtctattaaaattctga

SEQ ID NO: 1635646 - DNA, 20 bp, Homo sapiens
ctgtctcactcgttctgtta

SEQ ID NO: 1635647 - DNA, 19 bp, Homo sapiens
ctgtctcatccccaggggt

SEQ ID NO: 1635648 - DNA, 13 bp, Homo sapiens
ctgtctccagctg

SEQ ID NO: 1635649 - DNA, 17 bp, Homo sapiens
ctgtctccagctgcctg

SEQ ID NO: 1635650 - DNA, 20 bp, Homo sapiens
ctgtctccagctgcctgggc

SEQ ID NO: 1635651 - DNA, 18 bp, Homo sapiens
ctgtctccatgtttgatg

SEQ ID NO: 1635652 - DNA, 20 bp, Homo sapiens
ctgtctccctcccctctcag

SEQ ID NO: 1635653 - DNA, 21 bp, Homo sapiens
ctgtctccctcccctctcaga

SEQ ID NO: 1635654 - DNA, 15 bp, Homo sapiens
ctgtctcccttctct

SEQ ID NO: 1635655 - DNA, 16 bp, Homo sapiens
ctgtctcccttctctc

SEQ ID NO: 1635656 - DNA, 22 bp, Homo sapiens
ctgtctctaaaaagaagccaca

SEQ ID NO: 1635657 - DNA, 19 bp, Homo sapiens
ctgtctctaaccattcaaa

SEQ ID NO: 1635658 - DNA, 13 bp, Homo sapiens
ctgtctctctggg

SEQ ID NO: 1635659 - DNA, 15 bp, Homo sapiens
ctgtctctctgggct

SEQ ID NO: 1635660 - DNA, 16 bp, Homo sapiens
ctgtctctctgggctg

SEQ ID NO: 1635661 - DNA, 19 bp, Homo sapiens
ctgtctgaaggacacttcc

SEQ ID NO: 1635662 - DNA, 20 bp, Homo sapiens
ctgtctgacaacctcttggt

SEQ ID NO: 1635663 - DNA, 11 bp, Homo sapiens
ctgtctgattc

SEQ ID NO: 1635664 - DNA, 14 bp, Homo sapiens
ctgtctgattctat

SEQ ID NO: 1635665 - DNA, 16 bp, Homo sapiens
ctgtctgattctatgc

SEQ ID NO: 1635666 - DNA, 19 bp, Homo sapiens
ctgtctgcagtgcccggct

SEQ ID NO: 1635667 - DNA, 15 bp, Homo sapiens
ctgtctgccagccag

SEQ ID NO: 1635668 - DNA, 17 bp, Homo sapiens
ctgtctgccagccagca

SEQ ID NO: 1635669 - DNA, 20 bp, Homo sapiens
ctgtctgccagccagcagcc

SEQ ID NO: 1635670 - DNA, 18 bp, Homo sapiens
ctgtctgccccagcccag

SEQ ID NO: 1635671 - DNA, 16 bp, Homo sapiens
ctgtctgcctgtattt

SEQ ID NO: 1635672 - DNA, 15 bp, Homo sapiens
ctgtctgctcagaca

SEQ ID NO: 1635673 - DNA, 14 bp, Homo sapiens
ctgtctgctgccag

SEQ ID NO: 1635674 - DNA, 17 bp, Homo sapiens
ctgtctgctgccagcac

SEQ ID NO: 1635675 - DNA, 13 bp, Homo sapiens
ctgtctggtggcc

SEQ ID NO: 1635676 - DNA, 15 bp, Homo sapiens
ctgtctgtccctgaa

SEQ ID NO: 1635677 - DNA, 21 bp, Homo sapiens
ctgtctgtcccttttctttga

SEQ ID NO: 1635678 - DNA, 20 bp, Homo sapiens
ctgtctgtctctccatctgt

SEQ ID NO: 1635679 - DNA, 14 bp, Homo sapiens
ctgtctgtgtccca

SEQ ID NO: 1635680 - DNA, 17 bp, Homo sapiens
ctgtctgtgtcccagcc

SEQ ID NO: 1635681 - DNA, 18 bp, Homo sapiens
ctgtcttatggtccagaa

SEQ ID NO: 1635682 - DNA, 17 bp, Homo sapiens
ctgtcttcacatgtatg

SEQ ID NO: 1635683 - DNA, 14 bp, Homo sapiens
ctgtcttcagagca

SEQ ID NO: 1635684 - DNA, 15 bp, Homo sapiens
ctgtcttcagtctca

SEQ ID NO: 1635685 - DNA, 17 bp, Homo sapiens
ctgtcttcagtctcaca

SEQ ID NO: 1635686 - DNA, 22 bp, Homo sapiens
ctgtcttcagtctcacagagaa

SEQ ID NO: 1635687 - DNA, 20 bp, Homo sapiens
ctgtcttcatcccctcagaa

SEQ ID NO: 1635688 - DNA, 14 bp, Homo sapiens
ctgtcttccaagga

SEQ ID NO: 1635689 - DNA, 13 bp, Homo sapiens
ctgtcttcctcaa

SEQ ID NO: 1635690 - DNA, 14 bp, Homo sapiens
ctgtcttcctgcat

SEQ ID NO: 1635691 - DNA, 21 bp, Homo sapiens
ctgtcttgaattagtatttca

SEQ ID NO: 1635692 - DNA, 16 bp, Homo sapiens
ctgtcttgccagccag

SEQ ID NO: 1635693 - DNA, 18 bp, Homo sapiens
ctgtcttgttaatgcttt

SEQ ID NO: 1635694 - DNA, 16 bp, Homo sapiens
ctgtcttgttcatttt

SEQ ID NO: 1635695 - DNA, 21 bp, Homo sapiens
ctgtcttgttcattttgagta

SEQ ID NO: 1635696 - DNA, 22 bp, Homo sapiens
ctgtcttgttgcggatggatgg

SEQ ID NO: 1635697 - DNA, 16 bp, Homo sapiens
ctgtctttaaggaaaa

SEQ ID NO: 1635698 - DNA, 13 bp, Homo sapiens
ctgtctttattct

SEQ ID NO: 1635699 - DNA, 17 bp, Homo sapiens
ctgtctttcagcattca

SEQ ID NO: 1635700 - DNA, 15 bp, Homo sapiens
ctgtcttttgattct

SEQ ID NO: 1635701 - DNA, 18 bp, Homo sapiens
ctgtcttttgttctctga

SEQ ID NO: 1635702 - DNA, 22 bp, Homo sapiens
ctgtgaaaaatcagatgaattg

SEQ ID NO: 1635703 - DNA, 16 bp, Homo sapiens
ctgtgaaaactctggt

SEQ ID NO: 1635704 - DNA, 12 bp, Homo sapiens
ctgtgaaaatag

SEQ ID NO: 1635705 - DNA, 23 bp, Homo sapiens
ctgtgaaaatagtgtaagaactg

SEQ ID NO: 1635706 - DNA, 12 bp, Homo sapiens
ctgtgaaatagt

SEQ ID NO: 1635707 - DNA, 16 bp, Homo sapiens
ctgtgaaatgctggca

SEQ ID NO: 1635708 - DNA, 12 bp, Homo sapiens
ctgtgaaattct

SEQ ID NO: 1635709 - DNA, 14 bp, Homo sapiens
ctgtgaacagcttg

SEQ ID NO: 1635710 - DNA, 19 bp, Homo sapiens
ctgtgaacagcttgctgtc

SEQ ID NO: 1635711 - DNA, 21 bp, Homo sapiens
ctgtgaaccaacccccatctc

SEQ ID NO: 1635712 - DNA, 19 bp, Homo sapiens
ctgtgaacctgggcactcc

SEQ ID NO: 1635713 - DNA, 22 bp, Homo sapiens
ctgtgaacgatttagaaagaag

SEQ ID NO: 1635714 - DNA, 17 bp, Homo sapiens
ctgtgaacttgactggg

SEQ ID NO: 1635715 - DNA, 23 bp, Homo sapiens
ctgtgaagaaccctgcagggccc

SEQ ID NO: 1635716 - DNA, 16 bp, Homo sapiens
ctgtgaagacccagca

SEQ ID NO: 1635717 - DNA, 17 bp, Homo sapiens
ctgtgaagacccagcag

SEQ ID NO: 1635718 - DNA, 23 bp, Homo sapiens
ctgtgaagagccggtggtgcccg

SEQ ID NO: 1635719 - DNA, 21 bp, Homo sapiens
ctgtgaagtaacccctcctgg

SEQ ID NO: 1635720 - DNA, 21 bp, Homo sapiens
ctgtgaataaaaaccctgtat

SEQ ID NO: 1635721 - DNA, 15 bp, Homo sapiens
ctgtgaatacttgaa

SEQ ID NO: 1635722 - DNA, 15 bp, Homo sapiens
ctgtgaatcctggca

SEQ ID NO: 1635723 - DNA, 17 bp, Homo sapiens
ctgtgaatcctggcaag

SEQ ID NO: 1635724 - DNA, 16 bp, Homo sapiens
ctgtgaatgccactgc

SEQ ID NO: 1635725 - DNA, 13 bp, Homo sapiens
agcctctgctgcc

SEQ ID NO: 1635726 - DNA, 14 bp, Homo sapiens
agcctctgctggaa

SEQ ID NO: 1635727 - DNA, 13 bp, Homo sapiens
agcctctggctag

SEQ ID NO: 1635728 - DNA, 14 bp, Homo sapiens
agcctctggctaga

SEQ ID NO: 1635729 - DNA, 15 bp, Homo sapiens
agcctctggctagag

SEQ ID NO: 1635730 - DNA, 16 bp, Homo sapiens
agcctctgtcaggcct

SEQ ID NO: 1635731 - DNA, 17 bp, Homo sapiens
agcctctgtcaggcctt

SEQ ID NO: 1635732 - DNA, 20 bp, Homo sapiens
agcctcttaccttcccgcct

SEQ ID NO: 1635733 - DNA, 14 bp, Homo sapiens
agcctcttattcca

SEQ ID NO: 1635734 - DNA, 18 bp, Homo sapiens
agcctcttattccaggag

SEQ ID NO: 1635735 - DNA, 19 bp, Homo sapiens
agcctcttattccaggaga

SEQ ID NO: 1635736 - DNA, 21 bp, Homo sapiens
agcctcttcaaaaagcagagt

SEQ ID NO: 1635737 - DNA, 22 bp, Homo sapiens
agcctcttcaaaaagcagagtg

SEQ ID NO: 1635738 - DNA, 16 bp, Homo sapiens
agcctgaacagaagct

SEQ ID NO: 1635739 - DNA, 15 bp, Homo sapiens
agcctgaactattta

SEQ ID NO: 1635740 - DNA, 16 bp, Homo sapiens
agcctgaactgaggcc

SEQ ID NO: 1635741 - DNA, 15 bp, Homo sapiens
agcctgaagcctgga

SEQ ID NO: 1635742 - DNA, 17 bp, Homo sapiens
agcctgacccggaggaa

SEQ ID NO: 1635743 - DNA, 18 bp, Homo sapiens
agcctgacccggaggaaa

SEQ ID NO: 1635744 - DNA, 12 bp, Homo sapiens
agcctgagagag

SEQ ID NO: 1635745 - DNA, 14 bp, Homo sapiens
agcctgaggccttc

SEQ ID NO: 1635746 - DNA, 18 bp, Homo sapiens
agcctgagtctcctgtgc

SEQ ID NO: 1635747 - DNA, 13 bp, Homo sapiens
agcctgagtgaca

SEQ ID NO: 1635748 - DNA, 23 bp, Homo sapiens
agcctgatactttagccatcata

SEQ ID NO: 1635749 - DNA, 18 bp, Homo sapiens
agcctgatcaggcttcct

SEQ ID NO: 1635750 - DNA, 18 bp, Homo sapiens
agcctgcaaactcactgc

SEQ ID NO: 1635751 - DNA, 21 bp, Homo sapiens
agcctgcaatttcatatgctg

SEQ ID NO: 1635752 - DNA, 16 bp, Homo sapiens
agcctgcacacacctg

SEQ ID NO: 1635753 - DNA, 17 bp, Homo sapiens
agcctgcacacacctgc

SEQ ID NO: 1635754 - DNA, 19 bp, Homo sapiens
agcctgcacacacctgcct

SEQ ID NO: 1635755 - DNA, 21 bp, Homo sapiens
agcctgcacacacctgcctgc

SEQ ID NO: 1635756 - DNA, 19 bp, Homo sapiens
agcctgcagggaagcccca

SEQ ID NO: 1635757 - DNA, 23 bp, Homo sapiens
agcctgcagggaagccccacatg

SEQ ID NO: 1635758 - DNA, 18 bp, Homo sapiens
agcctgcagggtggtgct

SEQ ID NO: 1635759 - DNA, 14 bp, Homo sapiens
agcctgcattctta

SEQ ID NO: 1635760 - DNA, 15 bp, Homo sapiens
agcctgccgcccccg

SEQ ID NO: 1635761 - DNA, 22 bp, Homo sapiens
agcctgccgcccccgcctgggc

SEQ ID NO: 1635762 - DNA, 23 bp, Homo sapiens
agcctgctcccccaccccctccc

SEQ ID NO: 1635763 - DNA, 18 bp, Homo sapiens
cttagtatttctcaggaa

SEQ ID NO: 1635764 - DNA, 15 bp, Homo sapiens
cttagtcactgcctg

SEQ ID NO: 1635765 - DNA, 16 bp, Homo sapiens
cttagtccagttgtgt

SEQ ID NO: 1635766 - DNA, 12 bp, Homo sapiens
cttagtctcagt

SEQ ID NO: 1635767 - DNA, 13 bp, Homo sapiens
cttagtctcagtt

SEQ ID NO: 1635768 - DNA, 18 bp, Homo sapiens
cttagtctcagtttgtgt

SEQ ID NO: 1635769 - DNA, 18 bp, Homo sapiens
cttagtgccacccacctt

SEQ ID NO: 1635770 - DNA, 21 bp, Homo sapiens
cttagtgcccgcctaggagtt

SEQ ID NO: 1635771 - DNA, 18 bp, Homo sapiens
cttagtggtatgtctctt

SEQ ID NO: 1635772 - DNA, 20 bp, Homo sapiens
cttagtggtatgtctcttta

SEQ ID NO: 1635773 - DNA, 13 bp, Homo sapiens
cttagttggctgg

SEQ ID NO: 1635774 - DNA, 22 bp, Homo sapiens
cttagtttgtgatgtaaggcac

SEQ ID NO: 1635775 - DNA, 22 bp, Homo sapiens
cttagtttgtgtgttgtctctt

SEQ ID NO: 1635776 - DNA, 16 bp, Homo sapiens
cttagttttttttaaa

SEQ ID NO: 1635777 - DNA, 17 bp, Homo sapiens
cttagttttttttaaaa

SEQ ID NO: 1635778 - DNA, 22 bp, Homo sapiens
cttagttttttttttttacaac

SEQ ID NO: 1635779 - DNA, 22 bp, Homo sapiens
cttatagtcctcctggaacttg

SEQ ID NO: 1635780 - DNA, 16 bp, Homo sapiens
cttatagtctaagact

SEQ ID NO: 1635781 - DNA, 21 bp, Homo sapiens
cttatagtctaagactatata

SEQ ID NO: 1635782 - DNA, 14 bp, Homo sapiens
cttatagttactgt

SEQ ID NO: 1635783 - DNA, 15 bp, Homo sapiens
cttatagttctaggc

SEQ ID NO: 1635784 - DNA, 16 bp, Homo sapiens
cttatagttctaggca

SEQ ID NO: 1635785 - DNA, 17 bp, Homo sapiens
cttatatatgtgaacat

SEQ ID NO: 1635786 - DNA, 17 bp, Homo sapiens
cttatattttatgaaca

SEQ ID NO: 1635787 - DNA, 23 bp, Homo sapiens
cttatattttatgaacattgtac

SEQ ID NO: 1635788 - DNA, 13 bp, Homo sapiens
cttatcacatttt

SEQ ID NO: 1635789 - DNA, 23 bp, Homo sapiens
cttatcaccacagtaagttccta

SEQ ID NO: 1635790 - DNA, 18 bp, Homo sapiens
cttatcagcatgaagaat

SEQ ID NO: 1635791 - DNA, 15 bp, Homo sapiens
cttatcatccacatt

SEQ ID NO: 1635792 - DNA, 19 bp, Homo sapiens
cttatcatccacattgttt

SEQ ID NO: 1635793 - DNA, 15 bp, Homo sapiens
cttatcattcattct

SEQ ID NO: 1635794 - DNA, 14 bp, Homo sapiens
cttatccctctctt

SEQ ID NO: 1635795 - DNA, 21 bp, Homo sapiens
cttatcctaaaacaaatagtt

SEQ ID NO: 1635796 - DNA, 15 bp, Homo sapiens
cttatcctccaccgt

SEQ ID NO: 1635797 - DNA, 19 bp, Homo sapiens
cttatcctctctctcttct

SEQ ID NO: 1635798 - DNA, 14 bp, Homo sapiens
cttatctataaaag

SEQ ID NO: 1635799 - DNA, 19 bp, Homo sapiens
cttatctatgatgtttctt

SEQ ID NO: 1635800 - DNA, 18 bp, Homo sapiens
cttatgaatatttataac

SEQ ID NO: 1635801 - DNA, 14 bp, Homo sapiens
cttatgaggagggg

SEQ ID NO: 1635802 - DNA, 14 bp, Homo sapiens
cttatgcatgaaat

SEQ ID NO: 1635803 - DNA, 22 bp, Homo sapiens
cttatgcatgaaatgaatgtct

SEQ ID NO: 1635804 - DNA, 14 bp, Homo sapiens
cttatgccacggga

SEQ ID NO: 1635805 - DNA, 21 bp, Homo sapiens
cttatgccatgttaatttcat

SEQ ID NO: 1635806 - DNA, 17 bp, Homo sapiens
cttatggcacaaaaaat

SEQ ID NO: 1635807 - DNA, 19 bp, Homo sapiens
cttatgggctgaagtgttc

SEQ ID NO: 1635808 - DNA, 21 bp, Homo sapiens
cttatgtatcagtgtcctttc

SEQ ID NO: 1635809 - DNA, 15 bp, Homo sapiens
cttatgtctctgcct

SEQ ID NO: 1635810 - DNA, 17 bp, Homo sapiens
cttatgtgaaaaattaa

SEQ ID NO: 1635811 - DNA, 19 bp, Homo sapiens
cttatgttaatagtaattc

SEQ ID NO: 1635812 - DNA, 21 bp, Homo sapiens
agctgcacatgtgccacacag

SEQ ID NO: 1635813 - DNA, 14 bp, Homo sapiens
agctgcacattcct

SEQ ID NO: 1635814 - DNA, 22 bp, Homo sapiens
agctgcacattcctggccccgg

SEQ ID NO: 1635815 - DNA, 16 bp, Homo sapiens
agctgcacctgccagc

SEQ ID NO: 1635816 - DNA, 18 bp, Homo sapiens
agctgcacctgccagcct

SEQ ID NO: 1635817 - DNA, 11 bp, Homo sapiens
agctgcactga

SEQ ID NO: 1635818 - DNA, 13 bp, Homo sapiens
agctgcactgtga

SEQ ID NO: 1635819 - DNA, 22 bp, Homo sapiens
agctgcagctgggccccatgct

SEQ ID NO: 1635820 - DNA, 13 bp, Homo sapiens
agctgcagtgagc

SEQ ID NO: 1635821 - DNA, 21 bp, Homo sapiens
agctgcatcctccaagaatct

SEQ ID NO: 1635822 - DNA, 21 bp, Homo sapiens
agctgccacagagaagtttgt

SEQ ID NO: 1635823 - DNA, 14 bp, Homo sapiens
agctgccactgggc

SEQ ID NO: 1635824 - DNA, 16 bp, Homo sapiens
agctgccactgggcac

SEQ ID NO: 1635825 - DNA, 18 bp, Homo sapiens
agctgccactgggcacct

SEQ ID NO: 1635826 - DNA, 22 bp, Homo sapiens
agctgccatccttgctgcagct

SEQ ID NO: 1635827 - DNA, 19 bp, Homo sapiens
agctgccatcgctgtgatg

SEQ ID NO: 1635828 - DNA, 14 bp, Homo sapiens
agctgccatggcta

SEQ ID NO: 1635829 - DNA, 17 bp, Homo sapiens
agctgcccagacacatg

SEQ ID NO: 1635830 - DNA, 19 bp, Homo sapiens
agctgcccatcccagtccc

SEQ ID NO: 1635831 - DNA, 17 bp, Homo sapiens
agctgccccggcccctc

SEQ ID NO: 1635832 - DNA, 19 bp, Homo sapiens
agctgccccggcccctccc

SEQ ID NO: 1635833 - DNA, 14 bp, Homo sapiens
agctgccctagctg

SEQ ID NO: 1635834 - DNA, 22 bp, Homo sapiens
agctgccctagctgaccccgag

SEQ ID NO: 1635835 - DNA, 17 bp, Homo sapiens
agctgccctatgggcct

SEQ ID NO: 1635836 - DNA, 21 bp, Homo sapiens
agctgccctatgggcctgccg

SEQ ID NO: 1635837 - DNA, 13 bp, Homo sapiens
agctgccctggct

SEQ ID NO: 1635838 - DNA, 14 bp, Homo sapiens
agctgccctggctg

SEQ ID NO: 1635839 - DNA, 13 bp, Homo sapiens
agctgccgaccag

SEQ ID NO: 1635840 - DNA, 18 bp, Homo sapiens
agctgccgaccagagccc

SEQ ID NO: 1635841 - DNA, 22 bp, Homo sapiens
agctgccgcaccagcccgaaca

SEQ ID NO: 1635842 - DNA, 22 bp, Homo sapiens
agctgccgtgcctgtgtcctga

SEQ ID NO: 1635843 - DNA, 22 bp, Homo sapiens
agctgcctacctaatgaggact

SEQ ID NO: 1635844 - DNA, 19 bp, Homo sapiens
agctgcctctgccactgac

SEQ ID NO: 1635845 - DNA, 13 bp, Homo sapiens
agctgcctctgct

SEQ ID NO: 1635846 - DNA, 13 bp, Homo sapiens
agctgcctgcagc

SEQ ID NO: 1635847 - DNA, 19 bp, Homo sapiens
agctgcctgcttggcccgg

SEQ ID NO: 1635848 - DNA, 20 bp, Homo sapiens
agctgcctgcttggcccggc

SEQ ID NO: 1635849 - DNA, 10 bp, Homo sapiens
agctgcctgg

SEQ ID NO: 1635850 - DNA, 15 bp, Homo sapiens
agctgcctggatgag

SEQ ID NO: 1635851 - DNA, 20 bp, Homo sapiens
agctgcctggatgagaaaca

SEQ ID NO: 1635852 - DNA, 15 bp, Homo sapiens
agctgcctgggcccg

SEQ ID NO: 1635853 - DNA, 17 bp, Homo sapiens
agctgccttccctagct

SEQ ID NO: 1635854 - DNA, 19 bp, Homo sapiens
agctgccttcctcatcccc

SEQ ID NO: 1635855 - DNA, 17 bp, Homo sapiens
agctgccttggctcaga

SEQ ID NO: 1635856 - DNA, 22 bp, Homo sapiens
agctgctagtgaaatggctggg

SEQ ID NO: 1635857 - DNA, 18 bp, Homo sapiens
agctgctatccccatctc

SEQ ID NO: 1635858 - DNA, 22 bp, Homo sapiens
agctgctatccccatctccctg

SEQ ID NO: 1635859 - DNA, 23 bp, Homo sapiens
agctgctatccccatctccctgc

SEQ ID NO: 1635860 - DNA, 19 bp, Homo sapiens
agctgctcattacagttct

SEQ ID NO: 1635861 - DNA, 23 bp, Homo sapiens
agctgctcattacagttctttcc

SEQ ID NO: 1635862 - DNA, 16 bp, Homo sapiens
agctgctccccaggcc

SEQ ID NO: 1635863 - DNA, 22 bp, Homo sapiens
agctgctccgaggacccaggaa

SEQ ID NO: 1635864 - DNA, 19 bp, Homo sapiens
agctgctcctttaccctct

SEQ ID NO: 1635865 - DNA, 13 bp, Homo sapiens
agctgctctgccc

SEQ ID NO: 1635866 - DNA, 17 bp, Homo sapiens
agctgctctgccccttg

SEQ ID NO: 1635867 - DNA, 19 bp, Homo sapiens
agctgctcttagtgcccgc

SEQ ID NO: 1635868 - DNA, 20 bp, Homo sapiens
agctgctcttagtgcccgcc

SEQ ID NO: 1635869 - DNA, 21 bp, Homo sapiens
agctgctcttgcatctgggcc

SEQ ID NO: 1635870 - DNA, 16 bp, Homo sapiens
agctgctgaaacaaca

SEQ ID NO: 1635871 - DNA, 19 bp, Homo sapiens
agctgctgaagttctgagc

SEQ ID NO: 1635872 - DNA, 20 bp, Homo sapiens
agctgctgaagttctgagcc

SEQ ID NO: 1635873 - DNA, 20 bp, Homo sapiens
agctgctgaccaattgtgct

SEQ ID NO: 1635874 - DNA, 16 bp, Homo sapiens
agctgctgagtgacag

SEQ ID NO: 1635875 - DNA, 21 bp, Homo sapiens
agctgctgcagccctgccagt

SEQ ID NO: 1635876 - DNA, 12 bp, Homo sapiens
agctgctggagc

SEQ ID NO: 1635877 - DNA, 20 bp, Homo sapiens
agctgctggagcccgcactg

SEQ ID NO: 1635878 - DNA, 14 bp, Homo sapiens
agctgctggcttgc

SEQ ID NO: 1635879 - DNA, 17 bp, Homo sapiens
agctgctggcttgcagt

SEQ ID NO: 1635880 - DNA, 19 bp, Homo sapiens
agctgcttgccattctctt

SEQ ID NO: 1635881 - DNA, 12 bp, Homo sapiens
agctgcttgtcc

SEQ ID NO: 1635882 - DNA, 21 bp, Homo sapiens
cttcaatctctggaaaaataa

SEQ ID NO: 1635883 - DNA, 13 bp, Homo sapiens
cttcaatctctgt

SEQ ID NO: 1635884 - DNA, 19 bp, Homo sapiens
cttcaatgggctcttccaa

SEQ ID NO: 1635885 - DNA, 17 bp, Homo sapiens
cttcacaaagccaagcc

SEQ ID NO: 1635886 - DNA, 12 bp, Homo sapiens
cttcacaaatgt

SEQ ID NO: 1635887 - DNA, 14 bp, Homo sapiens
cttcacaaatgtca

SEQ ID NO: 1635888 - DNA, 16 bp, Homo sapiens
cttcacaaatgtcatt

SEQ ID NO: 1635889 - DNA, 16 bp, Homo sapiens
cttcacacacaggcaa

SEQ ID NO: 1635890 - DNA, 14 bp, Homo sapiens
cttcacactgcgca

SEQ ID NO: 1635891 - DNA, 22 bp, Homo sapiens
cttcacactggtttgccaggcc

SEQ ID NO: 1635892 - DNA, 18 bp, Homo sapiens
cttcacagcgtctgctca

SEQ ID NO: 1635893 - DNA, 18 bp, Homo sapiens
cttcacaggcagtgcatg

SEQ ID NO: 1635894 - DNA, 19 bp, Homo sapiens
cttcacaggcagtgcatgt

SEQ ID NO: 1635895 - DNA, 18 bp, Homo sapiens
cttcacagtagagccagc

SEQ ID NO: 1635896 - DNA, 21 bp, Homo sapiens
cttcacagtagagccagcttg

SEQ ID NO: 1635897 - DNA, 22 bp, Homo sapiens
cttcacataggaagggatctga

SEQ ID NO: 1635898 - DNA, 20 bp, Homo sapiens
cttcacatcctgtgtttcta

SEQ ID NO: 1635899 - DNA, 19 bp, Homo sapiens
cttcaccaagtgcaataga

SEQ ID NO: 1635900 - DNA, 16 bp, Homo sapiens
cttcaccagagcccat

SEQ ID NO: 1635901 - DNA, 16 bp, Homo sapiens
cttcaccatcaatcct

SEQ ID NO: 1635902 - DNA, 17 bp, Homo sapiens
cttcaccatcaatcctg

SEQ ID NO: 1635903 - DNA, 14 bp, Homo sapiens
cttcacccccaact

SEQ ID NO: 1635904 - DNA, 22 bp, Homo sapiens
cttcacccctacactgtgaagg

SEQ ID NO: 1635905 - DNA, 14 bp, Homo sapiens
cttcacccctgcac

SEQ ID NO: 1635906 - DNA, 21 bp, Homo sapiens
cttcacccgagttcctctggg

SEQ ID NO: 1635907 - DNA, 14 bp, Homo sapiens
cttcaccctgtcaa

SEQ ID NO: 1635908 - DNA, 16 bp, Homo sapiens
cttcaccgtggctacc

SEQ ID NO: 1635909 - DNA, 13 bp, Homo sapiens
cttcacctcagag

SEQ ID NO: 1635910 - DNA, 15 bp, Homo sapiens
cttcacctcttccac

SEQ ID NO: 1635911 - DNA, 16 bp, Homo sapiens
cttcacctcttccact

SEQ ID NO: 1635912 - DNA, 16 bp, Homo sapiens
cttcacctttggtgca

SEQ ID NO: 1635913 - DNA, 18 bp, Homo sapiens
cttcacctttggtgcaga

SEQ ID NO: 1635914 - DNA, 15 bp, Homo sapiens
cttcactaccctgat

SEQ ID NO: 1635915 - DNA, 23 bp, Homo sapiens
cttcactaccctgattcttgatt

SEQ ID NO: 1635916 - DNA, 18 bp, Homo sapiens
cttcactattcctaggag

SEQ ID NO: 1635917 - DNA, 17 bp, Homo sapiens
cttcactcaaattttgg

SEQ ID NO: 1635918 - DNA, 14 bp, Homo sapiens
cttcactccggtgt

SEQ ID NO: 1635919 - DNA, 19 bp, Homo sapiens
cttcactccggtgtgcctg

SEQ ID NO: 1635920 - DNA, 22 bp, Homo sapiens
cttcactccggtgtgcctgcag

SEQ ID NO: 1635921 - DNA, 18 bp, Homo sapiens
cttcactgaccagcggct

SEQ ID NO: 1635922 - DNA, 19 bp, Homo sapiens
cttcactgaccagcggctg

SEQ ID NO: 1635923 - DNA, 13 bp, Homo sapiens
cttcactgccatg

SEQ ID NO: 1635924 - DNA, 21 bp, Homo sapiens
cttcactggcgccttctcgga

SEQ ID NO: 1635925 - DNA, 12 bp, Homo sapiens
cttcactgtata

SEQ ID NO: 1635926 - DNA, 14 bp, Homo sapiens
cttcactgtatata

SEQ ID NO: 1635927 - DNA, 19 bp, Homo sapiens
cttcactgtatataaacat

SEQ ID NO: 1635928 - DNA, 18 bp, Homo sapiens
cttcactgtcatcttcaa

SEQ ID NO: 1635929 - DNA, 19 bp, Homo sapiens
cttcactgtggccacagcc

SEQ ID NO: 1635930 - DNA, 12 bp, Homo sapiens
cttcactgttcc

SEQ ID NO: 1635931 - DNA, 20 bp, Homo sapiens
cttcactgttccctctggct

SEQ ID NO: 1635932 - DNA, 22 bp, Homo sapiens
cttcactgttccctctggcttc

SEQ ID NO: 1635933 - DNA, 23 bp, Homo sapiens
cttcactgttccctctggcttcc

SEQ ID NO: 1635934 - DNA, 14 bp, Homo sapiens
cttcacttcaagct

SEQ ID NO: 1635935 - DNA, 16 bp, Homo sapiens
cttcagaaagagctca

SEQ ID NO: 1635936 - DNA, 23 bp, Homo sapiens
cttcagaacacacagactttctg

SEQ ID NO: 1635937 - DNA, 17 bp, Homo sapiens
cttcagaagacactgca

SEQ ID NO: 1635938 - DNA, 21 bp, Homo sapiens
cttcagaaggtaggggccgtg

SEQ ID NO: 1635939 - DNA, 20 bp, Homo sapiens
cttcagacagagaggactgt

SEQ ID NO: 1635940 - DNA, 13 bp, Homo sapiens
cttcagacccaga

SEQ ID NO: 1635941 - DNA, 16 bp, Homo sapiens
cttcagacccagagaa

SEQ ID NO: 1635942 - DNA, 15 bp, Homo sapiens
cttcagagcctagcc

SEQ ID NO: 1635943 - DNA, 18 bp, Homo sapiens
cttcagagcctagccacc

SEQ ID NO: 1635944 - DNA, 13 bp, Homo sapiens
cttcagaggctga

SEQ ID NO: 1635945 - DNA, 16 bp, Homo sapiens
cttcagaggctgaggt

SEQ ID NO: 1635946 - DNA, 12 bp, Homo sapiens
cttcagagtgaa

SEQ ID NO: 1635947 - DNA, 13 bp, Homo sapiens
cttcagagtttgt

SEQ ID NO: 1635948 - DNA, 15 bp, Homo sapiens
cttcagagtttgtgt

SEQ ID NO: 1635949 - DNA, 16 bp, Homo sapiens
cttcagagtttgtgtg

SEQ ID NO: 1635950 - DNA, 18 bp, Homo sapiens
cttcagatattattgctt

SEQ ID NO: 1635951 - DNA, 15 bp, Homo sapiens
cttcagatctgaggt

SEQ ID NO: 1635952 - DNA, 24 bp, Homo sapiens
cttcagattgttaggagtggttct

SEQ ID NO: 1635953 - DNA, 14 bp, Homo sapiens
cttcagcacggcgt

SEQ ID NO: 1635954 - DNA, 16 bp, Homo sapiens
cttcagcagcagctca

SEQ ID NO: 1635955 - DNA, 17 bp, Homo sapiens
cttcagccaggagctgg

SEQ ID NO: 1635956 - DNA, 19 bp, Homo sapiens
cttcagccaggagctgggc

SEQ ID NO: 1635957 - DNA, 21 bp, Homo sapiens
cttcagcccccaccaggggaa

SEQ ID NO: 1635958 - DNA, 16 bp, Homo sapiens
cttcagccctcacccc

SEQ ID NO: 1635959 - DNA, 20 bp, Homo sapiens
cttcagcctagccgacctca

SEQ ID NO: 1635960 - DNA, 21 bp, Homo sapiens
cttcagcctagccgacctcag

SEQ ID NO: 1635961 - DNA, 22 bp, Homo sapiens
cttcagcctagccgacctcagc

SEQ ID NO: 1635962 - DNA, 20 bp, Homo sapiens
cttcagctaaagtaacagag

SEQ ID NO: 1635963 - DNA, 21 bp, Homo sapiens
cttcagctaaagtaacagagc

SEQ ID NO: 1635964 - DNA, 13 bp, Homo sapiens
cttcagctccagg

SEQ ID NO: 1635965 - DNA, 16 bp, Homo sapiens
cttcaggaggccctgg

SEQ ID NO: 1635966 - DNA, 14 bp, Homo sapiens
cttcaggctcttct

SEQ ID NO: 1635967 - DNA, 18 bp, Homo sapiens
cttcaggctcttctcctt

SEQ ID NO: 1635968 - DNA, 16 bp, Homo sapiens
cttcagggcagggctc

SEQ ID NO: 1635969 - DNA, 11 bp, Homo sapiens
cttcagggcca

SEQ ID NO: 1635970 - DNA, 22 bp, Homo sapiens
cttcagggccagaaggagggca

SEQ ID NO: 1635971 - DNA, 21 bp, Homo sapiens
cttcaggggagtcccgtcagg

SEQ ID NO: 1635972 - DNA, 19 bp, Homo sapiens
cttcaggggcacttcattg

SEQ ID NO: 1635973 - DNA, 20 bp, Homo sapiens
cttcaggtggatgaggagac

SEQ ID NO: 1635974 - DNA, 14 bp, Homo sapiens
cttcaggtgtgact

SEQ ID NO: 1635975 - DNA, 15 bp, Homo sapiens
cttcagtctcacaga

SEQ ID NO: 1635976 - DNA, 18 bp, Homo sapiens
cttcagtctcacagagaa

SEQ ID NO: 1635977 - DNA, 13 bp, Homo sapiens
cttcagtctctat

SEQ ID NO: 1635978 - DNA, 13 bp, Homo sapiens
cttcagtctgctc

SEQ ID NO: 1635979 - DNA, 21 bp, Homo sapiens
cttcagtgaatatttttgtat

SEQ ID NO: 1635980 - DNA, 17 bp, Homo sapiens
cttcagtgctacatttt

SEQ ID NO: 1635981 - DNA, 13 bp, Homo sapiens
cttcagtgggaga

SEQ ID NO: 1635982 - DNA, 18 bp, Homo sapiens
cttcagtgggagaaaaca

SEQ ID NO: 1635983 - DNA, 20 bp, Homo sapiens
cttcagtgtatggaaataaa

SEQ ID NO: 1635984 - DNA, 19 bp, Homo sapiens
cttcagttcagctttaaag

SEQ ID NO: 1635985 - DNA, 23 bp, Homo sapiens
cttcagttgcttgtcttctggta

SEQ ID NO: 1635986 - DNA, 18 bp, Homo sapiens
cttcagtttaatgtctcc

SEQ ID NO: 1635987 - DNA, 15 bp, Homo sapiens
cttcagtttcacaga

SEQ ID NO: 1635988 - DNA, 17 bp, Homo sapiens
cttcagtttcacagaaa

SEQ ID NO: 1635989 - DNA, 15 bp, Homo sapiens
cttcataacaatttt

SEQ ID NO: 1635990 - DNA, 20 bp, Homo sapiens
cttcataataaactacacaa

SEQ ID NO: 1635991 - DNA, 14 bp, Homo sapiens
cttcatattcagct

SEQ ID NO: 1635992 - DNA, 19 bp, Homo sapiens
cttcatcattccctctcat

SEQ ID NO: 1635993 - DNA, 23 bp, Homo sapiens
cttcatcccattccaggcagcct

SEQ ID NO: 1635994 - DNA, 16 bp, Homo sapiens
cttcatcccctcagaa

SEQ ID NO: 1635995 - DNA, 16 bp, Homo sapiens
cttcatccgcctgtgg

SEQ ID NO: 1635996 - DNA, 17 bp, Homo sapiens
cttcatccgcctgtggg

SEQ ID NO: 1635997 - DNA, 17 bp, Homo sapiens
cttcatcctcctcccca

SEQ ID NO: 1635998 - DNA, 22 bp, Homo sapiens
cttcatcgacttagcctgagtc

SEQ ID NO: 1635999 - DNA, 24 bp, Homo sapiens
agctgcttgtcctgctctcttcag

SEQ ID NO: 1636000 - DNA, 21 bp, Homo sapiens
agctgcttgtcctgggcctgc

SEQ ID NO: 1636001 - DNA, 18 bp, Homo sapiens
agctgcttttgcatttct

SEQ ID NO: 1636002 - DNA, 17 bp, Homo sapiens
agctgctttttttgaaa

SEQ ID NO: 1636003 - DNA, 22 bp, Homo sapiens
agctgctttttttgaaactttg

SEQ ID NO: 1636004 - DNA, 17 bp, Homo sapiens
agctggaacatttgata

SEQ ID NO: 1636005 - DNA, 18 bp, Homo sapiens
agctggaacatttgatat

SEQ ID NO: 1636006 - DNA, 18 bp, Homo sapiens
agctggaaggcagggcag

SEQ ID NO: 1636007 - DNA, 16 bp, Homo sapiens
agctggactacccacg

SEQ ID NO: 1636008 - DNA, 17 bp, Homo sapiens
agctggagctcttggaa

SEQ ID NO: 1636009 - DNA, 23 bp, Homo sapiens
agctggagctcttggaagagctc

SEQ ID NO: 1636010 - DNA, 20 bp, Homo sapiens
agctggaggggtggggagct

SEQ ID NO: 1636011 - DNA, 15 bp, Homo sapiens
agctggagtgcagtg

SEQ ID NO: 1636012 - DNA, 19 bp, Homo sapiens
agctggagtgcagtggcat

SEQ ID NO: 1636013 - DNA, 15 bp, Homo sapiens
agctggcaaccagcc

SEQ ID NO: 1636014 - DNA, 21 bp, Homo sapiens
agctggcaaccagccagcgtc

SEQ ID NO: 1636015 - DNA, 22 bp, Homo sapiens
agctggcaaccagccagcgtcc

SEQ ID NO: 1636016 - DNA, 11 bp, Homo sapiens
agctggcagga

SEQ ID NO: 1636017 - DNA, 15 bp, Homo sapiens
agctggcattacagc

SEQ ID NO: 1636018 - DNA, 21 bp, Homo sapiens
agctggcattacagctggaga

SEQ ID NO: 1636019 - DNA, 19 bp, Homo sapiens
agctggccaaagagccttt

SEQ ID NO: 1636020 - DNA, 15 bp, Homo sapiens
agctggcctggacag

SEQ ID NO: 1636021 - DNA, 14 bp, Homo sapiens
agctggcctgtggc

SEQ ID NO: 1636022 - DNA, 22 bp, Homo sapiens
agctggcctgtggcacagccct

SEQ ID NO: 1636023 - DNA, 19 bp, Homo sapiens
agctggctctgagcgcctc

SEQ ID NO: 1636024 - DNA, 14 bp, Homo sapiens
agctggctctgtga

SEQ ID NO: 1636025 - DNA, 21 bp, Homo sapiens
agctggctctgtgagggtgct

SEQ ID NO: 1636026 - DNA, 22 bp, Homo sapiens
agctggctctgtgagggtgctg

SEQ ID NO: 1636027 - DNA, 20 bp, Homo sapiens
agctggctgagacactgaag

SEQ ID NO: 1636028 - DNA, 19 bp, Homo sapiens
agctggctgggctggctga

SEQ ID NO: 1636029 - DNA, 22 bp, Homo sapiens
agctgggaaaaaagttttgatg

SEQ ID NO: 1636030 - DNA, 14 bp, Homo sapiens
agctgggacccctc

SEQ ID NO: 1636031 - DNA, 15 bp, Homo sapiens
agctgggactacagg

SEQ ID NO: 1636032 - DNA, 20 bp, Homo sapiens
agctgggagaccctccccac

SEQ ID NO: 1636033 - DNA, 14 bp, Homo sapiens
agctgggagccggg

SEQ ID NO: 1636034 - DNA, 14 bp, Homo sapiens
agctgggaggaaaa

SEQ ID NO: 1636035 - DNA, 23 bp, Homo sapiens
agctgggaggtagaaggggagga

SEQ ID NO: 1636036 - DNA, 15 bp, Homo sapiens
agctgggattacagg

SEQ ID NO: 1636037 - DNA, 14 bp, Homo sapiens
agctgggcagggtg

SEQ ID NO: 1636038 - DNA, 16 bp, Homo sapiens
agctgggccccaccta

SEQ ID NO: 1636039 - DNA, 16 bp, Homo sapiens
agctgggccccatgct

SEQ ID NO: 1636040 - DNA, 19 bp, Homo sapiens
agctgggccccatgctctg

SEQ ID NO: 1636041 - DNA, 22 bp, Homo sapiens
agctgggccccatgctctgccc

SEQ ID NO: 1636042 - DNA, 14 bp, Homo sapiens
agctgggcccctgc

SEQ ID NO: 1636043 - DNA, 11 bp, Homo sapiens
agctgggcccg

SEQ ID NO: 1636044 - DNA, 15 bp, Homo sapiens
agctgggcctcctgc

SEQ ID NO: 1636045 - DNA, 15 bp, Homo sapiens
agctgggctctgcaa

SEQ ID NO: 1636046 - DNA, 14 bp, Homo sapiens
agctgggctctgcc

SEQ ID NO: 1636047 - DNA, 15 bp, Homo sapiens
agctggggatgtctc

SEQ ID NO: 1636048 - DNA, 14 bp, Homo sapiens
agctggggccggag

SEQ ID NO: 1636049 - DNA, 22 bp, Homo sapiens
agctggggcttcaccagtctgt

SEQ ID NO: 1636050 - DNA, 17 bp, Homo sapiens
agctggggggctgtcct

SEQ ID NO: 1636051 - DNA, 19 bp, Homo sapiens
agctggggtgggagctcct

SEQ ID NO: 1636052 - DNA, 22 bp, Homo sapiens
agctggtgccaaatagccccag

SEQ ID NO: 1636053 - DNA, 23 bp, Homo sapiens
agctggtgccaaatagccccaga

SEQ ID NO: 1636054 - DNA, 15 bp, Homo sapiens
agctggtgccccacc

SEQ ID NO: 1636055 - DNA, 18 bp, Homo sapiens
agctggtgccccacctgc

SEQ ID NO: 1636056 - DNA, 21 bp, Homo sapiens
agctggtgccccacctgcctg

SEQ ID NO: 1636057 - DNA, 14 bp, Homo sapiens
agctggtggccctg

SEQ ID NO: 1636058 - DNA, 18 bp, Homo sapiens
agctggtgtctgattgtt

SEQ ID NO: 1636059 - DNA, 21 bp, Homo sapiens
agctgtaatttcgccttaaac

SEQ ID NO: 1636060 - DNA, 16 bp, Homo sapiens
agctgtacccttgaga

SEQ ID NO: 1636061 - DNA, 23 bp, Homo sapiens
agctgtacgaaaaagagcatata

SEQ ID NO: 1636062 - DNA, 13 bp, Homo sapiens
agctgtactataa

SEQ ID NO: 1636063 - DNA, 23 bp, Homo sapiens
agctgtactataagtagttggtt

SEQ ID NO: 1636064 - DNA, 15 bp, Homo sapiens
agctgtactcagagc

SEQ ID NO: 1636065 - DNA, 19 bp, Homo sapiens
agctgtacttcgtcttcta

SEQ ID NO: 1636066 - DNA, 16 bp, Homo sapiens
agctgtagccatggct

SEQ ID NO: 1636067 - DNA, 20 bp, Homo sapiens
agctgtaggtgtgcgggacc

SEQ ID NO: 1636068 - DNA, 22 bp, Homo sapiens
agctgtatgatttgttttgaat

SEQ ID NO: 1636069 - DNA, 17 bp, Homo sapiens
agctgtcaccaaggaaa

SEQ ID NO: 1636070 - DNA, 16 bp, Homo sapiens
agctgtcactctgtgc

SEQ ID NO: 1636071 - DNA, 21 bp, Homo sapiens
agctgtcacttcgcgtgccct

SEQ ID NO: 1636072 - DNA, 19 bp, Homo sapiens
agctgtccctgcagggcca

SEQ ID NO: 1636073 - DNA, 18 bp, Homo sapiens
agctgtccctgtcaccaa

SEQ ID NO: 1636074 - DNA, 20 bp, Homo sapiens
agctgtccctgtcaccaagc

SEQ ID NO: 1636075 - DNA, 14 bp, Homo sapiens
agctgtcctgcagc

SEQ ID NO: 1636076 - DNA, 12 bp, Homo sapiens
agctgtcgctgc

SEQ ID NO: 1636077 - DNA, 17 bp, Homo sapiens
agctgtcgctgcctcca

SEQ ID NO: 1636078 - DNA, 14 bp, Homo sapiens
agctgtctcttcgg

SEQ ID NO: 1636079 - DNA, 13 bp, Homo sapiens
agctgtgaatatt

SEQ ID NO: 1636080 - DNA, 16 bp, Homo sapiens
agctgtgcaggcatgg

SEQ ID NO: 1636081 - DNA, 16 bp, Homo sapiens
agctgtgcctgctcag

SEQ ID NO: 1636082 - DNA, 20 bp, Homo sapiens
agctgtgcctgctcagcagc

SEQ ID NO: 1636083 - DNA, 15 bp, Homo sapiens
agctgtgctcagaag

SEQ ID NO: 1636084 - DNA, 13 bp, Homo sapiens
agctgtggcagcc

SEQ ID NO: 1636085 - DNA, 20 bp, Homo sapiens
agctgtggcagccgtcccag

SEQ ID NO: 1636086 - DNA, 18 bp, Homo sapiens
agctgtggctccctcctc

SEQ ID NO: 1636087 - DNA, 14 bp, Homo sapiens
agctgtggctggag

SEQ ID NO: 1636088 - DNA, 17 bp, Homo sapiens
agctgtggctggaggag

SEQ ID NO: 1636089 - DNA, 19 bp, Homo sapiens
agctgtggggaacatggct

SEQ ID NO: 1636090 - DNA, 20 bp, Homo sapiens
agctgtggggaacatggctg

SEQ ID NO: 1636091 - DNA, 24 bp, Homo sapiens
agctgtgtccttgcacctgcatcc

SEQ ID NO: 1636092 - DNA, 13 bp, Homo sapiens
agctgtgtgaaat

SEQ ID NO: 1636093 - DNA, 14 bp, Homo sapiens
agctgtgtgaaata

SEQ ID NO: 1636094 - DNA, 11 bp, Homo sapiens
agctgtgttta

SEQ ID NO: 1636095 - DNA, 20 bp, Homo sapiens
agctgttatttcttccctgc

SEQ ID NO: 1636096 - DNA, 14 bp, Homo sapiens
agctgttcacagcc

SEQ ID NO: 1636097 - DNA, 16 bp, Homo sapiens
agctgttcacagccag

SEQ ID NO: 1636098 - DNA, 19 bp, Homo sapiens
agctgttcacagccagact

SEQ ID NO: 1636099 - DNA, 13 bp, Homo sapiens
agctgtttattta

SEQ ID NO: 1636100 - DNA, 17 bp, Homo sapiens
agctgtttatttattca

SEQ ID NO: 1636101 - DNA, 18 bp, Homo sapiens
agctgtttatttattcac

SEQ ID NO: 1636102 - DNA, 20 bp, Homo sapiens
agctgtttatttattcactg

SEQ ID NO: 1636103 - DNA, 16 bp, Homo sapiens
agctgtttcaaagttg

SEQ ID NO: 1636104 - DNA, 14 bp, Homo sapiens
agctgtttctcatg

SEQ ID NO: 1636105 - DNA, 16 bp, Homo sapiens
agctgtttggaaaaga

SEQ ID NO: 1636106 - DNA, 18 bp, Homo sapiens
agcttaaacccatacaat

SEQ ID NO: 1636107 - DNA, 20 bp, Homo sapiens
agcttaaacccatacaatgt

SEQ ID NO: 1636108 - DNA, 23 bp, Homo sapiens
agcttaaacccatacaatgtatg

SEQ ID NO: 1636109 - DNA, 23 bp, Homo sapiens
agcttaaattgcttttgttgtga

SEQ ID NO: 1636110 - DNA, 17 bp, Homo sapiens
agcttaactaatttgaa

SEQ ID NO: 1636111 - DNA, 14 bp, Homo sapiens
agcttaatgctaca

SEQ ID NO: 1636112 - DNA, 15 bp, Homo sapiens
agcttaattttctgt

SEQ ID NO: 1636113 - DNA, 19 bp, Homo sapiens
agcttacactgaggactgt

SEQ ID NO: 1636114 - DNA, 18 bp, Homo sapiens
agcttacaggaagctttt

SEQ ID NO: 1636115 - DNA, 17 bp, Homo sapiens
cttcatctccagggagt

SEQ ID NO: 1636116 - DNA, 15 bp, Homo sapiens
cttcatctgcaaagg

SEQ ID NO: 1636117 - DNA, 14 bp, Homo sapiens
cttcatctggcaac

SEQ ID NO: 1636118 - DNA, 19 bp, Homo sapiens
cttcatctggcaacatctt

SEQ ID NO: 1636119 - DNA, 23 bp, Homo sapiens
cttcatctggcaacatctttatc

SEQ ID NO: 1636120 - DNA, 13 bp, Homo sapiens
cttcatcttcctg

SEQ ID NO: 1636121 - DNA, 21 bp, Homo sapiens
cttcatcttcctgtgtcctga

SEQ ID NO: 1636122 - DNA, 22 bp, Homo sapiens
cttcatcttcctgtgtcctgaa

SEQ ID NO: 1636123 - DNA, 12 bp, Homo sapiens
cttcatgcaatg

SEQ ID NO: 1636124 - DNA, 14 bp, Homo sapiens
cttcatgccagcta

SEQ ID NO: 1636125 - DNA, 15 bp, Homo sapiens
cttcatgcctttgta

SEQ ID NO: 1636126 - DNA, 12 bp, Homo sapiens
cttcatgctttt

SEQ ID NO: 1636127 - DNA, 18 bp, Homo sapiens
cttcatggaccaagaatg

SEQ ID NO: 1636128 - DNA, 12 bp, Homo sapiens
cttcatggaggg

SEQ ID NO: 1636129 - DNA, 23 bp, Homo sapiens
cttcatggatgggggaactcaga

SEQ ID NO: 1636130 - DNA, 23 bp, Homo sapiens
cttcatggcatcttcaatatgaa

SEQ ID NO: 1636131 - DNA, 19 bp, Homo sapiens
cttcattcaatattgacat

SEQ ID NO: 1636132 - DNA, 22 bp, Homo sapiens
cttcattcaatattgacatttg

SEQ ID NO: 1636133 - DNA, 14 bp, Homo sapiens
cttcattccattga

SEQ ID NO: 1636134 - DNA, 21 bp, Homo sapiens
cttcattccattgacttagag

SEQ ID NO: 1636135 - DNA, 18 bp, Homo sapiens
cttcattctggaaacttt

SEQ ID NO: 1636136 - DNA, 16 bp, Homo sapiens
cttcattctttactgc

SEQ ID NO: 1636137 - DNA, 20 bp, Homo sapiens
cttcattctttactgcactc

SEQ ID NO: 1636138 - DNA, 21 bp, Homo sapiens
cttcattgagagttttgtctt

SEQ ID NO: 1636139 - DNA, 18 bp, Homo sapiens
cttcattgttacatgtaa

SEQ ID NO: 1636140 - DNA, 17 bp, Homo sapiens
cttcattttcattacca

SEQ ID NO: 1636141 - DNA, 19 bp, Homo sapiens
cttccaaagactccctcca

SEQ ID NO: 1636142 - DNA, 22 bp, Homo sapiens
cttccaaagagagttaaaagca

SEQ ID NO: 1636143 - DNA, 13 bp, Homo sapiens
cttccaaagccta

SEQ ID NO: 1636144 - DNA, 23 bp, Homo sapiens
cttccaaatcctggaaggacaca

SEQ ID NO: 1636145 - DNA, 17 bp, Homo sapiens
cttccaacaaggacagc

SEQ ID NO: 1636146 - DNA, 20 bp, Homo sapiens
cttccaacaaggacagccct

SEQ ID NO: 1636147 - DNA, 21 bp, Homo sapiens
cttccaacatatatttattga

SEQ ID NO: 1636148 - DNA, 19 bp, Homo sapiens
cttccaaccatttatcttg

SEQ ID NO: 1636149 - DNA, 14 bp, Homo sapiens
cttccaaggagacc

SEQ ID NO: 1636150 - DNA, 18 bp, Homo sapiens
cttccaaggagaccaagt

SEQ ID NO: 1636151 - DNA, 21 bp, Homo sapiens
cttccaaggagaccaagtcct

SEQ ID NO: 1636152 - DNA, 13 bp, Homo sapiens
cttccacaaaatt

SEQ ID NO: 1636153 - DNA, 13 bp, Homo sapiens
cttccacagcagc

SEQ ID NO: 1636154 - DNA, 15 bp, Homo sapiens
cttccaccagcctgc

SEQ ID NO: 1636155 - DNA, 15 bp, Homo sapiens
cttccacctcctaga

SEQ ID NO: 1636156 - DNA, 12 bp, Homo sapiens
cttccacctgcc

SEQ ID NO: 1636157 - DNA, 21 bp, Homo sapiens
cttccacctgtgccctcacca

SEQ ID NO: 1636158 - DNA, 22 bp, Homo sapiens
cttccagaaagcaggagcagct

SEQ ID NO: 1636159 - DNA, 23 bp, Homo sapiens
cttccagaaagcaggagcagctg

SEQ ID NO: 1636160 - DNA, 17 bp, Homo sapiens
cttccagaatcccaaga

SEQ ID NO: 1636161 - DNA, 12 bp, Homo sapiens
cttccagaatgc

SEQ ID NO: 1636162 - DNA, 17 bp, Homo sapiens
cttccagatcactgcca

SEQ ID NO: 1636163 - DNA, 21 bp, Homo sapiens
cttccagatggtcatccagac

SEQ ID NO: 1636164 - DNA, 14 bp, Homo sapiens
cttccagattttaa

SEQ ID NO: 1636165 - DNA, 15 bp, Homo sapiens
cttccagcaccctgc

SEQ ID NO: 1636166 - DNA, 21 bp, Homo sapiens
cttccagcatttagctggcca

SEQ ID NO: 1636167 - DNA, 16 bp, Homo sapiens
cttccagctgctgtct

SEQ ID NO: 1636168 - DNA, 13 bp, Homo sapiens
cttccaggaaact

SEQ ID NO: 1636169 - DNA, 21 bp, Homo sapiens
cttccaggaaactccacatct

SEQ ID NO: 1636170 - DNA, 12 bp, Homo sapiens
cttccaggctct

SEQ ID NO: 1636171 - DNA, 19 bp, Homo sapiens
cttccaggggaacctgcca

SEQ ID NO: 1636172 - DNA, 22 bp, Homo sapiens
cttccaggtgggtgtgggacac

SEQ ID NO: 1636173 - DNA, 20 bp, Homo sapiens
cttccaggttccatccacca

SEQ ID NO: 1636174 - DNA, 14 bp, Homo sapiens
cttccagtgaacat

SEQ ID NO: 1636175 - DNA, 15 bp, Homo sapiens
cttccagtgaacatt

SEQ ID NO: 1636176 - DNA, 23 bp, Homo sapiens
cttccagtggtttgagacactgg

SEQ ID NO: 1636177 - DNA, 22 bp, Homo sapiens
cttccataatgctactgtctca

SEQ ID NO: 1636178 - DNA, 11 bp, Homo sapiens
cttccataatt

SEQ ID NO: 1636179 - DNA, 14 bp, Homo sapiens
cttccataattatg

SEQ ID NO: 1636180 - DNA, 23 bp, Homo sapiens
cttccataggacatactgcatgt

SEQ ID NO: 1636181 - DNA, 16 bp, Homo sapiens
cttccatcagcgggtc

SEQ ID NO: 1636182 - DNA, 16 bp, Homo sapiens
cttccatcatcactgt

SEQ ID NO: 1636183 - DNA, 18 bp, Homo sapiens
cttccatcatcactgtaa

SEQ ID NO: 1636184 - DNA, 17 bp, Homo sapiens
cttccatccatctttcc

SEQ ID NO: 1636185 - DNA, 22 bp, Homo sapiens
cttccatccatctttccatcca

SEQ ID NO: 1636186 - DNA, 17 bp, Homo sapiens
cttccatccctaccccc

SEQ ID NO: 1636187 - DNA, 16 bp, Homo sapiens
cttccatctctgactt

SEQ ID NO: 1636188 - DNA, 17 bp, Homo sapiens
cttccatcttgtggggc

SEQ ID NO: 1636189 - DNA, 23 bp, Homo sapiens
cttccatcttgtggggccaggac

SEQ ID NO: 1636190 - DNA, 21 bp, Homo sapiens
cttccatgagaacagcagggt

SEQ ID NO: 1636191 - DNA, 17 bp, Homo sapiens
cttccatgccccaggat

SEQ ID NO: 1636192 - DNA, 11 bp, Homo sapiens
cttccatgcct

SEQ ID NO: 1636193 - DNA, 14 bp, Homo sapiens
cttccatgcctgta

SEQ ID NO: 1636194 - DNA, 17 bp, Homo sapiens
cttccatgcctgtagct

SEQ ID NO: 1636195 - DNA, 13 bp, Homo sapiens
cttccatgcctta

SEQ ID NO: 1636196 - DNA, 14 bp, Homo sapiens
cttccatgctgtgc

SEQ ID NO: 1636197 - DNA, 13 bp, Homo sapiens
cttccatgtgcct

SEQ ID NO: 1636198 - DNA, 18 bp, Homo sapiens
cttccatgtgcctttctt

SEQ ID NO: 1636199 - DNA, 12 bp, Homo sapiens
cttccatgtgga

SEQ ID NO: 1636200 - DNA, 15 bp, Homo sapiens
cttccatgtggagaa

SEQ ID NO: 1636201 - DNA, 15 bp, Homo sapiens
cttccattccacaca

SEQ ID NO: 1636202 - DNA, 17 bp, Homo sapiens
cttccattccacacaga

SEQ ID NO: 1636203 - DNA, 22 bp, Homo sapiens
cttccattccacacagaatgca

SEQ ID NO: 1636204 - DNA, 22 bp, Homo sapiens
cttccatttgtattcaaatttg

SEQ ID NO: 1636205 - DNA, 23 bp, Homo sapiens
cttcccaaagtcctgggattaca

SEQ ID NO: 1636206 - DNA, 21 bp, Homo sapiens
cttcccaatcagcactgaaaa

SEQ ID NO: 1636207 - DNA, 22 bp, Homo sapiens
cttcccaatcagcactgaaaat

SEQ ID NO: 1636208 - DNA, 12 bp, Homo sapiens
cttcccacagga

SEQ ID NO: 1636209 - DNA, 21 bp, Homo sapiens
cttcccacccatcgctgtgtg

SEQ ID NO: 1636210 - DNA, 19 bp, Homo sapiens
cttcccaccctgcccctca

SEQ ID NO: 1636211 - DNA, 16 bp, Homo sapiens
cttcccacctactgca

SEQ ID NO: 1636212 - DNA, 18 bp, Homo sapiens
cttcccacctactgcact

SEQ ID NO: 1636213 - DNA, 22 bp, Homo sapiens
cttcccacctactgcactttcc

SEQ ID NO: 1636214 - DNA, 14 bp, Homo sapiens
cttcccagaccagg

SEQ ID NO: 1636215 - DNA, 16 bp, Homo sapiens
cttcccagaccaggaa

SEQ ID NO: 1636216 - DNA, 22 bp, Homo sapiens
cttcccagaccaggaaaggctt

SEQ ID NO: 1636217 - DNA, 20 bp, Homo sapiens
cttcccagaggagcagctct

SEQ ID NO: 1636218 - DNA, 22 bp, Homo sapiens
cttcccagctctccctctggcc

SEQ ID NO: 1636219 - DNA, 11 bp, Homo sapiens
cttcccaggag

SEQ ID NO: 1636220 - DNA, 23 bp, Homo sapiens
cttcccaggatctgctccaacag

SEQ ID NO: 1636221 - DNA, 16 bp, Homo sapiens
cttcccaggccctttg

SEQ ID NO: 1636222 - DNA, 19 bp, Homo sapiens
cttcccaggccctttggct

SEQ ID NO: 1636223 - DNA, 20 bp, Homo sapiens
cttcccaggccctttggctt

SEQ ID NO: 1636224 - DNA, 21 bp, Homo sapiens
cttcccagtgaatccctggga

SEQ ID NO: 1636225 - DNA, 23 bp, Homo sapiens
cttcccagtgaatccctgggagc

SEQ ID NO: 1636226 - DNA, 22 bp, Homo sapiens
cttcccagttcaggagtcccaa

SEQ ID NO: 1636227 - DNA, 16 bp, Homo sapiens
cttcccatagtggggc

SEQ ID NO: 1636228 - DNA, 18 bp, Homo sapiens
cttcccatcactggagca

SEQ ID NO: 1636229 - DNA, 19 bp, Homo sapiens
cttcccatcctaccctcgg

SEQ ID NO: 1636230 - DNA, 21 bp, Homo sapiens
cttcccatgcctgtctctgtt

SEQ ID NO: 1636231 - DNA, 15 bp, Homo sapiens
agcttacccaagctg

SEQ ID NO: 1636232 - DNA, 18 bp, Homo sapiens
agcttacccaagctgtgg

SEQ ID NO: 1636233 - DNA, 21 bp, Homo sapiens
agcttacctgaacaggaatcc

SEQ ID NO: 1636234 - DNA, 17 bp, Homo sapiens
agcttagccaatgtggg

SEQ ID NO: 1636235 - DNA, 15 bp, Homo sapiens
agcttagccttgtgc

SEQ ID NO: 1636236 - DNA, 20 bp, Homo sapiens
agcttagccttgtgccctgc

SEQ ID NO: 1636237 - DNA, 21 bp, Homo sapiens
agcttagccttgtgccctgcc

SEQ ID NO: 1636238 - DNA, 20 bp, Homo sapiens
agcttagttttttttaaaaa

SEQ ID NO: 1636239 - DNA, 22 bp, Homo sapiens
agcttagttttttttaaaaaaa

SEQ ID NO: 1636240 - DNA, 20 bp, Homo sapiens
agcttataagagggcatata

SEQ ID NO: 1636241 - DNA, 13 bp, Homo sapiens
agcttatctctga

SEQ ID NO: 1636242 - DNA, 13 bp, Homo sapiens
agcttatctcttt

SEQ ID NO: 1636243 - DNA, 14 bp, Homo sapiens
agcttatctctttt

SEQ ID NO: 1636244 - DNA, 20 bp, Homo sapiens
agcttatgggatccttgtct

SEQ ID NO: 1636245 - DNA, 20 bp, Homo sapiens
agcttattggccactgggtc

SEQ ID NO: 1636246 - DNA, 20 bp, Homo sapiens
agcttattgtgtgcgctgcc

SEQ ID NO: 1636247 - DNA, 22 bp, Homo sapiens
agcttattgtgtgcgctgcctg

SEQ ID NO: 1636248 - DNA, 15 bp, Homo sapiens
agcttattttgtaag

SEQ ID NO: 1636249 - DNA, 17 bp, Homo sapiens
agcttatttttctgtga

SEQ ID NO: 1636250 - DNA, 17 bp, Homo sapiens
agcttatttttttctac

SEQ ID NO: 1636251 - DNA, 14 bp, Homo sapiens
agcttcaaagttta

SEQ ID NO: 1636252 - DNA, 21 bp, Homo sapiens
agcttcaaccctcagccttga

SEQ ID NO: 1636253 - DNA, 18 bp, Homo sapiens
agcttcaagtcagtgagg

SEQ ID NO: 1636254 - DNA, 18 bp, Homo sapiens
agcttcaatataagaagc

SEQ ID NO: 1636255 - DNA, 16 bp, Homo sapiens
agcttcaccctgtcaa

SEQ ID NO: 1636256 - DNA, 15 bp, Homo sapiens
agcttcagactcaag

SEQ ID NO: 1636257 - DNA, 16 bp, Homo sapiens
agcttcagagcctagc

SEQ ID NO: 1636258 - DNA, 15 bp, Homo sapiens
agcttcagccaggag

SEQ ID NO: 1636259 - DNA, 19 bp, Homo sapiens
agcttcagccaggagctgg

SEQ ID NO: 1636260 - DNA, 20 bp, Homo sapiens
agcttcagccaggagctggg

SEQ ID NO: 1636261 - DNA, 17 bp, Homo sapiens
agcttcatataccagca

SEQ ID NO: 1636262 - DNA, 21 bp, Homo sapiens
agcttcattctccttgttgtt

SEQ ID NO: 1636263 - DNA, 14 bp, Homo sapiens
agcttccaaagcct

SEQ ID NO: 1636264 - DNA, 11 bp, Homo sapiens
agcttccaaat

SEQ ID NO: 1636265 - DNA, 18 bp, Homo sapiens
agcttccacaaaattaga

SEQ ID NO: 1636266 - DNA, 20 bp, Homo sapiens
agcttccacctgtccctctc

SEQ ID NO: 1636267 - DNA, 23 bp, Homo sapiens
agcttccattccaagcctgacca

SEQ ID NO: 1636268 - DNA, 20 bp, Homo sapiens
agcttcccacacctgcctgc

SEQ ID NO: 1636269 - DNA, 15 bp, Homo sapiens
cttccctctcctgct

SEQ ID NO: 1636270 - DNA, 17 bp, Homo sapiens
cttccctctcgctcccc

SEQ ID NO: 1636271 - DNA, 18 bp, Homo sapiens
cttccctctcgctcccct

SEQ ID NO: 1636272 - DNA, 23 bp, Homo sapiens
cttccctctcgctcccctctgcc

SEQ ID NO: 1636273 - DNA, 15 bp, Homo sapiens
cttccctctgggcct

SEQ ID NO: 1636274 - DNA, 21 bp, Homo sapiens
cttccctgaacgttttcttct

SEQ ID NO: 1636275 - DNA, 22 bp, Homo sapiens
cttccctgaacgttttcttctt

SEQ ID NO: 1636276 - DNA, 17 bp, Homo sapiens
cttccctgacttgcttt

SEQ ID NO: 1636277 - DNA, 12 bp, Homo sapiens
cttccctgcagt

SEQ ID NO: 1636278 - DNA, 17 bp, Homo sapiens
cttccctgctatttccc

SEQ ID NO: 1636279 - DNA, 14 bp, Homo sapiens
cttccctgctccca

SEQ ID NO: 1636280 - DNA, 22 bp, Homo sapiens
cttccctggaaaccttccaccc

SEQ ID NO: 1636281 - DNA, 10 bp, Homo sapiens
cttccctggc

SEQ ID NO: 1636282 - DNA, 13 bp, Homo sapiens
cttccctggcagg

SEQ ID NO: 1636283 - DNA, 13 bp, Homo sapiens
cttccctgggaag

SEQ ID NO: 1636284 - DNA, 13 bp, Homo sapiens
cttccctgggctg

SEQ ID NO: 1636285 - DNA, 17 bp, Homo sapiens
cttccctgggctgtgct

SEQ ID NO: 1636286 - DNA, 22 bp, Homo sapiens
cttccctgtatgattccttgat

SEQ ID NO: 1636287 - DNA, 12 bp, Homo sapiens
cttccctgtccc

SEQ ID NO: 1636288 - DNA, 13 bp, Homo sapiens
cttccctgtccct

SEQ ID NO: 1636289 - DNA, 16 bp, Homo sapiens
cttcccttaactccaa

SEQ ID NO: 1636290 - DNA, 15 bp, Homo sapiens
cttcccttacctcaa

SEQ ID NO: 1636291 - DNA, 18 bp, Homo sapiens
cttcccttagcctctccc

SEQ ID NO: 1636292 - DNA, 21 bp, Homo sapiens
cttcccttagcctctcccacc

SEQ ID NO: 1636293 - DNA, 18 bp, Homo sapiens
cttcccttctccccagcc

SEQ ID NO: 1636294 - DNA, 20 bp, Homo sapiens
cttcccttctccccagccag

SEQ ID NO: 1636295 - DNA, 14 bp, Homo sapiens
cttcccttctccct

SEQ ID NO: 1636296 - DNA, 14 bp, Homo sapiens
cttcccttctcttg

SEQ ID NO: 1636297 - DNA, 16 bp, Homo sapiens
cttcccttgagccctc

SEQ ID NO: 1636298 - DNA, 13 bp, Homo sapiens
cttccgacatccc

SEQ ID NO: 1636299 - DNA, 13 bp, Homo sapiens
cttccgatgacag

SEQ ID NO: 1636300 - DNA, 12 bp, Homo sapiens
cttccgctgagg

SEQ ID NO: 1636301 - DNA, 19 bp, Homo sapiens
cttccgctgcgggcccagc

SEQ ID NO: 1636302 - DNA, 23 bp, Homo sapiens
cttccgctgcgggcccagctgag

SEQ ID NO: 1636303 - DNA, 17 bp, Homo sapiens
cttccgctttgaaagaa

SEQ ID NO: 1636304 - DNA, 21 bp, Homo sapiens
cttccgctttgaaagaagcaa

SEQ ID NO: 1636305 - DNA, 22 bp, Homo sapiens
cttccgggtctcgcagcctgaa

SEQ ID NO: 1636306 - DNA, 17 bp, Homo sapiens
cttcctaaacccaatga

SEQ ID NO: 1636307 - DNA, 22 bp, Homo sapiens
cttcctacaagagcagcctgtg

SEQ ID NO: 1636308 - DNA, 17 bp, Homo sapiens
cttcctagatctgcagg

SEQ ID NO: 1636309 - DNA, 14 bp, Homo sapiens
cttcctagggatct

SEQ ID NO: 1636310 - DNA, 15 bp, Homo sapiens
cttcctagttttctc

SEQ ID NO: 1636311 - DNA, 17 bp, Homo sapiens
cttcctagttttctcct

SEQ ID NO: 1636312 - DNA, 23 bp, Homo sapiens
cttcctagttttctcctcccagg

SEQ ID NO: 1636313 - DNA, 16 bp, Homo sapiens
cttcctatttcagaag

SEQ ID NO: 1636314 - DNA, 22 bp, Homo sapiens
cttcctcaaaataaagaagtat

SEQ ID NO: 1636315 - DNA, 14 bp, Homo sapiens
cttcctcacacccc

SEQ ID NO: 1636316 - DNA, 13 bp, Homo sapiens
cttcctcactgcc

SEQ ID NO: 1636317 - DNA, 14 bp, Homo sapiens
cttcctcatcccct

SEQ ID NO: 1636318 - DNA, 15 bp, Homo sapiens
cttcctccccacact

SEQ ID NO: 1636319 - DNA, 16 bp, Homo sapiens
cttcctccccacactc

SEQ ID NO: 1636320 - DNA, 18 bp, Homo sapiens
cttcctccccacactcca

SEQ ID NO: 1636321 - DNA, 18 bp, Homo sapiens
cttcctcccggggccttc

SEQ ID NO: 1636322 - DNA, 13 bp, Homo sapiens
cttcctccgtcca

SEQ ID NO: 1636323 - DNA, 20 bp, Homo sapiens
cttcctccgtccacccaggc

SEQ ID NO: 1636324 - DNA, 22 bp, Homo sapiens
cttcctccgtccacccaggctg

SEQ ID NO: 1636325 - DNA, 16 bp, Homo sapiens
cttcctcctccacagt

SEQ ID NO: 1636326 - DNA, 15 bp, Homo sapiens
cttcctcctgatggc

SEQ ID NO: 1636327 - DNA, 22 bp, Homo sapiens
cttcctcctgatggccaagagc

SEQ ID NO: 1636328 - DNA, 19 bp, Homo sapiens
cttcctctagaagccaagg

SEQ ID NO: 1636329 - DNA, 13 bp, Homo sapiens
cttcctctcaggc

SEQ ID NO: 1636330 - DNA, 16 bp, Homo sapiens
cttcctctccactgcc

SEQ ID NO: 1636331 - DNA, 22 bp, Homo sapiens
cttcctctgcagctgacctctg

SEQ ID NO: 1636332 - DNA, 15 bp, Homo sapiens
cttcctctggttcct

SEQ ID NO: 1636333 - DNA, 23 bp, Homo sapiens
cttcctcttagcctctggatcta

SEQ ID NO: 1636334 - DNA, 17 bp, Homo sapiens
cttcctcttcccccaag

SEQ ID NO: 1636335 - DNA, 18 bp, Homo sapiens
cttcctcttcctgccctt

SEQ ID NO: 1636336 - DNA, 14 bp, Homo sapiens
cttcctcttcttgt

SEQ ID NO: 1636337 - DNA, 15 bp, Homo sapiens
cttcctcttggctga

SEQ ID NO: 1636338 - DNA, 16 bp, Homo sapiens
cttcctcttgtctgat

SEQ ID NO: 1636339 - DNA, 15 bp, Homo sapiens
cttcctgacacttta

SEQ ID NO: 1636340 - DNA, 20 bp, Homo sapiens
cttcctgcaggcaggaacaa

SEQ ID NO: 1636341 - DNA, 14 bp, Homo sapiens
cttcctgccactgc

SEQ ID NO: 1636342 - DNA, 10 bp, Homo sapiens
cttcctgccc

SEQ ID NO: 1636343 - DNA, 13 bp, Homo sapiens
cttcctgcccttg

SEQ ID NO: 1636344 - DNA, 13 bp, Homo sapiens
cttcctgctgcac

SEQ ID NO: 1636345 - DNA, 16 bp, Homo sapiens
cttcctgctgcaccct

SEQ ID NO: 1636346 - DNA, 12 bp, Homo sapiens
cttcctgctgct

SEQ ID NO: 1636347 - DNA, 19 bp, Homo sapiens
cttcctgcttcctcagagg

SEQ ID NO: 1636348 - DNA, 12 bp, Homo sapiens
cttcctgcttgc

SEQ ID NO: 1636349 - DNA, 14 bp, Homo sapiens
cttcctgcttgcca

SEQ ID NO: 1636350 - DNA, 16 bp, Homo sapiens
cttcctgcttgccaag

SEQ ID NO: 1636351 - DNA, 14 bp, Homo sapiens
agctttctttcaca

SEQ ID NO: 1636352 - DNA, 17 bp, Homo sapiens
agctttgagaagccttc

SEQ ID NO: 1636353 - DNA, 23 bp, Homo sapiens
agctttgagttgacttctgacaa

SEQ ID NO: 1636354 - DNA, 16 bp, Homo sapiens
agctttgctaccaaag

SEQ ID NO: 1636355 - DNA, 21 bp, Homo sapiens
agctttgctccgctcccaccg

SEQ ID NO: 1636356 - DNA, 22 bp, Homo sapiens
agctttgctccgctcccaccgc

SEQ ID NO: 1636357 - DNA, 13 bp, Homo sapiens
agctttgctgcta

SEQ ID NO: 1636358 - DNA, 14 bp, Homo sapiens
agctttggaaagtt

SEQ ID NO: 1636359 - DNA, 20 bp, Homo sapiens
agctttggaaagttactgta

SEQ ID NO: 1636360 - DNA, 15 bp, Homo sapiens
agctttggaatattt

SEQ ID NO: 1636361 - DNA, 22 bp, Homo sapiens
agctttggaatattttatcctg

SEQ ID NO: 1636362 - DNA, 12 bp, Homo sapiens
agctttgtagtt

SEQ ID NO: 1636363 - DNA, 15 bp, Homo sapiens
agctttgtcgtattt

SEQ ID NO: 1636364 - DNA, 19 bp, Homo sapiens
agctttgtttcaaccaagt

SEQ ID NO: 1636365 - DNA, 15 bp, Homo sapiens
agctttgtttgttct

SEQ ID NO: 1636366 - DNA, 16 bp, Homo sapiens
agctttgtttgttctt

SEQ ID NO: 1636367 - DNA, 17 bp, Homo sapiens
agctttgtttgttcttg

SEQ ID NO: 1636368 - DNA, 12 bp, Homo sapiens
agcttttaaaaa

SEQ ID NO: 1636369 - DNA, 15 bp, Homo sapiens
agcttttaaaaatgt

SEQ ID NO: 1636370 - DNA, 16 bp, Homo sapiens
agcttttaaaatgtag

SEQ ID NO: 1636371 - DNA, 20 bp, Homo sapiens
agcttttgatgccaggtgca

SEQ ID NO: 1636372 - DNA, 17 bp, Homo sapiens
agcttttgccagtatta

SEQ ID NO: 1636373 - DNA, 12 bp, Homo sapiens
agcttttggaag

SEQ ID NO: 1636374 - DNA, 23 bp, Homo sapiens
agcttttggttaatatgtctttt

SEQ ID NO: 1636375 - DNA, 17 bp, Homo sapiens
agcttttgttctagact

SEQ ID NO: 1636376 - DNA, 14 bp, Homo sapiens
agctttttcaaaag

SEQ ID NO: 1636377 - DNA, 13 bp, Homo sapiens
agctttttggaat

SEQ ID NO: 1636378 - DNA, 14 bp, Homo sapiens
agctttttggaatc

SEQ ID NO: 1636379 - DNA, 20 bp, Homo sapiens
aggaaaaaagaaccaaaact

SEQ ID NO: 1636380 - DNA, 18 bp, Homo sapiens
aggaaaaaataaaaagag

SEQ ID NO: 1636381 - DNA, 14 bp, Homo sapiens
aggaaaaaatggta

SEQ ID NO: 1636382 - DNA, 17 bp, Homo sapiens
aggaaaaacacaagcaa

SEQ ID NO: 1636383 - DNA, 19 bp, Homo sapiens
aggaaaaacacaagcaaaa

SEQ ID NO: 1636384 - DNA, 13 bp, Homo sapiens
aggaaaaataatc

SEQ ID NO: 1636385 - DNA, 16 bp, Homo sapiens
cttcctttctcctgcc

SEQ ID NO: 1636386 - DNA, 14 bp, Homo sapiens
cttcctttctctcc

SEQ ID NO: 1636387 - DNA, 17 bp, Homo sapiens
cttcctttctctcctgg

SEQ ID NO: 1636388 - DNA, 13 bp, Homo sapiens
cttccttttaact

SEQ ID NO: 1636389 - DNA, 14 bp, Homo sapiens
cttccttttaactg

SEQ ID NO: 1636390 - DNA, 17 bp, Homo sapiens
cttcgaaaggccttcag

SEQ ID NO: 1636391 - DNA, 22 bp, Homo sapiens
cttcgactactgctcctgtggc

SEQ ID NO: 1636392 - DNA, 14 bp, Homo sapiens
cttcgactcaggat

SEQ ID NO: 1636393 - DNA, 15 bp, Homo sapiens
cttcgactcaggatc

SEQ ID NO: 1636394 - DNA, 22 bp, Homo sapiens
cttcgaggaacccacccggctg

SEQ ID NO: 1636395 - DNA, 21 bp, Homo sapiens
cttcgatacaccgggcctgga

SEQ ID NO: 1636396 - DNA, 17 bp, Homo sapiens
cttcgcaaactgatgga

SEQ ID NO: 1636397 - DNA, 13 bp, Homo sapiens
cttcgctgctcta

SEQ ID NO: 1636398 - DNA, 20 bp, Homo sapiens
cttcgctgctctagctggca

SEQ ID NO: 1636399 - DNA, 13 bp, Homo sapiens
cttcgctggacta

SEQ ID NO: 1636400 - DNA, 17 bp, Homo sapiens
cttcgctggactattgt

SEQ ID NO: 1636401 - DNA, 21 bp, Homo sapiens
cttcgctggactattgtgcca

SEQ ID NO: 1636402 - DNA, 17 bp, Homo sapiens
cttcgcttcttgcctct

SEQ ID NO: 1636403 - DNA, 21 bp, Homo sapiens
cttcgcttcttgcctctgtgc

SEQ ID NO: 1636404 - DNA, 18 bp, Homo sapiens
cttcgggcgtctgtgtgc

SEQ ID NO: 1636405 - DNA, 18 bp, Homo sapiens
cttcggggaactcctgga

SEQ ID NO: 1636406 - DNA, 21 bp, Homo sapiens
cttcgtctttcccatggggag

SEQ ID NO: 1636407 - DNA, 15 bp, Homo sapiens
cttcgtgccccccct

SEQ ID NO: 1636408 - DNA, 20 bp, Homo sapiens
cttcgttaactgtgtatgta

SEQ ID NO: 1636409 - DNA, 18 bp, Homo sapiens
cttcgttagaatgtctgc

SEQ ID NO: 1636410 - DNA, 16 bp, Homo sapiens
cttcgtttattttcaa

SEQ ID NO: 1636411 - DNA, 16 bp, Homo sapiens
cttctaaaacaataaa

SEQ ID NO: 1636412 - DNA, 14 bp, Homo sapiens
cttctaaaagccat

SEQ ID NO: 1636413 - DNA, 17 bp, Homo sapiens
cttctaactggtaaaaa

SEQ ID NO: 1636414 - DNA, 18 bp, Homo sapiens
cttctaagaagacatttt

SEQ ID NO: 1636415 - DNA, 23 bp, Homo sapiens
cttctaagagcgaacttcacata

SEQ ID NO: 1636416 - DNA, 23 bp, Homo sapiens
cttctaaggaaatggagaagctc

SEQ ID NO: 1636417 - DNA, 21 bp, Homo sapiens
cttctaagtaaaaccacagca

SEQ ID NO: 1636418 - DNA, 22 bp, Homo sapiens
cttctacccagatggaaaaata

SEQ ID NO: 1636419 - DNA, 22 bp, Homo sapiens
cttctaccccaaggccagtagt

SEQ ID NO: 1636420 - DNA, 12 bp, Homo sapiens
cttctacctgcc

SEQ ID NO: 1636421 - DNA, 19 bp, Homo sapiens
cttctacctgccctcaagg

SEQ ID NO: 1636422 - DNA, 19 bp, Homo sapiens
cttctagaatgtaaagtta

SEQ ID NO: 1636423 - DNA, 13 bp, Homo sapiens
cttctagagtttt

SEQ ID NO: 1636424 - DNA, 20 bp, Homo sapiens
cttctaggcccattgtcctc

SEQ ID NO: 1636425 - DNA, 23 bp, Homo sapiens
cttctaggcccattgtcctcctt

SEQ ID NO: 1636426 - DNA, 15 bp, Homo sapiens
cttctagtttcccac

SEQ ID NO: 1636427 - DNA, 17 bp, Homo sapiens
cttctatacccacccag

SEQ ID NO: 1636428 - DNA, 13 bp, Homo sapiens
cttctatatttta

SEQ ID NO: 1636429 - DNA, 23 bp, Homo sapiens
cttctatggactggttgttgcca

SEQ ID NO: 1636430 - DNA, 14 bp, Homo sapiens
cttctattggtctc

SEQ ID NO: 1636431 - DNA, 16 bp, Homo sapiens
cttctatttaatgctt

SEQ ID NO: 1636432 - DNA, 17 bp, Homo sapiens
cttctattttgtaaact

SEQ ID NO: 1636433 - DNA, 19 bp, Homo sapiens
cttctatttttatcatgaa

SEQ ID NO: 1636434 - DNA, 20 bp, Homo sapiens
cttctcaagactttagcttt

SEQ ID NO: 1636435 - DNA, 14 bp, Homo sapiens
cttctcaagttcta

SEQ ID NO: 1636436 - DNA, 15 bp, Homo sapiens
cttctcaagttctaa

SEQ ID NO: 1636437 - DNA, 16 bp, Homo sapiens
cttctcaagttctaag

SEQ ID NO: 1636438 - DNA, 18 bp, Homo sapiens
cttctcaagttctaagat

SEQ ID NO: 1636439 - DNA, 15 bp, Homo sapiens
cttctcaccccagga

SEQ ID NO: 1636440 - DNA, 13 bp, Homo sapiens
cttctcacggcga

SEQ ID NO: 1636441 - DNA, 15 bp, Homo sapiens
cttctcaggctctgc

SEQ ID NO: 1636442 - DNA, 19 bp, Homo sapiens
cttctcaggctctgccctg

SEQ ID NO: 1636443 - DNA, 21 bp, Homo sapiens
cttctcaggctctgccctgcc

SEQ ID NO: 1636444 - DNA, 22 bp, Homo sapiens
cttctcaggctctgccctgccc

SEQ ID NO: 1636445 - DNA, 12 bp, Homo sapiens
cttctcagtgtc

SEQ ID NO: 1636446 - DNA, 18 bp, Homo sapiens
cttctcatttcacccctc

SEQ ID NO: 1636447 - DNA, 21 bp, Homo sapiens
cttctcatttcacccctccct

SEQ ID NO: 1636448 - DNA, 22 bp, Homo sapiens
cttctcatttcacccctccctt

SEQ ID NO: 1636449 - DNA, 22 bp, Homo sapiens
cttctccacctcccccaaaccc

SEQ ID NO: 1636450 - DNA, 13 bp, Homo sapiens
cttctccagtggt

SEQ ID NO: 1636451 - DNA, 12 bp, Homo sapiens
cttctccatgct

SEQ ID NO: 1636452 - DNA, 14 bp, Homo sapiens
cttctccatgctgc

SEQ ID NO: 1636453 - DNA, 14 bp, Homo sapiens
cttctcccagtgtg

SEQ ID NO: 1636454 - DNA, 17 bp, Homo sapiens
cttctccccactcccat

SEQ ID NO: 1636455 - DNA, 19 bp, Homo sapiens
cttctccccagccagaggt

SEQ ID NO: 1636456 - DNA, 16 bp, Homo sapiens
cttctcccctgcactg

SEQ ID NO: 1636457 - DNA, 17 bp, Homo sapiens
cttctcccctgcactgt

SEQ ID NO: 1636458 - DNA, 23 bp, Homo sapiens
cttctcccctgcactgtaaaatg

SEQ ID NO: 1636459 - DNA, 16 bp, Homo sapiens
cttctccctagctcct

SEQ ID NO: 1636460 - DNA, 18 bp, Homo sapiens
cttctccctattccctct

SEQ ID NO: 1636461 - DNA, 12 bp, Homo sapiens
cttctccgccag

SEQ ID NO: 1636462 - DNA, 17 bp, Homo sapiens
cttctccgccagcctcc

SEQ ID NO: 1636463 - DNA, 19 bp, Homo sapiens
cttctccgccagcctcctc

SEQ ID NO: 1636464 - DNA, 21 bp, Homo sapiens
cttctccgccagcctcctctg

SEQ ID NO: 1636465 - DNA, 14 bp, Homo sapiens
cttctcctcccaag

SEQ ID NO: 1636466 - DNA, 14 bp, Homo sapiens
cttctcctttcctt

SEQ ID NO: 1636467 - DNA, 15 bp, Homo sapiens
cttctcctttccttc

SEQ ID NO: 1636468 - DNA, 21 bp, Homo sapiens
cttctcctttctaagccctgt

SEQ ID NO: 1636469 - DNA, 15 bp, Homo sapiens
aggaaggagggcaca

SEQ ID NO: 1636470 - DNA, 13 bp, Homo sapiens
aggaaggcagctg

SEQ ID NO: 1636471 - DNA, 14 bp, Homo sapiens
aggaaggccaaaat

SEQ ID NO: 1636472 - DNA, 12 bp, Homo sapiens
aggaaggccttt

SEQ ID NO: 1636473 - DNA, 17 bp, Homo sapiens
aggaaggcctttcttct

SEQ ID NO: 1636474 - DNA, 19 bp, Homo sapiens
aggaaggcctttcttctgt

SEQ ID NO: 1636475 - DNA, 21 bp, Homo sapiens
aggaaggcctttcttctgtgt

SEQ ID NO: 1636476 - DNA, 21 bp, Homo sapiens
aggaaggctgaactcttcaga

SEQ ID NO: 1636477 - DNA, 16 bp, Homo sapiens
aggaagggatctgaga

SEQ ID NO: 1636478 - DNA, 13 bp, Homo sapiens
aggaagggcagag

SEQ ID NO: 1636479 - DNA, 14 bp, Homo sapiens
aggaaggtaaaaag

SEQ ID NO: 1636480 - DNA, 14 bp, Homo sapiens
aggaaggtgctgag

SEQ ID NO: 1636481 - DNA, 17 bp, Homo sapiens
aggaaggtgctgagctt

SEQ ID NO: 1636482 - DNA, 15 bp, Homo sapiens
aggaaggtttttaag

SEQ ID NO: 1636483 - DNA, 15 bp, Homo sapiens
aggaagtagtccagc

SEQ ID NO: 1636484 - DNA, 17 bp, Homo sapiens
aggaagtatcagcacta

SEQ ID NO: 1636485 - DNA, 12 bp, Homo sapiens
aggaagttctcc

SEQ ID NO: 1636486 - DNA, 19 bp, Homo sapiens
aggaagttctccagcttca

SEQ ID NO: 1636487 - DNA, 21 bp, Homo sapiens
aggaagttctccagcttcagc

SEQ ID NO: 1636488 - DNA, 20 bp, Homo sapiens
aggaagttttgagtttctct

SEQ ID NO: 1636489 - DNA, 21 bp, Homo sapiens
aggaataaatgagagggaatc

SEQ ID NO: 1636490 - DNA, 16 bp, Homo sapiens
aggaataacctttctg

SEQ ID NO: 1636491 - DNA, 13 bp, Homo sapiens
aggaataagcatt

SEQ ID NO: 1636492 - DNA, 19 bp, Homo sapiens
aggaataaggcccagagcg

SEQ ID NO: 1636493 - DNA, 14 bp, Homo sapiens
aggaataaggcctt

SEQ ID NO: 1636494 - DNA, 14 bp, Homo sapiens
aggaatagccagag

SEQ ID NO: 1636495 - DNA, 17 bp, Homo sapiens
aggaatagccagagagg

SEQ ID NO: 1636496 - DNA, 22 bp, Homo sapiens
aggaatatgacggaagaacata

SEQ ID NO: 1636497 - DNA, 20 bp, Homo sapiens
aggaatattttccaaagagt

SEQ ID NO: 1636498 - DNA, 17 bp, Homo sapiens
aggaatcaacagggcag

SEQ ID NO: 1636499 - DNA, 17 bp, Homo sapiens
aggaatcattcagaaat

SEQ ID NO: 1636500 - DNA, 22 bp, Homo sapiens
aggaatcattcagaaatgttga

SEQ ID NO: 1636501 - DNA, 23 bp, Homo sapiens
aggaatcattcagaaatgttgag

SEQ ID NO: 1636502 - DNA, 21 bp, Homo sapiens
aggaatccaaaagacaaaaat

SEQ ID NO: 1636503 - DNA, 17 bp, Homo sapiens
aggaatcctggattttg

SEQ ID NO: 1636504 - DNA, 15 bp, Homo sapiens
aggaatccttactga

SEQ ID NO: 1636505 - DNA, 12 bp, Homo sapiens
aggaatcctttg

SEQ ID NO: 1636506 - DNA, 23 bp, Homo sapiens
aggaatcggctggggactgctac

SEQ ID NO: 1636507 - DNA, 17 bp, Homo sapiens
aggaatctgtttctctg

SEQ ID NO: 1636508 - DNA, 21 bp, Homo sapiens
aggaatctgtttctctgctgt

SEQ ID NO: 1636509 - DNA, 22 bp, Homo sapiens
aggaatctgtttctctgctgtc

SEQ ID NO: 1636510 - DNA, 13 bp, Homo sapiens
aggaatgcctgtg

SEQ ID NO: 1636511 - DNA, 14 bp, Homo sapiens
aggaatgcttccga

SEQ ID NO: 1636512 - DNA, 14 bp, Homo sapiens
aggaatggaagtcc

SEQ ID NO: 1636513 - DNA, 18 bp, Homo sapiens
aggaatgtagctggtttc

SEQ ID NO: 1636514 - DNA, 21 bp, Homo sapiens
aggaattaccaagaatatcct

SEQ ID NO: 1636515 - DNA, 19 bp, Homo sapiens
aggaattagagaagctgaa

SEQ ID NO: 1636516 - DNA, 13 bp, Homo sapiens
aggaattcctctt

SEQ ID NO: 1636517 - DNA, 13 bp, Homo sapiens
aggaattggaaat

SEQ ID NO: 1636518 - DNA, 13 bp, Homo sapiens
aggaatttaaaat

SEQ ID NO: 1636519 - DNA, 13 bp, Homo sapiens
aggaatttacttt

SEQ ID NO: 1636520 - DNA, 21 bp, Homo sapiens
aggaatttagaacctaacttt

SEQ ID NO: 1636521 - DNA, 18 bp, Homo sapiens
aggaatttagaccttttc

SEQ ID NO: 1636522 - DNA, 18 bp, Homo sapiens
aggaatttcacctgtaaa

SEQ ID NO: 1636523 - DNA, 15 bp, Homo sapiens
aggaatttcccagga

SEQ ID NO: 1636524 - DNA, 18 bp, Homo sapiens
aggaatttcccaggaccc

SEQ ID NO: 1636525 - DNA, 21 bp, Homo sapiens
aggaatttcccaggaccctga

SEQ ID NO: 1636526 - DNA, 19 bp, Homo sapiens
aggaatttcttaacttctt

SEQ ID NO: 1636527 - DNA, 23 bp, Homo sapiens
aggaatttcttaacttcttgctt

SEQ ID NO: 1636528 - DNA, 19 bp, Homo sapiens
aggaatttgaagctgcagt

SEQ ID NO: 1636529 - DNA, 19 bp, Homo sapiens
aggaatttgtacttcttat

SEQ ID NO: 1636530 - DNA, 23 bp, Homo sapiens
aggaatttgtacttcttattgca

SEQ ID NO: 1636531 - DNA, 18 bp, Homo sapiens
aggaattttattttgctg

SEQ ID NO: 1636532 - DNA, 20 bp, Homo sapiens
aggaattttgtaaagtttct

SEQ ID NO: 1636533 - DNA, 16 bp, Homo sapiens
aggacaaagtctccag

SEQ ID NO: 1636534 - DNA, 17 bp, Homo sapiens
aggacaatcagtcccct

SEQ ID NO: 1636535 - DNA, 20 bp, Homo sapiens
aggacaatcagtcccctccc

SEQ ID NO: 1636536 - DNA, 21 bp, Homo sapiens
aggacaatcagtcccctccca

SEQ ID NO: 1636537 - DNA, 14 bp, Homo sapiens
aggacaatttcaaa

SEQ ID NO: 1636538 - DNA, 23 bp, Homo sapiens
aggacacactaatcgaactatga

SEQ ID NO: 1636539 - DNA, 17 bp, Homo sapiens
aggacacagtgatgaat

SEQ ID NO: 1636540 - DNA, 13 bp, Homo sapiens
aggacacatcccg

SEQ ID NO: 1636541 - DNA, 20 bp, Homo sapiens
aggacacatcccggcctctt

SEQ ID NO: 1636542 - DNA, 16 bp, Homo sapiens
aggacaccagtgaaag

SEQ ID NO: 1636543 - DNA, 12 bp, Homo sapiens
aggacacccctc

SEQ ID NO: 1636544 - DNA, 23 bp, Homo sapiens
aggacacctggccgcctccagga

SEQ ID NO: 1636545 - DNA, 16 bp, Homo sapiens
aggacacgtggcctgc

SEQ ID NO: 1636546 - DNA, 16 bp, Homo sapiens
aggacactaccctgag

SEQ ID NO: 1636547 - DNA, 11 bp, Homo sapiens
aggacactggt

SEQ ID NO: 1636548 - DNA, 16 bp, Homo sapiens
aggacacttcctgcct

SEQ ID NO: 1636549 - DNA, 14 bp, Homo sapiens
aggacagaaggact

SEQ ID NO: 1636550 - DNA, 14 bp, Homo sapiens
aggacagagccagc

SEQ ID NO: 1636551 - DNA, 13 bp, Homo sapiens
aggacagcagctg

SEQ ID NO: 1636552 - DNA, 15 bp, Homo sapiens
aggacagcagctggt

SEQ ID NO: 1636553 - DNA, 18 bp, Homo sapiens
aggacagcccttttgtga

SEQ ID NO: 1636554 - DNA, 14 bp, Homo sapiens
aggacaggaagctg

SEQ ID NO: 1636555 - DNA, 18 bp, Homo sapiens
aggacaggaccagatttt

SEQ ID NO: 1636556 - DNA, 17 bp, Homo sapiens
aggacaggaccctcagg

SEQ ID NO: 1636557 - DNA, 20 bp, Homo sapiens
aggacaggaggcggcccggc

SEQ ID NO: 1636558 - DNA, 15 bp, Homo sapiens
aggacagggctggct

SEQ ID NO: 1636559 - DNA, 16 bp, Homo sapiens
aggacagggctggctc

SEQ ID NO: 1636560 - DNA, 20 bp, Homo sapiens
aggacagggctggctcctct

SEQ ID NO: 1636561 - DNA, 15 bp, Homo sapiens
aggacagtctggaga

SEQ ID NO: 1636562 - DNA, 17 bp, Homo sapiens
aggacagtctggagaag

SEQ ID NO: 1636563 - DNA, 16 bp, Homo sapiens
aggacagtgcttcagc

SEQ ID NO: 1636564 - DNA, 19 bp, Homo sapiens
aggacagtgcttcagcctg

SEQ ID NO: 1636565 - DNA, 22 bp, Homo sapiens
aggacagtgggcaggaggcccc

SEQ ID NO: 1636566 - DNA, 20 bp, Homo sapiens
aggacataaattagaggtct

SEQ ID NO: 1636567 - DNA, 16 bp, Homo sapiens
aggacatactgcatgt

SEQ ID NO: 1636568 - DNA, 13 bp, Homo sapiens
aggacatcaaagt

SEQ ID NO: 1636569 - DNA, 13 bp, Homo sapiens
aggacatgcaata

SEQ ID NO: 1636570 - DNA, 16 bp, Homo sapiens
aggacatgcaataaaa

SEQ ID NO: 1636571 - DNA, 21 bp, Homo sapiens
aggacatgcaataaaatttaa

SEQ ID NO: 1636572 - DNA, 20 bp, Homo sapiens
aggacattgtatgcagggag

SEQ ID NO: 1636573 - DNA, 15 bp, Homo sapiens
aggacatttcccagg

SEQ ID NO: 1636574 - DNA, 21 bp, Homo sapiens
aggaccaactggcttctgtgc

SEQ ID NO: 1636575 - DNA, 17 bp, Homo sapiens
aggaccaagcatcttgg

SEQ ID NO: 1636576 - DNA, 16 bp, Homo sapiens
aggaccacagtgggtg

SEQ ID NO: 1636577 - DNA, 13 bp, Homo sapiens
aggaccaccagca

SEQ ID NO: 1636578 - DNA, 13 bp, Homo sapiens
aggaccagctcag

SEQ ID NO: 1636579 - DNA, 14 bp, Homo sapiens
aggaccagctcagg

SEQ ID NO: 1636580 - DNA, 18 bp, Homo sapiens
aggaccagctcaggacag

SEQ ID NO: 1636581 - DNA, 13 bp, Homo sapiens
aggaccagctggg

SEQ ID NO: 1636582 - DNA, 19 bp, Homo sapiens
aggaccagctggggcgtgg

SEQ ID NO: 1636583 - DNA, 13 bp, Homo sapiens
aggaccaggactc

SEQ ID NO: 1636584 - DNA, 21 bp, Homo sapiens
aggaccaggactccctcctca

SEQ ID NO: 1636585 - DNA, 14 bp, Homo sapiens
aggacccgccagcc

SEQ ID NO: 1636586 - DNA, 15 bp, Homo sapiens
cttctcggagaccca

SEQ ID NO: 1636587 - DNA, 18 bp, Homo sapiens
cttctcggagctggccca

SEQ ID NO: 1636588 - DNA, 20 bp, Homo sapiens
cttctcggagctggcccagg

SEQ ID NO: 1636589 - DNA, 21 bp, Homo sapiens
cttctcggagctggcccaggg

SEQ ID NO: 1636590 - DNA, 21 bp, Homo sapiens
cttctcggcttggatcctggg

SEQ ID NO: 1636591 - DNA, 23 bp, Homo sapiens
cttctcggcttggatcctgggct

SEQ ID NO: 1636592 - DNA, 11 bp, Homo sapiens
cttctctacag

SEQ ID NO: 1636593 - DNA, 21 bp, Homo sapiens
cttctctacccatctccccca

SEQ ID NO: 1636594 - DNA, 23 bp, Homo sapiens
cttctctcactgtgttactgctt

SEQ ID NO: 1636595 - DNA, 19 bp, Homo sapiens
cttctctcagctcccaggc

SEQ ID NO: 1636596 - DNA, 14 bp, Homo sapiens
cttctctcatctct

SEQ ID NO: 1636597 - DNA, 16 bp, Homo sapiens
cttctctccagctgac

SEQ ID NO: 1636598 - DNA, 14 bp, Homo sapiens
cttctctctctctc

SEQ ID NO: 1636599 - DNA, 21 bp, Homo sapiens
cttctctctctctcacacaca

SEQ ID NO: 1636600 - DNA, 14 bp, Homo sapiens
cttctctctggctc

SEQ ID NO: 1636601 - DNA, 16 bp, Homo sapiens
cttctctctggctcag

SEQ ID NO: 1636602 - DNA, 20 bp, Homo sapiens
cttctctcttcaatctctgg

SEQ ID NO: 1636603 - DNA, 21 bp, Homo sapiens
cttctctcttcaatctctgga

SEQ ID NO: 1636604 - DNA, 14 bp, Homo sapiens
cttctctgacttct

SEQ ID NO: 1636605 - DNA, 16 bp, Homo sapiens
cttctctgacttctgc

SEQ ID NO: 1636606 - DNA, 14 bp, Homo sapiens
cttctctgctccac

SEQ ID NO: 1636607 - DNA, 21 bp, Homo sapiens
cttctctgctccaccacatcc

SEQ ID NO: 1636608 - DNA, 16 bp, Homo sapiens
cttctctggtctcctt

SEQ ID NO: 1636609 - DNA, 18 bp, Homo sapiens
cttctctgtgagaaggtt

SEQ ID NO: 1636610 - DNA, 21 bp, Homo sapiens
cttctctgttcccttgcaggg

SEQ ID NO: 1636611 - DNA, 18 bp, Homo sapiens
cttctcttcctagatctg

SEQ ID NO: 1636612 - DNA, 15 bp, Homo sapiens
cttctgaaatgaaac

SEQ ID NO: 1636613 - DNA, 17 bp, Homo sapiens
cttctgaactcaagctg

SEQ ID NO: 1636614 - DNA, 16 bp, Homo sapiens
cttctgaactccatac

SEQ ID NO: 1636615 - DNA, 19 bp, Homo sapiens
ctgtgtgccccactccagc

SEQ ID NO: 1636616 - DNA, 22 bp, Homo sapiens
ctgtgtgccccactccagcctg

SEQ ID NO: 1636617 - DNA, 23 bp, Homo sapiens
ctgtgtgccccactccagcctgg

SEQ ID NO: 1636618 - DNA, 15 bp, Homo sapiens
ctgtgtgcgctctgt

SEQ ID NO: 1636619 - DNA, 23 bp, Homo sapiens
ctgtgtgctcctccttggtgcct

SEQ ID NO: 1636620 - DNA, 15 bp, Homo sapiens
ctgtgtggagaggga

SEQ ID NO: 1636621 - DNA, 12 bp, Homo sapiens
ctgtgtggctcc

SEQ ID NO: 1636622 - DNA, 19 bp, Homo sapiens
ctgtgtggctcctgggccg

SEQ ID NO: 1636623 - DNA, 20 bp, Homo sapiens
ctgtgtgggatacttagtgg

SEQ ID NO: 1636624 - DNA, 20 bp, Homo sapiens
ctgtgtggtggagccagggc

SEQ ID NO: 1636625 - DNA, 16 bp, Homo sapiens
ctgtgtgtcccaggca

SEQ ID NO: 1636626 - DNA, 19 bp, Homo sapiens
ctgtgtgtcccaggcaggg

SEQ ID NO: 1636627 - DNA, 23 bp, Homo sapiens
ctgtgtgtcccaggcagggagac

SEQ ID NO: 1636628 - DNA, 12 bp, Homo sapiens
ctgtgtgtctgg

SEQ ID NO: 1636629 - DNA, 14 bp, Homo sapiens
ctgtgtgtgtgtat

SEQ ID NO: 1636630 - DNA, 15 bp, Homo sapiens
ctgtgtgtgtgtatg

SEQ ID NO: 1636631 - DNA, 21 bp, Homo sapiens
ctgtgtgtgtgtatgtggggg

SEQ ID NO: 1636632 - DNA, 21 bp, Homo sapiens
ctgtgtgtgtgtgtgtgcgtg

SEQ ID NO: 1636633 - DNA, 19 bp, Homo sapiens
ctgtgtgttagttcccaac

SEQ ID NO: 1636634 - DNA, 15 bp, Homo sapiens
ctgtgttaagaggac

SEQ ID NO: 1636635 - DNA, 15 bp, Homo sapiens
ctgtgttaatggcta

SEQ ID NO: 1636636 - DNA, 15 bp, Homo sapiens
ctgtgttaattgcgt

SEQ ID NO: 1636637 - DNA, 15 bp, Homo sapiens
ctgtgttatgaaaat

SEQ ID NO: 1636638 - DNA, 21 bp, Homo sapiens
ctgtgttattatagagcagaa

SEQ ID NO: 1636639 - DNA, 22 bp, Homo sapiens
ctgtgttattatagagcagaaa

SEQ ID NO: 1636640 - DNA, 23 bp, Homo sapiens
ctgtgttattatagagcagaaat

SEQ ID NO: 1636641 - DNA, 16 bp, Homo sapiens
ctgtgttcaatattta

SEQ ID NO: 1636642 - DNA, 21 bp, Homo sapiens
ctgtgttcaatatttagaaaa

SEQ ID NO: 1636643 - DNA, 22 bp, Homo sapiens
ctgtgttcttgccactgcactc

SEQ ID NO: 1636644 - DNA, 14 bp, Homo sapiens
ctgtgttgggcaag

SEQ ID NO: 1636645 - DNA, 19 bp, Homo sapiens
ctgtgttgggcaagacctc

SEQ ID NO: 1636646 - DNA, 19 bp, Homo sapiens
ctgtgttgtctctagagca

SEQ ID NO: 1636647 - DNA, 22 bp, Homo sapiens
ctgtgtttatatggaagaaagt

SEQ ID NO: 1636648 - DNA, 21 bp, Homo sapiens
ctgtgtttattcaaactgaaa

SEQ ID NO: 1636649 - DNA, 14 bp, Homo sapiens
ctgtgtttccaaag

SEQ ID NO: 1636650 - DNA, 23 bp, Homo sapiens
ctgtgtttcgcattaagcacaca

SEQ ID NO: 1636651 - DNA, 13 bp, Homo sapiens
ctgtgtttctgga

SEQ ID NO: 1636652 - DNA, 17 bp, Homo sapiens
ctgtgttttgaaagaat

SEQ ID NO: 1636653 - DNA, 20 bp, Homo sapiens
ctgtgttttgtctgagcctc

SEQ ID NO: 1636654 - DNA, 20 bp, Homo sapiens
ctgttaaaagatgaaaatat

SEQ ID NO: 1636655 - DNA, 12 bp, Homo sapiens
ctgttaaaatgc

SEQ ID NO: 1636656 - DNA, 14 bp, Homo sapiens
ctgttaaaatgcat

SEQ ID NO: 1636657 - DNA, 16 bp, Homo sapiens
ctgttaaaatgtacac

SEQ ID NO: 1636658 - DNA, 18 bp, Homo sapiens
ctgttaaaatgtacactg

SEQ ID NO: 1636659 - DNA, 22 bp, Homo sapiens
ctgttaacatctagcctaaagt

SEQ ID NO: 1636660 - DNA, 18 bp, Homo sapiens
ctgttaacgtcatctcag

SEQ ID NO: 1636661 - DNA, 22 bp, Homo sapiens
ctgttacaacttgtatttccaa

SEQ ID NO: 1636662 - DNA, 17 bp, Homo sapiens
ctgttacactgggctgg

SEQ ID NO: 1636663 - DNA, 15 bp, Homo sapiens
ctgttaccattcaca

SEQ ID NO: 1636664 - DNA, 14 bp, Homo sapiens
ctgttactccacag

SEQ ID NO: 1636665 - DNA, 20 bp, Homo sapiens
ctgttactccattactgtga

SEQ ID NO: 1636666 - DNA, 19 bp, Homo sapiens
ctgttacttacctaaacag

SEQ ID NO: 1636667 - DNA, 18 bp, Homo sapiens
ctgttacttgcttcagtg

SEQ ID NO: 1636668 - DNA, 17 bp, Homo sapiens
ctgttagaattctttta

SEQ ID NO: 1636669 - DNA, 18 bp, Homo sapiens
ctgttagaattcttttat

SEQ ID NO: 1636670 - DNA, 18 bp, Homo sapiens
ctgttaggagaagctgca

SEQ ID NO: 1636671 - DNA, 21 bp, Homo sapiens
ctgttagtgacagagcccagc

SEQ ID NO: 1636672 - DNA, 18 bp, Homo sapiens
ctgttataggtcctttag

SEQ ID NO: 1636673 - DNA, 21 bp, Homo sapiens
ctgttatcattttttcctgtt

SEQ ID NO: 1636674 - DNA, 14 bp, Homo sapiens
ctgttatgctgtga

SEQ ID NO: 1636675 - DNA, 16 bp, Homo sapiens
ctgttattatatttga

SEQ ID NO: 1636676 - DNA, 20 bp, Homo sapiens
ctgttattatatttgacatg

SEQ ID NO: 1636677 - DNA, 13 bp, Homo sapiens
ctgttatttcttc

SEQ ID NO: 1636678 - DNA, 18 bp, Homo sapiens
ctgttatttcttccctgc

SEQ ID NO: 1636679 - DNA, 12 bp, Homo sapiens
ctgttattttta

SEQ ID NO: 1636680 - DNA, 16 bp, Homo sapiens
agcggtggtttgtaat

SEQ ID NO: 1636681 - DNA, 19 bp, Homo sapiens
agcggtttggggagcagag

SEQ ID NO: 1636682 - DNA, 16 bp, Homo sapiens
agcgtcaagacatttg

SEQ ID NO: 1636683 - DNA, 15 bp, Homo sapiens
agcgtcagctgctcc

SEQ ID NO: 1636684 - DNA, 21 bp, Homo sapiens
agcgtcagctgctccctggca

SEQ ID NO: 1636685 - DNA, 13 bp, Homo sapiens
agcgtcccagtct

SEQ ID NO: 1636686 - DNA, 14 bp, Homo sapiens
agcgtcccccgccg

SEQ ID NO: 1636687 - DNA, 16 bp, Homo sapiens
agcgtccctagcagtg

SEQ ID NO: 1636688 - DNA, 17 bp, Homo sapiens
agcgtccctagcagtga

SEQ ID NO: 1636689 - DNA, 15 bp, Homo sapiens
agcgtccctggcgca

SEQ ID NO: 1636690 - DNA, 16 bp, Homo sapiens
agcgtcctctcagtaa

SEQ ID NO: 1636691 - DNA, 14 bp, Homo sapiens
agcgtcctgccctg

SEQ ID NO: 1636692 - DNA, 16 bp, Homo sapiens
agcgtcctgccctgcc

SEQ ID NO: 1636693 - DNA, 18 bp, Homo sapiens
agcgtggactctgctaga

SEQ ID NO: 1636694 - DNA, 22 bp, Homo sapiens
agcgtggcgcagtggccctgag

SEQ ID NO: 1636695 - DNA, 24 bp, Homo sapiens
agcgtggcgcagtggccctgagca

SEQ ID NO: 1636696 - DNA, 13 bp, Homo sapiens
agcgtgtggagca

SEQ ID NO: 1636697 - DNA, 14 bp, Homo sapiens
agcgtgtgggtccc

SEQ ID NO: 1636698 - DNA, 18 bp, Homo sapiens
agcgttcctggccttctg

SEQ ID NO: 1636699 - DNA, 13 bp, Homo sapiens
agcgttctggact

SEQ ID NO: 1636700 - DNA, 18 bp, Homo sapiens
agcgttctggactctgcc

SEQ ID NO: 1636701 - DNA, 23 bp, Homo sapiens
agcgtttagtttctagaggcctc

SEQ ID NO: 1636702 - DNA, 14 bp, Homo sapiens
agcgttttgcaagg

SEQ ID NO: 1636703 - DNA, 22 bp, Homo sapiens
agcgttttgcaaggtaaaattt

SEQ ID NO: 1636704 - DNA, 15 bp, Homo sapiens
agctaaaaggaaaag

SEQ ID NO: 1636705 - DNA, 23 bp, Homo sapiens
agctaaataaatgtaatagccaa

SEQ ID NO: 1636706 - DNA, 22 bp, Homo sapiens
agctaaatgtaacttattccaa

SEQ ID NO: 1636707 - DNA, 15 bp, Homo sapiens
agctaaattttgtta

SEQ ID NO: 1636708 - DNA, 12 bp, Homo sapiens
agctaagaacct

SEQ ID NO: 1636709 - DNA, 14 bp, Homo sapiens
agctaagaacctgg

SEQ ID NO: 1636710 - DNA, 16 bp, Homo sapiens
agctaagaacctggaa

SEQ ID NO: 1636711 - DNA, 17 bp, Homo sapiens
agctaagatagaaagct

SEQ ID NO: 1636712 - DNA, 22 bp, Homo sapiens
agctaagatagaaagctggact

SEQ ID NO: 1636713 - DNA, 17 bp, Homo sapiens
agctaagctaggaatga

SEQ ID NO: 1636714 - DNA, 18 bp, Homo sapiens
agctaagctaggaatgaa

SEQ ID NO: 1636715 - DNA, 19 bp, Homo sapiens
agctaagtgaaaaggtcat

SEQ ID NO: 1636716 - DNA, 20 bp, Homo sapiens
agctaataaatctcttcttt

SEQ ID NO: 1636717 - DNA, 16 bp, Homo sapiens
agctaataattcttca

SEQ ID NO: 1636718 - DNA, 22 bp, Homo sapiens
agctaataattcttcacctaag

SEQ ID NO: 1636719 - DNA, 13 bp, Homo sapiens
agctaatctgtag

SEQ ID NO: 1636720 - DNA, 19 bp, Homo sapiens
agctaatctgtagggctgg

SEQ ID NO: 1636721 - DNA, 13 bp, Homo sapiens
agctaatttttgt

SEQ ID NO: 1636722 - DNA, 14 bp, Homo sapiens
agctaatttttgta

SEQ ID NO: 1636723 - DNA, 20 bp, Homo sapiens
agctacaaccctaccctggc

SEQ ID NO: 1636724 - DNA, 23 bp, Homo sapiens
agctacaaccctaccctggcagg

SEQ ID NO: 1636725 - DNA, 16 bp, Homo sapiens
agctacagcttgttta

SEQ ID NO: 1636726 - DNA, 18 bp, Homo sapiens
agctacagcttgtttaac

SEQ ID NO: 1636727 - DNA, 14 bp, Homo sapiens
agctacatgttctt

SEQ ID NO: 1636728 - DNA, 17 bp, Homo sapiens
agctacatgttctttgt

SEQ ID NO: 1636729 - DNA, 13 bp, Homo sapiens
agctacattcctc

SEQ ID NO: 1636730 - DNA, 24 bp, Homo sapiens
agctacattcctcagctgccaagc

SEQ ID NO: 1636731 - DNA, 15 bp, Homo sapiens
agctaccctcagcct

SEQ ID NO: 1636732 - DNA, 16 bp, Homo sapiens
agctaccctcagcctc

SEQ ID NO: 1636733 - DNA, 18 bp, Homo sapiens
ctgttcttcaactcctgg

SEQ ID NO: 1636734 - DNA, 20 bp, Homo sapiens
ctgttcttcaactcctgggc

SEQ ID NO: 1636735 - DNA, 23 bp, Homo sapiens
ctgttgaaaagcacacacaataa

SEQ ID NO: 1636736 - DNA, 20 bp, Homo sapiens
ctgttgaaacacacgtgctg

SEQ ID NO: 1636737 - DNA, 18 bp, Homo sapiens
ctgttgacatcagcctgc

SEQ ID NO: 1636738 - DNA, 12 bp, Homo sapiens
ctgttgagagaa

SEQ ID NO: 1636739 - DNA, 15 bp, Homo sapiens
ctgttgagatgtgct

SEQ ID NO: 1636740 - DNA, 16 bp, Homo sapiens
ctgttgagatgtgctt

SEQ ID NO: 1636741 - DNA, 19 bp, Homo sapiens
ctgttgagccccagtgctg

SEQ ID NO: 1636742 - DNA, 20 bp, Homo sapiens
ctgttgagccccagtgctgg

SEQ ID NO: 1636743 - DNA, 22 bp, Homo sapiens
ctgttgagggccaagagatctg

SEQ ID NO: 1636744 - DNA, 15 bp, Homo sapiens
ctgttgataaatcca

SEQ ID NO: 1636745 - DNA, 19 bp, Homo sapiens
ctgttgatcccacttcact

SEQ ID NO: 1636746 - DNA, 15 bp, Homo sapiens
ctgttgcatttactt

SEQ ID NO: 1636747 - DNA, 19 bp, Homo sapiens
ctgttgcatttacttttaa

SEQ ID NO: 1636748 - DNA, 22 bp, Homo sapiens
ctgttgccatggattcaccccc

SEQ ID NO: 1636749 - DNA, 12 bp, Homo sapiens
ctgttgcctcat

SEQ ID NO: 1636750 - DNA, 14 bp, Homo sapiens
ctgttgcctcatct

SEQ ID NO: 1636751 - DNA, 23 bp, Homo sapiens
ctgttgctatagagcctacctgt

SEQ ID NO: 1636752 - DNA, 15 bp, Homo sapiens
ctgttgctatttgta

SEQ ID NO: 1636753 - DNA, 21 bp, Homo sapiens
ctgttgctcaaatctattcag

SEQ ID NO: 1636754 - DNA, 17 bp, Homo sapiens
ctgttgctgtcttcagt

SEQ ID NO: 1636755 - DNA, 22 bp, Homo sapiens
ctgttgctttaatatgagcttc

SEQ ID NO: 1636756 - DNA, 18 bp, Homo sapiens
ctgttggacagctgcttg

SEQ ID NO: 1636757 - DNA, 19 bp, Homo sapiens
ctgttggacagctgcttgt

SEQ ID NO: 1636758 - DNA, 16 bp, Homo sapiens
ctgttggagaaagaaa

SEQ ID NO: 1636759 - DNA, 22 bp, Homo sapiens
ctgttggatttgtttaaaagga

SEQ ID NO: 1636760 - DNA, 22 bp, Homo sapiens
ctgttggcactcacagacctgg

SEQ ID NO: 1636761 - DNA, 23 bp, Homo sapiens
ctgttggcactcacagacctgga

SEQ ID NO: 1636762 - DNA, 23 bp, Homo sapiens
ctgttggcaggcccactccccag

SEQ ID NO: 1636763 - DNA, 19 bp, Homo sapiens
ctgttggcaggctggccag

SEQ ID NO: 1636764 - DNA, 22 bp, Homo sapiens
ctgttggcccctctgctgtcct

SEQ ID NO: 1636765 - DNA, 23 bp, Homo sapiens
ctgttggcccctctgctgtcctg

SEQ ID NO: 1636766 - DNA, 19 bp, Homo sapiens
ctgttgggagaaagcaata

SEQ ID NO: 1636767 - DNA, 15 bp, Homo sapiens
ctgttgtagaagaca

SEQ ID NO: 1636768 - DNA, 18 bp, Homo sapiens
ctgttgtcaataaatttt

SEQ ID NO: 1636769 - DNA, 13 bp, Homo sapiens
ctgttgtctgcgc

SEQ ID NO: 1636770 - DNA, 15 bp, Homo sapiens
ctgttgtctgcgcct

SEQ ID NO: 1636771 - DNA, 20 bp, Homo sapiens
ctgttgttccattttatgca

SEQ ID NO: 1636772 - DNA, 15 bp, Homo sapiens
ctgttgttcccgtga

SEQ ID NO: 1636773 - DNA, 22 bp, Homo sapiens
ctgttgttgttaatgaaaatgt

SEQ ID NO: 1636774 - DNA, 23 bp, Homo sapiens
ctgttgttgttaatgaaaatgtc

SEQ ID NO: 1636775 - DNA, 11 bp, Homo sapiens
ctgtttaaatt

SEQ ID NO: 1636776 - DNA, 21 bp, Homo sapiens
ctgtttaaattgctcacagtt

SEQ ID NO: 1636777 - DNA, 17 bp, Homo sapiens
ctgtttataaaaacaaa

SEQ ID NO: 1636778 - DNA, 18 bp, Homo sapiens
ctgtttatcccttaagaa

SEQ ID NO: 1636779 - DNA, 21 bp, Homo sapiens
ctgtttatggccacatttaat

SEQ ID NO: 1636780 - DNA, 21 bp, Homo sapiens
ctgtttatggcctcagctgcc

SEQ ID NO: 1636781 - DNA, 16 bp, Homo sapiens
ctgtttattaatctta

SEQ ID NO: 1636782 - DNA, 18 bp, Homo sapiens
ctgtttattaatcttagt

SEQ ID NO: 1636783 - DNA, 22 bp, Homo sapiens
ctgtttattcttccagaatgct

SEQ ID NO: 1636784 - DNA, 16 bp, Homo sapiens
ctgtttatttaaggat

SEQ ID NO: 1636785 - DNA, 19 bp, Homo sapiens
ctgtttatttaaggatgga

SEQ ID NO: 1636786 - DNA, 15 bp, Homo sapiens
ctgtttatttattca

SEQ ID NO: 1636787 - DNA, 11 bp, Homo sapiens
ctgtttcaagg

SEQ ID NO: 1636788 - DNA, 19 bp, Homo sapiens
ctgtttcaatgacctgtat

SEQ ID NO: 1636789 - DNA, 18 bp, Homo sapiens
ctgtttcataatgcagaa

SEQ ID NO: 1636790 - DNA, 15 bp, Homo sapiens
ctgtttccctgctga

SEQ ID NO: 1636791 - DNA, 17 bp, Homo sapiens
ctgtttccctgctgaat

SEQ ID NO: 1636792 - DNA, 20 bp, Homo sapiens
ctgtttccctgctgaatgcc

SEQ ID NO: 1636793 - DNA, 19 bp, Homo sapiens
ctgtttcctatttaataca

SEQ ID NO: 1636794 - DNA, 13 bp, Homo sapiens
agctcaccaggcc

SEQ ID NO: 1636795 - DNA, 16 bp, Homo sapiens
agctcaccaggcctgg

SEQ ID NO: 1636796 - DNA, 18 bp, Homo sapiens
agctcaccaggcctggcc

SEQ ID NO: 1636797 - DNA, 13 bp, Homo sapiens
agctcacgtcaca

SEQ ID NO: 1636798 - DNA, 21 bp, Homo sapiens
agctcacgtcctgagaaagct

SEQ ID NO: 1636799 - DNA, 13 bp, Homo sapiens
agctcactgctgc

SEQ ID NO: 1636800 - DNA, 22 bp, Homo sapiens
agctcagaatccaagtgaacac

SEQ ID NO: 1636801 - DNA, 15 bp, Homo sapiens
agctcagacattttc

SEQ ID NO: 1636802 - DNA, 18 bp, Homo sapiens
agctcagacccccactct

SEQ ID NO: 1636803 - DNA, 23 bp, Homo sapiens
agctcagacttgccaggctccct

SEQ ID NO: 1636804 - DNA, 17 bp, Homo sapiens
agctcagaggcccagga

SEQ ID NO: 1636805 - DNA, 18 bp, Homo sapiens
agctcagccttctcctcc

SEQ ID NO: 1636806 - DNA, 23 bp, Homo sapiens
agctcagccttctcctcccaagg

SEQ ID NO: 1636807 - DNA, 13 bp, Homo sapiens
agctcagctgcat

SEQ ID NO: 1636808 - DNA, 17 bp, Homo sapiens
agctcaggacagatgcc

SEQ ID NO: 1636809 - DNA, 17 bp, Homo sapiens
agctcaggaggcgccct

SEQ ID NO: 1636810 - DNA, 17 bp, Homo sapiens
agctcaggaggcttgga

SEQ ID NO: 1636811 - DNA, 23 bp, Homo sapiens
agctcaggagtttgagaccaggc

SEQ ID NO: 1636812 - DNA, 13 bp, Homo sapiens
agctcaggatggc

SEQ ID NO: 1636813 - DNA, 13 bp, Homo sapiens
agctcaggtgcct

SEQ ID NO: 1636814 - DNA, 22 bp, Homo sapiens
agctcaggtttgtcctggtcat

SEQ ID NO: 1636815 - DNA, 21 bp, Homo sapiens
agctcagtcccatcagagagc

SEQ ID NO: 1636816 - DNA, 16 bp, Homo sapiens
agctcatcccccctgc

SEQ ID NO: 1636817 - DNA, 17 bp, Homo sapiens
agctcatcccccctgct

SEQ ID NO: 1636818 - DNA, 21 bp, Homo sapiens
agctcatcccccctgctgccc

SEQ ID NO: 1636819 - DNA, 23 bp, Homo sapiens
agctcatcccccctgctgcccag

SEQ ID NO: 1636820 - DNA, 22 bp, Homo sapiens
agctcatgacactgtttggcct

SEQ ID NO: 1636821 - DNA, 19 bp, Homo sapiens
agctcattaaactttttta

SEQ ID NO: 1636822 - DNA, 23 bp, Homo sapiens
agctcattcccaacgtgcaaagc

SEQ ID NO: 1636823 - DNA, 16 bp, Homo sapiens
agctccaacctgcaaa

SEQ ID NO: 1636824 - DNA, 18 bp, Homo sapiens
agctccaacctgcaaaga

SEQ ID NO: 1636825 - DNA, 15 bp, Homo sapiens
agctccaagccccat

SEQ ID NO: 1636826 - DNA, 16 bp, Homo sapiens
agctccacctctggtg

SEQ ID NO: 1636827 - DNA, 19 bp, Homo sapiens
agctccacctctggtggct

SEQ ID NO: 1636828 - DNA, 19 bp, Homo sapiens
agctccacggtgcgtggct

SEQ ID NO: 1636829 - DNA, 22 bp, Homo sapiens
agctccacggtgcgtggctgtg

SEQ ID NO: 1636830 - DNA, 12 bp, Homo sapiens
agctccactctg

SEQ ID NO: 1636831 - DNA, 14 bp, Homo sapiens
agctccactctgct

SEQ ID NO: 1636832 - DNA, 16 bp, Homo sapiens
agctccactctgcttc

SEQ ID NO: 1636833 - DNA, 22 bp, Homo sapiens
agctccactctgcttctctgac

SEQ ID NO: 1636834 - DNA, 14 bp, Homo sapiens
agctccagctttct

SEQ ID NO: 1636835 - DNA, 13 bp, Homo sapiens
agctccagggcca

SEQ ID NO: 1636836 - DNA, 15 bp, Homo sapiens
agctccagggccaga

SEQ ID NO: 1636837 - DNA, 16 bp, Homo sapiens
agctcccacctccctt

SEQ ID NO: 1636838 - DNA, 13 bp, Homo sapiens
agctcccaggcca

SEQ ID NO: 1636839 - DNA, 10 bp, Homo sapiens
agctccccag

SEQ ID NO: 1636840 - DNA, 20 bp, Homo sapiens
agctccccaggactcaccct

SEQ ID NO: 1636841 - DNA, 16 bp, Homo sapiens
agctcccctccacagc

SEQ ID NO: 1636842 - DNA, 20 bp, Homo sapiens
agctcccctccacagctgca

SEQ ID NO: 1636843 - DNA, 17 bp, Homo sapiens
agctcccctcggagaag

SEQ ID NO: 1636844 - DNA, 20 bp, Homo sapiens
agctcccctcggagaagagc

SEQ ID NO: 1636845 - DNA, 22 bp, Homo sapiens
agctcccctcggagaagagctg

SEQ ID NO: 1636846 - DNA, 12 bp, Homo sapiens
agctcccctgga

SEQ ID NO: 1636847 - DNA, 14 bp, Homo sapiens
agctccctcctccc

SEQ ID NO: 1636848 - DNA, 18 bp, Homo sapiens
agctccctcctcccatct

SEQ ID NO: 1636849 - DNA, 13 bp, Homo sapiens
agctccctcgctg

SEQ ID NO: 1636850 - DNA, 17 bp, Homo sapiens
agctccgagctgtagga

SEQ ID NO: 1636851 - DNA, 21 bp, Homo sapiens
ctgtttttcagggaggtggct

SEQ ID NO: 1636852 - DNA, 12 bp, Homo sapiens
ctgtttttgtat

SEQ ID NO: 1636853 - DNA, 14 bp, Homo sapiens
ctgtttttttccca

SEQ ID NO: 1636854 - DNA, 15 bp, Homo sapiens
ctgtttttttttcat

SEQ ID NO: 1636855 - DNA, 22 bp, Homo sapiens
ctgtttttttttttttaaataa

SEQ ID NO: 1636856 - DNA, 15 bp, Homo sapiens
cttaaaaaaatgaca

SEQ ID NO: 1636857 - DNA, 12 bp, Homo sapiens
cttaaaaaactt

SEQ ID NO: 1636858 - DNA, 14 bp, Homo sapiens
cttaaaaaatgtcc

SEQ ID NO: 1636859 - DNA, 15 bp, Homo sapiens
cttaaaaatgtaaat

SEQ ID NO: 1636860 - DNA, 18 bp, Homo sapiens
cttaaaaatgtaaatatt

SEQ ID NO: 1636861 - DNA, 21 bp, Homo sapiens
cttaaaaggagagaagaaagt

SEQ ID NO: 1636862 - DNA, 18 bp, Homo sapiens
cttaaaaggggcccaagc

SEQ ID NO: 1636863 - DNA, 14 bp, Homo sapiens
cttaaaataagcag

SEQ ID NO: 1636864 - DNA, 17 bp, Homo sapiens
cttaaaattaagatttc

SEQ ID NO: 1636865 - DNA, 19 bp, Homo sapiens
cttaaaattaagttgaaaa

SEQ ID NO: 1636866 - DNA, 19 bp, Homo sapiens
cttaaaattgatattatat

SEQ ID NO: 1636867 - DNA, 12 bp, Homo sapiens
cttaaacaaaaa

SEQ ID NO: 1636868 - DNA, 13 bp, Homo sapiens
cttaaacaaaaaa

SEQ ID NO: 1636869 - DNA, 14 bp, Homo sapiens
cttaaacaatgtat

SEQ ID NO: 1636870 - DNA, 18 bp, Homo sapiens
cttaaacacaggctgtcc

SEQ ID NO: 1636871 - DNA, 16 bp, Homo sapiens
cttaaaccatttttgc

SEQ ID NO: 1636872 - DNA, 22 bp, Homo sapiens
cttaaaccatttttgctgaatt

SEQ ID NO: 1636873 - DNA, 16 bp, Homo sapiens
cttaaactctggacac

SEQ ID NO: 1636874 - DNA, 20 bp, Homo sapiens
cttaaactctggacactcta

SEQ ID NO: 1636875 - DNA, 23 bp, Homo sapiens
cttaaactgtgtggactgtgatg

SEQ ID NO: 1636876 - DNA, 13 bp, Homo sapiens
cttaaagaaacag

SEQ ID NO: 1636877 - DNA, 16 bp, Homo sapiens
cttaaagaaacagctt

SEQ ID NO: 1636878 - DNA, 20 bp, Homo sapiens
cttaaagatttatcaaatca

SEQ ID NO: 1636879 - DNA, 18 bp, Homo sapiens
cttaaagcatcctcctcc

SEQ ID NO: 1636880 - DNA, 14 bp, Homo sapiens
cttaaagctgaatt

SEQ ID NO: 1636881 - DNA, 13 bp, Homo sapiens
cttaaaggcctgg

SEQ ID NO: 1636882 - DNA, 14 bp, Homo sapiens
cttaaaggcctgga

SEQ ID NO: 1636883 - DNA, 23 bp, Homo sapiens
cttaaaggctgtggtagtactcc

SEQ ID NO: 1636884 - DNA, 15 bp, Homo sapiens
cttaaagttgtcact

SEQ ID NO: 1636885 - DNA, 17 bp, Homo sapiens
cttaaagtttcatgtga

SEQ ID NO: 1636886 - DNA, 21 bp, Homo sapiens
cttaaataataaacagtggaa

SEQ ID NO: 1636887 - DNA, 16 bp, Homo sapiens
cttaaatacagataat

SEQ ID NO: 1636888 - DNA, 19 bp, Homo sapiens
cttaaatacagataattca

SEQ ID NO: 1636889 - DNA, 23 bp, Homo sapiens
cttaaatcgaggcagaaagatac

SEQ ID NO: 1636890 - DNA, 18 bp, Homo sapiens
cttaaatgttatgtatat

SEQ ID NO: 1636891 - DNA, 18 bp, Homo sapiens
cttaaattatatatttat

SEQ ID NO: 1636892 - DNA, 12 bp, Homo sapiens
cttaaattcatt

SEQ ID NO: 1636893 - DNA, 23 bp, Homo sapiens
cttaaattcatttctagactcaa

SEQ ID NO: 1636894 - DNA, 19 bp, Homo sapiens
cttaaatttcttatgtgac

SEQ ID NO: 1636895 - DNA, 16 bp, Homo sapiens
cttaaatttgttcttt

SEQ ID NO: 1636896 - DNA, 16 bp, Homo sapiens
cttaaattttaactaa

SEQ ID NO: 1636897 - DNA, 15 bp, Homo sapiens
cttaacaaaccaaca

SEQ ID NO: 1636898 - DNA, 18 bp, Homo sapiens
cttaacaaactcttcagt

SEQ ID NO: 1636899 - DNA, 15 bp, Homo sapiens
cttaacacactggcc

SEQ ID NO: 1636900 - DNA, 17 bp, Homo sapiens
cttaacagttgtattta

SEQ ID NO: 1636901 - DNA, 16 bp, Homo sapiens
cttaacccacctctcc

SEQ ID NO: 1636902 - DNA, 13 bp, Homo sapiens
cttaaccctgtgc

SEQ ID NO: 1636903 - DNA, 13 bp, Homo sapiens
cttaacctttgct

SEQ ID NO: 1636904 - DNA, 15 bp, Homo sapiens
cttaacctttgctat

SEQ ID NO: 1636905 - DNA, 18 bp, Homo sapiens
cttaacctttgctatgta

SEQ ID NO: 1636906 - DNA, 21 bp, Homo sapiens
cttaactataaggtgcctcag

SEQ ID NO: 1636907 - DNA, 11 bp, Homo sapiens
cttaactattc

SEQ ID NO: 1636908 - DNA, 12 bp, Homo sapiens
cttaactatttc

SEQ ID NO: 1636909 - DNA, 17 bp, Homo sapiens
agctctgaggggaggca

SEQ ID NO: 1636910 - DNA, 13 bp, Homo sapiens
agctctgcattat

SEQ ID NO: 1636911 - DNA, 12 bp, Homo sapiens
agctctgccccc

SEQ ID NO: 1636912 - DNA, 14 bp, Homo sapiens
agctctgcccccgc

SEQ ID NO: 1636913 - DNA, 15 bp, Homo sapiens
agctctgcccccgcg

SEQ ID NO: 1636914 - DNA, 19 bp, Homo sapiens
agctctgcccccgcgggtt

SEQ ID NO: 1636915 - DNA, 11 bp, Homo sapiens
agctctgcctt

SEQ ID NO: 1636916 - DNA, 14 bp, Homo sapiens
agctctgcgccagg

SEQ ID NO: 1636917 - DNA, 19 bp, Homo sapiens
agctctgcgccaggcagag

SEQ ID NO: 1636918 - DNA, 13 bp, Homo sapiens
agctctggagaac

SEQ ID NO: 1636919 - DNA, 16 bp, Homo sapiens
agctctggaggggagg

SEQ ID NO: 1636920 - DNA, 18 bp, Homo sapiens
agctctggaggggagggg

SEQ ID NO: 1636921 - DNA, 19 bp, Homo sapiens
agctctggaggggaggggg

SEQ ID NO: 1636922 - DNA, 22 bp, Homo sapiens
agctctggccacaacagggcat

SEQ ID NO: 1636923 - DNA, 15 bp, Homo sapiens
agctctggccccagg

SEQ ID NO: 1636924 - DNA, 20 bp, Homo sapiens
agctctggggacagcttcct

SEQ ID NO: 1636925 - DNA, 19 bp, Homo sapiens
agctctggtgacaccagcc

SEQ ID NO: 1636926 - DNA, 21 bp, Homo sapiens
agctctggtgacaccagcctt

SEQ ID NO: 1636927 - DNA, 16 bp, Homo sapiens
agctctggtgctttag

SEQ ID NO: 1636928 - DNA, 14 bp, Homo sapiens
agctctggtggaga

SEQ ID NO: 1636929 - DNA, 21 bp, Homo sapiens
agctctggttatttttctctt

SEQ ID NO: 1636930 - DNA, 16 bp, Homo sapiens
agctctgtatggtcag

SEQ ID NO: 1636931 - DNA, 12 bp, Homo sapiens
agctctgtggcc

SEQ ID NO: 1636932 - DNA, 14 bp, Homo sapiens
agctctgtggcctg

SEQ ID NO: 1636933 - DNA, 15 bp, Homo sapiens
agctctgtggcctgt

SEQ ID NO: 1636934 - DNA, 18 bp, Homo sapiens
agctctgtggcctgtgtc

SEQ ID NO: 1636935 - DNA, 19 bp, Homo sapiens
agctctgtggcctgtgtcc

SEQ ID NO: 1636936 - DNA, 19 bp, Homo sapiens
agctctgtttataaaaaca

SEQ ID NO: 1636937 - DNA, 16 bp, Homo sapiens
agctcttagtctcttt

SEQ ID NO: 1636938 - DNA, 16 bp, Homo sapiens
agctcttcaggcctcc

SEQ ID NO: 1636939 - DNA, 18 bp, Homo sapiens
agctcttcaggcctccct

SEQ ID NO: 1636940 - DNA, 17 bp, Homo sapiens
agctcttcggtttctga

SEQ ID NO: 1636941 - DNA, 21 bp, Homo sapiens
agctcttgaaatatgtagtat

SEQ ID NO: 1636942 - DNA, 22 bp, Homo sapiens
agctcttgcccttccctgtccc

SEQ ID NO: 1636943 - DNA, 15 bp, Homo sapiens
agctcttgctctctt

SEQ ID NO: 1636944 - DNA, 20 bp, Homo sapiens
agctcttgggtcagagaaaa

SEQ ID NO: 1636945 - DNA, 14 bp, Homo sapiens
agctctttccaaat

SEQ ID NO: 1636946 - DNA, 11 bp, Homo sapiens
agctcttttaa

SEQ ID NO: 1636947 - DNA, 22 bp, Homo sapiens
agctgaaaaatcacatcctggc

SEQ ID NO: 1636948 - DNA, 23 bp, Homo sapiens
agctgaaaaatcacatcctggcc

SEQ ID NO: 1636949 - DNA, 22 bp, Homo sapiens
agctgaaaacctaagtccttta

SEQ ID NO: 1636950 - DNA, 22 bp, Homo sapiens
agctgaaaaggatcgaggcatg

SEQ ID NO: 1636951 - DNA, 16 bp, Homo sapiens
agctgaaaagggcact

SEQ ID NO: 1636952 - DNA, 19 bp, Homo sapiens
agctgaaaagggcactccc

SEQ ID NO: 1636953 - DNA, 21 bp, Homo sapiens
agctgaaacattccgaagagg

SEQ ID NO: 1636954 - DNA, 17 bp, Homo sapiens
agctgaaagttgggact

SEQ ID NO: 1636955 - DNA, 13 bp, Homo sapiens
agctgaaattgaa

SEQ ID NO: 1636956 - DNA, 13 bp, Homo sapiens
agctgaaatttta

SEQ ID NO: 1636957 - DNA, 17 bp, Homo sapiens
agctgaaattttagaaa

SEQ ID NO: 1636958 - DNA, 21 bp, Homo sapiens
agctgaacaataggctgttcc

SEQ ID NO: 1636959 - DNA, 23 bp, Homo sapiens
agctgaacaataggctgttccca

SEQ ID NO: 1636960 - DNA, 16 bp, Homo sapiens
agctgaacacatttct

SEQ ID NO: 1636961 - DNA, 17 bp, Homo sapiens
agctgaacacatttctt

SEQ ID NO: 1636962 - DNA, 14 bp, Homo sapiens
agctgaaccttgag

SEQ ID NO: 1636963 - DNA, 18 bp, Homo sapiens
agctgaagaattgaaaag

SEQ ID NO: 1636964 - DNA, 16 bp, Homo sapiens
agctgaagaccatgga

SEQ ID NO: 1636965 - DNA, 15 bp, Homo sapiens
agctgaaggctgagg

SEQ ID NO: 1636966 - DNA, 13 bp, Homo sapiens
agctgaagttact

SEQ ID NO: 1636967 - DNA, 18 bp, Homo sapiens
agctgaatacattctgct

SEQ ID NO: 1636968 - DNA, 19 bp, Homo sapiens
agctgaattcacttaagtt

SEQ ID NO: 1636969 - DNA, 15 bp, Homo sapiens
agctgacatcttgaa

SEQ ID NO: 1636970 - DNA, 16 bp, Homo sapiens
cttacaaaatgccaag

SEQ ID NO: 1636971 - DNA, 21 bp, Homo sapiens
cttacaacccagggtgtgaac

SEQ ID NO: 1636972 - DNA, 18 bp, Homo sapiens
cttacaaggccctttcct

SEQ ID NO: 1636973 - DNA, 20 bp, Homo sapiens
cttacaatattgattgggaa

SEQ ID NO: 1636974 - DNA, 21 bp, Homo sapiens
cttacaattgcactgctgttc

SEQ ID NO: 1636975 - DNA, 15 bp, Homo sapiens
cttacacttataaaa

SEQ ID NO: 1636976 - DNA, 18 bp, Homo sapiens
cttacacttggagcccgt

SEQ ID NO: 1636977 - DNA, 18 bp, Homo sapiens
cttacagccattttacat

SEQ ID NO: 1636978 - DNA, 23 bp, Homo sapiens
cttacagccctaagtggctgcct

SEQ ID NO: 1636979 - DNA, 15 bp, Homo sapiens
cttacagtaactaat

SEQ ID NO: 1636980 - DNA, 18 bp, Homo sapiens
cttacatactaggtgcct

SEQ ID NO: 1636981 - DNA, 20 bp, Homo sapiens
cttacatactaggtgccttt

SEQ ID NO: 1636982 - DNA, 17 bp, Homo sapiens
cttacatcttttctaat

SEQ ID NO: 1636983 - DNA, 21 bp, Homo sapiens
cttacatgttttctttgcttt

SEQ ID NO: 1636984 - DNA, 14 bp, Homo sapiens
cttacattgaaaac

SEQ ID NO: 1636985 - DNA, 20 bp, Homo sapiens
cttacattttactttttcct

SEQ ID NO: 1636986 - DNA, 15 bp, Homo sapiens
cttaccaaaggatag

SEQ ID NO: 1636987 - DNA, 16 bp, Homo sapiens
cttaccaatagcctga

SEQ ID NO: 1636988 - DNA, 11 bp, Homo sapiens
cttacccatct

SEQ ID NO: 1636989 - DNA, 16 bp, Homo sapiens
cttaccgtagcctccg

SEQ ID NO: 1636990 - DNA, 22 bp, Homo sapiens
cttacctaaacagatataaatg

SEQ ID NO: 1636991 - DNA, 17 bp, Homo sapiens
cttacctcctgcccagg

SEQ ID NO: 1636992 - DNA, 19 bp, Homo sapiens
cttacctcctgcccaggag

SEQ ID NO: 1636993 - DNA, 20 bp, Homo sapiens
cttacctcctgcccaggaga

SEQ ID NO: 1636994 - DNA, 15 bp, Homo sapiens
cttaccttcccgcct

SEQ ID NO: 1636995 - DNA, 17 bp, Homo sapiens
cttacctttcctgatgc

SEQ ID NO: 1636996 - DNA, 18 bp, Homo sapiens
cttacctttcctgatgcc

SEQ ID NO: 1636997 - DNA, 13 bp, Homo sapiens
cttacctttttat

SEQ ID NO: 1636998 - DNA, 20 bp, Homo sapiens
cttacctttttatttgcatg

SEQ ID NO: 1636999 - DNA, 21 bp, Homo sapiens
cttacgctatccagttgcagg

SEQ ID NO: 1637000 - DNA, 22 bp, Homo sapiens
cttactaaacattttgttattg

SEQ ID NO: 1637001 - DNA, 14 bp, Homo sapiens
cttactagccctgc

SEQ ID NO: 1637002 - DNA, 15 bp, Homo sapiens
cttactataatttga

SEQ ID NO: 1637003 - DNA, 18 bp, Homo sapiens
cttactatgatctcagga

SEQ ID NO: 1637004 - DNA, 12 bp, Homo sapiens
cttactattttg

SEQ ID NO: 1637005 - DNA, 12 bp, Homo sapiens
cttactctaaga

SEQ ID NO: 1637006 - DNA, 15 bp, Homo sapiens
cttactctgagccca

SEQ ID NO: 1637007 - DNA, 17 bp, Homo sapiens
cttactctgagcccagg

SEQ ID NO: 1637008 - DNA, 14 bp, Homo sapiens
cttactctgaggaa

SEQ ID NO: 1637009 - DNA, 15 bp, Homo sapiens
cttactcttcttgaa

SEQ ID NO: 1637010 - DNA, 16 bp, Homo sapiens
cttactctttcctatt

SEQ ID NO: 1637011 - DNA, 23 bp, Homo sapiens
cttactctttcctatttcagtgt

SEQ ID NO: 1637012 - DNA, 12 bp, Homo sapiens
cttactgaaggt

SEQ ID NO: 1637013 - DNA, 12 bp, Homo sapiens
cttactgatata

SEQ ID NO: 1637014 - DNA, 15 bp, Homo sapiens
cttactgatatattt

SEQ ID NO: 1637015 - DNA, 19 bp, Homo sapiens
cttactgatatattttaca

SEQ ID NO: 1637016 - DNA, 23 bp, Homo sapiens
cttactgtacctgttccttagac

SEQ ID NO: 1637017 - DNA, 15 bp, Homo sapiens
cttactgtctcactc

SEQ ID NO: 1637018 - DNA, 20 bp, Homo sapiens
cttacttggtgagggtgccc

SEQ ID NO: 1637019 - DNA, 14 bp, Homo sapiens
cttacttgtctgta

SEQ ID NO: 1637020 - DNA, 17 bp, Homo sapiens
cttactttgcttgagaa

SEQ ID NO: 1637021 - DNA, 19 bp, Homo sapiens
cttacttttccagtctgta

SEQ ID NO: 1637022 - DNA, 22 bp, Homo sapiens
cttagaaaaggtgataaaatca

SEQ ID NO: 1637023 - DNA, 23 bp, Homo sapiens
cttagaaaaggtgataaaatcat

SEQ ID NO: 1637024 - DNA, 14 bp, Homo sapiens
ctgggcagaaggcc

SEQ ID NO: 1637025 - DNA, 16 bp, Homo sapiens
ctgggcagaaggccaa

SEQ ID NO: 1637026 - DNA, 17 bp, Homo sapiens
ctgggcagaaggccaag

SEQ ID NO: 1637027 - DNA, 13 bp, Homo sapiens
ctgggcagacctt

SEQ ID NO: 1637028 - DNA, 13 bp, Homo sapiens
ctgggcagcaagg

SEQ ID NO: 1637029 - DNA, 22 bp, Homo sapiens
ctgggcagcaaggctgctgccg

SEQ ID NO: 1637030 - DNA, 21 bp, Homo sapiens
ctgggcagcacaaggccttgc

SEQ ID NO: 1637031 - DNA, 18 bp, Homo sapiens
ctgggcagcatagcaaga

SEQ ID NO: 1637032 - DNA, 15 bp, Homo sapiens
ctgggcagccaggct

SEQ ID NO: 1637033 - DNA, 19 bp, Homo sapiens
ctgggcagctgtcccttgc

SEQ ID NO: 1637034 - DNA, 22 bp, Homo sapiens
ctgggcagcttgagagggcaaa

SEQ ID NO: 1637035 - DNA, 13 bp, Homo sapiens
ctgggcaggtggg

SEQ ID NO: 1637036 - DNA, 13 bp, Homo sapiens
ctgggcagtgctc

SEQ ID NO: 1637037 - DNA, 12 bp, Homo sapiens
ctgggcagtgtg

SEQ ID NO: 1637038 - DNA, 13 bp, Homo sapiens
ctgggcagtgtgg

SEQ ID NO: 1637039 - DNA, 16 bp, Homo sapiens
ctgggcatgacatcct

SEQ ID NO: 1637040 - DNA, 18 bp, Homo sapiens
ctgggcatttggtgagag

SEQ ID NO: 1637041 - DNA, 12 bp, Homo sapiens
ctgggcattttc

SEQ ID NO: 1637042 - DNA, 19 bp, Homo sapiens
ctgggccaactcacctgag

SEQ ID NO: 1637043 - DNA, 18 bp, Homo sapiens
ctgggccagaagtcctcc

SEQ ID NO: 1637044 - DNA, 14 bp, Homo sapiens
ctgggccagccctg

SEQ ID NO: 1637045 - DNA, 22 bp, Homo sapiens
ctgggccagtgagccagaaatt

SEQ ID NO: 1637046 - DNA, 21 bp, Homo sapiens
ctgggccataatgttgcttct

SEQ ID NO: 1637047 - DNA, 17 bp, Homo sapiens
ctgggccatgtccaaag

SEQ ID NO: 1637048 - DNA, 18 bp, Homo sapiens
ctgggccatgtccaaaga

SEQ ID NO: 1637049 - DNA, 16 bp, Homo sapiens
ctgggcccagcagggg

SEQ ID NO: 1637050 - DNA, 18 bp, Homo sapiens
ctgggcccagcaggggcc

SEQ ID NO: 1637051 - DNA, 21 bp, Homo sapiens
ctgggcccagcaggggccctc

SEQ ID NO: 1637052 - DNA, 14 bp, Homo sapiens
ctgggcccaggcag

SEQ ID NO: 1637053 - DNA, 17 bp, Homo sapiens
ctgggcccaggcaggtc

SEQ ID NO: 1637054 - DNA, 13 bp, Homo sapiens
ctgggcccagggg

SEQ ID NO: 1637055 - DNA, 13 bp, Homo sapiens
ctgggccccacca

SEQ ID NO: 1637056 - DNA, 14 bp, Homo sapiens
ctgggccccaccta

SEQ ID NO: 1637057 - DNA, 16 bp, Homo sapiens
ctgggccccacctact

SEQ ID NO: 1637058 - DNA, 18 bp, Homo sapiens
ctgggccccatgctctgc

SEQ ID NO: 1637059 - DNA, 22 bp, Homo sapiens
ctgggccccatgctctgcccca

SEQ ID NO: 1637060 - DNA, 20 bp, Homo sapiens
ctgggcccgacatggctccg

SEQ ID NO: 1637061 - DNA, 11 bp, Homo sapiens
ctgggccctct

SEQ ID NO: 1637062 - DNA, 18 bp, Homo sapiens
ctgggccctctgtccaca

SEQ ID NO: 1637063 - DNA, 16 bp, Homo sapiens
ctgggccctctttccc

SEQ ID NO: 1637064 - DNA, 22 bp, Homo sapiens
ctgggccctctttccctgcgag

SEQ ID NO: 1637065 - DNA, 11 bp, Homo sapiens
ctgggccctga

SEQ ID NO: 1637066 - DNA, 13 bp, Homo sapiens
ctgggccctgggc

SEQ ID NO: 1637067 - DNA, 16 bp, Homo sapiens
ctgggccctgggctgg

SEQ ID NO: 1637068 - DNA, 16 bp, Homo sapiens
ctgggccggctgagtg

SEQ ID NO: 1637069 - DNA, 22 bp, Homo sapiens
ctgggccgggctgtagatcagg

SEQ ID NO: 1637070 - DNA, 20 bp, Homo sapiens
ctgggcctcagtgtgcccat

SEQ ID NO: 1637071 - DNA, 12 bp, Homo sapiens
ctgggcctcatg

SEQ ID NO: 1637072 - DNA, 15 bp, Homo sapiens
ctgggcctcccctgg

SEQ ID NO: 1637073 - DNA, 15 bp, Homo sapiens
ctgggcctcctgcct

SEQ ID NO: 1637074 - DNA, 16 bp, Homo sapiens
ctgggcctcctgcctc

SEQ ID NO: 1637075 - DNA, 19 bp, Homo sapiens
ctgggcctcctgcctccgg

SEQ ID NO: 1637076 - DNA, 12 bp, Homo sapiens
ctgggcctcctt

SEQ ID NO: 1637077 - DNA, 23 bp, Homo sapiens
ctgggcctccttcttccacttct

SEQ ID NO: 1637078 - DNA, 20 bp, Homo sapiens
ctgggcctgaccaaacagcc

SEQ ID NO: 1637079 - DNA, 21 bp, Homo sapiens
ctgggcctgagggtccacctg

SEQ ID NO: 1637080 - DNA, 13 bp, Homo sapiens
ctgggcctgcaga

SEQ ID NO: 1637081 - DNA, 20 bp, Homo sapiens
ctgggcctgcttttccagga

SEQ ID NO: 1637082 - DNA, 23 bp, Homo sapiens
ctgggcctgcttttccaggatcc

SEQ ID NO: 1637083 - DNA, 16 bp, Homo sapiens
ctgggcctgggttcca

SEQ ID NO: 1637084 - DNA, 22 bp, Homo sapiens
ctgggcctgtgcagcagcccag

SEQ ID NO: 1637085 - DNA, 23 bp, Homo sapiens
ctgggcctgtgcagcagcccagc

SEQ ID NO: 1637086 - DNA, 15 bp, Homo sapiens
ctgggcctgttctct

SEQ ID NO: 1637087 - DNA, 19 bp, Homo sapiens
ctgggcctgttctcttggc

SEQ ID NO: 1637088 - DNA, 20 bp, Homo sapiens
ctgggcctgttctcttggct

SEQ ID NO: 1637089 - DNA, 15 bp, Homo sapiens
ctgggcgacaaaaac

SEQ ID NO: 1637090 - DNA, 18 bp, Homo sapiens
ctgggcgacaaaaacgaa

SEQ ID NO: 1637091 - DNA, 16 bp, Homo sapiens
ctgggcgccctggaag

SEQ ID NO: 1637092 - DNA, 20 bp, Homo sapiens
ctgggcgtctgagctggggt

SEQ ID NO: 1637093 - DNA, 16 bp, Homo sapiens
ctgggctaccatctgc

SEQ ID NO: 1637094 - DNA, 17 bp, Homo sapiens
ctgggctaccatctgca

SEQ ID NO: 1637095 - DNA, 18 bp, Homo sapiens
ctgggctaccatctgcat

SEQ ID NO: 1637096 - DNA, 23 bp, Homo sapiens
ctgggctcaaatgatcctcccac

SEQ ID NO: 1637097 - DNA, 18 bp, Homo sapiens
ctgggctcagggctggag

SEQ ID NO: 1637098 - DNA, 15 bp, Homo sapiens
ctgggctccacacag

SEQ ID NO: 1637099 - DNA, 17 bp, Homo sapiens
ctgggctccacacagca

SEQ ID NO: 1637100 - DNA, 18 bp, Homo sapiens
ctgggctccacacagcag

SEQ ID NO: 1637101 - DNA, 20 bp, Homo sapiens
ctgggctccacacagcagtg

SEQ ID NO: 1637102 - DNA, 23 bp, Homo sapiens
ctgggctccacacagcagtgtcc

SEQ ID NO: 1637103 - DNA, 22 bp, Homo sapiens
ctgggctccggaggactcacca

SEQ ID NO: 1637104 - DNA, 20 bp, Homo sapiens
ctgggctcctggaaccaatc

SEQ ID NO: 1637105 - DNA, 14 bp, Homo sapiens
ctgggctctcaccc

SEQ ID NO: 1637106 - DNA, 16 bp, Homo sapiens
ctgggctctcacccag

SEQ ID NO: 1637107 - DNA, 17 bp, Homo sapiens
ctgggctctcacccagt

SEQ ID NO: 1637108 - DNA, 22 bp, Homo sapiens
ctgggctctcacccagtcccca

SEQ ID NO: 1637109 - DNA, 12 bp, Homo sapiens
ctgggctctcca

SEQ ID NO: 1637110 - DNA, 13 bp, Homo sapiens
ctgggctctccac

SEQ ID NO: 1637111 - DNA, 14 bp, Homo sapiens
ctgggctctccacc

SEQ ID NO: 1637112 - DNA, 17 bp, Homo sapiens
ctgggctctccacctca

SEQ ID NO: 1637113 - DNA, 15 bp, Homo sapiens
ctgggctctgccacc

SEQ ID NO: 1637114 - DNA, 13 bp, Homo sapiens
ctgggctctgccc

SEQ ID NO: 1637115 - DNA, 12 bp, Homo sapiens
ctgggctgagcc

SEQ ID NO: 1637116 - DNA, 19 bp, Homo sapiens
ctgggctgagcccctaccc

SEQ ID NO: 1637117 - DNA, 20 bp, Homo sapiens
ctgggctgccatgtgaagag

SEQ ID NO: 1637118 - DNA, 19 bp, Homo sapiens
ctgggctgctacccagaaa

SEQ ID NO: 1637119 - DNA, 18 bp, Homo sapiens
ctgggctggactggccat

SEQ ID NO: 1637120 - DNA, 17 bp, Homo sapiens
ctgggctgggccctctt

SEQ ID NO: 1637121 - DNA, 13 bp, Homo sapiens
ctgggctgtgcta

SEQ ID NO: 1637122 - DNA, 15 bp, Homo sapiens
ctgggctgtgggcaa

SEQ ID NO: 1637123 - DNA, 13 bp, Homo sapiens
ctgggctgttggc

SEQ ID NO: 1637124 - DNA, 15 bp, Homo sapiens
ctgggctgttggcac

SEQ ID NO: 1637125 - DNA, 15 bp, Homo sapiens
ctgggcttagggtcc

SEQ ID NO: 1637126 - DNA, 17 bp, Homo sapiens
ctgggcttagggtcctg

SEQ ID NO: 1637127 - DNA, 21 bp, Homo sapiens
ctgggcttcattccggactgg

SEQ ID NO: 1637128 - DNA, 15 bp, Homo sapiens
ctgggcttcattctg

SEQ ID NO: 1637129 - DNA, 19 bp, Homo sapiens
ctgggcttcattctggaaa

SEQ ID NO: 1637130 - DNA, 19 bp, Homo sapiens
ctgggcttggggcttccta

SEQ ID NO: 1637131 - DNA, 17 bp, Homo sapiens
ctgggcttggggtgtgg

SEQ ID NO: 1637132 - DNA, 23 bp, Homo sapiens
ctgggcttggggtgtggggtggg

SEQ ID NO: 1637133 - DNA, 20 bp, Homo sapiens
ctggggaaaactccaccttc

SEQ ID NO: 1637134 - DNA, 13 bp, Homo sapiens
ctggggaaagggg

SEQ ID NO: 1637135 - DNA, 22 bp, Homo sapiens
ctggggaaaggggacaaggaag

SEQ ID NO: 1637136 - DNA, 17 bp, Homo sapiens
ctggggaagacagtggc

SEQ ID NO: 1637137 - DNA, 21 bp, Homo sapiens
ctggggaagaggatgagcaga

SEQ ID NO: 1637138 - DNA, 22 bp, Homo sapiens
ctggggaagaggatgagcagag

SEQ ID NO: 1637139 - DNA, 14 bp, Homo sapiens
ctggggacagaggg

SEQ ID NO: 1637140 - DNA, 16 bp, Homo sapiens
ctggggacagcttcct

SEQ ID NO: 1637141 - DNA, 13 bp, Homo sapiens
agccaggagaagc

SEQ ID NO: 1637142 - DNA, 15 bp, Homo sapiens
agccaggagaagctc

SEQ ID NO: 1637143 - DNA, 20 bp, Homo sapiens
agccaggagaagctcagctg

SEQ ID NO: 1637144 - DNA, 12 bp, Homo sapiens
agccaggagcag

SEQ ID NO: 1637145 - DNA, 14 bp, Homo sapiens
agccaggaggcctg

SEQ ID NO: 1637146 - DNA, 16 bp, Homo sapiens
agccaggaggcctgct

SEQ ID NO: 1637147 - DNA, 19 bp, Homo sapiens
agccaggaggcctgctagg

SEQ ID NO: 1637148 - DNA, 23 bp, Homo sapiens
agccaggagtaagacaagtggga

SEQ ID NO: 1637149 - DNA, 14 bp, Homo sapiens
agccaggatgccca

SEQ ID NO: 1637150 - DNA, 13 bp, Homo sapiens
agccaggcagagg

SEQ ID NO: 1637151 - DNA, 13 bp, Homo sapiens
agccaggcgggct

SEQ ID NO: 1637152 - DNA, 14 bp, Homo sapiens
agccaggcgggctc

SEQ ID NO: 1637153 - DNA, 18 bp, Homo sapiens
agccaggcgggctcaagg

SEQ ID NO: 1637154 - DNA, 18 bp, Homo sapiens
agccaggctcactcacag

SEQ ID NO: 1637155 - DNA, 11 bp, Homo sapiens
agccaggctcc

SEQ ID NO: 1637156 - DNA, 17 bp, Homo sapiens
agccaggctgagtgagc

SEQ ID NO: 1637157 - DNA, 20 bp, Homo sapiens
agccaggctgccaaggccag

SEQ ID NO: 1637158 - DNA, 17 bp, Homo sapiens
agccagggaacagcccc

SEQ ID NO: 1637159 - DNA, 20 bp, Homo sapiens
agccagggacccccagaaca

SEQ ID NO: 1637160 - DNA, 15 bp, Homo sapiens
agccagggcagagga

SEQ ID NO: 1637161 - DNA, 22 bp, Homo sapiens
agccagggtgtggccctgccat

SEQ ID NO: 1637162 - DNA, 17 bp, Homo sapiens
agccagtctcagagacc

SEQ ID NO: 1637163 - DNA, 18 bp, Homo sapiens
agccagtctcagagacca

SEQ ID NO: 1637164 - DNA, 23 bp, Homo sapiens
agccagtctcagagaccagcact

SEQ ID NO: 1637165 - DNA, 12 bp, Homo sapiens
agccagtgactt

SEQ ID NO: 1637166 - DNA, 13 bp, Homo sapiens
agccagtgacttt

SEQ ID NO: 1637167 - DNA, 16 bp, Homo sapiens
agccagtgagggcagt

SEQ ID NO: 1637168 - DNA, 21 bp, Homo sapiens
agccagtgattattcttgttc

SEQ ID NO: 1637169 - DNA, 15 bp, Homo sapiens
agccagtggcacagg

SEQ ID NO: 1637170 - DNA, 22 bp, Homo sapiens
agccagtggggtcccccctgag

SEQ ID NO: 1637171 - DNA, 23 bp, Homo sapiens
agccagtggggtcccccctgagt

SEQ ID NO: 1637172 - DNA, 18 bp, Homo sapiens
agccagttcaaagtgtat

SEQ ID NO: 1637173 - DNA, 20 bp, Homo sapiens
agccagttcaaagtgtatat

SEQ ID NO: 1637174 - DNA, 14 bp, Homo sapiens
agccagttgtccta

SEQ ID NO: 1637175 - DNA, 17 bp, Homo sapiens
agccagttgtcctatgg

SEQ ID NO: 1637176 - DNA, 20 bp, Homo sapiens
agccagttgtcctatggaca

SEQ ID NO: 1637177 - DNA, 21 bp, Homo sapiens
agccagttgtcctatggacaa

SEQ ID NO: 1637178 - DNA, 13 bp, Homo sapiens
agccataaatgat

SEQ ID NO: 1637179 - DNA, 20 bp, Homo sapiens
agccatagacctacagacct

SEQ ID NO: 1637180 - DNA, 19 bp, Homo sapiens
agccatcactagaagaaaa

SEQ ID NO: 1637181 - DNA, 23 bp, Homo sapiens
agccatcactagaagaaaagccc

SEQ ID NO: 1637182 - DNA, 16 bp, Homo sapiens
agccatcacttctccc

SEQ ID NO: 1637183 - DNA, 13 bp, Homo sapiens
agccatcatggat

SEQ ID NO: 1637184 - DNA, 18 bp, Homo sapiens
agccatccccagggccca

SEQ ID NO: 1637185 - DNA, 22 bp, Homo sapiens
agccatcccttcggagccaaca

SEQ ID NO: 1637186 - DNA, 21 bp, Homo sapiens
agccatccctttttttacatt

SEQ ID NO: 1637187 - DNA, 15 bp, Homo sapiens
agccatcgactcctg

SEQ ID NO: 1637188 - DNA, 17 bp, Homo sapiens
agccatcttggcagggt

SEQ ID NO: 1637189 - DNA, 19 bp, Homo sapiens
agccatgaggagttgctgt

SEQ ID NO: 1637190 - DNA, 18 bp, Homo sapiens
agccatgataactgcaat

SEQ ID NO: 1637191 - DNA, 19 bp, Homo sapiens
agccatgatcgagccactg

SEQ ID NO: 1637192 - DNA, 21 bp, Homo sapiens
agccatgatcgagccactgca

SEQ ID NO: 1637193 - DNA, 15 bp, Homo sapiens
agccatgatttccca

SEQ ID NO: 1637194 - DNA, 23 bp, Homo sapiens
agccatgatttgtcccagcctgg

SEQ ID NO: 1637195 - DNA, 16 bp, Homo sapiens
agccatgcgccccctc

SEQ ID NO: 1637196 - DNA, 13 bp, Homo sapiens
agccatgcgtggc

SEQ ID NO: 1637197 - DNA, 14 bp, Homo sapiens
agccatggctcagg

SEQ ID NO: 1637198 - DNA, 19 bp, Homo sapiens
agccatggctcaggcaagc

SEQ ID NO: 1637199 - DNA, 21 bp, Homo sapiens
agccatggctcaggcaagccc

SEQ ID NO: 1637200 - DNA, 16 bp, Homo sapiens
agccatgggcctgggc

SEQ ID NO: 1637201 - DNA, 19 bp, Homo sapiens
agccatgggcctgggcctg

SEQ ID NO: 1637202 - DNA, 12 bp, Homo sapiens
agccattcctgg

SEQ ID NO: 1637203 - DNA, 13 bp, Homo sapiens
agccattctgtgt

SEQ ID NO: 1637204 - DNA, 22 bp, Homo sapiens
agccattctgtgtgtgactctg

SEQ ID NO: 1637205 - DNA, 22 bp, Homo sapiens
agccatttcactctcaaacttc

SEQ ID NO: 1637206 - DNA, 17 bp, Homo sapiens
agccatttccccctcct

SEQ ID NO: 1637207 - DNA, 19 bp, Homo sapiens
agccatttccccctcctca

SEQ ID NO: 1637208 - DNA, 12 bp, Homo sapiens
agccatttgaga

SEQ ID NO: 1637209 - DNA, 16 bp, Homo sapiens
agcccaaaacccaggg

SEQ ID NO: 1637210 - DNA, 14 bp, Homo sapiens
agcccaaaatttga

SEQ ID NO: 1637211 - DNA, 16 bp, Homo sapiens
agcccaaagctgttgg

SEQ ID NO: 1637212 - DNA, 19 bp, Homo sapiens
agcccaagaggtctgagcc

SEQ ID NO: 1637213 - DNA, 23 bp, Homo sapiens
agcccaagttcatgcagctgtgg

SEQ ID NO: 1637214 - DNA, 11 bp, Homo sapiens
agcccaataaa

SEQ ID NO: 1637215 - DNA, 16 bp, Homo sapiens
agcccaatattataat

SEQ ID NO: 1637216 - DNA, 16 bp, Homo sapiens
agcccaatgaaatgaa

SEQ ID NO: 1637217 - DNA, 15 bp, Homo sapiens
agcccacatattcta

SEQ ID NO: 1637218 - DNA, 21 bp, Homo sapiens
agcccacatggccgggccctc

SEQ ID NO: 1637219 - DNA, 19 bp, Homo sapiens
agcccaccagggacacctc

SEQ ID NO: 1637220 - DNA, 13 bp, Homo sapiens
agcccacccagca

SEQ ID NO: 1637221 - DNA, 19 bp, Homo sapiens
agcccaccctgctgctggt

SEQ ID NO: 1637222 - DNA, 18 bp, Homo sapiens
agcccagaaaacctccag

SEQ ID NO: 1637223 - DNA, 18 bp, Homo sapiens
agcccagaaagtgataag

SEQ ID NO: 1637224 - DNA, 12 bp, Homo sapiens
agcccagagact

SEQ ID NO: 1637225 - DNA, 14 bp, Homo sapiens
agcccagagccacc

SEQ ID NO: 1637226 - DNA, 21 bp, Homo sapiens
agcccagagcctggctgccca

SEQ ID NO: 1637227 - DNA, 16 bp, Homo sapiens
agcccagaggagggca

SEQ ID NO: 1637228 - DNA, 21 bp, Homo sapiens
agcccagatacgggggctgtg

SEQ ID NO: 1637229 - DNA, 17 bp, Homo sapiens
agcccagattcccctgt

SEQ ID NO: 1637230 - DNA, 12 bp, Homo sapiens
agcccagcacct

SEQ ID NO: 1637231 - DNA, 14 bp, Homo sapiens
agcccagcacctgc

SEQ ID NO: 1637232 - DNA, 14 bp, Homo sapiens
agcccagccccgcc

SEQ ID NO: 1637233 - DNA, 19 bp, Homo sapiens
agcccagcccctactgctg

SEQ ID NO: 1637234 - DNA, 17 bp, Homo sapiens
agcccagcctgggagcc

SEQ ID NO: 1637235 - DNA, 23 bp, Homo sapiens
agcccagctacattcctcagctg

SEQ ID NO: 1637236 - DNA, 14 bp, Homo sapiens
agcccagctccagg

SEQ ID NO: 1637237 - DNA, 11 bp, Homo sapiens
agcccagctct

SEQ ID NO: 1637238 - DNA, 15 bp, Homo sapiens
agcccagctggccac

SEQ ID NO: 1637239 - DNA, 17 bp, Homo sapiens
agcccagcttcctggtg

SEQ ID NO: 1637240 - DNA, 21 bp, Homo sapiens
agcccagcttggccctttcct

SEQ ID NO: 1637241 - DNA, 21 bp, Homo sapiens
agcccaggagctgagtcacct

SEQ ID NO: 1637242 - DNA, 11 bp, Homo sapiens
agcccaggccg

SEQ ID NO: 1637243 - DNA, 12 bp, Homo sapiens
agcccaggctcg

SEQ ID NO: 1637244 - DNA, 19 bp, Homo sapiens
agcccagggcatcttgctg

SEQ ID NO: 1637245 - DNA, 16 bp, Homo sapiens
agcccagggctcctgc

SEQ ID NO: 1637246 - DNA, 23 bp, Homo sapiens
agcccagggctcctgcacttact

SEQ ID NO: 1637247 - DNA, 14 bp, Homo sapiens
agcccagtgaagcc

SEQ ID NO: 1637248 - DNA, 16 bp, Homo sapiens
agcccagtgaagcctc

SEQ ID NO: 1637249 - DNA, 18 bp, Homo sapiens
agcccagtgcactgaaag

SEQ ID NO: 1637250 - DNA, 14 bp, Homo sapiens
agcccagtgttttc

SEQ ID NO: 1637251 - DNA, 21 bp, Homo sapiens
agcccataaggccagaaactc

SEQ ID NO: 1637252 - DNA, 24 bp, Homo sapiens
agcccataggccaccccctatcct

SEQ ID NO: 1637253 - DNA, 20 bp, Homo sapiens
agcccatccattaggccagc

SEQ ID NO: 1637254 - DNA, 23 bp, Homo sapiens
agcccatccattaggccagcaac

SEQ ID NO: 1637255 - DNA, 19 bp, Homo sapiens
agcccatgctcaaccactg

SEQ ID NO: 1637256 - DNA, 16 bp, Homo sapiens
agcccatggcccccaa

SEQ ID NO: 1637257 - DNA, 19 bp, Homo sapiens
agcccatggcccccaataa

SEQ ID NO: 1637258 - DNA, 18 bp, Homo sapiens
ctggggacagcttcctca

SEQ ID NO: 1637259 - DNA, 16 bp, Homo sapiens
ctggggaccaggagct

SEQ ID NO: 1637260 - DNA, 14 bp, Homo sapiens
ctggggaccccact

SEQ ID NO: 1637261 - DNA, 20 bp, Homo sapiens
ctggggacctggtaccctcc

SEQ ID NO: 1637262 - DNA, 14 bp, Homo sapiens
ctggggactcaggg

SEQ ID NO: 1637263 - DNA, 20 bp, Homo sapiens
ctggggactgctacctctga

SEQ ID NO: 1637264 - DNA, 17 bp, Homo sapiens
ctggggacttgtgtctg

SEQ ID NO: 1637265 - DNA, 21 bp, Homo sapiens
ctggggactttatttatttct

SEQ ID NO: 1637266 - DNA, 17 bp, Homo sapiens
ctggggagcagctgaga

SEQ ID NO: 1637267 - DNA, 16 bp, Homo sapiens
ctggggagccaaaggc

SEQ ID NO: 1637268 - DNA, 14 bp, Homo sapiens
ctggggaggaggag

SEQ ID NO: 1637269 - DNA, 16 bp, Homo sapiens
ctggggaggaggagag

SEQ ID NO: 1637270 - DNA, 12 bp, Homo sapiens
ctggggaggcag

SEQ ID NO: 1637271 - DNA, 20 bp, Homo sapiens
ctggggaggctgaggcagga

SEQ ID NO: 1637272 - DNA, 17 bp, Homo sapiens
ctggggagggctgcagt

SEQ ID NO: 1637273 - DNA, 20 bp, Homo sapiens
ctggggagggctgcagtcac

SEQ ID NO: 1637274 - DNA, 21 bp, Homo sapiens
ctggggagggctgcagtcaca

SEQ ID NO: 1637275 - DNA, 23 bp, Homo sapiens
ctggggagggctgcagtcacatt

SEQ ID NO: 1637276 - DNA, 19 bp, Homo sapiens
ctggggatcttcccacagg

SEQ ID NO: 1637277 - DNA, 20 bp, Homo sapiens
ctggggatcttcccacagga

SEQ ID NO: 1637278 - DNA, 20 bp, Homo sapiens
ctggggatgtaaccaagctg

SEQ ID NO: 1637279 - DNA, 15 bp, Homo sapiens
ctggggcagaggggc

SEQ ID NO: 1637280 - DNA, 20 bp, Homo sapiens
ctggggcagaggggcagccg

SEQ ID NO: 1637281 - DNA, 14 bp, Homo sapiens
ctggggcaggctgg

SEQ ID NO: 1637282 - DNA, 15 bp, Homo sapiens
ctggggcaggctggg

SEQ ID NO: 1637283 - DNA, 16 bp, Homo sapiens
ctggggcaggctgggc

SEQ ID NO: 1637284 - DNA, 18 bp, Homo sapiens
ctggggcaggctgggcca

SEQ ID NO: 1637285 - DNA, 19 bp, Homo sapiens
ctggggcaggctgggccat

SEQ ID NO: 1637286 - DNA, 14 bp, Homo sapiens
ctggggcatggcag

SEQ ID NO: 1637287 - DNA, 13 bp, Homo sapiens
ctggggccgccac

SEQ ID NO: 1637288 - DNA, 18 bp, Homo sapiens
ctggggccggagcctttg

SEQ ID NO: 1637289 - DNA, 17 bp, Homo sapiens
ctggggcctccagaact

SEQ ID NO: 1637290 - DNA, 23 bp, Homo sapiens
ctggggcctccagaagctgctcc

SEQ ID NO: 1637291 - DNA, 19 bp, Homo sapiens
ctggggcctcggagcctca

SEQ ID NO: 1637292 - DNA, 12 bp, Homo sapiens
ctggggcctgac

SEQ ID NO: 1637293 - DNA, 18 bp, Homo sapiens
ctggggcctgactgctca

SEQ ID NO: 1637294 - DNA, 19 bp, Homo sapiens
ctggggcctgactgctcag

SEQ ID NO: 1637295 - DNA, 14 bp, Homo sapiens
ctggggcctggacc

SEQ ID NO: 1637296 - DNA, 17 bp, Homo sapiens
ctggggcctggacctgc

SEQ ID NO: 1637297 - DNA, 14 bp, Homo sapiens
ctggggcgtgggga

SEQ ID NO: 1637298 - DNA, 13 bp, Homo sapiens
ctggggctccctc

SEQ ID NO: 1637299 - DNA, 14 bp, Homo sapiens
ctggggctccctct

SEQ ID NO: 1637300 - DNA, 19 bp, Homo sapiens
ctggggctccctctctggt

SEQ ID NO: 1637301 - DNA, 19 bp, Homo sapiens
ctggggctcctttctccag

SEQ ID NO: 1637302 - DNA, 15 bp, Homo sapiens
ctggggctctgggat

SEQ ID NO: 1637303 - DNA, 14 bp, Homo sapiens
ctggggctctgtgc

SEQ ID NO: 1637304 - DNA, 16 bp, Homo sapiens
ctggggctgtatttat

SEQ ID NO: 1637305 - DNA, 19 bp, Homo sapiens
ctggggcttctcctgaccc

SEQ ID NO: 1637306 - DNA, 17 bp, Homo sapiens
ctgggggacccctggct

SEQ ID NO: 1637307 - DNA, 23 bp, Homo sapiens
ctgggggacccctggctctgggc

SEQ ID NO: 1637308 - DNA, 13 bp, Homo sapiens
ctgggggcaaagg

SEQ ID NO: 1637309 - DNA, 21 bp, Homo sapiens
ctgggggcaaaggtttgaaga

SEQ ID NO: 1637310 - DNA, 14 bp, Homo sapiens
ctgggggcaggagg

SEQ ID NO: 1637311 - DNA, 13 bp, Homo sapiens
ctgggggcagtga

SEQ ID NO: 1637312 - DNA, 21 bp, Homo sapiens
ctgggggcagtgactggcagg

SEQ ID NO: 1637313 - DNA, 20 bp, Homo sapiens
ctgggggcttttgccactcc

SEQ ID NO: 1637314 - DNA, 20 bp, Homo sapiens
ctggggggacccagtgcaga

SEQ ID NO: 1637315 - DNA, 21 bp, Homo sapiens
ctggggggacccagtgcagaa

SEQ ID NO: 1637316 - DNA, 19 bp, Homo sapiens
ctggggggctgtcctgagc

SEQ ID NO: 1637317 - DNA, 14 bp, Homo sapiens
ctgggggtcctctc

SEQ ID NO: 1637318 - DNA, 21 bp, Homo sapiens
ctggggtccgtcttcacactg

SEQ ID NO: 1637319 - DNA, 18 bp, Homo sapiens
ctggggtcctcctgtgct

SEQ ID NO: 1637320 - DNA, 19 bp, Homo sapiens
ctggggtcctcctgtgcta

SEQ ID NO: 1637321 - DNA, 18 bp, Homo sapiens
ctggggtcctggggcctc

SEQ ID NO: 1637322 - DNA, 19 bp, Homo sapiens
ctggggtcctggggcctcg

SEQ ID NO: 1637323 - DNA, 14 bp, Homo sapiens
ctggggtgagggag

SEQ ID NO: 1637324 - DNA, 18 bp, Homo sapiens
ctggggtgcatctcctcc

SEQ ID NO: 1637325 - DNA, 15 bp, Homo sapiens
ctggggtggccacca

SEQ ID NO: 1637326 - DNA, 21 bp, Homo sapiens
ctggggtggcgtctgcctagg

SEQ ID NO: 1637327 - DNA, 19 bp, Homo sapiens
ctggggtgggagctcctcc

SEQ ID NO: 1637328 - DNA, 21 bp, Homo sapiens
ctggggtgggatctgagctcc

SEQ ID NO: 1637329 - DNA, 16 bp, Homo sapiens
ctggggtgggcagttt

SEQ ID NO: 1637330 - DNA, 18 bp, Homo sapiens
ctggggtgggcagttttt

SEQ ID NO: 1637331 - DNA, 17 bp, Homo sapiens
ctggggttcaagcccag

SEQ ID NO: 1637332 - DNA, 20 bp, Homo sapiens
ctggggttcaagcccaggct

SEQ ID NO: 1637333 - DNA, 14 bp, Homo sapiens
ctgggtaagaagaa

SEQ ID NO: 1637334 - DNA, 23 bp, Homo sapiens
ctgggtaagaagaaagcaaaagc

SEQ ID NO: 1637335 - DNA, 16 bp, Homo sapiens
ctgggtaatttataaa

SEQ ID NO: 1637336 - DNA, 23 bp, Homo sapiens
ctgggtaatttataaagaaaaat

SEQ ID NO: 1637337 - DNA, 17 bp, Homo sapiens
ctgggtacaagagatgg

SEQ ID NO: 1637338 - DNA, 17 bp, Homo sapiens
ctgggtactgaaagcct

SEQ ID NO: 1637339 - DNA, 14 bp, Homo sapiens
ctgggtactgactg

SEQ ID NO: 1637340 - DNA, 17 bp, Homo sapiens
ctgggtacttcttgaag

SEQ ID NO: 1637341 - DNA, 23 bp, Homo sapiens
ctgggtagaggtatgtttgtgaa

SEQ ID NO: 1637342 - DNA, 19 bp, Homo sapiens
ctgggtaggaaagaggaag

SEQ ID NO: 1637343 - DNA, 20 bp, Homo sapiens
ctgggtatcccctgcctcct

SEQ ID NO: 1637344 - DNA, 14 bp, Homo sapiens
ctgggtccctcctc

SEQ ID NO: 1637345 - DNA, 16 bp, Homo sapiens
ctgggtcctccaaaga

SEQ ID NO: 1637346 - DNA, 19 bp, Homo sapiens
ctgggtcctgcctggtcct

SEQ ID NO: 1637347 - DNA, 18 bp, Homo sapiens
ctgggtcctgttccctac

SEQ ID NO: 1637348 - DNA, 19 bp, Homo sapiens
ctgggtccttttcagaagt

SEQ ID NO: 1637349 - DNA, 19 bp, Homo sapiens
ctgggtctcaccggctctc

SEQ ID NO: 1637350 - DNA, 23 bp, Homo sapiens
ctgggtctcaccggctctcacct

SEQ ID NO: 1637351 - DNA, 15 bp, Homo sapiens
ctgggtctgacctgg

SEQ ID NO: 1637352 - DNA, 19 bp, Homo sapiens
ctgggtctgacctggtggg

SEQ ID NO: 1637353 - DNA, 22 bp, Homo sapiens
ctgggtctgattttctcactga

SEQ ID NO: 1637354 - DNA, 17 bp, Homo sapiens
ctgggtcttttgctact

SEQ ID NO: 1637355 - DNA, 14 bp, Homo sapiens
ctgggtgagaccca

SEQ ID NO: 1637356 - DNA, 17 bp, Homo sapiens
ctgggtgagccaaggac

SEQ ID NO: 1637357 - DNA, 20 bp, Homo sapiens
ctgggtgagccaaggacagg

SEQ ID NO: 1637358 - DNA, 15 bp, Homo sapiens
ctgggtgccattccc

SEQ ID NO: 1637359 - DNA, 19 bp, Homo sapiens
ctgggtgccattcccagcg

SEQ ID NO: 1637360 - DNA, 17 bp, Homo sapiens
ctgggtgccctgaaagg

SEQ ID NO: 1637361 - DNA, 19 bp, Homo sapiens
ctgggtgcgtctccagtca

SEQ ID NO: 1637362 - DNA, 19 bp, Homo sapiens
ctgggtggcccctgtctcg

SEQ ID NO: 1637363 - DNA, 13 bp, Homo sapiens
ctgggtgggctct

SEQ ID NO: 1637364 - DNA, 15 bp, Homo sapiens
ctgggtgggctctgt

SEQ ID NO: 1637365 - DNA, 13 bp, Homo sapiens
ctgggtggggctg

SEQ ID NO: 1637366 - DNA, 17 bp, Homo sapiens
ctgggtggggctgctcc

SEQ ID NO: 1637367 - DNA, 16 bp, Homo sapiens
ctgggtggggtgagga

SEQ ID NO: 1637368 - DNA, 18 bp, Homo sapiens
ctgggtgggtggtgggga

SEQ ID NO: 1637369 - DNA, 19 bp, Homo sapiens
ctgggtggtaactgccagc

SEQ ID NO: 1637370 - DNA, 20 bp, Homo sapiens
ctgggtggtaactgccagcc

SEQ ID NO: 1637371 - DNA, 13 bp, Homo sapiens
ctgggtgtgtcca

SEQ ID NO: 1637372 - DNA, 14 bp, Homo sapiens
ctgggtgtgtccag

SEQ ID NO: 1637373 - DNA, 14 bp, Homo sapiens
ctgggttaaatatt

SEQ ID NO: 1637374 - DNA, 16 bp, Homo sapiens
agcccatggcctctgg

SEQ ID NO: 1637375 - DNA, 22 bp, Homo sapiens
agcccatggcctctggccaggc

SEQ ID NO: 1637376 - DNA, 14 bp, Homo sapiens
agcccattcccacc

SEQ ID NO: 1637377 - DNA, 18 bp, Homo sapiens
agcccattctctctcctg

SEQ ID NO: 1637378 - DNA, 20 bp, Homo sapiens
agcccattctctctcctgtc

SEQ ID NO: 1637379 - DNA, 15 bp, Homo sapiens
agcccattgctgcca

SEQ ID NO: 1637380 - DNA, 17 bp, Homo sapiens
agcccatttgggctctg

SEQ ID NO: 1637381 - DNA, 14 bp, Homo sapiens
agccccaagctggg

SEQ ID NO: 1637382 - DNA, 19 bp, Homo sapiens
agccccaagctgggccgag

SEQ ID NO: 1637383 - DNA, 15 bp, Homo sapiens
agccccaagtcctga

SEQ ID NO: 1637384 - DNA, 20 bp, Homo sapiens
agccccacagagcaggaagc

SEQ ID NO: 1637385 - DNA, 20 bp, Homo sapiens
agccccacccaggagggagg

SEQ ID NO: 1637386 - DNA, 20 bp, Homo sapiens
agccccacccctaagtgccc

SEQ ID NO: 1637387 - DNA, 21 bp, Homo sapiens
agccccacccctaagtgccca

SEQ ID NO: 1637388 - DNA, 11 bp, Homo sapiens
agccccacctt

SEQ ID NO: 1637389 - DNA, 15 bp, Homo sapiens
agccccactgccagc

SEQ ID NO: 1637390 - DNA, 17 bp, Homo sapiens
agccccactgccagcag

SEQ ID NO: 1637391 - DNA, 18 bp, Homo sapiens
agccccactgccagcagc

SEQ ID NO: 1637392 - DNA, 19 bp, Homo sapiens
agccccactgccagcagca

SEQ ID NO: 1637393 - DNA, 17 bp, Homo sapiens
agccccacttcaccccc

SEQ ID NO: 1637394 - DNA, 18 bp, Homo sapiens
agccccacttcaccccca

SEQ ID NO: 1637395 - DNA, 16 bp, Homo sapiens
agccccagaaaatgaa

SEQ ID NO: 1637396 - DNA, 22 bp, Homo sapiens
agccccagactgggcccaggca

SEQ ID NO: 1637397 - DNA, 15 bp, Homo sapiens
agccccagcactaac

SEQ ID NO: 1637398 - DNA, 12 bp, Homo sapiens
agccccagcttg

SEQ ID NO: 1637399 - DNA, 19 bp, Homo sapiens
agccccagcttggctcaca

SEQ ID NO: 1637400 - DNA, 10 bp, Homo sapiens
agccccaggg

SEQ ID NO: 1637401 - DNA, 12 bp, Homo sapiens
agccccagggcc

SEQ ID NO: 1637402 - DNA, 16 bp, Homo sapiens
agccccagggcctggg

SEQ ID NO: 1637403 - DNA, 17 bp, Homo sapiens
agccccagggcctgggg

SEQ ID NO: 1637404 - DNA, 16 bp, Homo sapiens
agccccaggggacaag

SEQ ID NO: 1637405 - DNA, 18 bp, Homo sapiens
agccccagggtcttccct

SEQ ID NO: 1637406 - DNA, 23 bp, Homo sapiens
agccccagggtcttccctacctc

SEQ ID NO: 1637407 - DNA, 13 bp, Homo sapiens
agccccagtgctg

SEQ ID NO: 1637408 - DNA, 19 bp, Homo sapiens
agccccatctcatcctggc

SEQ ID NO: 1637409 - DNA, 20 bp, Homo sapiens
agcccccaaccccgcggtgc

SEQ ID NO: 1637410 - DNA, 13 bp, Homo sapiens
agcccccaccagg

SEQ ID NO: 1637411 - DNA, 13 bp, Homo sapiens
agcccccagccct

SEQ ID NO: 1637412 - DNA, 17 bp, Homo sapiens
agcccccagccctggga

SEQ ID NO: 1637413 - DNA, 12 bp, Homo sapiens
agcccccagcta

SEQ ID NO: 1637414 - DNA, 18 bp, Homo sapiens
agcccccagggcctccag

SEQ ID NO: 1637415 - DNA, 22 bp, Homo sapiens
agcccccatcacccaagccaca

SEQ ID NO: 1637416 - DNA, 23 bp, Homo sapiens
agccccccatgcccctcccctcc

SEQ ID NO: 1637417 - DNA, 21 bp, Homo sapiens
agcccccccaacactgtgccc

SEQ ID NO: 1637418 - DNA, 18 bp, Homo sapiens
agccccccttgccccacc

SEQ ID NO: 1637419 - DNA, 20 bp, Homo sapiens
agccccccttgccccacctc

SEQ ID NO: 1637420 - DNA, 17 bp, Homo sapiens
agccccctccagctcat

SEQ ID NO: 1637421 - DNA, 15 bp, Homo sapiens
agccccctgcaccca

SEQ ID NO: 1637422 - DNA, 14 bp, Homo sapiens
agccccctggcctc

SEQ ID NO: 1637423 - DNA, 15 bp, Homo sapiens
agccccctggcctct

SEQ ID NO: 1637424 - DNA, 19 bp, Homo sapiens
agccccctggcctctgtgc

SEQ ID NO: 1637425 - DNA, 18 bp, Homo sapiens
agccccgagacaccatcc

SEQ ID NO: 1637426 - DNA, 17 bp, Homo sapiens
agccccgctcccaccta

SEQ ID NO: 1637427 - DNA, 14 bp, Homo sapiens
agccccggcccccc

SEQ ID NO: 1637428 - DNA, 17 bp, Homo sapiens
agcccctaccccacacc

SEQ ID NO: 1637429 - DNA, 16 bp, Homo sapiens
agcccctactgctgtg

SEQ ID NO: 1637430 - DNA, 17 bp, Homo sapiens
agcccctactgctgtga

SEQ ID NO: 1637431 - DNA, 22 bp, Homo sapiens
agcccctcaaagggagagaaaa

SEQ ID NO: 1637432 - DNA, 11 bp, Homo sapiens
agcccctcctc

SEQ ID NO: 1637433 - DNA, 14 bp, Homo sapiens
agcccctcctcccc

SEQ ID NO: 1637434 - DNA, 15 bp, Homo sapiens
agcccctcctccccc

SEQ ID NO: 1637435 - DNA, 19 bp, Homo sapiens
agcccctcctcccccggct

SEQ ID NO: 1637436 - DNA, 12 bp, Homo sapiens
agcccctcctct

SEQ ID NO: 1637437 - DNA, 13 bp, Homo sapiens
agcccctcctctg

SEQ ID NO: 1637438 - DNA, 21 bp, Homo sapiens
agcccctccttctcccctgcc

SEQ ID NO: 1637439 - DNA, 17 bp, Homo sapiens
agcccctcggctctgga

SEQ ID NO: 1637440 - DNA, 13 bp, Homo sapiens
agcccctctggtc

SEQ ID NO: 1637441 - DNA, 17 bp, Homo sapiens
agcccctgaaagcctca

SEQ ID NO: 1637442 - DNA, 13 bp, Homo sapiens
agcccctgcccct

SEQ ID NO: 1637443 - DNA, 14 bp, Homo sapiens
agcccctgcccctc

SEQ ID NO: 1637444 - DNA, 11 bp, Homo sapiens
agcccctgggg

SEQ ID NO: 1637445 - DNA, 22 bp, Homo sapiens
agcccctggggtggccaccagt

SEQ ID NO: 1637446 - DNA, 21 bp, Homo sapiens
agccccttactatgatctcag

SEQ ID NO: 1637447 - DNA, 23 bp, Homo sapiens
agccccttactatgatctcagga

SEQ ID NO: 1637448 - DNA, 20 bp, Homo sapiens
agccccttctggccggtgct

SEQ ID NO: 1637449 - DNA, 17 bp, Homo sapiens
agccccttgagaaacct

SEQ ID NO: 1637450 - DNA, 12 bp, Homo sapiens
agccccttggag

SEQ ID NO: 1637451 - DNA, 20 bp, Homo sapiens
agccccttggattcctgcac

SEQ ID NO: 1637452 - DNA, 20 bp, Homo sapiens
agcccgacagtgccatcccc

SEQ ID NO: 1637453 - DNA, 19 bp, Homo sapiens
agcccgaggcaccagtgtc

SEQ ID NO: 1637454 - DNA, 19 bp, Homo sapiens
agcccgatattctccctga

SEQ ID NO: 1637455 - DNA, 22 bp, Homo sapiens
agcccgatattctccctgacct

SEQ ID NO: 1637456 - DNA, 23 bp, Homo sapiens
agcccgatattctccctgacctt

SEQ ID NO: 1637457 - DNA, 15 bp, Homo sapiens
agcccgcacacctgc

SEQ ID NO: 1637458 - DNA, 19 bp, Homo sapiens
agcccgccaaggtagccat

SEQ ID NO: 1637459 - DNA, 21 bp, Homo sapiens
agcccgcctgccgtgcatggc

SEQ ID NO: 1637460 - DNA, 21 bp, Homo sapiens
agcccggcctgctcccagcag

SEQ ID NO: 1637461 - DNA, 21 bp, Homo sapiens
agcccggcgccaccatcctgc

SEQ ID NO: 1637462 - DNA, 21 bp, Homo sapiens
agcccggcgcccctgccacct

SEQ ID NO: 1637463 - DNA, 14 bp, Homo sapiens
agcccggggaggaa

SEQ ID NO: 1637464 - DNA, 16 bp, Homo sapiens
agcccgtcgcgctgga

SEQ ID NO: 1637465 - DNA, 15 bp, Homo sapiens
agcccgtctcagtgt

SEQ ID NO: 1637466 - DNA, 17 bp, Homo sapiens
agcccgtgaagcagtgc

SEQ ID NO: 1637467 - DNA, 18 bp, Homo sapiens
agcccgttagccccaggg

SEQ ID NO: 1637468 - DNA, 19 bp, Homo sapiens
agccctaaaaatccagact

SEQ ID NO: 1637469 - DNA, 17 bp, Homo sapiens
agccctaaccccttcca

SEQ ID NO: 1637470 - DNA, 18 bp, Homo sapiens
agccctaaccccttccag

SEQ ID NO: 1637471 - DNA, 16 bp, Homo sapiens
agccctaaggatctct

SEQ ID NO: 1637472 - DNA, 17 bp, Homo sapiens
agccctaaggtcctaag

SEQ ID NO: 1637473 - DNA, 15 bp, Homo sapiens
agccctacagagctg

SEQ ID NO: 1637474 - DNA, 18 bp, Homo sapiens
agccctacagagctgtgg

SEQ ID NO: 1637475 - DNA, 22 bp, Homo sapiens
agccctagaggcgagccaggca

SEQ ID NO: 1637476 - DNA, 21 bp, Homo sapiens
agccctagctgtcccatgggg

SEQ ID NO: 1637477 - DNA, 21 bp, Homo sapiens
agccctcaaagaagtcggaat

SEQ ID NO: 1637478 - DNA, 19 bp, Homo sapiens
agccctcacctctgaggac

SEQ ID NO: 1637479 - DNA, 20 bp, Homo sapiens
agccctccactccagctctg

SEQ ID NO: 1637480 - DNA, 19 bp, Homo sapiens
agccctccacttctggtat

SEQ ID NO: 1637481 - DNA, 12 bp, Homo sapiens
agccctccaggc

SEQ ID NO: 1637482 - DNA, 16 bp, Homo sapiens
agccctccaggcctgc

SEQ ID NO: 1637483 - DNA, 12 bp, Homo sapiens
agccctccctgc

SEQ ID NO: 1637484 - DNA, 13 bp, Homo sapiens
agccctccctgcc

SEQ ID NO: 1637485 - DNA, 15 bp, Homo sapiens
agccctccctgcccc

SEQ ID NO: 1637486 - DNA, 23 bp, Homo sapiens
agccctccctggctgtgagcagc

SEQ ID NO: 1637487 - DNA, 14 bp, Homo sapiens
agccctccctgtcc

SEQ ID NO: 1637488 - DNA, 16 bp, Homo sapiens
agccctccctgtcctc

SEQ ID NO: 1637489 - DNA, 19 bp, Homo sapiens
agccctccgaccctcatgg

SEQ ID NO: 1637490 - DNA, 23 bp, Homo sapiens
agccctccgccattctcaagccc

SEQ ID NO: 1637491 - DNA, 16 bp, Homo sapiens
ctgggttaaatatttt

SEQ ID NO: 1637492 - DNA, 17 bp, Homo sapiens
ctgggttaacaaatgag

SEQ ID NO: 1637493 - DNA, 21 bp, Homo sapiens
ctgggttcagaaatgctgcct

SEQ ID NO: 1637494 - DNA, 13 bp, Homo sapiens
ctgggttcccact

SEQ ID NO: 1637495 - DNA, 21 bp, Homo sapiens
ctgggttccctttccttccat

SEQ ID NO: 1637496 - DNA, 12 bp, Homo sapiens
ctgggttcttcc

SEQ ID NO: 1637497 - DNA, 17 bp, Homo sapiens
ctgggttctttggaagc

SEQ ID NO: 1637498 - DNA, 16 bp, Homo sapiens
ctgggttggtgcacag

SEQ ID NO: 1637499 - DNA, 19 bp, Homo sapiens
ctgggttggtgcacagtga

SEQ ID NO: 1637500 - DNA, 22 bp, Homo sapiens
ctgggttggtgcacagtgattt

SEQ ID NO: 1637501 - DNA, 18 bp, Homo sapiens
ctgggtttctaagcagtt

SEQ ID NO: 1637502 - DNA, 20 bp, Homo sapiens
ctgggtttctaagcagttat

SEQ ID NO: 1637503 - DNA, 18 bp, Homo sapiens
ctggtaacagttcatgtt

SEQ ID NO: 1637504 - DNA, 22 bp, Homo sapiens
ctggtaaccaaatattaaagat

SEQ ID NO: 1637505 - DNA, 22 bp, Homo sapiens
ctggtaactggaaggccttcca

SEQ ID NO: 1637506 - DNA, 20 bp, Homo sapiens
ctggtaagcgatttgaaaca

SEQ ID NO: 1637507 - DNA, 20 bp, Homo sapiens
ctggtaattcctctccaggc

SEQ ID NO: 1637508 - DNA, 19 bp, Homo sapiens
ctggtacaacggaggcctg

SEQ ID NO: 1637509 - DNA, 14 bp, Homo sapiens
ctggtacccagcca

SEQ ID NO: 1637510 - DNA, 16 bp, Homo sapiens
ctggtacccagccatc

SEQ ID NO: 1637511 - DNA, 18 bp, Homo sapiens
ctggtacccagccatctg

SEQ ID NO: 1637512 - DNA, 21 bp, Homo sapiens
ctggtacccagccatctgccc

SEQ ID NO: 1637513 - DNA, 22 bp, Homo sapiens
ctggtacccagccatctgccca

SEQ ID NO: 1637514 - DNA, 15 bp, Homo sapiens
ctggtactgacccag

SEQ ID NO: 1637515 - DNA, 19 bp, Homo sapiens
ctggtacttcctttctccc

SEQ ID NO: 1637516 - DNA, 21 bp, Homo sapiens
ctggtagatgctgaggcccct

SEQ ID NO: 1637517 - DNA, 18 bp, Homo sapiens
ctggtaggaccaagcatc

SEQ ID NO: 1637518 - DNA, 18 bp, Homo sapiens
ctggtatatccaaaagct

SEQ ID NO: 1637519 - DNA, 22 bp, Homo sapiens
ctggtatctcagaaagtgcctg

SEQ ID NO: 1637520 - DNA, 21 bp, Homo sapiens
ctggtatttctaattccacag

SEQ ID NO: 1637521 - DNA, 15 bp, Homo sapiens
ctggtcactctgccc

SEQ ID NO: 1637522 - DNA, 13 bp, Homo sapiens
ctggtcagagaga

SEQ ID NO: 1637523 - DNA, 16 bp, Homo sapiens
ctggtcagtctttgct

SEQ ID NO: 1637524 - DNA, 15 bp, Homo sapiens
ctggtccaaaagatt

SEQ ID NO: 1637525 - DNA, 22 bp, Homo sapiens
ctggtccaaaagattgctgaaa

SEQ ID NO: 1637526 - DNA, 14 bp, Homo sapiens
ctggtccagctctg

SEQ ID NO: 1637527 - DNA, 15 bp, Homo sapiens
ctggtccagctctga

SEQ ID NO: 1637528 - DNA, 16 bp, Homo sapiens
ctggtccagctctgac

SEQ ID NO: 1637529 - DNA, 18 bp, Homo sapiens
ctggtccagctctgacat

SEQ ID NO: 1637530 - DNA, 21 bp, Homo sapiens
ctggtccagggaagctggccg

SEQ ID NO: 1637531 - DNA, 14 bp, Homo sapiens
ctggtccagggcta

SEQ ID NO: 1637532 - DNA, 14 bp, Homo sapiens
ctggtccctgccct

SEQ ID NO: 1637533 - DNA, 16 bp, Homo sapiens
ctggtccctgccctcc

SEQ ID NO: 1637534 - DNA, 21 bp, Homo sapiens
ctggtccctgccctcccctgc

SEQ ID NO: 1637535 - DNA, 14 bp, Homo sapiens
ctggtccctggtcc

SEQ ID NO: 1637536 - DNA, 20 bp, Homo sapiens
ctggtccctggtccttcact

SEQ ID NO: 1637537 - DNA, 14 bp, Homo sapiens
ctggtcccttcagt

SEQ ID NO: 1637538 - DNA, 19 bp, Homo sapiens
ctggtccgtgggacggtgc

SEQ ID NO: 1637539 - DNA, 21 bp, Homo sapiens
ctggtccgtgggacggtgccc

SEQ ID NO: 1637540 - DNA, 16 bp, Homo sapiens
ctggtcctccctccca

SEQ ID NO: 1637541 - DNA, 18 bp, Homo sapiens
ctggtcctggctgcactc

SEQ ID NO: 1637542 - DNA, 22 bp, Homo sapiens
ctggtcctggctgcactcttga

SEQ ID NO: 1637543 - DNA, 17 bp, Homo sapiens
ctggtccttccaggccc

SEQ ID NO: 1637544 - DNA, 15 bp, Homo sapiens
ctggtcctttttggt

SEQ ID NO: 1637545 - DNA, 22 bp, Homo sapiens
ctggtcctttttggtcgaggag

SEQ ID NO: 1637546 - DNA, 15 bp, Homo sapiens
ctggtctaatgtttg

SEQ ID NO: 1637547 - DNA, 17 bp, Homo sapiens
ctggtctattttgattt

SEQ ID NO: 1637548 - DNA, 17 bp, Homo sapiens
ctggtctcgaactcctg

SEQ ID NO: 1637549 - DNA, 18 bp, Homo sapiens
ctggtctcgaactcctgg

SEQ ID NO: 1637550 - DNA, 19 bp, Homo sapiens
ctggtctcgaactcctggc

SEQ ID NO: 1637551 - DNA, 20 bp, Homo sapiens
ctggtctcgaactcctggcc

SEQ ID NO: 1637552 - DNA, 18 bp, Homo sapiens
ctggtctgaggatgtaga

SEQ ID NO: 1637553 - DNA, 14 bp, Homo sapiens
ctggtctgtaggga

SEQ ID NO: 1637554 - DNA, 14 bp, Homo sapiens
ctggtctgtctgga

SEQ ID NO: 1637555 - DNA, 11 bp, Homo sapiens
ctggtctgtga

SEQ ID NO: 1637556 - DNA, 22 bp, Homo sapiens
ctggtctgtgaagagccggtgg

SEQ ID NO: 1637557 - DNA, 15 bp, Homo sapiens
ctggtcttgagatgt

SEQ ID NO: 1637558 - DNA, 18 bp, Homo sapiens
ctggtcttgtggaattgg

SEQ ID NO: 1637559 - DNA, 20 bp, Homo sapiens
ctggtcttgtggaattggga

SEQ ID NO: 1637560 - DNA, 15 bp, Homo sapiens
ctggtcttgttagaa

SEQ ID NO: 1637561 - DNA, 19 bp, Homo sapiens
ctggtgaacactgtgacca

SEQ ID NO: 1637562 - DNA, 15 bp, Homo sapiens
ctggtgaagctcact

SEQ ID NO: 1637563 - DNA, 16 bp, Homo sapiens
ctggtgaatattttca

SEQ ID NO: 1637564 - DNA, 14 bp, Homo sapiens
ctggtgacaccagc

SEQ ID NO: 1637565 - DNA, 16 bp, Homo sapiens
ctggtgacaccagcct

SEQ ID NO: 1637566 - DNA, 17 bp, Homo sapiens
ctggtgacaccagcctt

SEQ ID NO: 1637567 - DNA, 13 bp, Homo sapiens
ctggtgagaactg

SEQ ID NO: 1637568 - DNA, 18 bp, Homo sapiens
ctggtgagaactgaggag

SEQ ID NO: 1637569 - DNA, 19 bp, Homo sapiens
ctggtgagaactgaggagc

SEQ ID NO: 1637570 - DNA, 24 bp, Homo sapiens
ctggtgagtcaccacttcagggct

SEQ ID NO: 1637571 - DNA, 20 bp, Homo sapiens
ctggtgagtcttggcggcag

SEQ ID NO: 1637572 - DNA, 11 bp, Homo sapiens
ctggtgcagaa

SEQ ID NO: 1637573 - DNA, 20 bp, Homo sapiens
ctggtgcagggcctccattc

SEQ ID NO: 1637574 - DNA, 23 bp, Homo sapiens
ctggtgccaaatgaagattttta

SEQ ID NO: 1637575 - DNA, 18 bp, Homo sapiens
ctggtgccaatttcaagt

SEQ ID NO: 1637576 - DNA, 20 bp, Homo sapiens
ctggtgccaatttcaagttc

SEQ ID NO: 1637577 - DNA, 13 bp, Homo sapiens
ctggtgccagcct

SEQ ID NO: 1637578 - DNA, 15 bp, Homo sapiens
ctggtgccccacctg

SEQ ID NO: 1637579 - DNA, 17 bp, Homo sapiens
ctggtgccccacctgcc

SEQ ID NO: 1637580 - DNA, 20 bp, Homo sapiens
ctggtgccccccacccctgg

SEQ ID NO: 1637581 - DNA, 15 bp, Homo sapiens
ctggtgcctccagag

SEQ ID NO: 1637582 - DNA, 16 bp, Homo sapiens
ctggtgcctccagagg

SEQ ID NO: 1637583 - DNA, 14 bp, Homo sapiens
ctggtgcctctgtg

SEQ ID NO: 1637584 - DNA, 21 bp, Homo sapiens
ctggtgcgaccccccaccccc

SEQ ID NO: 1637585 - DNA, 23 bp, Homo sapiens
ctggtgcgaccccccacccccgc

SEQ ID NO: 1637586 - DNA, 14 bp, Homo sapiens
ctggtgcgggcctg

SEQ ID NO: 1637587 - DNA, 17 bp, Homo sapiens
ctggtgctactccatgc

SEQ ID NO: 1637588 - DNA, 14 bp, Homo sapiens
ctggtgctctctgc

SEQ ID NO: 1637589 - DNA, 22 bp, Homo sapiens
ctggtgctgccacacttcaggc

SEQ ID NO: 1637590 - DNA, 22 bp, Homo sapiens
ctggtgctttagttaggtcatt

SEQ ID NO: 1637591 - DNA, 17 bp, Homo sapiens
ctggtggacagtcctgg

SEQ ID NO: 1637592 - DNA, 21 bp, Homo sapiens
ctggtggagaaagcactgacc

SEQ ID NO: 1637593 - DNA, 22 bp, Homo sapiens
ctggtggagaaagcactgacct

SEQ ID NO: 1637594 - DNA, 19 bp, Homo sapiens
ctggtggatacctggttga

SEQ ID NO: 1637595 - DNA, 14 bp, Homo sapiens
ctggtggcacagga

SEQ ID NO: 1637596 - DNA, 15 bp, Homo sapiens
ctggtggcacaggag

SEQ ID NO: 1637597 - DNA, 17 bp, Homo sapiens
ctggtggctcctcctag

SEQ ID NO: 1637598 - DNA, 12 bp, Homo sapiens
ctggtggctggg

SEQ ID NO: 1637599 - DNA, 13 bp, Homo sapiens
ctggtggctgggc

SEQ ID NO: 1637600 - DNA, 16 bp, Homo sapiens
ctggtggctgggccca

SEQ ID NO: 1637601 - DNA, 19 bp, Homo sapiens
ctggtgggaaggccggcag

SEQ ID NO: 1637602 - DNA, 18 bp, Homo sapiens
ctggtgggacagtggtga

SEQ ID NO: 1637603 - DNA, 18 bp, Homo sapiens
ctggtgggagcacctgcc

SEQ ID NO: 1637604 - DNA, 16 bp, Homo sapiens
ctggtggggctgagcc

SEQ ID NO: 1637605 - DNA, 17 bp, Homo sapiens
ctggtggggctgagcct

SEQ ID NO: 1637606 - DNA, 19 bp, Homo sapiens
ctggtggggctgagcctga

SEQ ID NO: 1637607 - DNA, 18 bp, Homo sapiens
ctgtactcagagcagagc

SEQ ID NO: 1637608 - DNA, 19 bp, Homo sapiens
ctgtactcagagcagagca

SEQ ID NO: 1637609 - DNA, 15 bp, Homo sapiens
ctgtactcttagatg

SEQ ID NO: 1637610 - DNA, 13 bp, Homo sapiens
ctgtactgcatgt

SEQ ID NO: 1637611 - DNA, 15 bp, Homo sapiens
ctgtactgcatgtga

SEQ ID NO: 1637612 - DNA, 18 bp, Homo sapiens
ctgtactgcatgtgactt

SEQ ID NO: 1637613 - DNA, 18 bp, Homo sapiens
ctgtactgttactgggcc

SEQ ID NO: 1637614 - DNA, 20 bp, Homo sapiens
ctgtactgttactgggccct

SEQ ID NO: 1637615 - DNA, 20 bp, Homo sapiens
ctgtactgttttctgggcca

SEQ ID NO: 1637616 - DNA, 22 bp, Homo sapiens
ctgtacttgaagtctaaaagca

SEQ ID NO: 1637617 - DNA, 18 bp, Homo sapiens
ctgtactttgccattttt

SEQ ID NO: 1637618 - DNA, 19 bp, Homo sapiens
ctgtagaaaggggagaatg

SEQ ID NO: 1637619 - DNA, 22 bp, Homo sapiens
ctgtagaagtgagtttgtaaat

SEQ ID NO: 1637620 - DNA, 15 bp, Homo sapiens
ctgtagagttgctga

SEQ ID NO: 1637621 - DNA, 18 bp, Homo sapiens
ctgtagatatgtattctt

SEQ ID NO: 1637622 - DNA, 13 bp, Homo sapiens
ctgtagatgatgt

SEQ ID NO: 1637623 - DNA, 16 bp, Homo sapiens
ctgtagatgatgtatt

SEQ ID NO: 1637624 - DNA, 21 bp, Homo sapiens
ctgtagatggtgacctgggta

SEQ ID NO: 1637625 - DNA, 12 bp, Homo sapiens
ctgtagccatgg

SEQ ID NO: 1637626 - DNA, 17 bp, Homo sapiens
ctgtagccatggctcag

SEQ ID NO: 1637627 - DNA, 23 bp, Homo sapiens
ctgtagccatggctcaggcaagc

SEQ ID NO: 1637628 - DNA, 21 bp, Homo sapiens
ctgtagcctaaaacgaatggt

SEQ ID NO: 1637629 - DNA, 22 bp, Homo sapiens
ctgtagctcagtcatcaaagca

SEQ ID NO: 1637630 - DNA, 19 bp, Homo sapiens
ctgtagctcccctgctgag

SEQ ID NO: 1637631 - DNA, 22 bp, Homo sapiens
ctgtagctcccctgctgaggca

SEQ ID NO: 1637632 - DNA, 23 bp, Homo sapiens
ctgtagctcccctgctgaggcag

SEQ ID NO: 1637633 - DNA, 17 bp, Homo sapiens
ctgtagctccctcctcc

SEQ ID NO: 1637634 - DNA, 20 bp, Homo sapiens
ctgtagctccctcctcccat

SEQ ID NO: 1637635 - DNA, 23 bp, Homo sapiens
ctgtagctccctcctcccatctc

SEQ ID NO: 1637636 - DNA, 22 bp, Homo sapiens
ctgtagctgatgaaactcctga

SEQ ID NO: 1637637 - DNA, 13 bp, Homo sapiens
ctgtagctttaaa

SEQ ID NO: 1637638 - DNA, 16 bp, Homo sapiens
ctgtagctttcctggt

SEQ ID NO: 1637639 - DNA, 22 bp, Homo sapiens
ctgtagctttcctggtccctca

SEQ ID NO: 1637640 - DNA, 20 bp, Homo sapiens
ctgtaggagagtcggtctgc

SEQ ID NO: 1637641 - DNA, 19 bp, Homo sapiens
ctgtaggcacagagctgca

SEQ ID NO: 1637642 - DNA, 15 bp, Homo sapiens
ctgtaggcagaggct

SEQ ID NO: 1637643 - DNA, 20 bp, Homo sapiens
ctgtagggaaaccttggaga

SEQ ID NO: 1637644 - DNA, 20 bp, Homo sapiens
ctgtagggagggcggcaggg

SEQ ID NO: 1637645 - DNA, 21 bp, Homo sapiens
ctgtagggagggcggcagggg

SEQ ID NO: 1637646 - DNA, 18 bp, Homo sapiens
ctgtagggctggacctat

SEQ ID NO: 1637647 - DNA, 18 bp, Homo sapiens
ctgtaggttatttaaaat

SEQ ID NO: 1637648 - DNA, 20 bp, Homo sapiens
ctgtagtaaactatttatct

SEQ ID NO: 1637649 - DNA, 19 bp, Homo sapiens
ctgtagtaatttattgtct

SEQ ID NO: 1637650 - DNA, 18 bp, Homo sapiens
ctgtagtactccttaaga

SEQ ID NO: 1637651 - DNA, 21 bp, Homo sapiens
ctgtagtactccttaagaaca

SEQ ID NO: 1637652 - DNA, 12 bp, Homo sapiens
ctgtagtcccag

SEQ ID NO: 1637653 - DNA, 22 bp, Homo sapiens
ctgtagtcccagctactcagga

SEQ ID NO: 1637654 - DNA, 13 bp, Homo sapiens
ctgtagtctctga

SEQ ID NO: 1637655 - DNA, 13 bp, Homo sapiens
ctgtagtgagaaa

SEQ ID NO: 1637656 - DNA, 13 bp, Homo sapiens
ctgtagttctaag

SEQ ID NO: 1637657 - DNA, 19 bp, Homo sapiens
ctgtagttttccctgcact

SEQ ID NO: 1637658 - DNA, 20 bp, Homo sapiens
ctgtagttttccctgcactg

SEQ ID NO: 1637659 - DNA, 23 bp, Homo sapiens
ctgtataagttatttttgtacat

SEQ ID NO: 1637660 - DNA, 20 bp, Homo sapiens
ctgtataattaattgtcatt

SEQ ID NO: 1637661 - DNA, 15 bp, Homo sapiens
ctgtatagtactggc

SEQ ID NO: 1637662 - DNA, 18 bp, Homo sapiens
ctgtatataaaatatttt

SEQ ID NO: 1637663 - DNA, 15 bp, Homo sapiens
ctgtatataaaggtg

SEQ ID NO: 1637664 - DNA, 15 bp, Homo sapiens
ctgtatatacaataa

SEQ ID NO: 1637665 - DNA, 20 bp, Homo sapiens
ctgtatatagggcacaagta

SEQ ID NO: 1637666 - DNA, 18 bp, Homo sapiens
ctgtatatgattctctgt

SEQ ID NO: 1637667 - DNA, 21 bp, Homo sapiens
ctgtatatgtattcccttgta

SEQ ID NO: 1637668 - DNA, 17 bp, Homo sapiens
ctgtatatgttgtaata

SEQ ID NO: 1637669 - DNA, 18 bp, Homo sapiens
ctgtatccgtgaattgct

SEQ ID NO: 1637670 - DNA, 17 bp, Homo sapiens
ctgtatctaaaaaataa

SEQ ID NO: 1637671 - DNA, 21 bp, Homo sapiens
ctgtatctaaaaaataactgt

SEQ ID NO: 1637672 - DNA, 15 bp, Homo sapiens
ctgtatgatttgttt

SEQ ID NO: 1637673 - DNA, 22 bp, Homo sapiens
ctgtatgctgatcatcgccaga

SEQ ID NO: 1637674 - DNA, 23 bp, Homo sapiens
ctgtatggcacttattatgaggc

SEQ ID NO: 1637675 - DNA, 18 bp, Homo sapiens
ctgtatggtggaagctgg

SEQ ID NO: 1637676 - DNA, 22 bp, Homo sapiens
ctgtatggtggaagctgggtga

SEQ ID NO: 1637677 - DNA, 16 bp, Homo sapiens
ctgtatgtggtgtggg

SEQ ID NO: 1637678 - DNA, 13 bp, Homo sapiens
ctgtatgttgtcc

SEQ ID NO: 1637679 - DNA, 15 bp, Homo sapiens
ctgtattaaatctta

SEQ ID NO: 1637680 - DNA, 23 bp, Homo sapiens
ctgtattaaatcttaaacaatgt

SEQ ID NO: 1637681 - DNA, 20 bp, Homo sapiens
ctgtattactgaataatatc

SEQ ID NO: 1637682 - DNA, 21 bp, Homo sapiens
ctgtattactgaataatatca

SEQ ID NO: 1637683 - DNA, 23 bp, Homo sapiens
ctgtattactgaataatatcaaa

SEQ ID NO: 1637684 - DNA, 20 bp, Homo sapiens
ctgtattagagcgccagctc

SEQ ID NO: 1637685 - DNA, 14 bp, Homo sapiens
ctgtattgccccca

SEQ ID NO: 1637686 - DNA, 15 bp, Homo sapiens
ctgtattgcccccat

SEQ ID NO: 1637687 - DNA, 17 bp, Homo sapiens
ctgtattgtctgaactt

SEQ ID NO: 1637688 - DNA, 14 bp, Homo sapiens
ctgtatttaagaaa

SEQ ID NO: 1637689 - DNA, 18 bp, Homo sapiens
ctgtatttatgtgtgagg

SEQ ID NO: 1637690 - DNA, 19 bp, Homo sapiens
ctgtatttcctgcttccct

SEQ ID NO: 1637691 - DNA, 23 bp, Homo sapiens
ctgtattttatttagacaagaga

SEQ ID NO: 1637692 - DNA, 11 bp, Homo sapiens
ctgtattttct

SEQ ID NO: 1637693 - DNA, 12 bp, Homo sapiens
ctgtattttctt

SEQ ID NO: 1637694 - DNA, 23 bp, Homo sapiens
ctgtattttcttttatatctgta

SEQ ID NO: 1637695 - DNA, 16 bp, Homo sapiens
ctgtatttttttaact

SEQ ID NO: 1637696 - DNA, 17 bp, Homo sapiens
ctgtatttttttaacta

SEQ ID NO: 1637697 - DNA, 17 bp, Homo sapiens
ctgtcaaacaataaagg

SEQ ID NO: 1637698 - DNA, 23 bp, Homo sapiens
ctgtcaaatgtttccttaaacat

SEQ ID NO: 1637699 - DNA, 22 bp, Homo sapiens
ctgtcaacttcccatctggctc

SEQ ID NO: 1637700 - DNA, 22 bp, Homo sapiens
ctgtcaagttaacaaggaatgc

SEQ ID NO: 1637701 - DNA, 12 bp, Homo sapiens
ctgtcaataaac

SEQ ID NO: 1637702 - DNA, 13 bp, Homo sapiens
ctgtcaataaaca

SEQ ID NO: 1637703 - DNA, 16 bp, Homo sapiens
ctgtcacaaccaagaa

SEQ ID NO: 1637704 - DNA, 12 bp, Homo sapiens
ctgtcaccagag

SEQ ID NO: 1637705 - DNA, 14 bp, Homo sapiens
ctgtcaccagagct

SEQ ID NO: 1637706 - DNA, 21 bp, Homo sapiens
ctgtcaccagagcttctctgg

SEQ ID NO: 1637707 - DNA, 15 bp, Homo sapiens
ctgtcaccctgcagg

SEQ ID NO: 1637708 - DNA, 18 bp, Homo sapiens
ctgtcaccctgcaggact

SEQ ID NO: 1637709 - DNA, 23 bp, Homo sapiens
ctgtcacctagaacgtgcatcct

SEQ ID NO: 1637710 - DNA, 20 bp, Homo sapiens
ctgtcacgctcatgtcctgt

SEQ ID NO: 1637711 - DNA, 14 bp, Homo sapiens
ctgtcactcagctg

SEQ ID NO: 1637712 - DNA, 21 bp, Homo sapiens
ctgtcactcattgctgagcct

SEQ ID NO: 1637713 - DNA, 20 bp, Homo sapiens
ctgtcactgcttgagggaga

SEQ ID NO: 1637714 - DNA, 18 bp, Homo sapiens
ctgtcagagaatatgacc

SEQ ID NO: 1637715 - DNA, 15 bp, Homo sapiens
ctgtcagagccgcca

SEQ ID NO: 1637716 - DNA, 12 bp, Homo sapiens
ctgtcagaggct

SEQ ID NO: 1637717 - DNA, 16 bp, Homo sapiens
ctgtcagcatctggct

SEQ ID NO: 1637718 - DNA, 18 bp, Homo sapiens
ctgtcagcatctggctgt

SEQ ID NO: 1637719 - DNA, 16 bp, Homo sapiens
ctgtcagccgggccct

SEQ ID NO: 1637720 - DNA, 21 bp, Homo sapiens
ctgtcagctcccctcggagaa

SEQ ID NO: 1637721 - DNA, 23 bp, Homo sapiens
ctgtcagctcccctcggagaaga

SEQ ID NO: 1637722 - DNA, 24 bp, Homo sapiens
agccctccgccattctcaagccct

SEQ ID NO: 1637723 - DNA, 13 bp, Homo sapiens
agccctcctcacc

SEQ ID NO: 1637724 - DNA, 17 bp, Homo sapiens
agccctccttccacgga

SEQ ID NO: 1637725 - DNA, 18 bp, Homo sapiens
agccctcgaaccaaggca

SEQ ID NO: 1637726 - DNA, 23 bp, Homo sapiens
agccctcgaaccaaggcagcctc

SEQ ID NO: 1637727 - DNA, 24 bp, Homo sapiens
agccctcgaaccaaggcagcctcc

SEQ ID NO: 1637728 - DNA, 13 bp, Homo sapiens
agccctcggcctc

SEQ ID NO: 1637729 - DNA, 17 bp, Homo sapiens
agccctcggcctccgag

SEQ ID NO: 1637730 - DNA, 22 bp, Homo sapiens
agccctgaggtgaaagggagct

SEQ ID NO: 1637731 - DNA, 14 bp, Homo sapiens
agccctgagtgtcc

SEQ ID NO: 1637732 - DNA, 20 bp, Homo sapiens
agccctgagtgtcccaagcc

SEQ ID NO: 1637733 - DNA, 22 bp, Homo sapiens
agccctgcaccatgctgctggg

SEQ ID NO: 1637734 - DNA, 15 bp, Homo sapiens
agccctgcagcccaa

SEQ ID NO: 1637735 - DNA, 17 bp, Homo sapiens
agccctgccctcccaag

SEQ ID NO: 1637736 - DNA, 17 bp, Homo sapiens
agccctgcctctgtgta

SEQ ID NO: 1637737 - DNA, 16 bp, Homo sapiens
agccctgcggagccgg

SEQ ID NO: 1637738 - DNA, 15 bp, Homo sapiens
agccctgctgtggga

SEQ ID NO: 1637739 - DNA, 17 bp, Homo sapiens
agccctgctgtgggaga

SEQ ID NO: 1637740 - DNA, 22 bp, Homo sapiens
agccctgctttgggctgccctg

SEQ ID NO: 1637741 - DNA, 17 bp, Homo sapiens
agccctggagagcccca

SEQ ID NO: 1637742 - DNA, 23 bp, Homo sapiens
agccctggatttcagaaagagca

SEQ ID NO: 1637743 - DNA, 13 bp, Homo sapiens
agccctggcagga

SEQ ID NO: 1637744 - DNA, 15 bp, Homo sapiens
agccctggccctgcc

SEQ ID NO: 1637745 - DNA, 17 bp, Homo sapiens
agccctggccctgccca

SEQ ID NO: 1637746 - DNA, 22 bp, Homo sapiens
agccctggccctgcccagccca

SEQ ID NO: 1637747 - DNA, 18 bp, Homo sapiens
agccctgtccttcagtct

SEQ ID NO: 1637748 - DNA, 19 bp, Homo sapiens
agccctgtccttcagtctt

SEQ ID NO: 1637749 - DNA, 21 bp, Homo sapiens
agccctgtcgagacacttgcc

SEQ ID NO: 1637750 - DNA, 18 bp, Homo sapiens
agccctgtggccgccacc

SEQ ID NO: 1637751 - DNA, 11 bp, Homo sapiens
agccctgttct

SEQ ID NO: 1637752 - DNA, 16 bp, Homo sapiens
agccctgttctcctgt

SEQ ID NO: 1637753 - DNA, 22 bp, Homo sapiens
agcccttatgcggttaattttg

SEQ ID NO: 1637754 - DNA, 16 bp, Homo sapiens
agcccttatggccaat

SEQ ID NO: 1637755 - DNA, 15 bp, Homo sapiens
agcccttctgccttt

SEQ ID NO: 1637756 - DNA, 18 bp, Homo sapiens
agcccttgcccccatccc

SEQ ID NO: 1637757 - DNA, 14 bp, Homo sapiens
agcccttgcctccc

SEQ ID NO: 1637758 - DNA, 21 bp, Homo sapiens
agccctttacttgacctccta

SEQ ID NO: 1637759 - DNA, 17 bp, Homo sapiens
agccctttgctctggag

SEQ ID NO: 1637760 - DNA, 21 bp, Homo sapiens
agccctttgctctggaggaag

SEQ ID NO: 1637761 - DNA, 15 bp, Homo sapiens
agccgacctcagcct

SEQ ID NO: 1637762 - DNA, 19 bp, Homo sapiens
agccgactctggccctggc

SEQ ID NO: 1637763 - DNA, 20 bp, Homo sapiens
agccgactctggccctggcc

SEQ ID NO: 1637764 - DNA, 18 bp, Homo sapiens
agccgagatcacgccact

SEQ ID NO: 1637765 - DNA, 18 bp, Homo sapiens
agccgagattgcgccact

SEQ ID NO: 1637766 - DNA, 16 bp, Homo sapiens
agccgagccgggcctg

SEQ ID NO: 1637767 - DNA, 21 bp, Homo sapiens
agccgagccgggcctggggct

SEQ ID NO: 1637768 - DNA, 23 bp, Homo sapiens
agccgagctcgtgtatcctgggg

SEQ ID NO: 1637769 - DNA, 15 bp, Homo sapiens
agccgagggcgtcag

SEQ ID NO: 1637770 - DNA, 19 bp, Homo sapiens
agccgagggcgtcagagag

SEQ ID NO: 1637771 - DNA, 21 bp, Homo sapiens
agccgagggcgtcagagagac

SEQ ID NO: 1637772 - DNA, 16 bp, Homo sapiens
agccgaggggagagag

SEQ ID NO: 1637773 - DNA, 19 bp, Homo sapiens
agccgaggggagagaggga

SEQ ID NO: 1637774 - DNA, 20 bp, Homo sapiens
agccgcaccctgcacctgct

SEQ ID NO: 1637775 - DNA, 22 bp, Homo sapiens
agccgcaccctgcacctgctgc

SEQ ID NO: 1637776 - DNA, 16 bp, Homo sapiens
agccgcatcttctcca

SEQ ID NO: 1637777 - DNA, 13 bp, Homo sapiens
agccgccagctgg

SEQ ID NO: 1637778 - DNA, 14 bp, Homo sapiens
agccgccagctggg

SEQ ID NO: 1637779 - DNA, 22 bp, Homo sapiens
agccgccattgccaccaggaga

SEQ ID NO: 1637780 - DNA, 22 bp, Homo sapiens
agccgctcctgtctgccagcca

SEQ ID NO: 1637781 - DNA, 21 bp, Homo sapiens
agccgctgcagggctcccatg

SEQ ID NO: 1637782 - DNA, 20 bp, Homo sapiens
agccgctggcaacaacagct

SEQ ID NO: 1637783 - DNA, 15 bp, Homo sapiens
agccggcacagggtc

SEQ ID NO: 1637784 - DNA, 14 bp, Homo sapiens
agccggcctctctg

SEQ ID NO: 1637785 - DNA, 22 bp, Homo sapiens
agccggcctctctggcctccca

SEQ ID NO: 1637786 - DNA, 23 bp, Homo sapiens
agccgggaacagacaacagaagt

SEQ ID NO: 1637787 - DNA, 13 bp, Homo sapiens
agccgggagccaa

SEQ ID NO: 1637788 - DNA, 12 bp, Homo sapiens
agccgggcacag

SEQ ID NO: 1637789 - DNA, 16 bp, Homo sapiens
agccgggcccctgggc

SEQ ID NO: 1637790 - DNA, 11 bp, Homo sapiens
agccgggccgc

SEQ ID NO: 1637791 - DNA, 14 bp, Homo sapiens
agccgggccgcaga

SEQ ID NO: 1637792 - DNA, 13 bp, Homo sapiens
agccgggcctccc

SEQ ID NO: 1637793 - DNA, 13 bp, Homo sapiens
agccgggcctggg

SEQ ID NO: 1637794 - DNA, 19 bp, Homo sapiens
agccgggcctggggctcct

SEQ ID NO: 1637795 - DNA, 22 bp, Homo sapiens
agccgggcgtggtggcgggcac

SEQ ID NO: 1637796 - DNA, 23 bp, Homo sapiens
agccggggccttatcgggctcca

SEQ ID NO: 1637797 - DNA, 21 bp, Homo sapiens
agccggggtgtaacttcctgc

SEQ ID NO: 1637798 - DNA, 16 bp, Homo sapiens
agccggtaactgtcct

SEQ ID NO: 1637799 - DNA, 21 bp, Homo sapiens
agccggtaactgtcctgtcct

SEQ ID NO: 1637800 - DNA, 13 bp, Homo sapiens
agccggtggtgcc

SEQ ID NO: 1637801 - DNA, 15 bp, Homo sapiens
agccgtattttacat

SEQ ID NO: 1637802 - DNA, 16 bp, Homo sapiens
agccgtcagccaaatg

SEQ ID NO: 1637803 - DNA, 20 bp, Homo sapiens
agccgtcagccaaatgtaat

SEQ ID NO: 1637804 - DNA, 15 bp, Homo sapiens
agccgtccatggcac

SEQ ID NO: 1637805 - DNA, 19 bp, Homo sapiens
agccgtccatggcaccagc

SEQ ID NO: 1637806 - DNA, 13 bp, Homo sapiens
agccgtcccaggc

SEQ ID NO: 1637807 - DNA, 20 bp, Homo sapiens
agccgtcccgcgttcaagac

SEQ ID NO: 1637808 - DNA, 22 bp, Homo sapiens
agccgtcccgcgttcaagactt

SEQ ID NO: 1637809 - DNA, 13 bp, Homo sapiens
agccgtcctggcg

SEQ ID NO: 1637810 - DNA, 23 bp, Homo sapiens
agccgtcctggcgcctggcagtc

SEQ ID NO: 1637811 - DNA, 21 bp, Homo sapiens
agccgtctgactccagagtct

SEQ ID NO: 1637812 - DNA, 23 bp, Homo sapiens
agccgtctgactccagagtctga

SEQ ID NO: 1637813 - DNA, 17 bp, Homo sapiens
agccgtgatgctcaggc

SEQ ID NO: 1637814 - DNA, 19 bp, Homo sapiens
agccgtgatgctcaggctt

SEQ ID NO: 1637815 - DNA, 16 bp, Homo sapiens
agcctaaagattttga

SEQ ID NO: 1637816 - DNA, 15 bp, Homo sapiens
agcctaaagggcagg

SEQ ID NO: 1637817 - DNA, 16 bp, Homo sapiens
agcctaaagggcaggg

SEQ ID NO: 1637818 - DNA, 18 bp, Homo sapiens
agcctaaagggcagggcc

SEQ ID NO: 1637819 - DNA, 22 bp, Homo sapiens
agcctaaagggcagggcccacg

SEQ ID NO: 1637820 - DNA, 12 bp, Homo sapiens
agcctaaatgat

SEQ ID NO: 1637821 - DNA, 19 bp, Homo sapiens
agcctaaatttgtgctttt

SEQ ID NO: 1637822 - DNA, 21 bp, Homo sapiens
agcctaaatttgtgcttttta

SEQ ID NO: 1637823 - DNA, 17 bp, Homo sapiens
agcctaagatatacttg

SEQ ID NO: 1637824 - DNA, 16 bp, Homo sapiens
agcctaagggatcctg

SEQ ID NO: 1637825 - DNA, 15 bp, Homo sapiens
agcctaatccctggg

SEQ ID NO: 1637826 - DNA, 22 bp, Homo sapiens
agcctaatccctgggcattgct

SEQ ID NO: 1637827 - DNA, 23 bp, Homo sapiens
agcctaatccctgggcattgctt

SEQ ID NO: 1637828 - DNA, 12 bp, Homo sapiens
agcctaatgaaa

SEQ ID NO: 1637829 - DNA, 16 bp, Homo sapiens
agcctacaagctggca

SEQ ID NO: 1637830 - DNA, 19 bp, Homo sapiens
agcctacattttagtttct

SEQ ID NO: 1637831 - DNA, 13 bp, Homo sapiens
agcctaccccctg

SEQ ID NO: 1637832 - DNA, 13 bp, Homo sapiens
agcctactctcct

SEQ ID NO: 1637833 - DNA, 15 bp, Homo sapiens
agcctagccacctcc

SEQ ID NO: 1637834 - DNA, 16 bp, Homo sapiens
agcctagccacctccc

SEQ ID NO: 1637835 - DNA, 22 bp, Homo sapiens
agcctagccacctcccacccca

SEQ ID NO: 1637836 - DNA, 13 bp, Homo sapiens
agcctagcggagc

SEQ ID NO: 1637837 - DNA, 17 bp, Homo sapiens
agcctagcggagcccag

SEQ ID NO: 1637838 - DNA, 13 bp, Homo sapiens
ctgtcagctgagc

SEQ ID NO: 1637839 - DNA, 14 bp, Homo sapiens
ctgtcaggaagaaa

SEQ ID NO: 1637840 - DNA, 17 bp, Homo sapiens
ctgtcaggaagaaatca

SEQ ID NO: 1637841 - DNA, 22 bp, Homo sapiens
ctgtcagtagtggacattgtaa

SEQ ID NO: 1637842 - DNA, 18 bp, Homo sapiens
ctgtcagtgttaaagatt

SEQ ID NO: 1637843 - DNA, 19 bp, Homo sapiens
ctgtcataagaatgaataa

SEQ ID NO: 1637844 - DNA, 18 bp, Homo sapiens
ctgtcataagcattactt

SEQ ID NO: 1637845 - DNA, 14 bp, Homo sapiens
ctgtcatagaaatt

SEQ ID NO: 1637846 - DNA, 16 bp, Homo sapiens
ctgtcatcactccctg

SEQ ID NO: 1637847 - DNA, 14 bp, Homo sapiens
ctgtcatctttctt

SEQ ID NO: 1637848 - DNA, 20 bp, Homo sapiens
ctgtcatgaacatgttcctg

SEQ ID NO: 1637849 - DNA, 17 bp, Homo sapiens
ctgtcatgcccccctca

SEQ ID NO: 1637850 - DNA, 18 bp, Homo sapiens
ctgtcatgcccccctcaa

SEQ ID NO: 1637851 - DNA, 14 bp, Homo sapiens
ctgtcatggtcctt

SEQ ID NO: 1637852 - DNA, 18 bp, Homo sapiens
ctgtcatggtcctttctg

SEQ ID NO: 1637853 - DNA, 20 bp, Homo sapiens
ctgtcattgcccctccgatg

SEQ ID NO: 1637854 - DNA, 16 bp, Homo sapiens
ctgtcattttgcactg

SEQ ID NO: 1637855 - DNA, 17 bp, Homo sapiens
ctgtcattttgcactgt

SEQ ID NO: 1637856 - DNA, 15 bp, Homo sapiens
ctgtccaaactgcct

SEQ ID NO: 1637857 - DNA, 20 bp, Homo sapiens
ctgtccaaactgcctaagcc

SEQ ID NO: 1637858 - DNA, 21 bp, Homo sapiens
ctgtccaaaggaggctggcag

SEQ ID NO: 1637859 - DNA, 22 bp, Homo sapiens
ctgtccaaaggaggctggcagg

SEQ ID NO: 1637860 - DNA, 16 bp, Homo sapiens
ctgtccaacctaaccc

SEQ ID NO: 1637861 - DNA, 12 bp, Homo sapiens
ctgtccacatcc

SEQ ID NO: 1637862 - DNA, 15 bp, Homo sapiens
ctgtccacatcccca

SEQ ID NO: 1637863 - DNA, 17 bp, Homo sapiens
ctgtccacatccccaga

SEQ ID NO: 1637864 - DNA, 22 bp, Homo sapiens
ctgtccacatgacctccatttc

SEQ ID NO: 1637865 - DNA, 16 bp, Homo sapiens
ctgtccaccctgccaa

SEQ ID NO: 1637866 - DNA, 22 bp, Homo sapiens
ctgtccactctcggggcccttg

SEQ ID NO: 1637867 - DNA, 15 bp, Homo sapiens
ctgtccagcctgggc

SEQ ID NO: 1637868 - DNA, 12 bp, Homo sapiens
ctgtccagctcc

SEQ ID NO: 1637869 - DNA, 14 bp, Homo sapiens
ctgtccaggcagct

SEQ ID NO: 1637870 - DNA, 21 bp, Homo sapiens
ctgtccaggcagctccctcct

SEQ ID NO: 1637871 - DNA, 12 bp, Homo sapiens
ctgtccaggcca

SEQ ID NO: 1637872 - DNA, 14 bp, Homo sapiens
ctgtccaggccact

SEQ ID NO: 1637873 - DNA, 21 bp, Homo sapiens
ctgtccaggccactgtggcca

SEQ ID NO: 1637874 - DNA, 21 bp, Homo sapiens
ctgtccatgtattcacacacc

SEQ ID NO: 1637875 - DNA, 21 bp, Homo sapiens
ctgtccattttcttttaaagt

SEQ ID NO: 1637876 - DNA, 16 bp, Homo sapiens
ctgtcccacaaaatat

SEQ ID NO: 1637877 - DNA, 18 bp, Homo sapiens
ctgtcccaccaactctgc

SEQ ID NO: 1637878 - DNA, 14 bp, Homo sapiens
ctgtcccacccaca

SEQ ID NO: 1637879 - DNA, 15 bp, Homo sapiens
ctgtcccacccacac

SEQ ID NO: 1637880 - DNA, 21 bp, Homo sapiens
ctgtcccacccacacagctgc

SEQ ID NO: 1637881 - DNA, 21 bp, Homo sapiens
ctgtcccagagcttattggcc

SEQ ID NO: 1637882 - DNA, 22 bp, Homo sapiens
ctgtcccagagcttattggcca

SEQ ID NO: 1637883 - DNA, 22 bp, Homo sapiens
ctgtcccagaggttatctgcct

SEQ ID NO: 1637884 - DNA, 20 bp, Homo sapiens
ctgtcccagggccctcccag

SEQ ID NO: 1637885 - DNA, 21 bp, Homo sapiens
ctgtcccagtagccaaggccc

SEQ ID NO: 1637886 - DNA, 16 bp, Homo sapiens
ctgtcccattctagat

SEQ ID NO: 1637887 - DNA, 18 bp, Homo sapiens
ctgtcccccagctctggt

SEQ ID NO: 1637888 - DNA, 14 bp, Homo sapiens
ctgtccccttctct

SEQ ID NO: 1637889 - DNA, 16 bp, Homo sapiens
ctgtccctccaggccc

SEQ ID NO: 1637890 - DNA, 15 bp, Homo sapiens
ctgtccctccccctt

SEQ ID NO: 1637891 - DNA, 19 bp, Homo sapiens
ctgtccctctagtgccttc

SEQ ID NO: 1637892 - DNA, 20 bp, Homo sapiens
ctgtccctctcagtgccttc

SEQ ID NO: 1637893 - DNA, 22 bp, Homo sapiens
ctgtccctctcctatgtggcag

SEQ ID NO: 1637894 - DNA, 13 bp, Homo sapiens
ctgtccctgtagc

SEQ ID NO: 1637895 - DNA, 15 bp, Homo sapiens
ctgtccctgtagctc

SEQ ID NO: 1637896 - DNA, 15 bp, Homo sapiens
ctgtccctgtcacca

SEQ ID NO: 1637897 - DNA, 19 bp, Homo sapiens
ctgtcccttcgagtccagg

SEQ ID NO: 1637898 - DNA, 14 bp, Homo sapiens
ctgtcccttgcctc

SEQ ID NO: 1637899 - DNA, 15 bp, Homo sapiens
ctgtcccttgcctca

SEQ ID NO: 1637900 - DNA, 20 bp, Homo sapiens
ctgtcccttgcctcaatgcc

SEQ ID NO: 1637901 - DNA, 17 bp, Homo sapiens
ctgtcccttgcttgcct

SEQ ID NO: 1637902 - DNA, 18 bp, Homo sapiens
ctgtcccttgcttgcctg

SEQ ID NO: 1637903 - DNA, 23 bp, Homo sapiens
ctgtcctacttctgactttactt

SEQ ID NO: 1637904 - DNA, 13 bp, Homo sapiens
ctgtcctccagag

SEQ ID NO: 1637905 - DNA, 15 bp, Homo sapiens
ctgtcctccagaggg

SEQ ID NO: 1637906 - DNA, 22 bp, Homo sapiens
ctgtcctctcagaactcctgtg

SEQ ID NO: 1637907 - DNA, 13 bp, Homo sapiens
ctgtcctctgtag

SEQ ID NO: 1637908 - DNA, 18 bp, Homo sapiens
ctgtcctcttggccatcc

SEQ ID NO: 1637909 - DNA, 18 bp, Homo sapiens
ctgtcctgacctgtctca

SEQ ID NO: 1637910 - DNA, 14 bp, Homo sapiens
ctgtcctgagcccc

SEQ ID NO: 1637911 - DNA, 11 bp, Homo sapiens
ctgtcctgctc

SEQ ID NO: 1637912 - DNA, 13 bp, Homo sapiens
ctgtcctgctcac

SEQ ID NO: 1637913 - DNA, 13 bp, Homo sapiens
ctgtcctgctgcc

SEQ ID NO: 1637914 - DNA, 15 bp, Homo sapiens
ctgtcctgctgccct

SEQ ID NO: 1637915 - DNA, 17 bp, Homo sapiens
ctgtcctgctgccctcc

SEQ ID NO: 1637916 - DNA, 11 bp, Homo sapiens
ctgtcctgggc

SEQ ID NO: 1637917 - DNA, 20 bp, Homo sapiens
ctgtcctgggcatgggtcca

SEQ ID NO: 1637918 - DNA, 22 bp, Homo sapiens
ctgtcctgggcatgggtccagg

SEQ ID NO: 1637919 - DNA, 23 bp, Homo sapiens
ctgtcctgggcatgggtccaggg

SEQ ID NO: 1637920 - DNA, 18 bp, Homo sapiens
ctgtcctgggcctgcaga

SEQ ID NO: 1637921 - DNA, 16 bp, Homo sapiens
ctgtcctggtggctgg

SEQ ID NO: 1637922 - DNA, 17 bp, Homo sapiens
ctgtcctggtggctggg

SEQ ID NO: 1637923 - DNA, 22 bp, Homo sapiens
ctgtcctggtggctgggcccag

SEQ ID NO: 1637924 - DNA, 22 bp, Homo sapiens
ctgtcctgtacattgtgggatg

SEQ ID NO: 1637925 - DNA, 12 bp, Homo sapiens
ctgtcctgtcct

SEQ ID NO: 1637926 - DNA, 12 bp, Homo sapiens
ctgtcctgtgaa

SEQ ID NO: 1637927 - DNA, 11 bp, Homo sapiens
ctgtccttaac

SEQ ID NO: 1637928 - DNA, 19 bp, Homo sapiens
ctgtccttaacccacctct

SEQ ID NO: 1637929 - DNA, 15 bp, Homo sapiens
ctgtccttcagtctt

SEQ ID NO: 1637930 - DNA, 13 bp, Homo sapiens
ctgtccttgccct

SEQ ID NO: 1637931 - DNA, 12 bp, Homo sapiens
ctgtcctttcct

SEQ ID NO: 1637932 - DNA, 17 bp, Homo sapiens
ctgtcgaaggggaggca

SEQ ID NO: 1637933 - DNA, 20 bp, Homo sapiens
ctgtcgaaggggaggcacac

SEQ ID NO: 1637934 - DNA, 14 bp, Homo sapiens
ctgtcgagacactt

SEQ ID NO: 1637935 - DNA, 15 bp, Homo sapiens
ctgtcgatgtaggca

SEQ ID NO: 1637936 - DNA, 22 bp, Homo sapiens
ctgtcgcgtctcattttgtcca

SEQ ID NO: 1637937 - DNA, 14 bp, Homo sapiens
ctgtcggcaccatg

SEQ ID NO: 1637938 - DNA, 18 bp, Homo sapiens
ctgtcgggggctgtggat

SEQ ID NO: 1637939 - DNA, 22 bp, Homo sapiens
ctgtcgtctctcccaccccctc

SEQ ID NO: 1637940 - DNA, 15 bp, Homo sapiens
ctgtcgtgatggggc

SEQ ID NO: 1637941 - DNA, 21 bp, Homo sapiens
ctgtcgtgatggggcaagggc

SEQ ID NO: 1637942 - DNA, 12 bp, Homo sapiens
ctgtcgtgccag

SEQ ID NO: 1637943 - DNA, 15 bp, Homo sapiens
ctgtcgtgccagtcc

SEQ ID NO: 1637944 - DNA, 22 bp, Homo sapiens
ctgtcgttctccacccaccagt

SEQ ID NO: 1637945 - DNA, 13 bp, Homo sapiens
ctgtctaaaaaac

SEQ ID NO: 1637946 - DNA, 13 bp, Homo sapiens
ctgtctaactgct

SEQ ID NO: 1637947 - DNA, 14 bp, Homo sapiens
ctgtctaagcagtt

SEQ ID NO: 1637948 - DNA, 21 bp, Homo sapiens
ctgtctacagtagctgctacc

SEQ ID NO: 1637949 - DNA, 11 bp, Homo sapiens
ctgtctacatt

SEQ ID NO: 1637950 - DNA, 14 bp, Homo sapiens
ctgtctacatttct

SEQ ID NO: 1637951 - DNA, 15 bp, Homo sapiens
ctgtctactgtggtg

SEQ ID NO: 1637952 - DNA, 13 bp, Homo sapiens
ctgtctagaatgt

SEQ ID NO: 1637953 - DNA, 13 bp, Homo sapiens
ctgtctaggactg

SEQ ID NO: 1637954 - DNA, 15 bp, Homo sapiens
ctgtctaggactgca

SEQ ID NO: 1637955 - DNA, 20 bp, Homo sapiens
ctgtctaggactgcagtgtg

SEQ ID NO: 1637956 - DNA, 19 bp, Homo sapiens
ctggtggggctgtcctgct

SEQ ID NO: 1637957 - DNA, 21 bp, Homo sapiens
ctggtggggctgtcctgctgc

SEQ ID NO: 1637958 - DNA, 23 bp, Homo sapiens
ctggtggggtgtgcatgccacgc

SEQ ID NO: 1637959 - DNA, 16 bp, Homo sapiens
ctggtgggtcagccca

SEQ ID NO: 1637960 - DNA, 19 bp, Homo sapiens
ctggtgggtggtgtcctga

SEQ ID NO: 1637961 - DNA, 19 bp, Homo sapiens
ctggtggtaccattattat

SEQ ID NO: 1637962 - DNA, 22 bp, Homo sapiens
ctggtggtctgttggcaggctg

SEQ ID NO: 1637963 - DNA, 17 bp, Homo sapiens
ctggtggttaaggccag

SEQ ID NO: 1637964 - DNA, 18 bp, Homo sapiens
ctggtggttaaggccagg

SEQ ID NO: 1637965 - DNA, 20 bp, Homo sapiens
ctggtggttaaggccagggc

SEQ ID NO: 1637966 - DNA, 15 bp, Homo sapiens
ctggtgtaggaagtt

SEQ ID NO: 1637967 - DNA, 16 bp, Homo sapiens
ctggtgtagtcttttt

SEQ ID NO: 1637968 - DNA, 16 bp, Homo sapiens
ctggtgtcctgaccac

SEQ ID NO: 1637969 - DNA, 21 bp, Homo sapiens
ctggtgtcctgaccaccctcc

SEQ ID NO: 1637970 - DNA, 22 bp, Homo sapiens
ctggtgtcctgaccaccctccc

SEQ ID NO: 1637971 - DNA, 18 bp, Homo sapiens
ctggtgtgtggtgagggg

SEQ ID NO: 1637972 - DNA, 21 bp, Homo sapiens
ctggtgtgtggtgaggggctt

SEQ ID NO: 1637973 - DNA, 23 bp, Homo sapiens
ctggtgtgtggtgaggggctttc

SEQ ID NO: 1637974 - DNA, 14 bp, Homo sapiens
ctggtgtttcttga

SEQ ID NO: 1637975 - DNA, 19 bp, Homo sapiens
ctggttaaaaaacaaatgt

SEQ ID NO: 1637976 - DNA, 12 bp, Homo sapiens
ctggttaaatta

SEQ ID NO: 1637977 - DNA, 23 bp, Homo sapiens
ctggttatagttgatatgtaaca

SEQ ID NO: 1637978 - DNA, 22 bp, Homo sapiens
ctggttcaaacgggtgcctggt

SEQ ID NO: 1637979 - DNA, 18 bp, Homo sapiens
ctggttccagggtccctc

SEQ ID NO: 1637980 - DNA, 20 bp, Homo sapiens
ctggttccatttttcctctg

SEQ ID NO: 1637981 - DNA, 21 bp, Homo sapiens
ctggttcccgtttctccacct

SEQ ID NO: 1637982 - DNA, 18 bp, Homo sapiens
ctggttccgccaggcgct

SEQ ID NO: 1637983 - DNA, 17 bp, Homo sapiens
ctggttcctagatgtgt

SEQ ID NO: 1637984 - DNA, 12 bp, Homo sapiens
ctggttcctgct

SEQ ID NO: 1637985 - DNA, 16 bp, Homo sapiens
ctggttcctgctgtcc

SEQ ID NO: 1637986 - DNA, 17 bp, Homo sapiens
ctggttcctgctgtcct

SEQ ID NO: 1637987 - DNA, 22 bp, Homo sapiens
ctggttcctgctgtcctggtgg

SEQ ID NO: 1637988 - DNA, 19 bp, Homo sapiens
ctggttcctttcatctctc

SEQ ID NO: 1637989 - DNA, 21 bp, Homo sapiens
ctggttcggatttggggtgga

SEQ ID NO: 1637990 - DNA, 16 bp, Homo sapiens
ctggttctatttaatg

SEQ ID NO: 1637991 - DNA, 20 bp, Homo sapiens
ctggttctcatctttcttga

SEQ ID NO: 1637992 - DNA, 22 bp, Homo sapiens
ctggttctgtctagactggcct

SEQ ID NO: 1637993 - DNA, 12 bp, Homo sapiens
ctggttgatttg

SEQ ID NO: 1637994 - DNA, 21 bp, Homo sapiens
ctggttgatttgtaacacagt

SEQ ID NO: 1637995 - DNA, 12 bp, Homo sapiens
ctggttgtattt

SEQ ID NO: 1637996 - DNA, 13 bp, Homo sapiens
ctggttgtcattt

SEQ ID NO: 1637997 - DNA, 14 bp, Homo sapiens
ctggttgtcatttt

SEQ ID NO: 1637998 - DNA, 20 bp, Homo sapiens
ctggttgttcctgcatcccg

SEQ ID NO: 1637999 - DNA, 19 bp, Homo sapiens
ctggttgtttttgttcttt

SEQ ID NO: 1638000 - DNA, 15 bp, Homo sapiens
ctggtttacacttta

SEQ ID NO: 1638001 - DNA, 19 bp, Homo sapiens
ctggtttacttctttagca

SEQ ID NO: 1638002 - DNA, 21 bp, Homo sapiens
ctggtttgtcaaacaacatgt

SEQ ID NO: 1638003 - DNA, 20 bp, Homo sapiens
ctggttttctggtggggctg

SEQ ID NO: 1638004 - DNA, 20 bp, Homo sapiens
ctggttttgtaagatgctgg

SEQ ID NO: 1638005 - DNA, 21 bp, Homo sapiens
ctggttttgtaagatgctggg

SEQ ID NO: 1638006 - DNA, 17 bp, Homo sapiens
ctgtaaaaaatggagct

SEQ ID NO: 1638007 - DNA, 16 bp, Homo sapiens
ctgtaaaatgaaatta

SEQ ID NO: 1638008 - DNA, 20 bp, Homo sapiens
ctgtaaaatgcaaaaaatct

SEQ ID NO: 1638009 - DNA, 12 bp, Homo sapiens
ctgtaaactgtg

SEQ ID NO: 1638010 - DNA, 14 bp, Homo sapiens
ctgtaaactgtgta

SEQ ID NO: 1638011 - DNA, 16 bp, Homo sapiens
ctgtaaagatgtttat

SEQ ID NO: 1638012 - DNA, 18 bp, Homo sapiens
ctgtaaataaaatgtgta

SEQ ID NO: 1638013 - DNA, 21 bp, Homo sapiens
ctgtaaataaaatgtgtacag

SEQ ID NO: 1638014 - DNA, 23 bp, Homo sapiens
ctgtaaataaaatgtgtacagtg

SEQ ID NO: 1638015 - DNA, 11 bp, Homo sapiens
ctgtaaataac

SEQ ID NO: 1638016 - DNA, 12 bp, Homo sapiens
ctgtaaataaga

SEQ ID NO: 1638017 - DNA, 21 bp, Homo sapiens
ctgtaaatatgtttgtgcctt

SEQ ID NO: 1638018 - DNA, 23 bp, Homo sapiens
ctgtaaatatgtttgtgccttaa

SEQ ID NO: 1638019 - DNA, 17 bp, Homo sapiens
ctgtaaatggtgtacat

SEQ ID NO: 1638020 - DNA, 21 bp, Homo sapiens
ctgtaaatggtgtacataatg

SEQ ID NO: 1638021 - DNA, 23 bp, Homo sapiens
ctgtaaattgctggcagatgctt

SEQ ID NO: 1638022 - DNA, 19 bp, Homo sapiens
ctgtaacatactggcctgg

SEQ ID NO: 1638023 - DNA, 15 bp, Homo sapiens
ctgtaacattcagga

SEQ ID NO: 1638024 - DNA, 16 bp, Homo sapiens
ctgtaactattgggtg

SEQ ID NO: 1638025 - DNA, 19 bp, Homo sapiens
ctgtaactctaaaagatcc

SEQ ID NO: 1638026 - DNA, 17 bp, Homo sapiens
ctgtaactgagagaaag

SEQ ID NO: 1638027 - DNA, 16 bp, Homo sapiens
ctgtaactgctgagcc

SEQ ID NO: 1638028 - DNA, 17 bp, Homo sapiens
ctgtaactgctgagcca

SEQ ID NO: 1638029 - DNA, 14 bp, Homo sapiens
ctgtaactgtcagt

SEQ ID NO: 1638030 - DNA, 16 bp, Homo sapiens
ctgtaacttaaaatag

SEQ ID NO: 1638031 - DNA, 17 bp, Homo sapiens
ctgtaagaagagactgg

SEQ ID NO: 1638032 - DNA, 23 bp, Homo sapiens
ctgtaagaagagactgggaagat

SEQ ID NO: 1638033 - DNA, 12 bp, Homo sapiens
ctgtaagagctt

SEQ ID NO: 1638034 - DNA, 20 bp, Homo sapiens
ctgtaagagcttgctccaga

SEQ ID NO: 1638035 - DNA, 15 bp, Homo sapiens
ctgtaaggctctaga

SEQ ID NO: 1638036 - DNA, 16 bp, Homo sapiens
ctgtaaggctctagat

SEQ ID NO: 1638037 - DNA, 18 bp, Homo sapiens
ctgtaaggctctagatca

SEQ ID NO: 1638038 - DNA, 22 bp, Homo sapiens
ctgtaaggctctagatcataag

SEQ ID NO: 1638039 - DNA, 13 bp, Homo sapiens
ctgtaagggcagt

SEQ ID NO: 1638040 - DNA, 16 bp, Homo sapiens
ctgtaagggcagtgcc

SEQ ID NO: 1638041 - DNA, 17 bp, Homo sapiens
ctgtaagggcagtgccc

SEQ ID NO: 1638042 - DNA, 14 bp, Homo sapiens
ctgtaagtttattt

SEQ ID NO: 1638043 - DNA, 21 bp, Homo sapiens
ctgtaataactagaacaaata

SEQ ID NO: 1638044 - DNA, 14 bp, Homo sapiens
ctgtaatattgtaa

SEQ ID NO: 1638045 - DNA, 17 bp, Homo sapiens
ctgtaatcagcaataaa

SEQ ID NO: 1638046 - DNA, 13 bp, Homo sapiens
ctgtaatcccaga

SEQ ID NO: 1638047 - DNA, 16 bp, Homo sapiens
ctgtaatcccagcact

SEQ ID NO: 1638048 - DNA, 20 bp, Homo sapiens
ctgtaatcccagcactttgg

SEQ ID NO: 1638049 - DNA, 15 bp, Homo sapiens
ctgtaatcccagcag

SEQ ID NO: 1638050 - DNA, 19 bp, Homo sapiens
ctgtaatcccagctactca

SEQ ID NO: 1638051 - DNA, 16 bp, Homo sapiens
ctgtaatgacaaaaga

SEQ ID NO: 1638052 - DNA, 14 bp, Homo sapiens
ctgtaatgtaaata

SEQ ID NO: 1638053 - DNA, 16 bp, Homo sapiens
ctgtaatgtaaataaa

SEQ ID NO: 1638054 - DNA, 16 bp, Homo sapiens
ctgtaatgtttcacag

SEQ ID NO: 1638055 - DNA, 18 bp, Homo sapiens
ctgtaatttcgccttaaa

SEQ ID NO: 1638056 - DNA, 23 bp, Homo sapiens
ctgtacacattcctgcattcatg

SEQ ID NO: 1638057 - DNA, 21 bp, Homo sapiens
ctgtacactgacttgagacca

SEQ ID NO: 1638058 - DNA, 16 bp, Homo sapiens
ctgtacagatcaagaa

SEQ ID NO: 1638059 - DNA, 14 bp, Homo sapiens
ctgtacatttaaaa

SEQ ID NO: 1638060 - DNA, 16 bp, Homo sapiens
ctgtacatttaaaatt

SEQ ID NO: 1638061 - DNA, 16 bp, Homo sapiens
ctgtacatttgtgctc

SEQ ID NO: 1638062 - DNA, 14 bp, Homo sapiens
ctgtaccacatctg

SEQ ID NO: 1638063 - DNA, 18 bp, Homo sapiens
ctgtaccagttaattttt

SEQ ID NO: 1638064 - DNA, 13 bp, Homo sapiens
ctgtaccatattc

SEQ ID NO: 1638065 - DNA, 14 bp, Homo sapiens
ctgtacctctgcct

SEQ ID NO: 1638066 - DNA, 14 bp, Homo sapiens
ctgtacgaaaaaga

SEQ ID NO: 1638067 - DNA, 23 bp, Homo sapiens
ctgtactatcctgtaaatatatc

SEQ ID NO: 1638068 - DNA, 23 bp, Homo sapiens
ctgtactattgcagacctgtcac

SEQ ID NO: 1638069 - DNA, 13 bp, Homo sapiens
ctgtactcagagc

SEQ ID NO: 1638070 - DNA, 15 bp, Homo sapiens
ctgtactcagagcag

SEQ ID NO: 1638071 - DNA, 16 bp, Homo sapiens
ctgtactcagagcaga

SEQ ID NO: 1638072 - DNA, 14 bp, Homo sapiens
agccagctccctct

SEQ ID NO: 1638073 - DNA, 19 bp, Homo sapiens
agccagctcctgggcagct

SEQ ID NO: 1638074 - DNA, 16 bp, Homo sapiens
agccagctctgcatta

SEQ ID NO: 1638075 - DNA, 14 bp, Homo sapiens
agccagctgcttga

SEQ ID NO: 1638076 - DNA, 14 bp, Homo sapiens
agccagctgctttt

SEQ ID NO: 1638077 - DNA, 13 bp, Homo sapiens
agccagcttaaac

SEQ ID NO: 1638078 - DNA, 13 bp, Homo sapiens
agccagctttccc

SEQ ID NO: 1638079 - DNA, 22 bp, Homo sapiens
agccaggaatttcccaggaccc

SEQ ID NO: 1638080 - DNA, 18 bp, Homo sapiens
aacagccaagacccaaca

SEQ ID NO: 1638081 - DNA, 20 bp, Homo sapiens
aacagccgctcctgtctgcc

SEQ ID NO: 1638082 - DNA, 21 bp, Homo sapiens
aacagccgctcctgtctgcca

SEQ ID NO: 1638083 - DNA, 20 bp, Homo sapiens
aacagcgggagacctgtgct

SEQ ID NO: 1638084 - DNA, 17 bp, Homo sapiens
aacagcgtcttccttct

SEQ ID NO: 1638085 - DNA, 18 bp, Homo sapiens
aacagctatgggagcccc

SEQ ID NO: 1638086 - DNA, 19 bp, Homo sapiens
aacagctatgggagcccca

SEQ ID NO: 1638087 - DNA, 18 bp, Homo sapiens
aacagctcaagtcttccc

SEQ ID NO: 1638088 - DNA, 11 bp, Homo sapiens
aacagctcagc

SEQ ID NO: 1638089 - DNA, 18 bp, Homo sapiens
aacagctcagccagtggg

SEQ ID NO: 1638090 - DNA, 16 bp, Homo sapiens
aacagctgcattagaa

SEQ ID NO: 1638091 - DNA, 22 bp, Homo sapiens
aacagcttcatgcctttgtaag

SEQ ID NO: 1638092 - DNA, 20 bp, Homo sapiens
aacaggaatccttactgata

SEQ ID NO: 1638093 - DNA, 15 bp, Homo sapiens
aacaggaatctcaga

SEQ ID NO: 1638094 - DNA, 19 bp, Homo sapiens
aacaggacttaaaatgaca

SEQ ID NO: 1638095 - DNA, 16 bp, Homo sapiens
aacaggattgatcatt

SEQ ID NO: 1638096 - DNA, 11 bp, Homo sapiens
aacaggcccag

SEQ ID NO: 1638097 - DNA, 21 bp, Homo sapiens
aacagggagaagtagctagta

SEQ ID NO: 1638098 - DNA, 14 bp, Homo sapiens
aacagggctgcctt

SEQ ID NO: 1638099 - DNA, 16 bp, Homo sapiens
aacaggggaggaaaaa

SEQ ID NO: 1638100 - DNA, 21 bp, Homo sapiens
aacaggggaggaaaaaagaac

SEQ ID NO: 1638101 - DNA, 17 bp, Homo sapiens
aacaggtatatactttg

SEQ ID NO: 1638102 - DNA, 18 bp, Homo sapiens
aacaggtatatactttga

SEQ ID NO: 1638103 - DNA, 20 bp, Homo sapiens
aacaggtatttttttaaatc

SEQ ID NO: 1638104 - DNA, 22 bp, Homo sapiens
aacaggttcttaaaaaggaaca

SEQ ID NO: 1638105 - DNA, 21 bp, Homo sapiens
aacagtatgtgggatattgaa

SEQ ID NO: 1638106 - DNA, 17 bp, Homo sapiens
aacagtcaaaacagaga

SEQ ID NO: 1638107 - DNA, 13 bp, Homo sapiens
aacagtcatttaa

SEQ ID NO: 1638108 - DNA, 14 bp, Homo sapiens
aacagtctcaggaa

SEQ ID NO: 1638109 - DNA, 17 bp, Homo sapiens
aacagtctcaggaaatc

SEQ ID NO: 1638110 - DNA, 19 bp, Homo sapiens
aacagtctcaggaaatcaa

SEQ ID NO: 1638111 - DNA, 21 bp, Homo sapiens
aacagtctcattacagattta

SEQ ID NO: 1638112 - DNA, 18 bp, Homo sapiens
aacagtgtttcccataat

SEQ ID NO: 1638113 - DNA, 19 bp, Homo sapiens
aacagtgtttcccataatt

SEQ ID NO: 1638114 - DNA, 15 bp, Homo sapiens
aacagttatattttt

SEQ ID NO: 1638115 - DNA, 23 bp, Homo sapiens
aacagttcatgtttgcttcataa

SEQ ID NO: 1638116 - DNA, 18 bp, Homo sapiens
aacagttgcatgtagtaa

SEQ ID NO: 1638117 - DNA, 22 bp, Homo sapiens
aacagttgcatgtagtaacact

SEQ ID NO: 1638118 - DNA, 21 bp, Homo sapiens
aacagttggtaacttttgtga

SEQ ID NO: 1638119 - DNA, 23 bp, Homo sapiens
aacagttgtatttaacagaaatt

SEQ ID NO: 1638120 - DNA, 17 bp, Homo sapiens
aacagttttgtgtaact

SEQ ID NO: 1638121 - DNA, 15 bp, Homo sapiens
aacataaaaactgat

SEQ ID NO: 1638122 - DNA, 14 bp, Homo sapiens
aacataaagttgta

SEQ ID NO: 1638123 - DNA, 21 bp, Homo sapiens
aacataaattttttgaagtct

SEQ ID NO: 1638124 - DNA, 17 bp, Homo sapiens
aacataactgcttcttg

SEQ ID NO: 1638125 - DNA, 20 bp, Homo sapiens
aacataatcttctgccttct

SEQ ID NO: 1638126 - DNA, 12 bp, Homo sapiens
aacataattaaa

SEQ ID NO: 1638127 - DNA, 18 bp, Homo sapiens
aacatacaagaaaatgta

SEQ ID NO: 1638128 - DNA, 21 bp, Homo sapiens
aacatacgtgtgcatgtgtct

SEQ ID NO: 1638129 - DNA, 23 bp, Homo sapiens
aacatagaaatggaaattttgct

SEQ ID NO: 1638130 - DNA, 21 bp, Homo sapiens
aacatagcagatctgttttgt

SEQ ID NO: 1638131 - DNA, 18 bp, Homo sapiens
aacatataatgttgttat

SEQ ID NO: 1638132 - DNA, 12 bp, Homo sapiens
aacatatatgga

SEQ ID NO: 1638133 - DNA, 16 bp, Homo sapiens
aacatatctaaagtca

SEQ ID NO: 1638134 - DNA, 17 bp, Homo sapiens
aacatatgaaaatacaa

SEQ ID NO: 1638135 - DNA, 13 bp, Homo sapiens
aacatattcatga

SEQ ID NO: 1638136 - DNA, 16 bp, Homo sapiens
aacatatttttatact

SEQ ID NO: 1638137 - DNA, 21 bp, Homo sapiens
aacatatttttatactttatt

SEQ ID NO: 1638138 - DNA, 19 bp, Homo sapiens
aacatcacctatttaatgt

SEQ ID NO: 1638139 - DNA, 14 bp, Homo sapiens
aacatcactccctc

SEQ ID NO: 1638140 - DNA, 15 bp, Homo sapiens
aacatcactccctct

SEQ ID NO: 1638141 - DNA, 14 bp, Homo sapiens
aacatcataattac

SEQ ID NO: 1638142 - DNA, 21 bp, Homo sapiens
aacatcataattacattccta

SEQ ID NO: 1638143 - DNA, 15 bp, Homo sapiens
aacatcattgcataa

SEQ ID NO: 1638144 - DNA, 17 bp, Homo sapiens
aacatccaagccagagt

SEQ ID NO: 1638145 - DNA, 15 bp, Homo sapiens
aacatccaagtcttt

SEQ ID NO: 1638146 - DNA, 22 bp, Homo sapiens
aacatccaagtctttcttcttt

SEQ ID NO: 1638147 - DNA, 19 bp, Homo sapiens
aacatcccattgccctggt

SEQ ID NO: 1638148 - DNA, 15 bp, Homo sapiens
aacatccttccttcc

SEQ ID NO: 1638149 - DNA, 18 bp, Homo sapiens
aacatcgcaatagttttt

SEQ ID NO: 1638150 - DNA, 23 bp, Homo sapiens
aacatctctgcagtttttcccaa

SEQ ID NO: 1638151 - DNA, 12 bp, Homo sapiens
aacatctctggc

SEQ ID NO: 1638152 - DNA, 15 bp, Homo sapiens
aacatgaaactgcct

SEQ ID NO: 1638153 - DNA, 20 bp, Homo sapiens
aacatgaaagtctagaaata

SEQ ID NO: 1638154 - DNA, 22 bp, Homo sapiens
aacatgaacacccttagaaaat

SEQ ID NO: 1638155 - DNA, 18 bp, Homo sapiens
aacatgaccactcttggc

SEQ ID NO: 1638156 - DNA, 17 bp, Homo sapiens
aacatgacccagcctga

SEQ ID NO: 1638157 - DNA, 16 bp, Homo sapiens
aacatgaggacagaag

SEQ ID NO: 1638158 - DNA, 14 bp, Homo sapiens
aacatgatgaaacc

SEQ ID NO: 1638159 - DNA, 14 bp, Homo sapiens
aacatgcacattta

SEQ ID NO: 1638160 - DNA, 17 bp, Homo sapiens
aacatgcacattttgta

SEQ ID NO: 1638161 - DNA, 14 bp, Homo sapiens
aacatgcactgatg

SEQ ID NO: 1638162 - DNA, 19 bp, Homo sapiens
aacatgcactgatgttgtg

SEQ ID NO: 1638163 - DNA, 17 bp, Homo sapiens
aacatgccgcagggagg

SEQ ID NO: 1638164 - DNA, 22 bp, Homo sapiens
aacatgctggtgaatattttca

SEQ ID NO: 1638165 - DNA, 17 bp, Homo sapiens
aacatgcttttacttta

SEQ ID NO: 1638166 - DNA, 20 bp, Homo sapiens
aacatggagaaaccctgtct

SEQ ID NO: 1638167 - DNA, 14 bp, Homo sapiens
aacatggagaaatc

SEQ ID NO: 1638168 - DNA, 21 bp, Homo sapiens
aacatggtgcctatatctgag

SEQ ID NO: 1638169 - DNA, 22 bp, Homo sapiens
agccaaatctgacctaaaagtt

SEQ ID NO: 1638170 - DNA, 20 bp, Homo sapiens
agccaaatgaccgagccctg

SEQ ID NO: 1638171 - DNA, 21 bp, Homo sapiens
agccaaatgaccgagccctgg

SEQ ID NO: 1638172 - DNA, 13 bp, Homo sapiens
agccaaatttaaa

SEQ ID NO: 1638173 - DNA, 15 bp, Homo sapiens
gataaagatatcaat

SEQ ID NO: 1638174 - DNA, 22 bp, Homo sapiens
gataaagatgcaaggaccagga

SEQ ID NO: 1638175 - DNA, 16 bp, Homo sapiens
gataaagattgtgtgg

SEQ ID NO: 1638176 - DNA, 14 bp, Homo sapiens
gataaagcacagct

SEQ ID NO: 1638177 - DNA, 19 bp, Homo sapiens
gataaagccactgaaaatt

SEQ ID NO: 1638178 - DNA, 21 bp, Homo sapiens
gataaagccacttctggcttc

SEQ ID NO: 1638179 - DNA, 14 bp, Homo sapiens
gataaagttcctta

SEQ ID NO: 1638180 - DNA, 14 bp, Homo sapiens
gataaagtttctca

SEQ ID NO: 1638181 - DNA, 18 bp, Homo sapiens
gataaataatcggcccac

SEQ ID NO: 1638182 - DNA, 16 bp, Homo sapiens
gataaatcctctattg

SEQ ID NO: 1638183 - DNA, 22 bp, Homo sapiens
gataaatccttaacatttctct

SEQ ID NO: 1638184 - DNA, 15 bp, Homo sapiens
gataaatgattcaaa

SEQ ID NO: 1638185 - DNA, 13 bp, Homo sapiens
gataaattataag

SEQ ID NO: 1638186 - DNA, 16 bp, Homo sapiens
gataaattccactgga

SEQ ID NO: 1638187 - DNA, 23 bp, Homo sapiens
gataacaaccttttacattgtga

SEQ ID NO: 1638188 - DNA, 15 bp, Homo sapiens
gataacaagatcttt

SEQ ID NO: 1638189 - DNA, 20 bp, Homo sapiens
gataacagggattgatttta

SEQ ID NO: 1638190 - DNA, 16 bp, Homo sapiens
gataaccttgaaaaaa

SEQ ID NO: 1638191 - DNA, 15 bp, Homo sapiens
gataactagccagac

SEQ ID NO: 1638192 - DNA, 17 bp, Homo sapiens
gataactctctttcctt

SEQ ID NO: 1638193 - DNA, 15 bp, Homo sapiens
gataacttactgtat

SEQ ID NO: 1638194 - DNA, 16 bp, Homo sapiens
gataacttggggaggc

SEQ ID NO: 1638195 - DNA, 21 bp, Homo sapiens
gataaggaaacacttctattt

SEQ ID NO: 1638196 - DNA, 18 bp, Homo sapiens
gataagggactgatgttt

SEQ ID NO: 1638197 - DNA, 19 bp, Homo sapiens
gataagtgttcttcagtgt

SEQ ID NO: 1638198 - DNA, 21 bp, Homo sapiens
gataagtgttcttcagtgtaa

SEQ ID NO: 1638199 - DNA, 23 bp, Homo sapiens
gataagttcttatgccatgttaa

SEQ ID NO: 1638200 - DNA, 16 bp, Homo sapiens
gataagttggagcagg

SEQ ID NO: 1638201 - DNA, 19 bp, Homo sapiens
gataataactgtcttctgg

SEQ ID NO: 1638202 - DNA, 20 bp, Homo sapiens
gataataactgtcttctgga

SEQ ID NO: 1638203 - DNA, 11 bp, Homo sapiens
gataataataa

SEQ ID NO: 1638204 - DNA, 22 bp, Homo sapiens
gataataatactgacctacctc

SEQ ID NO: 1638205 - DNA, 12 bp, Homo sapiens
gataatagattc

SEQ ID NO: 1638206 - DNA, 19 bp, Homo sapiens
gataatatataaacaataa

SEQ ID NO: 1638207 - DNA, 20 bp, Homo sapiens
gataatattgtctgtctcta

SEQ ID NO: 1638208 - DNA, 22 bp, Homo sapiens
gataatattgtttggtaaatgt

SEQ ID NO: 1638209 - DNA, 22 bp, Homo sapiens
gataatatttttgtatttctct

SEQ ID NO: 1638210 - DNA, 15 bp, Homo sapiens
gataatcaggaaaaa

SEQ ID NO: 1638211 - DNA, 20 bp, Homo sapiens
gataatgaaataatcagtga

SEQ ID NO: 1638212 - DNA, 22 bp, Homo sapiens
gataatgataggtaatttagat

SEQ ID NO: 1638213 - DNA, 19 bp, Homo sapiens
gataatgctgttgcctcat

SEQ ID NO: 1638214 - DNA, 14 bp, Homo sapiens
gataattcatttgt

SEQ ID NO: 1638215 - DNA, 16 bp, Homo sapiens
gataattcatttgtat

SEQ ID NO: 1638216 - DNA, 22 bp, Homo sapiens
gataattcatttgtattgctta

SEQ ID NO: 1638217 - DNA, 18 bp, Homo sapiens
gataattgcattcatctt

SEQ ID NO: 1638218 - DNA, 17 bp, Homo sapiens
gataattgtgtagtaat

SEQ ID NO: 1638219 - DNA, 19 bp, Homo sapiens
gataattgtgtagtaatgt

SEQ ID NO: 1638220 - DNA, 17 bp, Homo sapiens
gatacaaaagcttttta

SEQ ID NO: 1638221 - DNA, 15 bp, Homo sapiens
ataacaaagggcagc

SEQ ID NO: 1638222 - DNA, 14 bp, Homo sapiens
ataacaactaactt

SEQ ID NO: 1638223 - DNA, 21 bp, Homo sapiens
ataacaactaacttgtttgag

SEQ ID NO: 1638224 - DNA, 18 bp, Homo sapiens
ataacaactatttacata

SEQ ID NO: 1638225 - DNA, 21 bp, Homo sapiens
ataacaactatttttgttgtt

SEQ ID NO: 1638226 - DNA, 14 bp, Homo sapiens
ataacaagatcttt

SEQ ID NO: 1638227 - DNA, 17 bp, Homo sapiens
ataacaagatctttcag

SEQ ID NO: 1638228 - DNA, 19 bp, Homo sapiens
ataacaagatctttcagga

SEQ ID NO: 1638229 - DNA, 17 bp, Homo sapiens
ataacaaggagatttct

SEQ ID NO: 1638230 - DNA, 21 bp, Homo sapiens
ataacaaggagctcaccctgc

SEQ ID NO: 1638231 - DNA, 17 bp, Homo sapiens
ataacaaggtccaagat

SEQ ID NO: 1638232 - DNA, 21 bp, Homo sapiens
ataacaaggtccaagatacct

SEQ ID NO: 1638233 - DNA, 14 bp, Homo sapiens
ataacacagagaga

SEQ ID NO: 1638234 - DNA, 12 bp, Homo sapiens
ataacacatttt

SEQ ID NO: 1638235 - DNA, 23 bp, Homo sapiens
ataacactataaaggttgacaat

SEQ ID NO: 1638236 - DNA, 16 bp, Homo sapiens
ataacactgtgaagag

SEQ ID NO: 1638237 - DNA, 18 bp, Homo sapiens
ataacaggcatttgttca

SEQ ID NO: 1638238 - DNA, 22 bp, Homo sapiens
ataacagggattgattttaaaa

SEQ ID NO: 1638239 - DNA, 19 bp, Homo sapiens
ataacagtcttactgcagg

SEQ ID NO: 1638240 - DNA, 13 bp, Homo sapiens
ataacagttatat

SEQ ID NO: 1638241 - DNA, 18 bp, Homo sapiens
ataacagttatatttttg

SEQ ID NO: 1638242 - DNA, 19 bp, Homo sapiens
ataacagttatatttttgt

SEQ ID NO: 1638243 - DNA, 14 bp, Homo sapiens
ataacatatctaaa

SEQ ID NO: 1638244 - DNA, 14 bp, Homo sapiens
ataacatctgaaaa

SEQ ID NO: 1638245 - DNA, 17 bp, Homo sapiens
ataacatctgaaaagaa

SEQ ID NO: 1638246 - DNA, 20 bp, Homo sapiens
ataacatctgaaaagaaatg

SEQ ID NO: 1638247 - DNA, 21 bp, Homo sapiens
ataacatctgaaaagaaatgc

SEQ ID NO: 1638248 - DNA, 20 bp, Homo sapiens
ataacatgtaattaagtact

SEQ ID NO: 1638249 - DNA, 13 bp, Homo sapiens
ataacattttcta

SEQ ID NO: 1638250 - DNA, 15 bp, Homo sapiens
ataacattttctata

SEQ ID NO: 1638251 - DNA, 20 bp, Homo sapiens
ataaccaaaaaatgtgagct

SEQ ID NO: 1638252 - DNA, 21 bp, Homo sapiens
ataaccacatttaatgggaaa

SEQ ID NO: 1638253 - DNA, 13 bp, Homo sapiens
ataaccacttaaa

SEQ ID NO: 1638254 - DNA, 14 bp, Homo sapiens
ataacctaattaat

SEQ ID NO: 1638255 - DNA, 15 bp, Homo sapiens
ataacctagttaaag

SEQ ID NO: 1638256 - DNA, 19 bp, Homo sapiens
ataacctagttaaagaaag

SEQ ID NO: 1638257 - DNA, 18 bp, Homo sapiens
ataacggttaagaaagca

SEQ ID NO: 1638258 - DNA, 14 bp, Homo sapiens
ataactacctcctc

SEQ ID NO: 1638259 - DNA, 13 bp, Homo sapiens
ataactatgcttt

SEQ ID NO: 1638260 - DNA, 15 bp, Homo sapiens
ataactcatcataaa

SEQ ID NO: 1638261 - DNA, 17 bp, Homo sapiens
ataactcatcataaaat

SEQ ID NO: 1638262 - DNA, 21 bp, Homo sapiens
ataactcctgtcccttttccc

SEQ ID NO: 1638263 - DNA, 20 bp, Homo sapiens
ataactctctttccttgagc

SEQ ID NO: 1638264 - DNA, 21 bp, Homo sapiens
ataactctgcactactcctct

SEQ ID NO: 1638265 - DNA, 15 bp, Homo sapiens
ataactgaaaatgtg

SEQ ID NO: 1638266 - DNA, 14 bp, Homo sapiens
ataactgaaggaga

SEQ ID NO: 1638267 - DNA, 16 bp, Homo sapiens
ataactgaaggagaag

SEQ ID NO: 1638268 - DNA, 14 bp, Homo sapiens
ataactgcagtgtt

SEQ ID NO: 1638269 - DNA, 14 bp, Homo sapiens
ataactgctttgca

SEQ ID NO: 1638270 - DNA, 22 bp, Homo sapiens
ataactggaaaacagaacactt

SEQ ID NO: 1638271 - DNA, 14 bp, Homo sapiens
ataactgtcttctg

SEQ ID NO: 1638272 - DNA, 16 bp, Homo sapiens
ataactgtcttctgga

SEQ ID NO: 1638273 - DNA, 12 bp, Homo sapiens
ataactgtcttg

SEQ ID NO: 1638274 - DNA, 13 bp, Homo sapiens
ataactgtcttgt

SEQ ID NO: 1638275 - DNA, 14 bp, Homo sapiens
ataactgtcttgtt

SEQ ID NO: 1638276 - DNA, 17 bp, Homo sapiens
ataactgtcttgtttca

SEQ ID NO: 1638277 - DNA, 16 bp, Homo sapiens
ataactgtgtactgtt

SEQ ID NO: 1638278 - DNA, 16 bp, Homo sapiens
ataacttaaaaaaatg

SEQ ID NO: 1638279 - DNA, 21 bp, Homo sapiens
ataacttaaaaatgtaaatat

SEQ ID NO: 1638280 - DNA, 16 bp, Homo sapiens
ataacttcaagcaaac

SEQ ID NO: 1638281 - DNA, 15 bp, Homo sapiens
ataacttgatataga

SEQ ID NO: 1638282 - DNA, 18 bp, Homo sapiens
ataacttgctgaatttca

SEQ ID NO: 1638283 - DNA, 18 bp, Homo sapiens
ataacttggggaggcaag

SEQ ID NO: 1638284 - DNA, 12 bp, Homo sapiens
ataagaaaaact

SEQ ID NO: 1638285 - DNA, 21 bp, Homo sapiens
ataagaaaatatattctttca

SEQ ID NO: 1638286 - DNA, 18 bp, Homo sapiens
ataagaaagcctaaaatt

SEQ ID NO: 1638287 - DNA, 20 bp, Homo sapiens
ataagaaagcctaaaattga

SEQ ID NO: 1638288 - DNA, 20 bp, Homo sapiens
ataagaatagaacaacatat

SEQ ID NO: 1638289 - DNA, 19 bp, Homo sapiens
ataagaatgctggttttcc

SEQ ID NO: 1638290 - DNA, 16 bp, Homo sapiens
ataagaattcagacat

SEQ ID NO: 1638291 - DNA, 14 bp, Homo sapiens
ataagacaaaaata

SEQ ID NO: 1638292 - DNA, 15 bp, Homo sapiens
ataagacaaaaataa

SEQ ID NO: 1638293 - DNA, 14 bp, Homo sapiens
ataagacagagaag

SEQ ID NO: 1638294 - DNA, 22 bp, Homo sapiens
ataagacagagaaggttcttct

SEQ ID NO: 1638295 - DNA, 21 bp, Homo sapiens
ataagagaaagaggccagaca

SEQ ID NO: 1638296 - DNA, 18 bp, Homo sapiens
ataagagaagtctcattc

SEQ ID NO: 1638297 - DNA, 20 bp, Homo sapiens
ataagagaattatatatttc

SEQ ID NO: 1638298 - DNA, 20 bp, Homo sapiens
ataagagagaacaactactg

SEQ ID NO: 1638299 - DNA, 20 bp, Homo sapiens
ataagagagtcataaacctt

SEQ ID NO: 1638300 - DNA, 14 bp, Homo sapiens
ataagatacacagc

SEQ ID NO: 1638301 - DNA, 19 bp, Homo sapiens
ataagatcctagatcctaa

SEQ ID NO: 1638302 - DNA, 14 bp, Homo sapiens
ataagattaaagga

SEQ ID NO: 1638303 - DNA, 20 bp, Homo sapiens
ataagcaagagacaataata

SEQ ID NO: 1638304 - DNA, 15 bp, Homo sapiens
ataagcaagagagat

SEQ ID NO: 1638305 - DNA, 16 bp, Homo sapiens
ataagcaagagagatg

SEQ ID NO: 1638306 - DNA, 17 bp, Homo sapiens
ataagcactgtaaactt

SEQ ID NO: 1638307 - DNA, 16 bp, Homo sapiens
ataagcagatttaaca

SEQ ID NO: 1638308 - DNA, 17 bp, Homo sapiens
ataagcaggtggatcta

SEQ ID NO: 1638309 - DNA, 20 bp, Homo sapiens
ataagcattgacttgccgtc

SEQ ID NO: 1638310 - DNA, 13 bp, Homo sapiens
ataagctaaagag

SEQ ID NO: 1638311 - DNA, 21 bp, Homo sapiens
ataagctatcacctagcagcc

SEQ ID NO: 1638312 - DNA, 15 bp, Homo sapiens
ataagctcagaatcc

SEQ ID NO: 1638313 - DNA, 17 bp, Homo sapiens
ataagctcgagtgaatt

SEQ ID NO: 1638314 - DNA, 22 bp, Homo sapiens
ataagctgggaaaaaagttttg

SEQ ID NO: 1638315 - DNA, 14 bp, Homo sapiens
ataaggacagcagc

SEQ ID NO: 1638316 - DNA, 16 bp, Homo sapiens
ataaggacagcagctg

SEQ ID NO: 1638317 - DNA, 22 bp, Homo sapiens
ataaggaggaggagggagaaga

SEQ ID NO: 1638318 - DNA, 13 bp, Homo sapiens
ataaggatgactt

SEQ ID NO: 1638319 - DNA, 13 bp, Homo sapiens
ataaggtgcctca

SEQ ID NO: 1638320 - DNA, 17 bp, Homo sapiens
ataaggtgctctctttc

SEQ ID NO: 1638321 - DNA, 17 bp, Homo sapiens
ataaggtttaaaaagat

SEQ ID NO: 1638322 - DNA, 23 bp, Homo sapiens
ataaggtttcgtttctgtataca

SEQ ID NO: 1638323 - DNA, 13 bp, Homo sapiens
ataagtactgtgt

SEQ ID NO: 1638324 - DNA, 14 bp, Homo sapiens
ataagtatttggaa

SEQ ID NO: 1638325 - DNA, 14 bp, Homo sapiens
ataagtcaacagta

SEQ ID NO: 1638326 - DNA, 16 bp, Homo sapiens
ataagtcaacagtaaa

SEQ ID NO: 1638327 - DNA, 17 bp, Homo sapiens
ataagtcaacagtaaac

SEQ ID NO: 1638328 - DNA, 18 bp, Homo sapiens
ataagtcaagcacatgta

SEQ ID NO: 1638329 - DNA, 21 bp, Homo sapiens
ataagtcaagcacatgtaata

SEQ ID NO: 1638330 - DNA, 16 bp, Homo sapiens
ataagtcattgtatgt

SEQ ID NO: 1638331 - DNA, 14 bp, Homo sapiens
ataagtgactttaa

SEQ ID NO: 1638332 - DNA, 22 bp, Homo sapiens
ataagtgagatggtatgaaata

SEQ ID NO: 1638333 - DNA, 17 bp, Homo sapiens
ataagtgttcttcagtg

SEQ ID NO: 1638334 - DNA, 22 bp, Homo sapiens
ataagtgttcttcagtgtaatg

SEQ ID NO: 1638335 - DNA, 22 bp, Homo sapiens
ataagttaacttccaatttaca

SEQ ID NO: 1638336 - DNA, 18 bp, Homo sapiens
ataagttatttttgtaca

SEQ ID NO: 1638337 - DNA, 20 bp, Homo sapiens
ataagttcaaattcttctga

SEQ ID NO: 1638338 - DNA, 14 bp, Homo sapiens
gatacaaatttggc

SEQ ID NO: 1638339 - DNA, 22 bp, Homo sapiens
gatacaatgtatttatttaaaa

SEQ ID NO: 1638340 - DNA, 11 bp, Homo sapiens
gatacacagct

SEQ ID NO: 1638341 - DNA, 12 bp, Homo sapiens
gatacagacatt

SEQ ID NO: 1638342 - DNA, 17 bp, Homo sapiens
gatacagacattcaatg

SEQ ID NO: 1638343 - DNA, 22 bp, Homo sapiens
gatacagacattcaatgaatta

SEQ ID NO: 1638344 - DNA, 19 bp, Homo sapiens
gatacagtacggatttgtc

SEQ ID NO: 1638345 - DNA, 13 bp, Homo sapiens
gatacataataaa

SEQ ID NO: 1638346 - DNA, 13 bp, Homo sapiens
gatacatttaata

SEQ ID NO: 1638347 - DNA, 19 bp, Homo sapiens
gataccctgtttctggagt

SEQ ID NO: 1638348 - DNA, 21 bp, Homo sapiens
gatacctcagccctggccctg

SEQ ID NO: 1638349 - DNA, 20 bp, Homo sapiens
gataccttcttatttaatct

SEQ ID NO: 1638350 - DNA, 22 bp, Homo sapiens
gatacgctactataaagagaag

SEQ ID NO: 1638351 - DNA, 19 bp, Homo sapiens
gatactgcgactttctgcc

SEQ ID NO: 1638352 - DNA, 14 bp, Homo sapiens
gatactggaagttt

SEQ ID NO: 1638353 - DNA, 19 bp, Homo sapiens
gatactggaagttttgcat

SEQ ID NO: 1638354 - DNA, 16 bp, Homo sapiens
gatactggcacagagg

SEQ ID NO: 1638355 - DNA, 19 bp, Homo sapiens
gatactgtgagcttacatt

SEQ ID NO: 1638356 - DNA, 23 bp, Homo sapiens
gatactgtgagcttacattgaaa

SEQ ID NO: 1638357 - DNA, 16 bp, Homo sapiens
gatacttatttttctg

SEQ ID NO: 1638358 - DNA, 13 bp, Homo sapiens
gatacttcaggtg

SEQ ID NO: 1638359 - DNA, 21 bp, Homo sapiens
gatacttcaggtgcttttgat

SEQ ID NO: 1638360 - DNA, 13 bp, Homo sapiens
gatactttacatg

SEQ ID NO: 1638361 - DNA, 18 bp, Homo sapiens
gatactttgatattttca

SEQ ID NO: 1638362 - DNA, 17 bp, Homo sapiens
gatagaaaatccttcag

SEQ ID NO: 1638363 - DNA, 18 bp, Homo sapiens
gatagaaaatccttcagc

SEQ ID NO: 1638364 - DNA, 16 bp, Homo sapiens
gatagaaagcattaca

SEQ ID NO: 1638365 - DNA, 16 bp, Homo sapiens
gatagaaagctggact

SEQ ID NO: 1638366 - DNA, 17 bp, Homo sapiens
gatagaaagctggactg

SEQ ID NO: 1638367 - DNA, 15 bp, Homo sapiens
gatagaactgtactg

SEQ ID NO: 1638368 - DNA, 20 bp, Homo sapiens
gatagaatgatgttttaaaa

SEQ ID NO: 1638369 - DNA, 18 bp, Homo sapiens
gatagacgggttgaaaga

SEQ ID NO: 1638370 - DNA, 19 bp, Homo sapiens
gatagacgggttgaaagac

SEQ ID NO: 1638371 - DNA, 15 bp, Homo sapiens
gatagagtaaaaaga

SEQ ID NO: 1638372 - DNA, 21 bp, Homo sapiens
gatagagtaaaaagaaaacaa

SEQ ID NO: 1638373 - DNA, 18 bp, Homo sapiens
gatagatgctggcccagg

SEQ ID NO: 1638374 - DNA, 20 bp, Homo sapiens
gatagatgctggcccagggc

SEQ ID NO: 1638375 - DNA, 16 bp, Homo sapiens
gatagatttggaatag

SEQ ID NO: 1638376 - DNA, 23 bp, Homo sapiens
gatagccctgggtaccctgagcc

SEQ ID NO: 1638377 - DNA, 20 bp, Homo sapiens
gatagctaactgtaaatcat

SEQ ID NO: 1638378 - DNA, 17 bp, Homo sapiens
gatagcttacactgagg

SEQ ID NO: 1638379 - DNA, 20 bp, Homo sapiens
gatagcttacactgaggact

SEQ ID NO: 1638380 - DNA, 14 bp, Homo sapiens
gataggctctgcac

SEQ ID NO: 1638381 - DNA, 17 bp, Homo sapiens
gataggctctgcacaga

SEQ ID NO: 1638382 - DNA, 15 bp, Homo sapiens
gatagtaacaatgaa

SEQ ID NO: 1638383 - DNA, 18 bp, Homo sapiens
gatagtagcatacattta

SEQ ID NO: 1638384 - DNA, 16 bp, Homo sapiens
gatagtcacctgctgg

SEQ ID NO: 1638385 - DNA, 17 bp, Homo sapiens
gatagtcacctgctggt

SEQ ID NO: 1638386 - DNA, 16 bp, Homo sapiens
gatagtcttcagtttc

SEQ ID NO: 1638387 - DNA, 16 bp, Homo sapiens
gatagtgatgtatttt

SEQ ID NO: 1638388 - DNA, 17 bp, Homo sapiens
gatagtgggatttccag

SEQ ID NO: 1638389 - DNA, 15 bp, Homo sapiens
gatagtgttctgctc

SEQ ID NO: 1638390 - DNA, 16 bp, Homo sapiens
gatagtgttctgctcc

SEQ ID NO: 1638391 - DNA, 21 bp, Homo sapiens
gatagttaaaagactgcagct

SEQ ID NO: 1638392 - DNA, 14 bp, Homo sapiens
gatagttttctaga

SEQ ID NO: 1638393 - DNA, 13 bp, Homo sapiens
gatataaaatgaa

SEQ ID NO: 1638394 - DNA, 17 bp, Homo sapiens
gatataaaatgaaagat

SEQ ID NO: 1638395 - DNA, 16 bp, Homo sapiens
gatataaatggctggt

SEQ ID NO: 1638396 - DNA, 13 bp, Homo sapiens
gatatacattgtg

SEQ ID NO: 1638397 - DNA, 13 bp, Homo sapiens
gatataccaaatt

SEQ ID NO: 1638398 - DNA, 16 bp, Homo sapiens
gatataccaaattaaa

SEQ ID NO: 1638399 - DNA, 15 bp, Homo sapiens
gatatacttgttttt

SEQ ID NO: 1638400 - DNA, 20 bp, Homo sapiens
gatataggcatttggtctca

SEQ ID NO: 1638401 - DNA, 19 bp, Homo sapiens
gatatagttttacttttaa

SEQ ID NO: 1638402 - DNA, 14 bp, Homo sapiens
gatatatacatagc

SEQ ID NO: 1638403 - DNA, 14 bp, Homo sapiens
ataatgctttgtta

SEQ ID NO: 1638404 - DNA, 17 bp, Homo sapiens
ataatggtcccatccag

SEQ ID NO: 1638405 - DNA, 20 bp, Homo sapiens
ataatggtcccatccaggca

SEQ ID NO: 1638406 - DNA, 14 bp, Homo sapiens
ataatggtttcaaa

SEQ ID NO: 1638407 - DNA, 15 bp, Homo sapiens
ataatgtactcacat

SEQ ID NO: 1638408 - DNA, 19 bp, Homo sapiens
ataatgtactgatttcagt

SEQ ID NO: 1638409 - DNA, 14 bp, Homo sapiens
ataatgtattttct

SEQ ID NO: 1638410 - DNA, 11 bp, Homo sapiens
ataatgtgtat

SEQ ID NO: 1638411 - DNA, 13 bp, Homo sapiens
ataatgtgtataa

SEQ ID NO: 1638412 - DNA, 19 bp, Homo sapiens
ataatgttctttaatgttg

SEQ ID NO: 1638413 - DNA, 21 bp, Homo sapiens
ataatgttctttaatgttgtc

SEQ ID NO: 1638414 - DNA, 17 bp, Homo sapiens
ataatgttgtatttaat

SEQ ID NO: 1638415 - DNA, 20 bp, Homo sapiens
ataatgttgtatttaatttt

SEQ ID NO: 1638416 - DNA, 19 bp, Homo sapiens
ataatgtttaatattgaga

SEQ ID NO: 1638417 - DNA, 22 bp, Homo sapiens
ataatgtttccctcaagaacaa

SEQ ID NO: 1638418 - DNA, 23 bp, Homo sapiens
ataatgtttccctcaagaacaaa

SEQ ID NO: 1638419 - DNA, 13 bp, Homo sapiens
ataatgtttgcta

SEQ ID NO: 1638420 - DNA, 18 bp, Homo sapiens
ataattaaattttaatgt

SEQ ID NO: 1638421 - DNA, 19 bp, Homo sapiens
ataattaaattttaatgta

SEQ ID NO: 1638422 - DNA, 14 bp, Homo sapiens
ataattaattgtca

SEQ ID NO: 1638423 - DNA, 13 bp, Homo sapiens
ataattacagaat

SEQ ID NO: 1638424 - DNA, 18 bp, Homo sapiens
ataattacagaatatact

SEQ ID NO: 1638425 - DNA, 16 bp, Homo sapiens
ataattacattcctaa

SEQ ID NO: 1638426 - DNA, 19 bp, Homo sapiens
ataattatataactgtatt

SEQ ID NO: 1638427 - DNA, 16 bp, Homo sapiens
ataattatcggaagca

SEQ ID NO: 1638428 - DNA, 22 bp, Homo sapiens
ataattatcggaagcagtgcct

SEQ ID NO: 1638429 - DNA, 14 bp, Homo sapiens
ataattatgacagt

SEQ ID NO: 1638430 - DNA, 18 bp, Homo sapiens
ataattatgacagttata

SEQ ID NO: 1638431 - DNA, 15 bp, Homo sapiens
ataattcatttgtat

SEQ ID NO: 1638432 - DNA, 17 bp, Homo sapiens
ataattcatttgtattg

SEQ ID NO: 1638433 - DNA, 19 bp, Homo sapiens
ataattccctatcttttag

SEQ ID NO: 1638434 - DNA, 20 bp, Homo sapiens
ataattccctatcttttagt

SEQ ID NO: 1638435 - DNA, 14 bp, Homo sapiens
ataattctcattaa

SEQ ID NO: 1638436 - DNA, 13 bp, Homo sapiens
ataattcttttct

SEQ ID NO: 1638437 - DNA, 23 bp, Homo sapiens
ataattgaaaagattttaacaag

SEQ ID NO: 1638438 - DNA, 15 bp, Homo sapiens
ataattgaagtgtat

SEQ ID NO: 1638439 - DNA, 18 bp, Homo sapiens
ataattgctttgccaaaa

SEQ ID NO: 1638440 - DNA, 23 bp, Homo sapiens
ataattgctttgccaaaatacca

SEQ ID NO: 1638441 - DNA, 16 bp, Homo sapiens
ataattggatttccta

SEQ ID NO: 1638442 - DNA, 17 bp, Homo sapiens
ataattggatttcctaa

SEQ ID NO: 1638443 - DNA, 18 bp, Homo sapiens
ataattggatttcctaat

SEQ ID NO: 1638444 - DNA, 20 bp, Homo sapiens
ataattggatttcctaatac

SEQ ID NO: 1638445 - DNA, 20 bp, Homo sapiens
ataattggcatgtctcctca

SEQ ID NO: 1638446 - DNA, 11 bp, Homo sapiens
ataattggctt

SEQ ID NO: 1638447 - DNA, 15 bp, Homo sapiens
ataattgtacaaaat

SEQ ID NO: 1638448 - DNA, 11 bp, Homo sapiens
ataattgtgac

SEQ ID NO: 1638449 - DNA, 13 bp, Homo sapiens
ataattgtggatt

SEQ ID NO: 1638450 - DNA, 22 bp, Homo sapiens
ataattgtgtaccttaagatat

SEQ ID NO: 1638451 - DNA, 23 bp, Homo sapiens
ataattgtgtaccttaagatatt

SEQ ID NO: 1638452 - DNA, 18 bp, Homo sapiens
ataattgtgtgatatttc

SEQ ID NO: 1638453 - DNA, 14 bp, Homo sapiens
ataattgttgcata

SEQ ID NO: 1638454 - DNA, 21 bp, Homo sapiens
ataattgtttccaacttgtct

SEQ ID NO: 1638455 - DNA, 20 bp, Homo sapiens
ataatttacaagatattatt

SEQ ID NO: 1638456 - DNA, 18 bp, Homo sapiens
ataatttcttactaaaca

SEQ ID NO: 1638457 - DNA, 16 bp, Homo sapiens
ataatttgaatgtatt

SEQ ID NO: 1638458 - DNA, 19 bp, Homo sapiens
ataatttgaatgtatttga

SEQ ID NO: 1638459 - DNA, 20 bp, Homo sapiens
ataatttgaatgtatttgat

SEQ ID NO: 1638460 - DNA, 18 bp, Homo sapiens
ataatttgtacaatggtt

SEQ ID NO: 1638461 - DNA, 14 bp, Homo sapiens
ataattttccaagt

SEQ ID NO: 1638462 - DNA, 21 bp, Homo sapiens
ataattttccagtataaaaca

SEQ ID NO: 1638463 - DNA, 22 bp, Homo sapiens
ataattttccagtataaaacaa

SEQ ID NO: 1638464 - DNA, 13 bp, Homo sapiens
ataattttcttca

SEQ ID NO: 1638465 - DNA, 17 bp, Homo sapiens
ataattttcttcatgca

SEQ ID NO: 1638466 - DNA, 12 bp, Homo sapiens
ataattttgcaa

SEQ ID NO: 1638467 - DNA, 22 bp, Homo sapiens
ataattttgctggaattcctaa

SEQ ID NO: 1638468 - DNA, 16 bp, Homo sapiens
ataattttggtaattt

SEQ ID NO: 1638469 - DNA, 18 bp, Homo sapiens
ataatttttaaagtatat

SEQ ID NO: 1638470 - DNA, 18 bp, Homo sapiens
ataatttttacctaatct

SEQ ID NO: 1638471 - DNA, 20 bp, Homo sapiens
ataatttttttcaatattta

SEQ ID NO: 1638472 - DNA, 22 bp, Homo sapiens
ataattttttttaaaatagaaa

SEQ ID NO: 1638473 - DNA, 15 bp, Homo sapiens
atacaaaaatgaata

SEQ ID NO: 1638474 - DNA, 18 bp, Homo sapiens
atacaaaatatttaagtg

SEQ ID NO: 1638475 - DNA, 22 bp, Homo sapiens
atacaaacaatggaaactgaat

SEQ ID NO: 1638476 - DNA, 15 bp, Homo sapiens
atacaaactctcacc

SEQ ID NO: 1638477 - DNA, 14 bp, Homo sapiens
atacaaatttggcc

SEQ ID NO: 1638478 - DNA, 16 bp, Homo sapiens
atacaacacaaagaga

SEQ ID NO: 1638479 - DNA, 20 bp, Homo sapiens
atacaacaccaaaaaatatc

SEQ ID NO: 1638480 - DNA, 22 bp, Homo sapiens
atacaaccctggcattatgtcc

SEQ ID NO: 1638481 - DNA, 15 bp, Homo sapiens
atacaagaaaatgta

SEQ ID NO: 1638482 - DNA, 12 bp, Homo sapiens
atacaaggcaag

SEQ ID NO: 1638483 - DNA, 10 bp, Homo sapiens
atacaataaa

SEQ ID NO: 1638484 - DNA, 15 bp, Homo sapiens
atacaatatcatcca

SEQ ID NO: 1638485 - DNA, 18 bp, Homo sapiens
atacaatgtatttattta

SEQ ID NO: 1638486 - DNA, 14 bp, Homo sapiens
atacacaaaatcaa

SEQ ID NO: 1638487 - DNA, 15 bp, Homo sapiens
atacacaacacacac

SEQ ID NO: 1638488 - DNA, 15 bp, Homo sapiens
atacacaatcctcca

SEQ ID NO: 1638489 - DNA, 14 bp, Homo sapiens
atacacacacacac

SEQ ID NO: 1638490 - DNA, 17 bp, Homo sapiens
atacacactcaaatcaa

SEQ ID NO: 1638491 - DNA, 21 bp, Homo sapiens
atacacagtactttattgtac

SEQ ID NO: 1638492 - DNA, 14 bp, Homo sapiens
atacacatgaaaac

SEQ ID NO: 1638493 - DNA, 20 bp, Homo sapiens
atacaccacctcactcctgt

SEQ ID NO: 1638494 - DNA, 14 bp, Homo sapiens
atacaccgggcctg

SEQ ID NO: 1638495 - DNA, 22 bp, Homo sapiens
atacaccgtttagaaaaaacaa

SEQ ID NO: 1638496 - DNA, 15 bp, Homo sapiens
atacactgaaaggaa

SEQ ID NO: 1638497 - DNA, 16 bp, Homo sapiens
atacactgtatctaaa

SEQ ID NO: 1638498 - DNA, 22 bp, Homo sapiens
atacacttacactttatgcaca

SEQ ID NO: 1638499 - DNA, 15 bp, Homo sapiens
atacagaaatgcaaa

SEQ ID NO: 1638500 - DNA, 12 bp, Homo sapiens
atacagacacta

SEQ ID NO: 1638501 - DNA, 15 bp, Homo sapiens
atacagacactaagt

SEQ ID NO: 1638502 - DNA, 13 bp, Homo sapiens
atacagaggagat

SEQ ID NO: 1638503 - DNA, 18 bp, Homo sapiens
atacagataaatgattca

SEQ ID NO: 1638504 - DNA, 17 bp, Homo sapiens
atacagatcatcttgga

SEQ ID NO: 1638505 - DNA, 22 bp, Homo sapiens
atacagatctcagggctcggga

SEQ ID NO: 1638506 - DNA, 13 bp, Homo sapiens
atacagattttac

SEQ ID NO: 1638507 - DNA, 16 bp, Homo sapiens
atacagcatacttcaa

SEQ ID NO: 1638508 - DNA, 14 bp, Homo sapiens
atacagctcagtaa

SEQ ID NO: 1638509 - DNA, 12 bp, Homo sapiens
atacagctgtat

SEQ ID NO: 1638510 - DNA, 20 bp, Homo sapiens
atacagctgtattgtctgaa

SEQ ID NO: 1638511 - DNA, 17 bp, Homo sapiens
atacaggaaaaacaaaa

SEQ ID NO: 1638512 - DNA, 14 bp, Homo sapiens
atacaggaaacagt

SEQ ID NO: 1638513 - DNA, 20 bp, Homo sapiens
atacagggagccggcggcct

SEQ ID NO: 1638514 - DNA, 21 bp, Homo sapiens
atacagggagccggcggcctc

SEQ ID NO: 1638515 - DNA, 19 bp, Homo sapiens
atacagtaactttatgtgt

SEQ ID NO: 1638516 - DNA, 19 bp, Homo sapiens
atacagtaagcatagttaa

SEQ ID NO: 1638517 - DNA, 19 bp, Homo sapiens
atacagtaagctgctctat

SEQ ID NO: 1638518 - DNA, 14 bp, Homo sapiens
gatcattttccccc

SEQ ID NO: 1638519 - DNA, 15 bp, Homo sapiens
gatcattttcccccc

SEQ ID NO: 1638520 - DNA, 18 bp, Homo sapiens
gatcattttccccccact

SEQ ID NO: 1638521 - DNA, 13 bp, Homo sapiens
gatccaaaagaag

SEQ ID NO: 1638522 - DNA, 16 bp, Homo sapiens
gatccaaaagaagccc

SEQ ID NO: 1638523 - DNA, 20 bp, Homo sapiens
gatccaactaatgccttact

SEQ ID NO: 1638524 - DNA, 21 bp, Homo sapiens
gatccacccgcctcagcctcc

SEQ ID NO: 1638525 - DNA, 19 bp, Homo sapiens
gatccaccggcctcggcct

SEQ ID NO: 1638526 - DNA, 14 bp, Homo sapiens
gatccacctgtctc

SEQ ID NO: 1638527 - DNA, 13 bp, Homo sapiens
gatccagaaatac

SEQ ID NO: 1638528 - DNA, 12 bp, Homo sapiens
gatccaggacta

SEQ ID NO: 1638529 - DNA, 15 bp, Homo sapiens
gatccagggacagag

SEQ ID NO: 1638530 - DNA, 18 bp, Homo sapiens
gatccagggacagaggcc

SEQ ID NO: 1638531 - DNA, 13 bp, Homo sapiens
gatccagggatgg

SEQ ID NO: 1638532 - DNA, 23 bp, Homo sapiens
gatccataaagacaatcactgcc

SEQ ID NO: 1638533 - DNA, 21 bp, Homo sapiens
gatccataggactaccgcagg

SEQ ID NO: 1638534 - DNA, 22 bp, Homo sapiens
gatccataggactaccgcaggc

SEQ ID NO: 1638535 - DNA, 16 bp, Homo sapiens
gatccatccatctcca

SEQ ID NO: 1638536 - DNA, 19 bp, Homo sapiens
gatccatcttgagccacag

SEQ ID NO: 1638537 - DNA, 14 bp, Homo sapiens
gatccatgggggga

SEQ ID NO: 1638538 - DNA, 17 bp, Homo sapiens
gatccatggggggagaa

SEQ ID NO: 1638539 - DNA, 19 bp, Homo sapiens
gatccatgtagcaggactg

SEQ ID NO: 1638540 - DNA, 17 bp, Homo sapiens
gatccatttccattgct

SEQ ID NO: 1638541 - DNA, 19 bp, Homo sapiens
gatcccagctcacgtcaca

SEQ ID NO: 1638542 - DNA, 18 bp, Homo sapiens
gatcccatgtcacctcag

SEQ ID NO: 1638543 - DNA, 20 bp, Homo sapiens
gatccccaagtgtgaacaaa

SEQ ID NO: 1638544 - DNA, 14 bp, Homo sapiens
gatccccagggcag

SEQ ID NO: 1638545 - DNA, 17 bp, Homo sapiens
gatccccagggcagcct

SEQ ID NO: 1638546 - DNA, 16 bp, Homo sapiens
gatccccgcctggcca

SEQ ID NO: 1638547 - DNA, 17 bp, Homo sapiens
gatccccgcctggccag

SEQ ID NO: 1638548 - DNA, 18 bp, Homo sapiens
gatccccgcctggccagg

SEQ ID NO: 1638549 - DNA, 22 bp, Homo sapiens
gatccccgcctggccaggagca

SEQ ID NO: 1638550 - DNA, 14 bp, Homo sapiens
gatcccctccccca

SEQ ID NO: 1638551 - DNA, 13 bp, Homo sapiens
gatccctcccccc

SEQ ID NO: 1638552 - DNA, 19 bp, Homo sapiens
gatccctcccccccatgca

SEQ ID NO: 1638553 - DNA, 21 bp, Homo sapiens
gatccctcccccccatgcact

SEQ ID NO: 1638554 - DNA, 11 bp, Homo sapiens
gatccctcctg

SEQ ID NO: 1638555 - DNA, 20 bp, Homo sapiens
gatccctgcccttctcaaga

SEQ ID NO: 1638556 - DNA, 15 bp, Homo sapiens
gatccctgctctctg

SEQ ID NO: 1638557 - DNA, 18 bp, Homo sapiens
gatccctgctctctgagt

SEQ ID NO: 1638558 - DNA, 20 bp, Homo sapiens
gatccctgttacccagagaa

SEQ ID NO: 1638559 - DNA, 15 bp, Homo sapiens
gatccgctgccacca

SEQ ID NO: 1638560 - DNA, 16 bp, Homo sapiens
gatcctaagcatctaa

SEQ ID NO: 1638561 - DNA, 19 bp, Homo sapiens
gatcctaagcatctaagtt

SEQ ID NO: 1638562 - DNA, 23 bp, Homo sapiens
gatcctcatatggcccagtgtca

SEQ ID NO: 1638563 - DNA, 14 bp, Homo sapiens
gatcctccacagag

SEQ ID NO: 1638564 - DNA, 16 bp, Homo sapiens
gatcctccacagagag

SEQ ID NO: 1638565 - DNA, 17 bp, Homo sapiens
gatcctccacagagagg

SEQ ID NO: 1638566 - DNA, 15 bp, Homo sapiens
gatcctctcacctca

SEQ ID NO: 1638567 - DNA, 19 bp, Homo sapiens
gatcctctcacctcagcct

SEQ ID NO: 1638568 - DNA, 15 bp, Homo sapiens
gatcctgcaccccag

SEQ ID NO: 1638569 - DNA, 17 bp, Homo sapiens
gatcctgcgggtggggc

SEQ ID NO: 1638570 - DNA, 15 bp, Homo sapiens
gatcctggaggccca

SEQ ID NO: 1638571 - DNA, 17 bp, Homo sapiens
gatcctggattcactca

SEQ ID NO: 1638572 - DNA, 18 bp, Homo sapiens
gatcctggattcactcac

SEQ ID NO: 1638573 - DNA, 17 bp, Homo sapiens
gatcctggggccctcag

SEQ ID NO: 1638574 - DNA, 22 bp, Homo sapiens
gatcctggggccctcagctcct

SEQ ID NO: 1638575 - DNA, 21 bp, Homo sapiens
gatccttagaggtcctctgga

SEQ ID NO: 1638576 - DNA, 16 bp, Homo sapiens
atacctaattgtggat

SEQ ID NO: 1638577 - DNA, 15 bp, Homo sapiens
atacctcaacctatg

SEQ ID NO: 1638578 - DNA, 19 bp, Homo sapiens
atacctcctccctaatgct

SEQ ID NO: 1638579 - DNA, 13 bp, Homo sapiens
atacctctgacca

SEQ ID NO: 1638580 - DNA, 14 bp, Homo sapiens
atacctctgaccaa

SEQ ID NO: 1638581 - DNA, 15 bp, Homo sapiens
atacctctgaccaac

SEQ ID NO: 1638582 - DNA, 14 bp, Homo sapiens
atacctctgtgtgc

SEQ ID NO: 1638583 - DNA, 21 bp, Homo sapiens
atacctgagcctcaaccttct

SEQ ID NO: 1638584 - DNA, 18 bp, Homo sapiens
atacctggcttttacttt

SEQ ID NO: 1638585 - DNA, 23 bp, Homo sapiens
atacctggcttttactttattaa

SEQ ID NO: 1638586 - DNA, 15 bp, Homo sapiens
atacctgtttaaatt

SEQ ID NO: 1638587 - DNA, 19 bp, Homo sapiens
ataccttttctcacaaaaa

SEQ ID NO: 1638588 - DNA, 17 bp, Homo sapiens
atacgagagcagaggtc

SEQ ID NO: 1638589 - DNA, 19 bp, Homo sapiens
atacgagagcagaggtctc

SEQ ID NO: 1638590 - DNA, 13 bp, Homo sapiens
atacgatttaagg

SEQ ID NO: 1638591 - DNA, 19 bp, Homo sapiens
atacgctactataaagaga

SEQ ID NO: 1638592 - DNA, 24 bp, Homo sapiens
atacgcttttctttgttataccat

SEQ ID NO: 1638593 - DNA, 20 bp, Homo sapiens
atacgggggctgtgactctg

SEQ ID NO: 1638594 - DNA, 16 bp, Homo sapiens
atacgtataaatatca

SEQ ID NO: 1638595 - DNA, 18 bp, Homo sapiens
atacgtataaatatcagt

SEQ ID NO: 1638596 - DNA, 15 bp, Homo sapiens
atacgtgcacagggt

SEQ ID NO: 1638597 - DNA, 19 bp, Homo sapiens
atacgtttgtgcagaatct

SEQ ID NO: 1638598 - DNA, 21 bp, Homo sapiens
atacgttttggtgttgctttt

SEQ ID NO: 1638599 - DNA, 14 bp, Homo sapiens
atactactgaaaca

SEQ ID NO: 1638600 - DNA, 15 bp, Homo sapiens
atactagatttggga

SEQ ID NO: 1638601 - DNA, 22 bp, Homo sapiens
atactagatttgggagaagggc

SEQ ID NO: 1638602 - DNA, 14 bp, Homo sapiens
atactaggtgcctt

SEQ ID NO: 1638603 - DNA, 22 bp, Homo sapiens
atactagtacaagtggtaattt

SEQ ID NO: 1638604 - DNA, 17 bp, Homo sapiens
atactatgaaataaaaa

SEQ ID NO: 1638605 - DNA, 17 bp, Homo sapiens
atactatggaatttctc

SEQ ID NO: 1638606 - DNA, 14 bp, Homo sapiens
atactattgcctca

SEQ ID NO: 1638607 - DNA, 22 bp, Homo sapiens
atactatttaaagcctcctcat

SEQ ID NO: 1638608 - DNA, 20 bp, Homo sapiens
atactatttaagatgtgaaa

SEQ ID NO: 1638609 - DNA, 22 bp, Homo sapiens
atactatttaagatgtgaaaat

SEQ ID NO: 1638610 - DNA, 16 bp, Homo sapiens
atactatttagatttt

SEQ ID NO: 1638611 - DNA, 19 bp, Homo sapiens
atactcaaatgagtaacat

SEQ ID NO: 1638612 - DNA, 15 bp, Homo sapiens
atactcaagctgtct

SEQ ID NO: 1638613 - DNA, 17 bp, Homo sapiens
atactccactcccagca

SEQ ID NO: 1638614 - DNA, 16 bp, Homo sapiens
atactccatacataac

SEQ ID NO: 1638615 - DNA, 20 bp, Homo sapiens
atactccgtgaggctgctgc

SEQ ID NO: 1638616 - DNA, 21 bp, Homo sapiens
atactccgtgaggctgctgcc

SEQ ID NO: 1638617 - DNA, 16 bp, Homo sapiens
atactcctgtcaccta

SEQ ID NO: 1638618 - DNA, 15 bp, Homo sapiens
atactccttgcttcc

SEQ ID NO: 1638619 - DNA, 18 bp, Homo sapiens
atactccttgcttcctga

SEQ ID NO: 1638620 - DNA, 17 bp, Homo sapiens
atactctagaacatgca

SEQ ID NO: 1638621 - DNA, 19 bp, Homo sapiens
atactctagaacatgcaca

SEQ ID NO: 1638622 - DNA, 13 bp, Homo sapiens
atactctgctatt

SEQ ID NO: 1638623 - DNA, 12 bp, Homo sapiens
atactctgtcag

SEQ ID NO: 1638624 - DNA, 13 bp, Homo sapiens
atactctgtcaga

SEQ ID NO: 1638625 - DNA, 14 bp, Homo sapiens
atactctgtcagat

SEQ ID NO: 1638626 - DNA, 18 bp, Homo sapiens
atactctgtgtaatctct

SEQ ID NO: 1638627 - DNA, 20 bp, Homo sapiens
atactctgtgtaatctctga

SEQ ID NO: 1638628 - DNA, 19 bp, Homo sapiens
atactcttaggaagagaaa

SEQ ID NO: 1638629 - DNA, 22 bp, Homo sapiens
atactcttcctatttttgtagt

SEQ ID NO: 1638630 - DNA, 16 bp, Homo sapiens
atactcttgaaatgta

SEQ ID NO: 1638631 - DNA, 20 bp, Homo sapiens
atactcttgaaatgtagaat

SEQ ID NO: 1638632 - DNA, 14 bp, Homo sapiens
atactgaaggaaaa

SEQ ID NO: 1638633 - DNA, 14 bp, Homo sapiens
gatctctcaggagc

SEQ ID NO: 1638634 - DNA, 17 bp, Homo sapiens
gatctctcaggagcaca

SEQ ID NO: 1638635 - DNA, 22 bp, Homo sapiens
gatctctcaggagcacaggcag

SEQ ID NO: 1638636 - DNA, 16 bp, Homo sapiens
gatctctctacaagag

SEQ ID NO: 1638637 - DNA, 13 bp, Homo sapiens
gatctctcttgtc

SEQ ID NO: 1638638 - DNA, 15 bp, Homo sapiens
gatctgaaatccata

SEQ ID NO: 1638639 - DNA, 19 bp, Homo sapiens
gatctgaaatccataaact

SEQ ID NO: 1638640 - DNA, 16 bp, Homo sapiens
gatctgaattaaataa

SEQ ID NO: 1638641 - DNA, 15 bp, Homo sapiens
gatctgagctcccac

SEQ ID NO: 1638642 - DNA, 17 bp, Homo sapiens
gatctgagctcccacct

SEQ ID NO: 1638643 - DNA, 24 bp, Homo sapiens
gatctgagctcccacctcccttcc

SEQ ID NO: 1638644 - DNA, 13 bp, Homo sapiens
gatctgatcaaga

SEQ ID NO: 1638645 - DNA, 22 bp, Homo sapiens
gatctgatggtgagctgggaag

SEQ ID NO: 1638646 - DNA, 16 bp, Homo sapiens
gatctgcacagtcaga

SEQ ID NO: 1638647 - DNA, 13 bp, Homo sapiens
gatctgcaggctg

SEQ ID NO: 1638648 - DNA, 15 bp, Homo sapiens
gatctgcaggctgca

SEQ ID NO: 1638649 - DNA, 16 bp, Homo sapiens
gatctgcaggctgcac

SEQ ID NO: 1638650 - DNA, 19 bp, Homo sapiens
gatctgcccacctcggcct

SEQ ID NO: 1638651 - DNA, 18 bp, Homo sapiens
gatctgcccatcgtgaag

SEQ ID NO: 1638652 - DNA, 23 bp, Homo sapiens
gatctgcccatcgtgaagaagcc

SEQ ID NO: 1638653 - DNA, 12 bp, Homo sapiens
gatctgcctggg

SEQ ID NO: 1638654 - DNA, 21 bp, Homo sapiens
gatctgcctgggcctgtgcag

SEQ ID NO: 1638655 - DNA, 15 bp, Homo sapiens
gatctgctagtgctg

SEQ ID NO: 1638656 - DNA, 21 bp, Homo sapiens
gatctgctgaggcccagtgca

SEQ ID NO: 1638657 - DNA, 15 bp, Homo sapiens
gatctggaacccaga

SEQ ID NO: 1638658 - DNA, 18 bp, Homo sapiens
gatctggaacccagactc

SEQ ID NO: 1638659 - DNA, 21 bp, Homo sapiens
gatctggaacctcagcctggc

SEQ ID NO: 1638660 - DNA, 22 bp, Homo sapiens
gatctggcacactccctctcct

SEQ ID NO: 1638661 - DNA, 13 bp, Homo sapiens
gatctggctgcag

SEQ ID NO: 1638662 - DNA, 17 bp, Homo sapiens
gatctgggaccctttcc

SEQ ID NO: 1638663 - DNA, 23 bp, Homo sapiens
gatctgggaccctttccttcctt

SEQ ID NO: 1638664 - DNA, 20 bp, Homo sapiens
gatctggggagagcggctgg

SEQ ID NO: 1638665 - DNA, 21 bp, Homo sapiens
gatctggggagagcggctgga

SEQ ID NO: 1638666 - DNA, 14 bp, Homo sapiens
gatctggggaggca

SEQ ID NO: 1638667 - DNA, 15 bp, Homo sapiens
gatctggggaggcag

SEQ ID NO: 1638668 - DNA, 16 bp, Homo sapiens
gatctggggaggcagg

SEQ ID NO: 1638669 - DNA, 17 bp, Homo sapiens
gatctggggaggcaggc

SEQ ID NO: 1638670 - DNA, 14 bp, Homo sapiens
gatctgtaccatga

SEQ ID NO: 1638671 - DNA, 21 bp, Homo sapiens
gatctgtagacttctggttgt

SEQ ID NO: 1638672 - DNA, 23 bp, Homo sapiens
gatctgtatatttttttctaaga

SEQ ID NO: 1638673 - DNA, 14 bp, Homo sapiens
gatctgtgattggc

SEQ ID NO: 1638674 - DNA, 14 bp, Homo sapiens
gatctgtgccccat

SEQ ID NO: 1638675 - DNA, 14 bp, Homo sapiens
gatctgtgtggctc

SEQ ID NO: 1638676 - DNA, 15 bp, Homo sapiens
gatctgtgtggctcc

SEQ ID NO: 1638677 - DNA, 18 bp, Homo sapiens
gatctgtttgaggagagc

SEQ ID NO: 1638678 - DNA, 16 bp, Homo sapiens
gatctgttttctggaa

SEQ ID NO: 1638679 - DNA, 21 bp, Homo sapiens
gatcttccagaagctgtactt

SEQ ID NO: 1638680 - DNA, 17 bp, Homo sapiens
gatcttcccacaggagg

SEQ ID NO: 1638681 - DNA, 18 bp, Homo sapiens
gatcttctatcattccaa

SEQ ID NO: 1638682 - DNA, 14 bp, Homo sapiens
gatcttctgaaatg

SEQ ID NO: 1638683 - DNA, 15 bp, Homo sapiens
gatcttctgaaatga

SEQ ID NO: 1638684 - DNA, 19 bp, Homo sapiens
gatcttctttataattcta

SEQ ID NO: 1638685 - DNA, 14 bp, Homo sapiens
gatcttgagagctg

SEQ ID NO: 1638686 - DNA, 13 bp, Homo sapiens
gatcttgcctgtc

SEQ ID NO: 1638687 - DNA, 16 bp, Homo sapiens
gatcttgtctccacta

SEQ ID NO: 1638688 - DNA, 17 bp, Homo sapiens
gatcttgtgctcagcat

SEQ ID NO: 1638689 - DNA, 18 bp, Homo sapiens
gatctttctagagccagc

SEQ ID NO: 1638690 - DNA, 15 bp, Homo sapiens
gatctttctcttccc

SEQ ID NO: 1638691 - DNA, 16 bp, Homo sapiens
gatctttgactgaaaa

SEQ ID NO: 1638692 - DNA, 14 bp, Homo sapiens
gatgaaaacatagc

SEQ ID NO: 1638693 - DNA, 20 bp, Homo sapiens
gatgaaatctgctagaaagt

SEQ ID NO: 1638694 - DNA, 19 bp, Homo sapiens
gatgaactctttctggcct

SEQ ID NO: 1638695 - DNA, 23 bp, Homo sapiens
atagaaattttgtaagaaggcaa

SEQ ID NO: 1638696 - DNA, 14 bp, Homo sapiens
atagaacaacatat

SEQ ID NO: 1638697 - DNA, 18 bp, Homo sapiens
atagaacaacatatacaa

SEQ ID NO: 1638698 - DNA, 15 bp, Homo sapiens
atagaacacaaggga

SEQ ID NO: 1638699 - DNA, 23 bp, Homo sapiens
atagaacacaagggatataaaat

SEQ ID NO: 1638700 - DNA, 21 bp, Homo sapiens
atagaactcagttttaactag

SEQ ID NO: 1638701 - DNA, 21 bp, Homo sapiens
atagaaggaatttgtacttct

SEQ ID NO: 1638702 - DNA, 13 bp, Homo sapiens
atagaaggtgatg

SEQ ID NO: 1638703 - DNA, 17 bp, Homo sapiens
atagaataaaggcagtt

SEQ ID NO: 1638704 - DNA, 22 bp, Homo sapiens
atagaatacttttttctagttt

SEQ ID NO: 1638705 - DNA, 14 bp, Homo sapiens
atagaatagcacag

SEQ ID NO: 1638706 - DNA, 19 bp, Homo sapiens
atagaatataattatcgga

SEQ ID NO: 1638707 - DNA, 12 bp, Homo sapiens
atagaatattta

SEQ ID NO: 1638708 - DNA, 19 bp, Homo sapiens
atagaatatttattacctc

SEQ ID NO: 1638709 - DNA, 19 bp, Homo sapiens
atagaatgatgttttaaaa

SEQ ID NO: 1638710 - DNA, 13 bp, Homo sapiens
atagaattgcagt

SEQ ID NO: 1638711 - DNA, 15 bp, Homo sapiens
atagacaaaaagtat

SEQ ID NO: 1638712 - DNA, 16 bp, Homo sapiens
atagacaaaaagtata

SEQ ID NO: 1638713 - DNA, 16 bp, Homo sapiens
atagacaaatagaaaa

SEQ ID NO: 1638714 - DNA, 17 bp, Homo sapiens
atagacaaatagaaaat

SEQ ID NO: 1638715 - DNA, 20 bp, Homo sapiens
atagacaatttgcacatctt

SEQ ID NO: 1638716 - DNA, 16 bp, Homo sapiens
atagacagtaaaatac

SEQ ID NO: 1638717 - DNA, 20 bp, Homo sapiens
atagacagtatatttatagt

SEQ ID NO: 1638718 - DNA, 15 bp, Homo sapiens
atagacattctcaca

SEQ ID NO: 1638719 - DNA, 20 bp, Homo sapiens
atagacctacagacctggct

SEQ ID NO: 1638720 - DNA, 20 bp, Homo sapiens
atagacgggttgaaagacat

SEQ ID NO: 1638721 - DNA, 15 bp, Homo sapiens
atagactaaatgaaa

SEQ ID NO: 1638722 - DNA, 21 bp, Homo sapiens
atagactgaggtataaagaca

SEQ ID NO: 1638723 - DNA, 12 bp, Homo sapiens
atagacttggga

SEQ ID NO: 1638724 - DNA, 13 bp, Homo sapiens
atagacttgggat

SEQ ID NO: 1638725 - DNA, 14 bp, Homo sapiens
atagacttgggatg

SEQ ID NO: 1638726 - DNA, 21 bp, Homo sapiens
atagagacaggacagaatgtg

SEQ ID NO: 1638727 - DNA, 23 bp, Homo sapiens
atagagactgtagattgcttctg

SEQ ID NO: 1638728 - DNA, 19 bp, Homo sapiens
atagagcaatgttggtttt

SEQ ID NO: 1638729 - DNA, 16 bp, Homo sapiens
atagagcagaaattct

SEQ ID NO: 1638730 - DNA, 12 bp, Homo sapiens
atagagctgcca

SEQ ID NO: 1638731 - DNA, 13 bp, Homo sapiens
atagagctgccac

SEQ ID NO: 1638732 - DNA, 17 bp, Homo sapiens
atagagctttttaatag

SEQ ID NO: 1638733 - DNA, 17 bp, Homo sapiens
atagaggcccaggcacc

SEQ ID NO: 1638734 - DNA, 18 bp, Homo sapiens
atagaggcccaggcacca

SEQ ID NO: 1638735 - DNA, 19 bp, Homo sapiens
atagaggctaaattactca

SEQ ID NO: 1638736 - DNA, 12 bp, Homo sapiens
atagaggctagc

SEQ ID NO: 1638737 - DNA, 21 bp, Homo sapiens
atagaggcttctccgccagcc

SEQ ID NO: 1638738 - DNA, 14 bp, Homo sapiens
atagagtatatgca

SEQ ID NO: 1638739 - DNA, 15 bp, Homo sapiens
atagagtatatgcac

SEQ ID NO: 1638740 - DNA, 14 bp, Homo sapiens
atagagtgtactta

SEQ ID NO: 1638741 - DNA, 16 bp, Homo sapiens
atagagttgattgtct

SEQ ID NO: 1638742 - DNA, 15 bp, Homo sapiens
atagataattatcca

SEQ ID NO: 1638743 - DNA, 13 bp, Homo sapiens
atagatacaaatg

SEQ ID NO: 1638744 - DNA, 22 bp, Homo sapiens
atagatattactggaaactaat

SEQ ID NO: 1638745 - DNA, 22 bp, Homo sapiens
atagatcactgccctttttgaa

SEQ ID NO: 1638746 - DNA, 13 bp, Homo sapiens
atagatctccagc

SEQ ID NO: 1638747 - DNA, 19 bp, Homo sapiens
atagatctccagcgtcagc

SEQ ID NO: 1638748 - DNA, 17 bp, Homo sapiens
gatgatcgtagacacag

SEQ ID NO: 1638749 - DNA, 17 bp, Homo sapiens
gatgatgatgatgatga

SEQ ID NO: 1638750 - DNA, 22 bp, Homo sapiens
gatgatgcttgtaacaagaaaa

SEQ ID NO: 1638751 - DNA, 16 bp, Homo sapiens
gatgatggcagagcca

SEQ ID NO: 1638752 - DNA, 20 bp, Homo sapiens
gatgatgtctcttgtagaag

SEQ ID NO: 1638753 - DNA, 15 bp, Homo sapiens
gatgattcccaccca

SEQ ID NO: 1638754 - DNA, 18 bp, Homo sapiens
gatgattcttctaggcat

SEQ ID NO: 1638755 - DNA, 13 bp, Homo sapiens
gatgattgcttga

SEQ ID NO: 1638756 - DNA, 18 bp, Homo sapiens
gatgatttcatcttctgg

SEQ ID NO: 1638757 - DNA, 19 bp, Homo sapiens
gatgatttcatcttctgga

SEQ ID NO: 1638758 - DNA, 19 bp, Homo sapiens
gatgattttttaagcagac

SEQ ID NO: 1638759 - DNA, 20 bp, Homo sapiens
gatgattttttaaggagctg

SEQ ID NO: 1638760 - DNA, 23 bp, Homo sapiens
gatgcaaatgttttgaaatgata

SEQ ID NO: 1638761 - DNA, 17 bp, Homo sapiens
gatgcaagatatttata

SEQ ID NO: 1638762 - DNA, 18 bp, Homo sapiens
gatgcaaggaccaggact

SEQ ID NO: 1638763 - DNA, 19 bp, Homo sapiens
gatgcaaggaccaggactc

SEQ ID NO: 1638764 - DNA, 18 bp, Homo sapiens
gatgcaatcagacaagtg

SEQ ID NO: 1638765 - DNA, 21 bp, Homo sapiens
gatgcaatcggtttaaacatg

SEQ ID NO: 1638766 - DNA, 16 bp, Homo sapiens
gatgcaccaccaagcc

SEQ ID NO: 1638767 - DNA, 19 bp, Homo sapiens
gatgcagagtaagtattat

SEQ ID NO: 1638768 - DNA, 13 bp, Homo sapiens
gatgcaggacagg

SEQ ID NO: 1638769 - DNA, 16 bp, Homo sapiens
gatgcaggacaggagg

SEQ ID NO: 1638770 - DNA, 20 bp, Homo sapiens
gatgcagtcctcaggaaggg

SEQ ID NO: 1638771 - DNA, 20 bp, Homo sapiens
gatgcatacagttttctagc

SEQ ID NO: 1638772 - DNA, 19 bp, Homo sapiens
gatgcatttaataaagatg

SEQ ID NO: 1638773 - DNA, 15 bp, Homo sapiens
gatgccaacctctgg

SEQ ID NO: 1638774 - DNA, 22 bp, Homo sapiens
gatgccaacctctggagcaatg

SEQ ID NO: 1638775 - DNA, 17 bp, Homo sapiens
gatgccaaggagcccct

SEQ ID NO: 1638776 - DNA, 17 bp, Homo sapiens
gatgccaatttcctctc

SEQ ID NO: 1638777 - DNA, 15 bp, Homo sapiens
gatgccacacaagga

SEQ ID NO: 1638778 - DNA, 13 bp, Homo sapiens
gatgccagagggc

SEQ ID NO: 1638779 - DNA, 14 bp, Homo sapiens
gatgccagagggcc

SEQ ID NO: 1638780 - DNA, 16 bp, Homo sapiens
gatgccagagggccag

SEQ ID NO: 1638781 - DNA, 19 bp, Homo sapiens
gatgccagagggccagcag

SEQ ID NO: 1638782 - DNA, 12 bp, Homo sapiens
gatgccagcctt

SEQ ID NO: 1638783 - DNA, 20 bp, Homo sapiens
gatgccagcttctctctcca

SEQ ID NO: 1638784 - DNA, 17 bp, Homo sapiens
gatgccagggccgacca

SEQ ID NO: 1638785 - DNA, 18 bp, Homo sapiens
gatgccataatcagaaca

SEQ ID NO: 1638786 - DNA, 20 bp, Homo sapiens
gatgcccagggccactctgc

SEQ ID NO: 1638787 - DNA, 18 bp, Homo sapiens
gatgccgaggtaaaagtt

SEQ ID NO: 1638788 - DNA, 23 bp, Homo sapiens
gatgcctcatgatatgtcagggc

SEQ ID NO: 1638789 - DNA, 12 bp, Homo sapiens
gatgcctccacc

SEQ ID NO: 1638790 - DNA, 13 bp, Homo sapiens
gatgcctccaccg

SEQ ID NO: 1638791 - DNA, 17 bp, Homo sapiens
gatgcctgcatgctgaa

SEQ ID NO: 1638792 - DNA, 18 bp, Homo sapiens
gatgcctgcatgctgaaa

SEQ ID NO: 1638793 - DNA, 13 bp, Homo sapiens
gatgcctgcttga

SEQ ID NO: 1638794 - DNA, 15 bp, Homo sapiens
gatgccttttctgtg

SEQ ID NO: 1638795 - DNA, 18 bp, Homo sapiens
gatgccttttttgtagtt

SEQ ID NO: 1638796 - DNA, 14 bp, Homo sapiens
gatgcgcactgcat

SEQ ID NO: 1638797 - DNA, 15 bp, Homo sapiens
gatgcggatcctgct

SEQ ID NO: 1638798 - DNA, 17 bp, Homo sapiens
gatgcggatcctgctgg

SEQ ID NO: 1638799 - DNA, 20 bp, Homo sapiens
gatgcggatcctgctggggc

SEQ ID NO: 1638800 - DNA, 19 bp, Homo sapiens
gatgcgtctacccagactc

SEQ ID NO: 1638801 - DNA, 18 bp, Homo sapiens
gatgcgttgttacaggaa

SEQ ID NO: 1638802 - DNA, 18 bp, Homo sapiens
gatgctatggtcaggtta

SEQ ID NO: 1638803 - DNA, 23 bp, Homo sapiens
gatgctatttatgcaagttaggg

SEQ ID NO: 1638804 - DNA, 16 bp, Homo sapiens
gatgctccaagattct

SEQ ID NO: 1638805 - DNA, 17 bp, Homo sapiens
gatgctccaagattcta

SEQ ID NO: 1638806 - DNA, 21 bp, Homo sapiens
gatgctccctcccctgccctg

SEQ ID NO: 1638807 - DNA, 15 bp, Homo sapiens
gatgctcttctgtgg

SEQ ID NO: 1638808 - DNA, 14 bp, Homo sapiens
gatgctctttccca

SEQ ID NO: 1638809 - DNA, 12 bp, Homo sapiens
gatgctgacctc

SEQ ID NO: 1638810 - DNA, 24 bp, Homo sapiens
gatgctgacctcacctggtcctcc

SEQ ID NO: 1638811 - DNA, 15 bp, Homo sapiens
gatgctgaggccacc

SEQ ID NO: 1638812 - DNA, 20 bp, Homo sapiens
gatgctgaggccacccactg

SEQ ID NO: 1638813 - DNA, 16 bp, Homo sapiens
gatgctgcagcagagt

SEQ ID NO: 1638814 - DNA, 18 bp, Homo sapiens
ataggacatactgcatgt

SEQ ID NO: 1638815 - DNA, 19 bp, Homo sapiens
ataggacatactgcatgta

SEQ ID NO: 1638816 - DNA, 15 bp, Homo sapiens
ataggacctgcatcc

SEQ ID NO: 1638817 - DNA, 22 bp, Homo sapiens
ataggacctgcatccttcctgg

SEQ ID NO: 1638818 - DNA, 20 bp, Homo sapiens
ataggacctttccaccacag

SEQ ID NO: 1638819 - DNA, 15 bp, Homo sapiens
ataggagaaagcaaa

SEQ ID NO: 1638820 - DNA, 12 bp, Homo sapiens
ataggagactgc

SEQ ID NO: 1638821 - DNA, 20 bp, Homo sapiens
ataggagtatgtgctgtgaa

SEQ ID NO: 1638822 - DNA, 21 bp, Homo sapiens
ataggatattgctaattgtgt

SEQ ID NO: 1638823 - DNA, 16 bp, Homo sapiens
ataggcagggggccct

SEQ ID NO: 1638824 - DNA, 22 bp, Homo sapiens
ataggcagggggccctgcccca

SEQ ID NO: 1638825 - DNA, 15 bp, Homo sapiens
ataggcctgtccctt

SEQ ID NO: 1638826 - DNA, 21 bp, Homo sapiens
ataggcctgtcccttgcctct

SEQ ID NO: 1638827 - DNA, 22 bp, Homo sapiens
ataggcggggcacggtggctca

SEQ ID NO: 1638828 - DNA, 16 bp, Homo sapiens
ataggcggtcatgtgt

SEQ ID NO: 1638829 - DNA, 19 bp, Homo sapiens
ataggcggtcatgtgtgca

SEQ ID NO: 1638830 - DNA, 22 bp, Homo sapiens
ataggcggtcatgtgtgcatgt

SEQ ID NO: 1638831 - DNA, 18 bp, Homo sapiens
ataggctattaaaaaagt

SEQ ID NO: 1638832 - DNA, 13 bp, Homo sapiens
ataggctctgcac

SEQ ID NO: 1638833 - DNA, 15 bp, Homo sapiens
atagggagaatattt

SEQ ID NO: 1638834 - DNA, 14 bp, Homo sapiens
atagggctgagctc

SEQ ID NO: 1638835 - DNA, 17 bp, Homo sapiens
ataggggatatttaagg

SEQ ID NO: 1638836 - DNA, 21 bp, Homo sapiens
atagggtagaatgattaatca

SEQ ID NO: 1638837 - DNA, 16 bp, Homo sapiens
atagggttaaatggta

SEQ ID NO: 1638838 - DNA, 21 bp, Homo sapiens
ataggtcactggctctccaag

SEQ ID NO: 1638839 - DNA, 14 bp, Homo sapiens
ataggtcagagatg

SEQ ID NO: 1638840 - DNA, 17 bp, Homo sapiens
ataggtcatcatgaaag

SEQ ID NO: 1638841 - DNA, 15 bp, Homo sapiens
ataggtgctacaaaa

SEQ ID NO: 1638842 - DNA, 14 bp, Homo sapiens
ataggttagatata

SEQ ID NO: 1638843 - DNA, 15 bp, Homo sapiens
ataggttttaaatct

SEQ ID NO: 1638844 - DNA, 19 bp, Homo sapiens
atagtaataagatggctgt

SEQ ID NO: 1638845 - DNA, 20 bp, Homo sapiens
atagtaataagatggctgtg

SEQ ID NO: 1638846 - DNA, 22 bp, Homo sapiens
atagtaataagatggctgtggc

SEQ ID NO: 1638847 - DNA, 17 bp, Homo sapiens
atagtaccaatcatttt

SEQ ID NO: 1638848 - DNA, 15 bp, Homo sapiens
atagtatacattgtc

SEQ ID NO: 1638849 - DNA, 15 bp, Homo sapiens
atagtatagaagtct

SEQ ID NO: 1638850 - DNA, 17 bp, Homo sapiens
atagtatatttatactc

SEQ ID NO: 1638851 - DNA, 18 bp, Homo sapiens
atagtatatttatactct

SEQ ID NO: 1638852 - DNA, 22 bp, Homo sapiens
atagtcatggggtccctgctgc

SEQ ID NO: 1638853 - DNA, 14 bp, Homo sapiens
atagtctctttaaa

SEQ ID NO: 1638854 - DNA, 21 bp, Homo sapiens
atagtctctttaaaaggaaag

SEQ ID NO: 1638855 - DNA, 22 bp, Homo sapiens
atagtctgattttaatgaaatc

SEQ ID NO: 1638856 - DNA, 16 bp, Homo sapiens
atagtcttgaaatgaa

SEQ ID NO: 1638857 - DNA, 14 bp, Homo sapiens
atagtcttttgctt

SEQ ID NO: 1638858 - DNA, 17 bp, Homo sapiens
atagtcttttgcttttg

SEQ ID NO: 1638859 - DNA, 12 bp, Homo sapiens
atagtgactttt

SEQ ID NO: 1638860 - DNA, 21 bp, Homo sapiens
atagtgacttttcaagtattt

SEQ ID NO: 1638861 - DNA, 23 bp, Homo sapiens
atagtgcaacatctctgaatcct

SEQ ID NO: 1638862 - DNA, 20 bp, Homo sapiens
gatggcatttggtctcaggc

SEQ ID NO: 1638863 - DNA, 16 bp, Homo sapiens
gatggccaagagcatc

SEQ ID NO: 1638864 - DNA, 22 bp, Homo sapiens
gatggccaagggggtggacgca

SEQ ID NO: 1638865 - DNA, 14 bp, Homo sapiens
gatggccaggccag

SEQ ID NO: 1638866 - DNA, 20 bp, Homo sapiens
gatggcccctccagcacaca

SEQ ID NO: 1638867 - DNA, 18 bp, Homo sapiens
gatggccgtggatggccg

SEQ ID NO: 1638868 - DNA, 14 bp, Homo sapiens
gatggccttaattt

SEQ ID NO: 1638869 - DNA, 18 bp, Homo sapiens
gatggccttaatttcctt

SEQ ID NO: 1638870 - DNA, 16 bp, Homo sapiens
gatggcgcgggaggca

SEQ ID NO: 1638871 - DNA, 20 bp, Homo sapiens
gatggcgcgggaggcaccag

SEQ ID NO: 1638872 - DNA, 19 bp, Homo sapiens
gatggcgctattgcactcc

SEQ ID NO: 1638873 - DNA, 21 bp, Homo sapiens
gatggctgctagattttaatt

SEQ ID NO: 1638874 - DNA, 21 bp, Homo sapiens
gatggctgggtccttgggcct

SEQ ID NO: 1638875 - DNA, 22 bp, Homo sapiens
gatggctgggtccttgggcctg

SEQ ID NO: 1638876 - DNA, 14 bp, Homo sapiens
gatggctgtggcat

SEQ ID NO: 1638877 - DNA, 22 bp, Homo sapiens
gatggctgtggcatttccaaac

SEQ ID NO: 1638878 - DNA, 13 bp, Homo sapiens
gatggcttgtcta

SEQ ID NO: 1638879 - DNA, 21 bp, Homo sapiens
gatggctttgaatgcggccca

SEQ ID NO: 1638880 - DNA, 12 bp, Homo sapiens
gatgggaaaata

SEQ ID NO: 1638881 - DNA, 23 bp, Homo sapiens
gatgggaatgaggtgggaggtgg

SEQ ID NO: 1638882 - DNA, 18 bp, Homo sapiens
gatgggcaaagcttgtca

SEQ ID NO: 1638883 - DNA, 14 bp, Homo sapiens
gatgggcagcccaa

SEQ ID NO: 1638884 - DNA, 23 bp, Homo sapiens
gatgggcagcccaacagcacttt

SEQ ID NO: 1638885 - DNA, 22 bp, Homo sapiens
gatgggcattgggctgacacct

SEQ ID NO: 1638886 - DNA, 21 bp, Homo sapiens
gatgggccctatgtctcagga

SEQ ID NO: 1638887 - DNA, 16 bp, Homo sapiens
gatgggggaactcaga

SEQ ID NO: 1638888 - DNA, 20 bp, Homo sapiens
gatgggggaactcagatcca

SEQ ID NO: 1638889 - DNA, 16 bp, Homo sapiens
gatgggggaactgtga

SEQ ID NO: 1638890 - DNA, 20 bp, Homo sapiens
gatgggggtgcaggcagcct

SEQ ID NO: 1638891 - DNA, 18 bp, Homo sapiens
gatggggtctgtgactgg

SEQ ID NO: 1638892 - DNA, 23 bp, Homo sapiens
gatggggtctgtgactggatctt

SEQ ID NO: 1638893 - DNA, 14 bp, Homo sapiens
gatggggttctgga

SEQ ID NO: 1638894 - DNA, 21 bp, Homo sapiens
gatgggtcagttgtatcagca

SEQ ID NO: 1638895 - DNA, 14 bp, Homo sapiens
gatgggtctgatat

SEQ ID NO: 1638896 - DNA, 13 bp, Homo sapiens
gatgggtgcagga

SEQ ID NO: 1638897 - DNA, 22 bp, Homo sapiens
gatggtaagagaaaagagagaa

SEQ ID NO: 1638898 - DNA, 13 bp, Homo sapiens
gatggtcatccag

SEQ ID NO: 1638899 - DNA, 17 bp, Homo sapiens
gatggtcctcacaagcc

SEQ ID NO: 1638900 - DNA, 13 bp, Homo sapiens
gatggtcctgggg

SEQ ID NO: 1638901 - DNA, 24 bp, Homo sapiens
gatggtcctggggctctgtgcagg

SEQ ID NO: 1638902 - DNA, 18 bp, Homo sapiens
gatggtgccagagagggg

SEQ ID NO: 1638903 - DNA, 15 bp, Homo sapiens
gatggtgctgcccag

SEQ ID NO: 1638904 - DNA, 21 bp, Homo sapiens
gatggtggccgcccacccgcc

SEQ ID NO: 1638905 - DNA, 21 bp, Homo sapiens
gatggtgtctcttctttagaa

SEQ ID NO: 1638906 - DNA, 14 bp, Homo sapiens
gatggtgttatctt

SEQ ID NO: 1638907 - DNA, 22 bp, Homo sapiens
gatggttaaaaaggccaaagat

SEQ ID NO: 1638908 - DNA, 17 bp, Homo sapiens
gatggttattttctttt

SEQ ID NO: 1638909 - DNA, 23 bp, Homo sapiens
gatggttattttcttttctttca

SEQ ID NO: 1638910 - DNA, 14 bp, Homo sapiens
gatggtttcttgca

SEQ ID NO: 1638911 - DNA, 16 bp, Homo sapiens
gatgtaaaatcttgtc

SEQ ID NO: 1638912 - DNA, 13 bp, Homo sapiens
gatgtaaaccatt

SEQ ID NO: 1638913 - DNA, 21 bp, Homo sapiens
gatgtaatctctctgcagctg

SEQ ID NO: 1638914 - DNA, 23 bp, Homo sapiens
gatgtaatctctctgcagctgcc

SEQ ID NO: 1638915 - DNA, 22 bp, Homo sapiens
gatgtacataactcctgtccct

SEQ ID NO: 1638916 - DNA, 19 bp, Homo sapiens
gatgtaccagtttgtccat

SEQ ID NO: 1638917 - DNA, 19 bp, Homo sapiens
gatgtaccatgaaacaaag

SEQ ID NO: 1638918 - DNA, 17 bp, Homo sapiens
gatgtagagagaacagg

SEQ ID NO: 1638919 - DNA, 13 bp, Homo sapiens
gatgtaggagctg

SEQ ID NO: 1638920 - DNA, 14 bp, Homo sapiens
gatgtaggagctgg

SEQ ID NO: 1638921 - DNA, 22 bp, Homo sapiens
gatgtatgaaggcttttggtct

SEQ ID NO: 1638922 - DNA, 19 bp, Homo sapiens
gatgtatttttgatgtata

SEQ ID NO: 1638923 - DNA, 19 bp, Homo sapiens
gatgtcaatagcattgttt

SEQ ID NO: 1638924 - DNA, 18 bp, Homo sapiens
gatgtcaatttctgtgtt

SEQ ID NO: 1638925 - DNA, 20 bp, Homo sapiens
gatgtcatagccaaagccag

SEQ ID NO: 1638926 - DNA, 20 bp, Homo sapiens
gatgtccacagatgcctcca

SEQ ID NO: 1638927 - DNA, 12 bp, Homo sapiens
gatgtccagaag

SEQ ID NO: 1638928 - DNA, 23 bp, Homo sapiens
gatgtccagggggagaaggaaga

SEQ ID NO: 1638929 - DNA, 17 bp, Homo sapiens
gatgtcccctgtcccac

SEQ ID NO: 1638930 - DNA, 22 bp, Homo sapiens
gatgtcccctgtcccaccaact

SEQ ID NO: 1638931 - DNA, 22 bp, Homo sapiens
atataagcccttgattggaagg

SEQ ID NO: 1638932 - DNA, 17 bp, Homo sapiens
atataagtattctaaat

SEQ ID NO: 1638933 - DNA, 18 bp, Homo sapiens
atataagtgacttgaaca

SEQ ID NO: 1638934 - DNA, 19 bp, Homo sapiens
atataagtttgaaggaaac

SEQ ID NO: 1638935 - DNA, 21 bp, Homo sapiens
atataagtttgaaggaaacag

SEQ ID NO: 1638936 - DNA, 12 bp, Homo sapiens
atataataaata

SEQ ID NO: 1638937 - DNA, 19 bp, Homo sapiens
atataatacacaaaatcaa

SEQ ID NO: 1638938 - DNA, 21 bp, Homo sapiens
atataatacacaaaatcaaat

SEQ ID NO: 1638939 - DNA, 12 bp, Homo sapiens
atataatacata

SEQ ID NO: 1638940 - DNA, 13 bp, Homo sapiens
atataatacatat

SEQ ID NO: 1638941 - DNA, 16 bp, Homo sapiens
atataatgtattttct

SEQ ID NO: 1638942 - DNA, 15 bp, Homo sapiens
atataatgttgataa

SEQ ID NO: 1638943 - DNA, 21 bp, Homo sapiens
atataattatcggaagcagtg

SEQ ID NO: 1638944 - DNA, 14 bp, Homo sapiens
atataattctgtaa

SEQ ID NO: 1638945 - DNA, 14 bp, Homo sapiens
atatacagtaactt

SEQ ID NO: 1638946 - DNA, 16 bp, Homo sapiens
atatacagtaacttta

SEQ ID NO: 1638947 - DNA, 22 bp, Homo sapiens
atatacagtaactttatgtgta

SEQ ID NO: 1638948 - DNA, 17 bp, Homo sapiens
atatacagtatagattt

SEQ ID NO: 1638949 - DNA, 15 bp, Homo sapiens
atatacatattgtat

SEQ ID NO: 1638950 - DNA, 17 bp, Homo sapiens
atatacatctgtgtatt

SEQ ID NO: 1638951 - DNA, 21 bp, Homo sapiens
atatacatgggtgaattatgt

SEQ ID NO: 1638952 - DNA, 21 bp, Homo sapiens
atatacatgtttttctattaa

SEQ ID NO: 1638953 - DNA, 16 bp, Homo sapiens
atatacattgcttaga

SEQ ID NO: 1638954 - DNA, 13 bp, Homo sapiens
atatacattgtgt

SEQ ID NO: 1638955 - DNA, 14 bp, Homo sapiens
atatacattgtgtg

SEQ ID NO: 1638956 - DNA, 17 bp, Homo sapiens
atatacattgtgtgaaa

SEQ ID NO: 1638957 - DNA, 15 bp, Homo sapiens
atatacattttctaa

SEQ ID NO: 1638958 - DNA, 16 bp, Homo sapiens
atatacattttctaaa

SEQ ID NO: 1638959 - DNA, 12 bp, Homo sapiens
atatacattttt

SEQ ID NO: 1638960 - DNA, 14 bp, Homo sapiens
atataccaaattaa

SEQ ID NO: 1638961 - DNA, 21 bp, Homo sapiens
atataccttttttgttccact

SEQ ID NO: 1638962 - DNA, 18 bp, Homo sapiens
atatactgggttcttgtt

SEQ ID NO: 1638963 - DNA, 15 bp, Homo sapiens
atatacttaaatgga

SEQ ID NO: 1638964 - DNA, 13 bp, Homo sapiens
atatacttatttt

SEQ ID NO: 1638965 - DNA, 13 bp, Homo sapiens
atatagaacacaa

SEQ ID NO: 1638966 - DNA, 21 bp, Homo sapiens
atatagagacaggacagaatg

SEQ ID NO: 1638967 - DNA, 20 bp, Homo sapiens
atataggatattgctaattg

SEQ ID NO: 1638968 - DNA, 23 bp, Homo sapiens
atatagtaactactttttatact

SEQ ID NO: 1638969 - DNA, 20 bp, Homo sapiens
atatagtatatttatactct

SEQ ID NO: 1638970 - DNA, 18 bp, Homo sapiens
atatagtcaacttattct

SEQ ID NO: 1638971 - DNA, 16 bp, Homo sapiens
atatagtccagacact

SEQ ID NO: 1638972 - DNA, 22 bp, Homo sapiens
atatagtgggtacatcaagtcc

SEQ ID NO: 1638973 - DNA, 21 bp, Homo sapiens
atatagttaattgtggcttta

SEQ ID NO: 1638974 - DNA, 19 bp, Homo sapiens
atatagttccttgccttaa

SEQ ID NO: 1638975 - DNA, 22 bp, Homo sapiens
atatagttccttgccttaataa

SEQ ID NO: 1638976 - DNA, 20 bp, Homo sapiens
gatgttttgtcccatttcct

SEQ ID NO: 1638977 - DNA, 23 bp, Homo sapiens
gatgttttgtcccatttccttgg

SEQ ID NO: 1638978 - DNA, 16 bp, Homo sapiens
gattaaacgtgcagac

SEQ ID NO: 1638979 - DNA, 15 bp, Homo sapiens
gattaaaggaaggaa

SEQ ID NO: 1638980 - DNA, 16 bp, Homo sapiens
gattaaaggaaggaaa

SEQ ID NO: 1638981 - DNA, 15 bp, Homo sapiens
gattaaatatttgaa

SEQ ID NO: 1638982 - DNA, 14 bp, Homo sapiens
gattaacctctgca

SEQ ID NO: 1638983 - DNA, 12 bp, Homo sapiens
gattaacttgga

SEQ ID NO: 1638984 - DNA, 15 bp, Homo sapiens
gattaagatgtatat

SEQ ID NO: 1638985 - DNA, 18 bp, Homo sapiens
gattaataagaacttgaa

SEQ ID NO: 1638986 - DNA, 10 bp, Homo sapiens
gattaatcaa

SEQ ID NO: 1638987 - DNA, 19 bp, Homo sapiens
gattaatctctaaaattct

SEQ ID NO: 1638988 - DNA, 22 bp, Homo sapiens
gattaatgtcaatgttaatcag

SEQ ID NO: 1638989 - DNA, 19 bp, Homo sapiens
gattaatgttttgtacaat

SEQ ID NO: 1638990 - DNA, 20 bp, Homo sapiens
gattaatttgcatctgaaat

SEQ ID NO: 1638991 - DNA, 19 bp, Homo sapiens
gattacaaatcagaagtca

SEQ ID NO: 1638992 - DNA, 21 bp, Homo sapiens
gattacaaatcagaagtcatc

SEQ ID NO: 1638993 - DNA, 18 bp, Homo sapiens
gattacaggcatgtgcca

SEQ ID NO: 1638994 - DNA, 20 bp, Homo sapiens
gattacataatcaaagctac

SEQ ID NO: 1638995 - DNA, 22 bp, Homo sapiens
gattacataatcaaagctacct

SEQ ID NO: 1638996 - DNA, 14 bp, Homo sapiens
gattacctgccaat

SEQ ID NO: 1638997 - DNA, 18 bp, Homo sapiens
gattactcagagcagatg

SEQ ID NO: 1638998 - DNA, 23 bp, Homo sapiens
gattactctccatatcccttcct

SEQ ID NO: 1638999 - DNA, 16 bp, Homo sapiens
gattactgatgtgata

SEQ ID NO: 1639000 - DNA, 17 bp, Homo sapiens
gattactgtcaataaac

SEQ ID NO: 1639001 - DNA, 20 bp, Homo sapiens
gattacttagattgtgttcc

SEQ ID NO: 1639002 - DNA, 12 bp, Homo sapiens
gattagaaacta

SEQ ID NO: 1639003 - DNA, 20 bp, Homo sapiens
gattagaaattacctgtgga

SEQ ID NO: 1639004 - DNA, 22 bp, Homo sapiens
gattagaaattacctgtggata

SEQ ID NO: 1639005 - DNA, 16 bp, Homo sapiens
gattagacagaacacc

SEQ ID NO: 1639006 - DNA, 17 bp, Homo sapiens
gattagagcctgtaaac

SEQ ID NO: 1639007 - DNA, 14 bp, Homo sapiens
gattagtaagtctt

SEQ ID NO: 1639008 - DNA, 21 bp, Homo sapiens
gattataaaaaatgtaacatc

SEQ ID NO: 1639009 - DNA, 22 bp, Homo sapiens
gattataaaaaatgtaacatca

SEQ ID NO: 1639010 - DNA, 21 bp, Homo sapiens
gattataatatgtgccttaag

SEQ ID NO: 1639011 - DNA, 13 bp, Homo sapiens
gattatagattct

SEQ ID NO: 1639012 - DNA, 14 bp, Homo sapiens
gattatagattcta

SEQ ID NO: 1639013 - DNA, 17 bp, Homo sapiens
gattatagattctaaag

SEQ ID NO: 1639014 - DNA, 18 bp, Homo sapiens
gattatatatccctgata

SEQ ID NO: 1639015 - DNA, 13 bp, Homo sapiens
gattatattcaca

SEQ ID NO: 1639016 - DNA, 18 bp, Homo sapiens
gattatcttcagcccagg

SEQ ID NO: 1639017 - DNA, 20 bp, Homo sapiens
gattatcttcagcccaggct

SEQ ID NO: 1639018 - DNA, 20 bp, Homo sapiens
gattatgagttccctaaaca

SEQ ID NO: 1639019 - DNA, 21 bp, Homo sapiens
gattatgagttccctaaacaa

SEQ ID NO: 1639020 - DNA, 22 bp, Homo sapiens
gattatgatgcatacagttttc

SEQ ID NO: 1639021 - DNA, 13 bp, Homo sapiens
gattatgggtcac

SEQ ID NO: 1639022 - DNA, 18 bp, Homo sapiens
gattatgggtcacaggaa

SEQ ID NO: 1639023 - DNA, 17 bp, Homo sapiens
gattatggttttgtgat

SEQ ID NO: 1639024 - DNA, 22 bp, Homo sapiens
gattatgtatggatatatttga

SEQ ID NO: 1639025 - DNA, 15 bp, Homo sapiens
gattatgttcctgct

SEQ ID NO: 1639026 - DNA, 22 bp, Homo sapiens
gattatgttcctgctgtatttc

SEQ ID NO: 1639027 - DNA, 19 bp, Homo sapiens
gattattaacgatgtccaa

SEQ ID NO: 1639028 - DNA, 19 bp, Homo sapiens
gattattatgtttattaca

SEQ ID NO: 1639029 - DNA, 22 bp, Homo sapiens
gattattatgtttattacaatt

SEQ ID NO: 1639030 - DNA, 14 bp, Homo sapiens
gattattcatttaa

SEQ ID NO: 1639031 - DNA, 16 bp, Homo sapiens
gattattcatttaaaa

SEQ ID NO: 1639032 - DNA, 19 bp, Homo sapiens
gattattcatttaaaatga

SEQ ID NO: 1639033 - DNA, 20 bp, Homo sapiens
gattattcatttaaaatgat

SEQ ID NO: 1639034 - DNA, 20 bp, Homo sapiens
gattattgaatgttatatca

SEQ ID NO: 1639035 - DNA, 23 bp, Homo sapiens
gattattgtgacttcactgtata

SEQ ID NO: 1639036 - DNA, 14 bp, Homo sapiens
gattatttcacttt

SEQ ID NO: 1639037 - DNA, 20 bp, Homo sapiens
gattatttgtatttacagtt

SEQ ID NO: 1639038 - DNA, 21 bp, Homo sapiens
gattcaaaattgacattgctt

SEQ ID NO: 1639039 - DNA, 19 bp, Homo sapiens
gattcaaaggttctaggtt

SEQ ID NO: 1639040 - DNA, 18 bp, Homo sapiens
gattcaaattgctgcttg

SEQ ID NO: 1639041 - DNA, 15 bp, Homo sapiens
gattcaacagggaag

SEQ ID NO: 1639042 - DNA, 19 bp, Homo sapiens
gattcaaccaaccaaggac

SEQ ID NO: 1639043 - DNA, 14 bp, Homo sapiens
gattcaatctgtaa

SEQ ID NO: 1639044 - DNA, 19 bp, Homo sapiens
gattcaatctgtaaactgt

SEQ ID NO: 1639045 - DNA, 21 bp, Homo sapiens
gattcaatctgtaaactgtgt

SEQ ID NO: 1639046 - DNA, 17 bp, Homo sapiens
gattcaattataattgt

SEQ ID NO: 1639047 - DNA, 14 bp, Homo sapiens
gattcacatctgca

SEQ ID NO: 1639048 - DNA, 16 bp, Homo sapiens
atatcaaacattaaaa

SEQ ID NO: 1639049 - DNA, 21 bp, Homo sapiens
atatcaaataaaatatcataa

SEQ ID NO: 1639050 - DNA, 23 bp, Homo sapiens
atatcaaataaaatatcataaag

SEQ ID NO: 1639051 - DNA, 15 bp, Homo sapiens
atatcaactctgaag

SEQ ID NO: 1639052 - DNA, 17 bp, Homo sapiens
atatcaagaagtcttga

SEQ ID NO: 1639053 - DNA, 14 bp, Homo sapiens
atatcacacaatat

SEQ ID NO: 1639054 - DNA, 11 bp, Homo sapiens
atatcacctct

SEQ ID NO: 1639055 - DNA, 13 bp, Homo sapiens
atatcactaattt

SEQ ID NO: 1639056 - DNA, 14 bp, Homo sapiens
atatcacttaaatc

SEQ ID NO: 1639057 - DNA, 20 bp, Homo sapiens
atatcagacaagcactattt

SEQ ID NO: 1639058 - DNA, 12 bp, Homo sapiens
atatcagcctga

SEQ ID NO: 1639059 - DNA, 22 bp, Homo sapiens
atatcagcctgagtctcctgtg

SEQ ID NO: 1639060 - DNA, 16 bp, Homo sapiens
atatcagctttgataa

SEQ ID NO: 1639061 - DNA, 20 bp, Homo sapiens
atatcagctttgataattgt

SEQ ID NO: 1639062 - DNA, 22 bp, Homo sapiens
atatcaggctattatttattgt

SEQ ID NO: 1639063 - DNA, 18 bp, Homo sapiens
atatcagggtataaatta

SEQ ID NO: 1639064 - DNA, 18 bp, Homo sapiens
atatcagtcgttttagtg

SEQ ID NO: 1639065 - DNA, 19 bp, Homo sapiens
atatcagttactcagccct

SEQ ID NO: 1639066 - DNA, 18 bp, Homo sapiens
atatcatatttctgtgga

SEQ ID NO: 1639067 - DNA, 15 bp, Homo sapiens
atatcatgaaacact

SEQ ID NO: 1639068 - DNA, 18 bp, Homo sapiens
atatcatgaaacacttct

SEQ ID NO: 1639069 - DNA, 19 bp, Homo sapiens
atatcatgttaaattagaa

SEQ ID NO: 1639070 - DNA, 23 bp, Homo sapiens
atatcatgttaaattagaatgaa

SEQ ID NO: 1639071 - DNA, 23 bp, Homo sapiens
atatcatttattttttacattat

SEQ ID NO: 1639072 - DNA, 19 bp, Homo sapiens
atatccaaaagctttttat

SEQ ID NO: 1639073 - DNA, 21 bp, Homo sapiens
atatccaagtaccaatgctgt

SEQ ID NO: 1639074 - DNA, 22 bp, Homo sapiens
atatccaagtaccaatgctgtt

SEQ ID NO: 1639075 - DNA, 17 bp, Homo sapiens
atatccatagtgacttt

SEQ ID NO: 1639076 - DNA, 16 bp, Homo sapiens
atatccatctttttct

SEQ ID NO: 1639077 - DNA, 15 bp, Homo sapiens
atatccatttatctt

SEQ ID NO: 1639078 - DNA, 14 bp, Homo sapiens
atatcctatactgg

SEQ ID NO: 1639079 - DNA, 13 bp, Homo sapiens
atatcctgagcca

SEQ ID NO: 1639080 - DNA, 10 bp, Homo sapiens
atatcctgtg

SEQ ID NO: 1639081 - DNA, 14 bp, Homo sapiens
atatcctgtgactg

SEQ ID NO: 1639082 - DNA, 15 bp, Homo sapiens
atatcctttctaaca

SEQ ID NO: 1639083 - DNA, 18 bp, Homo sapiens
atatctaatatatatgaa

SEQ ID NO: 1639084 - DNA, 15 bp, Homo sapiens
atatctaatatgaag

SEQ ID NO: 1639085 - DNA, 21 bp, Homo sapiens
atatctaccccagactagatg

SEQ ID NO: 1639086 - DNA, 22 bp, Homo sapiens
atatctagtaatatatttaaag

SEQ ID NO: 1639087 - DNA, 22 bp, Homo sapiens
atatctataaaatagatataaa

SEQ ID NO: 1639088 - DNA, 18 bp, Homo sapiens
atatctatatatataatt

SEQ ID NO: 1639089 - DNA, 20 bp, Homo sapiens
atatctctgccaacatgagg

SEQ ID NO: 1639090 - DNA, 12 bp, Homo sapiens
gattctgaatct

SEQ ID NO: 1639091 - DNA, 19 bp, Homo sapiens
gattctgatttcagttttt

SEQ ID NO: 1639092 - DNA, 22 bp, Homo sapiens
gattctgcagctgcttttgcat

SEQ ID NO: 1639093 - DNA, 11 bp, Homo sapiens
gattctgctgg

SEQ ID NO: 1639094 - DNA, 17 bp, Homo sapiens
gattctggatctcctgc

SEQ ID NO: 1639095 - DNA, 19 bp, Homo sapiens
gattctggatctcctgctg

SEQ ID NO: 1639096 - DNA, 11 bp, Homo sapiens
gattctgggaa

SEQ ID NO: 1639097 - DNA, 12 bp, Homo sapiens
gattctgggaag

SEQ ID NO: 1639098 - DNA, 15 bp, Homo sapiens
gattctggggctgtg

SEQ ID NO: 1639099 - DNA, 12 bp, Homo sapiens
gattctgtggct

SEQ ID NO: 1639100 - DNA, 16 bp, Homo sapiens
gattcttcaaaagcat

SEQ ID NO: 1639101 - DNA, 15 bp, Homo sapiens
gattcttcccgctcc

SEQ ID NO: 1639102 - DNA, 19 bp, Homo sapiens
gattcttcccgctccccac

SEQ ID NO: 1639103 - DNA, 16 bp, Homo sapiens
gattcttgattcctgg

SEQ ID NO: 1639104 - DNA, 13 bp, Homo sapiens
gattcttgtaaat

SEQ ID NO: 1639105 - DNA, 17 bp, Homo sapiens
gattcttgtaaatcttt

SEQ ID NO: 1639106 - DNA, 17 bp, Homo sapiens
gattctttaaggagata

SEQ ID NO: 1639107 - DNA, 19 bp, Homo sapiens
gattctttaaggagataga

SEQ ID NO: 1639108 - DNA, 19 bp, Homo sapiens
gattctttccattatgatt

SEQ ID NO: 1639109 - DNA, 23 bp, Homo sapiens
gattctttccccagaggctccca

SEQ ID NO: 1639110 - DNA, 12 bp, Homo sapiens
gattgaaaagaa

SEQ ID NO: 1639111 - DNA, 16 bp, Homo sapiens
gattgaaaagaagaaa

SEQ ID NO: 1639112 - DNA, 18 bp, Homo sapiens
gattgaaaatgtccagga

SEQ ID NO: 1639113 - DNA, 19 bp, Homo sapiens
gattgaaaatgtccaggaa

SEQ ID NO: 1639114 - DNA, 12 bp, Homo sapiens
gattgagaagcc

SEQ ID NO: 1639115 - DNA, 17 bp, Homo sapiens
gattgagctctctgccc

SEQ ID NO: 1639116 - DNA, 22 bp, Homo sapiens
gattgatcggagcctcctctct

SEQ ID NO: 1639117 - DNA, 18 bp, Homo sapiens
gattgattcagtcttctg

SEQ ID NO: 1639118 - DNA, 20 bp, Homo sapiens
gattgattttaaaatgtaca

SEQ ID NO: 1639119 - DNA, 11 bp, Homo sapiens
gattgattttc

SEQ ID NO: 1639120 - DNA, 23 bp, Homo sapiens
gattgcacgtggcctcttgagca

SEQ ID NO: 1639121 - DNA, 15 bp, Homo sapiens
gattgcagaattgtt

SEQ ID NO: 1639122 - DNA, 18 bp, Homo sapiens
gattgcagctttatgttc

SEQ ID NO: 1639123 - DNA, 22 bp, Homo sapiens
gattgcatttttattaaagcat

SEQ ID NO: 1639124 - DNA, 14 bp, Homo sapiens
gattgcctctgaaa

SEQ ID NO: 1639125 - DNA, 19 bp, Homo sapiens
gattgcggtttacagctat

SEQ ID NO: 1639126 - DNA, 15 bp, Homo sapiens
gattgctatgaatga

SEQ ID NO: 1639127 - DNA, 13 bp, Homo sapiens
gattgctctggag

SEQ ID NO: 1639128 - DNA, 18 bp, Homo sapiens
gattgctctggagcagcc

SEQ ID NO: 1639129 - DNA, 18 bp, Homo sapiens
gattgctgataataaatt

SEQ ID NO: 1639130 - DNA, 13 bp, Homo sapiens
gattgctgccact

SEQ ID NO: 1639131 - DNA, 22 bp, Homo sapiens
gattgctgccactttttaacta

SEQ ID NO: 1639132 - DNA, 17 bp, Homo sapiens
gattgcttaaaatagca

SEQ ID NO: 1639133 - DNA, 16 bp, Homo sapiens
gattgcttctgtagta

SEQ ID NO: 1639134 - DNA, 15 bp, Homo sapiens
gattggaatgcagag

SEQ ID NO: 1639135 - DNA, 15 bp, Homo sapiens
gattggaccaggcca

SEQ ID NO: 1639136 - DNA, 16 bp, Homo sapiens
gattggacggcctgat

SEQ ID NO: 1639137 - DNA, 20 bp, Homo sapiens
gattggattattcatttaaa

SEQ ID NO: 1639138 - DNA, 11 bp, Homo sapiens
gattggcctgt

SEQ ID NO: 1639139 - DNA, 23 bp, Homo sapiens
gattggctgcttaaactggaaag

SEQ ID NO: 1639140 - DNA, 11 bp, Homo sapiens
gattggctttg

SEQ ID NO: 1639141 - DNA, 14 bp, Homo sapiens
gattgggggctggt

SEQ ID NO: 1639142 - DNA, 12 bp, Homo sapiens
gattggtgttcg

SEQ ID NO: 1639143 - DNA, 18 bp, Homo sapiens
gattggttgtgccttccc

SEQ ID NO: 1639144 - DNA, 20 bp, Homo sapiens
gattggttgtgccttccctt

SEQ ID NO: 1639145 - DNA, 20 bp, Homo sapiens
gattgtcctttaaaaaagaa

SEQ ID NO: 1639146 - DNA, 16 bp, Homo sapiens
gattgtggaaaaccag

SEQ ID NO: 1639147 - DNA, 18 bp, Homo sapiens
gattgtggaaaaccagga

SEQ ID NO: 1639148 - DNA, 23 bp, Homo sapiens
gattgtgtacatagagcaatgtt

SEQ ID NO: 1639149 - DNA, 20 bp, Homo sapiens
gattgtgttcctgaagaaaa

SEQ ID NO: 1639150 - DNA, 23 bp, Homo sapiens
gattgtgtttgttcataataaaa

SEQ ID NO: 1639151 - DNA, 14 bp, Homo sapiens
gattgttaaaataa

SEQ ID NO: 1639152 - DNA, 23 bp, Homo sapiens
gattgttaggagtggttctcatt

SEQ ID NO: 1639153 - DNA, 13 bp, Homo sapiens
gattgttgtttgc

SEQ ID NO: 1639154 - DNA, 16 bp, Homo sapiens
gatttaaaagcctgct

SEQ ID NO: 1639155 - DNA, 12 bp, Homo sapiens
gatttaaatgcc

SEQ ID NO: 1639156 - DNA, 18 bp, Homo sapiens
gatttaacagtcatttaa

SEQ ID NO: 1639157 - DNA, 18 bp, Homo sapiens
gatttaagccttacaaag

SEQ ID NO: 1639158 - DNA, 19 bp, Homo sapiens
gatttaagtgaatacatta

SEQ ID NO: 1639159 - DNA, 22 bp, Homo sapiens
gatttaagtgaatacattaacg

SEQ ID NO: 1639160 - DNA, 12 bp, Homo sapiens
gatttacattca

SEQ ID NO: 1639161 - DNA, 16 bp, Homo sapiens
gatttaccttttctgt

SEQ ID NO: 1639162 - DNA, 20 bp, Homo sapiens
gatttaccttttctgttgta

SEQ ID NO: 1639163 - DNA, 12 bp, Homo sapiens
gatttagaaaaa

SEQ ID NO: 1639164 - DNA, 21 bp, Homo sapiens
gatttagaaaaaagtttacaa

SEQ ID NO: 1639165 - DNA, 23 bp, Homo sapiens
gatttaggcttctatgtccaaca

SEQ ID NO: 1639166 - DNA, 14 bp, Homo sapiens
gatttataaacaga

SEQ ID NO: 1639167 - DNA, 22 bp, Homo sapiens
atatgtgtttttcacatttgcg

SEQ ID NO: 1639168 - DNA, 16 bp, Homo sapiens
atatgttaatttgtgt

SEQ ID NO: 1639169 - DNA, 22 bp, Homo sapiens
atatgttagaatcaaatactca

SEQ ID NO: 1639170 - DNA, 12 bp, Homo sapiens
atatgttcaact

SEQ ID NO: 1639171 - DNA, 16 bp, Homo sapiens
atatgttcaactggag

SEQ ID NO: 1639172 - DNA, 18 bp, Homo sapiens
atatgttcaggaaatgaa

SEQ ID NO: 1639173 - DNA, 14 bp, Homo sapiens
atatgttgtaataa

SEQ ID NO: 1639174 - DNA, 21 bp, Homo sapiens
atatgttgtaatatttcttca

SEQ ID NO: 1639175 - DNA, 16 bp, Homo sapiens
atatgttgttaaacac

SEQ ID NO: 1639176 - DNA, 17 bp, Homo sapiens
atatgtttaccttttaa

SEQ ID NO: 1639177 - DNA, 24 bp, Homo sapiens
atatgtttaccttttaattaatga

SEQ ID NO: 1639178 - DNA, 14 bp, Homo sapiens
atatgtttctgcta

SEQ ID NO: 1639179 - DNA, 24 bp, Homo sapiens
atattaaaaaacttcatgtaattt

SEQ ID NO: 1639180 - DNA, 19 bp, Homo sapiens
atattaaaacaataatgca

SEQ ID NO: 1639181 - DNA, 15 bp, Homo sapiens
atattaaaattccaa

SEQ ID NO: 1639182 - DNA, 21 bp, Homo sapiens
atattaaaattccaaattcat

SEQ ID NO: 1639183 - DNA, 12 bp, Homo sapiens
atattaaaattg

SEQ ID NO: 1639184 - DNA, 12 bp, Homo sapiens
atattaaacaaa

SEQ ID NO: 1639185 - DNA, 18 bp, Homo sapiens
atattaaacaaagtttca

SEQ ID NO: 1639186 - DNA, 18 bp, Homo sapiens
atattaaagattctcttt

SEQ ID NO: 1639187 - DNA, 13 bp, Homo sapiens
atattaaataata

SEQ ID NO: 1639188 - DNA, 12 bp, Homo sapiens
atattaaataca

SEQ ID NO: 1639189 - DNA, 16 bp, Homo sapiens
atattaaatgttgctt

SEQ ID NO: 1639190 - DNA, 17 bp, Homo sapiens
atattaagaaagactat

SEQ ID NO: 1639191 - DNA, 14 bp, Homo sapiens
atattaagacagtg

SEQ ID NO: 1639192 - DNA, 17 bp, Homo sapiens
atattaagacagtgtac

SEQ ID NO: 1639193 - DNA, 13 bp, Homo sapiens
atattaagcactt

SEQ ID NO: 1639194 - DNA, 20 bp, Homo sapiens
atattaagcactttaagctc

SEQ ID NO: 1639195 - DNA, 18 bp, Homo sapiens
atattaagtgtgccaaat

SEQ ID NO: 1639196 - DNA, 22 bp, Homo sapiens
atattaagtgtgccaaatcagt

SEQ ID NO: 1639197 - DNA, 11 bp, Homo sapiens
atattaatcaa

SEQ ID NO: 1639198 - DNA, 13 bp, Homo sapiens
atattaatcaaaa

SEQ ID NO: 1639199 - DNA, 14 bp, Homo sapiens
atattaatgccttt

SEQ ID NO: 1639200 - DNA, 23 bp, Homo sapiens
atattaatgcctttaaagtatga

SEQ ID NO: 1639201 - DNA, 12 bp, Homo sapiens
atattaatgtac

SEQ ID NO: 1639202 - DNA, 18 bp, Homo sapiens
atattaatgtacttgttt

SEQ ID NO: 1639203 - DNA, 18 bp, Homo sapiens
atattacaacatttatgt

SEQ ID NO: 1639204 - DNA, 20 bp, Homo sapiens
atattacaacatttatgtga

SEQ ID NO: 1639205 - DNA, 16 bp, Homo sapiens
atattacagcttattt

SEQ ID NO: 1639206 - DNA, 13 bp, Homo sapiens
gatttggggtgga

SEQ ID NO: 1639207 - DNA, 23 bp, Homo sapiens
gatttgggtggaaaacagggtgc

SEQ ID NO: 1639208 - DNA, 14 bp, Homo sapiens
gatttgtactgaaa

SEQ ID NO: 1639209 - DNA, 16 bp, Homo sapiens
gatttgtcccagcctg

SEQ ID NO: 1639210 - DNA, 14 bp, Homo sapiens
gatttgtcccaggt

SEQ ID NO: 1639211 - DNA, 18 bp, Homo sapiens
gatttgtccttttatttc

SEQ ID NO: 1639212 - DNA, 14 bp, Homo sapiens
gatttgtgaactgg

SEQ ID NO: 1639213 - DNA, 22 bp, Homo sapiens
gatttgtgaactggaagaaagc

SEQ ID NO: 1639214 - DNA, 18 bp, Homo sapiens
gatttgtgtttttctttt

SEQ ID NO: 1639215 - DNA, 22 bp, Homo sapiens
gatttgttgccatgtgcacctt

SEQ ID NO: 1639216 - DNA, 14 bp, Homo sapiens
gatttgttttgaat

SEQ ID NO: 1639217 - DNA, 18 bp, Homo sapiens
gatttgttttgcattcct

SEQ ID NO: 1639218 - DNA, 19 bp, Homo sapiens
gatttgtttttgtattttt

SEQ ID NO: 1639219 - DNA, 18 bp, Homo sapiens
gattttaaaatgtacatg

SEQ ID NO: 1639220 - DNA, 12 bp, Homo sapiens
gattttaaatgt

SEQ ID NO: 1639221 - DNA, 14 bp, Homo sapiens
gattttaaatgtgt

SEQ ID NO: 1639222 - DNA, 16 bp, Homo sapiens
gattttaaatgtgtga

SEQ ID NO: 1639223 - DNA, 21 bp, Homo sapiens
gattttaaattcacaatagaa

SEQ ID NO: 1639224 - DNA, 18 bp, Homo sapiens
gattttaatttcaggaaa

SEQ ID NO: 1639225 - DNA, 19 bp, Homo sapiens
gattttaatttcaggaaaa

SEQ ID NO: 1639226 - DNA, 15 bp, Homo sapiens
gattttaattttgaa

SEQ ID NO: 1639227 - DNA, 17 bp, Homo sapiens
gattttacaaaagatgt

SEQ ID NO: 1639228 - DNA, 19 bp, Homo sapiens
gattttacaattgaaatga

SEQ ID NO: 1639229 - DNA, 15 bp, Homo sapiens
gattttaccaaagca

SEQ ID NO: 1639230 - DNA, 16 bp, Homo sapiens
gattttaccaaagcat

SEQ ID NO: 1639231 - DNA, 19 bp, Homo sapiens
gattttaccaaagcatcaa

SEQ ID NO: 1639232 - DNA, 21 bp, Homo sapiens
gattttaggagctaaggctct

SEQ ID NO: 1639233 - DNA, 16 bp, Homo sapiens
gattttatgtttaaaa

SEQ ID NO: 1639234 - DNA, 13 bp, Homo sapiens
gattttccaaatg

SEQ ID NO: 1639235 - DNA, 11 bp, Homo sapiens
gattttccatc

SEQ ID NO: 1639236 - DNA, 23 bp, Homo sapiens
gattttctcactgaactccaccg

SEQ ID NO: 1639237 - DNA, 21 bp, Homo sapiens
gattttgaaatttttattaaa

SEQ ID NO: 1639238 - DNA, 14 bp, Homo sapiens
gattttgagggtgg

SEQ ID NO: 1639239 - DNA, 13 bp, Homo sapiens
gatttttaaaatg

SEQ ID NO: 1639240 - DNA, 14 bp, Homo sapiens
gatttttactaata

SEQ ID NO: 1639241 - DNA, 16 bp, Homo sapiens
gatttttctaaccttg

SEQ ID NO: 1639242 - DNA, 13 bp, Homo sapiens
gatttttctcttt

SEQ ID NO: 1639243 - DNA, 20 bp, Homo sapiens
gatttttgcaataccaagta

SEQ ID NO: 1639244 - DNA, 13 bp, Homo sapiens
gatttttgcctct

SEQ ID NO: 1639245 - DNA, 15 bp, Homo sapiens
gatttttgtaagaca

SEQ ID NO: 1639246 - DNA, 14 bp, Homo sapiens
gattttttcccttt

SEQ ID NO: 1639247 - DNA, 21 bp, Homo sapiens
gatttttttttagacagcaaa

SEQ ID NO: 1639248 - DNA, 22 bp, Homo sapiens
gcaaaaaatcttaatactgtta

SEQ ID NO: 1639249 - DNA, 13 bp, Homo sapiens
gcaaaaataatca

SEQ ID NO: 1639250 - DNA, 20 bp, Homo sapiens
gcaaaaatgacaacagaaaa

SEQ ID NO: 1639251 - DNA, 22 bp, Homo sapiens
gcaaaacaaaaccctcagcact

SEQ ID NO: 1639252 - DNA, 18 bp, Homo sapiens
gcaaaacacgcaagggca

SEQ ID NO: 1639253 - DNA, 21 bp, Homo sapiens
gcaaaaccactagaactctcc

SEQ ID NO: 1639254 - DNA, 16 bp, Homo sapiens
gcaaaacccacagaag

SEQ ID NO: 1639255 - DNA, 23 bp, Homo sapiens
gcaaaactctacttaatccaatg

SEQ ID NO: 1639256 - DNA, 20 bp, Homo sapiens
gcaaaagatgtgcaaaatca

SEQ ID NO: 1639257 - DNA, 22 bp, Homo sapiens
gcaaaagatgtgcaaaatcact

SEQ ID NO: 1639258 - DNA, 23 bp, Homo sapiens
gcaaaagatgtgcaaaatcactg

SEQ ID NO: 1639259 - DNA, 20 bp, Homo sapiens
gcaaaagcaagggaccttca

SEQ ID NO: 1639260 - DNA, 11 bp, Homo sapiens
gcaaaaggaaa

SEQ ID NO: 1639261 - DNA, 16 bp, Homo sapiens
gcaaaaggctgagaag

SEQ ID NO: 1639262 - DNA, 20 bp, Homo sapiens
gcaaaaggttcactaaagca

SEQ ID NO: 1639263 - DNA, 11 bp, Homo sapiens
gcaaaatacat

SEQ ID NO: 1639264 - DNA, 15 bp, Homo sapiens
gcaaaatagacatct

SEQ ID NO: 1639265 - DNA, 16 bp, Homo sapiens
gcaaaatgttgaagaa

SEQ ID NO: 1639266 - DNA, 14 bp, Homo sapiens
gcaaaattcctgtg

SEQ ID NO: 1639267 - DNA, 10 bp, Homo sapiens
gcaaaatttc

SEQ ID NO: 1639268 - DNA, 16 bp, Homo sapiens
gcaaaattttatagct

SEQ ID NO: 1639269 - DNA, 14 bp, Homo sapiens
gcaaacactccacc

SEQ ID NO: 1639270 - DNA, 17 bp, Homo sapiens
gcaaacactccaccctc

SEQ ID NO: 1639271 - DNA, 19 bp, Homo sapiens
gcaaacaggttgttttcta

SEQ ID NO: 1639272 - DNA, 22 bp, Homo sapiens
gcaaacaggttgttttctactt

SEQ ID NO: 1639273 - DNA, 13 bp, Homo sapiens
gcaaacatggaga

SEQ ID NO: 1639274 - DNA, 19 bp, Homo sapiens
gcaaacatggagaaatcta

SEQ ID NO: 1639275 - DNA, 15 bp, Homo sapiens
gcaaacattttctct

SEQ ID NO: 1639276 - DNA, 20 bp, Homo sapiens
gcaaacattttctcttagaa

SEQ ID NO: 1639277 - DNA, 14 bp, Homo sapiens
gcaaaccacttctc

SEQ ID NO: 1639278 - DNA, 16 bp, Homo sapiens
gcaaacccattaaggg

SEQ ID NO: 1639279 - DNA, 18 bp, Homo sapiens
gcaaacgaataaagatag

SEQ ID NO: 1639280 - DNA, 16 bp, Homo sapiens
gcaaacgtctattttg

SEQ ID NO: 1639281 - DNA, 17 bp, Homo sapiens
gcaaactcactgctcaa

SEQ ID NO: 1639282 - DNA, 20 bp, Homo sapiens
gcaaacttaagaaacactga

SEQ ID NO: 1639283 - DNA, 23 bp, Homo sapiens
gcaaagaaagtgggaggtcagga

SEQ ID NO: 1639284 - DNA, 19 bp, Homo sapiens
gcaaagatctgtcctcagc

SEQ ID NO: 1639285 - DNA, 14 bp, Homo sapiens
gcaaagccaaggca

SEQ ID NO: 1639286 - DNA, 13 bp, Homo sapiens
atatttaatgata

SEQ ID NO: 1639287 - DNA, 20 bp, Homo sapiens
atatttaatgttgaacaaaa

SEQ ID NO: 1639288 - DNA, 18 bp, Homo sapiens
atatttaattatgaaaac

SEQ ID NO: 1639289 - DNA, 17 bp, Homo sapiens
atatttacatgctacta

SEQ ID NO: 1639290 - DNA, 15 bp, Homo sapiens
atatttactgctctt

SEQ ID NO: 1639291 - DNA, 17 bp, Homo sapiens
atatttagaaaattttg

SEQ ID NO: 1639292 - DNA, 19 bp, Homo sapiens
atatttagattgttaaaat

SEQ ID NO: 1639293 - DNA, 18 bp, Homo sapiens
atatttagtaacttctgt

SEQ ID NO: 1639294 - DNA, 17 bp, Homo sapiens
atatttataactcatca

SEQ ID NO: 1639295 - DNA, 14 bp, Homo sapiens
atatttatactcta

SEQ ID NO: 1639296 - DNA, 17 bp, Homo sapiens
atatttatagaacagtt

SEQ ID NO: 1639297 - DNA, 15 bp, Homo sapiens
atatttatccaaaat

SEQ ID NO: 1639298 - DNA, 13 bp, Homo sapiens
atatttatgaaga

SEQ ID NO: 1639299 - DNA, 14 bp, Homo sapiens
atatttatgaagaa

SEQ ID NO: 1639300 - DNA, 15 bp, Homo sapiens
atatttatgaagaaa

SEQ ID NO: 1639301 - DNA, 19 bp, Homo sapiens
atatttatggggggagaac

SEQ ID NO: 1639302 - DNA, 14 bp, Homo sapiens
atatttatgtagat

SEQ ID NO: 1639303 - DNA, 18 bp, Homo sapiens
atatttattcataatgaa

SEQ ID NO: 1639304 - DNA, 13 bp, Homo sapiens
atatttattgatt

SEQ ID NO: 1639305 - DNA, 14 bp, Homo sapiens
atatttattgtgct

SEQ ID NO: 1639306 - DNA, 17 bp, Homo sapiens
atatttatttatttatt

SEQ ID NO: 1639307 - DNA, 19 bp, Homo sapiens
atatttattttattctatg

SEQ ID NO: 1639308 - DNA, 22 bp, Homo sapiens
atatttattttcagtatactgt

SEQ ID NO: 1639309 - DNA, 21 bp, Homo sapiens
atatttattttctttctgtaa

SEQ ID NO: 1639310 - DNA, 13 bp, Homo sapiens
atatttcaagaca

SEQ ID NO: 1639311 - DNA, 15 bp, Homo sapiens
atatttcaagtgcct

SEQ ID NO: 1639312 - DNA, 12 bp, Homo sapiens
atatttcaatct

SEQ ID NO: 1639313 - DNA, 15 bp, Homo sapiens
atatttcaatctttt

SEQ ID NO: 1639314 - DNA, 12 bp, Homo sapiens
atatttcagaaa

SEQ ID NO: 1639315 - DNA, 15 bp, Homo sapiens
atatttcagaaatac

SEQ ID NO: 1639316 - DNA, 15 bp, Homo sapiens
atatttcagacattt

SEQ ID NO: 1639317 - DNA, 16 bp, Homo sapiens
atatttcctaaggcat

SEQ ID NO: 1639318 - DNA, 17 bp, Homo sapiens
atatttcctgacttgag

SEQ ID NO: 1639319 - DNA, 15 bp, Homo sapiens
atatttcctttatgt

SEQ ID NO: 1639320 - DNA, 21 bp, Homo sapiens
atatttcctttatgtgaattt

SEQ ID NO: 1639321 - DNA, 18 bp, Homo sapiens
atatttctaagcttattt

SEQ ID NO: 1639322 - DNA, 23 bp, Homo sapiens
gcaaatgttaaaagttttatatg

SEQ ID NO: 1639323 - DNA, 23 bp, Homo sapiens
gcaaattattctagtcaactgct

SEQ ID NO: 1639324 - DNA, 18 bp, Homo sapiens
gcaaattcaagagcctcc

SEQ ID NO: 1639325 - DNA, 22 bp, Homo sapiens
gcaaattcaagagcctcccctg

SEQ ID NO: 1639326 - DNA, 16 bp, Homo sapiens
gcaaattcagaactga

SEQ ID NO: 1639327 - DNA, 12 bp, Homo sapiens
gcaaattttaaa

SEQ ID NO: 1639328 - DNA, 16 bp, Homo sapiens
gcaacaaacctcactg

SEQ ID NO: 1639329 - DNA, 17 bp, Homo sapiens
gcaacaagactgccagg

SEQ ID NO: 1639330 - DNA, 20 bp, Homo sapiens
gcaacaagactgccaggtgg

SEQ ID NO: 1639331 - DNA, 22 bp, Homo sapiens
gcaacaatacatgctgctaatt

SEQ ID NO: 1639332 - DNA, 18 bp, Homo sapiens
gcaacacagcctgggccc

SEQ ID NO: 1639333 - DNA, 22 bp, Homo sapiens
gcaacactggaacatggctagc

SEQ ID NO: 1639334 - DNA, 12 bp, Homo sapiens
gcaacagatctg

SEQ ID NO: 1639335 - DNA, 17 bp, Homo sapiens
gcaacagcataacaagg

SEQ ID NO: 1639336 - DNA, 19 bp, Homo sapiens
gcaacaggaatctcagaga

SEQ ID NO: 1639337 - DNA, 12 bp, Homo sapiens
gcaacagggagc

SEQ ID NO: 1639338 - DNA, 15 bp, Homo sapiens
gcaacatttgacaaa

SEQ ID NO: 1639339 - DNA, 14 bp, Homo sapiens
gcaaccagcaaatt

SEQ ID NO: 1639340 - DNA, 17 bp, Homo sapiens
gcaaccaggaacagcaa

SEQ ID NO: 1639341 - DNA, 16 bp, Homo sapiens
gcaacccacagctcag

SEQ ID NO: 1639342 - DNA, 17 bp, Homo sapiens
gcaacccacagctcagc

SEQ ID NO: 1639343 - DNA, 19 bp, Homo sapiens
gcaacccacagctcagctg

SEQ ID NO: 1639344 - DNA, 23 bp, Homo sapiens
gcaacccacagctcagctgccca

SEQ ID NO: 1639345 - DNA, 18 bp, Homo sapiens
gcaaccccccagctcgct

SEQ ID NO: 1639346 - DNA, 14 bp, Homo sapiens
gcaacccctgtacc

SEQ ID NO: 1639347 - DNA, 19 bp, Homo sapiens
gcaacccctgtacccagct

SEQ ID NO: 1639348 - DNA, 20 bp, Homo sapiens
gcaacccctgtacccagctc

SEQ ID NO: 1639349 - DNA, 21 bp, Homo sapiens
gcaacccctgtacccagctcc

SEQ ID NO: 1639350 - DNA, 16 bp, Homo sapiens
gcaaccgggccctctc

SEQ ID NO: 1639351 - DNA, 23 bp, Homo sapiens
gcaacgaagaaaaaaaataacac

SEQ ID NO: 1639352 - DNA, 17 bp, Homo sapiens
gcaacgcccctccaaac

SEQ ID NO: 1639353 - DNA, 22 bp, Homo sapiens
gcaacgccgtgggctgcgtcct

SEQ ID NO: 1639354 - DNA, 22 bp, Homo sapiens
gcaacgggattgaagggtcctg

SEQ ID NO: 1639355 - DNA, 14 bp, Homo sapiens
gcaacgtagcctgg

SEQ ID NO: 1639356 - DNA, 21 bp, Homo sapiens
gcaacgtgcgtgtctctgcca

SEQ ID NO: 1639357 - DNA, 19 bp, Homo sapiens
gcaactaatgtttgaacaa

SEQ ID NO: 1639358 - DNA, 18 bp, Homo sapiens
gcaactctggctccaggc

SEQ ID NO: 1639359 - DNA, 22 bp, Homo sapiens
gcaactctggctccaggcagaa

SEQ ID NO: 1639360 - DNA, 20 bp, Homo sapiens
gcaactgaacaaaagctcag

SEQ ID NO: 1639361 - DNA, 15 bp, Homo sapiens
gcaactgcccttcca

SEQ ID NO: 1639362 - DNA, 20 bp, Homo sapiens
gcaactgcgacaaaacattt

SEQ ID NO: 1639363 - DNA, 20 bp, Homo sapiens
gcaactgctcagctctggtc

SEQ ID NO: 1639364 - DNA, 23 bp, Homo sapiens
gcaacttcatttgacacaaagct

SEQ ID NO: 1639365 - DNA, 22 bp, Homo sapiens
gcaacttccgcctcctgtgttc

SEQ ID NO: 1639366 - DNA, 15 bp, Homo sapiens
gcaacttccgctgag

SEQ ID NO: 1639367 - DNA, 22 bp, Homo sapiens
gcaacttgtctttttctggact

SEQ ID NO: 1639368 - DNA, 23 bp, Homo sapiens
gcaacttgtctttttctggactg

SEQ ID NO: 1639369 - DNA, 19 bp, Homo sapiens
gcaagaaaactaggcaatg

SEQ ID NO: 1639370 - DNA, 11 bp, Homo sapiens
gcaagaaaagg

SEQ ID NO: 1639371 - DNA, 22 bp, Homo sapiens
gcaagaaatggcgtctgctctg

SEQ ID NO: 1639372 - DNA, 18 bp, Homo sapiens
gcaagaacccaagtgcct

SEQ ID NO: 1639373 - DNA, 15 bp, Homo sapiens
gcaagaagattctaa

SEQ ID NO: 1639374 - DNA, 16 bp, Homo sapiens
gcaagaagattctaaa

SEQ ID NO: 1639375 - DNA, 19 bp, Homo sapiens
gcaagaagattctaaaaca

SEQ ID NO: 1639376 - DNA, 15 bp, Homo sapiens
gcaagaaggaaagat

SEQ ID NO: 1639377 - DNA, 23 bp, Homo sapiens
gcaagacacgtggcctcgtgagg

SEQ ID NO: 1639378 - DNA, 15 bp, Homo sapiens
gcaagacagaaaagt

SEQ ID NO: 1639379 - DNA, 13 bp, Homo sapiens
gcaagacagaaac

SEQ ID NO: 1639380 - DNA, 19 bp, Homo sapiens
gcaagacagagacgcagga

SEQ ID NO: 1639381 - DNA, 24 bp, Homo sapiens
gcaagacctcatctgtggagctgc

SEQ ID NO: 1639382 - DNA, 14 bp, Homo sapiens
gcaagacctcttcc

SEQ ID NO: 1639383 - DNA, 19 bp, Homo sapiens
gcaagacgtaaagaatttt

SEQ ID NO: 1639384 - DNA, 19 bp, Homo sapiens
gcaagagactgggagccac

SEQ ID NO: 1639385 - DNA, 17 bp, Homo sapiens
gcaagagagatgttttg

SEQ ID NO: 1639386 - DNA, 19 bp, Homo sapiens
gcaagaggcaagctgaaat

SEQ ID NO: 1639387 - DNA, 20 bp, Homo sapiens
gcaagagggggtggaggggt

SEQ ID NO: 1639388 - DNA, 23 bp, Homo sapiens
gcaagagggggtggaggggtgtg

SEQ ID NO: 1639389 - DNA, 13 bp, Homo sapiens
gcaagaggggtgg

SEQ ID NO: 1639390 - DNA, 17 bp, Homo sapiens
gcaagaggggtggagac

SEQ ID NO: 1639391 - DNA, 18 bp, Homo sapiens
gcaagagtgattgcagct

SEQ ID NO: 1639392 - DNA, 19 bp, Homo sapiens
gcaagagtgattgcagctt

SEQ ID NO: 1639393 - DNA, 14 bp, Homo sapiens
gcaagagtttcttg

SEQ ID NO: 1639394 - DNA, 18 bp, Homo sapiens
gcaagatgttttgtataa

SEQ ID NO: 1639395 - DNA, 14 bp, Homo sapiens
gcaagcacatctgc

SEQ ID NO: 1639396 - DNA, 12 bp, Homo sapiens
gcaagcagaact

SEQ ID NO: 1639397 - DNA, 16 bp, Homo sapiens
gcaagcagaggaccag

SEQ ID NO: 1639398 - DNA, 17 bp, Homo sapiens
gcaagcagctggtcagt

SEQ ID NO: 1639399 - DNA, 14 bp, Homo sapiens
gcaagccccagggc

SEQ ID NO: 1639400 - DNA, 18 bp, Homo sapiens
gcaagccccagggcctgg

SEQ ID NO: 1639401 - DNA, 18 bp, Homo sapiens
gcaagctaggccccagag

SEQ ID NO: 1639402 - DNA, 21 bp, Homo sapiens
gcaagctccgcctcctgggtt

SEQ ID NO: 1639403 - DNA, 21 bp, Homo sapiens
atcaaaggaaaatagtaatgt

SEQ ID NO: 1639404 - DNA, 23 bp, Homo sapiens
atcaaagtaaaaaattaaagccc

SEQ ID NO: 1639405 - DNA, 14 bp, Homo sapiens
atcaaataagaaat

SEQ ID NO: 1639406 - DNA, 20 bp, Homo sapiens
atcaaataagtatttataat

SEQ ID NO: 1639407 - DNA, 17 bp, Homo sapiens
atcaaataataccttag

SEQ ID NO: 1639408 - DNA, 14 bp, Homo sapiens
atcaaatatgcaaa

SEQ ID NO: 1639409 - DNA, 18 bp, Homo sapiens
atcaaatatgcaaagcac

SEQ ID NO: 1639410 - DNA, 20 bp, Homo sapiens
atcaaatatgcaaagcactg

SEQ ID NO: 1639411 - DNA, 12 bp, Homo sapiens
atcaaatcaact

SEQ ID NO: 1639412 - DNA, 22 bp, Homo sapiens
atcaaatcatcattaatgactt

SEQ ID NO: 1639413 - DNA, 22 bp, Homo sapiens
atcaaatctgtatatgttgtaa

SEQ ID NO: 1639414 - DNA, 13 bp, Homo sapiens
atcaaatgtaaat

SEQ ID NO: 1639415 - DNA, 13 bp, Homo sapiens
atcaaatgtatgt

SEQ ID NO: 1639416 - DNA, 15 bp, Homo sapiens
atcaaatgtatgtat

SEQ ID NO: 1639417 - DNA, 16 bp, Homo sapiens
atcaaatgtatgtatc

SEQ ID NO: 1639418 - DNA, 22 bp, Homo sapiens
atcaacaataaaatttttttaa

SEQ ID NO: 1639419 - DNA, 21 bp, Homo sapiens
atcaacagcatgtctactgct

SEQ ID NO: 1639420 - DNA, 15 bp, Homo sapiens
atcaacatcttttct

SEQ ID NO: 1639421 - DNA, 18 bp, Homo sapiens
atcaactaaagttgtact

SEQ ID NO: 1639422 - DNA, 14 bp, Homo sapiens
atcaactcccaact

SEQ ID NO: 1639423 - DNA, 18 bp, Homo sapiens
atcaactcccaacttctt

SEQ ID NO: 1639424 - DNA, 22 bp, Homo sapiens
atcaacttagtcaataagaaaa

SEQ ID NO: 1639425 - DNA, 17 bp, Homo sapiens
atcaacttcgctagaaa

SEQ ID NO: 1639426 - DNA, 16 bp, Homo sapiens
atcaacttgtgtactg

SEQ ID NO: 1639427 - DNA, 19 bp, Homo sapiens
atcaactttactgtaatat

SEQ ID NO: 1639428 - DNA, 16 bp, Homo sapiens
atcaagaaaaaaaggg

SEQ ID NO: 1639429 - DNA, 21 bp, Homo sapiens
atcaagaaaaaaagggagaat

SEQ ID NO: 1639430 - DNA, 13 bp, Homo sapiens
atcaagaagggct

SEQ ID NO: 1639431 - DNA, 19 bp, Homo sapiens
atcaagaagggctgcatga

SEQ ID NO: 1639432 - DNA, 21 bp, Homo sapiens
atcaagagcattgcttttgtt

SEQ ID NO: 1639433 - DNA, 17 bp, Homo sapiens
atcaagatttttttcct

SEQ ID NO: 1639434 - DNA, 16 bp, Homo sapiens
atcaagcaacattctt

SEQ ID NO: 1639435 - DNA, 18 bp, Homo sapiens
atcaagcacttcccagga

SEQ ID NO: 1639436 - DNA, 17 bp, Homo sapiens
gcaagtcgagagggctg

SEQ ID NO: 1639437 - DNA, 13 bp, Homo sapiens
gcaagtcttaaca

SEQ ID NO: 1639438 - DNA, 17 bp, Homo sapiens
gcaagtgagcagagatg

SEQ ID NO: 1639439 - DNA, 13 bp, Homo sapiens
gcaagtgcccagt

SEQ ID NO: 1639440 - DNA, 14 bp, Homo sapiens
gcaagtgcccagtg

SEQ ID NO: 1639441 - DNA, 15 bp, Homo sapiens
gcaagtggatgggaa

SEQ ID NO: 1639442 - DNA, 23 bp, Homo sapiens
gcaagtggatgggaatttgtcag

SEQ ID NO: 1639443 - DNA, 15 bp, Homo sapiens
gcaagtgtttgtggg

SEQ ID NO: 1639444 - DNA, 16 bp, Homo sapiens
gcaataaatctgaccc

SEQ ID NO: 1639445 - DNA, 13 bp, Homo sapiens
gcaataacttcta

SEQ ID NO: 1639446 - DNA, 15 bp, Homo sapiens
gcaataacttctata

SEQ ID NO: 1639447 - DNA, 22 bp, Homo sapiens
gcaataacttctatattttaat

SEQ ID NO: 1639448 - DNA, 19 bp, Homo sapiens
gcaataatggtcccatcca

SEQ ID NO: 1639449 - DNA, 21 bp, Homo sapiens
gcaataatggtcccatccagg

SEQ ID NO: 1639450 - DNA, 20 bp, Homo sapiens
gcaataattgtttccaactt

SEQ ID NO: 1639451 - DNA, 17 bp, Homo sapiens
gcaataatttgtacaat

SEQ ID NO: 1639452 - DNA, 13 bp, Homo sapiens
gcaatacattttt

SEQ ID NO: 1639453 - DNA, 13 bp, Homo sapiens
gcaataccaagta

SEQ ID NO: 1639454 - DNA, 13 bp, Homo sapiens
gcaatacgtttgt

SEQ ID NO: 1639455 - DNA, 14 bp, Homo sapiens
gcaatagagactgt

SEQ ID NO: 1639456 - DNA, 20 bp, Homo sapiens
gcaatagattactgatgtga

SEQ ID NO: 1639457 - DNA, 19 bp, Homo sapiens
gcaataggtgagagaatgt

SEQ ID NO: 1639458 - DNA, 16 bp, Homo sapiens
gcaatagttttttact

SEQ ID NO: 1639459 - DNA, 17 bp, Homo sapiens
gcaatatagaaacacga

SEQ ID NO: 1639460 - DNA, 14 bp, Homo sapiens
gcaatatttgaatt

SEQ ID NO: 1639461 - DNA, 15 bp, Homo sapiens
gcaatcaaatctgct

SEQ ID NO: 1639462 - DNA, 21 bp, Homo sapiens
gcaatccatgttagtttttac

SEQ ID NO: 1639463 - DNA, 21 bp, Homo sapiens
gcaatctccccttgatttaaa

SEQ ID NO: 1639464 - DNA, 23 bp, Homo sapiens
gcaatctccccttgatttaaaca

SEQ ID NO: 1639465 - DNA, 19 bp, Homo sapiens
gcaatctcggctcactgca

SEQ ID NO: 1639466 - DNA, 17 bp, Homo sapiens
gcaatctcttcattatt

SEQ ID NO: 1639467 - DNA, 23 bp, Homo sapiens
gcaatctcttcattattctctgc

SEQ ID NO: 1639468 - DNA, 14 bp, Homo sapiens
gcaatcttctactt

SEQ ID NO: 1639469 - DNA, 23 bp, Homo sapiens
gcaatgaaaggtactatatttgc

SEQ ID NO: 1639470 - DNA, 17 bp, Homo sapiens
gcaatgatgacccacta

SEQ ID NO: 1639471 - DNA, 22 bp, Homo sapiens
gcaatgatgacccactaaagag

SEQ ID NO: 1639472 - DNA, 15 bp, Homo sapiens
gcaatggaaactatt

SEQ ID NO: 1639473 - DNA, 16 bp, Homo sapiens
gcaatgggtcactcat

SEQ ID NO: 1639474 - DNA, 23 bp, Homo sapiens
gcaatggtgtcagtatccaggct

SEQ ID NO: 1639475 - DNA, 18 bp, Homo sapiens
gcaatgtcacaacctctc

SEQ ID NO: 1639476 - DNA, 20 bp, Homo sapiens
gcaatgtcaggaacagaagg

SEQ ID NO: 1639477 - DNA, 22 bp, Homo sapiens
gcaatgtcaggaacagaaggat

SEQ ID NO: 1639478 - DNA, 14 bp, Homo sapiens
gcaatgtctgtgct

SEQ ID NO: 1639479 - DNA, 15 bp, Homo sapiens
gcaatgtgttttttc

SEQ ID NO: 1639480 - DNA, 21 bp, Homo sapiens
gcaatgttggttttttataaa

SEQ ID NO: 1639481 - DNA, 22 bp, Homo sapiens
gcaattcaaaagttccaagagt

SEQ ID NO: 1639482 - DNA, 13 bp, Homo sapiens
gcaattccaggct

SEQ ID NO: 1639483 - DNA, 14 bp, Homo sapiens
gcaattcccctctg

SEQ ID NO: 1639484 - DNA, 21 bp, Homo sapiens
gcaattcccctctgctgctgt

SEQ ID NO: 1639485 - DNA, 17 bp, Homo sapiens
gcaattccgcatttaat

SEQ ID NO: 1639486 - DNA, 14 bp, Homo sapiens
gcaattctacagtt

SEQ ID NO: 1639487 - DNA, 18 bp, Homo sapiens
gcaattctacagtttctt

SEQ ID NO: 1639488 - DNA, 23 bp, Homo sapiens
gcaattgtcttttttttcctttg

SEQ ID NO: 1639489 - DNA, 18 bp, Homo sapiens
gcaattgttacaagtgtt

SEQ ID NO: 1639490 - DNA, 19 bp, Homo sapiens
gcaattgttacaagtgttc

SEQ ID NO: 1639491 - DNA, 19 bp, Homo sapiens
gcaatttatacaatatcat

SEQ ID NO: 1639492 - DNA, 14 bp, Homo sapiens
gcaatttcctggcc

SEQ ID NO: 1639493 - DNA, 20 bp, Homo sapiens
gcaatttcctggccctccac

SEQ ID NO: 1639494 - DNA, 21 bp, Homo sapiens
gcacaaacttgtgagcatcag

SEQ ID NO: 1639495 - DNA, 13 bp, Homo sapiens
gcacaaatattta

SEQ ID NO: 1639496 - DNA, 16 bp, Homo sapiens
gcacaaatatttattt

SEQ ID NO: 1639497 - DNA, 19 bp, Homo sapiens
gcacaacagagtaactatc

SEQ ID NO: 1639498 - DNA, 14 bp, Homo sapiens
gcacaagaatggat

SEQ ID NO: 1639499 - DNA, 15 bp, Homo sapiens
gcacaagaatggatc

SEQ ID NO: 1639500 - DNA, 14 bp, Homo sapiens
gcacaagcagagtg

SEQ ID NO: 1639501 - DNA, 23 bp, Homo sapiens
gcacaagcagagtgcacagctgt

SEQ ID NO: 1639502 - DNA, 14 bp, Homo sapiens
gcacaagctcagaa

SEQ ID NO: 1639503 - DNA, 18 bp, Homo sapiens
gcacaagctcagaataga

SEQ ID NO: 1639504 - DNA, 22 bp, Homo sapiens
gcacaagctcagaatagatctg

SEQ ID NO: 1639505 - DNA, 22 bp, Homo sapiens
gcacaaggacattgtatgcagg

SEQ ID NO: 1639506 - DNA, 23 bp, Homo sapiens
gcacaaggccttgcctggcctga

SEQ ID NO: 1639507 - DNA, 21 bp, Homo sapiens
gcacaagggcacattgcccat

SEQ ID NO: 1639508 - DNA, 19 bp, Homo sapiens
gcacaagtaacacatttgg

SEQ ID NO: 1639509 - DNA, 16 bp, Homo sapiens
gcacaataaaaatgtt

SEQ ID NO: 1639510 - DNA, 17 bp, Homo sapiens
gcacaataaaaatgttt

SEQ ID NO: 1639511 - DNA, 11 bp, Homo sapiens
gcacaataaat

SEQ ID NO: 1639512 - DNA, 23 bp, Homo sapiens
gcacaataactagtaataccaaa

SEQ ID NO: 1639513 - DNA, 17 bp, Homo sapiens
gcacaatattgaacttt

SEQ ID NO: 1639514 - DNA, 16 bp, Homo sapiens
gcacaattctgtttta

SEQ ID NO: 1639515 - DNA, 21 bp, Homo sapiens
gcacacacaaacctactgccc

SEQ ID NO: 1639516 - DNA, 16 bp, Homo sapiens
gcacacacagctcctc

SEQ ID NO: 1639517 - DNA, 17 bp, Homo sapiens
gcacacacatctggccc

SEQ ID NO: 1639518 - DNA, 14 bp, Homo sapiens
gcacacacctgcct

SEQ ID NO: 1639519 - DNA, 19 bp, Homo sapiens
gcacacagaatgctcaggg

SEQ ID NO: 1639520 - DNA, 18 bp, Homo sapiens
gcacacagagattctgga

SEQ ID NO: 1639521 - DNA, 20 bp, Homo sapiens
atcactgccacactctccat

SEQ ID NO: 1639522 - DNA, 12 bp, Homo sapiens
atcactggactg

SEQ ID NO: 1639523 - DNA, 17 bp, Homo sapiens
atcactggactgcatgg

SEQ ID NO: 1639524 - DNA, 18 bp, Homo sapiens
atcactggactgcatggg

SEQ ID NO: 1639525 - DNA, 17 bp, Homo sapiens
atcactggagcaccagg

SEQ ID NO: 1639526 - DNA, 23 bp, Homo sapiens
atcactggagcaccaggcacgaa

SEQ ID NO: 1639527 - DNA, 12 bp, Homo sapiens
atcactggagcc

SEQ ID NO: 1639528 - DNA, 14 bp, Homo sapiens
atcactggagccca

SEQ ID NO: 1639529 - DNA, 13 bp, Homo sapiens
atcactggatgaa

SEQ ID NO: 1639530 - DNA, 16 bp, Homo sapiens
atcactggcaatgaaa

SEQ ID NO: 1639531 - DNA, 22 bp, Homo sapiens
atcactggcaatgaaaaattct

SEQ ID NO: 1639532 - DNA, 19 bp, Homo sapiens
atcactggctggcctgagc

SEQ ID NO: 1639533 - DNA, 21 bp, Homo sapiens
atcactggctggcctgagcaa

SEQ ID NO: 1639534 - DNA, 14 bp, Homo sapiens
atcactgtaaagac

SEQ ID NO: 1639535 - DNA, 22 bp, Homo sapiens
atcactgtaaagacaaataaat

SEQ ID NO: 1639536 - DNA, 15 bp, Homo sapiens
atcactgtaacctga

SEQ ID NO: 1639537 - DNA, 19 bp, Homo sapiens
atcactgtatcattttctt

SEQ ID NO: 1639538 - DNA, 21 bp, Homo sapiens
atcactgtctttgactgtgat

SEQ ID NO: 1639539 - DNA, 13 bp, Homo sapiens
atcacttaaatcg

SEQ ID NO: 1639540 - DNA, 20 bp, Homo sapiens
atcacttaggaaatggcttt

SEQ ID NO: 1639541 - DNA, 23 bp, Homo sapiens
atcacttgaatccattgaaagtg

SEQ ID NO: 1639542 - DNA, 14 bp, Homo sapiens
atcacttgtacaaa

SEQ ID NO: 1639543 - DNA, 16 bp, Homo sapiens
atcacttgtacaaaat

SEQ ID NO: 1639544 - DNA, 20 bp, Homo sapiens
atcacttgttttattgactg

SEQ ID NO: 1639545 - DNA, 20 bp, Homo sapiens
atcactttacctgcaggctc

SEQ ID NO: 1639546 - DNA, 17 bp, Homo sapiens
atcagaaagtgacattt

SEQ ID NO: 1639547 - DNA, 18 bp, Homo sapiens
atcagaacattcagctct

SEQ ID NO: 1639548 - DNA, 20 bp, Homo sapiens
atcagaacattcagctctgg

SEQ ID NO: 1639549 - DNA, 17 bp, Homo sapiens
atcagaagaaaggccaa

SEQ ID NO: 1639550 - DNA, 17 bp, Homo sapiens
atcatggaaatgtattt

SEQ ID NO: 1639551 - DNA, 17 bp, Homo sapiens
atcatggtcaagttccc

SEQ ID NO: 1639552 - DNA, 20 bp, Homo sapiens
atcatggtcaagttcccaac

SEQ ID NO: 1639553 - DNA, 15 bp, Homo sapiens
atcatggtttttgaa

SEQ ID NO: 1639554 - DNA, 17 bp, Homo sapiens
atcatgtactttttagt

SEQ ID NO: 1639555 - DNA, 15 bp, Homo sapiens
atcatgtctgtatac

SEQ ID NO: 1639556 - DNA, 22 bp, Homo sapiens
atcatgtctgtatactcctgtc

SEQ ID NO: 1639557 - DNA, 18 bp, Homo sapiens
atcatgtgggtgagccag

SEQ ID NO: 1639558 - DNA, 20 bp, Homo sapiens
atcatgttaaattagaatga

SEQ ID NO: 1639559 - DNA, 12 bp, Homo sapiens
atcatgtttctt

SEQ ID NO: 1639560 - DNA, 15 bp, Homo sapiens
atcatgtttctttga

SEQ ID NO: 1639561 - DNA, 23 bp, Homo sapiens
atcatgttttgatgagaaaaaac

SEQ ID NO: 1639562 - DNA, 20 bp, Homo sapiens
atcattaaaaattaccttta

SEQ ID NO: 1639563 - DNA, 23 bp, Homo sapiens
atcattaatgactttatgtatta

SEQ ID NO: 1639564 - DNA, 17 bp, Homo sapiens
atcattacaattttctg

SEQ ID NO: 1639565 - DNA, 15 bp, Homo sapiens
atcattactggtaaa

SEQ ID NO: 1639566 - DNA, 16 bp, Homo sapiens
atcattcagaaatgtt

SEQ ID NO: 1639567 - DNA, 15 bp, Homo sapiens
atcattccctctcat

SEQ ID NO: 1639568 - DNA, 16 bp, Homo sapiens
atcattccttctggcc

SEQ ID NO: 1639569 - DNA, 13 bp, Homo sapiens
atcattctaaaga

SEQ ID NO: 1639570 - DNA, 17 bp, Homo sapiens
atcattctaaagataga

SEQ ID NO: 1639571 - DNA, 20 bp, Homo sapiens
atcattcttgtgggagacag

SEQ ID NO: 1639572 - DNA, 13 bp, Homo sapiens
atcatttactctt

SEQ ID NO: 1639573 - DNA, 22 bp, Homo sapiens
atcatttattttttacattatt

SEQ ID NO: 1639574 - DNA, 20 bp, Homo sapiens
atcatttctgcatcagctgc

SEQ ID NO: 1639575 - DNA, 23 bp, Homo sapiens
atcatttctttttgggagagact

SEQ ID NO: 1639576 - DNA, 18 bp, Homo sapiens
atcatttgtttaaaaagg

SEQ ID NO: 1639577 - DNA, 15 bp, Homo sapiens
atcattttaattatt

SEQ ID NO: 1639578 - DNA, 14 bp, Homo sapiens
atcattttcccccc

SEQ ID NO: 1639579 - DNA, 19 bp, Homo sapiens
atcattttgcctcttttct

SEQ ID NO: 1639580 - DNA, 18 bp, Homo sapiens
atcattttttatatatat

SEQ ID NO: 1639581 - DNA, 21 bp, Homo sapiens
atcattttttatatatatgca

SEQ ID NO: 1639582 - DNA, 15 bp, Homo sapiens
atcattttttcctgt

SEQ ID NO: 1639583 - DNA, 23 bp, Homo sapiens
atcattttttcctgtttgggaag

SEQ ID NO: 1639584 - DNA, 17 bp, Homo sapiens
atccaaaacttctcttg

SEQ ID NO: 1639585 - DNA, 21 bp, Homo sapiens
atccaaagaaaaagggctgcc

SEQ ID NO: 1639586 - DNA, 20 bp, Homo sapiens
atccaaagcttattttgtaa

SEQ ID NO: 1639587 - DNA, 14 bp, Homo sapiens
atccaaataaagat

SEQ ID NO: 1639588 - DNA, 16 bp, Homo sapiens
atccaaatctgtcctc

SEQ ID NO: 1639589 - DNA, 22 bp, Homo sapiens
atccaaatctgtcctctgtagt

SEQ ID NO: 1639590 - DNA, 14 bp, Homo sapiens
atccaactccagca

SEQ ID NO: 1639591 - DNA, 14 bp, Homo sapiens
atccaactccagga

SEQ ID NO: 1639592 - DNA, 13 bp, Homo sapiens
atccaagccagag

SEQ ID NO: 1639593 - DNA, 17 bp, Homo sapiens
atccaagcctccacagc

SEQ ID NO: 1639594 - DNA, 19 bp, Homo sapiens
atccaaggaaacattttat

SEQ ID NO: 1639595 - DNA, 13 bp, Homo sapiens
atccaaggagaaa

SEQ ID NO: 1639596 - DNA, 19 bp, Homo sapiens
atccaaggagaaacagaga

SEQ ID NO: 1639597 - DNA, 17 bp, Homo sapiens
atccaatcctcactggg

SEQ ID NO: 1639598 - DNA, 18 bp, Homo sapiens
atccaatcctcactgggt

SEQ ID NO: 1639599 - DNA, 23 bp, Homo sapiens
atccaatgtgaagttcatcttgc

SEQ ID NO: 1639600 - DNA, 17 bp, Homo sapiens
atccacaataaccaaga

SEQ ID NO: 1639601 - DNA, 20 bp, Homo sapiens
atccacatctttactcaggc

SEQ ID NO: 1639602 - DNA, 15 bp, Homo sapiens
atccacatttctaaa

SEQ ID NO: 1639603 - DNA, 14 bp, Homo sapiens
atccaccaccttgc

SEQ ID NO: 1639604 - DNA, 13 bp, Homo sapiens
atccacccagccc

SEQ ID NO: 1639605 - DNA, 16 bp, Homo sapiens
atccacccagtgctgc

SEQ ID NO: 1639606 - DNA, 16 bp, Homo sapiens
atccacccatgttatc

SEQ ID NO: 1639607 - DNA, 20 bp, Homo sapiens
atccacccgcctcagcctcc

SEQ ID NO: 1639608 - DNA, 23 bp, Homo sapiens
atccacccgggggagcccagtga

SEQ ID NO: 1639609 - DNA, 17 bp, Homo sapiens
atccaccggcctcggcc

SEQ ID NO: 1639610 - DNA, 20 bp, Homo sapiens
atccacctcatcactggact

SEQ ID NO: 1639611 - DNA, 13 bp, Homo sapiens
atccacctgtctc

SEQ ID NO: 1639612 - DNA, 18 bp, Homo sapiens
atccacctgtctcagcct

SEQ ID NO: 1639613 - DNA, 21 bp, Homo sapiens
atccactctaccctcccaccc

SEQ ID NO: 1639614 - DNA, 13 bp, Homo sapiens
atccactgtgacg

SEQ ID NO: 1639615 - DNA, 16 bp, Homo sapiens
atccagaacagtggct

SEQ ID NO: 1639616 - DNA, 15 bp, Homo sapiens
atccagacctggctc

SEQ ID NO: 1639617 - DNA, 12 bp, Homo sapiens
atccagcctggg

SEQ ID NO: 1639618 - DNA, 14 bp, Homo sapiens
atccagctcactca

SEQ ID NO: 1639619 - DNA, 18 bp, Homo sapiens
atccaggaatatgacaca

SEQ ID NO: 1639620 - DNA, 15 bp, Homo sapiens
atccaggcacagctg

SEQ ID NO: 1639621 - DNA, 16 bp, Homo sapiens
atccaggcacagctga

SEQ ID NO: 1639622 - DNA, 19 bp, Homo sapiens
atccaggcagatccaggac

SEQ ID NO: 1639623 - DNA, 16 bp, Homo sapiens
atccaggccagggctc

SEQ ID NO: 1639624 - DNA, 12 bp, Homo sapiens
atccaggcgtgg

SEQ ID NO: 1639625 - DNA, 12 bp, Homo sapiens
atccagggacag

SEQ ID NO: 1639626 - DNA, 21 bp, Homo sapiens
atccagggacagaggccccag

SEQ ID NO: 1639627 - DNA, 18 bp, Homo sapiens
atccagggatggagatgg

SEQ ID NO: 1639628 - DNA, 14 bp, Homo sapiens
atccagtctggaaa

SEQ ID NO: 1639629 - DNA, 11 bp, Homo sapiens
atccagtgacc

SEQ ID NO: 1639630 - DNA, 16 bp, Homo sapiens
atccagtgatccttac

SEQ ID NO: 1639631 - DNA, 18 bp, Homo sapiens
atccagtgcagttgtgat

SEQ ID NO: 1639632 - DNA, 19 bp, Homo sapiens
atccagtgcagttgtgatt

SEQ ID NO: 1639633 - DNA, 13 bp, Homo sapiens
atccagtggtggg

SEQ ID NO: 1639634 - DNA, 15 bp, Homo sapiens
atccagtggtgggta

SEQ ID NO: 1639635 - DNA, 23 bp, Homo sapiens
atccagtgtgcacccctccccat

SEQ ID NO: 1639636 - DNA, 19 bp, Homo sapiens
atccagttataagaagaag

SEQ ID NO: 1639637 - DNA, 22 bp, Homo sapiens
atccataaagacaatcactgcc

SEQ ID NO: 1639638 - DNA, 23 bp, Homo sapiens
atccataaagacaatcactgcca

SEQ ID NO: 1639639 - DNA, 16 bp, Homo sapiens
gaggcagggaggggac

SEQ ID NO: 1639640 - DNA, 21 bp, Homo sapiens
gaggcaggggtcctgcaggtc

SEQ ID NO: 1639641 - DNA, 13 bp, Homo sapiens
gaggcagggtcag

SEQ ID NO: 1639642 - DNA, 15 bp, Homo sapiens
gaggcaggtgagaga

SEQ ID NO: 1639643 - DNA, 22 bp, Homo sapiens
gaggcatcatggaaagactggg

SEQ ID NO: 1639644 - DNA, 17 bp, Homo sapiens
gaggcatctggaaaggg

SEQ ID NO: 1639645 - DNA, 18 bp, Homo sapiens
gaggcattcggggaagct

SEQ ID NO: 1639646 - DNA, 16 bp, Homo sapiens
gaggccaaccagcccg

SEQ ID NO: 1639647 - DNA, 20 bp, Homo sapiens
gaggccaagcagtgcctgcc

SEQ ID NO: 1639648 - DNA, 21 bp, Homo sapiens
gaggccaagcagtgcctgcct

SEQ ID NO: 1639649 - DNA, 16 bp, Homo sapiens
gaggccaaggcaggta

SEQ ID NO: 1639650 - DNA, 19 bp, Homo sapiens
gaggccacccactgaccca

SEQ ID NO: 1639651 - DNA, 22 bp, Homo sapiens
gaggccaccgggacagacctgg

SEQ ID NO: 1639652 - DNA, 21 bp, Homo sapiens
gaggccagccccacccaggag

SEQ ID NO: 1639653 - DNA, 15 bp, Homo sapiens
gaggccatctcagga

SEQ ID NO: 1639654 - DNA, 16 bp, Homo sapiens
gaggccatctcaggag

SEQ ID NO: 1639655 - DNA, 19 bp, Homo sapiens
gaggcccagcgggcagatg

SEQ ID NO: 1639656 - DNA, 13 bp, Homo sapiens
gaggcccaggcac

SEQ ID NO: 1639657 - DNA, 13 bp, Homo sapiens
gaggcccaggctg

SEQ ID NO: 1639658 - DNA, 23 bp, Homo sapiens
gaggcccaggctgggaactcatc

SEQ ID NO: 1639659 - DNA, 14 bp, Homo sapiens
gaggccccaggggg

SEQ ID NO: 1639660 - DNA, 14 bp, Homo sapiens
gaggcccccagccc

SEQ ID NO: 1639661 - DNA, 16 bp, Homo sapiens
gaggcccccagcccag

SEQ ID NO: 1639662 - DNA, 18 bp, Homo sapiens
gaggcccccgtcagggag

SEQ ID NO: 1639663 - DNA, 19 bp, Homo sapiens
gaggcccctaggtgcccag

SEQ ID NO: 1639664 - DNA, 21 bp, Homo sapiens
gaggcccctaggtgcccaggg

SEQ ID NO: 1639665 - DNA, 22 bp, Homo sapiens
gaggcccctaggtgcccagggc

SEQ ID NO: 1639666 - DNA, 21 bp, Homo sapiens
gaggcccctgaggcagcccag

SEQ ID NO: 1639667 - DNA, 23 bp, Homo sapiens
gaggcccctgggctctcacccag

SEQ ID NO: 1639668 - DNA, 20 bp, Homo sapiens
gaggcccgcatgcggcccag

SEQ ID NO: 1639669 - DNA, 18 bp, Homo sapiens
gaggccctgcccaatgag

SEQ ID NO: 1639670 - DNA, 19 bp, Homo sapiens
gaggccctggaggtctcca

SEQ ID NO: 1639671 - DNA, 21 bp, Homo sapiens
gaggccctggaggtctccagg

SEQ ID NO: 1639672 - DNA, 19 bp, Homo sapiens
gaggccctggtcctggcct

SEQ ID NO: 1639673 - DNA, 18 bp, Homo sapiens
gaggccctgttccctgga

SEQ ID NO: 1639674 - DNA, 23 bp, Homo sapiens
gaggcccttgtcgtgggatggca

SEQ ID NO: 1639675 - DNA, 21 bp, Homo sapiens
gaggccgaaggtgcctcagac

SEQ ID NO: 1639676 - DNA, 15 bp, Homo sapiens
gaggccgaggaccac

SEQ ID NO: 1639677 - DNA, 14 bp, Homo sapiens
gaggccgaggcggg

SEQ ID NO: 1639678 - DNA, 17 bp, Homo sapiens
gaggccggggtccaggc

SEQ ID NO: 1639679 - DNA, 19 bp, Homo sapiens
gaggcctaaaagtaaacat

SEQ ID NO: 1639680 - DNA, 22 bp, Homo sapiens
gaggcctcactactcgagccca

SEQ ID NO: 1639681 - DNA, 14 bp, Homo sapiens
gaggcctcatccct

SEQ ID NO: 1639682 - DNA, 20 bp, Homo sapiens
gaggcctcccccagccagga

SEQ ID NO: 1639683 - DNA, 18 bp, Homo sapiens
gaggcctctggaaagcaa

SEQ ID NO: 1639684 - DNA, 9 bp, Homo sapiens
gaggcctga

SEQ ID NO: 1639685 - DNA, 13 bp, Homo sapiens
gaggcctgaggat

SEQ ID NO: 1639686 - DNA, 21 bp, Homo sapiens
gaggcctgaggatgagctgga

SEQ ID NO: 1639687 - DNA, 22 bp, Homo sapiens
gaggcctgatctgcccatcgtg

SEQ ID NO: 1639688 - DNA, 14 bp, Homo sapiens
gaggcctgatgctg

SEQ ID NO: 1639689 - DNA, 21 bp, Homo sapiens
gaggcctgcctccagggctgg

SEQ ID NO: 1639690 - DNA, 19 bp, Homo sapiens
gaggcctgcgaccctgggg

SEQ ID NO: 1639691 - DNA, 18 bp, Homo sapiens
gaggcctggactttcctg

SEQ ID NO: 1639692 - DNA, 21 bp, Homo sapiens
gaggcctggcatcttctggag

SEQ ID NO: 1639693 - DNA, 14 bp, Homo sapiens
gaggcctgggccgc

SEQ ID NO: 1639694 - DNA, 20 bp, Homo sapiens
gaggcctgggccgctgccac

SEQ ID NO: 1639695 - DNA, 19 bp, Homo sapiens
gaggcctgtttggcctctc

SEQ ID NO: 1639696 - DNA, 19 bp, Homo sapiens
gaggccttccagctgctgt

SEQ ID NO: 1639697 - DNA, 14 bp, Homo sapiens
gaggcctttaacca

SEQ ID NO: 1639698 - DNA, 14 bp, Homo sapiens
gaggcgagccaggc

SEQ ID NO: 1639699 - DNA, 15 bp, Homo sapiens
gaggcgagccaggca

SEQ ID NO: 1639700 - DNA, 14 bp, Homo sapiens
gaggcgatgccagc

SEQ ID NO: 1639701 - DNA, 22 bp, Homo sapiens
gaggcgcccttggcttctgtga

SEQ ID NO: 1639702 - DNA, 13 bp, Homo sapiens
gaggcggcagctg

SEQ ID NO: 1639703 - DNA, 14 bp, Homo sapiens
gaggcggcagctgg

SEQ ID NO: 1639704 - DNA, 14 bp, Homo sapiens
gaggcggcccggcc

SEQ ID NO: 1639705 - DNA, 17 bp, Homo sapiens
gaggcggcccggccagc

SEQ ID NO: 1639706 - DNA, 21 bp, Homo sapiens
gaggcggcccggccagcgggc

SEQ ID NO: 1639707 - DNA, 13 bp, Homo sapiens
gaggcgggccagc

SEQ ID NO: 1639708 - DNA, 17 bp, Homo sapiens
gaggcgggccagccagg

SEQ ID NO: 1639709 - DNA, 12 bp, Homo sapiens
gaggcgggtgga

SEQ ID NO: 1639710 - DNA, 19 bp, Homo sapiens
gaggcgggtggatcacctg

SEQ ID NO: 1639711 - DNA, 18 bp, Homo sapiens
gaggcgtactacccagct

SEQ ID NO: 1639712 - DNA, 16 bp, Homo sapiens
gaggcgtgcccccctc

SEQ ID NO: 1639713 - DNA, 22 bp, Homo sapiens
gaggcgtgcccccctcctccag

SEQ ID NO: 1639714 - DNA, 20 bp, Homo sapiens
gaggcgttagtgggcaggtg

SEQ ID NO: 1639715 - DNA, 21 bp, Homo sapiens
gaggcgttagtgggcaggtgg

SEQ ID NO: 1639716 - DNA, 22 bp, Homo sapiens
gaggctacctcacctgggcagg

SEQ ID NO: 1639717 - DNA, 14 bp, Homo sapiens
gaggctagaggcat

SEQ ID NO: 1639718 - DNA, 13 bp, Homo sapiens
gaggctccccgcc

SEQ ID NO: 1639719 - DNA, 15 bp, Homo sapiens
gaggctctccgtgca

SEQ ID NO: 1639720 - DNA, 17 bp, Homo sapiens
gaggctctgttctgcct

SEQ ID NO: 1639721 - DNA, 18 bp, Homo sapiens
gaggctgagacaggagaa

SEQ ID NO: 1639722 - DNA, 14 bp, Homo sapiens
gaggctgaggcagg

SEQ ID NO: 1639723 - DNA, 16 bp, Homo sapiens
gaggctgaggcctgga

SEQ ID NO: 1639724 - DNA, 12 bp, Homo sapiens
gaggctgaggcg

SEQ ID NO: 1639725 - DNA, 16 bp, Homo sapiens
gaggctgagggacagg

SEQ ID NO: 1639726 - DNA, 18 bp, Homo sapiens
gaggctgaggtgggcaga

SEQ ID NO: 1639727 - DNA, 18 bp, Homo sapiens
gaggctgcaatgagccat

SEQ ID NO: 1639728 - DNA, 18 bp, Homo sapiens
gaggctgcagcaggtgct

SEQ ID NO: 1639729 - DNA, 22 bp, Homo sapiens
gaggctgcagcaggtgctgggc

SEQ ID NO: 1639730 - DNA, 16 bp, Homo sapiens
gaggctgcagcgagct

SEQ ID NO: 1639731 - DNA, 15 bp, Homo sapiens
gaggctgcatgctct

SEQ ID NO: 1639732 - DNA, 22 bp, Homo sapiens
gaggctgcatgctctggaagcc

SEQ ID NO: 1639733 - DNA, 11 bp, Homo sapiens
gaggctgcccc

SEQ ID NO: 1639734 - DNA, 13 bp, Homo sapiens
gaggctgccccag

SEQ ID NO: 1639735 - DNA, 16 bp, Homo sapiens
gaggctgccccaggcc

SEQ ID NO: 1639736 - DNA, 18 bp, Homo sapiens
gaggctgcccctctcacc

SEQ ID NO: 1639737 - DNA, 19 bp, Homo sapiens
gaggctgcccctctcacca

SEQ ID NO: 1639738 - DNA, 13 bp, Homo sapiens
gaggctgcctcag

SEQ ID NO: 1639739 - DNA, 14 bp, Homo sapiens
gaggctgcctcagc

SEQ ID NO: 1639740 - DNA, 15 bp, Homo sapiens
gaggctggaggaagg

SEQ ID NO: 1639741 - DNA, 18 bp, Homo sapiens
gaggctggaggcagggcc

SEQ ID NO: 1639742 - DNA, 20 bp, Homo sapiens
gaggctgggggagagccgtg

SEQ ID NO: 1639743 - DNA, 21 bp, Homo sapiens
gaggctggttttgatggctgg

SEQ ID NO: 1639744 - DNA, 23 bp, Homo sapiens
gaggctggttttgatggctgggt

SEQ ID NO: 1639745 - DNA, 21 bp, Homo sapiens
gaggctgtaactgagagaaag

SEQ ID NO: 1639746 - DNA, 17 bp, Homo sapiens
gaggctgtcacagtcct

SEQ ID NO: 1639747 - DNA, 21 bp, Homo sapiens
gaggctgtcttctcaggctct

SEQ ID NO: 1639748 - DNA, 13 bp, Homo sapiens
gaggcttccaggc

SEQ ID NO: 1639749 - DNA, 19 bp, Homo sapiens
gaggcttccaggctcttcc

SEQ ID NO: 1639750 - DNA, 15 bp, Homo sapiens
gaggcttcctgcgtc

SEQ ID NO: 1639751 - DNA, 14 bp, Homo sapiens
gaggcttctccttc

SEQ ID NO: 1639752 - DNA, 22 bp, Homo sapiens
gaggcttcttcagatcagtgct

SEQ ID NO: 1639753 - DNA, 15 bp, Homo sapiens
gaggcttggaaagca

SEQ ID NO: 1639754 - DNA, 23 bp, Homo sapiens
gaggctttatgataatagattct

SEQ ID NO: 1639755 - DNA, 15 bp, Homo sapiens
gagctcccacctccc

SEQ ID NO: 1639756 - DNA, 18 bp, Homo sapiens
gagctcccacctcccttc

SEQ ID NO: 1639757 - DNA, 20 bp, Homo sapiens
gagctcccacctcccttccc

SEQ ID NO: 1639758 - DNA, 19 bp, Homo sapiens
gagctcctcttccatgctg

SEQ ID NO: 1639759 - DNA, 11 bp, Homo sapiens
gagctcctgcg

SEQ ID NO: 1639760 - DNA, 17 bp, Homo sapiens
gagctcgcggggcagca

SEQ ID NO: 1639761 - DNA, 18 bp, Homo sapiens
gagctcggggggctctgc

SEQ ID NO: 1639762 - DNA, 21 bp, Homo sapiens
gagctcggggggctctgcctt

SEQ ID NO: 1639763 - DNA, 16 bp, Homo sapiens
gagctcgtgtatcctg

SEQ ID NO: 1639764 - DNA, 18 bp, Homo sapiens
gagctcgtgtatcctggg

SEQ ID NO: 1639765 - DNA, 23 bp, Homo sapiens
gagctcgtgtatcctggggctcc

SEQ ID NO: 1639766 - DNA, 15 bp, Homo sapiens
gagctctatccccat

SEQ ID NO: 1639767 - DNA, 16 bp, Homo sapiens
gagctctccaggccag

SEQ ID NO: 1639768 - DNA, 17 bp, Homo sapiens
gagctctccaggccagg

SEQ ID NO: 1639769 - DNA, 16 bp, Homo sapiens
gagctctcccctcctg

SEQ ID NO: 1639770 - DNA, 15 bp, Homo sapiens
gagctctgaaatctt

SEQ ID NO: 1639771 - DNA, 20 bp, Homo sapiens
gagctctgcgccaggcagag

SEQ ID NO: 1639772 - DNA, 16 bp, Homo sapiens
gagctctggccccgct

SEQ ID NO: 1639773 - DNA, 13 bp, Homo sapiens
gagctctggggac

SEQ ID NO: 1639774 - DNA, 22 bp, Homo sapiens
gagctctggggacagcttcctc

SEQ ID NO: 1639775 - DNA, 19 bp, Homo sapiens
gagctctgtgggtctctgg

SEQ ID NO: 1639776 - DNA, 20 bp, Homo sapiens
gagctcttcaagctgtcccc

SEQ ID NO: 1639777 - DNA, 13 bp, Homo sapiens
gagctcttccctt

SEQ ID NO: 1639778 - DNA, 13 bp, Homo sapiens
gagctcttggaag

SEQ ID NO: 1639779 - DNA, 22 bp, Homo sapiens
gagctgaaaaggatcgaggcat

SEQ ID NO: 1639780 - DNA, 13 bp, Homo sapiens
gagctgagatcgt

SEQ ID NO: 1639781 - DNA, 15 bp, Homo sapiens
gagctgagggccctg

SEQ ID NO: 1639782 - DNA, 16 bp, Homo sapiens
gagctgagtcacctcc

SEQ ID NO: 1639783 - DNA, 20 bp, Homo sapiens
gagctgagtcacctcctcca

SEQ ID NO: 1639784 - DNA, 13 bp, Homo sapiens
gagctgatccaga

SEQ ID NO: 1639785 - DNA, 16 bp, Homo sapiens
gagctgatccagagca

SEQ ID NO: 1639786 - DNA, 20 bp, Homo sapiens
gagctgatccagagcacaga

SEQ ID NO: 1639787 - DNA, 14 bp, Homo sapiens
gagctgatggcagc

SEQ ID NO: 1639788 - DNA, 15 bp, Homo sapiens
gagctgatggcagct

SEQ ID NO: 1639789 - DNA, 22 bp, Homo sapiens
gagctgcataatgtccctctct

SEQ ID NO: 1639790 - DNA, 20 bp, Homo sapiens
gagctgccactgggcacctg

SEQ ID NO: 1639791 - DNA, 19 bp, Homo sapiens
gagctgccgacttggagac

SEQ ID NO: 1639792 - DNA, 15 bp, Homo sapiens
gagctgcctgcagca

SEQ ID NO: 1639793 - DNA, 20 bp, Homo sapiens
gagctgcctgcttggcccgg

SEQ ID NO: 1639794 - DNA, 21 bp, Homo sapiens
gagctgcctggatgagaaaca

SEQ ID NO: 1639795 - DNA, 14 bp, Homo sapiens
gagctgccttccct

SEQ ID NO: 1639796 - DNA, 23 bp, Homo sapiens
gagctgccttccctagctttaga

SEQ ID NO: 1639797 - DNA, 18 bp, Homo sapiens
gagctgccttggctcaga

SEQ ID NO: 1639798 - DNA, 18 bp, Homo sapiens
gagctgcgccggacagag

SEQ ID NO: 1639799 - DNA, 12 bp, Homo sapiens
gagctgctcaga

SEQ ID NO: 1639800 - DNA, 22 bp, Homo sapiens
gagctgctgagtgacagctttc

SEQ ID NO: 1639801 - DNA, 12 bp, Homo sapiens
gagctgctgtcc

SEQ ID NO: 1639802 - DNA, 14 bp, Homo sapiens
gagctggaaggcag

SEQ ID NO: 1639803 - DNA, 22 bp, Homo sapiens
gagctggaaggggccacgtgga

SEQ ID NO: 1639804 - DNA, 12 bp, Homo sapiens
gagctggagggg

SEQ ID NO: 1639805 - DNA, 15 bp, Homo sapiens
gagctggaggggtgg

SEQ ID NO: 1639806 - DNA, 17 bp, Homo sapiens
gagctggaggggtgggg

SEQ ID NO: 1639807 - DNA, 19 bp, Homo sapiens
gagctggaggggtggggag

SEQ ID NO: 1639808 - DNA, 21 bp, Homo sapiens
gagctggatagacttgggatg

SEQ ID NO: 1639809 - DNA, 21 bp, Homo sapiens
gagctggatttgggagctctg

SEQ ID NO: 1639810 - DNA, 22 bp, Homo sapiens
gagctggatttgggagctctgc

SEQ ID NO: 1639811 - DNA, 17 bp, Homo sapiens
gagctggcaaccagcca

SEQ ID NO: 1639812 - DNA, 22 bp, Homo sapiens
gagctggccaaagagcctttcc

SEQ ID NO: 1639813 - DNA, 15 bp, Homo sapiens
gagctggcctgtggc

SEQ ID NO: 1639814 - DNA, 22 bp, Homo sapiens
gagctggctctgagcgcctcca

SEQ ID NO: 1639815 - DNA, 13 bp, Homo sapiens
gagctggctggca

SEQ ID NO: 1639816 - DNA, 23 bp, Homo sapiens
gagctgggaagctgtactcagag

SEQ ID NO: 1639817 - DNA, 16 bp, Homo sapiens
gagctgggagacaaag

SEQ ID NO: 1639818 - DNA, 20 bp, Homo sapiens
gagctgggagaccctcccca

SEQ ID NO: 1639819 - DNA, 17 bp, Homo sapiens
gagctgggcagaaggcc

SEQ ID NO: 1639820 - DNA, 15 bp, Homo sapiens
gagctgggcccctgc

SEQ ID NO: 1639821 - DNA, 14 bp, Homo sapiens
gagctggggccaca

SEQ ID NO: 1639822 - DNA, 13 bp, Homo sapiens
gagctggggtggg

SEQ ID NO: 1639823 - DNA, 21 bp, Homo sapiens
gagctggggtgggagctcctc

SEQ ID NO: 1639824 - DNA, 16 bp, Homo sapiens
gagctggtgcccggag

SEQ ID NO: 1639825 - DNA, 17 bp, Homo sapiens
gagctggtgcccggaga

SEQ ID NO: 1639826 - DNA, 14 bp, Homo sapiens
gagctggtgtctga

SEQ ID NO: 1639827 - DNA, 23 bp, Homo sapiens
gagctgtaatttcgccttaaact

SEQ ID NO: 1639828 - DNA, 16 bp, Homo sapiens
gagctgtcaccaagga

SEQ ID NO: 1639829 - DNA, 17 bp, Homo sapiens
gagctgtcaccaaggaa

SEQ ID NO: 1639830 - DNA, 15 bp, Homo sapiens
gagctgtcgctgcct

SEQ ID NO: 1639831 - DNA, 15 bp, Homo sapiens
gagctgtgccagcag

SEQ ID NO: 1639832 - DNA, 19 bp, Homo sapiens
gagctgtgcctgctcagca

SEQ ID NO: 1639833 - DNA, 21 bp, Homo sapiens
gagctgtgttttgtctgagcc

SEQ ID NO: 1639834 - DNA, 22 bp, Homo sapiens
gagctgtgttttgtctgagcct

SEQ ID NO: 1639835 - DNA, 17 bp, Homo sapiens
gagctgtttatggcctc

SEQ ID NO: 1639836 - DNA, 22 bp, Homo sapiens
gagcttacattgaaaacagata

SEQ ID NO: 1639837 - DNA, 13 bp, Homo sapiens
gagcttacccaag

SEQ ID NO: 1639838 - DNA, 15 bp, Homo sapiens
gagcttacccaagct

SEQ ID NO: 1639839 - DNA, 18 bp, Homo sapiens
gagcttagccttgtgccc

SEQ ID NO: 1639840 - DNA, 22 bp, Homo sapiens
gagcttagccttgtgccctgcc

SEQ ID NO: 1639841 - DNA, 14 bp, Homo sapiens
gagcttagggatga

SEQ ID NO: 1639842 - DNA, 15 bp, Homo sapiens
gagcttattggccac

SEQ ID NO: 1639843 - DNA, 19 bp, Homo sapiens
gagcttattggccactggg

SEQ ID NO: 1639844 - DNA, 15 bp, Homo sapiens
gagcttccaaatgtg

SEQ ID NO: 1639845 - DNA, 21 bp, Homo sapiens
gagcttcccacacctgcctgc

SEQ ID NO: 1639846 - DNA, 16 bp, Homo sapiens
gagcttcggggcctcc

SEQ ID NO: 1639847 - DNA, 16 bp, Homo sapiens
gagcttctctgggctg

SEQ ID NO: 1639848 - DNA, 16 bp, Homo sapiens
gagcttgagctcccct

SEQ ID NO: 1639849 - DNA, 14 bp, Homo sapiens
gagcttgctccaga

SEQ ID NO: 1639850 - DNA, 18 bp, Homo sapiens
gagcttgctccagattct

SEQ ID NO: 1639851 - DNA, 16 bp, Homo sapiens
gagcttggactacaca

SEQ ID NO: 1639852 - DNA, 13 bp, Homo sapiens
gagcttgggaatg

SEQ ID NO: 1639853 - DNA, 16 bp, Homo sapiens
gagcttgtgtcctgtc

SEQ ID NO: 1639854 - DNA, 21 bp, Homo sapiens
gagctttccatgttgctgcca

SEQ ID NO: 1639855 - DNA, 23 bp, Homo sapiens
gagctttctgtccttttggcact

SEQ ID NO: 1639856 - DNA, 13 bp, Homo sapiens
gagctttgctgct

SEQ ID NO: 1639857 - DNA, 19 bp, Homo sapiens
gagctttgggtgaccagcc

SEQ ID NO: 1639858 - DNA, 21 bp, Homo sapiens
gagctttgggtgaccagccac

SEQ ID NO: 1639859 - DNA, 14 bp, Homo sapiens
gagctttgtgcttg

SEQ ID NO: 1639860 - DNA, 11 bp, Homo sapiens
gagcttttaaa

SEQ ID NO: 1639861 - DNA, 18 bp, Homo sapiens
gagcttttaaaaatgttt

SEQ ID NO: 1639862 - DNA, 12 bp, Homo sapiens
gaggaaaaaaga

SEQ ID NO: 1639863 - DNA, 15 bp, Homo sapiens
gaggaaaaaatggta

SEQ ID NO: 1639864 - DNA, 19 bp, Homo sapiens
gaggaaaaatgggagccag

SEQ ID NO: 1639865 - DNA, 21 bp, Homo sapiens
gaggaaaaccaagccgtggct

SEQ ID NO: 1639866 - DNA, 23 bp, Homo sapiens
gaggaaaaggcccctgcaatgtg

SEQ ID NO: 1639867 - DNA, 21 bp, Homo sapiens
gaggaaaagtcaaagtgttgc

SEQ ID NO: 1639868 - DNA, 13 bp, Homo sapiens
gaggaaaagtgca

SEQ ID NO: 1639869 - DNA, 13 bp, Homo sapiens
gaggaaaattctt

SEQ ID NO: 1639870 - DNA, 19 bp, Homo sapiens
gaggaaataacagagagaa

SEQ ID NO: 1639871 - DNA, 21 bp, Homo sapiens
gaggaaataagaaaaatcatg

SEQ ID NO: 1639872 - DNA, 21 bp, Homo sapiens
gaggaactgggtgactggagg

SEQ ID NO: 1639873 - DNA, 12 bp, Homo sapiens
gaggaagagaga

SEQ ID NO: 1639874 - DNA, 14 bp, Homo sapiens
gaggaagagccacc

SEQ ID NO: 1639875 - DNA, 15 bp, Homo sapiens
gaggaagagccacct

SEQ ID NO: 1639876 - DNA, 22 bp, Homo sapiens
gaggaagcccaggctcggagga

SEQ ID NO: 1639877 - DNA, 13 bp, Homo sapiens
gaggaaggggggt

SEQ ID NO: 1639878 - DNA, 13 bp, Homo sapiens
gaggaaggtgctg

SEQ ID NO: 1639879 - DNA, 16 bp, Homo sapiens
gaggaagtagtccagc

SEQ ID NO: 1639880 - DNA, 18 bp, Homo sapiens
gaggaagtcttatcttct

SEQ ID NO: 1639881 - DNA, 22 bp, Homo sapiens
gaggaatagtgcttgctggcca

SEQ ID NO: 1639882 - DNA, 23 bp, Homo sapiens
gaggaatatgacggaagaacata

SEQ ID NO: 1639883 - DNA, 20 bp, Homo sapiens
gaggaatcaacagggcagca

SEQ ID NO: 1639884 - DNA, 19 bp, Homo sapiens
gaggaatccaaaagacaaa

SEQ ID NO: 1639885 - DNA, 19 bp, Homo sapiens
gaggaatcctggcagccca

SEQ ID NO: 1639886 - DNA, 22 bp, Homo sapiens
gaggaatctgtttctctgctgt

SEQ ID NO: 1639887 - DNA, 16 bp, Homo sapiens
gaggaatgtagggcct

SEQ ID NO: 1639888 - DNA, 17 bp, Homo sapiens
gaggaatgtagggcctg

SEQ ID NO: 1639889 - DNA, 22 bp, Homo sapiens
gaggaattttctttgtgtagct

SEQ ID NO: 1639890 - DNA, 15 bp, Homo sapiens
gaggacaaccattcc

SEQ ID NO: 1639891 - DNA, 23 bp, Homo sapiens
gaggacacagcacaagggcacat

SEQ ID NO: 1639892 - DNA, 19 bp, Homo sapiens
gaggacaccagtgaaagaa

SEQ ID NO: 1639893 - DNA, 19 bp, Homo sapiens
gaggacagaaggactggtg

SEQ ID NO: 1639894 - DNA, 14 bp, Homo sapiens
gaggacagagcttg

SEQ ID NO: 1639895 - DNA, 15 bp, Homo sapiens
gaggacagtctggag

SEQ ID NO: 1639896 - DNA, 16 bp, Homo sapiens
gaggacagtctggaga

SEQ ID NO: 1639897 - DNA, 18 bp, Homo sapiens
gaggacatgatggagcgc

SEQ ID NO: 1639898 - DNA, 19 bp, Homo sapiens
gaggaccaacatccagtcc

SEQ ID NO: 1639899 - DNA, 19 bp, Homo sapiens
gaggaccaccagcaggcag

SEQ ID NO: 1639900 - DNA, 14 bp, Homo sapiens
gaggaccagggcct

SEQ ID NO: 1639901 - DNA, 11 bp, Homo sapiens
gaggaccctgg

SEQ ID NO: 1639902 - DNA, 15 bp, Homo sapiens
gaggacgagaccccc

SEQ ID NO: 1639903 - DNA, 17 bp, Homo sapiens
gaggacgagacccccat

SEQ ID NO: 1639904 - DNA, 19 bp, Homo sapiens
gaggacgtgttacccactg

SEQ ID NO: 1639905 - DNA, 21 bp, Homo sapiens
gaggactcccaaccctggctt

SEQ ID NO: 1639906 - DNA, 18 bp, Homo sapiens
gaggactccgggaccatt

SEQ ID NO: 1639907 - DNA, 11 bp, Homo sapiens
gaggactgaga

SEQ ID NO: 1639908 - DNA, 15 bp, Homo sapiens
gaggactgagactgg

SEQ ID NO: 1639909 - DNA, 20 bp, Homo sapiens
gaggactgtagggagggcgg

SEQ ID NO: 1639910 - DNA, 13 bp, Homo sapiens
gaggacttcaagc

SEQ ID NO: 1639911 - DNA, 18 bp, Homo sapiens
gaggacttgtgtctctgt

SEQ ID NO: 1639912 - DNA, 15 bp, Homo sapiens
gaggagaaatgcaat

SEQ ID NO: 1639913 - DNA, 21 bp, Homo sapiens
gaggagaaatgcaataactct

SEQ ID NO: 1639914 - DNA, 14 bp, Homo sapiens
gaggagaagacaac

SEQ ID NO: 1639915 - DNA, 16 bp, Homo sapiens
gaggagacagaaagcc

SEQ ID NO: 1639916 - DNA, 16 bp, Homo sapiens
gaggagaccagctcag

SEQ ID NO: 1639917 - DNA, 12 bp, Homo sapiens
gaggagaccctg

SEQ ID NO: 1639918 - DNA, 16 bp, Homo sapiens
gaggagaccctggaat

SEQ ID NO: 1639919 - DNA, 14 bp, Homo sapiens
gaggagagtcccag

SEQ ID NO: 1639920 - DNA, 13 bp, Homo sapiens
gaggagcacctga

SEQ ID NO: 1639921 - DNA, 13 bp, Homo sapiens
gaggagcagaggg

SEQ ID NO: 1639922 - DNA, 23 bp, Homo sapiens
gaggagcagcttccttctgggac

SEQ ID NO: 1639923 - DNA, 14 bp, Homo sapiens
gaggagccctgagg

SEQ ID NO: 1639924 - DNA, 16 bp, Homo sapiens
gaggagcctcagaaga

SEQ ID NO: 1639925 - DNA, 17 bp, Homo sapiens
gaggagcctcagaagaa

SEQ ID NO: 1639926 - DNA, 21 bp, Homo sapiens
gaggagcctgtgcgtcccagc

SEQ ID NO: 1639927 - DNA, 11 bp, Homo sapiens
gaggagctgct

SEQ ID NO: 1639928 - DNA, 13 bp, Homo sapiens
gaggagctgctgg

SEQ ID NO: 1639929 - DNA, 17 bp, Homo sapiens
gaggagctggaggggtg

SEQ ID NO: 1639930 - DNA, 18 bp, Homo sapiens
gaggagctggaggggtgg

SEQ ID NO: 1639931 - DNA, 23 bp, Homo sapiens
gaggagctggaggggtggggagc

SEQ ID NO: 1639932 - DNA, 13 bp, Homo sapiens
gaggagctgggcc

SEQ ID NO: 1639933 - DNA, 19 bp, Homo sapiens
gaggagcttctcccagtgt

SEQ ID NO: 1639934 - DNA, 20 bp, Homo sapiens
gaggagcttctcccagtgtg

SEQ ID NO: 1639935 - DNA, 21 bp, Homo sapiens
gaggagcttgggggatgacta

SEQ ID NO: 1639936 - DNA, 16 bp, Homo sapiens
gaggaggaaggcaaga

SEQ ID NO: 1639937 - DNA, 15 bp, Homo sapiens
gaggaggacacagca

SEQ ID NO: 1639938 - DNA, 14 bp, Homo sapiens
gaggaggagagagt

SEQ ID NO: 1639939 - DNA, 14 bp, Homo sapiens
gaggaggaggacac

SEQ ID NO: 1639940 - DNA, 16 bp, Homo sapiens
gaggaggaggacacag

SEQ ID NO: 1639941 - DNA, 14 bp, Homo sapiens
gaggaggagggaga

SEQ ID NO: 1639942 - DNA, 12 bp, Homo sapiens
gaggaggccacc

SEQ ID NO: 1639943 - DNA, 16 bp, Homo sapiens
gaggaggccacctctc

SEQ ID NO: 1639944 - DNA, 18 bp, Homo sapiens
gaggaggccacctctcca

SEQ ID NO: 1639945 - DNA, 12 bp, Homo sapiens
gaggagggagaa

SEQ ID NO: 1639946 - DNA, 14 bp, Homo sapiens
gaggagggatgctg

SEQ ID NO: 1639947 - DNA, 19 bp, Homo sapiens
gaggagggatgctgcctga

SEQ ID NO: 1639948 - DNA, 16 bp, Homo sapiens
gaggagggtggaggaa

SEQ ID NO: 1639949 - DNA, 18 bp, Homo sapiens
gaggaggtcccacttgca

SEQ ID NO: 1639950 - DNA, 18 bp, Homo sapiens
gaggaggtggcagccctg

SEQ ID NO: 1639951 - DNA, 23 bp, Homo sapiens
gaggaggtgtctggggtgaggga

SEQ ID NO: 1639952 - DNA, 21 bp, Homo sapiens
gaggaggtgtgaggaggaggc

SEQ ID NO: 1639953 - DNA, 15 bp, Homo sapiens
gaggaggtttgcctg

SEQ ID NO: 1639954 - DNA, 18 bp, Homo sapiens
gaggatatattttcactt

SEQ ID NO: 1639955 - DNA, 19 bp, Homo sapiens
gaggatcactggagcccag

SEQ ID NO: 1639956 - DNA, 14 bp, Homo sapiens
gaggatcagttttt

SEQ ID NO: 1639957 - DNA, 18 bp, Homo sapiens
gaggatgaatagatgtga

SEQ ID NO: 1639958 - DNA, 15 bp, Homo sapiens
gaggatgcattcgag

SEQ ID NO: 1639959 - DNA, 15 bp, Homo sapiens
gaggatgccttttct

SEQ ID NO: 1639960 - DNA, 22 bp, Homo sapiens
gaggatggagagcagccagcac

SEQ ID NO: 1639961 - DNA, 14 bp, Homo sapiens
gaggattattgata

SEQ ID NO: 1639962 - DNA, 22 bp, Homo sapiens
gaggattgcttgagcccaggag

SEQ ID NO: 1639963 - DNA, 14 bp, Homo sapiens
gaggattgtggaaa

SEQ ID NO: 1639964 - DNA, 22 bp, Homo sapiens
gaggatttaagggatggaaaag

SEQ ID NO: 1639965 - DNA, 17 bp, Homo sapiens
gaggatttcaagcctgc

SEQ ID NO: 1639966 - DNA, 13 bp, Homo sapiens
gaggcaagaaaag

SEQ ID NO: 1639967 - DNA, 15 bp, Homo sapiens
gaggcaagaaaagga

SEQ ID NO: 1639968 - DNA, 16 bp, Homo sapiens
gaggcaagcctggcca

SEQ ID NO: 1639969 - DNA, 19 bp, Homo sapiens
gaggcaatgtcaggaacag

SEQ ID NO: 1639970 - DNA, 21 bp, Homo sapiens
gaggcaatgtcaggaacagaa

SEQ ID NO: 1639971 - DNA, 16 bp, Homo sapiens
gaggcacactttctgg

SEQ ID NO: 1639972 - DNA, 22 bp, Homo sapiens
gaggcacagttttagaataagg

SEQ ID NO: 1639973 - DNA, 15 bp, Homo sapiens
gaggcaccagctctg

SEQ ID NO: 1639974 - DNA, 19 bp, Homo sapiens
gaggcaccggcgctgcagg

SEQ ID NO: 1639975 - DNA, 15 bp, Homo sapiens
gaggcacctccaggc

SEQ ID NO: 1639976 - DNA, 19 bp, Homo sapiens
gaggcacctccaggcaggc

SEQ ID NO: 1639977 - DNA, 15 bp, Homo sapiens
gaggcacgcaccact

SEQ ID NO: 1639978 - DNA, 17 bp, Homo sapiens
gaggcacgcaccactgc

SEQ ID NO: 1639979 - DNA, 21 bp, Homo sapiens
gaggcactagtcaccgacagc

SEQ ID NO: 1639980 - DNA, 14 bp, Homo sapiens
gaggcactcgctgt

SEQ ID NO: 1639981 - DNA, 16 bp, Homo sapiens
gaggcagaaaattgca

SEQ ID NO: 1639982 - DNA, 22 bp, Homo sapiens
gaggcagacagcagctcaggca

SEQ ID NO: 1639983 - DNA, 22 bp, Homo sapiens
gaggcagacttccctgaatgta

SEQ ID NO: 1639984 - DNA, 20 bp, Homo sapiens
gaggcagatgtggggctgag

SEQ ID NO: 1639985 - DNA, 12 bp, Homo sapiens
gaggcagcccgc

SEQ ID NO: 1639986 - DNA, 23 bp, Homo sapiens
gaggcagcgtgaaagcagatgag

SEQ ID NO: 1639987 - DNA, 20 bp, Homo sapiens
gaggcaggagaatcacttga

SEQ ID NO: 1639988 - DNA, 17 bp, Homo sapiens
gaggcaggcattcctga

SEQ ID NO: 1639989 - DNA, 13 bp, Homo sapiens
gaattttaagcct

SEQ ID NO: 1639990 - DNA, 20 bp, Homo sapiens
gaattttaagcctttgttga

SEQ ID NO: 1639991 - DNA, 15 bp, Homo sapiens
gaattttaatgtgaa

SEQ ID NO: 1639992 - DNA, 17 bp, Homo sapiens
gaattttaatgtgaaga

SEQ ID NO: 1639993 - DNA, 19 bp, Homo sapiens
gaattttaggaacttcaga

SEQ ID NO: 1639994 - DNA, 13 bp, Homo sapiens
gaattttattttg

SEQ ID NO: 1639995 - DNA, 17 bp, Homo sapiens
gaattttcaaggccttc

SEQ ID NO: 1639996 - DNA, 23 bp, Homo sapiens
gaattttcagaccccagcggctg

SEQ ID NO: 1639997 - DNA, 12 bp, Homo sapiens
gaattttcatcc

SEQ ID NO: 1639998 - DNA, 15 bp, Homo sapiens
gaattttgcaatgta

SEQ ID NO: 1639999 - DNA, 21 bp, Homo sapiens
gaattttgggtattgtaatct

SEQ ID NO: 1640000 - DNA, 17 bp, Homo sapiens
gaattttgtatgctgaa

SEQ ID NO: 1640001 - DNA, 16 bp, Homo sapiens
gaattttgtgtgattg

SEQ ID NO: 1640002 - DNA, 17 bp, Homo sapiens
gaattttgttctctggg

SEQ ID NO: 1640003 - DNA, 23 bp, Homo sapiens
gaattttgttctctgggagaaaa

SEQ ID NO: 1640004 - DNA, 15 bp, Homo sapiens
gaatttttattgttg

SEQ ID NO: 1640005 - DNA, 21 bp, Homo sapiens
gaatttttcccctttgattca

SEQ ID NO: 1640006 - DNA, 24 bp, Homo sapiens
gaatttttccctccactccatccc

SEQ ID NO: 1640007 - DNA, 13 bp, Homo sapiens
gaattttttctca

SEQ ID NO: 1640008 - DNA, 16 bp, Homo sapiens
gaatttttttcatctt

SEQ ID NO: 1640009 - DNA, 20 bp, Homo sapiens
gaattttttttaacattcct

SEQ ID NO: 1640010 - DNA, 17 bp, Homo sapiens
gacaaaaacagcctcac

SEQ ID NO: 1640011 - DNA, 18 bp, Homo sapiens
gacaaaaacagcctcaca

SEQ ID NO: 1640012 - DNA, 20 bp, Homo sapiens
gacaaaaacagcctcacaga

SEQ ID NO: 1640013 - DNA, 16 bp, Homo sapiens
gacaaaaagtttccat

SEQ ID NO: 1640014 - DNA, 18 bp, Homo sapiens
gacaaaaagtttccatat

SEQ ID NO: 1640015 - DNA, 16 bp, Homo sapiens
gacaaaatatttccca

SEQ ID NO: 1640016 - DNA, 18 bp, Homo sapiens
gacaaaatctcctggctt

SEQ ID NO: 1640017 - DNA, 14 bp, Homo sapiens
gacaaaatgaaaca

SEQ ID NO: 1640018 - DNA, 22 bp, Homo sapiens
gacaaaatttgagaatacataa

SEQ ID NO: 1640019 - DNA, 24 bp, Homo sapiens
gacaaaatttgagaatacataaac

SEQ ID NO: 1640020 - DNA, 12 bp, Homo sapiens
gacaaacactgc

SEQ ID NO: 1640021 - DNA, 14 bp, Homo sapiens
gacaaacactgcca

SEQ ID NO: 1640022 - DNA, 21 bp, Homo sapiens
gacaaagacaaattctgtttc

SEQ ID NO: 1640023 - DNA, 20 bp, Homo sapiens
gacaaagaggcctttaacca

SEQ ID NO: 1640024 - DNA, 14 bp, Homo sapiens
gacaaagatttctt

SEQ ID NO: 1640025 - DNA, 16 bp, Homo sapiens
gacaaagatttcttct

SEQ ID NO: 1640026 - DNA, 15 bp, Homo sapiens
gacaaagccctgtcc

SEQ ID NO: 1640027 - DNA, 17 bp, Homo sapiens
gacaaaggacatttgtt

SEQ ID NO: 1640028 - DNA, 15 bp, Homo sapiens
gacaaaggatgaaga

SEQ ID NO: 1640029 - DNA, 18 bp, Homo sapiens
gacaaagtctaaggaaga

SEQ ID NO: 1640030 - DNA, 14 bp, Homo sapiens
gacaaagtctccag

SEQ ID NO: 1640031 - DNA, 19 bp, Homo sapiens
gacaaagtctccagcccac

SEQ ID NO: 1640032 - DNA, 12 bp, Homo sapiens
gacaaagtgcct

SEQ ID NO: 1640033 - DNA, 20 bp, Homo sapiens
gacaaagttccaaaatgcca

SEQ ID NO: 1640034 - DNA, 22 bp, Homo sapiens
agtgagagacgccctatttcta

SEQ ID NO: 1640035 - DNA, 13 bp, Homo sapiens
agtgagagagaca

SEQ ID NO: 1640036 - DNA, 18 bp, Homo sapiens
agtgagagagacaagaag

SEQ ID NO: 1640037 - DNA, 16 bp, Homo sapiens
agtgagagccagcagc

SEQ ID NO: 1640038 - DNA, 16 bp, Homo sapiens
agtgagatatcataga

SEQ ID NO: 1640039 - DNA, 18 bp, Homo sapiens
agtgagcaagggggccca

SEQ ID NO: 1640040 - DNA, 12 bp, Homo sapiens
agtgagcagaac

SEQ ID NO: 1640041 - DNA, 16 bp, Homo sapiens
agtgagcagaacaggt

SEQ ID NO: 1640042 - DNA, 19 bp, Homo sapiens
agtgagcagaacaggtagt

SEQ ID NO: 1640043 - DNA, 20 bp, Homo sapiens
agtgagccacagaccacctg

SEQ ID NO: 1640044 - DNA, 19 bp, Homo sapiens
agtgagccagaaattgatt

SEQ ID NO: 1640045 - DNA, 11 bp, Homo sapiens
agtgagcctga

SEQ ID NO: 1640046 - DNA, 23 bp, Homo sapiens
agtgagctgagatcgtgccgtta

SEQ ID NO: 1640047 - DNA, 21 bp, Homo sapiens
agtgagcttggaaaggaccag

SEQ ID NO: 1640048 - DNA, 20 bp, Homo sapiens
agtgagctttgctgctacag

SEQ ID NO: 1640049 - DNA, 12 bp, Homo sapiens
agtgaggaggga

SEQ ID NO: 1640050 - DNA, 14 bp, Homo sapiens
agtgaggagggatg

SEQ ID NO: 1640051 - DNA, 19 bp, Homo sapiens
agtgaggatgctgcagtga

SEQ ID NO: 1640052 - DNA, 12 bp, Homo sapiens
agtgaggcccaa

SEQ ID NO: 1640053 - DNA, 17 bp, Homo sapiens
agtgaggcccaaggagc

SEQ ID NO: 1640054 - DNA, 17 bp, Homo sapiens
agtgagtacctgcaaaa

SEQ ID NO: 1640055 - DNA, 18 bp, Homo sapiens
agtgagtacctgcaaaaa

SEQ ID NO: 1640056 - DNA, 14 bp, Homo sapiens
agtgagtcacctgc

SEQ ID NO: 1640057 - DNA, 20 bp, Homo sapiens
agtgagtcacctgctccaga

SEQ ID NO: 1640058 - DNA, 21 bp, Homo sapiens
agtgagtcacctgctccagaa

SEQ ID NO: 1640059 - DNA, 19 bp, Homo sapiens
agtgagtcagcaccttggc

SEQ ID NO: 1640060 - DNA, 17 bp, Homo sapiens
agtgagtttgtaaatat

SEQ ID NO: 1640061 - DNA, 19 bp, Homo sapiens
agtgagtttgtaaatattc

SEQ ID NO: 1640062 - DNA, 19 bp, Homo sapiens
agtgataattttatttata

SEQ ID NO: 1640063 - DNA, 23 bp, Homo sapiens
agtgataattttatttataaact

SEQ ID NO: 1640064 - DNA, 23 bp, Homo sapiens
agtgatacaacttcaagtgcatg

SEQ ID NO: 1640065 - DNA, 18 bp, Homo sapiens
agtgatatggtgaaggga

SEQ ID NO: 1640066 - DNA, 20 bp, Homo sapiens
agtgatatggtgaagggaag

SEQ ID NO: 1640067 - DNA, 21 bp, Homo sapiens
agtgatatggtgaagggaagt

SEQ ID NO: 1640068 - DNA, 15 bp, Homo sapiens
agtgatattacattt

SEQ ID NO: 1640069 - DNA, 14 bp, Homo sapiens
agtgatcaaactac

SEQ ID NO: 1640070 - DNA, 17 bp, Homo sapiens
agtgatcaataaaatgt

SEQ ID NO: 1640071 - DNA, 15 bp, Homo sapiens
agtgatctatgtttg

SEQ ID NO: 1640072 - DNA, 16 bp, Homo sapiens
agtgatctatgtttgt

SEQ ID NO: 1640073 - DNA, 12 bp, Homo sapiens
agtgatcttggc

SEQ ID NO: 1640074 - DNA, 14 bp, Homo sapiens
agtgatgcctgccc

SEQ ID NO: 1640075 - DNA, 21 bp, Homo sapiens
agtgatgctgtgctatgaatt

SEQ ID NO: 1640076 - DNA, 23 bp, Homo sapiens
agtgatggcgcgggaggcaccag

SEQ ID NO: 1640077 - DNA, 16 bp, Homo sapiens
agtgatgtaccatgaa

SEQ ID NO: 1640078 - DNA, 19 bp, Homo sapiens
agtgatgtcactagggcag

SEQ ID NO: 1640079 - DNA, 14 bp, Homo sapiens
agtgattcagcagg

SEQ ID NO: 1640080 - DNA, 11 bp, Homo sapiens
agtgattctag

SEQ ID NO: 1640081 - DNA, 22 bp, Homo sapiens
agtgattctcctgcctcagcct

SEQ ID NO: 1640082 - DNA, 14 bp, Homo sapiens
agtgattctgattt

SEQ ID NO: 1640083 - DNA, 18 bp, Homo sapiens
agtgattctgatttcagt

SEQ ID NO: 1640084 - DNA, 16 bp, Homo sapiens
agtgattgacacacag

SEQ ID NO: 1640085 - DNA, 17 bp, Homo sapiens
agtgatttttggtcttc

SEQ ID NO: 1640086 - DNA, 22 bp, Homo sapiens
agtgcaatgcttgtagaagtag

SEQ ID NO: 1640087 - DNA, 11 bp, Homo sapiens
agtgcacacct

SEQ ID NO: 1640088 - DNA, 13 bp, Homo sapiens
agtgcacagctgt

SEQ ID NO: 1640089 - DNA, 14 bp, Homo sapiens
agtgcacagctgtc

SEQ ID NO: 1640090 - DNA, 15 bp, Homo sapiens
agtgcacagctgtcc

SEQ ID NO: 1640091 - DNA, 14 bp, Homo sapiens
agtgcacaggagcc

SEQ ID NO: 1640092 - DNA, 18 bp, Homo sapiens
agtgcacggggcacagcg

SEQ ID NO: 1640093 - DNA, 17 bp, Homo sapiens
agtgcactaaacaaata

SEQ ID NO: 1640094 - DNA, 13 bp, Homo sapiens
agtgcactgcatt

SEQ ID NO: 1640095 - DNA, 23 bp, Homo sapiens
agtgcactgcattcctgtgccct

SEQ ID NO: 1640096 - DNA, 19 bp, Homo sapiens
agtgcacttacacttataa

SEQ ID NO: 1640097 - DNA, 13 bp, Homo sapiens
agtgcagaatgta

SEQ ID NO: 1640098 - DNA, 14 bp, Homo sapiens
agtgcagaatgtaa

SEQ ID NO: 1640099 - DNA, 22 bp, Homo sapiens
agtgcagaatgtaagtgggccc

SEQ ID NO: 1640100 - DNA, 12 bp, Homo sapiens
agtgcagacagg

SEQ ID NO: 1640101 - DNA, 16 bp, Homo sapiens
agtgcagacaggccat

SEQ ID NO: 1640102 - DNA, 21 bp, Homo sapiens
agtgcagagccttctcagaag

SEQ ID NO: 1640103 - DNA, 17 bp, Homo sapiens
agtgcagatctgtgctc

SEQ ID NO: 1640104 - DNA, 16 bp, Homo sapiens
agtgcagcagaggaca

SEQ ID NO: 1640105 - DNA, 15 bp, Homo sapiens
agtgcagccactggc

SEQ ID NO: 1640106 - DNA, 17 bp, Homo sapiens
agtgcaggtttctattg

SEQ ID NO: 1640107 - DNA, 10 bp, Homo sapiens
agtgcagtga

SEQ ID NO: 1640108 - DNA, 20 bp, Homo sapiens
agtgcagtggcgcaatctcg

SEQ ID NO: 1640109 - DNA, 23 bp, Homo sapiens
agtgcagtggcgtgatctcagct

SEQ ID NO: 1640110 - DNA, 15 bp, Homo sapiens
agtgcatgctctctg

SEQ ID NO: 1640111 - DNA, 17 bp, Homo sapiens
agtgcatgctctctgca

SEQ ID NO: 1640112 - DNA, 19 bp, Homo sapiens
agtgcatggtggccagagg

SEQ ID NO: 1640113 - DNA, 15 bp, Homo sapiens
agtgcattttcccag

SEQ ID NO: 1640114 - DNA, 20 bp, Homo sapiens
agtgcattttgtttctgtat

SEQ ID NO: 1640115 - DNA, 22 bp, Homo sapiens
agtgcattttgtttctgtatat

SEQ ID NO: 1640116 - DNA, 13 bp, Homo sapiens
agtgcatttttaa

SEQ ID NO: 1640117 - DNA, 19 bp, Homo sapiens
agtgcatttttaaacttga

SEQ ID NO: 1640118 - DNA, 20 bp, Homo sapiens
agtgcatttttaaacttgaa

SEQ ID NO: 1640119 - DNA, 15 bp, Homo sapiens
agtgccaagtttgtt

SEQ ID NO: 1640120 - DNA, 15 bp, Homo sapiens
agtgccacccgcaga

SEQ ID NO: 1640121 - DNA, 20 bp, Homo sapiens
agtgccacccgcagatgaca

SEQ ID NO: 1640122 - DNA, 18 bp, Homo sapiens
agtgccactgccccccga

SEQ ID NO: 1640123 - DNA, 18 bp, Homo sapiens
agtgccacttaatgtatg

SEQ ID NO: 1640124 - DNA, 18 bp, Homo sapiens
agtgccacttgacattcc

SEQ ID NO: 1640125 - DNA, 20 bp, Homo sapiens
agtgccacttgacattcctt

SEQ ID NO: 1640126 - DNA, 15 bp, Homo sapiens
agtgccagaggtggg

SEQ ID NO: 1640127 - DNA, 16 bp, Homo sapiens
agtgccagaggtgggc

SEQ ID NO: 1640128 - DNA, 19 bp, Homo sapiens
agtgccagaggtgggcagg

SEQ ID NO: 1640129 - DNA, 17 bp, Homo sapiens
agtgccaggaccagcct

SEQ ID NO: 1640130 - DNA, 20 bp, Homo sapiens
agtgccagtcttgtgtctgc

SEQ ID NO: 1640131 - DNA, 13 bp, Homo sapiens
agtgcccaaagtg

SEQ ID NO: 1640132 - DNA, 19 bp, Homo sapiens
agtgcccaaagtggggagg

SEQ ID NO: 1640133 - DNA, 14 bp, Homo sapiens
agtgcccaactgtt

SEQ ID NO: 1640134 - DNA, 15 bp, Homo sapiens
agtgcccaactgtta

SEQ ID NO: 1640135 - DNA, 13 bp, Homo sapiens
agtgcccagcccc

SEQ ID NO: 1640136 - DNA, 15 bp, Homo sapiens
agtgcccagcccctg

SEQ ID NO: 1640137 - DNA, 22 bp, Homo sapiens
agtgcccagcccctgcccctac

SEQ ID NO: 1640138 - DNA, 23 bp, Homo sapiens
agtgcccagcccctgcccctacg

SEQ ID NO: 1640139 - DNA, 20 bp, Homo sapiens
agtgcccagtggagcctgcc

SEQ ID NO: 1640140 - DNA, 12 bp, Homo sapiens
agtgccccagac

SEQ ID NO: 1640141 - DNA, 19 bp, Homo sapiens
gactttatttatttctagt

SEQ ID NO: 1640142 - DNA, 21 bp, Homo sapiens
gactttatttatttctagttc

SEQ ID NO: 1640143 - DNA, 14 bp, Homo sapiens
gactttcccctctc

SEQ ID NO: 1640144 - DNA, 18 bp, Homo sapiens
gactttccttccctctcc

SEQ ID NO: 1640145 - DNA, 22 bp, Homo sapiens
gactttccttccctctcctgct

SEQ ID NO: 1640146 - DNA, 12 bp, Homo sapiens
gactttctgctg

SEQ ID NO: 1640147 - DNA, 13 bp, Homo sapiens
gactttctgtgac

SEQ ID NO: 1640148 - DNA, 11 bp, Homo sapiens
gactttgacaa

SEQ ID NO: 1640149 - DNA, 19 bp, Homo sapiens
agtgcccgcctaggagttg

SEQ ID NO: 1640150 - DNA, 20 bp, Homo sapiens
agtgcccgcctaggagttga

SEQ ID NO: 1640151 - DNA, 23 bp, Homo sapiens
agtgccctggggctgatctcagg

SEQ ID NO: 1640152 - DNA, 17 bp, Homo sapiens
agtgccctttgagatct

SEQ ID NO: 1640153 - DNA, 13 bp, Homo sapiens
agtgccgaggaca

SEQ ID NO: 1640154 - DNA, 14 bp, Homo sapiens
agtgcctaaaataa

SEQ ID NO: 1640155 - DNA, 15 bp, Homo sapiens
agtgcctagactgtt

SEQ ID NO: 1640156 - DNA, 13 bp, Homo sapiens
agtgcctcacctc

SEQ ID NO: 1640157 - DNA, 21 bp, Homo sapiens
agtgcctcacctcgaaaggag

SEQ ID NO: 1640158 - DNA, 17 bp, Homo sapiens
agtgcctcttccagtga

SEQ ID NO: 1640159 - DNA, 13 bp, Homo sapiens
agtgcctcttgtt

SEQ ID NO: 1640160 - DNA, 13 bp, Homo sapiens
agtgcctgccact

SEQ ID NO: 1640161 - DNA, 17 bp, Homo sapiens
agtgcctgccactctct

SEQ ID NO: 1640162 - DNA, 21 bp, Homo sapiens
agtgcctgccactctctggga

SEQ ID NO: 1640163 - DNA, 23 bp, Homo sapiens
agtgcctgccactctctgggact

SEQ ID NO: 1640164 - DNA, 12 bp, Homo sapiens
agtgcctgctga

SEQ ID NO: 1640165 - DNA, 17 bp, Homo sapiens
agtgcctgggaatgtat

SEQ ID NO: 1640166 - DNA, 22 bp, Homo sapiens
agtgcctgggaatgtattattc

SEQ ID NO: 1640167 - DNA, 22 bp, Homo sapiens
agtgcctgtttgggataatgat

SEQ ID NO: 1640168 - DNA, 17 bp, Homo sapiens
agtgccttacctcctgc

SEQ ID NO: 1640169 - DNA, 19 bp, Homo sapiens
agtgccttacctcctgccc

SEQ ID NO: 1640170 - DNA, 23 bp, Homo sapiens
agtgccttacctcctgcccagga

SEQ ID NO: 1640171 - DNA, 20 bp, Homo sapiens
agtgccttcaataaatggta

SEQ ID NO: 1640172 - DNA, 13 bp, Homo sapiens
agtgccttccata

SEQ ID NO: 1640173 - DNA, 13 bp, Homo sapiens
agtgccttcctct

SEQ ID NO: 1640174 - DNA, 20 bp, Homo sapiens
agtgccttctctcagctccc

SEQ ID NO: 1640175 - DNA, 23 bp, Homo sapiens
agtgccttctctcagctcccagg

SEQ ID NO: 1640176 - DNA, 21 bp, Homo sapiens
agtgccttggatgagaagtgt

SEQ ID NO: 1640177 - DNA, 22 bp, Homo sapiens
agtgccttggggaatttcctct

SEQ ID NO: 1640178 - DNA, 18 bp, Homo sapiens
agtgcgatgtttcaggag

SEQ ID NO: 1640179 - DNA, 17 bp, Homo sapiens
agtgcgattctggataa

SEQ ID NO: 1640180 - DNA, 18 bp, Homo sapiens
agtgcgctcttggtccct

SEQ ID NO: 1640181 - DNA, 19 bp, Homo sapiens
agtgcgctcttggtccctg

SEQ ID NO: 1640182 - DNA, 20 bp, Homo sapiens
agtgcgctcttggtccctgg

SEQ ID NO: 1640183 - DNA, 21 bp, Homo sapiens
agtgcgctcttggtccctggt

SEQ ID NO: 1640184 - DNA, 14 bp, Homo sapiens
agtgcggttcctca

SEQ ID NO: 1640185 - DNA, 15 bp, Homo sapiens
agtgcggttcctcat

SEQ ID NO: 1640186 - DNA, 16 bp, Homo sapiens
agtgcggttcctcatc

SEQ ID NO: 1640187 - DNA, 18 bp, Homo sapiens
agtgcggttcctcatctg

SEQ ID NO: 1640188 - DNA, 22 bp, Homo sapiens
agtgcggttcctcatctgagag

SEQ ID NO: 1640189 - DNA, 14 bp, Homo sapiens
agtgcgtggatctg

SEQ ID NO: 1640190 - DNA, 14 bp, Homo sapiens
agtgctacattttg

SEQ ID NO: 1640191 - DNA, 21 bp, Homo sapiens
agtgctataaatgccagagcc

SEQ ID NO: 1640192 - DNA, 22 bp, Homo sapiens
agtgctataaatgccagagcca

SEQ ID NO: 1640193 - DNA, 23 bp, Homo sapiens
agtgctataaatgccagagccaa

SEQ ID NO: 1640194 - DNA, 14 bp, Homo sapiens
agtgctatgcggag

SEQ ID NO: 1640195 - DNA, 21 bp, Homo sapiens
agtgctatgcggaggaaagca

SEQ ID NO: 1640196 - DNA, 22 bp, Homo sapiens
agtgctatgcggaggaaagcaa

SEQ ID NO: 1640197 - DNA, 13 bp, Homo sapiens
agtgctattctgt

SEQ ID NO: 1640198 - DNA, 16 bp, Homo sapiens
agtgctattctgtgtt

SEQ ID NO: 1640199 - DNA, 12 bp, Homo sapiens
agtgctcagctg

SEQ ID NO: 1640200 - DNA, 15 bp, Homo sapiens
agtgctcagctgtgg

SEQ ID NO: 1640201 - DNA, 22 bp, Homo sapiens
agtgctcagctgtggctggagg

SEQ ID NO: 1640202 - DNA, 23 bp, Homo sapiens
agtgctcagctgtggctggagga

SEQ ID NO: 1640203 - DNA, 17 bp, Homo sapiens
agtgctctaggctgccc

SEQ ID NO: 1640204 - DNA, 18 bp, Homo sapiens
agtgctctaggctgcccc

SEQ ID NO: 1640205 - DNA, 16 bp, Homo sapiens
agtgctctcagctggc

SEQ ID NO: 1640206 - DNA, 18 bp, Homo sapiens
agtgctctttgtggcagt

SEQ ID NO: 1640207 - DNA, 19 bp, Homo sapiens
agtgctctttgtggcagtg

SEQ ID NO: 1640208 - DNA, 22 bp, Homo sapiens
agtgctctttgtggcagtggcc

SEQ ID NO: 1640209 - DNA, 21 bp, Homo sapiens
agtgctgagattacaggcatg

SEQ ID NO: 1640210 - DNA, 21 bp, Homo sapiens
agtgctgaggccagggctgat

SEQ ID NO: 1640211 - DNA, 21 bp, Homo sapiens
agtgctgccatgccactgcca

SEQ ID NO: 1640212 - DNA, 22 bp, Homo sapiens
agtgctgccatgccactgccag

SEQ ID NO: 1640213 - DNA, 23 bp, Homo sapiens
agtgctgccatgccactgccagg

SEQ ID NO: 1640214 - DNA, 24 bp, Homo sapiens
agtgctgccatgccactgccaggc

SEQ ID NO: 1640215 - DNA, 15 bp, Homo sapiens
agtgctgctgaagat

SEQ ID NO: 1640216 - DNA, 13 bp, Homo sapiens
agtgctggaaggg

SEQ ID NO: 1640217 - DNA, 12 bp, Homo sapiens
agtgctggattt

SEQ ID NO: 1640218 - DNA, 17 bp, Homo sapiens
agtgctggcccacccag

SEQ ID NO: 1640219 - DNA, 17 bp, Homo sapiens
agtgctgggaccagagc

SEQ ID NO: 1640220 - DNA, 20 bp, Homo sapiens
agtgctgggatgacaggcat

SEQ ID NO: 1640221 - DNA, 19 bp, Homo sapiens
agtgctgggattacaggct

SEQ ID NO: 1640222 - DNA, 19 bp, Homo sapiens
agtgctggtcagagagacc

SEQ ID NO: 1640223 - DNA, 13 bp, Homo sapiens
agtgctgtaatat

SEQ ID NO: 1640224 - DNA, 21 bp, Homo sapiens
agtgctgtacccttccacctc

SEQ ID NO: 1640225 - DNA, 20 bp, Homo sapiens
agtgctgtggcctgggcaag

SEQ ID NO: 1640226 - DNA, 16 bp, Homo sapiens
agtgcttcagcctgag

SEQ ID NO: 1640227 - DNA, 20 bp, Homo sapiens
agtgcttcagcctgaggctg

SEQ ID NO: 1640228 - DNA, 14 bp, Homo sapiens
agtgcttcttacta

SEQ ID NO: 1640229 - DNA, 19 bp, Homo sapiens
agtgcttgtcccctaagag

SEQ ID NO: 1640230 - DNA, 14 bp, Homo sapiens
agtgcttgtttact

SEQ ID NO: 1640231 - DNA, 23 bp, Homo sapiens
agtgctttacatgctgtgctctt

SEQ ID NO: 1640232 - DNA, 16 bp, Homo sapiens
agtggaacagcgggag

SEQ ID NO: 1640233 - DNA, 13 bp, Homo sapiens
agtggaagagcag

SEQ ID NO: 1640234 - DNA, 15 bp, Homo sapiens
agtggaagagcagcc

SEQ ID NO: 1640235 - DNA, 19 bp, Homo sapiens
agtggaagagcagcctgat

SEQ ID NO: 1640236 - DNA, 22 bp, Homo sapiens
agtggaagagcagcctgatggc

SEQ ID NO: 1640237 - DNA, 23 bp, Homo sapiens
agtggaagagcagcctgatggcc

SEQ ID NO: 1640238 - DNA, 21 bp, Homo sapiens
agtggaagtgcttgatatgta

SEQ ID NO: 1640239 - DNA, 20 bp, Homo sapiens
agtggacaccaggagtccct

SEQ ID NO: 1640240 - DNA, 17 bp, Homo sapiens
agtggaccttaggcctt

SEQ ID NO: 1640241 - DNA, 17 bp, Homo sapiens
agtggactcagcagtga

SEQ ID NO: 1640242 - DNA, 18 bp, Homo sapiens
agtggactgaatgtgcct

SEQ ID NO: 1640243 - DNA, 21 bp, Homo sapiens
agtggagacagtcctttccca

SEQ ID NO: 1640244 - DNA, 12 bp, Homo sapiens
agtggagaggga

SEQ ID NO: 1640245 - DNA, 16 bp, Homo sapiens
agtggagcagccagca

SEQ ID NO: 1640246 - DNA, 16 bp, Homo sapiens
agtggagcctgccgcc

SEQ ID NO: 1640247 - DNA, 10 bp, Homo sapiens
agtggaggaa

SEQ ID NO: 1640248 - DNA, 18 bp, Homo sapiens
agtggaggaaatgttgga

SEQ ID NO: 1640249 - DNA, 13 bp, Homo sapiens
agtggaggaggag

SEQ ID NO: 1640250 - DNA, 11 bp, Homo sapiens
agtggaggcat

SEQ ID NO: 1640251 - DNA, 16 bp, Homo sapiens
agtggaggcattgttt

SEQ ID NO: 1640252 - DNA, 16 bp, Homo sapiens
agtggaggctgctgtg

SEQ ID NO: 1640253 - DNA, 19 bp, Homo sapiens
agtggaggtgggctgggcc

SEQ ID NO: 1640254 - DNA, 23 bp, Homo sapiens
agtggaggtgggctgggccctct

SEQ ID NO: 1640255 - DNA, 14 bp, Homo sapiens
agtggaggtttgtc

SEQ ID NO: 1640256 - DNA, 20 bp, Homo sapiens
agtggagttgaaactgctat

SEQ ID NO: 1640257 - DNA, 17 bp, Homo sapiens
agtggagttgactctgg

SEQ ID NO: 1640258 - DNA, 20 bp, Homo sapiens
agtggatgatgtttcgtgaa

SEQ ID NO: 1640259 - DNA, 18 bp, Homo sapiens
gagaattaagttttaaat

SEQ ID NO: 1640260 - DNA, 22 bp, Homo sapiens
gagaattaagttttaaataaac

SEQ ID NO: 1640261 - DNA, 23 bp, Homo sapiens
gagaattaagttttaaataaacc

SEQ ID NO: 1640262 - DNA, 13 bp, Homo sapiens
gagaattgaaact

SEQ ID NO: 1640263 - DNA, 12 bp, Homo sapiens
agtggatgtata

SEQ ID NO: 1640264 - DNA, 14 bp, Homo sapiens
agtggattgcattt

SEQ ID NO: 1640265 - DNA, 17 bp, Homo sapiens
agtggattggctttgtg

SEQ ID NO: 1640266 - DNA, 16 bp, Homo sapiens
agtggcagacaaacag

SEQ ID NO: 1640267 - DNA, 16 bp, Homo sapiens
agtggcagccatgcct

SEQ ID NO: 1640268 - DNA, 14 bp, Homo sapiens
agtggcaggggagc

SEQ ID NO: 1640269 - DNA, 20 bp, Homo sapiens
agtggcagtgaaaaatatgt

SEQ ID NO: 1640270 - DNA, 15 bp, Homo sapiens
agtggcatcatctca

SEQ ID NO: 1640271 - DNA, 18 bp, Homo sapiens
agtggcatttgtcaggga

SEQ ID NO: 1640272 - DNA, 18 bp, Homo sapiens
agtggccaagaagcagtg

SEQ ID NO: 1640273 - DNA, 17 bp, Homo sapiens
agtggccaggcagggag

SEQ ID NO: 1640274 - DNA, 17 bp, Homo sapiens
agtggccatcatttctg

SEQ ID NO: 1640275 - DNA, 18 bp, Homo sapiens
agtggccccacctgtgtc

SEQ ID NO: 1640276 - DNA, 16 bp, Homo sapiens
agtggcccccacagaa

SEQ ID NO: 1640277 - DNA, 16 bp, Homo sapiens
agtggccccctcctcc

SEQ ID NO: 1640278 - DNA, 20 bp, Homo sapiens
agtggccggttgccactctc

SEQ ID NO: 1640279 - DNA, 15 bp, Homo sapiens
agtggcctccctgct

SEQ ID NO: 1640280 - DNA, 21 bp, Homo sapiens
agtggcggcacgtccttgggc

SEQ ID NO: 1640281 - DNA, 14 bp, Homo sapiens
agtggctagtcctc

SEQ ID NO: 1640282 - DNA, 14 bp, Homo sapiens
agtggctcacgcct

SEQ ID NO: 1640283 - DNA, 17 bp, Homo sapiens
agtggctcacgcctgta

SEQ ID NO: 1640284 - DNA, 17 bp, Homo sapiens
agtggctcctcccggtg

SEQ ID NO: 1640285 - DNA, 21 bp, Homo sapiens
agtggctcgtatcccaaatct

SEQ ID NO: 1640286 - DNA, 15 bp, Homo sapiens
agtggctgccggagg

SEQ ID NO: 1640287 - DNA, 14 bp, Homo sapiens
agtggctgctgact

SEQ ID NO: 1640288 - DNA, 16 bp, Homo sapiens
agtggctggaagaacc

SEQ ID NO: 1640289 - DNA, 15 bp, Homo sapiens
agtggctggtccagg

SEQ ID NO: 1640290 - DNA, 13 bp, Homo sapiens
agtggctgtctta

SEQ ID NO: 1640291 - DNA, 18 bp, Homo sapiens
agtgggaactctgacaag

SEQ ID NO: 1640292 - DNA, 21 bp, Homo sapiens
agtgggaagcccatcctgacc

SEQ ID NO: 1640293 - DNA, 22 bp, Homo sapiens
agtgggaagcccatcctgacca

SEQ ID NO: 1640294 - DNA, 15 bp, Homo sapiens
agtgggacagcccag

SEQ ID NO: 1640295 - DNA, 22 bp, Homo sapiens
agtgggacagcccagagcctgg

SEQ ID NO: 1640296 - DNA, 15 bp, Homo sapiens
agtgggagctgagct

SEQ ID NO: 1640297 - DNA, 17 bp, Homo sapiens
agtgggagctgagctgg

SEQ ID NO: 1640298 - DNA, 16 bp, Homo sapiens
agtgggaggcgtgccc

SEQ ID NO: 1640299 - DNA, 12 bp, Homo sapiens
agtgggaggggc

SEQ ID NO: 1640300 - DNA, 12 bp, Homo sapiens
agtgggaggtca

SEQ ID NO: 1640301 - DNA, 22 bp, Homo sapiens
agtgggatttggggcctcaaga

SEQ ID NO: 1640302 - DNA, 23 bp, Homo sapiens
agtgggcaggaggccccaggctg

SEQ ID NO: 1640303 - DNA, 17 bp, Homo sapiens
agtgggcaggtggccac

SEQ ID NO: 1640304 - DNA, 18 bp, Homo sapiens
agtgggccccgggctgga

SEQ ID NO: 1640305 - DNA, 20 bp, Homo sapiens
agtgggcccggagaaacctg

SEQ ID NO: 1640306 - DNA, 14 bp, Homo sapiens
agtgggcctgtgtg

SEQ ID NO: 1640307 - DNA, 17 bp, Homo sapiens
agtgggcctgtgtgtgt

SEQ ID NO: 1640308 - DNA, 12 bp, Homo sapiens
agtgggcgcagt

SEQ ID NO: 1640309 - DNA, 15 bp, Homo sapiens
agtgggcgttgggag

SEQ ID NO: 1640310 - DNA, 18 bp, Homo sapiens
agtgggcgttgggagcct

SEQ ID NO: 1640311 - DNA, 18 bp, Homo sapiens
agtgggctgggccctctg

SEQ ID NO: 1640312 - DNA, 19 bp, Homo sapiens
agtggggaaggaggccaag

SEQ ID NO: 1640313 - DNA, 18 bp, Homo sapiens
agtggggacgggggctgc

SEQ ID NO: 1640314 - DNA, 23 bp, Homo sapiens
agtggggacgggggctgcttctc

SEQ ID NO: 1640315 - DNA, 21 bp, Homo sapiens
agtggggatgaggtcaccagg

SEQ ID NO: 1640316 - DNA, 13 bp, Homo sapiens
agtggggcctgcc

SEQ ID NO: 1640317 - DNA, 14 bp, Homo sapiens
agtggggcctggga

SEQ ID NO: 1640318 - DNA, 15 bp, Homo sapiens
agtggggcctgggag

SEQ ID NO: 1640319 - DNA, 15 bp, Homo sapiens
agtggggctggcatc

SEQ ID NO: 1640320 - DNA, 18 bp, Homo sapiens
agtggggggtcgtgggcc

SEQ ID NO: 1640321 - DNA, 23 bp, Homo sapiens
agtggggtctccctctcctgcct

SEQ ID NO: 1640322 - DNA, 19 bp, Homo sapiens
agtggggttatctctgtgt

SEQ ID NO: 1640323 - DNA, 15 bp, Homo sapiens
agtgggtacatcaag

SEQ ID NO: 1640324 - DNA, 14 bp, Homo sapiens
agtgggtcccagat

SEQ ID NO: 1640325 - DNA, 14 bp, Homo sapiens
agtgggtggcacct

SEQ ID NO: 1640326 - DNA, 23 bp, Homo sapiens
agtgggttttttagttgaatttt

SEQ ID NO: 1640327 - DNA, 18 bp, Homo sapiens
agtggtacaatctggctc

SEQ ID NO: 1640328 - DNA, 14 bp, Homo sapiens
agtggtatgtctct

SEQ ID NO: 1640329 - DNA, 15 bp, Homo sapiens
agtggtatgtctctt

SEQ ID NO: 1640330 - DNA, 12 bp, Homo sapiens
agtggtcaagga

SEQ ID NO: 1640331 - DNA, 17 bp, Homo sapiens
agtggtcatgctcagcc

SEQ ID NO: 1640332 - DNA, 18 bp, Homo sapiens
agtggtcatgctcagcct

SEQ ID NO: 1640333 - DNA, 15 bp, Homo sapiens
agtggtccagaaaca

SEQ ID NO: 1640334 - DNA, 13 bp, Homo sapiens
agtggtccagcgt

SEQ ID NO: 1640335 - DNA, 21 bp, Homo sapiens
agtggtccagcgtcactccag

SEQ ID NO: 1640336 - DNA, 22 bp, Homo sapiens
agtggtcgcttactttgagtga

SEQ ID NO: 1640337 - DNA, 13 bp, Homo sapiens
agtggtctcccca

SEQ ID NO: 1640338 - DNA, 15 bp, Homo sapiens
agtggtctctgctgg

SEQ ID NO: 1640339 - DNA, 13 bp, Homo sapiens
agtggtgccctgg

SEQ ID NO: 1640340 - DNA, 22 bp, Homo sapiens
agtggtgcgtttataattggct

SEQ ID NO: 1640341 - DNA, 20 bp, Homo sapiens
agtggtgggtaattgtacaa

SEQ ID NO: 1640342 - DNA, 19 bp, Homo sapiens
agtggtgtgactcttactc

SEQ ID NO: 1640343 - DNA, 13 bp, Homo sapiens
agtggttctcatt

SEQ ID NO: 1640344 - DNA, 15 bp, Homo sapiens
agtggttgcctgggg

SEQ ID NO: 1640345 - DNA, 19 bp, Homo sapiens
agtggttgttagttataga

SEQ ID NO: 1640346 - DNA, 14 bp, Homo sapiens
agtggttgttgcca

SEQ ID NO: 1640347 - DNA, 17 bp, Homo sapiens
agtggtttgcaggtcag

SEQ ID NO: 1640348 - DNA, 16 bp, Homo sapiens
agtgtaaaattgttaa

SEQ ID NO: 1640349 - DNA, 21 bp, Homo sapiens
agtgtaaatcctttttcttta

SEQ ID NO: 1640350 - DNA, 18 bp, Homo sapiens
agtgtaacaattgtgtag

SEQ ID NO: 1640351 - DNA, 22 bp, Homo sapiens
agtgtaacaattgtgtagcctt

SEQ ID NO: 1640352 - DNA, 14 bp, Homo sapiens
agtgtaacactgca

SEQ ID NO: 1640353 - DNA, 18 bp, Homo sapiens
agtgtaacagatatcagt

SEQ ID NO: 1640354 - DNA, 13 bp, Homo sapiens
agtgtaacagctg

SEQ ID NO: 1640355 - DNA, 17 bp, Homo sapiens
agtgtaacagctgaggt

SEQ ID NO: 1640356 - DNA, 16 bp, Homo sapiens
agtgtaagaactgtac

SEQ ID NO: 1640357 - DNA, 13 bp, Homo sapiens
agtgtaagtgtga

SEQ ID NO: 1640358 - DNA, 15 bp, Homo sapiens
agtgtacacagactg

SEQ ID NO: 1640359 - DNA, 13 bp, Homo sapiens
agtgtacatcatg

SEQ ID NO: 1640360 - DNA, 17 bp, Homo sapiens
agtgtacatcatgttat

SEQ ID NO: 1640361 - DNA, 12 bp, Homo sapiens
agtgtacatgta

SEQ ID NO: 1640362 - DNA, 15 bp, Homo sapiens
agtgtacatgtacat

SEQ ID NO: 1640363 - DNA, 20 bp, Homo sapiens
agtgtacatttctataaata

SEQ ID NO: 1640364 - DNA, 21 bp, Homo sapiens
agtgtacctcctctcagtgtt

SEQ ID NO: 1640365 - DNA, 17 bp, Homo sapiens
agtgtacttaactattc

SEQ ID NO: 1640366 - DNA, 23 bp, Homo sapiens
agtgtagcctaaagggcagggcc

SEQ ID NO: 1640367 - DNA, 15 bp, Homo sapiens
agtgtagccttgccc

SEQ ID NO: 1640368 - DNA, 21 bp, Homo sapiens
agtgtagctgtaagggcagtg

SEQ ID NO: 1640369 - DNA, 15 bp, Homo sapiens
agtgtagctgtgaaa

SEQ ID NO: 1640370 - DNA, 17 bp, Homo sapiens
agtgtagctgtgaaatc

SEQ ID NO: 1640371 - DNA, 23 bp, Homo sapiens
agtgtagctgtgtggctttcctt

SEQ ID NO: 1640372 - DNA, 17 bp, Homo sapiens
agtgtagtttacagaaa

SEQ ID NO: 1640373 - DNA, 15 bp, Homo sapiens
agtgtataataagaa

SEQ ID NO: 1640374 - DNA, 16 bp, Homo sapiens
agtgtataatataaaa

SEQ ID NO: 1640375 - DNA, 16 bp, Homo sapiens
agtgtatatttattca

SEQ ID NO: 1640376 - DNA, 15 bp, Homo sapiens
agtgtatgattactg

SEQ ID NO: 1640377 - DNA, 14 bp, Homo sapiens
agtgtatggggcag

SEQ ID NO: 1640378 - DNA, 16 bp, Homo sapiens
agtgtatggggcagct

SEQ ID NO: 1640379 - DNA, 19 bp, Homo sapiens
gaaaggctctgaaagccag

SEQ ID NO: 1640380 - DNA, 15 bp, Homo sapiens
gaaaggcttggctgg

SEQ ID NO: 1640381 - DNA, 19 bp, Homo sapiens
gaaaggcttggctggtgta

SEQ ID NO: 1640382 - DNA, 10 bp, Homo sapiens
gaaagggaaa

SEQ ID NO: 1640383 - DNA, 15 bp, Homo sapiens
gaaagggaactagat

SEQ ID NO: 1640384 - DNA, 22 bp, Homo sapiens
gaaagggagcccctcctctgag

SEQ ID NO: 1640385 - DNA, 15 bp, Homo sapiens
gaaagggagggagga

SEQ ID NO: 1640386 - DNA, 21 bp, Homo sapiens
gaaagggatggtaagttgaga

SEQ ID NO: 1640387 - DNA, 19 bp, Homo sapiens
gaaagggattgctgaggca

SEQ ID NO: 1640388 - DNA, 13 bp, Homo sapiens
gaaagggcctggc

SEQ ID NO: 1640389 - DNA, 16 bp, Homo sapiens
gaaagggcctggccag

SEQ ID NO: 1640390 - DNA, 22 bp, Homo sapiens
gaaagggcctggccagtcctgg

SEQ ID NO: 1640391 - DNA, 18 bp, Homo sapiens
gaaagggctatggcaagg

SEQ ID NO: 1640392 - DNA, 21 bp, Homo sapiens
gaaaggggagagcctgctggc

SEQ ID NO: 1640393 - DNA, 15 bp, Homo sapiens
gaaaggggagcccac

SEQ ID NO: 1640394 - DNA, 21 bp, Homo sapiens
gaaagggggggaaaaaagcaa

SEQ ID NO: 1640395 - DNA, 18 bp, Homo sapiens
gaaaggtctctggaggga

SEQ ID NO: 1640396 - DNA, 22 bp, Homo sapiens
gaaaggtgagtttgagctgcct

SEQ ID NO: 1640397 - DNA, 22 bp, Homo sapiens
gaaaggttaaaaaagcgaggtg

SEQ ID NO: 1640398 - DNA, 20 bp, Homo sapiens
gaaaggttagagaataaatt

SEQ ID NO: 1640399 - DNA, 16 bp, Homo sapiens
gaaaggtttacattgt

SEQ ID NO: 1640400 - DNA, 14 bp, Homo sapiens
gaaagtagctgcta

SEQ ID NO: 1640401 - DNA, 17 bp, Homo sapiens
gaaagtcaaaaaattat

SEQ ID NO: 1640402 - DNA, 17 bp, Homo sapiens
gaaagtcagatgcccag

SEQ ID NO: 1640403 - DNA, 14 bp, Homo sapiens
gaaagtctatgctt

SEQ ID NO: 1640404 - DNA, 19 bp, Homo sapiens
gaaagtgaagcaaatcaga

SEQ ID NO: 1640405 - DNA, 16 bp, Homo sapiens
gaaagtgacagagacc

SEQ ID NO: 1640406 - DNA, 16 bp, Homo sapiens
gaaagtgccagaaagt

SEQ ID NO: 1640407 - DNA, 17 bp, Homo sapiens
gaaagttaacattaatg

SEQ ID NO: 1640408 - DNA, 14 bp, Homo sapiens
gaaagttagagatt

SEQ ID NO: 1640409 - DNA, 23 bp, Homo sapiens
gaaagttattgataagttcatac

SEQ ID NO: 1640410 - DNA, 13 bp, Homo sapiens
gaaagttctggaa

SEQ ID NO: 1640411 - DNA, 20 bp, Homo sapiens
gaaagttgacatgggtgggg

SEQ ID NO: 1640412 - DNA, 16 bp, Homo sapiens
aggccgtcctcccggg

SEQ ID NO: 1640413 - DNA, 17 bp, Homo sapiens
aggccgtcctcccgggc

SEQ ID NO: 1640414 - DNA, 21 bp, Homo sapiens
aggccgtcctcccgggccctc

SEQ ID NO: 1640415 - DNA, 18 bp, Homo sapiens
aggccgttccccttggct

SEQ ID NO: 1640416 - DNA, 23 bp, Homo sapiens
aggccgttccccttggcttcctc

SEQ ID NO: 1640417 - DNA, 16 bp, Homo sapiens
aggcctaccccgcaga

SEQ ID NO: 1640418 - DNA, 22 bp, Homo sapiens
aggcctaccccgcagacacctt

SEQ ID NO: 1640419 - DNA, 16 bp, Homo sapiens
aggcctagactctgtc

SEQ ID NO: 1640420 - DNA, 21 bp, Homo sapiens
aggcctagactctgtctacct

SEQ ID NO: 1640421 - DNA, 21 bp, Homo sapiens
aggcctataaaattaaatgcc

SEQ ID NO: 1640422 - DNA, 15 bp, Homo sapiens
aggcctatctggaag

SEQ ID NO: 1640423 - DNA, 13 bp, Homo sapiens
aggcctcaagaac

SEQ ID NO: 1640424 - DNA, 15 bp, Homo sapiens
aggcctcaggtgctg

SEQ ID NO: 1640425 - DNA, 19 bp, Homo sapiens
aggcctcaggtgctgtcca

SEQ ID NO: 1640426 - DNA, 21 bp, Homo sapiens
aggcctcaggtgctgtccatg

SEQ ID NO: 1640427 - DNA, 13 bp, Homo sapiens
aggcctcatccct

SEQ ID NO: 1640428 - DNA, 19 bp, Homo sapiens
aggcctccaacgcccctgt

SEQ ID NO: 1640429 - DNA, 23 bp, Homo sapiens
aggcctccaacgcccctgtggcc

SEQ ID NO: 1640430 - DNA, 11 bp, Homo sapiens
aggcctccagc

SEQ ID NO: 1640431 - DNA, 22 bp, Homo sapiens
aggcctccctctctcttctgct

SEQ ID NO: 1640432 - DNA, 21 bp, Homo sapiens
aggcctctcattccagaggaa

SEQ ID NO: 1640433 - DNA, 23 bp, Homo sapiens
aggcctctccagtttgcacctgt

SEQ ID NO: 1640434 - DNA, 14 bp, Homo sapiens
aggcctctgcagaa

SEQ ID NO: 1640435 - DNA, 13 bp, Homo sapiens
aggcctctgcctg

SEQ ID NO: 1640436 - DNA, 14 bp, Homo sapiens
aggcctctgcctgc

SEQ ID NO: 1640437 - DNA, 21 bp, Homo sapiens
aggcctctgcctgctggggat

SEQ ID NO: 1640438 - DNA, 22 bp, Homo sapiens
aggcctctgcctgctggggatt

SEQ ID NO: 1640439 - DNA, 21 bp, Homo sapiens
aggcctcttgtgctcacgctc

SEQ ID NO: 1640440 - DNA, 21 bp, Homo sapiens
aggcctgaagccagctgccct

SEQ ID NO: 1640441 - DNA, 19 bp, Homo sapiens
aggcctgaatcatgagcct

SEQ ID NO: 1640442 - DNA, 15 bp, Homo sapiens
aggcctgaccagggg

SEQ ID NO: 1640443 - DNA, 15 bp, Homo sapiens
aggcctgacctcaag

SEQ ID NO: 1640444 - DNA, 21 bp, Homo sapiens
aggcctgacctcaagcaacca

SEQ ID NO: 1640445 - DNA, 16 bp, Homo sapiens
aggcctgactactgcc

SEQ ID NO: 1640446 - DNA, 18 bp, Homo sapiens
aggcctgactactgccca

SEQ ID NO: 1640447 - DNA, 14 bp, Homo sapiens
aggcctgagaatga

SEQ ID NO: 1640448 - DNA, 21 bp, Homo sapiens
aggcctgagatttcatctgct

SEQ ID NO: 1640449 - DNA, 18 bp, Homo sapiens
aggcctgagcgctcctgc

SEQ ID NO: 1640450 - DNA, 21 bp, Homo sapiens
aggcctgagcgctcctgccgc

SEQ ID NO: 1640451 - DNA, 18 bp, Homo sapiens
aggcctgatcttgcctgt

SEQ ID NO: 1640452 - DNA, 23 bp, Homo sapiens
aggcctgatcttgcctgtctggc

SEQ ID NO: 1640453 - DNA, 17 bp, Homo sapiens
aggcctgatgctgcccc

SEQ ID NO: 1640454 - DNA, 17 bp, Homo sapiens
aggcctgcaggggcaag

SEQ ID NO: 1640455 - DNA, 22 bp, Homo sapiens
aggcctgcctcccacttcactg

SEQ ID NO: 1640456 - DNA, 14 bp, Homo sapiens
aggcctgcctgcat

SEQ ID NO: 1640457 - DNA, 19 bp, Homo sapiens
aggcctgcgaccctggggg

SEQ ID NO: 1640458 - DNA, 12 bp, Homo sapiens
aggcctgctccc

SEQ ID NO: 1640459 - DNA, 22 bp, Homo sapiens
aggcctgctgccagtgcagcca

SEQ ID NO: 1640460 - DNA, 14 bp, Homo sapiens
aggcctggaaccag

SEQ ID NO: 1640461 - DNA, 17 bp, Homo sapiens
aggcctggaaccaggga

SEQ ID NO: 1640462 - DNA, 18 bp, Homo sapiens
aggcctggaaccagggag

SEQ ID NO: 1640463 - DNA, 22 bp, Homo sapiens
aggcctggaaccagggaggaga

SEQ ID NO: 1640464 - DNA, 22 bp, Homo sapiens
aggcctggactttcctgcaact

SEQ ID NO: 1640465 - DNA, 15 bp, Homo sapiens
aggcctggagcccac

SEQ ID NO: 1640466 - DNA, 21 bp, Homo sapiens
aggcctggcatggcacctgtc

SEQ ID NO: 1640467 - DNA, 17 bp, Homo sapiens
aggcctggcctctgggc

SEQ ID NO: 1640468 - DNA, 21 bp, Homo sapiens
aggcctggcctctgggcagtg

SEQ ID NO: 1640469 - DNA, 16 bp, Homo sapiens
aggcctgggacccagc

SEQ ID NO: 1640470 - DNA, 18 bp, Homo sapiens
aggcctgggacccagcta

SEQ ID NO: 1640471 - DNA, 19 bp, Homo sapiens
aggcctgggccgctgccac

SEQ ID NO: 1640472 - DNA, 22 bp, Homo sapiens
aggcctgggggacccctggctc

SEQ ID NO: 1640473 - DNA, 17 bp, Homo sapiens
aggcctggtgtttcttg

SEQ ID NO: 1640474 - DNA, 23 bp, Homo sapiens
aggcctgtgctgcatgcgacagc

SEQ ID NO: 1640475 - DNA, 17 bp, Homo sapiens
aggcctgtggggagccg

SEQ ID NO: 1640476 - DNA, 20 bp, Homo sapiens
aggcctgttgctatagagcc

SEQ ID NO: 1640477 - DNA, 19 bp, Homo sapiens
aggccttaacacactggcc

SEQ ID NO: 1640478 - DNA, 18 bp, Homo sapiens
aggccttatcattcattc

SEQ ID NO: 1640479 - DNA, 18 bp, Homo sapiens
aggccttcagacacatgc

SEQ ID NO: 1640480 - DNA, 20 bp, Homo sapiens
aggccttcagtttatttcca

SEQ ID NO: 1640481 - DNA, 17 bp, Homo sapiens
aggccttcatcctcctc

SEQ ID NO: 1640482 - DNA, 22 bp, Homo sapiens
aggccttcatcctcctccccag

SEQ ID NO: 1640483 - DNA, 16 bp, Homo sapiens
aggccttccagctgct

SEQ ID NO: 1640484 - DNA, 17 bp, Homo sapiens
aggccttccagctgctg

SEQ ID NO: 1640485 - DNA, 15 bp, Homo sapiens
aggccttccctggcc

SEQ ID NO: 1640486 - DNA, 18 bp, Homo sapiens
aggccttcctctctccag

SEQ ID NO: 1640487 - DNA, 16 bp, Homo sapiens
aggccttgcctggcct

SEQ ID NO: 1640488 - DNA, 18 bp, Homo sapiens
aggccttggtggagcagc

SEQ ID NO: 1640489 - DNA, 21 bp, Homo sapiens
aggccttggtggagcagccag

SEQ ID NO: 1640490 - DNA, 23 bp, Homo sapiens
aggccttggtggagcagccagag

SEQ ID NO: 1640491 - DNA, 21 bp, Homo sapiens
aggccttgtgtgtcaggccct

SEQ ID NO: 1640492 - DNA, 14 bp, Homo sapiens
gaaatgtgtttctg

SEQ ID NO: 1640493 - DNA, 19 bp, Homo sapiens
gaaattaagatgttgtctt

SEQ ID NO: 1640494 - DNA, 18 bp, Homo sapiens
gaaattaagcattttgaa

SEQ ID NO: 1640495 - DNA, 17 bp, Homo sapiens
gaaattacacccaaaga

SEQ ID NO: 1640496 - DNA, 18 bp, Homo sapiens
gaaattacctgtggatat

SEQ ID NO: 1640497 - DNA, 18 bp, Homo sapiens
gaaattactacaaaattt

SEQ ID NO: 1640498 - DNA, 21 bp, Homo sapiens
gaaattcaaagcataaaactt

SEQ ID NO: 1640499 - DNA, 15 bp, Homo sapiens
gaaattcatttgtgg

SEQ ID NO: 1640500 - DNA, 19 bp, Homo sapiens
gaaattcgctgaaatactt

SEQ ID NO: 1640501 - DNA, 15 bp, Homo sapiens
gaaattctgaaaact

SEQ ID NO: 1640502 - DNA, 19 bp, Homo sapiens
gaaattctggcccagccaa

SEQ ID NO: 1640503 - DNA, 13 bp, Homo sapiens
gaaattctgtttt

SEQ ID NO: 1640504 - DNA, 21 bp, Homo sapiens
gaaattgacacaagtggacct

SEQ ID NO: 1640505 - DNA, 17 bp, Homo sapiens
gaaattgagctgctttt

SEQ ID NO: 1640506 - DNA, 13 bp, Homo sapiens
gaaattgcatact

SEQ ID NO: 1640507 - DNA, 17 bp, Homo sapiens
gaaattggaacagaatg

SEQ ID NO: 1640508 - DNA, 22 bp, Homo sapiens
gaaattgtttaagtgttgtaaa

SEQ ID NO: 1640509 - DNA, 16 bp, Homo sapiens
gaaattgtttatgtgt

SEQ ID NO: 1640510 - DNA, 20 bp, Homo sapiens
gaaatttacagttactgcct

SEQ ID NO: 1640511 - DNA, 16 bp, Homo sapiens
gaaatttattcacata

SEQ ID NO: 1640512 - DNA, 23 bp, Homo sapiens
gaaatttcagattcccagagcaa

SEQ ID NO: 1640513 - DNA, 11 bp, Homo sapiens
gaaatttgaat

SEQ ID NO: 1640514 - DNA, 20 bp, Homo sapiens
gaaatttggcattgatctta

SEQ ID NO: 1640515 - DNA, 22 bp, Homo sapiens
gaaattttatatgcttactgat

SEQ ID NO: 1640516 - DNA, 19 bp, Homo sapiens
gaaatttttattaaattat

SEQ ID NO: 1640517 - DNA, 22 bp, Homo sapiens
gaaatttttcagatgcttctgg

SEQ ID NO: 1640518 - DNA, 22 bp, Homo sapiens
gaacaaaggacagagtatgaac

SEQ ID NO: 1640519 - DNA, 21 bp, Homo sapiens
gaacaaatgtgtttttctata

SEQ ID NO: 1640520 - DNA, 20 bp, Homo sapiens
gaacaaattctttagtactc

SEQ ID NO: 1640521 - DNA, 22 bp, Homo sapiens
gaacaaattctttagtactcaa

SEQ ID NO: 1640522 - DNA, 15 bp, Homo sapiens
gaacaacatgttcta

SEQ ID NO: 1640523 - DNA, 16 bp, Homo sapiens
gaacaacatgttctac

SEQ ID NO: 1640524 - DNA, 19 bp, Homo sapiens
gaacaactaggcttcagca

SEQ ID NO: 1640525 - DNA, 16 bp, Homo sapiens
gaacaagacagccttc

SEQ ID NO: 1640526 - DNA, 15 bp, Homo sapiens
gaacaagatttccct

SEQ ID NO: 1640527 - DNA, 23 bp, Homo sapiens
gaacaagcatgtctctctgccaa

SEQ ID NO: 1640528 - DNA, 20 bp, Homo sapiens
gccttaaacactcaccttct

SEQ ID NO: 1640529 - DNA, 16 bp, Homo sapiens
gccttaacacactggc

SEQ ID NO: 1640530 - DNA, 14 bp, Homo sapiens
gccttaagcagaac

SEQ ID NO: 1640531 - DNA, 20 bp, Homo sapiens
gccttaagcagaacaaatgt

SEQ ID NO: 1640532 - DNA, 16 bp, Homo sapiens
gccttaataaatatgt

SEQ ID NO: 1640533 - DNA, 21 bp, Homo sapiens
gccttaatttcctttttgaca

SEQ ID NO: 1640534 - DNA, 23 bp, Homo sapiens
gccttaatttcctttttgacact

SEQ ID NO: 1640535 - DNA, 13 bp, Homo sapiens
gccttacctcctg

SEQ ID NO: 1640536 - DNA, 17 bp, Homo sapiens
gccttacctcctgccca

SEQ ID NO: 1640537 - DNA, 17 bp, Homo sapiens
gccttagaacctttctt

SEQ ID NO: 1640538 - DNA, 15 bp, Homo sapiens
gccttagggaagctg

SEQ ID NO: 1640539 - DNA, 19 bp, Homo sapiens
gccttagggcactgggctg

SEQ ID NO: 1640540 - DNA, 22 bp, Homo sapiens
gccttatcttgcaccccaaagc

SEQ ID NO: 1640541 - DNA, 16 bp, Homo sapiens
gccttatgggctgaag

SEQ ID NO: 1640542 - DNA, 23 bp, Homo sapiens
gccttattcacctttttaataaa

SEQ ID NO: 1640543 - DNA, 22 bp, Homo sapiens
gccttatttgtctgtaaaaaat

SEQ ID NO: 1640544 - DNA, 19 bp, Homo sapiens
gccttcaaaactatagctt

SEQ ID NO: 1640545 - DNA, 23 bp, Homo sapiens
gccttcaaggactgtttcagtgt

SEQ ID NO: 1640546 - DNA, 14 bp, Homo sapiens
gccttcaagtgcca

SEQ ID NO: 1640547 - DNA, 19 bp, Homo sapiens
gccttcacttttctgagtt

SEQ ID NO: 1640548 - DNA, 17 bp, Homo sapiens
gccttcagaaccatcca

SEQ ID NO: 1640549 - DNA, 23 bp, Homo sapiens
gccttcagacagagaggactgta

SEQ ID NO: 1640550 - DNA, 18 bp, Homo sapiens
gccttcagcagcagctca

SEQ ID NO: 1640551 - DNA, 14 bp, Homo sapiens
gccttcagctccag

SEQ ID NO: 1640552 - DNA, 21 bp, Homo sapiens
gccttcataggcggtcatgtg

SEQ ID NO: 1640553 - DNA, 21 bp, Homo sapiens
gccttcatcctcctccccagc

SEQ ID NO: 1640554 - DNA, 23 bp, Homo sapiens
gccttcatcctcctccccagctc

SEQ ID NO: 1640555 - DNA, 17 bp, Homo sapiens
gccttccaaaacctgct

SEQ ID NO: 1640556 - DNA, 13 bp, Homo sapiens
gccttccagctgc

SEQ ID NO: 1640557 - DNA, 15 bp, Homo sapiens
gccttccagctgctg

SEQ ID NO: 1640558 - DNA, 16 bp, Homo sapiens
gccttccagctgctgt

SEQ ID NO: 1640559 - DNA, 15 bp, Homo sapiens
gccttccataattat

SEQ ID NO: 1640560 - DNA, 21 bp, Homo sapiens
gccttccataattatgacagt

SEQ ID NO: 1640561 - DNA, 14 bp, Homo sapiens
gccttccccagcct

SEQ ID NO: 1640562 - DNA, 15 bp, Homo sapiens
gccttccccagcctc

SEQ ID NO: 1640563 - DNA, 18 bp, Homo sapiens
gccttccccctcccaggg

SEQ ID NO: 1640564 - DNA, 23 bp, Homo sapiens
gccttccccctcccagggccagg

SEQ ID NO: 1640565 - DNA, 22 bp, Homo sapiens
gccttccccttttgcctggctg

SEQ ID NO: 1640566 - DNA, 23 bp, Homo sapiens
gccttccccttttgcctggctgt

SEQ ID NO: 1640567 - DNA, 18 bp, Homo sapiens
gccttccctggccttgag

SEQ ID NO: 1640568 - DNA, 19 bp, Homo sapiens
gccttcccttctctggtct

SEQ ID NO: 1640569 - DNA, 18 bp, Homo sapiens
gccttcctccacatcctt

SEQ ID NO: 1640570 - DNA, 14 bp, Homo sapiens
gccttcctcctcca

SEQ ID NO: 1640571 - DNA, 20 bp, Homo sapiens
gccttcctcctccacagtgc

SEQ ID NO: 1640572 - DNA, 19 bp, Homo sapiens
gccttcctctctctaccag

SEQ ID NO: 1640573 - DNA, 22 bp, Homo sapiens
gccttcctttctcctgccccaa

SEQ ID NO: 1640574 - DNA, 21 bp, Homo sapiens
gccttccttttgaggagctgg

SEQ ID NO: 1640575 - DNA, 22 bp, Homo sapiens
gccttcgatacaccgggcctgg

SEQ ID NO: 1640576 - DNA, 21 bp, Homo sapiens
gccttcgccccagtgttctgc

SEQ ID NO: 1640577 - DNA, 14 bp, Homo sapiens
gccttcgtgccccc

SEQ ID NO: 1640578 - DNA, 19 bp, Homo sapiens
gccttcgtgcccccccttc

SEQ ID NO: 1640579 - DNA, 21 bp, Homo sapiens
gccttctagattcactgtctt

SEQ ID NO: 1640580 - DNA, 14 bp, Homo sapiens
gccttctcaggccc

SEQ ID NO: 1640581 - DNA, 17 bp, Homo sapiens
gccttctcatgatccaa

SEQ ID NO: 1640582 - DNA, 18 bp, Homo sapiens
gccttctcggagctggcc

SEQ ID NO: 1640583 - DNA, 16 bp, Homo sapiens
gccttctctcagctcc

SEQ ID NO: 1640584 - DNA, 23 bp, Homo sapiens
gccttctctcagctcccaggcca

SEQ ID NO: 1640585 - DNA, 18 bp, Homo sapiens
gccttctgaactccatac

SEQ ID NO: 1640586 - DNA, 20 bp, Homo sapiens
gccttctggatccatggggg

SEQ ID NO: 1640587 - DNA, 22 bp, Homo sapiens
gccttctgggaagggagagggc

SEQ ID NO: 1640588 - DNA, 19 bp, Homo sapiens
gccttcttattctcactcc

SEQ ID NO: 1640589 - DNA, 20 bp, Homo sapiens
gccttcttattctcactcca

SEQ ID NO: 1640590 - DNA, 17 bp, Homo sapiens
gccttcttcacccagct

SEQ ID NO: 1640591 - DNA, 22 bp, Homo sapiens
gccttcttcggggaactcctgg

SEQ ID NO: 1640592 - DNA, 15 bp, Homo sapiens
gccttcttttgatta

SEQ ID NO: 1640593 - DNA, 19 bp, Homo sapiens
gccttgaaaaacaagtctt

SEQ ID NO: 1640594 - DNA, 15 bp, Homo sapiens
gccttgaagacagag

SEQ ID NO: 1640595 - DNA, 16 bp, Homo sapiens
gccttgaagacagagc

SEQ ID NO: 1640596 - DNA, 14 bp, Homo sapiens
gccttgaagccact

SEQ ID NO: 1640597 - DNA, 19 bp, Homo sapiens
gccttgagagacccagctg

SEQ ID NO: 1640598 - DNA, 15 bp, Homo sapiens
gccttgagccctggc

SEQ ID NO: 1640599 - DNA, 16 bp, Homo sapiens
gccttgagccctggct

SEQ ID NO: 1640600 - DNA, 15 bp, Homo sapiens
gccttgagttccagt

SEQ ID NO: 1640601 - DNA, 13 bp, Homo sapiens
gccttgcagctgg

SEQ ID NO: 1640602 - DNA, 17 bp, Homo sapiens
gccttgcagctggccca

SEQ ID NO: 1640603 - DNA, 14 bp, Homo sapiens
gccttgcataccca

SEQ ID NO: 1640604 - DNA, 12 bp, Homo sapiens
gccttgcccaga

SEQ ID NO: 1640605 - DNA, 15 bp, Homo sapiens
gccttgcccagagat

SEQ ID NO: 1640606 - DNA, 22 bp, Homo sapiens
gccttgcccagagatgcctcca

SEQ ID NO: 1640607 - DNA, 22 bp, Homo sapiens
gccttgcccggattctgggagg

SEQ ID NO: 1640608 - DNA, 15 bp, Homo sapiens
gccttgcctggcctg

SEQ ID NO: 1640609 - DNA, 12 bp, Homo sapiens
gccttgctgctc

SEQ ID NO: 1640610 - DNA, 14 bp, Homo sapiens
gccttgctgctctg

SEQ ID NO: 1640611 - DNA, 16 bp, Homo sapiens
gccttgctgctctgcg

SEQ ID NO: 1640612 - DNA, 13 bp, Homo sapiens
gccttgctgggcc

SEQ ID NO: 1640613 - DNA, 18 bp, Homo sapiens
gccttgctgggccaggga

SEQ ID NO: 1640614 - DNA, 17 bp, Homo sapiens
gccttgctgtttgtcct

SEQ ID NO: 1640615 - DNA, 21 bp, Homo sapiens
gccttgcttctgtatttcctt

SEQ ID NO: 1640616 - DNA, 13 bp, Homo sapiens
gccttgcttgtta

SEQ ID NO: 1640617 - DNA, 14 bp, Homo sapiens
gccttggaaattcc

SEQ ID NO: 1640618 - DNA, 21 bp, Homo sapiens
gccttggataatgctgttgcc

SEQ ID NO: 1640619 - DNA, 15 bp, Homo sapiens
gccttggcctcccaa

SEQ ID NO: 1640620 - DNA, 14 bp, Homo sapiens
gccttggccttgca

SEQ ID NO: 1640621 - DNA, 15 bp, Homo sapiens
gccttggctcagaca

SEQ ID NO: 1640622 - DNA, 16 bp, Homo sapiens
gccttggctcagacat

SEQ ID NO: 1640623 - DNA, 14 bp, Homo sapiens
gccttgggctgctc

SEQ ID NO: 1640624 - DNA, 15 bp, Homo sapiens
gccttgggctgctcc

SEQ ID NO: 1640625 - DNA, 22 bp, Homo sapiens
gccttgggctgctcctcatggt

SEQ ID NO: 1640626 - DNA, 21 bp, Homo sapiens
gccttgggtctcagctgctga

SEQ ID NO: 1640627 - DNA, 18 bp, Homo sapiens
gccttggtggagcagcca

SEQ ID NO: 1640628 - DNA, 21 bp, Homo sapiens
gccttggtggagcagccagag

SEQ ID NO: 1640629 - DNA, 24 bp, Homo sapiens
gccttggtggagcagccagagctg

SEQ ID NO: 1640630 - DNA, 17 bp, Homo sapiens
gccttggtgtccacctg

SEQ ID NO: 1640631 - DNA, 18 bp, Homo sapiens
gccttggtgtccacctgg

SEQ ID NO: 1640632 - DNA, 18 bp, Homo sapiens
gccttggttcccttgtgt

SEQ ID NO: 1640633 - DNA, 12 bp, Homo sapiens
gccttgtacttt

SEQ ID NO: 1640634 - DNA, 12 bp, Homo sapiens
gccttgtataaa

SEQ ID NO: 1640635 - DNA, 20 bp, Homo sapiens
gccttgtgagatccttcaca

SEQ ID NO: 1640636 - DNA, 12 bp, Homo sapiens
gccttgtgccct

SEQ ID NO: 1640637 - DNA, 15 bp, Homo sapiens
gccttgtgccctgcc

SEQ ID NO: 1640638 - DNA, 19 bp, Homo sapiens
gccttgtgccctgccccca

SEQ ID NO: 1640639 - DNA, 14 bp, Homo sapiens
gccttgtgtgtcag

SEQ ID NO: 1640640 - DNA, 18 bp, Homo sapiens
gccttgtgtgtcaggccc

SEQ ID NO: 1640641 - DNA, 19 bp, Homo sapiens
gccttgtgtgtcaggccct

SEQ ID NO: 1640642 - DNA, 16 bp, Homo sapiens
gccttgttcctgctct

SEQ ID NO: 1640643 - DNA, 12 bp, Homo sapiens
gcctttaagcca

SEQ ID NO: 1640644 - DNA, 15 bp, Homo sapiens
gcctttacaagggag

SEQ ID NO: 1640645 - DNA, 20 bp, Homo sapiens
gcctttacgttcatcacctg

SEQ ID NO: 1640646 - DNA, 22 bp, Homo sapiens
gcctttccataaggaatgtagc

SEQ ID NO: 1640647 - DNA, 19 bp, Homo sapiens
gcctttcgaggcctgaagc

SEQ ID NO: 1640648 - DNA, 14 bp, Homo sapiens
gcctttctcccccg

SEQ ID NO: 1640649 - DNA, 12 bp, Homo sapiens
gcctttcttctg

SEQ ID NO: 1640650 - DNA, 15 bp, Homo sapiens
gcctttctttgcctc

SEQ ID NO: 1640651 - DNA, 20 bp, Homo sapiens
gcctttgaagagtgaaatac

SEQ ID NO: 1640652 - DNA, 14 bp, Homo sapiens
gcctttgcaagatg

SEQ ID NO: 1640653 - DNA, 21 bp, Homo sapiens
gcctttgcagttggactctca

SEQ ID NO: 1640654 - DNA, 23 bp, Homo sapiens
gcctttgcagttggactctcagg

SEQ ID NO: 1640655 - DNA, 19 bp, Homo sapiens
gcctttggaagggtctctc

SEQ ID NO: 1640656 - DNA, 12 bp, Homo sapiens
gcctttggcctg

SEQ ID NO: 1640657 - DNA, 19 bp, Homo sapiens
gcctttgggtcctgggcag

SEQ ID NO: 1640658 - DNA, 20 bp, Homo sapiens
gcctttgtcttgtacttctg

SEQ ID NO: 1640659 - DNA, 14 bp, Homo sapiens
gcctttgttctggg

SEQ ID NO: 1640660 - DNA, 14 bp, Homo sapiens
gccttttaattttt

SEQ ID NO: 1640661 - DNA, 11 bp, Homo sapiens
gccttttctgg

SEQ ID NO: 1640662 - DNA, 14 bp, Homo sapiens
gccttttctggagt

SEQ ID NO: 1640663 - DNA, 22 bp, Homo sapiens
gccttttctggcaccgcagttt

SEQ ID NO: 1640664 - DNA, 12 bp, Homo sapiens
gccttttctgtg

SEQ ID NO: 1640665 - DNA, 13 bp, Homo sapiens
gccttttcttttc

SEQ ID NO: 1640666 - DNA, 16 bp, Homo sapiens
gccttttgaatacatt

SEQ ID NO: 1640667 - DNA, 22 bp, Homo sapiens
gccttttgaatacatttgtatt

SEQ ID NO: 1640668 - DNA, 18 bp, Homo sapiens
gccttttgcaaccaggaa

SEQ ID NO: 1640669 - DNA, 14 bp, Homo sapiens
gccttttgcacccc

SEQ ID NO: 1640670 - DNA, 17 bp, Homo sapiens
gccttttgcacccctcc

SEQ ID NO: 1640671 - DNA, 13 bp, Homo sapiens
gccttttgctctc

SEQ ID NO: 1640672 - DNA, 21 bp, Homo sapiens
gccttttgtgtaataagaaag

SEQ ID NO: 1640673 - DNA, 21 bp, Homo sapiens
gcgaacggaacgttggacttt

SEQ ID NO: 1640674 - DNA, 13 bp, Homo sapiens
gcgaactgggttc

SEQ ID NO: 1640675 - DNA, 15 bp, Homo sapiens
gcgaagatgatttca

SEQ ID NO: 1640676 - DNA, 16 bp, Homo sapiens
gcgacagcattttaag

SEQ ID NO: 1640677 - DNA, 17 bp, Homo sapiens
gcgacagcattttaagg

SEQ ID NO: 1640678 - DNA, 14 bp, Homo sapiens
gcgaccccccaccc

SEQ ID NO: 1640679 - DNA, 19 bp, Homo sapiens
gcgaccctgggggcacagg

SEQ ID NO: 1640680 - DNA, 23 bp, Homo sapiens
gcgaccctgggggcacaggaggc

SEQ ID NO: 1640681 - DNA, 15 bp, Homo sapiens
gcgaccttcctcatc

SEQ ID NO: 1640682 - DNA, 22 bp, Homo sapiens
gcgaccttcctcatccacccca

SEQ ID NO: 1640683 - DNA, 23 bp, Homo sapiens
gcgaccttcctcatccaccccat

SEQ ID NO: 1640684 - DNA, 16 bp, Homo sapiens
gcgacggagagaaaaa

SEQ ID NO: 1640685 - DNA, 19 bp, Homo sapiens
gcgactccgttggccactc

SEQ ID NO: 1640686 - DNA, 20 bp, Homo sapiens
gcgactccgttggccactcc

SEQ ID NO: 1640687 - DNA, 19 bp, Homo sapiens
gcgactctgcagagtcact

SEQ ID NO: 1640688 - DNA, 14 bp, Homo sapiens
gcgactttctgcct

SEQ ID NO: 1640689 - DNA, 17 bp, Homo sapiens
gcgactttctgcctgga

SEQ ID NO: 1640690 - DNA, 19 bp, Homo sapiens
gcgagagatcaaagatgaa

SEQ ID NO: 1640691 - DNA, 21 bp, Homo sapiens
gcgagcatgggggctgccagc

SEQ ID NO: 1640692 - DNA, 18 bp, Homo sapiens
gcgagcatgtcgtggaca

SEQ ID NO: 1640693 - DNA, 21 bp, Homo sapiens
gcgagcccctcggctctggag

SEQ ID NO: 1640694 - DNA, 12 bp, Homo sapiens
gcgagggcagct

SEQ ID NO: 1640695 - DNA, 17 bp, Homo sapiens
gcgaggggaaaggcctg

SEQ ID NO: 1640696 - DNA, 16 bp, Homo sapiens
gcgaggtcaacagaga

SEQ ID NO: 1640697 - DNA, 23 bp, Homo sapiens
gcgaggtcaacagagaaggcagg

SEQ ID NO: 1640698 - DNA, 21 bp, Homo sapiens
gcgatccacctgtctcagcct

SEQ ID NO: 1640699 - DNA, 20 bp, Homo sapiens
gcgatcccacacaggctggc

SEQ ID NO: 1640700 - DNA, 18 bp, Homo sapiens
gcgatctctcctggccta

SEQ ID NO: 1640701 - DNA, 19 bp, Homo sapiens
gcgatgaatttggagactc

SEQ ID NO: 1640702 - DNA, 21 bp, Homo sapiens
gcgatggggcaagacagaaaa

SEQ ID NO: 1640703 - DNA, 16 bp, Homo sapiens
gcgatgtgcaggaaga

SEQ ID NO: 1640704 - DNA, 14 bp, Homo sapiens
gcgattccctctca

SEQ ID NO: 1640705 - DNA, 12 bp, Homo sapiens
gcgcaagcctgt

SEQ ID NO: 1640706 - DNA, 19 bp, Homo sapiens
gcgcaatctcggctcactg

SEQ ID NO: 1640707 - DNA, 12 bp, Homo sapiens
gcgcacctgccc

SEQ ID NO: 1640708 - DNA, 11 bp, Homo sapiens
gcgcagacagg

SEQ ID NO: 1640709 - DNA, 16 bp, Homo sapiens
gcgcagagccctccag

SEQ ID NO: 1640710 - DNA, 20 bp, Homo sapiens
gcgcagagccctccaggcct

SEQ ID NO: 1640711 - DNA, 24 bp, Homo sapiens
gcgcagagccctccaggcctgcag

SEQ ID NO: 1640712 - DNA, 16 bp, Homo sapiens
gcgcaggctcctttgt

SEQ ID NO: 1640713 - DNA, 18 bp, Homo sapiens
gcgcaggtgccatgcctg

SEQ ID NO: 1640714 - DNA, 20 bp, Homo sapiens
gcgcaggtgccatgcctgct

SEQ ID NO: 1640715 - DNA, 18 bp, Homo sapiens
gcgcaggtgggctggact

SEQ ID NO: 1640716 - DNA, 14 bp, Homo sapiens
gcgcagtgccttgc

SEQ ID NO: 1640717 - DNA, 20 bp, Homo sapiens
gcgcatcaatgtattttatc

SEQ ID NO: 1640718 - DNA, 22 bp, Homo sapiens
gcgcatcctgcagggcttctcc

SEQ ID NO: 1640719 - DNA, 21 bp, Homo sapiens
gcgccaaaacaagccaaagag

SEQ ID NO: 1640720 - DNA, 22 bp, Homo sapiens
gcgccaaaacaagccaaagagc

SEQ ID NO: 1640721 - DNA, 24 bp, Homo sapiens
gcgccactacactccagcctgagc

SEQ ID NO: 1640722 - DNA, 11 bp, Homo sapiens
gcgccagctcc

SEQ ID NO: 1640723 - DNA, 14 bp, Homo sapiens
gcgccagtccccgc

SEQ ID NO: 1640724 - DNA, 14 bp, Homo sapiens
gcgccagtcctgct

SEQ ID NO: 1640725 - DNA, 12 bp, Homo sapiens
gcgcccaccctg

SEQ ID NO: 1640726 - DNA, 16 bp, Homo sapiens
gcgcccaccctgggct

SEQ ID NO: 1640727 - DNA, 17 bp, Homo sapiens
gcgcccaccctgggctc

SEQ ID NO: 1640728 - DNA, 19 bp, Homo sapiens
gcgcccaccctgggctcca

SEQ ID NO: 1640729 - DNA, 20 bp, Homo sapiens
gcgcccaccctgggctccac

SEQ ID NO: 1640730 - DNA, 12 bp, Homo sapiens
gcgccccaccca

SEQ ID NO: 1640731 - DNA, 21 bp, Homo sapiens
gcgccccctccgccctgccac

SEQ ID NO: 1640732 - DNA, 12 bp, Homo sapiens
gcgccccgcccc

SEQ ID NO: 1640733 - DNA, 15 bp, Homo sapiens
gcgcccgctgggctg

SEQ ID NO: 1640734 - DNA, 15 bp, Homo sapiens
gcgccctctctgctc

SEQ ID NO: 1640735 - DNA, 17 bp, Homo sapiens
gcgccctctctgctcct

SEQ ID NO: 1640736 - DNA, 19 bp, Homo sapiens
gcgcccttgtgccctgcct

SEQ ID NO: 1640737 - DNA, 22 bp, Homo sapiens
gcgccgtctccaggggctgctt

SEQ ID NO: 1640738 - DNA, 20 bp, Homo sapiens
gcgcctagtggggtctccct

SEQ ID NO: 1640739 - DNA, 12 bp, Homo sapiens
gcgcctccagag

SEQ ID NO: 1640740 - DNA, 13 bp, Homo sapiens
gcgcctccagagg

SEQ ID NO: 1640741 - DNA, 15 bp, Homo sapiens
gcgcctgccttggga

SEQ ID NO: 1640742 - DNA, 16 bp, Homo sapiens
gcgcctgtgatgctgg

SEQ ID NO: 1640743 - DNA, 15 bp, Homo sapiens
gcgcgatctcagctc

SEQ ID NO: 1640744 - DNA, 13 bp, Homo sapiens
gcgcgcaggcctg

SEQ ID NO: 1640745 - DNA, 22 bp, Homo sapiens
gcgcgcatgtaatcccagctac

SEQ ID NO: 1640746 - DNA, 18 bp, Homo sapiens
gcgcgggcagccacccaa

SEQ ID NO: 1640747 - DNA, 15 bp, Homo sapiens
gcgcgtccccctgcc

SEQ ID NO: 1640748 - DNA, 22 bp, Homo sapiens
gcgcgtttgtgcatatctgcct

SEQ ID NO: 1640749 - DNA, 16 bp, Homo sapiens
gcgctacccacttcta

SEQ ID NO: 1640750 - DNA, 22 bp, Homo sapiens
gcgctattgcactccagtctgg

SEQ ID NO: 1640751 - DNA, 13 bp, Homo sapiens
gcgctcacctgca

SEQ ID NO: 1640752 - DNA, 16 bp, Homo sapiens
gcgctcacctgcagcc

SEQ ID NO: 1640753 - DNA, 22 bp, Homo sapiens
gcgctcagacggcggccaggca

SEQ ID NO: 1640754 - DNA, 10 bp, Homo sapiens
gcgctcagga

SEQ ID NO: 1640755 - DNA, 11 bp, Homo sapiens
gcgctcaggac

SEQ ID NO: 1640756 - DNA, 19 bp, Homo sapiens
gcgctcaggacccaggccc

SEQ ID NO: 1640757 - DNA, 22 bp, Homo sapiens
gcgctcagggccatgctgaggc

SEQ ID NO: 1640758 - DNA, 17 bp, Homo sapiens
gcgctcagtaaacggga

SEQ ID NO: 1640759 - DNA, 19 bp, Homo sapiens
gcgctcctgccgcagagct

SEQ ID NO: 1640760 - DNA, 21 bp, Homo sapiens
gcgctcctgccgcagagctgg

SEQ ID NO: 1640761 - DNA, 17 bp, Homo sapiens
gcctgggccacacctga

SEQ ID NO: 1640762 - DNA, 14 bp, Homo sapiens
gcctgggccagaga

SEQ ID NO: 1640763 - DNA, 15 bp, Homo sapiens
gcctgggccccagct

SEQ ID NO: 1640764 - DNA, 16 bp, Homo sapiens
gcctgggccctgggct

SEQ ID NO: 1640765 - DNA, 22 bp, Homo sapiens
gcctgggccctgggctgatgga

SEQ ID NO: 1640766 - DNA, 18 bp, Homo sapiens
gcctgggccgctgccacg

SEQ ID NO: 1640767 - DNA, 11 bp, Homo sapiens
gcctgggcctc

SEQ ID NO: 1640768 - DNA, 13 bp, Homo sapiens
gcctgggcctcct

SEQ ID NO: 1640769 - DNA, 12 bp, Homo sapiens
gcctgggcctgc

SEQ ID NO: 1640770 - DNA, 14 bp, Homo sapiens
gcctgggcctgtgc

SEQ ID NO: 1640771 - DNA, 19 bp, Homo sapiens
gcctgggcctgtgcagcag

SEQ ID NO: 1640772 - DNA, 21 bp, Homo sapiens
gcctgggcgtacagagcacat

SEQ ID NO: 1640773 - DNA, 20 bp, Homo sapiens
gcctggggatgtaaccaagc

SEQ ID NO: 1640774 - DNA, 14 bp, Homo sapiens
gcctgggggcagtg

SEQ ID NO: 1640775 - DNA, 15 bp, Homo sapiens
gcctgggggcagtga

SEQ ID NO: 1640776 - DNA, 22 bp, Homo sapiens
gcctgggggcagtgactggcag

SEQ ID NO: 1640777 - DNA, 22 bp, Homo sapiens
gcctgggggcttttgccactcc

SEQ ID NO: 1640778 - DNA, 16 bp, Homo sapiens
gcctggggtgcatctc

SEQ ID NO: 1640779 - DNA, 18 bp, Homo sapiens
gcctggggtgcatctcct

SEQ ID NO: 1640780 - DNA, 20 bp, Homo sapiens
gcctggggtgcatctcctcc

SEQ ID NO: 1640781 - DNA, 15 bp, Homo sapiens
gcctgggtcacagag

SEQ ID NO: 1640782 - DNA, 20 bp, Homo sapiens
gcctgggtcacagagtgaga

SEQ ID NO: 1640783 - DNA, 22 bp, Homo sapiens
gcctgggtgacagagtgagacc

SEQ ID NO: 1640784 - DNA, 17 bp, Homo sapiens
gcctgggtgctggctgc

SEQ ID NO: 1640785 - DNA, 21 bp, Homo sapiens
gcctgggtgctggctgcccag

SEQ ID NO: 1640786 - DNA, 16 bp, Homo sapiens
gcctgggtggggctgc

SEQ ID NO: 1640787 - DNA, 23 bp, Homo sapiens
gcctgggtggggctgctcctcca

SEQ ID NO: 1640788 - DNA, 24 bp, Homo sapiens
gcctgggtggggctgctcctccag

SEQ ID NO: 1640789 - DNA, 22 bp, Homo sapiens
gcctgggttttgtggtcatcta

SEQ ID NO: 1640790 - DNA, 20 bp, Homo sapiens
gcctggtatatccaaaagct

SEQ ID NO: 1640791 - DNA, 15 bp, Homo sapiens
gcctggtattttcaa

SEQ ID NO: 1640792 - DNA, 16 bp, Homo sapiens
gcctggtccctgggag

SEQ ID NO: 1640793 - DNA, 14 bp, Homo sapiens
gcctggtccctggt

SEQ ID NO: 1640794 - DNA, 21 bp, Homo sapiens
gcctggtccctggtccttcac

SEQ ID NO: 1640795 - DNA, 15 bp, Homo sapiens
gcctggtcctccctc

SEQ ID NO: 1640796 - DNA, 19 bp, Homo sapiens
gcctggtcctccctcccaa

SEQ ID NO: 1640797 - DNA, 20 bp, Homo sapiens
gcctggtcctccctcccaag

SEQ ID NO: 1640798 - DNA, 21 bp, Homo sapiens
gcctggtcctccctcccaagg

SEQ ID NO: 1640799 - DNA, 15 bp, Homo sapiens
gcctggtctgtctgg

SEQ ID NO: 1640800 - DNA, 13 bp, Homo sapiens
gcctggtgcagtg

SEQ ID NO: 1640801 - DNA, 19 bp, Homo sapiens
gcctggtgcattgctgtgt

SEQ ID NO: 1640802 - DNA, 21 bp, Homo sapiens
gcctggtgcattgctgtgtga

SEQ ID NO: 1640803 - DNA, 14 bp, Homo sapiens
gcctggtggttttc

SEQ ID NO: 1640804 - DNA, 13 bp, Homo sapiens
gcctgtaacaatg

SEQ ID NO: 1640805 - DNA, 22 bp, Homo sapiens
gcctgtaagaaaaaaaatgtac

SEQ ID NO: 1640806 - DNA, 16 bp, Homo sapiens
gcctgtaatcccagca

SEQ ID NO: 1640807 - DNA, 18 bp, Homo sapiens
gcctgtaatcccagcact

SEQ ID NO: 1640808 - DNA, 17 bp, Homo sapiens
gcctgtaatcccagcta

SEQ ID NO: 1640809 - DNA, 18 bp, Homo sapiens
gcctgtaatcccagctac

SEQ ID NO: 1640810 - DNA, 15 bp, Homo sapiens
gcctgtagagttgct

SEQ ID NO: 1640811 - DNA, 19 bp, Homo sapiens
gcctgtagagttgctgaga

SEQ ID NO: 1640812 - DNA, 19 bp, Homo sapiens
gcctgtagctttcctggtc

SEQ ID NO: 1640813 - DNA, 18 bp, Homo sapiens
gcctgtatttgagagact

SEQ ID NO: 1640814 - DNA, 19 bp, Homo sapiens
gcctgtatttgagagactg

SEQ ID NO: 1640815 - DNA, 13 bp, Homo sapiens
gcctgtcaccaga

SEQ ID NO: 1640816 - DNA, 18 bp, Homo sapiens
gcctgtcaccagagcttc

SEQ ID NO: 1640817 - DNA, 22 bp, Homo sapiens
gcctgtcaccagagcttctctg

SEQ ID NO: 1640818 - DNA, 15 bp, Homo sapiens
gcctgtcatgcgcaa

SEQ ID NO: 1640819 - DNA, 15 bp, Homo sapiens
gcctgtccaccctgc

SEQ ID NO: 1640820 - DNA, 21 bp, Homo sapiens
gcctgtccaccctgccaagac

SEQ ID NO: 1640821 - DNA, 16 bp, Homo sapiens
gcctgtcccccaaggt

SEQ ID NO: 1640822 - DNA, 14 bp, Homo sapiens
gcctgtcccttgcc

SEQ ID NO: 1640823 - DNA, 20 bp, Homo sapiens
gcctgtcccttgcctctgcc

SEQ ID NO: 1640824 - DNA, 15 bp, Homo sapiens
gcctgtcgtgccagt

SEQ ID NO: 1640825 - DNA, 19 bp, Homo sapiens
gcctgtctcatccccaggg

SEQ ID NO: 1640826 - DNA, 21 bp, Homo sapiens
gcctgtctcatcttctgaaga

SEQ ID NO: 1640827 - DNA, 20 bp, Homo sapiens
gcctgtctctagctgttctg

SEQ ID NO: 1640828 - DNA, 12 bp, Homo sapiens
gcctgtctgtct

SEQ ID NO: 1640829 - DNA, 17 bp, Homo sapiens
gcctgtctgtctctcca

SEQ ID NO: 1640830 - DNA, 23 bp, Homo sapiens
gcctgtgaagcagtcagccctta

SEQ ID NO: 1640831 - DNA, 17 bp, Homo sapiens
gcctgtgaggtgcagag

SEQ ID NO: 1640832 - DNA, 23 bp, Homo sapiens
gcctgtgaggtgcagagtgccca

SEQ ID NO: 1640833 - DNA, 15 bp, Homo sapiens
gcctgtgattaactt

SEQ ID NO: 1640834 - DNA, 19 bp, Homo sapiens
gcctgtgattaacttgctt

SEQ ID NO: 1640835 - DNA, 15 bp, Homo sapiens
gcctgtgcaatgcat

SEQ ID NO: 1640836 - DNA, 13 bp, Homo sapiens
gcctgtgcagcag

SEQ ID NO: 1640837 - DNA, 19 bp, Homo sapiens
gcctgtgcagcagcccagc

SEQ ID NO: 1640838 - DNA, 16 bp, Homo sapiens
gcctgtgccagcacct

SEQ ID NO: 1640839 - DNA, 17 bp, Homo sapiens
gcctgtgcctctgggac

SEQ ID NO: 1640840 - DNA, 23 bp, Homo sapiens
gcctgtgcgtcccagctgaaggc

SEQ ID NO: 1640841 - DNA, 14 bp, Homo sapiens
gcctgtgctcctgc

SEQ ID NO: 1640842 - DNA, 16 bp, Homo sapiens
gcctgtgctgcccgtc

SEQ ID NO: 1640843 - DNA, 23 bp, Homo sapiens
gcctgtgctgcccgtcttcagcc

SEQ ID NO: 1640844 - DNA, 21 bp, Homo sapiens
gcctgtgctgggccagtggct

SEQ ID NO: 1640845 - DNA, 15 bp, Homo sapiens
gcctgtggcacagcc

SEQ ID NO: 1640846 - DNA, 19 bp, Homo sapiens
gcctgtggcacagccctga

SEQ ID NO: 1640847 - DNA, 21 bp, Homo sapiens
gcctgtggcgccgtctccagg

SEQ ID NO: 1640848 - DNA, 16 bp, Homo sapiens
gcctgtggcggtgcct

SEQ ID NO: 1640849 - DNA, 19 bp, Homo sapiens
gcctgtggcggtgcctggg

SEQ ID NO: 1640850 - DNA, 13 bp, Homo sapiens
gcctgtggcttgg

SEQ ID NO: 1640851 - DNA, 16 bp, Homo sapiens
gcctgtggcttggagt

SEQ ID NO: 1640852 - DNA, 21 bp, Homo sapiens
gcctgtgggcgcatactacag

SEQ ID NO: 1640853 - DNA, 14 bp, Homo sapiens
gcctgtggggagcc

SEQ ID NO: 1640854 - DNA, 15 bp, Homo sapiens
gcctgtggggagccg

SEQ ID NO: 1640855 - DNA, 14 bp, Homo sapiens
gcctgtgggtctct

SEQ ID NO: 1640856 - DNA, 13 bp, Homo sapiens
gcctgtgtccagc

SEQ ID NO: 1640857 - DNA, 14 bp, Homo sapiens
gcctgtgtccagca

SEQ ID NO: 1640858 - DNA, 12 bp, Homo sapiens
gcctgtgtccat

SEQ ID NO: 1640859 - DNA, 15 bp, Homo sapiens
gcctgtgtgctccgg

SEQ ID NO: 1640860 - DNA, 19 bp, Homo sapiens
gcctgttataactctgcac

SEQ ID NO: 1640861 - DNA, 12 bp, Homo sapiens
gcctgttcccta

SEQ ID NO: 1640862 - DNA, 21 bp, Homo sapiens
gcctgttccctagagagaata

SEQ ID NO: 1640863 - DNA, 22 bp, Homo sapiens
gcctgttccctagagagaataa

SEQ ID NO: 1640864 - DNA, 18 bp, Homo sapiens
gcctgttctatgccttta

SEQ ID NO: 1640865 - DNA, 16 bp, Homo sapiens
gcctgttctgcttcga

SEQ ID NO: 1640866 - DNA, 20 bp, Homo sapiens
gcctgttgctatagagccta

SEQ ID NO: 1640867 - DNA, 19 bp, Homo sapiens
gcctgttggctgctgcggc

SEQ ID NO: 1640868 - DNA, 19 bp, Homo sapiens
gcctgtttctgatttgctg

SEQ ID NO: 1640869 - DNA, 12 bp, Homo sapiens
gcctgtttgatg

SEQ ID NO: 1640870 - DNA, 14 bp, Homo sapiens
gcctgtttgatgta

SEQ ID NO: 1640871 - DNA, 17 bp, Homo sapiens
gcctgtttgatgtatgt

SEQ ID NO: 1640872 - DNA, 18 bp, Homo sapiens
gcctgtttgatgtatgtg

SEQ ID NO: 1640873 - DNA, 16 bp, Homo sapiens
gcctgtttggcctctc

SEQ ID NO: 1640874 - DNA, 20 bp, Homo sapiens
gccttaaaaggagagaagaa

SEQ ID NO: 1640875 - DNA, 16 bp, Homo sapiens
gccttaaaaggggccc

SEQ ID NO: 1640876 - DNA, 17 bp, Homo sapiens
gccttaaaaggggccca

SEQ ID NO: 1640877 - DNA, 16 bp, Homo sapiens
gccaagctccaagccc

SEQ ID NO: 1640878 - DNA, 16 bp, Homo sapiens
gccaagctttaaatta

SEQ ID NO: 1640879 - DNA, 17 bp, Homo sapiens
gccaaggacagggctgg

SEQ ID NO: 1640880 - DNA, 14 bp, Homo sapiens
gccaaggagcccct

SEQ ID NO: 1640881 - DNA, 16 bp, Homo sapiens
gccaaggcagaggcct

SEQ ID NO: 1640882 - DNA, 21 bp, Homo sapiens
gccaaggccagagtggcctgg

SEQ ID NO: 1640883 - DNA, 19 bp, Homo sapiens
gccaaggccgccagcgtgt

SEQ ID NO: 1640884 - DNA, 14 bp, Homo sapiens
gccaaggccttctc

SEQ ID NO: 1640885 - DNA, 12 bp, Homo sapiens
gccaagggaaag

SEQ ID NO: 1640886 - DNA, 14 bp, Homo sapiens
gccaagggccccag

SEQ ID NO: 1640887 - DNA, 19 bp, Homo sapiens
gccaagggccccaggggca

SEQ ID NO: 1640888 - DNA, 21 bp, Homo sapiens
gccaagggccccaggggcagc

SEQ ID NO: 1640889 - DNA, 23 bp, Homo sapiens
gccaaggggtgggcctgtgaatc

SEQ ID NO: 1640890 - DNA, 20 bp, Homo sapiens
gccaagggtcctcacccctc

SEQ ID NO: 1640891 - DNA, 19 bp, Homo sapiens
gccaaggtgggctgagccc

SEQ ID NO: 1640892 - DNA, 22 bp, Homo sapiens
gccaaggtgggctgagccctgg

SEQ ID NO: 1640893 - DNA, 18 bp, Homo sapiens
gccaaggtgtccagggtc

SEQ ID NO: 1640894 - DNA, 19 bp, Homo sapiens
gccaagtaaacagggtacc

SEQ ID NO: 1640895 - DNA, 21 bp, Homo sapiens
gccaagtcatggagaatctgc

SEQ ID NO: 1640896 - DNA, 14 bp, Homo sapiens
gccaagtctcagaa

SEQ ID NO: 1640897 - DNA, 23 bp, Homo sapiens
gccaagtggggtgctgggaggag

SEQ ID NO: 1640898 - DNA, 17 bp, Homo sapiens
gccaagtggtccagcgt

SEQ ID NO: 1640899 - DNA, 20 bp, Homo sapiens
gccaagtttatatacaatta

SEQ ID NO: 1640900 - DNA, 21 bp, Homo sapiens
gccaatccctcaccttctgag

SEQ ID NO: 1640901 - DNA, 18 bp, Homo sapiens
gccaatctagaggcaagc

SEQ ID NO: 1640902 - DNA, 22 bp, Homo sapiens
gccaatctagaggcaagcctgg

SEQ ID NO: 1640903 - DNA, 18 bp, Homo sapiens
gccaatgaacagctcctc

SEQ ID NO: 1640904 - DNA, 19 bp, Homo sapiens
gccaatggagactgtctca

SEQ ID NO: 1640905 - DNA, 16 bp, Homo sapiens
gccaatgtctcctccc

SEQ ID NO: 1640906 - DNA, 13 bp, Homo sapiens
gccaatttcctct

SEQ ID NO: 1640907 - DNA, 22 bp, Homo sapiens
gccaatttcctctccactgctg

SEQ ID NO: 1640908 - DNA, 23 bp, Homo sapiens
gccaatttttgccttcattacct

SEQ ID NO: 1640909 - DNA, 15 bp, Homo sapiens
gccacaagctgcact

SEQ ID NO: 1640910 - DNA, 17 bp, Homo sapiens
gccacaagctgcactgt

SEQ ID NO: 1640911 - DNA, 21 bp, Homo sapiens
gccacaagctgcactgtgaac

SEQ ID NO: 1640912 - DNA, 18 bp, Homo sapiens
gccacaaggaaaaggagg

SEQ ID NO: 1640913 - DNA, 22 bp, Homo sapiens
gccacaaggaaaaggaggaggt

SEQ ID NO: 1640914 - DNA, 21 bp, Homo sapiens
gccacaaggacgctggctact

SEQ ID NO: 1640915 - DNA, 15 bp, Homo sapiens
gccacaagtcttcca

SEQ ID NO: 1640916 - DNA, 21 bp, Homo sapiens
gccacaattatataaatcatt

SEQ ID NO: 1640917 - DNA, 19 bp, Homo sapiens
gccacacaaacgtttactt

SEQ ID NO: 1640918 - DNA, 19 bp, Homo sapiens
gccacaccatctcctttca

SEQ ID NO: 1640919 - DNA, 12 bp, Homo sapiens
gccacacccagc

SEQ ID NO: 1640920 - DNA, 17 bp, Homo sapiens
gccacacccagcggccc

SEQ ID NO: 1640921 - DNA, 15 bp, Homo sapiens
gccacacccaggcac

SEQ ID NO: 1640922 - DNA, 14 bp, Homo sapiens
gccacacctggcct

SEQ ID NO: 1640923 - DNA, 16 bp, Homo sapiens
gccacacgtggctggc

SEQ ID NO: 1640924 - DNA, 20 bp, Homo sapiens
gccacacgtggctggcggcc

SEQ ID NO: 1640925 - DNA, 21 bp, Homo sapiens
gccacactattaccatgagaa

SEQ ID NO: 1640926 - DNA, 12 bp, Homo sapiens
gccacactgatg

SEQ ID NO: 1640927 - DNA, 13 bp, Homo sapiens
gccacactgatgg

SEQ ID NO: 1640928 - DNA, 11 bp, Homo sapiens
gccacactggg

SEQ ID NO: 1640929 - DNA, 12 bp, Homo sapiens
gccacactgggc

SEQ ID NO: 1640930 - DNA, 20 bp, Homo sapiens
gccacagaaagctccttcca

SEQ ID NO: 1640931 - DNA, 20 bp, Homo sapiens
gccacagaccacctgcttct

SEQ ID NO: 1640932 - DNA, 16 bp, Homo sapiens
gccacagacccctggg

SEQ ID NO: 1640933 - DNA, 19 bp, Homo sapiens
gccacagacccctgggagc

SEQ ID NO: 1640934 - DNA, 21 bp, Homo sapiens
gccacagagaagtttgtagcc

SEQ ID NO: 1640935 - DNA, 21 bp, Homo sapiens
gccacagcaggactgaggaca

SEQ ID NO: 1640936 - DNA, 13 bp, Homo sapiens
gccacagctgctg

SEQ ID NO: 1640937 - DNA, 15 bp, Homo sapiens
gccacagctgctgga

SEQ ID NO: 1640938 - DNA, 18 bp, Homo sapiens
gccacagcttttgcaact

SEQ ID NO: 1640939 - DNA, 13 bp, Homo sapiens
gccacaggcctga

SEQ ID NO: 1640940 - DNA, 23 bp, Homo sapiens
gccacaggcctgagatttcatct

SEQ ID NO: 1640941 - DNA, 16 bp, Homo sapiens
gccacagtcactggat

SEQ ID NO: 1640942 - DNA, 20 bp, Homo sapiens
gccacagtgggatgaaccag

SEQ ID NO: 1640943 - DNA, 20 bp, Homo sapiens
gccacagtgtcactggtcag

SEQ ID NO: 1640944 - DNA, 15 bp, Homo sapiens
gccacatgccccagg

SEQ ID NO: 1640945 - DNA, 17 bp, Homo sapiens
gccacatgccgcgtccc

SEQ ID NO: 1640946 - DNA, 15 bp, Homo sapiens
gccacatggagcccc

SEQ ID NO: 1640947 - DNA, 16 bp, Homo sapiens
gccacatggagccccc

SEQ ID NO: 1640948 - DNA, 17 bp, Homo sapiens
gccacattgctggctgc

SEQ ID NO: 1640949 - DNA, 12 bp, Homo sapiens
gccacatttaat

SEQ ID NO: 1640950 - DNA, 14 bp, Homo sapiens
gccaccaaagctgc

SEQ ID NO: 1640951 - DNA, 15 bp, Homo sapiens
gccaccaaagctgcc

SEQ ID NO: 1640952 - DNA, 17 bp, Homo sapiens
gccaccaaagctgccca

SEQ ID NO: 1640953 - DNA, 20 bp, Homo sapiens
gccaccaaagctgcccactg

SEQ ID NO: 1640954 - DNA, 23 bp, Homo sapiens
gccaccaagtgaaaaatgttagg

SEQ ID NO: 1640955 - DNA, 14 bp, Homo sapiens
gccaccacccaccc

SEQ ID NO: 1640956 - DNA, 14 bp, Homo sapiens
gccaccacgtccag

SEQ ID NO: 1640957 - DNA, 16 bp, Homo sapiens
gccaccacgtctgcca

SEQ ID NO: 1640958 - DNA, 17 bp, Homo sapiens
gccactttcaagctgca

SEQ ID NO: 1640959 - DNA, 20 bp, Homo sapiens
gccactttggcttctcctgt

SEQ ID NO: 1640960 - DNA, 22 bp, Homo sapiens
gccactttggcttctcctgtga

SEQ ID NO: 1640961 - DNA, 16 bp, Homo sapiens
gccagaagagaattca

SEQ ID NO: 1640962 - DNA, 20 bp, Homo sapiens
gccagaagagcttgtcagca

SEQ ID NO: 1640963 - DNA, 16 bp, Homo sapiens
gccagaaggagggcag

SEQ ID NO: 1640964 - DNA, 17 bp, Homo sapiens
gccagaaggagggcaga

SEQ ID NO: 1640965 - DNA, 19 bp, Homo sapiens
gccagaaggagggcagagc

SEQ ID NO: 1640966 - DNA, 22 bp, Homo sapiens
gccagaaggagggcagagccat

SEQ ID NO: 1640967 - DNA, 23 bp, Homo sapiens
gccagaaggagggcagagccatg

SEQ ID NO: 1640968 - DNA, 18 bp, Homo sapiens
gccagaagtaccagacta

SEQ ID NO: 1640969 - DNA, 22 bp, Homo sapiens
gccagaagtcctccctcctgca

SEQ ID NO: 1640970 - DNA, 21 bp, Homo sapiens
gccagaagtttgtcaagtcaa

SEQ ID NO: 1640971 - DNA, 23 bp, Homo sapiens
gccagaatactgggttcttagtt

SEQ ID NO: 1640972 - DNA, 16 bp, Homo sapiens
gccagacacaggccct

SEQ ID NO: 1640973 - DNA, 14 bp, Homo sapiens
gccagacccactga

SEQ ID NO: 1640974 - DNA, 20 bp, Homo sapiens
gccagaccccacgctgacca

SEQ ID NO: 1640975 - DNA, 13 bp, Homo sapiens
gccagacctcaac

SEQ ID NO: 1640976 - DNA, 15 bp, Homo sapiens
gccagactggcacag

SEQ ID NO: 1640977 - DNA, 18 bp, Homo sapiens
gccagactggcacagttt

SEQ ID NO: 1640978 - DNA, 22 bp, Homo sapiens
gccagacttgcttcctgcatgg

SEQ ID NO: 1640979 - DNA, 16 bp, Homo sapiens
gccagagaagataatg

SEQ ID NO: 1640980 - DNA, 23 bp, Homo sapiens
gccagagaggagcacctgaaccc

SEQ ID NO: 1640981 - DNA, 18 bp, Homo sapiens
gccagagagggcccagct

SEQ ID NO: 1640982 - DNA, 24 bp, Homo sapiens
gccagagagggcccagctgtagcc

SEQ ID NO: 1640983 - DNA, 16 bp, Homo sapiens
gccagagcaggagccc

SEQ ID NO: 1640984 - DNA, 15 bp, Homo sapiens
gccagagccaacctg

SEQ ID NO: 1640985 - DNA, 18 bp, Homo sapiens
gccagagccaacctggac

SEQ ID NO: 1640986 - DNA, 12 bp, Homo sapiens
gccagagccagg

SEQ ID NO: 1640987 - DNA, 22 bp, Homo sapiens
gccagagcccttcactgccatg

SEQ ID NO: 1640988 - DNA, 15 bp, Homo sapiens
gccagagctggaagg

SEQ ID NO: 1640989 - DNA, 20 bp, Homo sapiens
gccagagctggaaggcaggg

SEQ ID NO: 1640990 - DNA, 13 bp, Homo sapiens
gccagagctgtgc

SEQ ID NO: 1640991 - DNA, 20 bp, Homo sapiens
gccagaggaatcctggcagc

SEQ ID NO: 1640992 - DNA, 22 bp, Homo sapiens
gccagaggaatcctggcagccc

SEQ ID NO: 1640993 - DNA, 23 bp, Homo sapiens
gccagaggaatcctggcagccca

SEQ ID NO: 1640994 - DNA, 13 bp, Homo sapiens
gccagaggagaag

SEQ ID NO: 1640995 - DNA, 23 bp, Homo sapiens
gccagaggatgctctttcccagg

SEQ ID NO: 1640996 - DNA, 13 bp, Homo sapiens
gccgctggctggt

SEQ ID NO: 1640997 - DNA, 22 bp, Homo sapiens
gccgctggctggtgggccccca

SEQ ID NO: 1640998 - DNA, 13 bp, Homo sapiens
gccgctgtctctg

SEQ ID NO: 1640999 - DNA, 15 bp, Homo sapiens
gccgctgtctctgag

SEQ ID NO: 1641000 - DNA, 16 bp, Homo sapiens
gccgctttctctgagg

SEQ ID NO: 1641001 - DNA, 23 bp, Homo sapiens
gccgctttctctgagggggtggg

SEQ ID NO: 1641002 - DNA, 14 bp, Homo sapiens
gccggacagctgcc

SEQ ID NO: 1641003 - DNA, 17 bp, Homo sapiens
gccggacagctgcccag

SEQ ID NO: 1641004 - DNA, 18 bp, Homo sapiens
gccggacagctgcccaga

SEQ ID NO: 1641005 - DNA, 14 bp, Homo sapiens
gccggacgcaggtg

SEQ ID NO: 1641006 - DNA, 14 bp, Homo sapiens
gccggagcccagat

SEQ ID NO: 1641007 - DNA, 13 bp, Homo sapiens
gccggagcctttg

SEQ ID NO: 1641008 - DNA, 21 bp, Homo sapiens
gccggcaaaactttggcactg

SEQ ID NO: 1641009 - DNA, 20 bp, Homo sapiens
gccggcacctacatccccag

SEQ ID NO: 1641010 - DNA, 22 bp, Homo sapiens
gccggcacctacatccccaggt

SEQ ID NO: 1641011 - DNA, 20 bp, Homo sapiens
gccggcatctcccctagctc

SEQ ID NO: 1641012 - DNA, 24 bp, Homo sapiens
gccggcatctcccctagctcacca

SEQ ID NO: 1641013 - DNA, 14 bp, Homo sapiens
gccggccctgtgtg

SEQ ID NO: 1641014 - DNA, 18 bp, Homo sapiens
gccggccctgtgtgcagg

SEQ ID NO: 1641015 - DNA, 16 bp, Homo sapiens
gccggcctctctggcc

SEQ ID NO: 1641016 - DNA, 18 bp, Homo sapiens
gccggcctctctggcctc

SEQ ID NO: 1641017 - DNA, 15 bp, Homo sapiens
gccggcctggcaccg

SEQ ID NO: 1641018 - DNA, 13 bp, Homo sapiens
gccggcggcctct

SEQ ID NO: 1641019 - DNA, 14 bp, Homo sapiens
gccggctctgggcc

SEQ ID NO: 1641020 - DNA, 12 bp, Homo sapiens
gccggctggtga

SEQ ID NO: 1641021 - DNA, 17 bp, Homo sapiens
gccggcttctgcctggg

SEQ ID NO: 1641022 - DNA, 21 bp, Homo sapiens
gcctccctctcagaggcctgc

SEQ ID NO: 1641023 - DNA, 23 bp, Homo sapiens
gcctccctctctcttctgctcca

SEQ ID NO: 1641024 - DNA, 20 bp, Homo sapiens
gcctccctggggaccaggag

SEQ ID NO: 1641025 - DNA, 22 bp, Homo sapiens
gcctccctggggaccaggagct

SEQ ID NO: 1641026 - DNA, 16 bp, Homo sapiens
gcctccctggtccctt

SEQ ID NO: 1641027 - DNA, 18 bp, Homo sapiens
gcctccctgtctccagct

SEQ ID NO: 1641028 - DNA, 21 bp, Homo sapiens
gcctccctgtctccagctgcc

SEQ ID NO: 1641029 - DNA, 20 bp, Homo sapiens
gcctccctgttgaagctctg

SEQ ID NO: 1641030 - DNA, 17 bp, Homo sapiens
gcctcccttccatgccc

SEQ ID NO: 1641031 - DNA, 14 bp, Homo sapiens
gcctcccttccgct

SEQ ID NO: 1641032 - DNA, 12 bp, Homo sapiens
gcctcccttctc

SEQ ID NO: 1641033 - DNA, 16 bp, Homo sapiens
gcctccgagagggaga

SEQ ID NO: 1641034 - DNA, 21 bp, Homo sapiens
gcctccgaggctccccgcctc

SEQ ID NO: 1641035 - DNA, 13 bp, Homo sapiens
gcctccgagggac

SEQ ID NO: 1641036 - DNA, 14 bp, Homo sapiens
gcctccgctgggct

SEQ ID NO: 1641037 - DNA, 12 bp, Homo sapiens
gcctccggcctc

SEQ ID NO: 1641038 - DNA, 19 bp, Homo sapiens
gcctccgtttatgggcctt

SEQ ID NO: 1641039 - DNA, 22 bp, Homo sapiens
gcctcctcacccaccctgtggc

SEQ ID NO: 1641040 - DNA, 23 bp, Homo sapiens
gcctcctcacccaccctgtggct

SEQ ID NO: 1641041 - DNA, 21 bp, Homo sapiens
gcctcctcacccccagctttg

SEQ ID NO: 1641042 - DNA, 15 bp, Homo sapiens
gcctcctcagtgaag

SEQ ID NO: 1641043 - DNA, 15 bp, Homo sapiens
gcctcctcatcccgt

SEQ ID NO: 1641044 - DNA, 17 bp, Homo sapiens
gcctcctcggagagcag

SEQ ID NO: 1641045 - DNA, 21 bp, Homo sapiens
gcctcctcggagagcagcagc

SEQ ID NO: 1641046 - DNA, 23 bp, Homo sapiens
gcctcctcggagagcagcagcac

SEQ ID NO: 1641047 - DNA, 17 bp, Homo sapiens
gcctcctctggacggca

SEQ ID NO: 1641048 - DNA, 23 bp, Homo sapiens
gcctcctgagtagctgggactac

SEQ ID NO: 1641049 - DNA, 13 bp, Homo sapiens
gcctcctgccacc

SEQ ID NO: 1641050 - DNA, 18 bp, Homo sapiens
gcctcctgccaccccttc

SEQ ID NO: 1641051 - DNA, 13 bp, Homo sapiens
gcctcctgcctcc

SEQ ID NO: 1641052 - DNA, 14 bp, Homo sapiens
gcctcctgcctgcc

SEQ ID NO: 1641053 - DNA, 14 bp, Homo sapiens
gcctcctggctcag

SEQ ID NO: 1641054 - DNA, 18 bp, Homo sapiens
gcctcctgttctgcccac

SEQ ID NO: 1641055 - DNA, 19 bp, Homo sapiens
gcctccttagaaaaaaaat

SEQ ID NO: 1641056 - DNA, 18 bp, Homo sapiens
gcctccttgtccaggtct

SEQ ID NO: 1641057 - DNA, 12 bp, Homo sapiens
gcctccttgtgc

SEQ ID NO: 1641058 - DNA, 23 bp, Homo sapiens
gcctccttgtgcaattgtctttt

SEQ ID NO: 1641059 - DNA, 14 bp, Homo sapiens
gcctcgaggcaccg

SEQ ID NO: 1641060 - DNA, 13 bp, Homo sapiens
gcctcgctccctt

SEQ ID NO: 1641061 - DNA, 15 bp, Homo sapiens
gcctcggagcctcat

SEQ ID NO: 1641062 - DNA, 23 bp, Homo sapiens
gcctcggagcctcatccgaggca

SEQ ID NO: 1641063 - DNA, 17 bp, Homo sapiens
gcctcggtatctggctt

SEQ ID NO: 1641064 - DNA, 18 bp, Homo sapiens
gcctcggtatctggcttc

SEQ ID NO: 1641065 - DNA, 14 bp, Homo sapiens
gcctcgtgccagca

SEQ ID NO: 1641066 - DNA, 20 bp, Homo sapiens
gcctcgttggaagaggaaca

SEQ ID NO: 1641067 - DNA, 14 bp, Homo sapiens
gcctcgttggagag

SEQ ID NO: 1641068 - DNA, 15 bp, Homo sapiens
gcctcgttggagagc

SEQ ID NO: 1641069 - DNA, 16 bp, Homo sapiens
gcctcgttggagagca

SEQ ID NO: 1641070 - DNA, 18 bp, Homo sapiens
gcctctaagagtgcccgt

SEQ ID NO: 1641071 - DNA, 17 bp, Homo sapiens
gcctctacagccgtccc

SEQ ID NO: 1641072 - DNA, 22 bp, Homo sapiens
gcctctagtccccaaggcctct

SEQ ID NO: 1641073 - DNA, 16 bp, Homo sapiens
gcctctcatcaactga

SEQ ID NO: 1641074 - DNA, 18 bp, Homo sapiens
gcctctcatcaactgaat

SEQ ID NO: 1641075 - DNA, 19 bp, Homo sapiens
gcctctcattccagaggaa

SEQ ID NO: 1641076 - DNA, 16 bp, Homo sapiens
gcctctccaaccactg

SEQ ID NO: 1641077 - DNA, 21 bp, Homo sapiens
gcctctccagtttgcacctgt

SEQ ID NO: 1641078 - DNA, 22 bp, Homo sapiens
gcctctccatttgctcttcaga

SEQ ID NO: 1641079 - DNA, 12 bp, Homo sapiens
gcctctcccacc

SEQ ID NO: 1641080 - DNA, 22 bp, Homo sapiens
gcctctcccacccggccacagc

SEQ ID NO: 1641081 - DNA, 18 bp, Homo sapiens
gcctctccccaggtccag

SEQ ID NO: 1641082 - DNA, 22 bp, Homo sapiens
gcctctccccaggtccagctct

SEQ ID NO: 1641083 - DNA, 23 bp, Homo sapiens
gcctctccccaggtccagctctg

SEQ ID NO: 1641084 - DNA, 15 bp, Homo sapiens
gcctctcccggctgc

SEQ ID NO: 1641085 - DNA, 16 bp, Homo sapiens
gcctctcccggctgcc

SEQ ID NO: 1641086 - DNA, 20 bp, Homo sapiens
gcctctcccggctgcctgcc

SEQ ID NO: 1641087 - DNA, 23 bp, Homo sapiens
gcctctcccggctgcctgccgcc

SEQ ID NO: 1641088 - DNA, 13 bp, Homo sapiens
gcctctcccgtca

SEQ ID NO: 1641089 - DNA, 23 bp, Homo sapiens
gcctctccctttagtggagccag

SEQ ID NO: 1641090 - DNA, 17 bp, Homo sapiens
gcctctcctgccctctg

SEQ ID NO: 1641091 - DNA, 19 bp, Homo sapiens
gcctctcctgccctctgct

SEQ ID NO: 1641092 - DNA, 21 bp, Homo sapiens
gcctctctatcctctcttcct

SEQ ID NO: 1641093 - DNA, 16 bp, Homo sapiens
gcctctctctccctcc

SEQ ID NO: 1641094 - DNA, 14 bp, Homo sapiens
gcctctctctgcct

SEQ ID NO: 1641095 - DNA, 14 bp, Homo sapiens
gcctctctgcctgg

SEQ ID NO: 1641096 - DNA, 14 bp, Homo sapiens
gcctctctgctata

SEQ ID NO: 1641097 - DNA, 17 bp, Homo sapiens
gcctctctggcctccca

SEQ ID NO: 1641098 - DNA, 20 bp, Homo sapiens
gcctctctggcctcccaccc

SEQ ID NO: 1641099 - DNA, 23 bp, Homo sapiens
gcctctctggcctcccacccgat

SEQ ID NO: 1641100 - DNA, 16 bp, Homo sapiens
gcctctgaaaagtgtg

SEQ ID NO: 1641101 - DNA, 13 bp, Homo sapiens
gcctctgaaaata

SEQ ID NO: 1641102 - DNA, 20 bp, Homo sapiens
gcctctgacagtccacaggg

SEQ ID NO: 1641103 - DNA, 19 bp, Homo sapiens
gcctctgagaagctctgaa

SEQ ID NO: 1641104 - DNA, 17 bp, Homo sapiens
gcctctgcaactgctca

SEQ ID NO: 1641105 - DNA, 21 bp, Homo sapiens
gcctctgcacaccctccagag

SEQ ID NO: 1641106 - DNA, 18 bp, Homo sapiens
gcctctgccaggcctgta

SEQ ID NO: 1641107 - DNA, 14 bp, Homo sapiens
gcctctgccctgga

SEQ ID NO: 1641108 - DNA, 12 bp, Homo sapiens
gcctctgcctgg

SEQ ID NO: 1641109 - DNA, 15 bp, Homo sapiens
gcctctgcctggggc

SEQ ID NO: 1641110 - DNA, 18 bp, Homo sapiens
gcctctgctgaatgcagg

SEQ ID NO: 1641111 - DNA, 11 bp, Homo sapiens
gcctctgctgc

SEQ ID NO: 1641112 - DNA, 15 bp, Homo sapiens
gcctctgctgccatg

SEQ ID NO: 1641113 - DNA, 17 bp, Homo sapiens
gcctctggaaagcaaag

SEQ ID NO: 1641114 - DNA, 19 bp, Homo sapiens
gcctctggccaggcatggc

SEQ ID NO: 1641115 - DNA, 11 bp, Homo sapiens
gcctctggccg

SEQ ID NO: 1641116 - DNA, 14 bp, Homo sapiens
gcctctggccgcca

SEQ ID NO: 1641117 - DNA, 18 bp, Homo sapiens
gcctctggctagaggcca

SEQ ID NO: 1641118 - DNA, 19 bp, Homo sapiens
gcctctggctagaggccag

SEQ ID NO: 1641119 - DNA, 22 bp, Homo sapiens
gcctctggctagaggccagccc

SEQ ID NO: 1641120 - DNA, 14 bp, Homo sapiens
gcctctgggactgg

SEQ ID NO: 1641121 - DNA, 22 bp, Homo sapiens
attcaaaacctgcagttaacag

SEQ ID NO: 1641122 - DNA, 20 bp, Homo sapiens
attcaaaaggtttttaaaag

SEQ ID NO: 1641123 - DNA, 14 bp, Homo sapiens
attcaaaagtattg

SEQ ID NO: 1641124 - DNA, 21 bp, Homo sapiens
attcaaaagtattgaaagcca

SEQ ID NO: 1641125 - DNA, 22 bp, Homo sapiens
attcaaaagtgattatctcttt

SEQ ID NO: 1641126 - DNA, 17 bp, Homo sapiens
attcaaaagttccaaga

SEQ ID NO: 1641127 - DNA, 21 bp, Homo sapiens
attcaaaagttccaagagtct

SEQ ID NO: 1641128 - DNA, 23 bp, Homo sapiens
attcaaaatagttctatttctat

SEQ ID NO: 1641129 - DNA, 21 bp, Homo sapiens
attcaaaattgacattgcttt

SEQ ID NO: 1641130 - DNA, 22 bp, Homo sapiens
attcaaaattgacattgcttta

SEQ ID NO: 1641131 - DNA, 14 bp, Homo sapiens
attcaaacagtctc

SEQ ID NO: 1641132 - DNA, 15 bp, Homo sapiens
attcaaacagtctca

SEQ ID NO: 1641133 - DNA, 16 bp, Homo sapiens
attcaaacagtctcag

SEQ ID NO: 1641134 - DNA, 22 bp, Homo sapiens
attcaaacagtctcaggaaatc

SEQ ID NO: 1641135 - DNA, 18 bp, Homo sapiens
attcaaactgaaaagctg

SEQ ID NO: 1641136 - DNA, 19 bp, Homo sapiens
gcctctgtgtagccgccct

SEQ ID NO: 1641137 - DNA, 21 bp, Homo sapiens
gcctctgttcctttctctggg

SEQ ID NO: 1641138 - DNA, 22 bp, Homo sapiens
gcctctgttcctttctctgggc

SEQ ID NO: 1641139 - DNA, 23 bp, Homo sapiens
gcctctgttcctttctctgggct

SEQ ID NO: 1641140 - DNA, 19 bp, Homo sapiens
gcctcttaccttcccgcct

SEQ ID NO: 1641141 - DNA, 14 bp, Homo sapiens
gcctcttagtgatt

SEQ ID NO: 1641142 - DNA, 21 bp, Homo sapiens
gcctcttattccaggagaagg

SEQ ID NO: 1641143 - DNA, 22 bp, Homo sapiens
gcctcttctgaagatggaaggc

SEQ ID NO: 1641144 - DNA, 15 bp, Homo sapiens
gcctcttctttgtgc

SEQ ID NO: 1641145 - DNA, 16 bp, Homo sapiens
gcctcttctttgtgcc

SEQ ID NO: 1641146 - DNA, 17 bp, Homo sapiens
gcctcttctttgtgcct

SEQ ID NO: 1641147 - DNA, 14 bp, Homo sapiens
gcctcttgaatttt

SEQ ID NO: 1641148 - DNA, 14 bp, Homo sapiens
gcctcttgaccagg

SEQ ID NO: 1641149 - DNA, 22 bp, Homo sapiens
gcctcttgaccaggctgcctcc

SEQ ID NO: 1641150 - DNA, 12 bp, Homo sapiens
gcctcttgtctt

SEQ ID NO: 1641151 - DNA, 17 bp, Homo sapiens
gcctcttgtgctcacgc

SEQ ID NO: 1641152 - DNA, 16 bp, Homo sapiens
gcctcttgtgtaacta

SEQ ID NO: 1641153 - DNA, 16 bp, Homo sapiens
gcctctttccctagga

SEQ ID NO: 1641154 - DNA, 18 bp, Homo sapiens
gcctctttgccccgactc

SEQ ID NO: 1641155 - DNA, 12 bp, Homo sapiens
gcctcttttctc

SEQ ID NO: 1641156 - DNA, 12 bp, Homo sapiens
gcctgaaaaggg

SEQ ID NO: 1641157 - DNA, 16 bp, Homo sapiens
gcctgaaagccacaat

SEQ ID NO: 1641158 - DNA, 20 bp, Homo sapiens
gcctgaacagaagctcttac

SEQ ID NO: 1641159 - DNA, 15 bp, Homo sapiens
gcctgaacatccttc

SEQ ID NO: 1641160 - DNA, 21 bp, Homo sapiens
gcctgaacctggggtcatcga

SEQ ID NO: 1641161 - DNA, 14 bp, Homo sapiens
gcctgaaccttcca

SEQ ID NO: 1641162 - DNA, 17 bp, Homo sapiens
gcctgaactcctgccat

SEQ ID NO: 1641163 - DNA, 13 bp, Homo sapiens
gcctgaagcctgg

SEQ ID NO: 1641164 - DNA, 19 bp, Homo sapiens
gcctgacctcaagcaacca

SEQ ID NO: 1641165 - DNA, 17 bp, Homo sapiens
gcctgactcctgggtgg

SEQ ID NO: 1641166 - DNA, 18 bp, Homo sapiens
gcctgagaatgagtggga

SEQ ID NO: 1641167 - DNA, 14 bp, Homo sapiens
gcctgagaggcagg

SEQ ID NO: 1641168 - DNA, 18 bp, Homo sapiens
gcctgagaggcaggcata

SEQ ID NO: 1641169 - DNA, 22 bp, Homo sapiens
gcctgagaggcaggcatagagg

SEQ ID NO: 1641170 - DNA, 21 bp, Homo sapiens
gcctgagagtatttaggcaga

SEQ ID NO: 1641171 - DNA, 17 bp, Homo sapiens
gcctgagatgcaggtga

SEQ ID NO: 1641172 - DNA, 22 bp, Homo sapiens
gcctgagatttcatctgctctc

SEQ ID NO: 1641173 - DNA, 22 bp, Homo sapiens
gcctgagcaacagagtgagacc

SEQ ID NO: 1641174 - DNA, 18 bp, Homo sapiens
gcctgagcacctcccagc

SEQ ID NO: 1641175 - DNA, 18 bp, Homo sapiens
gcctgagctggggccaca

SEQ ID NO: 1641176 - DNA, 19 bp, Homo sapiens
gcctgagctggggccacaa

SEQ ID NO: 1641177 - DNA, 10 bp, Homo sapiens
gcctgaggag

SEQ ID NO: 1641178 - DNA, 13 bp, Homo sapiens
gcctgaggaggag

SEQ ID NO: 1641179 - DNA, 21 bp, Homo sapiens
gcctgaggatgagctggaagg

SEQ ID NO: 1641180 - DNA, 14 bp, Homo sapiens
gcctgaggctgaga

SEQ ID NO: 1641181 - DNA, 17 bp, Homo sapiens
gcctgaggctgagactg

SEQ ID NO: 1641182 - DNA, 13 bp, Homo sapiens
gcctgaggctggg

SEQ ID NO: 1641183 - DNA, 14 bp, Homo sapiens
gcctgaggctggga

SEQ ID NO: 1641184 - DNA, 19 bp, Homo sapiens
gcctgagggcccctctgcc

SEQ ID NO: 1641185 - DNA, 13 bp, Homo sapiens
gcctgagggtcca

SEQ ID NO: 1641186 - DNA, 22 bp, Homo sapiens
gcctgagggtccacctggagag

SEQ ID NO: 1641187 - DNA, 14 bp, Homo sapiens
gcctgagggtggag

SEQ ID NO: 1641188 - DNA, 15 bp, Homo sapiens
gcctgagggtggaga

SEQ ID NO: 1641189 - DNA, 15 bp, Homo sapiens
gcctgagtcagtgct

SEQ ID NO: 1641190 - DNA, 22 bp, Homo sapiens
gcctgagtcagtgctctcagct

SEQ ID NO: 1641191 - DNA, 17 bp, Homo sapiens
gcctgagtgacagagcg

SEQ ID NO: 1641192 - DNA, 18 bp, Homo sapiens
gcctgagtgacagagcga

SEQ ID NO: 1641193 - DNA, 18 bp, Homo sapiens
gcctgatcaggcttcctg

SEQ ID NO: 1641194 - DNA, 14 bp, Homo sapiens
gcctgatccagcct

SEQ ID NO: 1641195 - DNA, 15 bp, Homo sapiens
gcctgatctgcccat

SEQ ID NO: 1641196 - DNA, 21 bp, Homo sapiens
gcctgatcttgcctgtctggc

SEQ ID NO: 1641197 - DNA, 20 bp, Homo sapiens
gcctgatgagatttttaaaa

SEQ ID NO: 1641198 - DNA, 17 bp, Homo sapiens
gcctgatgctgccccgt

SEQ ID NO: 1641199 - DNA, 17 bp, Homo sapiens
gcctgatggccaagggg

SEQ ID NO: 1641200 - DNA, 21 bp, Homo sapiens
gcctgcaaactcactgctcaa

SEQ ID NO: 1641201 - DNA, 14 bp, Homo sapiens
gcctgcaagagaat

SEQ ID NO: 1641202 - DNA, 15 bp, Homo sapiens
gcctgcacacacctg

SEQ ID NO: 1641203 - DNA, 18 bp, Homo sapiens
gcctgcacacacctgcct

SEQ ID NO: 1641204 - DNA, 20 bp, Homo sapiens
gcctgcacacacctgcctgc

SEQ ID NO: 1641205 - DNA, 12 bp, Homo sapiens
gcctgcaccagg

SEQ ID NO: 1641206 - DNA, 14 bp, Homo sapiens
gcctgcaccaggag

SEQ ID NO: 1641207 - DNA, 17 bp, Homo sapiens
gcctgcacccttccctc

SEQ ID NO: 1641208 - DNA, 18 bp, Homo sapiens
gcctgcacccttccctct

SEQ ID NO: 1641209 - DNA, 15 bp, Homo sapiens
gcctgcactccctgg

SEQ ID NO: 1641210 - DNA, 17 bp, Homo sapiens
gcctgcactccctggcc

SEQ ID NO: 1641211 - DNA, 21 bp, Homo sapiens
gcctgcactccctggccttgc

SEQ ID NO: 1641212 - DNA, 19 bp, Homo sapiens
gcctgcagaggtctgtgct

SEQ ID NO: 1641213 - DNA, 14 bp, Homo sapiens
gcctgcagcacatg

SEQ ID NO: 1641214 - DNA, 12 bp, Homo sapiens
gcctgcagggaa

SEQ ID NO: 1641215 - DNA, 22 bp, Homo sapiens
gcctgcagggaagccccacatg

SEQ ID NO: 1641216 - DNA, 19 bp, Homo sapiens
gcctgcagggaataacata

SEQ ID NO: 1641217 - DNA, 22 bp, Homo sapiens
gcctgcagtgattcagcaggcc

SEQ ID NO: 1641218 - DNA, 23 bp, Homo sapiens
gcctgcataggagtttggaggaa

SEQ ID NO: 1641219 - DNA, 17 bp, Homo sapiens
gcctgcatgagctggca

SEQ ID NO: 1641220 - DNA, 18 bp, Homo sapiens
gcctgcatgagctggcaa

SEQ ID NO: 1641221 - DNA, 19 bp, Homo sapiens
gcctgcatgagctggcaac

SEQ ID NO: 1641222 - DNA, 15 bp, Homo sapiens
gcctgcatgctgaaa

SEQ ID NO: 1641223 - DNA, 13 bp, Homo sapiens
gcctgcatggaga

SEQ ID NO: 1641224 - DNA, 15 bp, Homo sapiens
gcctgcatggagaag

SEQ ID NO: 1641225 - DNA, 16 bp, Homo sapiens
gcctgccaccggaggt

SEQ ID NO: 1641226 - DNA, 13 bp, Homo sapiens
gcctgccaccttc

SEQ ID NO: 1641227 - DNA, 21 bp, Homo sapiens
gcctgccactctctgggactc

SEQ ID NO: 1641228 - DNA, 12 bp, Homo sapiens
gcctgccatctt

SEQ ID NO: 1641229 - DNA, 18 bp, Homo sapiens
gcctgcccaatgctttgg

SEQ ID NO: 1641230 - DNA, 16 bp, Homo sapiens
gcctgcccagctgccg

SEQ ID NO: 1641231 - DNA, 18 bp, Homo sapiens
gcctgccctctgccccat

SEQ ID NO: 1641232 - DNA, 17 bp, Homo sapiens
gcctgccgcccaaagag

SEQ ID NO: 1641233 - DNA, 17 bp, Homo sapiens
gcctgccgcccccgcct

SEQ ID NO: 1641234 - DNA, 18 bp, Homo sapiens
gcctgccgcccccgcctg

SEQ ID NO: 1641235 - DNA, 14 bp, Homo sapiens
gcctgccgggctga

SEQ ID NO: 1641236 - DNA, 16 bp, Homo sapiens
gcctgccgtgcatggc

SEQ ID NO: 1641237 - DNA, 18 bp, Homo sapiens
gcctgcctccagggctgg

SEQ ID NO: 1641238 - DNA, 13 bp, Homo sapiens
gcctgcctcccac

SEQ ID NO: 1641239 - DNA, 19 bp, Homo sapiens
attcagtggcgagaaataa

SEQ ID NO: 1641240 - DNA, 15 bp, Homo sapiens
attcataaaaataac

SEQ ID NO: 1641241 - DNA, 16 bp, Homo sapiens
attcataaaaataacc

SEQ ID NO: 1641242 - DNA, 23 bp, Homo sapiens
attcataaaaataaccaaaaaat

SEQ ID NO: 1641243 - DNA, 15 bp, Homo sapiens
attcataaatacaaa

SEQ ID NO: 1641244 - DNA, 12 bp, Homo sapiens
attcataaatct

SEQ ID NO: 1641245 - DNA, 15 bp, Homo sapiens
attcataatgaatta

SEQ ID NO: 1641246 - DNA, 19 bp, Homo sapiens
attcataatgaattataac

SEQ ID NO: 1641247 - DNA, 14 bp, Homo sapiens
attcatatttactt

SEQ ID NO: 1641248 - DNA, 18 bp, Homo sapiens
attcatatttacttctta

SEQ ID NO: 1641249 - DNA, 13 bp, Homo sapiens
attcatatttgta

SEQ ID NO: 1641250 - DNA, 19 bp, Homo sapiens
attcatcctgggatgtaaa

SEQ ID NO: 1641251 - DNA, 16 bp, Homo sapiens
gcctgctagagcaacc

SEQ ID NO: 1641252 - DNA, 15 bp, Homo sapiens
gcctgctcagcagcc

SEQ ID NO: 1641253 - DNA, 16 bp, Homo sapiens
gcctgctcagcagcca

SEQ ID NO: 1641254 - DNA, 18 bp, Homo sapiens
gcctgctcagcagccagt

SEQ ID NO: 1641255 - DNA, 14 bp, Homo sapiens
gcctgctcatggcc

SEQ ID NO: 1641256 - DNA, 21 bp, Homo sapiens
gcctgctccagacctgatcct

SEQ ID NO: 1641257 - DNA, 15 bp, Homo sapiens
gcctgctcccagcag

SEQ ID NO: 1641258 - DNA, 16 bp, Homo sapiens
gcctgctcccagcagc

SEQ ID NO: 1641259 - DNA, 22 bp, Homo sapiens
gcctgctcccagcagccctaag

SEQ ID NO: 1641260 - DNA, 16 bp, Homo sapiens
gcctgctcccccaccc

SEQ ID NO: 1641261 - DNA, 17 bp, Homo sapiens
gcctgctcccccacccc

SEQ ID NO: 1641262 - DNA, 12 bp, Homo sapiens
gcctgctccctg

SEQ ID NO: 1641263 - DNA, 20 bp, Homo sapiens
gcctgctcctcactggagga

SEQ ID NO: 1641264 - DNA, 10 bp, Homo sapiens
gcctgctgca

SEQ ID NO: 1641265 - DNA, 11 bp, Homo sapiens
gcctgctgcat

SEQ ID NO: 1641266 - DNA, 21 bp, Homo sapiens
gcctgctgccagtgcagccac

SEQ ID NO: 1641267 - DNA, 17 bp, Homo sapiens
gcctgctggaagcccag

SEQ ID NO: 1641268 - DNA, 19 bp, Homo sapiens
gcctgctggaagcccagcc

SEQ ID NO: 1641269 - DNA, 13 bp, Homo sapiens
gcctgctggaggc

SEQ ID NO: 1641270 - DNA, 23 bp, Homo sapiens
gcctgctgggaaccccgcagccc

SEQ ID NO: 1641271 - DNA, 20 bp, Homo sapiens
gcctgctgggctctccacct

SEQ ID NO: 1641272 - DNA, 21 bp, Homo sapiens
gcctgctgggctctccacctc

SEQ ID NO: 1641273 - DNA, 22 bp, Homo sapiens
gcctgctgggctctccacctca

SEQ ID NO: 1641274 - DNA, 20 bp, Homo sapiens
gcctgctgtgttaagaggac

SEQ ID NO: 1641275 - DNA, 23 bp, Homo sapiens
gcctgcttccccctccccctcct

SEQ ID NO: 1641276 - DNA, 15 bp, Homo sapiens
gcctgcttggcccgg

SEQ ID NO: 1641277 - DNA, 16 bp, Homo sapiens
gcctgcttttccagga

SEQ ID NO: 1641278 - DNA, 18 bp, Homo sapiens
gcctgcttttccaggatc

SEQ ID NO: 1641279 - DNA, 22 bp, Homo sapiens
gcctgcttttccaggatcctgc

SEQ ID NO: 1641280 - DNA, 23 bp, Homo sapiens
gcctgcttttccaggatcctgca

SEQ ID NO: 1641281 - DNA, 17 bp, Homo sapiens
gcctggaaccagggagg

SEQ ID NO: 1641282 - DNA, 21 bp, Homo sapiens
gcctggaaccagggaggagag

SEQ ID NO: 1641283 - DNA, 22 bp, Homo sapiens
gcctggacagtatcccacatcc

SEQ ID NO: 1641284 - DNA, 11 bp, Homo sapiens
gcctggacctg

SEQ ID NO: 1641285 - DNA, 17 bp, Homo sapiens
gcctggacctgcctcct

SEQ ID NO: 1641286 - DNA, 22 bp, Homo sapiens
gcctggactctaagctggagct

SEQ ID NO: 1641287 - DNA, 23 bp, Homo sapiens
gcctggactctaagctggagctc

SEQ ID NO: 1641288 - DNA, 17 bp, Homo sapiens
gcctggactgaccacac

SEQ ID NO: 1641289 - DNA, 20 bp, Homo sapiens
gcctggactgactgcagccc

SEQ ID NO: 1641290 - DNA, 17 bp, Homo sapiens
gcctggagacttagggc

SEQ ID NO: 1641291 - DNA, 23 bp, Homo sapiens
gcctggagacttagggcaccagg

SEQ ID NO: 1641292 - DNA, 19 bp, Homo sapiens
gcctggagccctgggcgga

SEQ ID NO: 1641293 - DNA, 15 bp, Homo sapiens
gcctggagggacttt

SEQ ID NO: 1641294 - DNA, 14 bp, Homo sapiens
gcctggagggggag

SEQ ID NO: 1641295 - DNA, 14 bp, Homo sapiens
gcctggaggtctgg

SEQ ID NO: 1641296 - DNA, 24 bp, Homo sapiens
gcctggagtgtatgactgcacatg

SEQ ID NO: 1641297 - DNA, 23 bp, Homo sapiens
gcctggagtgtcggatcctgtga

SEQ ID NO: 1641298 - DNA, 18 bp, Homo sapiens
gcctggatccctgccctt

SEQ ID NO: 1641299 - DNA, 12 bp, Homo sapiens
gcctggatgaga

SEQ ID NO: 1641300 - DNA, 21 bp, Homo sapiens
gcctggatgagaaacagctca

SEQ ID NO: 1641301 - DNA, 22 bp, Homo sapiens
gcctggatgagaaacagctcag

SEQ ID NO: 1641302 - DNA, 16 bp, Homo sapiens
gcctggattcatttcc

SEQ ID NO: 1641303 - DNA, 19 bp, Homo sapiens
gcctggattcatttcctgc

SEQ ID NO: 1641304 - DNA, 14 bp, Homo sapiens
gcctggattccagc

SEQ ID NO: 1641305 - DNA, 18 bp, Homo sapiens
gcctggattccagcagtg

SEQ ID NO: 1641306 - DNA, 19 bp, Homo sapiens
gcctggattccagcagtga

SEQ ID NO: 1641307 - DNA, 19 bp, Homo sapiens
gcctggcaacagagcgaga

SEQ ID NO: 1641308 - DNA, 18 bp, Homo sapiens
gcctggcaagtgggtgaa

SEQ ID NO: 1641309 - DNA, 16 bp, Homo sapiens
gcctggcacaggactg

SEQ ID NO: 1641310 - DNA, 19 bp, Homo sapiens
gcctggcacagggcagtgg

SEQ ID NO: 1641311 - DNA, 21 bp, Homo sapiens
gcctggcagccgtgccttcag

SEQ ID NO: 1641312 - DNA, 22 bp, Homo sapiens
gcctggcagccgtgccttcagc

SEQ ID NO: 1641313 - DNA, 13 bp, Homo sapiens
gcctggcaggtgg

SEQ ID NO: 1641314 - DNA, 17 bp, Homo sapiens
gcctggcaggtggaact

SEQ ID NO: 1641315 - DNA, 16 bp, Homo sapiens
gcctggccacctctct

SEQ ID NO: 1641316 - DNA, 17 bp, Homo sapiens
gcctggccagacacagg

SEQ ID NO: 1641317 - DNA, 17 bp, Homo sapiens
gcctggccaggagcagg

SEQ ID NO: 1641318 - DNA, 19 bp, Homo sapiens
gcctggccaggagctcttc

SEQ ID NO: 1641319 - DNA, 17 bp, Homo sapiens
gcctggccaggcagatc

SEQ ID NO: 1641320 - DNA, 14 bp, Homo sapiens
gcctggccaggccc

SEQ ID NO: 1641321 - DNA, 18 bp, Homo sapiens
gcctggccagtcctggtc

SEQ ID NO: 1641322 - DNA, 14 bp, Homo sapiens
gcctggccagtctt

SEQ ID NO: 1641323 - DNA, 17 bp, Homo sapiens
gcctggccagtcttcct

SEQ ID NO: 1641324 - DNA, 19 bp, Homo sapiens
gcctggccagtcttcctct

SEQ ID NO: 1641325 - DNA, 10 bp, Homo sapiens
gcctggcccc

SEQ ID NO: 1641326 - DNA, 15 bp, Homo sapiens
gcctggccctcactc

SEQ ID NO: 1641327 - DNA, 19 bp, Homo sapiens
gcctggccctcactcaaga

SEQ ID NO: 1641328 - DNA, 14 bp, Homo sapiens
gcctggccggctcc

SEQ ID NO: 1641329 - DNA, 17 bp, Homo sapiens
gcctggccgttcagcct

SEQ ID NO: 1641330 - DNA, 19 bp, Homo sapiens
gcctggccgttcagcctgt

SEQ ID NO: 1641331 - DNA, 12 bp, Homo sapiens
gcctggcctcca

SEQ ID NO: 1641332 - DNA, 18 bp, Homo sapiens
gcctggcctccagctccc

SEQ ID NO: 1641333 - DNA, 14 bp, Homo sapiens
gcctggcctgagct

SEQ ID NO: 1641334 - DNA, 13 bp, Homo sapiens
gcctggcctggca

SEQ ID NO: 1641335 - DNA, 17 bp, Homo sapiens
gcctggctcccaggaca

SEQ ID NO: 1641336 - DNA, 12 bp, Homo sapiens
gcctggctcccc

SEQ ID NO: 1641337 - DNA, 14 bp, Homo sapiens
gcctggctctgccc

SEQ ID NO: 1641338 - DNA, 22 bp, Homo sapiens
gcctggctctgccccctccccc

SEQ ID NO: 1641339 - DNA, 16 bp, Homo sapiens
gcctggctgtggaggc

SEQ ID NO: 1641340 - DNA, 21 bp, Homo sapiens
gcctggctgtggaggcctgat

SEQ ID NO: 1641341 - DNA, 21 bp, Homo sapiens
gcctggcttacctatctgtgg

SEQ ID NO: 1641342 - DNA, 14 bp, Homo sapiens
gcctggcttctgga

SEQ ID NO: 1641343 - DNA, 15 bp, Homo sapiens
gcctggcttctggag

SEQ ID NO: 1641344 - DNA, 23 bp, Homo sapiens
gcctggcttctggagcccttggg

SEQ ID NO: 1641345 - DNA, 17 bp, Homo sapiens
gcctggcttgctccagg

SEQ ID NO: 1641346 - DNA, 18 bp, Homo sapiens
gcctggcttgctccaggg

SEQ ID NO: 1641347 - DNA, 19 bp, Homo sapiens
gcctggcttgctccagggt

SEQ ID NO: 1641348 - DNA, 18 bp, Homo sapiens
gcctgggaaataagcccc

SEQ ID NO: 1641349 - DNA, 15 bp, Homo sapiens
gcctgggactcccag

SEQ ID NO: 1641350 - DNA, 16 bp, Homo sapiens
gcctgggactcccagt

SEQ ID NO: 1641351 - DNA, 21 bp, Homo sapiens
gcctgggacttccatgcctta

SEQ ID NO: 1641352 - DNA, 16 bp, Homo sapiens
gcctgggagcccagag

SEQ ID NO: 1641353 - DNA, 21 bp, Homo sapiens
gcctgggagggttcccctggc

SEQ ID NO: 1641354 - DNA, 22 bp, Homo sapiens
gcctgggatctggcacactccc

SEQ ID NO: 1641355 - DNA, 12 bp, Homo sapiens
gcctgggcaaga

SEQ ID NO: 1641356 - DNA, 13 bp, Homo sapiens
gcctgggcagagg

SEQ ID NO: 1641357 - DNA, 22 bp, Homo sapiens
attcctggtttgactcagttcc

SEQ ID NO: 1641358 - DNA, 13 bp, Homo sapiens
attcctgtaaata

SEQ ID NO: 1641359 - DNA, 20 bp, Homo sapiens
attcctgttgaccttcccac

SEQ ID NO: 1641360 - DNA, 16 bp, Homo sapiens
attcctgttgctctgt

SEQ ID NO: 1641361 - DNA, 16 bp, Homo sapiens
attccttaaataaact

SEQ ID NO: 1641362 - DNA, 20 bp, Homo sapiens
attccttagcttagacctca

SEQ ID NO: 1641363 - DNA, 21 bp, Homo sapiens
attccttagcttagacctcag

SEQ ID NO: 1641364 - DNA, 23 bp, Homo sapiens
attccttagcttagacctcagcc

SEQ ID NO: 1641365 - DNA, 18 bp, Homo sapiens
atggaggactctcctctt

SEQ ID NO: 1641366 - DNA, 13 bp, Homo sapiens
atggaggagaaga

SEQ ID NO: 1641367 - DNA, 16 bp, Homo sapiens
atggaggatggagaga

SEQ ID NO: 1641368 - DNA, 12 bp, Homo sapiens
atggaggcaggg

SEQ ID NO: 1641369 - DNA, 14 bp, Homo sapiens
atggaggcttttca

SEQ ID NO: 1641370 - DNA, 16 bp, Homo sapiens
atggaggggggtgctg

SEQ ID NO: 1641371 - DNA, 18 bp, Homo sapiens
atggaggggtggtcctga

SEQ ID NO: 1641372 - DNA, 22 bp, Homo sapiens
atggaggggtggtcctgactca

SEQ ID NO: 1641373 - DNA, 13 bp, Homo sapiens
atggaggttctaa

SEQ ID NO: 1641374 - DNA, 17 bp, Homo sapiens
atggagtaatggtcacg

SEQ ID NO: 1641375 - DNA, 20 bp, Homo sapiens
atggagtcttttctgttatt

SEQ ID NO: 1641376 - DNA, 12 bp, Homo sapiens
atggagtgtgca

SEQ ID NO: 1641377 - DNA, 14 bp, Homo sapiens
atggagtgtgcaga

SEQ ID NO: 1641378 - DNA, 13 bp, Homo sapiens
atggagtttctaa

SEQ ID NO: 1641379 - DNA, 22 bp, Homo sapiens
atggataatgccggtgagaata

SEQ ID NO: 1641380 - DNA, 22 bp, Homo sapiens
atggatatagttttacttttaa

SEQ ID NO: 1641381 - DNA, 18 bp, Homo sapiens
atggatattattagaaat

SEQ ID NO: 1641382 - DNA, 20 bp, Homo sapiens
atggatcaaagaaattcaga

SEQ ID NO: 1641383 - DNA, 15 bp, Homo sapiens
atggatcaatacaca

SEQ ID NO: 1641384 - DNA, 12 bp, Homo sapiens
atggatctgatc

SEQ ID NO: 1641385 - DNA, 14 bp, Homo sapiens
atggatctgatctg

SEQ ID NO: 1641386 - DNA, 19 bp, Homo sapiens
atggatctgatctgtacca

SEQ ID NO: 1641387 - DNA, 13 bp, Homo sapiens
atggatgattcag

SEQ ID NO: 1641388 - DNA, 13 bp, Homo sapiens
atggatggcaccc

SEQ ID NO: 1641389 - DNA, 19 bp, Homo sapiens
atggatgggggaactcaga

SEQ ID NO: 1641390 - DNA, 21 bp, Homo sapiens
atggattccaaaccaggacac

SEQ ID NO: 1641391 - DNA, 18 bp, Homo sapiens
atggattgataattgcat

SEQ ID NO: 1641392 - DNA, 22 bp, Homo sapiens
atggattgattcagtcttctgg

SEQ ID NO: 1641393 - DNA, 19 bp, Homo sapiens
atggatttgatgctgtttg

SEQ ID NO: 1641394 - DNA, 15 bp, Homo sapiens
atggatttttcttta

SEQ ID NO: 1641395 - DNA, 16 bp, Homo sapiens
atggcaacagatctgg

SEQ ID NO: 1641396 - DNA, 17 bp, Homo sapiens
atggcaacagatctgga

SEQ ID NO: 1641397 - DNA, 23 bp, Homo sapiens
atggcaagggggtgtcatctgag

SEQ ID NO: 1641398 - DNA, 14 bp, Homo sapiens
atggcaagtgatat

SEQ ID NO: 1641399 - DNA, 22 bp, Homo sapiens
atggcaatcaaacattttctgg

SEQ ID NO: 1641400 - DNA, 16 bp, Homo sapiens
atggcaattttgtaac

SEQ ID NO: 1641401 - DNA, 14 bp, Homo sapiens
atggcaccagcccc

SEQ ID NO: 1641402 - DNA, 20 bp, Homo sapiens
atggcaccagccccctggat

SEQ ID NO: 1641403 - DNA, 21 bp, Homo sapiens
atggcaccttcagactttgct

SEQ ID NO: 1641404 - DNA, 16 bp, Homo sapiens
atggcagagccaggct

SEQ ID NO: 1641405 - DNA, 20 bp, Homo sapiens
atggcagagtttgtgtgttg

SEQ ID NO: 1641406 - DNA, 12 bp, Homo sapiens
atggcagcagcc

SEQ ID NO: 1641407 - DNA, 19 bp, Homo sapiens
atggcagcagccagggacc

SEQ ID NO: 1641408 - DNA, 14 bp, Homo sapiens
atggcagtccagcc

SEQ ID NO: 1641409 - DNA, 17 bp, Homo sapiens
atggcagtcctggaggc

SEQ ID NO: 1641410 - DNA, 18 bp, Homo sapiens
gccagaggcccccagccc

SEQ ID NO: 1641411 - DNA, 23 bp, Homo sapiens
gccagaggcccccagcccagggc

SEQ ID NO: 1641412 - DNA, 11 bp, Homo sapiens
gccagagggcc

SEQ ID NO: 1641413 - DNA, 13 bp, Homo sapiens
gccagagggccag

SEQ ID NO: 1641414 - DNA, 20 bp, Homo sapiens
gccagagggccagcaggctc

SEQ ID NO: 1641415 - DNA, 15 bp, Homo sapiens
gccagaggtgcttca

SEQ ID NO: 1641416 - DNA, 13 bp, Homo sapiens
gccagaggtggag

SEQ ID NO: 1641417 - DNA, 12 bp, Homo sapiens
gccagaggtggg

SEQ ID NO: 1641418 - DNA, 16 bp, Homo sapiens
gccagaggtgggcagg

SEQ ID NO: 1641419 - DNA, 22 bp, Homo sapiens
gccagaggtgggcaggtggtgg

SEQ ID NO: 1641420 - DNA, 17 bp, Homo sapiens
gccagagtcctttccaa

SEQ ID NO: 1641421 - DNA, 14 bp, Homo sapiens
gccagagtggcctg

SEQ ID NO: 1641422 - DNA, 22 bp, Homo sapiens
gccagagtggcctggccaggag

SEQ ID NO: 1641423 - DNA, 18 bp, Homo sapiens
gccagagttcctgcggag

SEQ ID NO: 1641424 - DNA, 21 bp, Homo sapiens
gccagatataactgtcttgtt

SEQ ID NO: 1641425 - DNA, 17 bp, Homo sapiens
gccagatccagcctggg

SEQ ID NO: 1641426 - DNA, 14 bp, Homo sapiens
gccagatcttaggt

SEQ ID NO: 1641427 - DNA, 16 bp, Homo sapiens
gccagatgatcaactc

SEQ ID NO: 1641428 - DNA, 18 bp, Homo sapiens
gccagatgcaggacagga

SEQ ID NO: 1641429 - DNA, 20 bp, Homo sapiens
gccagatgctaggctgtctg

SEQ ID NO: 1641430 - DNA, 18 bp, Homo sapiens
gccagatgttgttcctgg

SEQ ID NO: 1641431 - DNA, 16 bp, Homo sapiens
gccagattctcttgaa

SEQ ID NO: 1641432 - DNA, 19 bp, Homo sapiens
gccagcaacattggcacat

SEQ ID NO: 1641433 - DNA, 21 bp, Homo sapiens
gccagcacaccaagtggctgg

SEQ ID NO: 1641434 - DNA, 15 bp, Homo sapiens
gccagcacaggggcc

SEQ ID NO: 1641435 - DNA, 21 bp, Homo sapiens
gccagcacagtaggtcccggc

SEQ ID NO: 1641436 - DNA, 16 bp, Homo sapiens
gccagcaccacctaca

SEQ ID NO: 1641437 - DNA, 16 bp, Homo sapiens
gccagcacgcctggct

SEQ ID NO: 1641438 - DNA, 21 bp, Homo sapiens
gccagcactggaggggcccac

SEQ ID NO: 1641439 - DNA, 22 bp, Homo sapiens
gccagcactggaggggcccacc

SEQ ID NO: 1641440 - DNA, 19 bp, Homo sapiens
gccagcagcagcaggtgat

SEQ ID NO: 1641441 - DNA, 12 bp, Homo sapiens
gccagcagccag

SEQ ID NO: 1641442 - DNA, 15 bp, Homo sapiens
gccagcagcctcgca

SEQ ID NO: 1641443 - DNA, 23 bp, Homo sapiens
gccagcagcctcgcacaggccct

SEQ ID NO: 1641444 - DNA, 18 bp, Homo sapiens
gccagcagcgcgcaggcc

SEQ ID NO: 1641445 - DNA, 20 bp, Homo sapiens
gccagcagcgcgcaggcctg

SEQ ID NO: 1641446 - DNA, 19 bp, Homo sapiens
gccagcagctgtcagaaca

SEQ ID NO: 1641447 - DNA, 13 bp, Homo sapiens
gccagcaggctcc

SEQ ID NO: 1641448 - DNA, 16 bp, Homo sapiens
gccagcaggctcctgg

SEQ ID NO: 1641449 - DNA, 14 bp, Homo sapiens
gccagcaggggggc

SEQ ID NO: 1641450 - DNA, 19 bp, Homo sapiens
gccagcattcagcacacac

SEQ ID NO: 1641451 - DNA, 18 bp, Homo sapiens
gccagccaactctgggaa

SEQ ID NO: 1641452 - DNA, 9 bp, Homo sapiens
gccagccac

SEQ ID NO: 1641453 - DNA, 20 bp, Homo sapiens
gccagccacagacccctggg

SEQ ID NO: 1641454 - DNA, 21 bp, Homo sapiens
gccagccacagacccctggga

SEQ ID NO: 1641455 - DNA, 21 bp, Homo sapiens
gccagccacggggactcagcc

SEQ ID NO: 1641456 - DNA, 13 bp, Homo sapiens
gccagccagcagc

SEQ ID NO: 1641457 - DNA, 14 bp, Homo sapiens
gccagccagcagcc

SEQ ID NO: 1641458 - DNA, 11 bp, Homo sapiens
gccagccaggc

SEQ ID NO: 1641459 - DNA, 13 bp, Homo sapiens
gccagccaggcgg

SEQ ID NO: 1641460 - DNA, 21 bp, Homo sapiens
gccagccagtcttgcctaggc

SEQ ID NO: 1641461 - DNA, 17 bp, Homo sapiens
gccagcccagccaggcc

SEQ ID NO: 1641462 - DNA, 13 bp, Homo sapiens
gccagcccagccc

SEQ ID NO: 1641463 - DNA, 14 bp, Homo sapiens
gccagccccaccca

SEQ ID NO: 1641464 - DNA, 19 bp, Homo sapiens
gccagccccctccagctca

SEQ ID NO: 1641465 - DNA, 16 bp, Homo sapiens
gccagccccgctccca

SEQ ID NO: 1641466 - DNA, 22 bp, Homo sapiens
gccagcccggccgctccaccag

SEQ ID NO: 1641467 - DNA, 15 bp, Homo sapiens
gccagcccggctggt

SEQ ID NO: 1641468 - DNA, 10 bp, Homo sapiens
gccagccctc

SEQ ID NO: 1641469 - DNA, 20 bp, Homo sapiens
gccagccctccctggctgtg

SEQ ID NO: 1641470 - DNA, 23 bp, Homo sapiens
gccagccctccctgtcctcctcg

SEQ ID NO: 1641471 - DNA, 16 bp, Homo sapiens
gccagccggtgcctgg

SEQ ID NO: 1641472 - DNA, 17 bp, Homo sapiens
gccagcctcagtgccac

SEQ ID NO: 1641473 - DNA, 23 bp, Homo sapiens
gccagcctcagtgccacttgaca

SEQ ID NO: 1641474 - DNA, 18 bp, Homo sapiens
gccagcctccgagaggga

SEQ ID NO: 1641475 - DNA, 14 bp, Homo sapiens
gccagcctcctctg

SEQ ID NO: 1641476 - DNA, 15 bp, Homo sapiens
gccagcctcctctgg

SEQ ID NO: 1641477 - DNA, 16 bp, Homo sapiens
gccagcctcctctgga

SEQ ID NO: 1641478 - DNA, 20 bp, Homo sapiens
gccagcctggcttctggagc

SEQ ID NO: 1641479 - DNA, 21 bp, Homo sapiens
gccagcctgggactcccagtg

SEQ ID NO: 1641480 - DNA, 20 bp, Homo sapiens
atggctgggtccttgggcct

SEQ ID NO: 1641481 - DNA, 21 bp, Homo sapiens
atggctgggtccttgggcctg

SEQ ID NO: 1641482 - DNA, 20 bp, Homo sapiens
atggctgtctcaaaccaagc

SEQ ID NO: 1641483 - DNA, 21 bp, Homo sapiens
atggctgtggcatttccaaac

SEQ ID NO: 1641484 - DNA, 14 bp, Homo sapiens
atggcttaatgttt

SEQ ID NO: 1641485 - DNA, 16 bp, Homo sapiens
atggcttaatgtttat

SEQ ID NO: 1641486 - DNA, 15 bp, Homo sapiens
atggcttatttctat

SEQ ID NO: 1641487 - DNA, 22 bp, Homo sapiens
atggcttcttctagaatgtaaa

SEQ ID NO: 1641488 - DNA, 20 bp, Homo sapiens
atggcttgtctatactcctt

SEQ ID NO: 1641489 - DNA, 22 bp, Homo sapiens
atggctttcaatacccttttaa

SEQ ID NO: 1641490 - DNA, 17 bp, Homo sapiens
atggctttgtgattcaa

SEQ ID NO: 1641491 - DNA, 20 bp, Homo sapiens
atggcttttgctttccctga

SEQ ID NO: 1641492 - DNA, 19 bp, Homo sapiens
atgggaaaaaacttaaaaa

SEQ ID NO: 1641493 - DNA, 18 bp, Homo sapiens
atgggaaaactgccaata

SEQ ID NO: 1641494 - DNA, 18 bp, Homo sapiens
atgggaaaatatttcctg

SEQ ID NO: 1641495 - DNA, 18 bp, Homo sapiens
atgggaaagtattctctt

SEQ ID NO: 1641496 - DNA, 22 bp, Homo sapiens
atgggaaagtattctcttttca

SEQ ID NO: 1641497 - DNA, 21 bp, Homo sapiens
atgggaaagtattctgtactc

SEQ ID NO: 1641498 - DNA, 21 bp, Homo sapiens
atgggaacaaattagaggaga

SEQ ID NO: 1641499 - DNA, 23 bp, Homo sapiens
atgggaacagtaaagaaagcaga

SEQ ID NO: 1641500 - DNA, 16 bp, Homo sapiens
atgggaataattgctt

SEQ ID NO: 1641501 - DNA, 18 bp, Homo sapiens
atgggaatagggagacag

SEQ ID NO: 1641502 - DNA, 19 bp, Homo sapiens
atgggaatagggagacagg

SEQ ID NO: 1641503 - DNA, 15 bp, Homo sapiens
atgggaatttgtcag

SEQ ID NO: 1641504 - DNA, 16 bp, Homo sapiens
atgggagatggtcagt

SEQ ID NO: 1641505 - DNA, 17 bp, Homo sapiens
atgggagccagctgctt

SEQ ID NO: 1641506 - DNA, 12 bp, Homo sapiens
atgggagccagg

SEQ ID NO: 1641507 - DNA, 14 bp, Homo sapiens
atgggaggcagccg

SEQ ID NO: 1641508 - DNA, 18 bp, Homo sapiens
atgggaggcagccgaggc

SEQ ID NO: 1641509 - DNA, 22 bp, Homo sapiens
atgggagggggcttgaagccaa

SEQ ID NO: 1641510 - DNA, 23 bp, Homo sapiens
atgggagggggcttgaagccaaa

SEQ ID NO: 1641511 - DNA, 22 bp, Homo sapiens
atgggatggtcggatctcacag

SEQ ID NO: 1641512 - DNA, 23 bp, Homo sapiens
atgggcaactggctgaaaggtta

SEQ ID NO: 1641513 - DNA, 12 bp, Homo sapiens
atgggcagccca

SEQ ID NO: 1641514 - DNA, 16 bp, Homo sapiens
atgggcatcttttgta

SEQ ID NO: 1641515 - DNA, 21 bp, Homo sapiens
atgggcatcttttgtattaag

SEQ ID NO: 1641516 - DNA, 16 bp, Homo sapiens
atgggcattgggctga

SEQ ID NO: 1641517 - DNA, 19 bp, Homo sapiens
atgggcattgggctgacac

SEQ ID NO: 1641518 - DNA, 20 bp, Homo sapiens
atgggccctatgtctcagga

SEQ ID NO: 1641519 - DNA, 21 bp, Homo sapiens
atgggcctgcccaatgctttg

SEQ ID NO: 1641520 - DNA, 20 bp, Homo sapiens
atgggcctggccacctctct

SEQ ID NO: 1641521 - DNA, 11 bp, Homo sapiens
atgggcctggg

SEQ ID NO: 1641522 - DNA, 15 bp, Homo sapiens
atgggcctgggcctg

SEQ ID NO: 1641523 - DNA, 17 bp, Homo sapiens
atgggcctgggcctgct

SEQ ID NO: 1641524 - DNA, 15 bp, Homo sapiens
atgggccttgctttg

SEQ ID NO: 1641525 - DNA, 21 bp, Homo sapiens
atgggctagtgtgagtggcag

SEQ ID NO: 1641526 - DNA, 20 bp, Homo sapiens
atgggctcccaccctcccct

SEQ ID NO: 1641527 - DNA, 17 bp, Homo sapiens
atgggctgtgtcctaag

SEQ ID NO: 1641528 - DNA, 12 bp, Homo sapiens
gccaggcacagg

SEQ ID NO: 1641529 - DNA, 14 bp, Homo sapiens
gccaggcacagggc

SEQ ID NO: 1641530 - DNA, 17 bp, Homo sapiens
gccaggcacccatgtgg

SEQ ID NO: 1641531 - DNA, 14 bp, Homo sapiens
gccaggcacctggc

SEQ ID NO: 1641532 - DNA, 20 bp, Homo sapiens
gccaggcacctggcctgctg

SEQ ID NO: 1641533 - DNA, 22 bp, Homo sapiens
gccaggcacctggcctgctggg

SEQ ID NO: 1641534 - DNA, 14 bp, Homo sapiens
gccaggcagaggtt

SEQ ID NO: 1641535 - DNA, 21 bp, Homo sapiens
gccaggcagatctgtgcccca

SEQ ID NO: 1641536 - DNA, 23 bp, Homo sapiens
gccaggcagatctgtgccccatg

SEQ ID NO: 1641537 - DNA, 14 bp, Homo sapiens
gccaggcaggggtg

SEQ ID NO: 1641538 - DNA, 19 bp, Homo sapiens
gccaggcattggctcagcc

SEQ ID NO: 1641539 - DNA, 18 bp, Homo sapiens
gccaggcccatctcaggt

SEQ ID NO: 1641540 - DNA, 21 bp, Homo sapiens
gccaggcccatctcaggtgcc

SEQ ID NO: 1641541 - DNA, 23 bp, Homo sapiens
gccaggcccatctcaggtgccac

SEQ ID NO: 1641542 - DNA, 23 bp, Homo sapiens
gccaggcccgcaccccggcctca

SEQ ID NO: 1641543 - DNA, 15 bp, Homo sapiens
gccaggccctgggtc

SEQ ID NO: 1641544 - DNA, 16 bp, Homo sapiens
gccaggccgcgcccag

SEQ ID NO: 1641545 - DNA, 20 bp, Homo sapiens
gccaggccgcgcccagcaga

SEQ ID NO: 1641546 - DNA, 15 bp, Homo sapiens
gccaggcgttggtgc

SEQ ID NO: 1641547 - DNA, 17 bp, Homo sapiens
gccaggcgttggtgcca

SEQ ID NO: 1641548 - DNA, 20 bp, Homo sapiens
gccaggctccctttctcttc

SEQ ID NO: 1641549 - DNA, 21 bp, Homo sapiens
gccaggctcctacctgtctgc

SEQ ID NO: 1641550 - DNA, 18 bp, Homo sapiens
gccaggctgagtgagcca

SEQ ID NO: 1641551 - DNA, 16 bp, Homo sapiens
gccaggctgcacagca

SEQ ID NO: 1641552 - DNA, 19 bp, Homo sapiens
gccaggctgcctcctgccc

SEQ ID NO: 1641553 - DNA, 18 bp, Homo sapiens
gccaggctggagtgcagt

SEQ ID NO: 1641554 - DNA, 19 bp, Homo sapiens
gccaggctggagtgcagtg

SEQ ID NO: 1641555 - DNA, 14 bp, Homo sapiens
gccagggaacagcc

SEQ ID NO: 1641556 - DNA, 19 bp, Homo sapiens
gccagggaacagccccagg

SEQ ID NO: 1641557 - DNA, 15 bp, Homo sapiens
gccagggacccccag

SEQ ID NO: 1641558 - DNA, 15 bp, Homo sapiens
gccagggagaagctc

SEQ ID NO: 1641559 - DNA, 20 bp, Homo sapiens
gccagggagaagctcctctc

SEQ ID NO: 1641560 - DNA, 19 bp, Homo sapiens
gccagggatgggcagccca

SEQ ID NO: 1641561 - DNA, 13 bp, Homo sapiens
gccagggcagagg

SEQ ID NO: 1641562 - DNA, 15 bp, Homo sapiens
gccagggccacgctc

SEQ ID NO: 1641563 - DNA, 22 bp, Homo sapiens
gccagggccacgctccagctgc

SEQ ID NO: 1641564 - DNA, 13 bp, Homo sapiens
gccagggccctgc

SEQ ID NO: 1641565 - DNA, 17 bp, Homo sapiens
gccagggcctctccaac

SEQ ID NO: 1641566 - DNA, 20 bp, Homo sapiens
gccagggctcctgtggcagc

SEQ ID NO: 1641567 - DNA, 22 bp, Homo sapiens
gccagggctcctgtggcagctg

SEQ ID NO: 1641568 - DNA, 11 bp, Homo sapiens
gccagggctgg

SEQ ID NO: 1641569 - DNA, 15 bp, Homo sapiens
gccagggggatgcca

SEQ ID NO: 1641570 - DNA, 19 bp, Homo sapiens
gccaggggggtgaggagct

SEQ ID NO: 1641571 - DNA, 20 bp, Homo sapiens
gccaggggggtgaggagctg

SEQ ID NO: 1641572 - DNA, 18 bp, Homo sapiens
gccagggtgggaagagaa

SEQ ID NO: 1641573 - DNA, 20 bp, Homo sapiens
gccagggtgggaagagaaga

SEQ ID NO: 1641574 - DNA, 20 bp, Homo sapiens
gccagggtggtcttgatctc

SEQ ID NO: 1641575 - DNA, 21 bp, Homo sapiens
gccaggtaatgtgaataaatt

SEQ ID NO: 1641576 - DNA, 20 bp, Homo sapiens
gccaggtacaggagaggcag

SEQ ID NO: 1641577 - DNA, 21 bp, Homo sapiens
gccaggtacaggagaggcagc

SEQ ID NO: 1641578 - DNA, 22 bp, Homo sapiens
gccaggtcaccctttgctgtga

SEQ ID NO: 1641579 - DNA, 14 bp, Homo sapiens
gccaggtccctgga

SEQ ID NO: 1641580 - DNA, 21 bp, Homo sapiens
gccaggtccctggaccagcct

SEQ ID NO: 1641581 - DNA, 14 bp, Homo sapiens
gccaggtgcagacc

SEQ ID NO: 1641582 - DNA, 15 bp, Homo sapiens
gccaggtgcagacct

SEQ ID NO: 1641583 - DNA, 19 bp, Homo sapiens
gccaggtgcagaccttggg

SEQ ID NO: 1641584 - DNA, 14 bp, Homo sapiens
gccaggtgcagtgg

SEQ ID NO: 1641585 - DNA, 22 bp, Homo sapiens
gccaggtggttgtcttattgca

SEQ ID NO: 1641586 - DNA, 15 bp, Homo sapiens
gccaggttcctgtac

SEQ ID NO: 1641587 - DNA, 23 bp, Homo sapiens
gccaggttctccgttagctcctg

SEQ ID NO: 1641588 - DNA, 14 bp, Homo sapiens
gccaggttgcagct

SEQ ID NO: 1641589 - DNA, 17 bp, Homo sapiens
gccaggttgcagctgct

SEQ ID NO: 1641590 - DNA, 14 bp, Homo sapiens
gccaggttgctaag

SEQ ID NO: 1641591 - DNA, 22 bp, Homo sapiens
gccaggtttctgcccacattgg

SEQ ID NO: 1641592 - DNA, 21 bp, Homo sapiens
gccagtaaaaaaaaaaaatgg

SEQ ID NO: 1641593 - DNA, 16 bp, Homo sapiens
gccatccccagggggc

SEQ ID NO: 1641594 - DNA, 18 bp, Homo sapiens
gccatccccagggggcat

SEQ ID NO: 1641595 - DNA, 18 bp, Homo sapiens
gccatccctttttttaca

SEQ ID NO: 1641596 - DNA, 19 bp, Homo sapiens
gccatcctaaaagccaccc

SEQ ID NO: 1641597 - DNA, 15 bp, Homo sapiens
gccatccttctgtgt

SEQ ID NO: 1641598 - DNA, 15 bp, Homo sapiens
gccatctagccagcc

SEQ ID NO: 1641599 - DNA, 16 bp, Homo sapiens
gccatctagccagccc

SEQ ID NO: 1641600 - DNA, 17 bp, Homo sapiens
gccatctcaggagatgg

SEQ ID NO: 1641601 - DNA, 22 bp, Homo sapiens
gccatctcaggagatggagggc

SEQ ID NO: 1641602 - DNA, 18 bp, Homo sapiens
gccatctcatgaggggag

SEQ ID NO: 1641603 - DNA, 19 bp, Homo sapiens
gccatctcatgaggggaga

SEQ ID NO: 1641604 - DNA, 20 bp, Homo sapiens
gccatctcatgaggggagag

SEQ ID NO: 1641605 - DNA, 13 bp, Homo sapiens
gccatctgcccag

SEQ ID NO: 1641606 - DNA, 19 bp, Homo sapiens
gccatctgcccaggggtgc

SEQ ID NO: 1641607 - DNA, 19 bp, Homo sapiens
gccatctgtgtgcagcaac

SEQ ID NO: 1641608 - DNA, 13 bp, Homo sapiens
gccatcttcagga

SEQ ID NO: 1641609 - DNA, 14 bp, Homo sapiens
gccatcttcccagc

SEQ ID NO: 1641610 - DNA, 19 bp, Homo sapiens
gccatcttctccccgaggc

SEQ ID NO: 1641611 - DNA, 20 bp, Homo sapiens
gccatcttctccccgaggct

SEQ ID NO: 1641612 - DNA, 15 bp, Homo sapiens
gccatcttcttccct

SEQ ID NO: 1641613 - DNA, 12 bp, Homo sapiens
gccatgaacaaa

SEQ ID NO: 1641614 - DNA, 20 bp, Homo sapiens
gccatgaagtcaccgggatg

SEQ ID NO: 1641615 - DNA, 11 bp, Homo sapiens
gccatgaatta

SEQ ID NO: 1641616 - DNA, 20 bp, Homo sapiens
gccatgagttccagaaagta

SEQ ID NO: 1641617 - DNA, 16 bp, Homo sapiens
gccatgatcagacata

SEQ ID NO: 1641618 - DNA, 17 bp, Homo sapiens
gccatgatggcaacaga

SEQ ID NO: 1641619 - DNA, 19 bp, Homo sapiens
gccatgatggcaacagatc

SEQ ID NO: 1641620 - DNA, 23 bp, Homo sapiens
gccatgatggcaacagatctgga

SEQ ID NO: 1641621 - DNA, 22 bp, Homo sapiens
gccatgcaccaggactggctgt

SEQ ID NO: 1641622 - DNA, 23 bp, Homo sapiens
gccatgcagacctcatgcccagc

SEQ ID NO: 1641623 - DNA, 14 bp, Homo sapiens
gccatgccactgcc

SEQ ID NO: 1641624 - DNA, 16 bp, Homo sapiens
gccatgccactgccag

SEQ ID NO: 1641625 - DNA, 16 bp, Homo sapiens
gccatgccaggaacct

SEQ ID NO: 1641626 - DNA, 13 bp, Homo sapiens
gccatgcctcatg

SEQ ID NO: 1641627 - DNA, 15 bp, Homo sapiens
gccatgcctcatgcc

SEQ ID NO: 1641628 - DNA, 16 bp, Homo sapiens
gccatgcctcatgcca

SEQ ID NO: 1641629 - DNA, 13 bp, Homo sapiens
gccatgctgaggc

SEQ ID NO: 1641630 - DNA, 18 bp, Homo sapiens
gccatgctgaggcctggg

SEQ ID NO: 1641631 - DNA, 20 bp, Homo sapiens
gccatgctgaggcctgggcc

SEQ ID NO: 1641632 - DNA, 17 bp, Homo sapiens
gccatggcgtgtccctc

SEQ ID NO: 1641633 - DNA, 17 bp, Homo sapiens
gccatggctcaggcaag

SEQ ID NO: 1641634 - DNA, 18 bp, Homo sapiens
gccatggctcaggcaagc

SEQ ID NO: 1641635 - DNA, 21 bp, Homo sapiens
gccatgggcctgggcctgctt

SEQ ID NO: 1641636 - DNA, 16 bp, Homo sapiens
gccatggtaatcagaa

SEQ ID NO: 1641637 - DNA, 23 bp, Homo sapiens
gccatgtaaggttgtgcagggtg

SEQ ID NO: 1641638 - DNA, 22 bp, Homo sapiens
gccatgtctgagcggcgcagag

SEQ ID NO: 1641639 - DNA, 22 bp, Homo sapiens
gccatgtctgggaacagggacg

SEQ ID NO: 1641640 - DNA, 15 bp, Homo sapiens
gccatgtgaagaggg

SEQ ID NO: 1641641 - DNA, 17 bp, Homo sapiens
gccatgtgaagagggag

SEQ ID NO: 1641642 - DNA, 17 bp, Homo sapiens
gccatgtgctgcggtca

SEQ ID NO: 1641643 - DNA, 19 bp, Homo sapiens
gccatgttggccaggctgg

SEQ ID NO: 1641644 - DNA, 14 bp, Homo sapiens
gccatgtttagtga

SEQ ID NO: 1641645 - DNA, 18 bp, Homo sapiens
gccatgtttggttgtaaa

SEQ ID NO: 1641646 - DNA, 14 bp, Homo sapiens
gccattacccagtg

SEQ ID NO: 1641647 - DNA, 18 bp, Homo sapiens
gccattatgcaaatggag

SEQ ID NO: 1641648 - DNA, 14 bp, Homo sapiens
gccattattatgat

SEQ ID NO: 1641649 - DNA, 18 bp, Homo sapiens
gccattatttttgtagtt

SEQ ID NO: 1641650 - DNA, 16 bp, Homo sapiens
gccattccaaaatatt

SEQ ID NO: 1641651 - DNA, 15 bp, Homo sapiens
gccattctccccctc

SEQ ID NO: 1641652 - DNA, 14 bp, Homo sapiens
gccattgcactcca

SEQ ID NO: 1641653 - DNA, 20 bp, Homo sapiens
atggtctggcaatattctgt

SEQ ID NO: 1641654 - DNA, 15 bp, Homo sapiens
atggtcttacattgg

SEQ ID NO: 1641655 - DNA, 12 bp, Homo sapiens
atggtgaggctg

SEQ ID NO: 1641656 - DNA, 14 bp, Homo sapiens
atggtgatgactta

SEQ ID NO: 1641657 - DNA, 14 bp, Homo sapiens
atggtgattttaaa

SEQ ID NO: 1641658 - DNA, 19 bp, Homo sapiens
atggtgattttaaatgtgt

SEQ ID NO: 1641659 - DNA, 14 bp, Homo sapiens
atggtgccccagga

SEQ ID NO: 1641660 - DNA, 17 bp, Homo sapiens
atggtgccccaggacca

SEQ ID NO: 1641661 - DNA, 13 bp, Homo sapiens
atggtgcccctag

SEQ ID NO: 1641662 - DNA, 20 bp, Homo sapiens
atggtgcctatatctgagag

SEQ ID NO: 1641663 - DNA, 16 bp, Homo sapiens
atggtgcctgagaggc

SEQ ID NO: 1641664 - DNA, 17 bp, Homo sapiens
atggtgcctgagaggca

SEQ ID NO: 1641665 - DNA, 21 bp, Homo sapiens
atggtgcctgagaggcaggca

SEQ ID NO: 1641666 - DNA, 19 bp, Homo sapiens
atggtgctgcccaggcctc

SEQ ID NO: 1641667 - DNA, 14 bp, Homo sapiens
atggtgcttccccc

SEQ ID NO: 1641668 - DNA, 13 bp, Homo sapiens
atggtgcttcctt

SEQ ID NO: 1641669 - DNA, 23 bp, Homo sapiens
atggtggcgctttctcctgtgcc

SEQ ID NO: 1641670 - DNA, 22 bp, Homo sapiens
atggtggtattgtgaccactga

SEQ ID NO: 1641671 - DNA, 22 bp, Homo sapiens
atggtgtagaacactaattcat

SEQ ID NO: 1641672 - DNA, 12 bp, Homo sapiens
atggtgtatttt

SEQ ID NO: 1641673 - DNA, 18 bp, Homo sapiens
atggtgtgaacccgggag

SEQ ID NO: 1641674 - DNA, 18 bp, Homo sapiens
atggttaaaaaggccaaa

SEQ ID NO: 1641675 - DNA, 23 bp, Homo sapiens
atggttaagagtccaagaatcca

SEQ ID NO: 1641676 - DNA, 20 bp, Homo sapiens
atggttaatttttcctgcat

SEQ ID NO: 1641677 - DNA, 21 bp, Homo sapiens
atggttcagaattaaactttt

SEQ ID NO: 1641678 - DNA, 18 bp, Homo sapiens
atggttcccaataaaagt

SEQ ID NO: 1641679 - DNA, 20 bp, Homo sapiens
atggttcccctgttcactct

SEQ ID NO: 1641680 - DNA, 16 bp, Homo sapiens
atggttcttctccagt

SEQ ID NO: 1641681 - DNA, 16 bp, Homo sapiens
atggttgagaaatgaa

SEQ ID NO: 1641682 - DNA, 13 bp, Homo sapiens
atggttgatggaa

SEQ ID NO: 1641683 - DNA, 15 bp, Homo sapiens
atggttgatggaaaa

SEQ ID NO: 1641684 - DNA, 22 bp, Homo sapiens
atggttgatggaaaataaacat

SEQ ID NO: 1641685 - DNA, 17 bp, Homo sapiens
atggttgccaggacgaa

SEQ ID NO: 1641686 - DNA, 13 bp, Homo sapiens
atggttggtttta

SEQ ID NO: 1641687 - DNA, 17 bp, Homo sapiens
atggttgtagcatttaa

SEQ ID NO: 1641688 - DNA, 19 bp, Homo sapiens
atggtttatgcatgtatat

SEQ ID NO: 1641689 - DNA, 16 bp, Homo sapiens
atggtttattcccaag

SEQ ID NO: 1641690 - DNA, 12 bp, Homo sapiens
atggtttcctct

SEQ ID NO: 1641691 - DNA, 13 bp, Homo sapiens
atggtttcctctg

SEQ ID NO: 1641692 - DNA, 14 bp, Homo sapiens
atggtttcctctgg

SEQ ID NO: 1641693 - DNA, 15 bp, Homo sapiens
atggtttgatatgta

SEQ ID NO: 1641694 - DNA, 14 bp, Homo sapiens
atggttttcaaaat

SEQ ID NO: 1641695 - DNA, 13 bp, Homo sapiens
atgtaaaaaagaa

SEQ ID NO: 1641696 - DNA, 19 bp, Homo sapiens
atgtaaaaaagaaaaacac

SEQ ID NO: 1641697 - DNA, 23 bp, Homo sapiens
atgtaaaagaacttactgattat

SEQ ID NO: 1641698 - DNA, 13 bp, Homo sapiens
atgtaaaatcttg

SEQ ID NO: 1641699 - DNA, 14 bp, Homo sapiens
atgtaaaatcttgt

SEQ ID NO: 1641700 - DNA, 15 bp, Homo sapiens
atgtaaaatgaattg

SEQ ID NO: 1641701 - DNA, 13 bp, Homo sapiens
atgtaaaatgttt

SEQ ID NO: 1641702 - DNA, 14 bp, Homo sapiens
atgtaaaattcata

SEQ ID NO: 1641703 - DNA, 15 bp, Homo sapiens
atgtaaacaaatctt

SEQ ID NO: 1641704 - DNA, 23 bp, Homo sapiens
atgtaaacataattcttgtatat

SEQ ID NO: 1641705 - DNA, 16 bp, Homo sapiens
atgtaaaccattcgaa

SEQ ID NO: 1641706 - DNA, 16 bp, Homo sapiens
atgtaaaggagggaga

SEQ ID NO: 1641707 - DNA, 12 bp, Homo sapiens
atgtaaagttat

SEQ ID NO: 1641708 - DNA, 14 bp, Homo sapiens
atgtaaataaacta

SEQ ID NO: 1641709 - DNA, 17 bp, Homo sapiens
atgtaaataaactattt

SEQ ID NO: 1641710 - DNA, 19 bp, Homo sapiens
atgtaaatactttccatgt

SEQ ID NO: 1641711 - DNA, 14 bp, Homo sapiens
atgtaaatccccac

SEQ ID NO: 1641712 - DNA, 21 bp, Homo sapiens
atgtaacagccaggagtgtta

SEQ ID NO: 1641713 - DNA, 19 bp, Homo sapiens
gcccacccctcactcccca

SEQ ID NO: 1641714 - DNA, 20 bp, Homo sapiens
gcccacccgcccgagggatg

SEQ ID NO: 1641715 - DNA, 18 bp, Homo sapiens
gcccaccctgctgctggt

SEQ ID NO: 1641716 - DNA, 21 bp, Homo sapiens
gcccaccctgctgctggtgca

SEQ ID NO: 1641717 - DNA, 22 bp, Homo sapiens
gcccaccctgctgctggtgcac

SEQ ID NO: 1641718 - DNA, 12 bp, Homo sapiens
gcccaccctggg

SEQ ID NO: 1641719 - DNA, 14 bp, Homo sapiens
gcccaccctgggct

SEQ ID NO: 1641720 - DNA, 18 bp, Homo sapiens
gcccaccctgggctccac

SEQ ID NO: 1641721 - DNA, 19 bp, Homo sapiens
gcccaccctgggctccaca

SEQ ID NO: 1641722 - DNA, 14 bp, Homo sapiens
gcccacctgcccat

SEQ ID NO: 1641723 - DNA, 15 bp, Homo sapiens
gcccacctgcccatc

SEQ ID NO: 1641724 - DNA, 17 bp, Homo sapiens
gcccacctggccacctg

SEQ ID NO: 1641725 - DNA, 19 bp, Homo sapiens
gcccacctggccacctgag

SEQ ID NO: 1641726 - DNA, 21 bp, Homo sapiens
gcccacgatcccctcccccaa

SEQ ID NO: 1641727 - DNA, 18 bp, Homo sapiens
gcccacgcgcttccctgg

SEQ ID NO: 1641728 - DNA, 21 bp, Homo sapiens
gcccacgttctctctgcctgt

SEQ ID NO: 1641729 - DNA, 14 bp, Homo sapiens
gcccactagagggc

SEQ ID NO: 1641730 - DNA, 15 bp, Homo sapiens
gcccactagagggcc

SEQ ID NO: 1641731 - DNA, 18 bp, Homo sapiens
gcccactagagggcccat

SEQ ID NO: 1641732 - DNA, 18 bp, Homo sapiens
gcccactccccagcccca

SEQ ID NO: 1641733 - DNA, 22 bp, Homo sapiens
gcccactctgtaatagttcagt

SEQ ID NO: 1641734 - DNA, 18 bp, Homo sapiens
gcccactgcccaccccct

SEQ ID NO: 1641735 - DNA, 21 bp, Homo sapiens
gcccactgcctgcctcccctc

SEQ ID NO: 1641736 - DNA, 22 bp, Homo sapiens
gcccactgctcgtggactgtgc

SEQ ID NO: 1641737 - DNA, 13 bp, Homo sapiens
gcccactgctggc

SEQ ID NO: 1641738 - DNA, 13 bp, Homo sapiens
gcccactgtcctg

SEQ ID NO: 1641739 - DNA, 21 bp, Homo sapiens
gcccactgtcctgggcctgca

SEQ ID NO: 1641740 - DNA, 23 bp, Homo sapiens
gcccactgtgcctcagagaccag

SEQ ID NO: 1641741 - DNA, 18 bp, Homo sapiens
gcccacttgattgagaaa

SEQ ID NO: 1641742 - DNA, 17 bp, Homo sapiens
gcccactttcctgagct

SEQ ID NO: 1641743 - DNA, 19 bp, Homo sapiens
gcccactttcctgagctgt

SEQ ID NO: 1641744 - DNA, 18 bp, Homo sapiens
gcccagaaagcctctctc

SEQ ID NO: 1641745 - DNA, 19 bp, Homo sapiens
gcccagaaagcctctctct

SEQ ID NO: 1641746 - DNA, 16 bp, Homo sapiens
gcccagacccctctgg

SEQ ID NO: 1641747 - DNA, 12 bp, Homo sapiens
gcccagaccctg

SEQ ID NO: 1641748 - DNA, 15 bp, Homo sapiens
gcccagaccctgggc

SEQ ID NO: 1641749 - DNA, 16 bp, Homo sapiens
gcccagaccctgggca

SEQ ID NO: 1641750 - DNA, 17 bp, Homo sapiens
gcccagaccggcttctc

SEQ ID NO: 1641751 - DNA, 15 bp, Homo sapiens
gcccagactacaggg

SEQ ID NO: 1641752 - DNA, 10 bp, Homo sapiens
gcccagagac

SEQ ID NO: 1641753 - DNA, 12 bp, Homo sapiens
gcccagagactt

SEQ ID NO: 1641754 - DNA, 16 bp, Homo sapiens
gcccagagatgcctcc

SEQ ID NO: 1641755 - DNA, 19 bp, Homo sapiens
gcccagagatgcctccacc

SEQ ID NO: 1641756 - DNA, 22 bp, Homo sapiens
gcccagagatgcctccaccgct

SEQ ID NO: 1641757 - DNA, 15 bp, Homo sapiens
gcccagagccacctg

SEQ ID NO: 1641758 - DNA, 17 bp, Homo sapiens
gcccagagccacctgga

SEQ ID NO: 1641759 - DNA, 14 bp, Homo sapiens
gcccagagcccagc

SEQ ID NO: 1641760 - DNA, 15 bp, Homo sapiens
gcccagagcccagct

SEQ ID NO: 1641761 - DNA, 19 bp, Homo sapiens
gcccagagcctctgctgga

SEQ ID NO: 1641762 - DNA, 16 bp, Homo sapiens
gcccagaggagggcag

SEQ ID NO: 1641763 - DNA, 15 bp, Homo sapiens
gcccagagggcccag

SEQ ID NO: 1641764 - DNA, 21 bp, Homo sapiens
gcccagagggcccaggcaggc

SEQ ID NO: 1641765 - DNA, 14 bp, Homo sapiens
gcccagagttgctg

SEQ ID NO: 1641766 - DNA, 19 bp, Homo sapiens
gcccagagttgctgtgccg

SEQ ID NO: 1641767 - DNA, 17 bp, Homo sapiens
gcccagatacgggggct

SEQ ID NO: 1641768 - DNA, 12 bp, Homo sapiens
atgtagaaagct

SEQ ID NO: 1641769 - DNA, 18 bp, Homo sapiens
atgtagaactcagcagtt

SEQ ID NO: 1641770 - DNA, 14 bp, Homo sapiens
atgtagaactgttc

SEQ ID NO: 1641771 - DNA, 17 bp, Homo sapiens
atgtagaactgttcatt

SEQ ID NO: 1641772 - DNA, 23 bp, Homo sapiens
atgtagaacttcaagaagtaaga

SEQ ID NO: 1641773 - DNA, 18 bp, Homo sapiens
atgtagataaactcagaa

SEQ ID NO: 1641774 - DNA, 19 bp, Homo sapiens
atgtagataaactcagaaa

SEQ ID NO: 1641775 - DNA, 19 bp, Homo sapiens
atgtagataacaagacctc

SEQ ID NO: 1641776 - DNA, 22 bp, Homo sapiens
atgtagatattgtgaagtacat

SEQ ID NO: 1641777 - DNA, 13 bp, Homo sapiens
atgtagcacttac

SEQ ID NO: 1641778 - DNA, 22 bp, Homo sapiens
atgtagcacttacgtaaaacat

SEQ ID NO: 1641779 - DNA, 16 bp, Homo sapiens
atgtagccagctgtgc

SEQ ID NO: 1641780 - DNA, 13 bp, Homo sapiens
atgtagcccatcc

SEQ ID NO: 1641781 - DNA, 14 bp, Homo sapiens
atgtagctggtttc

SEQ ID NO: 1641782 - DNA, 23 bp, Homo sapiens
atgtaggagctgccttggctcag

SEQ ID NO: 1641783 - DNA, 22 bp, Homo sapiens
atgtaggggaagagatgtttac

SEQ ID NO: 1641784 - DNA, 23 bp, Homo sapiens
atgtaggggaagagatgtttaca

SEQ ID NO: 1641785 - DNA, 16 bp, Homo sapiens
atgtaggtatgaataa

SEQ ID NO: 1641786 - DNA, 15 bp, Homo sapiens
atgtagtaacactaa

SEQ ID NO: 1641787 - DNA, 16 bp, Homo sapiens
atgtagtaacactaat

SEQ ID NO: 1641788 - DNA, 16 bp, Homo sapiens
atgtagtataaagaaa

SEQ ID NO: 1641789 - DNA, 22 bp, Homo sapiens
atgtagtattttttgtataatt

SEQ ID NO: 1641790 - DNA, 15 bp, Homo sapiens
atgtagtcagttgca

SEQ ID NO: 1641791 - DNA, 21 bp, Homo sapiens
atgtagtgcatttttaaactt

SEQ ID NO: 1641792 - DNA, 15 bp, Homo sapiens
atgtagtttgaggaa

SEQ ID NO: 1641793 - DNA, 19 bp, Homo sapiens
atgtagtttgaggaaattt

SEQ ID NO: 1641794 - DNA, 14 bp, Homo sapiens
atgtataaaataca

SEQ ID NO: 1641795 - DNA, 15 bp, Homo sapiens
atgtataaaatacat

SEQ ID NO: 1641796 - DNA, 13 bp, Homo sapiens
atgtataaagatt

SEQ ID NO: 1641797 - DNA, 17 bp, Homo sapiens
atgtataaagattgtac

SEQ ID NO: 1641798 - DNA, 16 bp, Homo sapiens
atgtataaatatacag

SEQ ID NO: 1641799 - DNA, 18 bp, Homo sapiens
atgtataatatatatcta

SEQ ID NO: 1641800 - DNA, 13 bp, Homo sapiens
atgtatacttcag

SEQ ID NO: 1641801 - DNA, 17 bp, Homo sapiens
atgtatacttcagtgct

SEQ ID NO: 1641802 - DNA, 17 bp, Homo sapiens
atgtatataaacatgct

SEQ ID NO: 1641803 - DNA, 16 bp, Homo sapiens
atgtatatatctatta

SEQ ID NO: 1641804 - DNA, 16 bp, Homo sapiens
atgtatatgtatatat

SEQ ID NO: 1641805 - DNA, 21 bp, Homo sapiens
atgtatatttttgctaggagc

SEQ ID NO: 1641806 - DNA, 21 bp, Homo sapiens
atgtatatttttttaatttaa

SEQ ID NO: 1641807 - DNA, 13 bp, Homo sapiens
atgtatcaggaaa

SEQ ID NO: 1641808 - DNA, 21 bp, Homo sapiens
atgtatcaggaaatatatatg

SEQ ID NO: 1641809 - DNA, 17 bp, Homo sapiens
atgtatcagtgtccttt

SEQ ID NO: 1641810 - DNA, 16 bp, Homo sapiens
atgtatcatagaaatg

SEQ ID NO: 1641811 - DNA, 15 bp, Homo sapiens
atgtatctatttgta

SEQ ID NO: 1641812 - DNA, 19 bp, Homo sapiens
atgtatctatttgtacaat

SEQ ID NO: 1641813 - DNA, 15 bp, Homo sapiens
atgtatctgagcagg

SEQ ID NO: 1641814 - DNA, 14 bp, Homo sapiens
atgtatgattacat

SEQ ID NO: 1641815 - DNA, 17 bp, Homo sapiens
atgtatggatatatttg

SEQ ID NO: 1641816 - DNA, 18 bp, Homo sapiens
atgtatggatatatttga

SEQ ID NO: 1641817 - DNA, 19 bp, Homo sapiens
atgtatggatatatttgaa

SEQ ID NO: 1641818 - DNA, 21 bp, Homo sapiens
atgtatgggtagggtaaatca

SEQ ID NO: 1641819 - DNA, 13 bp, Homo sapiens
atgtatggtatct

SEQ ID NO: 1641820 - DNA, 12 bp, Homo sapiens
atgtatgtatca

SEQ ID NO: 1641821 - DNA, 12 bp, Homo sapiens
atgtatgtgtaa

SEQ ID NO: 1641822 - DNA, 12 bp, Homo sapiens
atgtatgtgtca

SEQ ID NO: 1641823 - DNA, 13 bp, Homo sapiens
atgtatgtgtgaa

SEQ ID NO: 1641824 - DNA, 17 bp, Homo sapiens
atgtatgtgtgaaacaa

SEQ ID NO: 1641825 - DNA, 13 bp, Homo sapiens
atgtatgttacca

SEQ ID NO: 1641826 - DNA, 12 bp, Homo sapiens
atgtatgtttac

SEQ ID NO: 1641827 - DNA, 12 bp, Homo sapiens
atgtattaaatt

SEQ ID NO: 1641828 - DNA, 16 bp, Homo sapiens
atgtattaaattacat

SEQ ID NO: 1641829 - DNA, 21 bp, Homo sapiens
atgtattaaattacatttgta

SEQ ID NO: 1641830 - DNA, 23 bp, Homo sapiens
atgtattaacactactcaaagca

SEQ ID NO: 1641831 - DNA, 15 bp, Homo sapiens
atgtattatgagcca

SEQ ID NO: 1641832 - DNA, 21 bp, Homo sapiens
gcccaggagtttgaggctgca

SEQ ID NO: 1641833 - DNA, 15 bp, Homo sapiens
gcccaggcaccacca

SEQ ID NO: 1641834 - DNA, 12 bp, Homo sapiens
gcccaggcaggt

SEQ ID NO: 1641835 - DNA, 13 bp, Homo sapiens
gcccaggcaggtc

SEQ ID NO: 1641836 - DNA, 17 bp, Homo sapiens
gcccaggcaggtctgca

SEQ ID NO: 1641837 - DNA, 19 bp, Homo sapiens
gcccaggctggagctggcc

SEQ ID NO: 1641838 - DNA, 18 bp, Homo sapiens
gcccagggccactctgcc

SEQ ID NO: 1641839 - DNA, 17 bp, Homo sapiens
gcccagggcccagagcc

SEQ ID NO: 1641840 - DNA, 18 bp, Homo sapiens
gcccagggcccagagccc

SEQ ID NO: 1641841 - DNA, 14 bp, Homo sapiens
gcccagggctcagc

SEQ ID NO: 1641842 - DNA, 16 bp, Homo sapiens
gcccagggctcagcct

SEQ ID NO: 1641843 - DNA, 18 bp, Homo sapiens
gcccagggctcagcctgg

SEQ ID NO: 1641844 - DNA, 18 bp, Homo sapiens
gcccagggctcctgcact

SEQ ID NO: 1641845 - DNA, 15 bp, Homo sapiens
gcccagggctgggag

SEQ ID NO: 1641846 - DNA, 16 bp, Homo sapiens
gcccagggggcctgga

SEQ ID NO: 1641847 - DNA, 18 bp, Homo sapiens
gcccagggggcctggagc

SEQ ID NO: 1641848 - DNA, 18 bp, Homo sapiens
gcccaggggtgccccctc

SEQ ID NO: 1641849 - DNA, 22 bp, Homo sapiens
gcccaggggtgccccctcctct

SEQ ID NO: 1641850 - DNA, 18 bp, Homo sapiens
gcccagggtcctgtgcct

SEQ ID NO: 1641851 - DNA, 17 bp, Homo sapiens
gcccagtagaccttgtt

SEQ ID NO: 1641852 - DNA, 17 bp, Homo sapiens
gcccagtccctggagct

SEQ ID NO: 1641853 - DNA, 24 bp, Homo sapiens
gcccagtccctggagctgtccttc

SEQ ID NO: 1641854 - DNA, 18 bp, Homo sapiens
gcccagtcctctcccaag

SEQ ID NO: 1641855 - DNA, 16 bp, Homo sapiens
gcccagtcgaccccaa

SEQ ID NO: 1641856 - DNA, 21 bp, Homo sapiens
gcccagtcgaccccaaaggaa

SEQ ID NO: 1641857 - DNA, 15 bp, Homo sapiens
gcccagtgaagcctc

SEQ ID NO: 1641858 - DNA, 20 bp, Homo sapiens
gcccagtgcatatgcaatgt

SEQ ID NO: 1641859 - DNA, 14 bp, Homo sapiens
gcccagtgcatggt

SEQ ID NO: 1641860 - DNA, 18 bp, Homo sapiens
gcccagtgccctggggct

SEQ ID NO: 1641861 - DNA, 16 bp, Homo sapiens
gcccagtggagcctgc

SEQ ID NO: 1641862 - DNA, 22 bp, Homo sapiens
gcccagtgtcaagttgtgcttg

SEQ ID NO: 1641863 - DNA, 18 bp, Homo sapiens
gcccagtgttgtttgtaa

SEQ ID NO: 1641864 - DNA, 23 bp, Homo sapiens
gcccagtgttgtttgtaaataag

SEQ ID NO: 1641865 - DNA, 21 bp, Homo sapiens
gcccagtgttttctttgagga

SEQ ID NO: 1641866 - DNA, 20 bp, Homo sapiens
gcccataatagttagccctc

SEQ ID NO: 1641867 - DNA, 16 bp, Homo sapiens
gcccataccttctggt

SEQ ID NO: 1641868 - DNA, 21 bp, Homo sapiens
gcccatagaaacatgacactg

SEQ ID NO: 1641869 - DNA, 22 bp, Homo sapiens
gcccatagaaacatgacactga

SEQ ID NO: 1641870 - DNA, 13 bp, Homo sapiens
gcccatcccagtc

SEQ ID NO: 1641871 - DNA, 15 bp, Homo sapiens
gcccatcccagtccc

SEQ ID NO: 1641872 - DNA, 15 bp, Homo sapiens
gcccatcctgaccag

SEQ ID NO: 1641873 - DNA, 18 bp, Homo sapiens
gcccatcctgaccagctg

SEQ ID NO: 1641874 - DNA, 20 bp, Homo sapiens
gcccatcgtgaagaagcctg

SEQ ID NO: 1641875 - DNA, 16 bp, Homo sapiens
gcccatctcaggtgcc

SEQ ID NO: 1641876 - DNA, 19 bp, Homo sapiens
gcccatgagcaagcctagg

SEQ ID NO: 1641877 - DNA, 17 bp, Homo sapiens
gcccatgcactggggac

SEQ ID NO: 1641878 - DNA, 14 bp, Homo sapiens
gcccatgcccacct

SEQ ID NO: 1641879 - DNA, 17 bp, Homo sapiens
gcccatggcccccaata

SEQ ID NO: 1641880 - DNA, 19 bp, Homo sapiens
gcccatggcccccaataaa

SEQ ID NO: 1641881 - DNA, 21 bp, Homo sapiens
gcccatggcccccaataaagg

SEQ ID NO: 1641882 - DNA, 14 bp, Homo sapiens
gcccatggcctctg

SEQ ID NO: 1641883 - DNA, 16 bp, Homo sapiens
atgtccctttcttggc

SEQ ID NO: 1641884 - DNA, 20 bp, Homo sapiens
atgtcctaaggacacactaa

SEQ ID NO: 1641885 - DNA, 19 bp, Homo sapiens
atgtcctaattcttctgtc

SEQ ID NO: 1641886 - DNA, 15 bp, Homo sapiens
atgtcctagacaggt

SEQ ID NO: 1641887 - DNA, 21 bp, Homo sapiens
atgtcctcagcatttcttttc

SEQ ID NO: 1641888 - DNA, 20 bp, Homo sapiens
atgtcctgcctattatctgt

SEQ ID NO: 1641889 - DNA, 13 bp, Homo sapiens
atgtcctgtcctg

SEQ ID NO: 1641890 - DNA, 13 bp, Homo sapiens
atgtccttattct

SEQ ID NO: 1641891 - DNA, 14 bp, Homo sapiens
atgtcgagagctgg

SEQ ID NO: 1641892 - DNA, 16 bp, Homo sapiens
atgtcgaggctagagg

SEQ ID NO: 1641893 - DNA, 16 bp, Homo sapiens
atgtcgtaggtaaact

SEQ ID NO: 1641894 - DNA, 20 bp, Homo sapiens
atgtcgtggacacacacaga

SEQ ID NO: 1641895 - DNA, 19 bp, Homo sapiens
atgtctaaatgctgaaaaa

SEQ ID NO: 1641896 - DNA, 16 bp, Homo sapiens
atgtctacctggcaga

SEQ ID NO: 1641897 - DNA, 20 bp, Homo sapiens
atgtctcaatagtaaaagat

SEQ ID NO: 1641898 - DNA, 23 bp, Homo sapiens
atgtctcaggtttgttttgtgaa

SEQ ID NO: 1641899 - DNA, 15 bp, Homo sapiens
atgtctcctttgctc

SEQ ID NO: 1641900 - DNA, 18 bp, Homo sapiens
atgtctcctttgctcttg

SEQ ID NO: 1641901 - DNA, 19 bp, Homo sapiens
atgtctcctttgctcttgc

SEQ ID NO: 1641902 - DNA, 16 bp, Homo sapiens
atgtctctcagaattc

SEQ ID NO: 1641903 - DNA, 17 bp, Homo sapiens
atgtctctcagaattct

SEQ ID NO: 1641904 - DNA, 21 bp, Homo sapiens
atgtctctcagaattcttcag

SEQ ID NO: 1641905 - DNA, 21 bp, Homo sapiens
atgtctctgtgagactcgaga

SEQ ID NO: 1641906 - DNA, 16 bp, Homo sapiens
atgtctcttgagcatc

SEQ ID NO: 1641907 - DNA, 13 bp, Homo sapiens
atgtctgaaacag

SEQ ID NO: 1641908 - DNA, 23 bp, Homo sapiens
atgtctgagatacgtctgtgact

SEQ ID NO: 1641909 - DNA, 21 bp, Homo sapiens
atgtctgagcggcgcagagcc

SEQ ID NO: 1641910 - DNA, 15 bp, Homo sapiens
atgtctgcagctcaa

SEQ ID NO: 1641911 - DNA, 14 bp, Homo sapiens
atgtctgccaattt

SEQ ID NO: 1641912 - DNA, 16 bp, Homo sapiens
atgtctgccaattttt

SEQ ID NO: 1641913 - DNA, 21 bp, Homo sapiens
atgtctgccaatttttgcctt

SEQ ID NO: 1641914 - DNA, 23 bp, Homo sapiens
atgtctgccaatttttgccttca

SEQ ID NO: 1641915 - DNA, 15 bp, Homo sapiens
atgtctgccatgttg

SEQ ID NO: 1641916 - DNA, 21 bp, Homo sapiens
atgtctgctgagttggcctgg

SEQ ID NO: 1641917 - DNA, 18 bp, Homo sapiens
atgtctgctggtatttct

SEQ ID NO: 1641918 - DNA, 20 bp, Homo sapiens
atgtctgctggtatttctaa

SEQ ID NO: 1641919 - DNA, 22 bp, Homo sapiens
atgtctgtatactcctgtcacc

SEQ ID NO: 1641920 - DNA, 9 bp, Homo sapiens
atgtctgtg

SEQ ID NO: 1641921 - DNA, 12 bp, Homo sapiens
atgtctgtgcta

SEQ ID NO: 1641922 - DNA, 20 bp, Homo sapiens
atgtctgtgctagggaaact

SEQ ID NO: 1641923 - DNA, 15 bp, Homo sapiens
atgtctgtgtatgta

SEQ ID NO: 1641924 - DNA, 16 bp, Homo sapiens
atgtctgttgatgact

SEQ ID NO: 1641925 - DNA, 17 bp, Homo sapiens
atgtctgtttttgtatc

SEQ ID NO: 1641926 - DNA, 20 bp, Homo sapiens
atgtcttggacactgtacaa

SEQ ID NO: 1641927 - DNA, 14 bp, Homo sapiens
atgtcttgtacatg

SEQ ID NO: 1641928 - DNA, 22 bp, Homo sapiens
atgtctttaggcagcagctttt

SEQ ID NO: 1641929 - DNA, 15 bp, Homo sapiens
atgtcttttgaatat

SEQ ID NO: 1641930 - DNA, 16 bp, Homo sapiens
atgtcttttgaatatt

SEQ ID NO: 1641931 - DNA, 13 bp, Homo sapiens
atgtgaaaaagga

SEQ ID NO: 1641932 - DNA, 14 bp, Homo sapiens
atgtgaaaaaggaa

SEQ ID NO: 1641933 - DNA, 13 bp, Homo sapiens
atgtgaaaaatta

SEQ ID NO: 1641934 - DNA, 15 bp, Homo sapiens
atgtgaaaaattaac

SEQ ID NO: 1641935 - DNA, 17 bp, Homo sapiens
atgtgaaaaattaactt

SEQ ID NO: 1641936 - DNA, 18 bp, Homo sapiens
atgtgaaaaattaacttt

SEQ ID NO: 1641937 - DNA, 19 bp, Homo sapiens
atgtgaaaaattaactttt

SEQ ID NO: 1641938 - DNA, 18 bp, Homo sapiens
atgtgaaaaggcaaaaag

SEQ ID NO: 1641939 - DNA, 16 bp, Homo sapiens
atgtgaaaatcaaata

SEQ ID NO: 1641940 - DNA, 12 bp, Homo sapiens
atgtgaaacatt

SEQ ID NO: 1641941 - DNA, 16 bp, Homo sapiens
atgtgaaaggaacatt

SEQ ID NO: 1641942 - DNA, 19 bp, Homo sapiens
atgtgaaattcatttgtgg

SEQ ID NO: 1641943 - DNA, 21 bp, Homo sapiens
atgtgaagcatgctttgctgc

SEQ ID NO: 1641944 - DNA, 23 bp, Homo sapiens
atgtgaagttcatcttgcagcat

SEQ ID NO: 1641945 - DNA, 15 bp, Homo sapiens
atgtgaatcagaccc

SEQ ID NO: 1641946 - DNA, 18 bp, Homo sapiens
atgtgaattattgacact

SEQ ID NO: 1641947 - DNA, 21 bp, Homo sapiens
atgtgaattattgacactgaa

SEQ ID NO: 1641948 - DNA, 17 bp, Homo sapiens
atgtgaatttttaagct

SEQ ID NO: 1641949 - DNA, 18 bp, Homo sapiens
atgtgaatttttaagctg

SEQ ID NO: 1641950 - DNA, 21 bp, Homo sapiens
atgtgaatttttaagctgcaa

SEQ ID NO: 1641951 - DNA, 19 bp, Homo sapiens
gccccaggaccagctcagg

SEQ ID NO: 1641952 - DNA, 22 bp, Homo sapiens
gccccaggaccagctcaggaca

SEQ ID NO: 1641953 - DNA, 24 bp, Homo sapiens
gccccaggaccagctcaggacaga

SEQ ID NO: 1641954 - DNA, 17 bp, Homo sapiens
gccccaggccctactac

SEQ ID NO: 1641955 - DNA, 14 bp, Homo sapiens
gccccaggccggag

SEQ ID NO: 1641956 - DNA, 20 bp, Homo sapiens
gccccaggccggagcccaga

SEQ ID NO: 1641957 - DNA, 19 bp, Homo sapiens
gccccaggctgagagccag

SEQ ID NO: 1641958 - DNA, 12 bp, Homo sapiens
gccccagggcct

SEQ ID NO: 1641959 - DNA, 19 bp, Homo sapiens
gccccaggggcagcaaggc

SEQ ID NO: 1641960 - DNA, 16 bp, Homo sapiens
gccccagtagtcagaa

SEQ ID NO: 1641961 - DNA, 19 bp, Homo sapiens
gccccagtgcggttcctca

SEQ ID NO: 1641962 - DNA, 20 bp, Homo sapiens
gccccatcattgcacctgca

SEQ ID NO: 1641963 - DNA, 22 bp, Homo sapiens
gccccatcattgcacctgcagg

SEQ ID NO: 1641964 - DNA, 23 bp, Homo sapiens
gccccatcattgcacctgcaggc

SEQ ID NO: 1641965 - DNA, 16 bp, Homo sapiens
gccccatcggccaaga

SEQ ID NO: 1641966 - DNA, 14 bp, Homo sapiens
gccccatctcatcc

SEQ ID NO: 1641967 - DNA, 20 bp, Homo sapiens
gccccatctcatcctggcac

SEQ ID NO: 1641968 - DNA, 13 bp, Homo sapiens
gccccatgctctg

SEQ ID NO: 1641969 - DNA, 16 bp, Homo sapiens
gccccatgctctgccc

SEQ ID NO: 1641970 - DNA, 16 bp, Homo sapiens
gccccatgtctctcag

SEQ ID NO: 1641971 - DNA, 18 bp, Homo sapiens
gcccccaaattgccttca

SEQ ID NO: 1641972 - DNA, 19 bp, Homo sapiens
gcccccaaattgccttcag

SEQ ID NO: 1641973 - DNA, 21 bp, Homo sapiens
gcccccaaattgccttcagcc

SEQ ID NO: 1641974 - DNA, 23 bp, Homo sapiens
gcccccaaattgccttcagccct

SEQ ID NO: 1641975 - DNA, 23 bp, Homo sapiens
gcccccaaccccgcggtgctctg

SEQ ID NO: 1641976 - DNA, 16 bp, Homo sapiens
gcccccaacctcaggg

SEQ ID NO: 1641977 - DNA, 17 bp, Homo sapiens
gcccccaacctcagggc

SEQ ID NO: 1641978 - DNA, 23 bp, Homo sapiens
gcccccaacctcagggctcccag

SEQ ID NO: 1641979 - DNA, 16 bp, Homo sapiens
gcccccaataaaggca

SEQ ID NO: 1641980 - DNA, 18 bp, Homo sapiens
gcccccaataaaggcagc

SEQ ID NO: 1641981 - DNA, 23 bp, Homo sapiens
gcccccacaatggtcccaaacag

SEQ ID NO: 1641982 - DNA, 12 bp, Homo sapiens
gcccccaccagg

SEQ ID NO: 1641983 - DNA, 12 bp, Homo sapiens
gcccccacccct

SEQ ID NO: 1641984 - DNA, 20 bp, Homo sapiens
gcccccaccccttccccagg

SEQ ID NO: 1641985 - DNA, 21 bp, Homo sapiens
gcccccaccccttccccaggc

SEQ ID NO: 1641986 - DNA, 17 bp, Homo sapiens
gcccccactgaccagaa

SEQ ID NO: 1641987 - DNA, 14 bp, Homo sapiens
gcccccacttgcct

SEQ ID NO: 1641988 - DNA, 17 bp, Homo sapiens
gcccccacttgcctctt

SEQ ID NO: 1641989 - DNA, 17 bp, Homo sapiens
gcccccagcccagggct

SEQ ID NO: 1641990 - DNA, 20 bp, Homo sapiens
gcccccagccccggggtgag

SEQ ID NO: 1641991 - DNA, 15 bp, Homo sapiens
gcccccagccctggg

SEQ ID NO: 1641992 - DNA, 18 bp, Homo sapiens
gcccccagccctgggaac

SEQ ID NO: 1641993 - DNA, 17 bp, Homo sapiens
gcccccagcctgtaggg

SEQ ID NO: 1641994 - DNA, 21 bp, Homo sapiens
gcccccagctaagaacctgga

SEQ ID NO: 1641995 - DNA, 22 bp, Homo sapiens
gcccccagctaagaacctggaa

SEQ ID NO: 1641996 - DNA, 18 bp, Homo sapiens
gcccccaggattccccca

SEQ ID NO: 1641997 - DNA, 19 bp, Homo sapiens
atgtgctagaacaatggga

SEQ ID NO: 1641998 - DNA, 19 bp, Homo sapiens
atgtgctatactgcatact

SEQ ID NO: 1641999 - DNA, 15 bp, Homo sapiens
atgtgctatgcaaaa

SEQ ID NO: 1642000 - DNA, 21 bp, Homo sapiens
atgtgctatgcaaaatagaca

SEQ ID NO: 1642001 - DNA, 21 bp, Homo sapiens
atgtgctcagccaaatttcct

SEQ ID NO: 1642002 - DNA, 13 bp, Homo sapiens
atgtgctttgctg

SEQ ID NO: 1642003 - DNA, 16 bp, Homo sapiens
atgtgcttttctccaa

SEQ ID NO: 1642004 - DNA, 17 bp, Homo sapiens
atgtgcttttctccaat

SEQ ID NO: 1642005 - DNA, 13 bp, Homo sapiens
atgtggaaaacag

SEQ ID NO: 1642006 - DNA, 18 bp, Homo sapiens
atgtggacttgtatgctg

SEQ ID NO: 1642007 - DNA, 17 bp, Homo sapiens
atgtggaggaagagcca

SEQ ID NO: 1642008 - DNA, 14 bp, Homo sapiens
atgtggccccaccc

SEQ ID NO: 1642009 - DNA, 18 bp, Homo sapiens
atgtggcccctgaacaag

SEQ ID NO: 1642010 - DNA, 16 bp, Homo sapiens
atgtggccgaggactt

SEQ ID NO: 1642011 - DNA, 20 bp, Homo sapiens
atgtggctgaaaatgcaaag

SEQ ID NO: 1642012 - DNA, 13 bp, Homo sapiens
atgtggctggaag

SEQ ID NO: 1642013 - DNA, 20 bp, Homo sapiens
atgtggctggaagatcctgc

SEQ ID NO: 1642014 - DNA, 22 bp, Homo sapiens
atgtggctgtaatgacaaaaga

SEQ ID NO: 1642015 - DNA, 13 bp, Homo sapiens
atgtggggccagg

SEQ ID NO: 1642016 - DNA, 21 bp, Homo sapiens
atgtgggtaagaggagcagag

SEQ ID NO: 1642017 - DNA, 15 bp, Homo sapiens
atgtgggtgagccag

SEQ ID NO: 1642018 - DNA, 13 bp, Homo sapiens
atgtgggtggaga

SEQ ID NO: 1642019 - DNA, 19 bp, Homo sapiens
atgtgggtggcttctagtt

SEQ ID NO: 1642020 - DNA, 20 bp, Homo sapiens
atgtgggttatacacatgga

SEQ ID NO: 1642021 - DNA, 22 bp, Homo sapiens
atgtggtggcacaggccccctt

SEQ ID NO: 1642022 - DNA, 15 bp, Homo sapiens
atgtggttacacact

SEQ ID NO: 1642023 - DNA, 23 bp, Homo sapiens
atgtggttacttcctactgtagg

SEQ ID NO: 1642024 - DNA, 22 bp, Homo sapiens
atgtgtaacacagtgccttcaa

SEQ ID NO: 1642025 - DNA, 23 bp, Homo sapiens
atgtgtacagtgaattgtctttt

SEQ ID NO: 1642026 - DNA, 15 bp, Homo sapiens
atgtgtacatatatg

SEQ ID NO: 1642027 - DNA, 16 bp, Homo sapiens
atgtgtacatggcaga

SEQ ID NO: 1642028 - DNA, 17 bp, Homo sapiens
atgtgtagcctgtgcat

SEQ ID NO: 1642029 - DNA, 21 bp, Homo sapiens
atgtgtagctgcaaaaataat

SEQ ID NO: 1642030 - DNA, 20 bp, Homo sapiens
atgtgtagggaaagttaaaa

SEQ ID NO: 1642031 - DNA, 19 bp, Homo sapiens
atgtgtatgcacagtaaaa

SEQ ID NO: 1642032 - DNA, 20 bp, Homo sapiens
atgtgtatgtacgtttgtat

SEQ ID NO: 1642033 - DNA, 20 bp, Homo sapiens
atgtgtatttccagtgcaat

SEQ ID NO: 1642034 - DNA, 17 bp, Homo sapiens
atgtgtattttattaca

SEQ ID NO: 1642035 - DNA, 20 bp, Homo sapiens
atgtgtatttttcaaggcat

SEQ ID NO: 1642036 - DNA, 14 bp, Homo sapiens
atgtgtgaaacaat

SEQ ID NO: 1642037 - DNA, 18 bp, Homo sapiens
atgtgtgaattctgcaac

SEQ ID NO: 1642038 - DNA, 18 bp, Homo sapiens
atgtgtgacccttgtcat

SEQ ID NO: 1642039 - DNA, 22 bp, Homo sapiens
atgtgtgaggagctgctggctt

SEQ ID NO: 1642040 - DNA, 22 bp, Homo sapiens
atgtgtgcaacagggtatggac

SEQ ID NO: 1642041 - DNA, 15 bp, Homo sapiens
atgtgtgcctgtggc

SEQ ID NO: 1642042 - DNA, 17 bp, Homo sapiens
atgtgtgcctgtggcag

SEQ ID NO: 1642043 - DNA, 18 bp, Homo sapiens
atgtgtgcctgtggcaga

SEQ ID NO: 1642044 - DNA, 19 bp, Homo sapiens
atgtgtggctcattctttt

SEQ ID NO: 1642045 - DNA, 19 bp, Homo sapiens
atgtgtggctgtgggtgtg

SEQ ID NO: 1642046 - DNA, 13 bp, Homo sapiens
atgtgtgtgcatg

SEQ ID NO: 1642047 - DNA, 10 bp, Homo sapiens
atgtgtgtgt

SEQ ID NO: 1642048 - DNA, 22 bp, Homo sapiens
atgtgtgtgtatataaatacat

SEQ ID NO: 1642049 - DNA, 15 bp, Homo sapiens
atgtgtgtgtatgtt

SEQ ID NO: 1642050 - DNA, 14 bp, Homo sapiens
atgtgtgtgtctgt

SEQ ID NO: 1642051 - DNA, 21 bp, Homo sapiens
atgtgttatagacggtgctca

SEQ ID NO: 1642052 - DNA, 20 bp, Homo sapiens
atgtgttctcggagtgtgta

SEQ ID NO: 1642053 - DNA, 19 bp, Homo sapiens
atgtgttgcaaattattct

SEQ ID NO: 1642054 - DNA, 23 bp, Homo sapiens
atgtgttgcaaattattctagtc

SEQ ID NO: 1642055 - DNA, 22 bp, Homo sapiens
atgtgttggggaagggcctgcc

SEQ ID NO: 1642056 - DNA, 12 bp, Homo sapiens
atgtgtttcaaa

SEQ ID NO: 1642057 - DNA, 15 bp, Homo sapiens
atgtgttttgcacgt

SEQ ID NO: 1642058 - DNA, 16 bp, Homo sapiens
atgtgttttgcacgtc

SEQ ID NO: 1642059 - DNA, 23 bp, Homo sapiens
atgtgttttgcacgtcttgctat

SEQ ID NO: 1642060 - DNA, 19 bp, Homo sapiens
atgtgtttttctatatagt

SEQ ID NO: 1642061 - DNA, 22 bp, Homo sapiens
atgtgtttttctatatagttcc

SEQ ID NO: 1642062 - DNA, 21 bp, Homo sapiens
atgtgtttttgggaagaagaa

SEQ ID NO: 1642063 - DNA, 18 bp, Homo sapiens
atgttaaaaagaaatcca

SEQ ID NO: 1642064 - DNA, 13 bp, Homo sapiens
atgttaaaagaag

SEQ ID NO: 1642065 - DNA, 18 bp, Homo sapiens
atgttaaagagaatgagt

SEQ ID NO: 1642066 - DNA, 22 bp, Homo sapiens
atgttaaagagaatgagtcctt

SEQ ID NO: 1642067 - DNA, 13 bp, Homo sapiens
gcccctactgctg

SEQ ID NO: 1642068 - DNA, 17 bp, Homo sapiens
gcccctagggtccctcg

SEQ ID NO: 1642069 - DNA, 13 bp, Homo sapiens
gcccctcagccct

SEQ ID NO: 1642070 - DNA, 14 bp, Homo sapiens
gcccctcagccctt

SEQ ID NO: 1642071 - DNA, 15 bp, Homo sapiens
gcccctcagcccttg

SEQ ID NO: 1642072 - DNA, 20 bp, Homo sapiens
gcccctccagaccctgcctg

SEQ ID NO: 1642073 - DNA, 13 bp, Homo sapiens
gcccctccagcac

SEQ ID NO: 1642074 - DNA, 14 bp, Homo sapiens
gcccctccagcaca

SEQ ID NO: 1642075 - DNA, 13 bp, Homo sapiens
gcccctcccacgc

SEQ ID NO: 1642076 - DNA, 15 bp, Homo sapiens
gcccctcccccaacc

SEQ ID NO: 1642077 - DNA, 22 bp, Homo sapiens
gcccctcccccaacccccaccc

SEQ ID NO: 1642078 - DNA, 16 bp, Homo sapiens
gcccctccccctgcca

SEQ ID NO: 1642079 - DNA, 15 bp, Homo sapiens
gcccctcccctcccc

SEQ ID NO: 1642080 - DNA, 15 bp, Homo sapiens
gcccctccctctgcc

SEQ ID NO: 1642081 - DNA, 17 bp, Homo sapiens
gcccctccctctgcccc

SEQ ID NO: 1642082 - DNA, 18 bp, Homo sapiens
gcccctccctctgcccca

SEQ ID NO: 1642083 - DNA, 20 bp, Homo sapiens
gcccctccctctgccccaag

SEQ ID NO: 1642084 - DNA, 15 bp, Homo sapiens
gcccctccgatgctg

SEQ ID NO: 1642085 - DNA, 20 bp, Homo sapiens
gcccctccgatgctgaggcc

SEQ ID NO: 1642086 - DNA, 20 bp, Homo sapiens
gcccctcctagacccaggtg

SEQ ID NO: 1642087 - DNA, 21 bp, Homo sapiens
gcccctcctagacccaggtgg

SEQ ID NO: 1642088 - DNA, 15 bp, Homo sapiens
gcccctcctccagcc

SEQ ID NO: 1642089 - DNA, 18 bp, Homo sapiens
gcccctcctccagcccct

SEQ ID NO: 1642090 - DNA, 12 bp, Homo sapiens
gcccctcctccc

SEQ ID NO: 1642091 - DNA, 20 bp, Homo sapiens
gcccctcctcccccggctgg

SEQ ID NO: 1642092 - DNA, 20 bp, Homo sapiens
gcccctcctctgagcagcct

SEQ ID NO: 1642093 - DNA, 13 bp, Homo sapiens
gcccctcctctgc

SEQ ID NO: 1642094 - DNA, 15 bp, Homo sapiens
gcccctcctctgcca

SEQ ID NO: 1642095 - DNA, 17 bp, Homo sapiens
gcccctcctctgccacc

SEQ ID NO: 1642096 - DNA, 20 bp, Homo sapiens
gcccctcctctgccacctcc

SEQ ID NO: 1642097 - DNA, 14 bp, Homo sapiens
gcccctccttctcc

SEQ ID NO: 1642098 - DNA, 18 bp, Homo sapiens
gcccctccttctcccctg

SEQ ID NO: 1642099 - DNA, 15 bp, Homo sapiens
gcccctcgctgctgc

SEQ ID NO: 1642100 - DNA, 15 bp, Homo sapiens
gcccctctcaccaaa

SEQ ID NO: 1642101 - DNA, 14 bp, Homo sapiens
gcccctctgcccag

SEQ ID NO: 1642102 - DNA, 18 bp, Homo sapiens
gcccctctgcccagcttg

SEQ ID NO: 1642103 - DNA, 20 bp, Homo sapiens
gcccctctggtcgctcctgc

SEQ ID NO: 1642104 - DNA, 22 bp, Homo sapiens
gcccctctggtcgctcctgccc

SEQ ID NO: 1642105 - DNA, 14 bp, Homo sapiens
gcccctcttcccca

SEQ ID NO: 1642106 - DNA, 22 bp, Homo sapiens
gcccctcttggagaagtctcag

SEQ ID NO: 1642107 - DNA, 16 bp, Homo sapiens
gcccctgaaagcctca

SEQ ID NO: 1642108 - DNA, 16 bp, Homo sapiens
gcccctgaacaagaat

SEQ ID NO: 1642109 - DNA, 22 bp, Homo sapiens
gcccctgagacaaatggaggcc

SEQ ID NO: 1642110 - DNA, 16 bp, Homo sapiens
gcccctgagcccagag

SEQ ID NO: 1642111 - DNA, 21 bp, Homo sapiens
atgttattttctgttgaagtt

SEQ ID NO: 1642112 - DNA, 17 bp, Homo sapiens
atgttattttttaatta

SEQ ID NO: 1642113 - DNA, 19 bp, Homo sapiens
atgttattttttaattatt

SEQ ID NO: 1642114 - DNA, 20 bp, Homo sapiens
atgttattttttaattatta

SEQ ID NO: 1642115 - DNA, 12 bp, Homo sapiens
atgttcaaagac

SEQ ID NO: 1642116 - DNA, 18 bp, Homo sapiens
atgttcaaagactgtgaa

SEQ ID NO: 1642117 - DNA, 14 bp, Homo sapiens
atgttcaactggag

SEQ ID NO: 1642118 - DNA, 19 bp, Homo sapiens
atgttcagcactgtccctt

SEQ ID NO: 1642119 - DNA, 22 bp, Homo sapiens
atgttcatcctcattgcctcct

SEQ ID NO: 1642120 - DNA, 13 bp, Homo sapiens
atgttcatgtgat

SEQ ID NO: 1642121 - DNA, 20 bp, Homo sapiens
atgttcattataatctcaaa

SEQ ID NO: 1642122 - DNA, 20 bp, Homo sapiens
atgttccaaaccctcctggg

SEQ ID NO: 1642123 - DNA, 22 bp, Homo sapiens
atgttccaccattgctggaaaa

SEQ ID NO: 1642124 - DNA, 22 bp, Homo sapiens
atgttccagatggcccccagct

SEQ ID NO: 1642125 - DNA, 12 bp, Homo sapiens
atgttccccagg

SEQ ID NO: 1642126 - DNA, 11 bp, Homo sapiens
atgttccctct

SEQ ID NO: 1642127 - DNA, 13 bp, Homo sapiens
atgttccctgcac

SEQ ID NO: 1642128 - DNA, 19 bp, Homo sapiens
atgttcctaacaaaatgag

SEQ ID NO: 1642129 - DNA, 15 bp, Homo sapiens
atgttcctagtgaaa

SEQ ID NO: 1642130 - DNA, 16 bp, Homo sapiens
atgttcctagtgaaag

SEQ ID NO: 1642131 - DNA, 17 bp, Homo sapiens
atgttcctgctgtattt

SEQ ID NO: 1642132 - DNA, 12 bp, Homo sapiens
atgttctaaggc

SEQ ID NO: 1642133 - DNA, 15 bp, Homo sapiens
atgttctaaggctct

SEQ ID NO: 1642134 - DNA, 12 bp, Homo sapiens
atgttctaagtt

SEQ ID NO: 1642135 - DNA, 16 bp, Homo sapiens
atgttctaagtttcta

SEQ ID NO: 1642136 - DNA, 18 bp, Homo sapiens
atgttctattaatcacct

SEQ ID NO: 1642137 - DNA, 20 bp, Homo sapiens
atgttctatttaacaactgg

SEQ ID NO: 1642138 - DNA, 16 bp, Homo sapiens
atgttctgaataattt

SEQ ID NO: 1642139 - DNA, 18 bp, Homo sapiens
atgttctgtcacgtgaaa

SEQ ID NO: 1642140 - DNA, 16 bp, Homo sapiens
atgttctgtcttccca

SEQ ID NO: 1642141 - DNA, 18 bp, Homo sapiens
atgttctgtcttcccaaa

SEQ ID NO: 1642142 - DNA, 16 bp, Homo sapiens
atgttcttttctattt

SEQ ID NO: 1642143 - DNA, 18 bp, Homo sapiens
atgttcttttctatttat

SEQ ID NO: 1642144 - DNA, 13 bp, Homo sapiens
atgttgaacaaaa

SEQ ID NO: 1642145 - DNA, 22 bp, Homo sapiens
atgttgaatgcccacaggcaaa

SEQ ID NO: 1642146 - DNA, 16 bp, Homo sapiens
atgttgacgagactgg

SEQ ID NO: 1642147 - DNA, 21 bp, Homo sapiens
atgttgagtgttcattttagt

SEQ ID NO: 1642148 - DNA, 23 bp, Homo sapiens
atgttgatttttactgtgtttta

SEQ ID NO: 1642149 - DNA, 18 bp, Homo sapiens
atgttgccatgtgtttta

SEQ ID NO: 1642150 - DNA, 20 bp, Homo sapiens
atgttgctgaggagtgagga

SEQ ID NO: 1642151 - DNA, 13 bp, Homo sapiens
atgttgctgccaa

SEQ ID NO: 1642152 - DNA, 14 bp, Homo sapiens
atgttgcttctcag

SEQ ID NO: 1642153 - DNA, 15 bp, Homo sapiens
atgttgcttttgaaa

SEQ ID NO: 1642154 - DNA, 19 bp, Homo sapiens
atgttgcttttgaaaagtt

SEQ ID NO: 1642155 - DNA, 17 bp, Homo sapiens
atgttggccaggctggt

SEQ ID NO: 1642156 - DNA, 19 bp, Homo sapiens
atgttggccaggctggtct

SEQ ID NO: 1642157 - DNA, 23 bp, Homo sapiens
atgttgggaggatacagaggaga

SEQ ID NO: 1642158 - DNA, 18 bp, Homo sapiens
atgttggttttttataaa

SEQ ID NO: 1642159 - DNA, 20 bp, Homo sapiens
atgttggttttttataaagt

SEQ ID NO: 1642160 - DNA, 17 bp, Homo sapiens
atgttgtaatatttctt

SEQ ID NO: 1642161 - DNA, 14 bp, Homo sapiens
atgttgtaatgctg

SEQ ID NO: 1642162 - DNA, 15 bp, Homo sapiens
atgttgtaatgctgc

SEQ ID NO: 1642163 - DNA, 18 bp, Homo sapiens
atgttgtaatgctgcact

SEQ ID NO: 1642164 - DNA, 15 bp, Homo sapiens
atgttgtacttgaaa

SEQ ID NO: 1642165 - DNA, 22 bp, Homo sapiens
atgttgtccaacaataaacagg

SEQ ID NO: 1642166 - DNA, 23 bp, Homo sapiens
atgttgtccaacaataaacagga

SEQ ID NO: 1642167 - DNA, 15 bp, Homo sapiens
atgttgtgtggcaat

SEQ ID NO: 1642168 - DNA, 12 bp, Homo sapiens
atgttgttattt

SEQ ID NO: 1642169 - DNA, 13 bp, Homo sapiens
atgttgttattta

SEQ ID NO: 1642170 - DNA, 20 bp, Homo sapiens
atgtttaaaagaaatatatt

SEQ ID NO: 1642171 - DNA, 15 bp, Homo sapiens
atgtttaaatagcct

SEQ ID NO: 1642172 - DNA, 19 bp, Homo sapiens
atgtttaaatagcctaaat

SEQ ID NO: 1642173 - DNA, 22 bp, Homo sapiens
atgtttaacaaatctaatctct

SEQ ID NO: 1642174 - DNA, 17 bp, Homo sapiens
atgtttaatctgttatg

SEQ ID NO: 1642175 - DNA, 19 bp, Homo sapiens
atgtttacactctttgtaa

SEQ ID NO: 1642176 - DNA, 15 bp, Homo sapiens
atgtttacagaggac

SEQ ID NO: 1642177 - DNA, 17 bp, Homo sapiens
atgtttacagaggacag

SEQ ID NO: 1642178 - DNA, 19 bp, Homo sapiens
atgtttacagaggacagta

SEQ ID NO: 1642179 - DNA, 22 bp, Homo sapiens
atgtttacaggtggacacacaa

SEQ ID NO: 1642180 - DNA, 15 bp, Homo sapiens
atgtttaccttttaa

SEQ ID NO: 1642181 - DNA, 19 bp, Homo sapiens
atgtttaccttttaattaa

SEQ ID NO: 1642182 - DNA, 14 bp, Homo sapiens
atgtttactgtaaa

SEQ ID NO: 1642183 - DNA, 14 bp, Homo sapiens
atgtttatatactg

SEQ ID NO: 1642184 - DNA, 16 bp, Homo sapiens
atgtttatgagccaga

SEQ ID NO: 1642185 - DNA, 20 bp, Homo sapiens
atgtttatgagccagacaaa

SEQ ID NO: 1642186 - DNA, 21 bp, Homo sapiens
atgtttatgagccagacaaat

SEQ ID NO: 1642187 - DNA, 19 bp, Homo sapiens
gcccggcagccccttctgg

SEQ ID NO: 1642188 - DNA, 20 bp, Homo sapiens
gcccggcagccccttctggc

SEQ ID NO: 1642189 - DNA, 21 bp, Homo sapiens
gcccggcagccccttctggcc

SEQ ID NO: 1642190 - DNA, 15 bp, Homo sapiens
gcccggcagggcggg

SEQ ID NO: 1642191 - DNA, 12 bp, Homo sapiens
gcccggccagcg

SEQ ID NO: 1642192 - DNA, 17 bp, Homo sapiens
gcccggccagcgggcac

SEQ ID NO: 1642193 - DNA, 18 bp, Homo sapiens
gcccggccagcgggcaca

SEQ ID NO: 1642194 - DNA, 15 bp, Homo sapiens
gcccggcctgctccc

SEQ ID NO: 1642195 - DNA, 20 bp, Homo sapiens
gcccggcgccgggcaccaac

SEQ ID NO: 1642196 - DNA, 21 bp, Homo sapiens
gcccggcgccgggcaccaact

SEQ ID NO: 1642197 - DNA, 19 bp, Homo sapiens
gcccggctgtgattgctgc

SEQ ID NO: 1642198 - DNA, 21 bp, Homo sapiens
gcccggctgtgattgctgcca

SEQ ID NO: 1642199 - DNA, 17 bp, Homo sapiens
gcccgggctgcctgggc

SEQ ID NO: 1642200 - DNA, 13 bp, Homo sapiens
gcccggggtgggg

SEQ ID NO: 1642201 - DNA, 22 bp, Homo sapiens
gcccgtaatcccagctactcag

SEQ ID NO: 1642202 - DNA, 13 bp, Homo sapiens
gcccgtcctgcct

SEQ ID NO: 1642203 - DNA, 18 bp, Homo sapiens
gcccgtcgcgctggacag

SEQ ID NO: 1642204 - DNA, 15 bp, Homo sapiens
gcccgtcgtgtgctg

SEQ ID NO: 1642205 - DNA, 13 bp, Homo sapiens
gcccgtgaagcag

SEQ ID NO: 1642206 - DNA, 21 bp, Homo sapiens
gcccgtgaagcagtgcctcga

SEQ ID NO: 1642207 - DNA, 17 bp, Homo sapiens
gcccgtgcagtacaggc

SEQ ID NO: 1642208 - DNA, 18 bp, Homo sapiens
gcccgtgcagtacaggca

SEQ ID NO: 1642209 - DNA, 23 bp, Homo sapiens
gcccgtgcccccgcctgccaccg

SEQ ID NO: 1642210 - DNA, 23 bp, Homo sapiens
gcccgtggggtctgcgcttggtc

SEQ ID NO: 1642211 - DNA, 19 bp, Homo sapiens
gccctaagcccccagggcc

SEQ ID NO: 1642212 - DNA, 15 bp, Homo sapiens
gccctaaggatctct

SEQ ID NO: 1642213 - DNA, 20 bp, Homo sapiens
gccctaagtggctgccttct

SEQ ID NO: 1642214 - DNA, 16 bp, Homo sapiens
gccctacagagctgtg

SEQ ID NO: 1642215 - DNA, 18 bp, Homo sapiens
gccctactccactgccct

SEQ ID NO: 1642216 - DNA, 16 bp, Homo sapiens
gccctactccctgcag

SEQ ID NO: 1642217 - DNA, 22 bp, Homo sapiens
gccctactccctgcagatgcca

SEQ ID NO: 1642218 - DNA, 19 bp, Homo sapiens
gccctagcctgacccggag

SEQ ID NO: 1642219 - DNA, 14 bp, Homo sapiens
gccctatgggcctg

SEQ ID NO: 1642220 - DNA, 14 bp, Homo sapiens
gccctatgtctcag

SEQ ID NO: 1642221 - DNA, 13 bp, Homo sapiens
gccctcaagggtg

SEQ ID NO: 1642222 - DNA, 15 bp, Homo sapiens
gccctcaatcccagc

SEQ ID NO: 1642223 - DNA, 13 bp, Homo sapiens
gccctcacccctg

SEQ ID NO: 1642224 - DNA, 19 bp, Homo sapiens
gccctcacccctgccctgg

SEQ ID NO: 1642225 - DNA, 20 bp, Homo sapiens
gccctcacccctgccctggg

SEQ ID NO: 1642226 - DNA, 22 bp, Homo sapiens
atgtttgtgcagtaacttggga

SEQ ID NO: 1642227 - DNA, 19 bp, Homo sapiens
atgtttgtgccttaaaagg

SEQ ID NO: 1642228 - DNA, 16 bp, Homo sapiens
atgtttgtggcctcag

SEQ ID NO: 1642229 - DNA, 18 bp, Homo sapiens
atgtttgtggcctcagaa

SEQ ID NO: 1642230 - DNA, 15 bp, Homo sapiens
atgtttgtgtgattt

SEQ ID NO: 1642231 - DNA, 18 bp, Homo sapiens
atgtttgtgtgatttcct

SEQ ID NO: 1642232 - DNA, 17 bp, Homo sapiens
atgtttgttaaaaataa

SEQ ID NO: 1642233 - DNA, 23 bp, Homo sapiens
atgtttgttatttacactggtct

SEQ ID NO: 1642234 - DNA, 20 bp, Homo sapiens
atgttttaccgtaataatta

SEQ ID NO: 1642235 - DNA, 14 bp, Homo sapiens
atgttttagagtta

SEQ ID NO: 1642236 - DNA, 17 bp, Homo sapiens
atgttttagcatttgta

SEQ ID NO: 1642237 - DNA, 18 bp, Homo sapiens
atgttttagcatttgtat

SEQ ID NO: 1642238 - DNA, 11 bp, Homo sapiens
atgttttctgg

SEQ ID NO: 1642239 - DNA, 18 bp, Homo sapiens
atgttttctttgctttaa

SEQ ID NO: 1642240 - DNA, 16 bp, Homo sapiens
atgttttgaaatgata

SEQ ID NO: 1642241 - DNA, 12 bp, Homo sapiens
atgttttgacat

SEQ ID NO: 1642242 - DNA, 23 bp, Homo sapiens
atgttttgcatgtaaaagcctag

SEQ ID NO: 1642243 - DNA, 17 bp, Homo sapiens
atgttttgtataaaatc

SEQ ID NO: 1642244 - DNA, 20 bp, Homo sapiens
atgttttgtataaaatctga

SEQ ID NO: 1642245 - DNA, 23 bp, Homo sapiens
atgttttgtattatttcaccagc

SEQ ID NO: 1642246 - DNA, 20 bp, Homo sapiens
atgttttgtcccatttcctt

SEQ ID NO: 1642247 - DNA, 14 bp, Homo sapiens
atgtttttatacaa

SEQ ID NO: 1642248 - DNA, 18 bp, Homo sapiens
atgtttttatacaaaata

SEQ ID NO: 1642249 - DNA, 21 bp, Homo sapiens
atgtttttctgccagggagct

SEQ ID NO: 1642250 - DNA, 13 bp, Homo sapiens
atgttttttagaa

SEQ ID NO: 1642251 - DNA, 22 bp, Homo sapiens
atgttttttccttttcacattt

SEQ ID NO: 1642252 - DNA, 15 bp, Homo sapiens
atgttttttctgtaa

SEQ ID NO: 1642253 - DNA, 20 bp, Homo sapiens
atgttttttcttcaaatgtt

SEQ ID NO: 1642254 - DNA, 23 bp, Homo sapiens
atgttttttcttcaaatgtttaa

SEQ ID NO: 1642255 - DNA, 17 bp, Homo sapiens
attaaaaaaaaaacttc

SEQ ID NO: 1642256 - DNA, 17 bp, Homo sapiens
attaaaaacatgaccac

SEQ ID NO: 1642257 - DNA, 12 bp, Homo sapiens
attaaaaagcct

SEQ ID NO: 1642258 - DNA, 17 bp, Homo sapiens
attaaaaagcctgcatt

SEQ ID NO: 1642259 - DNA, 20 bp, Homo sapiens
attaaaaagttgttctttgt

SEQ ID NO: 1642260 - DNA, 14 bp, Homo sapiens
attaaaaatgcttt

SEQ ID NO: 1642261 - DNA, 13 bp, Homo sapiens
attaaaaattacc

SEQ ID NO: 1642262 - DNA, 13 bp, Homo sapiens
attaaaacaaaag

SEQ ID NO: 1642263 - DNA, 22 bp, Homo sapiens
attaaaacaaaagggtgtatag

SEQ ID NO: 1642264 - DNA, 19 bp, Homo sapiens
attaaaacaaatatacatt

SEQ ID NO: 1642265 - DNA, 12 bp, Homo sapiens
attaaaacaata

SEQ ID NO: 1642266 - DNA, 15 bp, Homo sapiens
attaaaacaataatg

SEQ ID NO: 1642267 - DNA, 18 bp, Homo sapiens
attaaaacaatattgttt

SEQ ID NO: 1642268 - DNA, 21 bp, Homo sapiens
attaaaacaatattgtttcta

SEQ ID NO: 1642269 - DNA, 13 bp, Homo sapiens
attaaaacacagc

SEQ ID NO: 1642270 - DNA, 16 bp, Homo sapiens
attaaaacacagcttt

SEQ ID NO: 1642271 - DNA, 18 bp, Homo sapiens
attaaaacgggaatcaca

SEQ ID NO: 1642272 - DNA, 17 bp, Homo sapiens
attaaaactaaatttca

SEQ ID NO: 1642273 - DNA, 13 bp, Homo sapiens
attaaaactgctt

SEQ ID NO: 1642274 - DNA, 16 bp, Homo sapiens
attaaaagaatatctg

SEQ ID NO: 1642275 - DNA, 15 bp, Homo sapiens
attaaaagaatattt

SEQ ID NO: 1642276 - DNA, 16 bp, Homo sapiens
attaaaagaatatttt

SEQ ID NO: 1642277 - DNA, 16 bp, Homo sapiens
attaaaagattatttg

SEQ ID NO: 1642278 - DNA, 13 bp, Homo sapiens
attaaaatcttaa

SEQ ID NO: 1642279 - DNA, 22 bp, Homo sapiens
attaaaatgtcggatttatctt

SEQ ID NO: 1642280 - DNA, 22 bp, Homo sapiens
attaaaattctgatgtttctgt

SEQ ID NO: 1642281 - DNA, 13 bp, Homo sapiens
attaaaattgttg

SEQ ID NO: 1642282 - DNA, 14 bp, Homo sapiens
attaaaatttctta

SEQ ID NO: 1642283 - DNA, 13 bp, Homo sapiens
attaaacattttt

SEQ ID NO: 1642284 - DNA, 14 bp, Homo sapiens
attaaacttgaagc

SEQ ID NO: 1642285 - DNA, 15 bp, Homo sapiens
attaaagatgctatg

SEQ ID NO: 1642286 - DNA, 12 bp, Homo sapiens
attaaagcccat

SEQ ID NO: 1642287 - DNA, 16 bp, Homo sapiens
attaaaggaaggaaaa

SEQ ID NO: 1642288 - DNA, 23 bp, Homo sapiens
attaaaggtattccttgttcttc

SEQ ID NO: 1642289 - DNA, 11 bp, Homo sapiens
attaaagtcag

SEQ ID NO: 1642290 - DNA, 13 bp, Homo sapiens
attaaagtcagaa

SEQ ID NO: 1642291 - DNA, 19 bp, Homo sapiens
attaaagtcagaagtttta

SEQ ID NO: 1642292 - DNA, 20 bp, Homo sapiens
attaaagtgctaaggttcta

SEQ ID NO: 1642293 - DNA, 14 bp, Homo sapiens
attaaatacagaca

SEQ ID NO: 1642294 - DNA, 20 bp, Homo sapiens
attaaatacagacactaagt

SEQ ID NO: 1642295 - DNA, 19 bp, Homo sapiens
attaaatcctccagctttt

SEQ ID NO: 1642296 - DNA, 19 bp, Homo sapiens
attaaatcttaaacaatgt

SEQ ID NO: 1642297 - DNA, 22 bp, Homo sapiens
attaaatcttaaacaatgtata

SEQ ID NO: 1642298 - DNA, 17 bp, Homo sapiens
attaaatgccttgtata

SEQ ID NO: 1642299 - DNA, 18 bp, Homo sapiens
attaaatgccttgtataa

SEQ ID NO: 1642300 - DNA, 19 bp, Homo sapiens
attaaatgccttgtataaa

SEQ ID NO: 1642301 - DNA, 15 bp, Homo sapiens
attaaattaattgaa

SEQ ID NO: 1642302 - DNA, 12 bp, Homo sapiens
attaaattacat

SEQ ID NO: 1642303 - DNA, 17 bp, Homo sapiens
attaaattacatttgta

SEQ ID NO: 1642304 - DNA, 18 bp, Homo sapiens
attaaattacatttgtaa

SEQ ID NO: 1642305 - DNA, 10 bp, Homo sapiens
gccctgccct

SEQ ID NO: 1642306 - DNA, 18 bp, Homo sapiens
gccctgccctagctccac

SEQ ID NO: 1642307 - DNA, 20 bp, Homo sapiens
gccctgccctctccttcctt

SEQ ID NO: 1642308 - DNA, 15 bp, Homo sapiens
gccctgccctggcag

SEQ ID NO: 1642309 - DNA, 12 bp, Homo sapiens
gccctgcctgag

SEQ ID NO: 1642310 - DNA, 15 bp, Homo sapiens
gccctgcctgaggag

SEQ ID NO: 1642311 - DNA, 16 bp, Homo sapiens
gccctgcctgaggagg

SEQ ID NO: 1642312 - DNA, 15 bp, Homo sapiens
gccctgcctgagggc

SEQ ID NO: 1642313 - DNA, 12 bp, Homo sapiens
gccctgcctgcc

SEQ ID NO: 1642314 - DNA, 15 bp, Homo sapiens
gccctgcctgcccac

SEQ ID NO: 1642315 - DNA, 16 bp, Homo sapiens
gccctgcctgcccact

SEQ ID NO: 1642316 - DNA, 17 bp, Homo sapiens
gccctgcgttggagcca

SEQ ID NO: 1642317 - DNA, 19 bp, Homo sapiens
gccctgcgttggagccact

SEQ ID NO: 1642318 - DNA, 21 bp, Homo sapiens
gccctgcgttggagccactcc

SEQ ID NO: 1642319 - DNA, 9 bp, Homo sapiens
gccctgcta

SEQ ID NO: 1642320 - DNA, 19 bp, Homo sapiens
gccctgctcctccctggct

SEQ ID NO: 1642321 - DNA, 17 bp, Homo sapiens
gccctgctgaagctgct

SEQ ID NO: 1642322 - DNA, 22 bp, Homo sapiens
gccctgctgaagctgctgcagc

SEQ ID NO: 1642323 - DNA, 17 bp, Homo sapiens
gccctgctgtgggagag

SEQ ID NO: 1642324 - DNA, 22 bp, Homo sapiens
gccctgcttcctgcttgccaag

SEQ ID NO: 1642325 - DNA, 19 bp, Homo sapiens
gccctgctttgggctgccc

SEQ ID NO: 1642326 - DNA, 12 bp, Homo sapiens
gccctgcttttt

SEQ ID NO: 1642327 - DNA, 20 bp, Homo sapiens
gccctgctttttttcttaaa

SEQ ID NO: 1642328 - DNA, 14 bp, Homo sapiens
gccctggagccagg

SEQ ID NO: 1642329 - DNA, 15 bp, Homo sapiens
gccctggagccaggg

SEQ ID NO: 1642330 - DNA, 17 bp, Homo sapiens
gccctggagccagggca

SEQ ID NO: 1642331 - DNA, 18 bp, Homo sapiens
gccctggagccagggcag

SEQ ID NO: 1642332 - DNA, 19 bp, Homo sapiens
gccctggagccagggcaga

SEQ ID NO: 1642333 - DNA, 14 bp, Homo sapiens
gccctggaggtctc

SEQ ID NO: 1642334 - DNA, 17 bp, Homo sapiens
gccctggcacccccaca

SEQ ID NO: 1642335 - DNA, 14 bp, Homo sapiens
gccctggcagcagc

SEQ ID NO: 1642336 - DNA, 15 bp, Homo sapiens
gccctggcagcagca

SEQ ID NO: 1642337 - DNA, 19 bp, Homo sapiens
gccctggcagcagcaggtg

SEQ ID NO: 1642338 - DNA, 19 bp, Homo sapiens
gccctggcaggatgaccct

SEQ ID NO: 1642339 - DNA, 16 bp, Homo sapiens
gccctggcagggggca

SEQ ID NO: 1642340 - DNA, 20 bp, Homo sapiens
gccctggccactaaagcttc

SEQ ID NO: 1642341 - DNA, 12 bp, Homo sapiens
gccctggccctg

SEQ ID NO: 1642342 - DNA, 22 bp, Homo sapiens
attaagtttgaaaatagttacc

SEQ ID NO: 1642343 - DNA, 22 bp, Homo sapiens
attaataaaaaatggaaagaat

SEQ ID NO: 1642344 - DNA, 11 bp, Homo sapiens
attaataaagc

SEQ ID NO: 1642345 - DNA, 13 bp, Homo sapiens
attaataaagcat

SEQ ID NO: 1642346 - DNA, 14 bp, Homo sapiens
attaataaagcatt

SEQ ID NO: 1642347 - DNA, 17 bp, Homo sapiens
attaataagtgaagaat

SEQ ID NO: 1642348 - DNA, 15 bp, Homo sapiens
attaataatatttat

SEQ ID NO: 1642349 - DNA, 17 bp, Homo sapiens
attaataatatttatgt

SEQ ID NO: 1642350 - DNA, 12 bp, Homo sapiens
attaatagttca

SEQ ID NO: 1642351 - DNA, 13 bp, Homo sapiens
attaatatattaa

SEQ ID NO: 1642352 - DNA, 16 bp, Homo sapiens
attaatatcaactctg

SEQ ID NO: 1642353 - DNA, 23 bp, Homo sapiens
attaatattcagggtaaatagga

SEQ ID NO: 1642354 - DNA, 23 bp, Homo sapiens
attaatatttaacattatttata

SEQ ID NO: 1642355 - DNA, 13 bp, Homo sapiens
attaatcaaaggc

SEQ ID NO: 1642356 - DNA, 20 bp, Homo sapiens
attaatcaagagaaacttca

SEQ ID NO: 1642357 - DNA, 16 bp, Homo sapiens
attaatcatacaaact

SEQ ID NO: 1642358 - DNA, 20 bp, Homo sapiens
attaatcatacaaactctca

SEQ ID NO: 1642359 - DNA, 21 bp, Homo sapiens
attaatcatacaaactctcac

SEQ ID NO: 1642360 - DNA, 14 bp, Homo sapiens
attaatcatctata

SEQ ID NO: 1642361 - DNA, 21 bp, Homo sapiens
attaatcttagtgtatgatta

SEQ ID NO: 1642362 - DNA, 22 bp, Homo sapiens
attaatcttagtgtatgattac

SEQ ID NO: 1642363 - DNA, 14 bp, Homo sapiens
attaatcttattgt

SEQ ID NO: 1642364 - DNA, 18 bp, Homo sapiens
attaatctttctttacct

SEQ ID NO: 1642365 - DNA, 13 bp, Homo sapiens
attaatgaaatat

SEQ ID NO: 1642366 - DNA, 15 bp, Homo sapiens
attaatgaaatatct

SEQ ID NO: 1642367 - DNA, 16 bp, Homo sapiens
attaatgacagagcca

SEQ ID NO: 1642368 - DNA, 14 bp, Homo sapiens
attaatgataaact

SEQ ID NO: 1642369 - DNA, 15 bp, Homo sapiens
attaatgcctgcttt

SEQ ID NO: 1642370 - DNA, 17 bp, Homo sapiens
attaatgcctgcttttt

SEQ ID NO: 1642371 - DNA, 22 bp, Homo sapiens
attaatgcctgctttttggaaa

SEQ ID NO: 1642372 - DNA, 17 bp, Homo sapiens
attaatgcctttaaagt

SEQ ID NO: 1642373 - DNA, 18 bp, Homo sapiens
attaatgcctttaaagta

SEQ ID NO: 1642374 - DNA, 21 bp, Homo sapiens
attaatgtcctcttgctgtct

SEQ ID NO: 1642375 - DNA, 12 bp, Homo sapiens
attaatgtttct

SEQ ID NO: 1642376 - DNA, 22 bp, Homo sapiens
attaatgtttctatctgatttt

SEQ ID NO: 1642377 - DNA, 14 bp, Homo sapiens
attaatgtttctta

SEQ ID NO: 1642378 - DNA, 15 bp, Homo sapiens
attaatgtttcttaa

SEQ ID NO: 1642379 - DNA, 17 bp, Homo sapiens
attaatgttttcaaaag

SEQ ID NO: 1642380 - DNA, 16 bp, Homo sapiens
attaatgttttgtaca

SEQ ID NO: 1642381 - DNA, 18 bp, Homo sapiens
attaattacatacagatt

SEQ ID NO: 1642382 - DNA, 15 bp, Homo sapiens
attaattactgtgtg

SEQ ID NO: 1642383 - DNA, 16 bp, Homo sapiens
attaattagttccagt

SEQ ID NO: 1642384 - DNA, 19 bp, Homo sapiens
attaattgttttgcacttt

SEQ ID NO: 1642385 - DNA, 14 bp, Homo sapiens
attaatttctgata

SEQ ID NO: 1642386 - DNA, 15 bp, Homo sapiens
attaatttctgataa

SEQ ID NO: 1642387 - DNA, 15 bp, Homo sapiens
attaatttgcatctg

SEQ ID NO: 1642388 - DNA, 21 bp, Homo sapiens
attaatttgcatctgaaatag

SEQ ID NO: 1642389 - DNA, 13 bp, Homo sapiens
attaattttactc

SEQ ID NO: 1642390 - DNA, 15 bp, Homo sapiens
attaattttctatgt

SEQ ID NO: 1642391 - DNA, 16 bp, Homo sapiens
attaattttgtgcatt

SEQ ID NO: 1642392 - DNA, 17 bp, Homo sapiens
attaatttttatttatt

SEQ ID NO: 1642393 - DNA, 22 bp, Homo sapiens
attaatttttatttatttttct

SEQ ID NO: 1642394 - DNA, 22 bp, Homo sapiens
attacaaatcagaagtcatctt

SEQ ID NO: 1642395 - DNA, 15 bp, Homo sapiens
attacaacatttatg

SEQ ID NO: 1642396 - DNA, 18 bp, Homo sapiens
attacaaggcaatggaaa

SEQ ID NO: 1642397 - DNA, 17 bp, Homo sapiens
attacaatgtatcttta

SEQ ID NO: 1642398 - DNA, 15 bp, Homo sapiens
attacaattttatct

SEQ ID NO: 1642399 - DNA, 14 bp, Homo sapiens
attacacccaaaga

SEQ ID NO: 1642400 - DNA, 19 bp, Homo sapiens
attacagatgggcaaatta

SEQ ID NO: 1642401 - DNA, 21 bp, Homo sapiens
attacagcttatttttttcta

SEQ ID NO: 1642402 - DNA, 18 bp, Homo sapiens
attacagtccaaaatact

SEQ ID NO: 1642403 - DNA, 21 bp, Homo sapiens
attacagtgaaattttggtga

SEQ ID NO: 1642404 - DNA, 18 bp, Homo sapiens
attacagtgcctaaaata

SEQ ID NO: 1642405 - DNA, 16 bp, Homo sapiens
attacagttctttcct

SEQ ID NO: 1642406 - DNA, 21 bp, Homo sapiens
attacatacagattttaccta

SEQ ID NO: 1642407 - DNA, 14 bp, Homo sapiens
attacatctaatgc

SEQ ID NO: 1642408 - DNA, 15 bp, Homo sapiens
attacatctttcaca

SEQ ID NO: 1642409 - DNA, 22 bp, Homo sapiens
attacatctttcacattggcta

SEQ ID NO: 1642410 - DNA, 16 bp, Homo sapiens
attacatgtaaaacat

SEQ ID NO: 1642411 - DNA, 16 bp, Homo sapiens
attacattattaaacg

SEQ ID NO: 1642412 - DNA, 19 bp, Homo sapiens
attacattcctaactagaa

SEQ ID NO: 1642413 - DNA, 19 bp, Homo sapiens
attacattgctttttcttg

SEQ ID NO: 1642414 - DNA, 13 bp, Homo sapiens
attacatttgtaa

SEQ ID NO: 1642415 - DNA, 14 bp, Homo sapiens
attacatttgtaat

SEQ ID NO: 1642416 - DNA, 14 bp, Homo sapiens
attaccaacctgtt

SEQ ID NO: 1642417 - DNA, 23 bp, Homo sapiens
attaccagacggttcaccagcct

SEQ ID NO: 1642418 - DNA, 19 bp, Homo sapiens
attaccagcttaaaacact

SEQ ID NO: 1642419 - DNA, 18 bp, Homo sapiens
attaccaggtttcatttt

SEQ ID NO: 1642420 - DNA, 15 bp, Homo sapiens
attaccattaattac

SEQ ID NO: 1642421 - DNA, 17 bp, Homo sapiens
attaccattaattacat

SEQ ID NO: 1642422 - DNA, 17 bp, Homo sapiens
attacccataaacagca

SEQ ID NO: 1642423 - DNA, 18 bp, Homo sapiens
attaccccctccttcaga

SEQ ID NO: 1642424 - DNA, 22 bp, Homo sapiens
attacccctatacctgagcctc

SEQ ID NO: 1642425 - DNA, 20 bp, Homo sapiens
gcccttggtagcagcctggg

SEQ ID NO: 1642426 - DNA, 15 bp, Homo sapiens
gcccttgtcctgcca

SEQ ID NO: 1642427 - DNA, 21 bp, Homo sapiens
gcccttgtcctgccagctgcc

SEQ ID NO: 1642428 - DNA, 22 bp, Homo sapiens
gcccttgtcctgccagctgcct

SEQ ID NO: 1642429 - DNA, 13 bp, Homo sapiens
gcccttgtgccct

SEQ ID NO: 1642430 - DNA, 15 bp, Homo sapiens
gcccttgtgccctgc

SEQ ID NO: 1642431 - DNA, 15 bp, Homo sapiens
gcccttgttgcctgc

SEQ ID NO: 1642432 - DNA, 16 bp, Homo sapiens
gcccttgttgcctgca

SEQ ID NO: 1642433 - DNA, 22 bp, Homo sapiens
gcccttgttgcctgcacccttc

SEQ ID NO: 1642434 - DNA, 22 bp, Homo sapiens
gccctttccccgacgcccaccc

SEQ ID NO: 1642435 - DNA, 16 bp, Homo sapiens
gccctttcctcctcag

SEQ ID NO: 1642436 - DNA, 21 bp, Homo sapiens
gccctttgagatctggggagg

SEQ ID NO: 1642437 - DNA, 24 bp, Homo sapiens
gccctttggagaacgccagtctcc

SEQ ID NO: 1642438 - DNA, 14 bp, Homo sapiens
gccctttggcttct

SEQ ID NO: 1642439 - DNA, 15 bp, Homo sapiens
gccctttggcttctg

SEQ ID NO: 1642440 - DNA, 18 bp, Homo sapiens
gcccttttcaggaagctc

SEQ ID NO: 1642441 - DNA, 21 bp, Homo sapiens
gcccttttcaggaagctctct

SEQ ID NO: 1642442 - DNA, 17 bp, Homo sapiens
gcccttttcatatactt

SEQ ID NO: 1642443 - DNA, 19 bp, Homo sapiens
gccctttttcccttccctc

SEQ ID NO: 1642444 - DNA, 13 bp, Homo sapiens
gccgaacacacat

SEQ ID NO: 1642445 - DNA, 19 bp, Homo sapiens
gccgaacacacatcccagg

SEQ ID NO: 1642446 - DNA, 21 bp, Homo sapiens
gccgaacacacatcccaggag

SEQ ID NO: 1642447 - DNA, 16 bp, Homo sapiens
gccgaagccccttgga

SEQ ID NO: 1642448 - DNA, 17 bp, Homo sapiens
gccgaagccccttggag

SEQ ID NO: 1642449 - DNA, 18 bp, Homo sapiens
gccgaagccccttggaga

SEQ ID NO: 1642450 - DNA, 14 bp, Homo sapiens
gccgaagctctggc

SEQ ID NO: 1642451 - DNA, 19 bp, Homo sapiens
gccgaagctctggctgaac

SEQ ID NO: 1642452 - DNA, 15 bp, Homo sapiens
gccgaaggtgcctca

SEQ ID NO: 1642453 - DNA, 17 bp, Homo sapiens
gccgaaggtgcctcaga

SEQ ID NO: 1642454 - DNA, 21 bp, Homo sapiens
gccgacatccctcccccagca

SEQ ID NO: 1642455 - DNA, 23 bp, Homo sapiens
gccgacatccctcccccagcaga

SEQ ID NO: 1642456 - DNA, 19 bp, Homo sapiens
gccgaccagaggagccttt

SEQ ID NO: 1642457 - DNA, 14 bp, Homo sapiens
gcagccttggggca

SEQ ID NO: 1642458 - DNA, 15 bp, Homo sapiens
gcagccttggggcat

SEQ ID NO: 1642459 - DNA, 18 bp, Homo sapiens
gcagcctttgcctccccg

SEQ ID NO: 1642460 - DNA, 13 bp, Homo sapiens
gcagcgaccccag

SEQ ID NO: 1642461 - DNA, 14 bp, Homo sapiens
gcagcgaccgcccc

SEQ ID NO: 1642462 - DNA, 22 bp, Homo sapiens
gcagcgagctatgatcgcgcca

SEQ ID NO: 1642463 - DNA, 13 bp, Homo sapiens
gcagcgagggcgg

SEQ ID NO: 1642464 - DNA, 24 bp, Homo sapiens
gcagcgagttgtggaaagcctctg

SEQ ID NO: 1642465 - DNA, 16 bp, Homo sapiens
gcagcgcccctctgca

SEQ ID NO: 1642466 - DNA, 15 bp, Homo sapiens
gcagcgcgcaggcct

SEQ ID NO: 1642467 - DNA, 17 bp, Homo sapiens
gcagcgcgcaggcctgc

SEQ ID NO: 1642468 - DNA, 12 bp, Homo sapiens
gcagcgggccag

SEQ ID NO: 1642469 - DNA, 13 bp, Homo sapiens
gcagcgggccagg

SEQ ID NO: 1642470 - DNA, 14 bp, Homo sapiens
gcagcgggccaggc

SEQ ID NO: 1642471 - DNA, 17 bp, Homo sapiens
gcagcgggccaggcccg

SEQ ID NO: 1642472 - DNA, 14 bp, Homo sapiens
gcagcgggcggagg

SEQ ID NO: 1642473 - DNA, 13 bp, Homo sapiens
gcagcgtcccccg

SEQ ID NO: 1642474 - DNA, 15 bp, Homo sapiens
gcagcgtcccccgcc

SEQ ID NO: 1642475 - DNA, 16 bp, Homo sapiens
gcagcgtcccccgccg

SEQ ID NO: 1642476 - DNA, 19 bp, Homo sapiens
gcagctaactccgagagca

SEQ ID NO: 1642477 - DNA, 22 bp, Homo sapiens
gcagctaactccgagagcagtg

SEQ ID NO: 1642478 - DNA, 12 bp, Homo sapiens
gcagctaccctc

SEQ ID NO: 1642479 - DNA, 15 bp, Homo sapiens
gcagctaccctcagc

SEQ ID NO: 1642480 - DNA, 19 bp, Homo sapiens
gcagctaccctcagcctcc

SEQ ID NO: 1642481 - DNA, 14 bp, Homo sapiens
gcagctactggaat

SEQ ID NO: 1642482 - DNA, 15 bp, Homo sapiens
gcagctactggaatg

SEQ ID NO: 1642483 - DNA, 22 bp, Homo sapiens
gcagctagactggagtgaggct

SEQ ID NO: 1642484 - DNA, 21 bp, Homo sapiens
gcagctaggactgaggagtgg

SEQ ID NO: 1642485 - DNA, 16 bp, Homo sapiens
gcagctcaacctaccc

SEQ ID NO: 1642486 - DNA, 17 bp, Homo sapiens
gcagctcaagggctggc

SEQ ID NO: 1642487 - DNA, 19 bp, Homo sapiens
gcagctcaagggctggcac

SEQ ID NO: 1642488 - DNA, 20 bp, Homo sapiens
gcagctcaagggctggcact

SEQ ID NO: 1642489 - DNA, 19 bp, Homo sapiens
gcagctcacaccctacctt

SEQ ID NO: 1642490 - DNA, 22 bp, Homo sapiens
gcagctcacaccctaccttccc

SEQ ID NO: 1642491 - DNA, 21 bp, Homo sapiens
gcagctcactgctgctgcctc

SEQ ID NO: 1642492 - DNA, 14 bp, Homo sapiens
gcagctcccgcagg

SEQ ID NO: 1642493 - DNA, 13 bp, Homo sapiens
gcagctccctcct

SEQ ID NO: 1642494 - DNA, 14 bp, Homo sapiens
gcagctctgagaca

SEQ ID NO: 1642495 - DNA, 20 bp, Homo sapiens
gcagctctggacagccccac

SEQ ID NO: 1642496 - DNA, 17 bp, Homo sapiens
gcagctcttgcccttcc

SEQ ID NO: 1642497 - DNA, 18 bp, Homo sapiens
gcagctcttgcccttccc

SEQ ID NO: 1642498 - DNA, 20 bp, Homo sapiens
gcagctcttgcccttccctg

SEQ ID NO: 1642499 - DNA, 16 bp, Homo sapiens
gcagctgagagccctg

SEQ ID NO: 1642500 - DNA, 21 bp, Homo sapiens
gcagctgagagccctgctgtg

SEQ ID NO: 1642501 - DNA, 23 bp, Homo sapiens
gcagctgagagccctgctgtggg

SEQ ID NO: 1642502 - DNA, 14 bp, Homo sapiens
gcagctgcccctgg

SEQ ID NO: 1642503 - DNA, 17 bp, Homo sapiens
gcagctgcctctgctcc

SEQ ID NO: 1642504 - DNA, 21 bp, Homo sapiens
gcagctgcctctgctccctct

SEQ ID NO: 1642505 - DNA, 20 bp, Homo sapiens
gcagctgcgggtctgaagga

SEQ ID NO: 1642506 - DNA, 22 bp, Homo sapiens
gcagctgctatttattttccta

SEQ ID NO: 1642507 - DNA, 22 bp, Homo sapiens
gcagctgctccccaggccaccc

SEQ ID NO: 1642508 - DNA, 13 bp, Homo sapiens
gcagctgctctta

SEQ ID NO: 1642509 - DNA, 19 bp, Homo sapiens
gcagctggcccactgctgg

SEQ ID NO: 1642510 - DNA, 23 bp, Homo sapiens
gcagctggcccactgctggctgc

SEQ ID NO: 1642511 - DNA, 16 bp, Homo sapiens
gcagctgggacccctc

SEQ ID NO: 1642512 - DNA, 17 bp, Homo sapiens
gcagctgggccccatgc

SEQ ID NO: 1642513 - DNA, 16 bp, Homo sapiens
gcagctggggagcagc

SEQ ID NO: 1642514 - DNA, 21 bp, Homo sapiens
gcagctggggggctgtcctga

SEQ ID NO: 1642515 - DNA, 16 bp, Homo sapiens
gcagctggtgccccac

SEQ ID NO: 1642516 - DNA, 19 bp, Homo sapiens
gcagctggtgccccacctg

SEQ ID NO: 1642517 - DNA, 23 bp, Homo sapiens
gcagctggtgccccacctgcctg

SEQ ID NO: 1642518 - DNA, 22 bp, Homo sapiens
gcagctgtcccttgcttgcctg

SEQ ID NO: 1642519 - DNA, 14 bp, Homo sapiens
gcagctgtgctgca

SEQ ID NO: 1642520 - DNA, 18 bp, Homo sapiens
gcagctgtttctcatgaa

SEQ ID NO: 1642521 - DNA, 15 bp, Homo sapiens
gcagcttaacattga

SEQ ID NO: 1642522 - DNA, 21 bp, Homo sapiens
gcagcttcaacttttctcttt

SEQ ID NO: 1642523 - DNA, 12 bp, Homo sapiens
gcagcttccaga

SEQ ID NO: 1642524 - DNA, 21 bp, Homo sapiens
gcagcttttggtctccttggg

SEQ ID NO: 1642525 - DNA, 22 bp, Homo sapiens
gcagcttttggttaatatgtct

SEQ ID NO: 1642526 - DNA, 21 bp, Homo sapiens
gcaggaaatgagagatagagg

SEQ ID NO: 1642527 - DNA, 18 bp, Homo sapiens
gcaggaacaaacagggct

SEQ ID NO: 1642528 - DNA, 15 bp, Homo sapiens
gcaggaacgagcact

SEQ ID NO: 1642529 - DNA, 17 bp, Homo sapiens
gcaggaacgagcactgg

SEQ ID NO: 1642530 - DNA, 22 bp, Homo sapiens
gcaggaacgagcactggccaga

SEQ ID NO: 1642531 - DNA, 19 bp, Homo sapiens
gcaggaactgggctgggcc

SEQ ID NO: 1642532 - DNA, 15 bp, Homo sapiens
gcaggaagaaacttt

SEQ ID NO: 1642533 - DNA, 13 bp, Homo sapiens
gcaggaagaggcc

SEQ ID NO: 1642534 - DNA, 21 bp, Homo sapiens
gcaggaagaggcccactagag

SEQ ID NO: 1642535 - DNA, 18 bp, Homo sapiens
gcaggaaggaacaaagac

SEQ ID NO: 1642536 - DNA, 22 bp, Homo sapiens
gcaggaaggaacaaagacaggc

SEQ ID NO: 1642537 - DNA, 14 bp, Homo sapiens
gcaggaattatgtc

SEQ ID NO: 1642538 - DNA, 17 bp, Homo sapiens
gcaggacagctcttgat

SEQ ID NO: 1642539 - DNA, 22 bp, Homo sapiens
gcaggacaggaggcggcccggc

SEQ ID NO: 1642540 - DNA, 16 bp, Homo sapiens
gcaggaccttgggcac

SEQ ID NO: 1642541 - DNA, 14 bp, Homo sapiens
gcaggactccaggc

SEQ ID NO: 1642542 - DNA, 17 bp, Homo sapiens
gcaggactccaggccca

SEQ ID NO: 1642543 - DNA, 18 bp, Homo sapiens
gcaggactccaggcccaa

SEQ ID NO: 1642544 - DNA, 13 bp, Homo sapiens
gcaggactgagga

SEQ ID NO: 1642545 - DNA, 22 bp, Homo sapiens
gcaggactgagtcccctccagg

SEQ ID NO: 1642546 - DNA, 19 bp, Homo sapiens
gcaggactttgaggcaagt

SEQ ID NO: 1642547 - DNA, 22 bp, Homo sapiens
gcaggagaagaacaagaaatgg

SEQ ID NO: 1642548 - DNA, 16 bp, Homo sapiens
gcaggagaatcagcct

SEQ ID NO: 1642549 - DNA, 22 bp, Homo sapiens
gcaggagagactgagcagccgc

SEQ ID NO: 1642550 - DNA, 13 bp, Homo sapiens
gcaggagcagctg

SEQ ID NO: 1642551 - DNA, 18 bp, Homo sapiens
gcaggagccccgccacag

SEQ ID NO: 1642552 - DNA, 19 bp, Homo sapiens
gcaggagccccgccacagc

SEQ ID NO: 1642553 - DNA, 14 bp, Homo sapiens
gcaggagcctgagc

SEQ ID NO: 1642554 - DNA, 14 bp, Homo sapiens
gcaggagccttcct

SEQ ID NO: 1642555 - DNA, 18 bp, Homo sapiens
gcaggagctcctggaagc

SEQ ID NO: 1642556 - DNA, 22 bp, Homo sapiens
gcaggagcttctgggagatttt

SEQ ID NO: 1642557 - DNA, 23 bp, Homo sapiens
gcaggaggattgcttgagcccag

SEQ ID NO: 1642558 - DNA, 12 bp, Homo sapiens
gcaggaggcccc

SEQ ID NO: 1642559 - DNA, 23 bp, Homo sapiens
gcaggaggccccaggctgagagc

SEQ ID NO: 1642560 - DNA, 24 bp, Homo sapiens
gcaggaggccccaggctgagagcc

SEQ ID NO: 1642561 - DNA, 14 bp, Homo sapiens
gcaggaggcccctg

SEQ ID NO: 1642562 - DNA, 16 bp, Homo sapiens
gcaggaggcccctggc

SEQ ID NO: 1642563 - DNA, 22 bp, Homo sapiens
gcaggaggcccctggcccagcg

SEQ ID NO: 1642564 - DNA, 20 bp, Homo sapiens
gcaggaggctttgggtggct

SEQ ID NO: 1642565 - DNA, 14 bp, Homo sapiens
atgatttgttttga

SEQ ID NO: 1642566 - DNA, 19 bp, Homo sapiens
atgatttgttttgaatttt

SEQ ID NO: 1642567 - DNA, 21 bp, Homo sapiens
atgatttgttttgaattttgt

SEQ ID NO: 1642568 - DNA, 16 bp, Homo sapiens
atgattttatttgaca

SEQ ID NO: 1642569 - DNA, 13 bp, Homo sapiens
atgattttttaag

SEQ ID NO: 1642570 - DNA, 17 bp, Homo sapiens
atgattttttaagcaga

SEQ ID NO: 1642571 - DNA, 19 bp, Homo sapiens
atgattttttaaggagctg

SEQ ID NO: 1642572 - DNA, 17 bp, Homo sapiens
atgattttttgaaagtt

SEQ ID NO: 1642573 - DNA, 17 bp, Homo sapiens
atgatttttttttcata

SEQ ID NO: 1642574 - DNA, 15 bp, Homo sapiens
atgatttttttttcc

SEQ ID NO: 1642575 - DNA, 16 bp, Homo sapiens
atgatttttttttcca

SEQ ID NO: 1642576 - DNA, 14 bp, Homo sapiens
atgcaaaaaatctt

SEQ ID NO: 1642577 - DNA, 15 bp, Homo sapiens
atgcaaaaaatctta

SEQ ID NO: 1642578 - DNA, 23 bp, Homo sapiens
atgcaaaaactctttgagagggt

SEQ ID NO: 1642579 - DNA, 12 bp, Homo sapiens
atgcaaaaagaa

SEQ ID NO: 1642580 - DNA, 19 bp, Homo sapiens
atgcaaaaataaccaagtc

SEQ ID NO: 1642581 - DNA, 15 bp, Homo sapiens
atgcaaaagttctca

SEQ ID NO: 1642582 - DNA, 12 bp, Homo sapiens
atgcaaaataga

SEQ ID NO: 1642583 - DNA, 17 bp, Homo sapiens
atgcaaaatagacatct

SEQ ID NO: 1642584 - DNA, 24 bp, Homo sapiens
gcataggctcttaagcagcatgga

SEQ ID NO: 1642585 - DNA, 14 bp, Homo sapiens
gcataggtctggaa

SEQ ID NO: 1642586 - DNA, 21 bp, Homo sapiens
gcatagttgtagacaaagtac

SEQ ID NO: 1642587 - DNA, 21 bp, Homo sapiens
gcatatactgaagtcttttct

SEQ ID NO: 1642588 - DNA, 18 bp, Homo sapiens
gcatatatatatgtgtgt

SEQ ID NO: 1642589 - DNA, 16 bp, Homo sapiens
gcatatcctgagccat

SEQ ID NO: 1642590 - DNA, 14 bp, Homo sapiens
gcatatcgctgggc

SEQ ID NO: 1642591 - DNA, 16 bp, Homo sapiens
gcatatgacaaatgtt

SEQ ID NO: 1642592 - DNA, 20 bp, Homo sapiens
gcatatgacaaatgtttcta

SEQ ID NO: 1642593 - DNA, 17 bp, Homo sapiens
gcatatgagcctgccct

SEQ ID NO: 1642594 - DNA, 23 bp, Homo sapiens
gcatatgagcctgccctcactcc

SEQ ID NO: 1642595 - DNA, 23 bp, Homo sapiens
gcatatgggtgggattttgcaaa

SEQ ID NO: 1642596 - DNA, 17 bp, Homo sapiens
gcatatgggttagatgt

SEQ ID NO: 1642597 - DNA, 16 bp, Homo sapiens
gcatattcaatgtatt

SEQ ID NO: 1642598 - DNA, 21 bp, Homo sapiens
gcatattgtattactagaaga

SEQ ID NO: 1642599 - DNA, 21 bp, Homo sapiens
gcatatttattgcattgctgg

SEQ ID NO: 1642600 - DNA, 23 bp, Homo sapiens
gcatatttattgcattgctggta

SEQ ID NO: 1642601 - DNA, 18 bp, Homo sapiens
gcatatttgccaataaag

SEQ ID NO: 1642602 - DNA, 14 bp, Homo sapiens
gcatattttgctgg

SEQ ID NO: 1642603 - DNA, 14 bp, Homo sapiens
gcatatttttcaca

SEQ ID NO: 1642604 - DNA, 15 bp, Homo sapiens
gcatatttttcacat

SEQ ID NO: 1642605 - DNA, 14 bp, Homo sapiens
gcatcaaccaggaa

SEQ ID NO: 1642606 - DNA, 23 bp, Homo sapiens
gcatcaagaggtgggagggccct

SEQ ID NO: 1642607 - DNA, 15 bp, Homo sapiens
gcatcaagggagaca

SEQ ID NO: 1642608 - DNA, 21 bp, Homo sapiens
gcatcaagggagacaccagtg

SEQ ID NO: 1642609 - DNA, 13 bp, Homo sapiens
gcatcaatacaac

SEQ ID NO: 1642610 - DNA, 19 bp, Homo sapiens
gcatcaatacaaccagccc

SEQ ID NO: 1642611 - DNA, 17 bp, Homo sapiens
gcatcaatgtattttat

SEQ ID NO: 1642612 - DNA, 15 bp, Homo sapiens
gcatcacagggcaga

SEQ ID NO: 1642613 - DNA, 21 bp, Homo sapiens
gcatcacagggcagagccggg

SEQ ID NO: 1642614 - DNA, 22 bp, Homo sapiens
gcatcacagggcagagccggga

SEQ ID NO: 1642615 - DNA, 17 bp, Homo sapiens
gcatcacatgatgaaaa

SEQ ID NO: 1642616 - DNA, 15 bp, Homo sapiens
gcatcacctcaggcc

SEQ ID NO: 1642617 - DNA, 15 bp, Homo sapiens
gcatcacgctgcatc

SEQ ID NO: 1642618 - DNA, 23 bp, Homo sapiens
gcatcacggatggtgcatgggct

SEQ ID NO: 1642619 - DNA, 19 bp, Homo sapiens
gcatcagaggtttgcttcc

SEQ ID NO: 1642620 - DNA, 11 bp, Homo sapiens
gcatcagcctg

SEQ ID NO: 1642621 - DNA, 12 bp, Homo sapiens
gcatcagctgct

SEQ ID NO: 1642622 - DNA, 14 bp, Homo sapiens
gcatcaggcactgg

SEQ ID NO: 1642623 - DNA, 15 bp, Homo sapiens
gcatcaggcactggt

SEQ ID NO: 1642624 - DNA, 18 bp, Homo sapiens
gcatcaggcactggtggc

SEQ ID NO: 1642625 - DNA, 19 bp, Homo sapiens
gcatcaggcactggtggca

SEQ ID NO: 1642626 - DNA, 22 bp, Homo sapiens
gcatcaggctaagaccctgtgt

SEQ ID NO: 1642627 - DNA, 12 bp, Homo sapiens
gcatcagggtta

SEQ ID NO: 1642628 - DNA, 19 bp, Homo sapiens
gcatcagtccctatgtatt

SEQ ID NO: 1642629 - DNA, 14 bp, Homo sapiens
gcatcatctgtaga

SEQ ID NO: 1642630 - DNA, 21 bp, Homo sapiens
gcatcatggaaagactgggac

SEQ ID NO: 1642631 - DNA, 19 bp, Homo sapiens
gcatccacccagtgctgcc

SEQ ID NO: 1642632 - DNA, 21 bp, Homo sapiens
gcatccacccagtgctgccat

SEQ ID NO: 1642633 - DNA, 23 bp, Homo sapiens
gcatccacccagtgctgccatgc

SEQ ID NO: 1642634 - DNA, 24 bp, Homo sapiens
gcatccacccagtgctgccatgcc

SEQ ID NO: 1642635 - DNA, 13 bp, Homo sapiens
gcatccagcctgt

SEQ ID NO: 1642636 - DNA, 14 bp, Homo sapiens
gcatccagcctgtg

SEQ ID NO: 1642637 - DNA, 15 bp, Homo sapiens
gcatccagcctgtgt

SEQ ID NO: 1642638 - DNA, 17 bp, Homo sapiens
gcatccagcctgtgtgt

SEQ ID NO: 1642639 - DNA, 12 bp, Homo sapiens
gcatccaggctg

SEQ ID NO: 1642640 - DNA, 14 bp, Homo sapiens
gcatccattcctca

SEQ ID NO: 1642641 - DNA, 15 bp, Homo sapiens
gcatccattcctcag

SEQ ID NO: 1642642 - DNA, 16 bp, Homo sapiens
gcatccattcctcagg

SEQ ID NO: 1642643 - DNA, 21 bp, Homo sapiens
gcatccattcctcagggacag

SEQ ID NO: 1642644 - DNA, 14 bp, Homo sapiens
gcatcccaggggac

SEQ ID NO: 1642645 - DNA, 19 bp, Homo sapiens
gcatcccaggggaccacac

SEQ ID NO: 1642646 - DNA, 16 bp, Homo sapiens
gcatcccattgctagc

SEQ ID NO: 1642647 - DNA, 19 bp, Homo sapiens
gcatcccgatacctcagcc

SEQ ID NO: 1642648 - DNA, 18 bp, Homo sapiens
gcatccctgaggagccag

SEQ ID NO: 1642649 - DNA, 19 bp, Homo sapiens
gcatccctgtgtccactga

SEQ ID NO: 1642650 - DNA, 21 bp, Homo sapiens
gcatcccttcgcctgcagcct

SEQ ID NO: 1642651 - DNA, 16 bp, Homo sapiens
gcatccgcaggtgctg

SEQ ID NO: 1642652 - DNA, 17 bp, Homo sapiens
gcatccgcaggtgctgg

SEQ ID NO: 1642653 - DNA, 19 bp, Homo sapiens
gcatccgtagttccctgaa

SEQ ID NO: 1642654 - DNA, 20 bp, Homo sapiens
gcatcctaaagataaagcca

SEQ ID NO: 1642655 - DNA, 11 bp, Homo sapiens
gcatcctggat

SEQ ID NO: 1642656 - DNA, 17 bp, Homo sapiens
gcatccttcccagcaga

SEQ ID NO: 1642657 - DNA, 18 bp, Homo sapiens
gcatcgcaccattctgac

SEQ ID NO: 1642658 - DNA, 20 bp, Homo sapiens
gcatcgcaccattctgactc

SEQ ID NO: 1642659 - DNA, 19 bp, Homo sapiens
gcatcgcatcctcttccat

SEQ ID NO: 1642660 - DNA, 15 bp, Homo sapiens
gcatcgtagaagaga

SEQ ID NO: 1642661 - DNA, 22 bp, Homo sapiens
gcatcgtagaagagatgtggca

SEQ ID NO: 1642662 - DNA, 14 bp, Homo sapiens
gcatctacacagcc

SEQ ID NO: 1642663 - DNA, 19 bp, Homo sapiens
gcatctacacagcctggac

SEQ ID NO: 1642664 - DNA, 21 bp, Homo sapiens
gcatctactctaaagaaaaat

SEQ ID NO: 1642665 - DNA, 20 bp, Homo sapiens
gcatctatcgagtttgcaat

SEQ ID NO: 1642666 - DNA, 22 bp, Homo sapiens
gcatctcaaaacagagggctgc

SEQ ID NO: 1642667 - DNA, 13 bp, Homo sapiens
gcatctcagccca

SEQ ID NO: 1642668 - DNA, 16 bp, Homo sapiens
gcatctcccctagctc

SEQ ID NO: 1642669 - DNA, 23 bp, Homo sapiens
gcatctcccctagctcaccaggc

SEQ ID NO: 1642670 - DNA, 17 bp, Homo sapiens
gcatctccctcactgaa

SEQ ID NO: 1642671 - DNA, 20 bp, Homo sapiens
gcatctccctcactgaaacc

SEQ ID NO: 1642672 - DNA, 18 bp, Homo sapiens
gcatctcctgtcctgggc

SEQ ID NO: 1642673 - DNA, 14 bp, Homo sapiens
gcatctctgtactt

SEQ ID NO: 1642674 - DNA, 17 bp, Homo sapiens
gcatctcttgaggccag

SEQ ID NO: 1642675 - DNA, 20 bp, Homo sapiens
gcatctgaaataggaaacaa

SEQ ID NO: 1642676 - DNA, 14 bp, Homo sapiens
gcatctgacacaaa

SEQ ID NO: 1642677 - DNA, 15 bp, Homo sapiens
gcatctgaccatctg

SEQ ID NO: 1642678 - DNA, 15 bp, Homo sapiens
gcatctgagggggag

SEQ ID NO: 1642679 - DNA, 12 bp, Homo sapiens
gcatctgcccct

SEQ ID NO: 1642680 - DNA, 14 bp, Homo sapiens
gcatgtgtgcctgt

SEQ ID NO: 1642681 - DNA, 17 bp, Homo sapiens
gcatgtgtgcctgtggc

SEQ ID NO: 1642682 - DNA, 21 bp, Homo sapiens
gcatgttcacccttatagtct

SEQ ID NO: 1642683 - DNA, 23 bp, Homo sapiens
gcatgttcctccttttcttcacc

SEQ ID NO: 1642684 - DNA, 16 bp, Homo sapiens
gcatgttgctgaggag

SEQ ID NO: 1642685 - DNA, 19 bp, Homo sapiens
gcattaaataaccttcatc

SEQ ID NO: 1642686 - DNA, 13 bp, Homo sapiens
gcattaagcacac

SEQ ID NO: 1642687 - DNA, 14 bp, Homo sapiens
gcattaagcacaca

SEQ ID NO: 1642688 - DNA, 15 bp, Homo sapiens
gcattaagcacacac

SEQ ID NO: 1642689 - DNA, 17 bp, Homo sapiens
gcattaagcacacacat

SEQ ID NO: 1642690 - DNA, 20 bp, Homo sapiens
gcattaccagcttaaaacac

SEQ ID NO: 1642691 - DNA, 15 bp, Homo sapiens
gcattactttatagc

SEQ ID NO: 1642692 - DNA, 16 bp, Homo sapiens
gcattagaaatagaca

SEQ ID NO: 1642693 - DNA, 21 bp, Homo sapiens
gcattagagtcaactacacaa

SEQ ID NO: 1642694 - DNA, 21 bp, Homo sapiens
gcattaggcttttaagaaaca

SEQ ID NO: 1642695 - DNA, 22 bp, Homo sapiens
gcattaggcttttaagaaacac

SEQ ID NO: 1642696 - DNA, 18 bp, Homo sapiens
gcattagggatgcctcct

SEQ ID NO: 1642697 - DNA, 15 bp, Homo sapiens
gcattatataccatt

SEQ ID NO: 1642698 - DNA, 18 bp, Homo sapiens
gcattatatttgtaaatt

SEQ ID NO: 1642699 - DNA, 21 bp, Homo sapiens
gcattatgtccactgtgtata

SEQ ID NO: 1642700 - DNA, 23 bp, Homo sapiens
gcattatgtccactgtgtataga

SEQ ID NO: 1642701 - DNA, 15 bp, Homo sapiens
gcattattgcattat

SEQ ID NO: 1642702 - DNA, 23 bp, Homo sapiens
gcattcagtccgcctggccggct

SEQ ID NO: 1642703 - DNA, 18 bp, Homo sapiens
gcattcatgcaagagttt

SEQ ID NO: 1642704 - DNA, 13 bp, Homo sapiens
atgcatttgaggt

SEQ ID NO: 1642705 - DNA, 17 bp, Homo sapiens
atgcatttgaggtcaag

SEQ ID NO: 1642706 - DNA, 23 bp, Homo sapiens
atgcatttgaggtcaagtaagaa

SEQ ID NO: 1642707 - DNA, 15 bp, Homo sapiens
atgcattttgagtgt

SEQ ID NO: 1642708 - DNA, 18 bp, Homo sapiens
atgcattttgcagcagtg

SEQ ID NO: 1642709 - DNA, 19 bp, Homo sapiens
atgccaaacactagctctg

SEQ ID NO: 1642710 - DNA, 21 bp, Homo sapiens
atgccaaagaatgaatttcaa

SEQ ID NO: 1642711 - DNA, 18 bp, Homo sapiens
atgccaaagatcacttgt

SEQ ID NO: 1642712 - DNA, 20 bp, Homo sapiens
atgccaaagatcacttgttg

SEQ ID NO: 1642713 - DNA, 23 bp, Homo sapiens
atgccaaagatcacttgttgttt

SEQ ID NO: 1642714 - DNA, 14 bp, Homo sapiens
atgccaacttgtcc

SEQ ID NO: 1642715 - DNA, 22 bp, Homo sapiens
atgccaagaaaagggctgacat

SEQ ID NO: 1642716 - DNA, 19 bp, Homo sapiens
atgccaagggggtgactgg

SEQ ID NO: 1642717 - DNA, 14 bp, Homo sapiens
atgccaatttcctc

SEQ ID NO: 1642718 - DNA, 18 bp, Homo sapiens
atgccaatttcctctcca

SEQ ID NO: 1642719 - DNA, 16 bp, Homo sapiens
atgccacaaggacttc

SEQ ID NO: 1642720 - DNA, 19 bp, Homo sapiens
atgccacaaggacttcctg

SEQ ID NO: 1642721 - DNA, 14 bp, Homo sapiens
atgccaccacccac

SEQ ID NO: 1642722 - DNA, 18 bp, Homo sapiens
atgccaccacccacccca

SEQ ID NO: 1642723 - DNA, 20 bp, Homo sapiens
atgccaccctgttttcagct

SEQ ID NO: 1642724 - DNA, 23 bp, Homo sapiens
atgccaccggcctgtgggtctct

SEQ ID NO: 1642725 - DNA, 14 bp, Homo sapiens
atgccacctggcaa

SEQ ID NO: 1642726 - DNA, 21 bp, Homo sapiens
atgccacctggcaaaggaccc

SEQ ID NO: 1642727 - DNA, 18 bp, Homo sapiens
atgccactcctccctccg

SEQ ID NO: 1642728 - DNA, 14 bp, Homo sapiens
atgccactgccagg

SEQ ID NO: 1642729 - DNA, 15 bp, Homo sapiens
atgccactgccaggc

SEQ ID NO: 1642730 - DNA, 17 bp, Homo sapiens
atgccactgccaggcac

SEQ ID NO: 1642731 - DNA, 23 bp, Homo sapiens
atgccactgccaggcacctggcc

SEQ ID NO: 1642732 - DNA, 12 bp, Homo sapiens
atgccactggga

SEQ ID NO: 1642733 - DNA, 14 bp, Homo sapiens
atgccagagccaac

SEQ ID NO: 1642734 - DNA, 14 bp, Homo sapiens
atgccagagggcca

SEQ ID NO: 1642735 - DNA, 19 bp, Homo sapiens
atgccagctcagtcccatc

SEQ ID NO: 1642736 - DNA, 15 bp, Homo sapiens
atgccagcttctctc

SEQ ID NO: 1642737 - DNA, 19 bp, Homo sapiens
atgccagcttctctctcca

SEQ ID NO: 1642738 - DNA, 20 bp, Homo sapiens
atgccaggacccgccagccc

SEQ ID NO: 1642739 - DNA, 22 bp, Homo sapiens
atgccaggacccgccagccccg

SEQ ID NO: 1642740 - DNA, 18 bp, Homo sapiens
atgccagggccgaccaga

SEQ ID NO: 1642741 - DNA, 14 bp, Homo sapiens
atgccagtattttt

SEQ ID NO: 1642742 - DNA, 15 bp, Homo sapiens
atgccatcatgccca

SEQ ID NO: 1642743 - DNA, 14 bp, Homo sapiens
atgccatgaacaaa

SEQ ID NO: 1642744 - DNA, 20 bp, Homo sapiens
atgccatgaacaaattcttt

SEQ ID NO: 1642745 - DNA, 15 bp, Homo sapiens
atgccatgaatgagt

SEQ ID NO: 1642746 - DNA, 13 bp, Homo sapiens
atgccatgtctga

SEQ ID NO: 1642747 - DNA, 21 bp, Homo sapiens
atgccattctgcctcagcctc

SEQ ID NO: 1642748 - DNA, 17 bp, Homo sapiens
atgccatttaaagctta

SEQ ID NO: 1642749 - DNA, 16 bp, Homo sapiens
atgcccaatatattct

SEQ ID NO: 1642750 - DNA, 12 bp, Homo sapiens
atgcccaccccc

SEQ ID NO: 1642751 - DNA, 15 bp, Homo sapiens
atgcccaccccctgc

SEQ ID NO: 1642752 - DNA, 16 bp, Homo sapiens
atgcccaccccctgcc

SEQ ID NO: 1642753 - DNA, 15 bp, Homo sapiens
atgcccacctgccca

SEQ ID NO: 1642754 - DNA, 19 bp, Homo sapiens
atgcccacctgcccatcac

SEQ ID NO: 1642755 - DNA, 17 bp, Homo sapiens
atgcccagctctctgac

SEQ ID NO: 1642756 - DNA, 21 bp, Homo sapiens
atgcccagggccactctgcct

SEQ ID NO: 1642757 - DNA, 15 bp, Homo sapiens
atgccccagagctgt

SEQ ID NO: 1642758 - DNA, 21 bp, Homo sapiens
atgccccaggatcactctctg

SEQ ID NO: 1642759 - DNA, 14 bp, Homo sapiens
atgccccaggctct

SEQ ID NO: 1642760 - DNA, 22 bp, Homo sapiens
atgccccctaatccccttctcc

SEQ ID NO: 1642761 - DNA, 15 bp, Homo sapiens
atgcccctcccctcc

SEQ ID NO: 1642762 - DNA, 20 bp, Homo sapiens
atgcccctgtactccagcct

SEQ ID NO: 1642763 - DNA, 15 bp, Homo sapiens
atgccctacatctta

SEQ ID NO: 1642764 - DNA, 12 bp, Homo sapiens
atgccctcctgg

SEQ ID NO: 1642765 - DNA, 15 bp, Homo sapiens
atgcccttaaatcat

SEQ ID NO: 1642766 - DNA, 18 bp, Homo sapiens
atgccgcagggagggctg

SEQ ID NO: 1642767 - DNA, 19 bp, Homo sapiens
atgccgcgggcggccaggc

SEQ ID NO: 1642768 - DNA, 20 bp, Homo sapiens
atgccgcgggcggccaggca

SEQ ID NO: 1642769 - DNA, 22 bp, Homo sapiens
atgccgcgggcggccaggcaac

SEQ ID NO: 1642770 - DNA, 16 bp, Homo sapiens
atgccgcgtccctgcc

SEQ ID NO: 1642771 - DNA, 18 bp, Homo sapiens
atgccgcgtccctgcccc

SEQ ID NO: 1642772 - DNA, 14 bp, Homo sapiens
atgccgctgtctct

SEQ ID NO: 1642773 - DNA, 14 bp, Homo sapiens
atgccggatgtgct

SEQ ID NO: 1642774 - DNA, 23 bp, Homo sapiens
atgccgtataggatgtcagacaa

SEQ ID NO: 1642775 - DNA, 17 bp, Homo sapiens
atgccgtcttctgccct

SEQ ID NO: 1642776 - DNA, 20 bp, Homo sapiens
atgccgttctgttccaacct

SEQ ID NO: 1642777 - DNA, 19 bp, Homo sapiens
atgcctagcacaagtacca

SEQ ID NO: 1642778 - DNA, 16 bp, Homo sapiens
atgcctatggtggatc

SEQ ID NO: 1642779 - DNA, 19 bp, Homo sapiens
atgcctatggtggatccaa

SEQ ID NO: 1642780 - DNA, 16 bp, Homo sapiens
atgcctcaattcacat

SEQ ID NO: 1642781 - DNA, 14 bp, Homo sapiens
atgcctccaagcca

SEQ ID NO: 1642782 - DNA, 19 bp, Homo sapiens
atgcctccaagccattcac

SEQ ID NO: 1642783 - DNA, 12 bp, Homo sapiens
atgcctccaccg

SEQ ID NO: 1642784 - DNA, 14 bp, Homo sapiens
atgcctccccaaga

SEQ ID NO: 1642785 - DNA, 14 bp, Homo sapiens
atgcctccttggcc

SEQ ID NO: 1642786 - DNA, 15 bp, Homo sapiens
atgcctcgctccctt

SEQ ID NO: 1642787 - DNA, 22 bp, Homo sapiens
atgcctctgatatgggactgag

SEQ ID NO: 1642788 - DNA, 20 bp, Homo sapiens
atgcctgactaatttttgta

SEQ ID NO: 1642789 - DNA, 16 bp, Homo sapiens
atgcctgagttataaa

SEQ ID NO: 1642790 - DNA, 14 bp, Homo sapiens
atgcctgcatgctg

SEQ ID NO: 1642791 - DNA, 19 bp, Homo sapiens
atgcctgccccaaacaaat

SEQ ID NO: 1642792 - DNA, 23 bp, Homo sapiens
atgcctgcccgcaccctggcctg

SEQ ID NO: 1642793 - DNA, 18 bp, Homo sapiens
atgcctggtattttcaac

SEQ ID NO: 1642794 - DNA, 20 bp, Homo sapiens
gagatccctgcagaacccac

SEQ ID NO: 1642795 - DNA, 13 bp, Homo sapiens
gagatcctcctgc

SEQ ID NO: 1642796 - DNA, 23 bp, Homo sapiens
gagatcctcctgcagaccacgcc

SEQ ID NO: 1642797 - DNA, 17 bp, Homo sapiens
gagatccttcacaggca

SEQ ID NO: 1642798 - DNA, 21 bp, Homo sapiens
gagatcgacaccatcctggct

SEQ ID NO: 1642799 - DNA, 17 bp, Homo sapiens
gagatcgagaccatcct

SEQ ID NO: 1642800 - DNA, 18 bp, Homo sapiens
gagatcgagaccatcctg

SEQ ID NO: 1642801 - DNA, 22 bp, Homo sapiens
gagatcgagaccatcctggcta

SEQ ID NO: 1642802 - DNA, 14 bp, Homo sapiens
gagatcgcttttct

SEQ ID NO: 1642803 - DNA, 22 bp, Homo sapiens
gagatcgtgccgttactctcca

SEQ ID NO: 1642804 - DNA, 20 bp, Homo sapiens
gagatctaagcctttccata

SEQ ID NO: 1642805 - DNA, 16 bp, Homo sapiens
gagatctacacatgtt

SEQ ID NO: 1642806 - DNA, 15 bp, Homo sapiens
gagatctcaggagcc

SEQ ID NO: 1642807 - DNA, 19 bp, Homo sapiens
gagatctgcacagtcagaa

SEQ ID NO: 1642808 - DNA, 23 bp, Homo sapiens
gagatctgcacagtcagaaggac

SEQ ID NO: 1642809 - DNA, 23 bp, Homo sapiens
gagatctggggaggcaggcattc

SEQ ID NO: 1642810 - DNA, 20 bp, Homo sapiens
gagatctgtgtggctcctgg

SEQ ID NO: 1642811 - DNA, 22 bp, Homo sapiens
gagatctgtgtggctcctgggc

SEQ ID NO: 1642812 - DNA, 22 bp, Homo sapiens
gagatctttctttccaaaacat

SEQ ID NO: 1642813 - DNA, 15 bp, Homo sapiens
gagatgaaatgcctt

SEQ ID NO: 1642814 - DNA, 14 bp, Homo sapiens
gagatgaccaggga

SEQ ID NO: 1642815 - DNA, 17 bp, Homo sapiens
gagatgaccagggatgc

SEQ ID NO: 1642816 - DNA, 22 bp, Homo sapiens
gagatgaccagggatgctgggc

SEQ ID NO: 1642817 - DNA, 13 bp, Homo sapiens
gagatgactgagt

SEQ ID NO: 1642818 - DNA, 21 bp, Homo sapiens
gagatgactgagtcctcgtag

SEQ ID NO: 1642819 - DNA, 19 bp, Homo sapiens
gagatgaggagtaaaattc

SEQ ID NO: 1642820 - DNA, 20 bp, Homo sapiens
gagatgaggagtaaaattca

SEQ ID NO: 1642821 - DNA, 15 bp, Homo sapiens
gagatgagtgtctgg

SEQ ID NO: 1642822 - DNA, 16 bp, Homo sapiens
gagatgagtgtctgga

SEQ ID NO: 1642823 - DNA, 18 bp, Homo sapiens
gagatgcaccaccaagcc

SEQ ID NO: 1642824 - DNA, 20 bp, Homo sapiens
gagatgcagctactggaatg

SEQ ID NO: 1642825 - DNA, 15 bp, Homo sapiens
gagatgcatggcctc

SEQ ID NO: 1642826 - DNA, 22 bp, Homo sapiens
gagatgcctccaccgctgccta

SEQ ID NO: 1642827 - DNA, 21 bp, Homo sapiens
gagatgcgttgttacaggaag

SEQ ID NO: 1642828 - DNA, 14 bp, Homo sapiens
gagatgcttggagc

SEQ ID NO: 1642829 - DNA, 20 bp, Homo sapiens
gagatgcttggagcaatcag

SEQ ID NO: 1642830 - DNA, 15 bp, Homo sapiens
gagatggaagcttgt

SEQ ID NO: 1642831 - DNA, 14 bp, Homo sapiens
gagatggagggctt

SEQ ID NO: 1642832 - DNA, 15 bp, Homo sapiens
gagatggagggcttg

SEQ ID NO: 1642833 - DNA, 18 bp, Homo sapiens
gagatggagttcttgtgc

SEQ ID NO: 1642834 - DNA, 21 bp, Homo sapiens
gagatgggaatgaggtgggag

SEQ ID NO: 1642835 - DNA, 21 bp, Homo sapiens
gagatgggacaagcagtccct

SEQ ID NO: 1642836 - DNA, 15 bp, Homo sapiens
gagatggtcagtgtg

SEQ ID NO: 1642837 - DNA, 15 bp, Homo sapiens
gagatggtgaggctg

SEQ ID NO: 1642838 - DNA, 16 bp, Homo sapiens
gagatggttaaaaagg

SEQ ID NO: 1642839 - DNA, 19 bp, Homo sapiens
gagatggttaaaaaggcca

SEQ ID NO: 1642840 - DNA, 22 bp, Homo sapiens
gagatggttaaaaaggccaaag

SEQ ID NO: 1642841 - DNA, 16 bp, Homo sapiens
gagatgtatgaaggct

SEQ ID NO: 1642842 - DNA, 16 bp, Homo sapiens
gagatgtgtggactgt

SEQ ID NO: 1642843 - DNA, 20 bp, Homo sapiens
gagatgtgtggactgtggca

SEQ ID NO: 1642844 - DNA, 19 bp, Homo sapiens
gagattctggatctcctgc

SEQ ID NO: 1642845 - DNA, 15 bp, Homo sapiens
gagattctgtgatct

SEQ ID NO: 1642846 - DNA, 23 bp, Homo sapiens
gagattgctgtgtgttgcctggg

SEQ ID NO: 1642847 - DNA, 23 bp, Homo sapiens
gagattgttgtttgccatacttt

SEQ ID NO: 1642848 - DNA, 21 bp, Homo sapiens
gagatttcatctgctctcctt

SEQ ID NO: 1642849 - DNA, 22 bp, Homo sapiens
gagatttcatctgctctccttc

SEQ ID NO: 1642850 - DNA, 15 bp, Homo sapiens
gagatttgccagcac

SEQ ID NO: 1642851 - DNA, 19 bp, Homo sapiens
gagatttgccagcacaggg

SEQ ID NO: 1642852 - DNA, 20 bp, Homo sapiens
gagcaaaactccgtctcaaa

SEQ ID NO: 1642853 - DNA, 19 bp, Homo sapiens
gagcaaaagacttgagcca

SEQ ID NO: 1642854 - DNA, 19 bp, Homo sapiens
gagcaaacccagaggtgga

SEQ ID NO: 1642855 - DNA, 13 bp, Homo sapiens
gagcaaagatcaa

SEQ ID NO: 1642856 - DNA, 13 bp, Homo sapiens
gagcaaagcgccc

SEQ ID NO: 1642857 - DNA, 13 bp, Homo sapiens
gagcaaagctgat

SEQ ID NO: 1642858 - DNA, 14 bp, Homo sapiens
gagcaacccctgta

SEQ ID NO: 1642859 - DNA, 16 bp, Homo sapiens
gagcaacccctgtacc

SEQ ID NO: 1642860 - DNA, 18 bp, Homo sapiens
gagcaacccctgtaccca

SEQ ID NO: 1642861 - DNA, 20 bp, Homo sapiens
gagcaacccctgtacccagc

SEQ ID NO: 1642862 - DNA, 22 bp, Homo sapiens
gagcaacccctgtacccagctc

SEQ ID NO: 1642863 - DNA, 23 bp, Homo sapiens
gagcaacccctgtacccagctcc

SEQ ID NO: 1642864 - DNA, 22 bp, Homo sapiens
gagcaacctactgtctaagcag

SEQ ID NO: 1642865 - DNA, 20 bp, Homo sapiens
gagcaagaccccatctcaaa

SEQ ID NO: 1642866 - DNA, 16 bp, Homo sapiens
gagcaaggccttctct

SEQ ID NO: 1642867 - DNA, 18 bp, Homo sapiens
gagcaatcagaacttcag

SEQ ID NO: 1642868 - DNA, 16 bp, Homo sapiens
gagcaatgtctgtgct

SEQ ID NO: 1642869 - DNA, 18 bp, Homo sapiens
gagcaattccaggctgag

SEQ ID NO: 1642870 - DNA, 20 bp, Homo sapiens
gagcaattccaggctgagcc

SEQ ID NO: 1642871 - DNA, 22 bp, Homo sapiens
gagcaattccaggctgagccat

SEQ ID NO: 1642872 - DNA, 22 bp, Homo sapiens
gagcacacaggtacagcaacag

SEQ ID NO: 1642873 - DNA, 22 bp, Homo sapiens
gagcacacccgtgtgcacactc

SEQ ID NO: 1642874 - DNA, 17 bp, Homo sapiens
gagcacagatctgtttc

SEQ ID NO: 1642875 - DNA, 17 bp, Homo sapiens
gagcacagcatgcctta

SEQ ID NO: 1642876 - DNA, 12 bp, Homo sapiens
gagcacagccct

SEQ ID NO: 1642877 - DNA, 14 bp, Homo sapiens
gagcacagccctgg

SEQ ID NO: 1642878 - DNA, 18 bp, Homo sapiens
gagcacatagagcttttt

SEQ ID NO: 1642879 - DNA, 13 bp, Homo sapiens
gagcacccagagc

SEQ ID NO: 1642880 - DNA, 15 bp, Homo sapiens
gagcaccccctgctc

SEQ ID NO: 1642881 - DNA, 17 bp, Homo sapiens
gagcaccccctgctcca

SEQ ID NO: 1642882 - DNA, 14 bp, Homo sapiens
gagcaccctctgga

SEQ ID NO: 1642883 - DNA, 18 bp, Homo sapiens
gagcaccgtgtcaagctg

SEQ ID NO: 1642884 - DNA, 20 bp, Homo sapiens
gagcacctgaaccccatggg

SEQ ID NO: 1642885 - DNA, 23 bp, Homo sapiens
gagcacctgccagaggatgctct

SEQ ID NO: 1642886 - DNA, 13 bp, Homo sapiens
gagcacctgtctg

SEQ ID NO: 1642887 - DNA, 15 bp, Homo sapiens
gagcactggccagag

SEQ ID NO: 1642888 - DNA, 22 bp, Homo sapiens
gagcactggccagagagggccc

SEQ ID NO: 1642889 - DNA, 24 bp, Homo sapiens
gagcactggccagagagggcccag

SEQ ID NO: 1642890 - DNA, 23 bp, Homo sapiens
gagcactggtgtgaactcaccct

SEQ ID NO: 1642891 - DNA, 12 bp, Homo sapiens
gagcactgttca

SEQ ID NO: 1642892 - DNA, 16 bp, Homo sapiens
gagcacttgcgtcctg

SEQ ID NO: 1642893 - DNA, 19 bp, Homo sapiens
gagcacttgcgtcctgcag

SEQ ID NO: 1642894 - DNA, 22 bp, Homo sapiens
gagcagaaaacccttgggccag

SEQ ID NO: 1642895 - DNA, 17 bp, Homo sapiens
gagcagaaattctgttt

SEQ ID NO: 1642896 - DNA, 15 bp, Homo sapiens
gagcagaacaggtag

SEQ ID NO: 1642897 - DNA, 16 bp, Homo sapiens
gagcagagaattctct

SEQ ID NO: 1642898 - DNA, 22 bp, Homo sapiens
gagcagagctctcccctcctgc

SEQ ID NO: 1642899 - DNA, 17 bp, Homo sapiens
gagcagagggaggaaga

SEQ ID NO: 1642900 - DNA, 15 bp, Homo sapiens
gagcagagggcaggg

SEQ ID NO: 1642901 - DNA, 17 bp, Homo sapiens
gagcagagggcaggggt

SEQ ID NO: 1642902 - DNA, 13 bp, Homo sapiens
agttggtttgtat

SEQ ID NO: 1642903 - DNA, 16 bp, Homo sapiens
agttggtttgtatgag

SEQ ID NO: 1642904 - DNA, 19 bp, Homo sapiens
agttggtttgtatgagatg

SEQ ID NO: 1642905 - DNA, 16 bp, Homo sapiens
agttggtttgtgtgat

SEQ ID NO: 1642906 - DNA, 16 bp, Homo sapiens
agttgtaaaatagaaa

SEQ ID NO: 1642907 - DNA, 21 bp, Homo sapiens
agttgtaaaatagaaaaagtg

SEQ ID NO: 1642908 - DNA, 22 bp, Homo sapiens
agttgtaaataatttatttaat

SEQ ID NO: 1642909 - DNA, 19 bp, Homo sapiens
agttgtaacttatattgaa

SEQ ID NO: 1642910 - DNA, 16 bp, Homo sapiens
agttgtaataaatcta

SEQ ID NO: 1642911 - DNA, 19 bp, Homo sapiens
agttgtactttaaaaattt

SEQ ID NO: 1642912 - DNA, 16 bp, Homo sapiens
agttgtatctcttttg

SEQ ID NO: 1642913 - DNA, 19 bp, Homo sapiens
agttgtatttaacagaaat

SEQ ID NO: 1642914 - DNA, 16 bp, Homo sapiens
agttgtcctatggaca

SEQ ID NO: 1642915 - DNA, 21 bp, Homo sapiens
agttgtctattctgagccttg

SEQ ID NO: 1642916 - DNA, 14 bp, Homo sapiens
agttgtgcttgagc

SEQ ID NO: 1642917 - DNA, 14 bp, Homo sapiens
gagcccagctcttg

SEQ ID NO: 1642918 - DNA, 19 bp, Homo sapiens
gagcccagctcttgctctc

SEQ ID NO: 1642919 - DNA, 22 bp, Homo sapiens
gagcccagctcttgctctcttg

SEQ ID NO: 1642920 - DNA, 23 bp, Homo sapiens
gagcccaggagttcgaggctgca

SEQ ID NO: 1642921 - DNA, 11 bp, Homo sapiens
gagcccaggcc

SEQ ID NO: 1642922 - DNA, 22 bp, Homo sapiens
gagcccagggcatcttgctggc

SEQ ID NO: 1642923 - DNA, 20 bp, Homo sapiens
gagcccagtgaagcctctga

SEQ ID NO: 1642924 - DNA, 13 bp, Homo sapiens
gagccccaagtcc

SEQ ID NO: 1642925 - DNA, 17 bp, Homo sapiens
gagccccaagtcctgaa

SEQ ID NO: 1642926 - DNA, 21 bp, Homo sapiens
gagccccaagtcctgaagagg

SEQ ID NO: 1642927 - DNA, 12 bp, Homo sapiens
gagccccagggt

SEQ ID NO: 1642928 - DNA, 19 bp, Homo sapiens
gagccccagggtcttccct

SEQ ID NO: 1642929 - DNA, 12 bp, Homo sapiens
gagccccagtgc

SEQ ID NO: 1642930 - DNA, 18 bp, Homo sapiens
gagccccatcagctccag

SEQ ID NO: 1642931 - DNA, 16 bp, Homo sapiens
gagcccccacattctc

SEQ ID NO: 1642932 - DNA, 14 bp, Homo sapiens
gagccccctctgcc

SEQ ID NO: 1642933 - DNA, 13 bp, Homo sapiens
gagccccctgcac

SEQ ID NO: 1642934 - DNA, 12 bp, Homo sapiens
gagccccctgga

SEQ ID NO: 1642935 - DNA, 15 bp, Homo sapiens
gagcccctaccccac

SEQ ID NO: 1642936 - DNA, 17 bp, Homo sapiens
gagcccctaccccacac

SEQ ID NO: 1642937 - DNA, 12 bp, Homo sapiens
gagcccctcctc

SEQ ID NO: 1642938 - DNA, 17 bp, Homo sapiens
gagcccctcctccagcc

SEQ ID NO: 1642939 - DNA, 21 bp, Homo sapiens
gagcccctcctccagcccctg

SEQ ID NO: 1642940 - DNA, 16 bp, Homo sapiens
gagcccctcctccccc

SEQ ID NO: 1642941 - DNA, 20 bp, Homo sapiens
gagcccctccttctcccctg

SEQ ID NO: 1642942 - DNA, 13 bp, Homo sapiens
gagcccctgggtg

SEQ ID NO: 1642943 - DNA, 16 bp, Homo sapiens
gagcccgaggcaccag

SEQ ID NO: 1642944 - DNA, 14 bp, Homo sapiens
gagcccgcagggcc

SEQ ID NO: 1642945 - DNA, 14 bp, Homo sapiens
gagcccgggctgcc

SEQ ID NO: 1642946 - DNA, 19 bp, Homo sapiens
gagcccgggctgcctgggc

SEQ ID NO: 1642947 - DNA, 20 bp, Homo sapiens
gagcccgggctgcctgggct

SEQ ID NO: 1642948 - DNA, 21 bp, Homo sapiens
gagcccgtgcagtacaggcaa

SEQ ID NO: 1642949 - DNA, 20 bp, Homo sapiens
gagccctaaccccttccaga

SEQ ID NO: 1642950 - DNA, 13 bp, Homo sapiens
gagccctccaggc

SEQ ID NO: 1642951 - DNA, 20 bp, Homo sapiens
gagccctccaggcctgcagg

SEQ ID NO: 1642952 - DNA, 12 bp, Homo sapiens
gagccctcccta

SEQ ID NO: 1642953 - DNA, 19 bp, Homo sapiens
gagccctgaggacctctca

SEQ ID NO: 1642954 - DNA, 12 bp, Homo sapiens
gagccctggaga

SEQ ID NO: 1642955 - DNA, 14 bp, Homo sapiens
gagccctggagagc

SEQ ID NO: 1642956 - DNA, 15 bp, Homo sapiens
gagcccttgcctccc

SEQ ID NO: 1642957 - DNA, 16 bp, Homo sapiens
gagcccttgcctcccc

SEQ ID NO: 1642958 - DNA, 22 bp, Homo sapiens
gagcccttgcctccccatttcc

SEQ ID NO: 1642959 - DNA, 20 bp, Homo sapiens
gagccgagatcgcgccactg

SEQ ID NO: 1642960 - DNA, 16 bp, Homo sapiens
gagccgagggcgtcag

SEQ ID NO: 1642961 - DNA, 20 bp, Homo sapiens
gagccgagggcgtcagagag

SEQ ID NO: 1642962 - DNA, 18 bp, Homo sapiens
gagccgaggggagagagg

SEQ ID NO: 1642963 - DNA, 23 bp, Homo sapiens
gagccgaggggagagagggactc

SEQ ID NO: 1642964 - DNA, 22 bp, Homo sapiens
gagccgattgtcctatctccag

SEQ ID NO: 1642965 - DNA, 21 bp, Homo sapiens
gagccgcatcttctccatctg

SEQ ID NO: 1642966 - DNA, 23 bp, Homo sapiens
gagccggcacctacatccccagg

SEQ ID NO: 1642967 - DNA, 23 bp, Homo sapiens
gagccggccccaggctcgtggac

SEQ ID NO: 1642968 - DNA, 14 bp, Homo sapiens
gagccgggccgcag

SEQ ID NO: 1642969 - DNA, 15 bp, Homo sapiens
gagccgggccgcaga

SEQ ID NO: 1642970 - DNA, 13 bp, Homo sapiens
gagccgggcctgg

SEQ ID NO: 1642971 - DNA, 20 bp, Homo sapiens
gagccgggcctggggctcct

SEQ ID NO: 1642972 - DNA, 21 bp, Homo sapiens
gagccggtaactgtcctgtcc

SEQ ID NO: 1642973 - DNA, 16 bp, Homo sapiens
gagccggtggtgcccg

SEQ ID NO: 1642974 - DNA, 20 bp, Homo sapiens
gagccgtggtccctgaggat

SEQ ID NO: 1642975 - DNA, 16 bp, Homo sapiens
gagcctaatgaaaggg

SEQ ID NO: 1642976 - DNA, 14 bp, Homo sapiens
gagcctagccacct

SEQ ID NO: 1642977 - DNA, 17 bp, Homo sapiens
gagcctagccacctccc

SEQ ID NO: 1642978 - DNA, 18 bp, Homo sapiens
gagcctagcggagcccag

SEQ ID NO: 1642979 - DNA, 11 bp, Homo sapiens
gagcctcagaa

SEQ ID NO: 1642980 - DNA, 19 bp, Homo sapiens
gagcctcccaccagagccg

SEQ ID NO: 1642981 - DNA, 23 bp, Homo sapiens
gagcctctgctggaaggggcagc

SEQ ID NO: 1642982 - DNA, 12 bp, Homo sapiens
gagcctcttagt

SEQ ID NO: 1642983 - DNA, 18 bp, Homo sapiens
gagcctgccctcactccc

SEQ ID NO: 1642984 - DNA, 13 bp, Homo sapiens
gagcctgctcccc

SEQ ID NO: 1642985 - DNA, 18 bp, Homo sapiens
gagcctgctcccccaccc

SEQ ID NO: 1642986 - DNA, 20 bp, Homo sapiens
gagcctgctggaagcccagc

SEQ ID NO: 1642987 - DNA, 13 bp, Homo sapiens
gagcctgctggca

SEQ ID NO: 1642988 - DNA, 15 bp, Homo sapiens
gagcctggtcctggc

SEQ ID NO: 1642989 - DNA, 12 bp, Homo sapiens
gagcctgtcacc

SEQ ID NO: 1642990 - DNA, 18 bp, Homo sapiens
gagcctgtcaccagagct

SEQ ID NO: 1642991 - DNA, 24 bp, Homo sapiens
gagcctgtcaccagagcttctctg

SEQ ID NO: 1642992 - DNA, 19 bp, Homo sapiens
gagcctgtgcgtcccagct

SEQ ID NO: 1642993 - DNA, 17 bp, Homo sapiens
gagccttcaagtgccaa

SEQ ID NO: 1642994 - DNA, 18 bp, Homo sapiens
gagccttcaagtgccaaa

SEQ ID NO: 1642995 - DNA, 22 bp, Homo sapiens
gagccttcagaatgctcctgag

SEQ ID NO: 1642996 - DNA, 16 bp, Homo sapiens
gagccttcctttctcc

SEQ ID NO: 1642997 - DNA, 21 bp, Homo sapiens
gagccttcctttctcctgccc

SEQ ID NO: 1642998 - DNA, 17 bp, Homo sapiens
gagccttctcagaagca

SEQ ID NO: 1642999 - DNA, 18 bp, Homo sapiens
gagccttctcagaagcac

SEQ ID NO: 1643000 - DNA, 22 bp, Homo sapiens
gagccttgcagatatctgcatg

SEQ ID NO: 1643001 - DNA, 17 bp, Homo sapiens
gagccttgctgggccag

SEQ ID NO: 1643002 - DNA, 20 bp, Homo sapiens
gagccttgctgggccaggga

SEQ ID NO: 1643003 - DNA, 18 bp, Homo sapiens
gagcctttggttctggcc

SEQ ID NO: 1643004 - DNA, 23 bp, Homo sapiens
gagccttttccctctttggctcc

SEQ ID NO: 1643005 - DNA, 12 bp, Homo sapiens
gagccttttgct

SEQ ID NO: 1643006 - DNA, 14 bp, Homo sapiens
gagccttttgctct

SEQ ID NO: 1643007 - DNA, 13 bp, Homo sapiens
gagcgaaactccg

SEQ ID NO: 1643008 - DNA, 13 bp, Homo sapiens
gagcgacacagac

SEQ ID NO: 1643009 - DNA, 23 bp, Homo sapiens
gagcgacgtttatttcatctctt

SEQ ID NO: 1643010 - DNA, 21 bp, Homo sapiens
gagcgagacttggtttcaaaa

SEQ ID NO: 1643011 - DNA, 18 bp, Homo sapiens
gagcgcacctgccccctg

SEQ ID NO: 1643012 - DNA, 16 bp, Homo sapiens
gagcgcatcaggcctg

SEQ ID NO: 1643013 - DNA, 12 bp, Homo sapiens
gagcgccagctc

SEQ ID NO: 1643014 - DNA, 13 bp, Homo sapiens
gagcgccagctcc

SEQ ID NO: 1643015 - DNA, 22 bp, Homo sapiens
gagcgctcctgccgcagagctg

SEQ ID NO: 1643016 - DNA, 13 bp, Homo sapiens
gagcggagcccga

SEQ ID NO: 1643017 - DNA, 22 bp, Homo sapiens
atcccaaagttgttgtaacctg

SEQ ID NO: 1643018 - DNA, 15 bp, Homo sapiens
atcccaacagccaag

SEQ ID NO: 1643019 - DNA, 15 bp, Homo sapiens
atcccaacagccatg

SEQ ID NO: 1643020 - DNA, 14 bp, Homo sapiens
atcccaagaaatgg

SEQ ID NO: 1643021 - DNA, 15 bp, Homo sapiens
atcccacagtggcac

SEQ ID NO: 1643022 - DNA, 18 bp, Homo sapiens
atcccacccacatgtgac

SEQ ID NO: 1643023 - DNA, 20 bp, Homo sapiens
atcccacccacatgtgacac

SEQ ID NO: 1643024 - DNA, 24 bp, Homo sapiens
atcccacccccgaccctgccctgg

SEQ ID NO: 1643025 - DNA, 21 bp, Homo sapiens
atcccaccccctcctccccca

SEQ ID NO: 1643026 - DNA, 13 bp, Homo sapiens
atcccaccttccc

SEQ ID NO: 1643027 - DNA, 18 bp, Homo sapiens
atcccagaccagccaagg

SEQ ID NO: 1643028 - DNA, 19 bp, Homo sapiens
atcccagcactttgggagg

SEQ ID NO: 1643029 - DNA, 15 bp, Homo sapiens
atcccagcctgtggt

SEQ ID NO: 1643030 - DNA, 23 bp, Homo sapiens
atcccagctactcaagaggctga

SEQ ID NO: 1643031 - DNA, 13 bp, Homo sapiens
atcccagctcacg

SEQ ID NO: 1643032 - DNA, 12 bp, Homo sapiens
atcccaggggac

SEQ ID NO: 1643033 - DNA, 20 bp, Homo sapiens
atcccaggggaccacacctc

SEQ ID NO: 1643034 - DNA, 11 bp, Homo sapiens
atcccatctct

SEQ ID NO: 1643035 - DNA, 19 bp, Homo sapiens
atcccatgtcacctcagct

SEQ ID NO: 1643036 - DNA, 14 bp, Homo sapiens
atcccattccaggc

SEQ ID NO: 1643037 - DNA, 14 bp, Homo sapiens
atcccattgccctg

SEQ ID NO: 1643038 - DNA, 23 bp, Homo sapiens
atccccaaaacaggccaggtgtg

SEQ ID NO: 1643039 - DNA, 21 bp, Homo sapiens
atccccaataattgcagaact

SEQ ID NO: 1643040 - DNA, 22 bp, Homo sapiens
atccccaataattgcagaacta

SEQ ID NO: 1643041 - DNA, 19 bp, Homo sapiens
atccccactgggaccaacc

SEQ ID NO: 1643042 - DNA, 12 bp, Homo sapiens
atccccagagcc

SEQ ID NO: 1643043 - DNA, 13 bp, Homo sapiens
atccccagagccc

SEQ ID NO: 1643044 - DNA, 17 bp, Homo sapiens
atccccagagcccagct

SEQ ID NO: 1643045 - DNA, 19 bp, Homo sapiens
atccccagagcccagctct

SEQ ID NO: 1643046 - DNA, 16 bp, Homo sapiens
atccccaggccaggtc

SEQ ID NO: 1643047 - DNA, 14 bp, Homo sapiens
atccccagggcagc

SEQ ID NO: 1643048 - DNA, 19 bp, Homo sapiens
atccccagggcccaccccc

SEQ ID NO: 1643049 - DNA, 22 bp, Homo sapiens
atccccagggggcatgaccaga

SEQ ID NO: 1643050 - DNA, 21 bp, Homo sapiens
atccccaggggtcccagccac

SEQ ID NO: 1643051 - DNA, 23 bp, Homo sapiens
atccccaggggtcccagccaccc

SEQ ID NO: 1643052 - DNA, 13 bp, Homo sapiens
atccccaggtctc

SEQ ID NO: 1643053 - DNA, 17 bp, Homo sapiens
atccccaggtctctcca

SEQ ID NO: 1643054 - DNA, 13 bp, Homo sapiens
atccccatctccc

SEQ ID NO: 1643055 - DNA, 16 bp, Homo sapiens
atccccatctccctgc

SEQ ID NO: 1643056 - DNA, 12 bp, Homo sapiens
atcccccagcct

SEQ ID NO: 1643057 - DNA, 13 bp, Homo sapiens
atcccccctgctg

SEQ ID NO: 1643058 - DNA, 17 bp, Homo sapiens
atccccgcctggccagg

SEQ ID NO: 1643059 - DNA, 14 bp, Homo sapiens
atcccctccttggg

SEQ ID NO: 1643060 - DNA, 21 bp, Homo sapiens
atcccctcgtcctgtcccaga

SEQ ID NO: 1643061 - DNA, 13 bp, Homo sapiens
atccccttctccc

SEQ ID NO: 1643062 - DNA, 20 bp, Homo sapiens
atccccttctcccctgcact

SEQ ID NO: 1643063 - DNA, 14 bp, Homo sapiens
atcccgaaaatctc

SEQ ID NO: 1643064 - DNA, 17 bp, Homo sapiens
atcccgatacctcagcc

SEQ ID NO: 1643065 - DNA, 17 bp, Homo sapiens
atcccggccggccctgg

SEQ ID NO: 1643066 - DNA, 23 bp, Homo sapiens
atcccggccggccctggcttgga

SEQ ID NO: 1643067 - DNA, 14 bp, Homo sapiens
atcccggcctcttc

SEQ ID NO: 1643068 - DNA, 16 bp, Homo sapiens
atcccggcctcttcca

SEQ ID NO: 1643069 - DNA, 23 bp, Homo sapiens
atcccggcggaaagcctctgtcc

SEQ ID NO: 1643070 - DNA, 22 bp, Homo sapiens
atcccgggtttggctgagcctg

SEQ ID NO: 1643071 - DNA, 15 bp, Homo sapiens
atcccgtatcacagt

SEQ ID NO: 1643072 - DNA, 13 bp, Homo sapiens
atcccgtgttctc

SEQ ID NO: 1643073 - DNA, 21 bp, Homo sapiens
atccctaccccctaagagcca

SEQ ID NO: 1643074 - DNA, 20 bp, Homo sapiens
atccctagtccccctgtttt

SEQ ID NO: 1643075 - DNA, 17 bp, Homo sapiens
atccctatgggattcag

SEQ ID NO: 1643076 - DNA, 19 bp, Homo sapiens
atccctccattcatccttc

SEQ ID NO: 1643077 - DNA, 15 bp, Homo sapiens
atccctcctgagctc

SEQ ID NO: 1643078 - DNA, 18 bp, Homo sapiens
atccctcggaagccgtct

SEQ ID NO: 1643079 - DNA, 15 bp, Homo sapiens
atccctctcctaact

SEQ ID NO: 1643080 - DNA, 11 bp, Homo sapiens
atccctctctt

SEQ ID NO: 1643081 - DNA, 16 bp, Homo sapiens
atccctctcttcccct

SEQ ID NO: 1643082 - DNA, 20 bp, Homo sapiens
atccctctcttccccttccc

SEQ ID NO: 1643083 - DNA, 20 bp, Homo sapiens
atccctgaacccctggccag

SEQ ID NO: 1643084 - DNA, 18 bp, Homo sapiens
atccctgactggccaaac

SEQ ID NO: 1643085 - DNA, 15 bp, Homo sapiens
atccctgaggactga

SEQ ID NO: 1643086 - DNA, 18 bp, Homo sapiens
atccctgaggactgattt

SEQ ID NO: 1643087 - DNA, 19 bp, Homo sapiens
atccctgcggcctccacac

SEQ ID NO: 1643088 - DNA, 18 bp, Homo sapiens
atccctggagcaggagcc

SEQ ID NO: 1643089 - DNA, 15 bp, Homo sapiens
atccctgtactctga

SEQ ID NO: 1643090 - DNA, 13 bp, Homo sapiens
atccctgtgtcca

SEQ ID NO: 1643091 - DNA, 18 bp, Homo sapiens
atccctgttacccagaga

SEQ ID NO: 1643092 - DNA, 14 bp, Homo sapiens
atcccttaagaatg

SEQ ID NO: 1643093 - DNA, 12 bp, Homo sapiens
atcccttcctgg

SEQ ID NO: 1643094 - DNA, 16 bp, Homo sapiens
atcccttcctggaaac

SEQ ID NO: 1643095 - DNA, 21 bp, Homo sapiens
atcccttcctggaaacagcat

SEQ ID NO: 1643096 - DNA, 23 bp, Homo sapiens
atcccttcctggaaacagcatga

SEQ ID NO: 1643097 - DNA, 17 bp, Homo sapiens
atcccttcggagccaac

SEQ ID NO: 1643098 - DNA, 22 bp, Homo sapiens
atcccttgtacctatggctgcc

SEQ ID NO: 1643099 - DNA, 14 bp, Homo sapiens
atccctttattacc

SEQ ID NO: 1643100 - DNA, 16 bp, Homo sapiens
atccctttttttacat

SEQ ID NO: 1643101 - DNA, 20 bp, Homo sapiens
atccctttttttacatttca

SEQ ID NO: 1643102 - DNA, 13 bp, Homo sapiens
atccgaagggaat

SEQ ID NO: 1643103 - DNA, 18 bp, Homo sapiens
atccgcaatgtggagcag

SEQ ID NO: 1643104 - DNA, 23 bp, Homo sapiens
atccgcaatgtggagcagcagcc

SEQ ID NO: 1643105 - DNA, 12 bp, Homo sapiens
atccgctgccac

SEQ ID NO: 1643106 - DNA, 21 bp, Homo sapiens
atccggtggcctattccagga

SEQ ID NO: 1643107 - DNA, 16 bp, Homo sapiens
atccgtcattgctgct

SEQ ID NO: 1643108 - DNA, 17 bp, Homo sapiens
atccgtcattgctgctg

SEQ ID NO: 1643109 - DNA, 16 bp, Homo sapiens
atccgtgaattgcttt

SEQ ID NO: 1643110 - DNA, 18 bp, Homo sapiens
atcctaagatgtgttctt

SEQ ID NO: 1643111 - DNA, 23 bp, Homo sapiens
atcctaagggtcgaaagctctag

SEQ ID NO: 1643112 - DNA, 17 bp, Homo sapiens
ctttattttgagatgta

SEQ ID NO: 1643113 - DNA, 22 bp, Homo sapiens
ctttattttgagatgtaaaaag

SEQ ID NO: 1643114 - DNA, 21 bp, Homo sapiens
ctttattttttaagtatttat

SEQ ID NO: 1643115 - DNA, 15 bp, Homo sapiens
ctttcaaagaaggaa

SEQ ID NO: 1643116 - DNA, 16 bp, Homo sapiens
ctttcaaatcctccct

SEQ ID NO: 1643117 - DNA, 14 bp, Homo sapiens
ctttcaacttgcat

SEQ ID NO: 1643118 - DNA, 14 bp, Homo sapiens
ctttcacaaaaaag

SEQ ID NO: 1643119 - DNA, 17 bp, Homo sapiens
ctttcacaaaattttat

SEQ ID NO: 1643120 - DNA, 20 bp, Homo sapiens
ctttcacaacatttgcagat

SEQ ID NO: 1643121 - DNA, 19 bp, Homo sapiens
ctttcacacttccaccagc

SEQ ID NO: 1643122 - DNA, 20 bp, Homo sapiens
ctttcacacttccaccagcc

SEQ ID NO: 1643123 - DNA, 14 bp, Homo sapiens
ctttcacagctcct

SEQ ID NO: 1643124 - DNA, 18 bp, Homo sapiens
ctttcacagctcctccca

SEQ ID NO: 1643125 - DNA, 21 bp, Homo sapiens
ctttcacagtgaagtgccttt

SEQ ID NO: 1643126 - DNA, 15 bp, Homo sapiens
ctttcaccagaattt

SEQ ID NO: 1643127 - DNA, 18 bp, Homo sapiens
ctttcaccctcatgaaaa

SEQ ID NO: 1643128 - DNA, 16 bp, Homo sapiens
ctttcacttcttccta

SEQ ID NO: 1643129 - DNA, 22 bp, Homo sapiens
ctttcagaaatataacacattt

SEQ ID NO: 1643130 - DNA, 20 bp, Homo sapiens
ctttcagagaggtctcaggt

SEQ ID NO: 1643131 - DNA, 14 bp, Homo sapiens
ctttcagagccagt

SEQ ID NO: 1643132 - DNA, 20 bp, Homo sapiens
ctttcagagccagtgaagga

SEQ ID NO: 1643133 - DNA, 12 bp, Homo sapiens
ctttcagatgtc

SEQ ID NO: 1643134 - DNA, 22 bp, Homo sapiens
ctttcagatgtcttctgcctgt

SEQ ID NO: 1643135 - DNA, 20 bp, Homo sapiens
ctttcagcagaaatgaaatc

SEQ ID NO: 1643136 - DNA, 19 bp, Homo sapiens
ctttcagccacatgcccca

SEQ ID NO: 1643137 - DNA, 22 bp, Homo sapiens
ctttcagccacatgccccaggc

SEQ ID NO: 1643138 - DNA, 12 bp, Homo sapiens
ctttcaggtact

SEQ ID NO: 1643139 - DNA, 15 bp, Homo sapiens
ctttcagtacttttt

SEQ ID NO: 1643140 - DNA, 16 bp, Homo sapiens
ctttcatccttgacta

SEQ ID NO: 1643141 - DNA, 18 bp, Homo sapiens
ctttcatctctctacctc

SEQ ID NO: 1643142 - DNA, 19 bp, Homo sapiens
ctttcatctctctacctcc

SEQ ID NO: 1643143 - DNA, 16 bp, Homo sapiens
ctttcatcttaaacta

SEQ ID NO: 1643144 - DNA, 22 bp, Homo sapiens
ctttcatggctgctgttgctta

SEQ ID NO: 1643145 - DNA, 16 bp, Homo sapiens
ctttcattttgcttta

SEQ ID NO: 1643146 - DNA, 17 bp, Homo sapiens
ctttcattttgctttaa

SEQ ID NO: 1643147 - DNA, 16 bp, Homo sapiens
ctttcatttttttcca

SEQ ID NO: 1643148 - DNA, 20 bp, Homo sapiens
ctttcatttttttccaggct

SEQ ID NO: 1643149 - DNA, 11 bp, Homo sapiens
ctttccaaaga

SEQ ID NO: 1643150 - DNA, 10 bp, Homo sapiens
ctttccaaat

SEQ ID NO: 1643151 - DNA, 22 bp, Homo sapiens
ctttccaaattaaaacaaatat

SEQ ID NO: 1643152 - DNA, 22 bp, Homo sapiens
ctttccaatccagaggaacaag

SEQ ID NO: 1643153 - DNA, 22 bp, Homo sapiens
ctttccaccacagccagcacct

SEQ ID NO: 1643154 - DNA, 23 bp, Homo sapiens
ctttccagagcaaccagaaggag

SEQ ID NO: 1643155 - DNA, 16 bp, Homo sapiens
ctttccagcctgggca

SEQ ID NO: 1643156 - DNA, 13 bp, Homo sapiens
ctttccatcaact

SEQ ID NO: 1643157 - DNA, 23 bp, Homo sapiens
ctttccatccattacctccatcc

SEQ ID NO: 1643158 - DNA, 16 bp, Homo sapiens
ctttccatctctgcct

SEQ ID NO: 1643159 - DNA, 17 bp, Homo sapiens
ctttccatctgtccaca

SEQ ID NO: 1643160 - DNA, 22 bp, Homo sapiens
ctttccatgggagccagctgct

SEQ ID NO: 1643161 - DNA, 14 bp, Homo sapiens
ctttccatgttgct

SEQ ID NO: 1643162 - DNA, 22 bp, Homo sapiens
ctttccatttggtttagaacat

SEQ ID NO: 1643163 - DNA, 19 bp, Homo sapiens
ctttccatttttttcttta

SEQ ID NO: 1643164 - DNA, 11 bp, Homo sapiens
ctttcccaagc

SEQ ID NO: 1643165 - DNA, 13 bp, Homo sapiens
ctttcccaccatt

SEQ ID NO: 1643166 - DNA, 21 bp, Homo sapiens
ctttcccaccattcctgcctt

SEQ ID NO: 1643167 - DNA, 12 bp, Homo sapiens
ctttcccaggac

SEQ ID NO: 1643168 - DNA, 13 bp, Homo sapiens
ctttcccaggacg

SEQ ID NO: 1643169 - DNA, 15 bp, Homo sapiens
ctttcccaggagaaa

SEQ ID NO: 1643170 - DNA, 19 bp, Homo sapiens
ctttcccaggagaaagatg

SEQ ID NO: 1643171 - DNA, 15 bp, Homo sapiens
ctttcccaggccgca

SEQ ID NO: 1643172 - DNA, 15 bp, Homo sapiens
ctttcccatgtattt

SEQ ID NO: 1643173 - DNA, 19 bp, Homo sapiens
ctttcccatgtatttgtta

SEQ ID NO: 1643174 - DNA, 17 bp, Homo sapiens
ctttccccagaggctcc

SEQ ID NO: 1643175 - DNA, 19 bp, Homo sapiens
ctttcccccaccagctaag

SEQ ID NO: 1643176 - DNA, 18 bp, Homo sapiens
ctttccccgggggaggaa

SEQ ID NO: 1643177 - DNA, 11 bp, Homo sapiens
ctttcccctct

SEQ ID NO: 1643178 - DNA, 13 bp, Homo sapiens
ctttcccctgtgg

SEQ ID NO: 1643179 - DNA, 15 bp, Homo sapiens
ctttcccctgtgggg

SEQ ID NO: 1643180 - DNA, 13 bp, Homo sapiens
ctttccctgaagc

SEQ ID NO: 1643181 - DNA, 18 bp, Homo sapiens
ctttccctgaagccctag

SEQ ID NO: 1643182 - DNA, 12 bp, Homo sapiens
ctttccctgagg

SEQ ID NO: 1643183 - DNA, 14 bp, Homo sapiens
ctttccctgaggaa

SEQ ID NO: 1643184 - DNA, 15 bp, Homo sapiens
ctttcccttggctgt

SEQ ID NO: 1643185 - DNA, 19 bp, Homo sapiens
ctttccgtggcactgcata

SEQ ID NO: 1643186 - DNA, 22 bp, Homo sapiens
ctttccgtttttttctttcctg

SEQ ID NO: 1643187 - DNA, 17 bp, Homo sapiens
ctttcctcaaaaagcag

SEQ ID NO: 1643188 - DNA, 22 bp, Homo sapiens
ctttcctcctcaggcacacagc

SEQ ID NO: 1643189 - DNA, 20 bp, Homo sapiens
ctttcctctttctgctctgc

SEQ ID NO: 1643190 - DNA, 15 bp, Homo sapiens
ctttcctgaatccaa

SEQ ID NO: 1643191 - DNA, 15 bp, Homo sapiens
ctttcctgagctgtc

SEQ ID NO: 1643192 - DNA, 20 bp, Homo sapiens
ctttcctgagctgtcgctgc

SEQ ID NO: 1643193 - DNA, 20 bp, Homo sapiens
ctttcctggacactcagacc

SEQ ID NO: 1643194 - DNA, 13 bp, Homo sapiens
ctttcctgggcct

SEQ ID NO: 1643195 - DNA, 17 bp, Homo sapiens
ctttcctgggcctttgc

SEQ ID NO: 1643196 - DNA, 14 bp, Homo sapiens
ctttccttcccaat

SEQ ID NO: 1643197 - DNA, 15 bp, Homo sapiens
ctttccttcccaata

SEQ ID NO: 1643198 - DNA, 13 bp, Homo sapiens
ctttccttctcca

SEQ ID NO: 1643199 - DNA, 16 bp, Homo sapiens
ctttccttctccagga

SEQ ID NO: 1643200 - DNA, 14 bp, Homo sapiens
ctttccttgccttc

SEQ ID NO: 1643201 - DNA, 15 bp, Homo sapiens
ctttccttggcttta

SEQ ID NO: 1643202 - DNA, 13 bp, Homo sapiens
ctttcctttttcc

SEQ ID NO: 1643203 - DNA, 14 bp, Homo sapiens
ctttcgaggcctga

SEQ ID NO: 1643204 - DNA, 20 bp, Homo sapiens
ctttcgaggcctgaagccag

SEQ ID NO: 1643205 - DNA, 14 bp, Homo sapiens
ctttcgggccatgt

SEQ ID NO: 1643206 - DNA, 17 bp, Homo sapiens
ctttcgtctactgcaag

SEQ ID NO: 1643207 - DNA, 14 bp, Homo sapiens
ctttcgttctgctg

SEQ ID NO: 1643208 - DNA, 22 bp, Homo sapiens
ctttcgttctgctgaccaaatg

SEQ ID NO: 1643209 - DNA, 13 bp, Homo sapiens
ctttctaaaactg

SEQ ID NO: 1643210 - DNA, 19 bp, Homo sapiens
ctttctaagccctgttctc

SEQ ID NO: 1643211 - DNA, 20 bp, Homo sapiens
ctttctagtcctattctatt

SEQ ID NO: 1643212 - DNA, 21 bp, Homo sapiens
ctttctagtcctattctattg

SEQ ID NO: 1643213 - DNA, 18 bp, Homo sapiens
ctttctcaaagaaatatt

SEQ ID NO: 1643214 - DNA, 14 bp, Homo sapiens
ctttctcaatgtct

SEQ ID NO: 1643215 - DNA, 20 bp, Homo sapiens
ctttctcagttttcataagt

SEQ ID NO: 1643216 - DNA, 15 bp, Homo sapiens
ctttctccactgggt

SEQ ID NO: 1643217 - DNA, 15 bp, Homo sapiens
ctttctccagccagc

SEQ ID NO: 1643218 - DNA, 20 bp, Homo sapiens
ctttctccagccagcaatga

SEQ ID NO: 1643219 - DNA, 13 bp, Homo sapiens
ctttctcccaggc

SEQ ID NO: 1643220 - DNA, 21 bp, Homo sapiens
ctttctcccaggccaggctcc

SEQ ID NO: 1643221 - DNA, 23 bp, Homo sapiens
ctttctcccccgacactgctgca

SEQ ID NO: 1643222 - DNA, 18 bp, Homo sapiens
ctttctcccctgccccca

SEQ ID NO: 1643223 - DNA, 22 bp, Homo sapiens
ctttctcccctgcccccaggac

SEQ ID NO: 1643224 - DNA, 13 bp, Homo sapiens
ctttctccctcaa

SEQ ID NO: 1643225 - DNA, 21 bp, Homo sapiens
ctttctccggggtctgtgctg

SEQ ID NO: 1643226 - DNA, 15 bp, Homo sapiens
ctttctcctgcccca

SEQ ID NO: 1643227 - DNA, 22 bp, Homo sapiens
agctcactgcaagctctgcctc

SEQ ID NO: 1643228 - DNA, 16 bp, Homo sapiens
agctcactgctgctgc

SEQ ID NO: 1643229 - DNA, 21 bp, Homo sapiens
agctcagaatagatctgatgg

SEQ ID NO: 1643230 - DNA, 16 bp, Homo sapiens
agctcagaatccaagt

SEQ ID NO: 1643231 - DNA, 19 bp, Homo sapiens
agctcagacattttctttt

SEQ ID NO: 1643232 - DNA, 20 bp, Homo sapiens
agctcagacccccactctca

SEQ ID NO: 1643233 - DNA, 18 bp, Homo sapiens
agctcagaggcccaggaa

SEQ ID NO: 1643234 - DNA, 19 bp, Homo sapiens
agctcagccccaactcttt

SEQ ID NO: 1643235 - DNA, 13 bp, Homo sapiens
agctcagccttct

SEQ ID NO: 1643236 - DNA, 22 bp, Homo sapiens
agctcagctgcccatcccagtc

SEQ ID NO: 1643237 - DNA, 13 bp, Homo sapiens
agctcaggacaga

SEQ ID NO: 1643238 - DNA, 22 bp, Homo sapiens
agctcagtaacataactgcttc

SEQ ID NO: 1643239 - DNA, 11 bp, Homo sapiens
agctcagtcat

SEQ ID NO: 1643240 - DNA, 22 bp, Homo sapiens
agctcagtcatcaaagcagaag

SEQ ID NO: 1643241 - DNA, 20 bp, Homo sapiens
agctcatcccccctgctgcc

SEQ ID NO: 1643242 - DNA, 24 bp, Homo sapiens
agctcatcccccctgctgcccagt

SEQ ID NO: 1643243 - DNA, 18 bp, Homo sapiens
agctcattaaactttttt

SEQ ID NO: 1643244 - DNA, 21 bp, Homo sapiens
agctcattataatgtcattaa

SEQ ID NO: 1643245 - DNA, 23 bp, Homo sapiens
agctcatttgagataaagtcaaa

SEQ ID NO: 1643246 - DNA, 15 bp, Homo sapiens
agctccaacctgcaa

SEQ ID NO: 1643247 - DNA, 21 bp, Homo sapiens
agctccacggtgcgtggctgt

SEQ ID NO: 1643248 - DNA, 19 bp, Homo sapiens
agctccactctgcttctct

SEQ ID NO: 1643249 - DNA, 16 bp, Homo sapiens
agctccagtttgcatt

SEQ ID NO: 1643250 - DNA, 13 bp, Homo sapiens
agctccattttct

SEQ ID NO: 1643251 - DNA, 19 bp, Homo sapiens
agctcccaacagaggcctc

SEQ ID NO: 1643252 - DNA, 22 bp, Homo sapiens
agctcccacccacctgtagggc

SEQ ID NO: 1643253 - DNA, 17 bp, Homo sapiens
agctcccaccccacccc

SEQ ID NO: 1643254 - DNA, 11 bp, Homo sapiens
agctcccaggc

SEQ ID NO: 1643255 - DNA, 16 bp, Homo sapiens
agctcccagggtggac

SEQ ID NO: 1643256 - DNA, 22 bp, Homo sapiens
agctccccacaccttccagggc

SEQ ID NO: 1643257 - DNA, 22 bp, Homo sapiens
agctccccaggactcaccctca

SEQ ID NO: 1643258 - DNA, 18 bp, Homo sapiens
agctccccccgcccaccc

SEQ ID NO: 1643259 - DNA, 15 bp, Homo sapiens
agctcccctccacag

SEQ ID NO: 1643260 - DNA, 19 bp, Homo sapiens
agctcccctcggagaagag

SEQ ID NO: 1643261 - DNA, 17 bp, Homo sapiens
agctcccctggagccag

SEQ ID NO: 1643262 - DNA, 15 bp, Homo sapiens
agctccctcctccca

SEQ ID NO: 1643263 - DNA, 19 bp, Homo sapiens
agctccctcctcccatctc

SEQ ID NO: 1643264 - DNA, 20 bp, Homo sapiens
agctccctcctcccatctcc

SEQ ID NO: 1643265 - DNA, 23 bp, Homo sapiens
agctccctcctcccatctccttc

SEQ ID NO: 1643266 - DNA, 15 bp, Homo sapiens
agctccctcgctgta

SEQ ID NO: 1643267 - DNA, 18 bp, Homo sapiens
agctccctcgctgtatga

SEQ ID NO: 1643268 - DNA, 13 bp, Homo sapiens
agctccctctgcc

SEQ ID NO: 1643269 - DNA, 14 bp, Homo sapiens
agctccctctgcct

SEQ ID NO: 1643270 - DNA, 16 bp, Homo sapiens
agctccgcctgctggg

SEQ ID NO: 1643271 - DNA, 17 bp, Homo sapiens
agctcctcctcctgggc

SEQ ID NO: 1643272 - DNA, 16 bp, Homo sapiens
agctcctctccccagc

SEQ ID NO: 1643273 - DNA, 18 bp, Homo sapiens
agctcctctccccagccc

SEQ ID NO: 1643274 - DNA, 22 bp, Homo sapiens
agctcctctccccagcccagag

SEQ ID NO: 1643275 - DNA, 13 bp, Homo sapiens
agctcctctcctt

SEQ ID NO: 1643276 - DNA, 24 bp, Homo sapiens
agctcctctccttgggctcctggc

SEQ ID NO: 1643277 - DNA, 15 bp, Homo sapiens
agctcctgctacttc

SEQ ID NO: 1643278 - DNA, 17 bp, Homo sapiens
agctcctgctacttccc

SEQ ID NO: 1643279 - DNA, 19 bp, Homo sapiens
agctcctgctgcggaggag

SEQ ID NO: 1643280 - DNA, 16 bp, Homo sapiens
agctcctgggcagctt

SEQ ID NO: 1643281 - DNA, 12 bp, Homo sapiens
agctcctgtggc

SEQ ID NO: 1643282 - DNA, 17 bp, Homo sapiens
agctccttttgtcccca

SEQ ID NO: 1643283 - DNA, 21 bp, Homo sapiens
agctccttttgtccccagggc

SEQ ID NO: 1643284 - DNA, 14 bp, Homo sapiens
agctcgctggcttt

SEQ ID NO: 1643285 - DNA, 22 bp, Homo sapiens
agctcgctggctttctctctgg

SEQ ID NO: 1643286 - DNA, 19 bp, Homo sapiens
agctcggggggctctgcct

SEQ ID NO: 1643287 - DNA, 15 bp, Homo sapiens
agctcggtggaccca

SEQ ID NO: 1643288 - DNA, 16 bp, Homo sapiens
agctcggtggacccag

SEQ ID NO: 1643289 - DNA, 18 bp, Homo sapiens
agctcggtggacccaggg

SEQ ID NO: 1643290 - DNA, 19 bp, Homo sapiens
agctcggtggacccaggga

SEQ ID NO: 1643291 - DNA, 13 bp, Homo sapiens
agctcgtgtgtcc

SEQ ID NO: 1643292 - DNA, 23 bp, Homo sapiens
agctcgtgtgtcctcatggagaa

SEQ ID NO: 1643293 - DNA, 19 bp, Homo sapiens
agctctaaagtagcaactg

SEQ ID NO: 1643294 - DNA, 18 bp, Homo sapiens
agctctactgccctcccc

SEQ ID NO: 1643295 - DNA, 14 bp, Homo sapiens
agctctagaatctg

SEQ ID NO: 1643296 - DNA, 18 bp, Homo sapiens
agctctagcaagggaggc

SEQ ID NO: 1643297 - DNA, 14 bp, Homo sapiens
agctctagttcaaa

SEQ ID NO: 1643298 - DNA, 16 bp, Homo sapiens
agctctataattgttt

SEQ ID NO: 1643299 - DNA, 22 bp, Homo sapiens
agctctataattgttttgctac

SEQ ID NO: 1643300 - DNA, 20 bp, Homo sapiens
agctctattaagatttccaa

SEQ ID NO: 1643301 - DNA, 22 bp, Homo sapiens
agctctattaagatttccaagt

SEQ ID NO: 1643302 - DNA, 17 bp, Homo sapiens
agctctattttaaagta

SEQ ID NO: 1643303 - DNA, 17 bp, Homo sapiens
agctctcagcaagtgcc

SEQ ID NO: 1643304 - DNA, 19 bp, Homo sapiens
agctctcagcaagtgccca

SEQ ID NO: 1643305 - DNA, 20 bp, Homo sapiens
agctctcagcaagtgcccag

SEQ ID NO: 1643306 - DNA, 23 bp, Homo sapiens
agctctcagcaagtgcccagtgg

SEQ ID NO: 1643307 - DNA, 13 bp, Homo sapiens
agctctccaggcc

SEQ ID NO: 1643308 - DNA, 14 bp, Homo sapiens
agctctccaggcca

SEQ ID NO: 1643309 - DNA, 19 bp, Homo sapiens
agctctccaggccaggtgg

SEQ ID NO: 1643310 - DNA, 21 bp, Homo sapiens
agctctccaggccaggtggga

SEQ ID NO: 1643311 - DNA, 16 bp, Homo sapiens
agctctcccctcctgc

SEQ ID NO: 1643312 - DNA, 21 bp, Homo sapiens
agctctcccctcctgctgggc

SEQ ID NO: 1643313 - DNA, 19 bp, Homo sapiens
agctctccctctggccctg

SEQ ID NO: 1643314 - DNA, 21 bp, Homo sapiens
agctctccgagctctggtgct

SEQ ID NO: 1643315 - DNA, 19 bp, Homo sapiens
agctctctaggcctctcca

SEQ ID NO: 1643316 - DNA, 14 bp, Homo sapiens
agctctctgccctg

SEQ ID NO: 1643317 - DNA, 17 bp, Homo sapiens
agctctctgccctgtgt

SEQ ID NO: 1643318 - DNA, 15 bp, Homo sapiens
agctctctgggcctg

SEQ ID NO: 1643319 - DNA, 21 bp, Homo sapiens
agctctgaagtcacatcacag

SEQ ID NO: 1643320 - DNA, 23 bp, Homo sapiens
agctctgaagtcacatcacagga

SEQ ID NO: 1643321 - DNA, 15 bp, Homo sapiens
agctctgacatccct

SEQ ID NO: 1643322 - DNA, 22 bp, Homo sapiens
agctctgacatcccttcctgga

SEQ ID NO: 1643323 - DNA, 20 bp, Homo sapiens
agctctgagacccttttctc

SEQ ID NO: 1643324 - DNA, 15 bp, Homo sapiens
agctctgaggggagg

SEQ ID NO: 1643325 - DNA, 12 bp, Homo sapiens
agctctgcatta

SEQ ID NO: 1643326 - DNA, 17 bp, Homo sapiens
agctctggacagcccca

SEQ ID NO: 1643327 - DNA, 12 bp, Homo sapiens
agctctggaggg

SEQ ID NO: 1643328 - DNA, 13 bp, Homo sapiens
agctctggccccg

SEQ ID NO: 1643329 - DNA, 20 bp, Homo sapiens
agctctggctgaaccctgtg

SEQ ID NO: 1643330 - DNA, 21 bp, Homo sapiens
agctctggctgaaccctgtgc

SEQ ID NO: 1643331 - DNA, 20 bp, Homo sapiens
agctctggcttccagaaaac

SEQ ID NO: 1643332 - DNA, 19 bp, Homo sapiens
agctctggggacagcttcc

SEQ ID NO: 1643333 - DNA, 23 bp, Homo sapiens
agctctggggacagcttcctcac

SEQ ID NO: 1643334 - DNA, 17 bp, Homo sapiens
agctctggtgacaccag

SEQ ID NO: 1643335 - DNA, 16 bp, Homo sapiens
agctctgtggcctgtg

SEQ ID NO: 1643336 - DNA, 20 bp, Homo sapiens
agctctgtggcctgtgtcca

SEQ ID NO: 1643337 - DNA, 19 bp, Homo sapiens
agctctgtgggtctctgga

SEQ ID NO: 1643338 - DNA, 17 bp, Homo sapiens
agctctgtttataaaaa

SEQ ID NO: 1643339 - DNA, 17 bp, Homo sapiens
agctcttactctttcct

SEQ ID NO: 1643340 - DNA, 18 bp, Homo sapiens
agctcttactctttccta

SEQ ID NO: 1643341 - DNA, 14 bp, Homo sapiens
agctcttcaagctg

SEQ ID NO: 1643342 - DNA, 16 bp, Homo sapiens
agctcttcattccatt

SEQ ID NO: 1643343 - DNA, 12 bp, Homo sapiens
agctcttccctt

SEQ ID NO: 1643344 - DNA, 13 bp, Homo sapiens
agctcttccctta

SEQ ID NO: 1643345 - DNA, 19 bp, Homo sapiens
agctcttcctatccctctc

SEQ ID NO: 1643346 - DNA, 18 bp, Homo sapiens
agctcttcggtttctgag

SEQ ID NO: 1643347 - DNA, 19 bp, Homo sapiens
agctcttcggtttctgagc

SEQ ID NO: 1643348 - DNA, 14 bp, Homo sapiens
agctcttctaagga

SEQ ID NO: 1643349 - DNA, 14 bp, Homo sapiens
agctcttctcagtg

SEQ ID NO: 1643350 - DNA, 17 bp, Homo sapiens
agctcttctcagtgtct

SEQ ID NO: 1643351 - DNA, 18 bp, Homo sapiens
agctcttctcagtgtctg

SEQ ID NO: 1643352 - DNA, 18 bp, Homo sapiens
agctcttgcccttccctg

SEQ ID NO: 1643353 - DNA, 12 bp, Homo sapiens
agctcttggaag

SEQ ID NO: 1643354 - DNA, 16 bp, Homo sapiens
agctcttggaagagct

SEQ ID NO: 1643355 - DNA, 23 bp, Homo sapiens
agctcttggcccctgtgtgagtt

SEQ ID NO: 1643356 - DNA, 17 bp, Homo sapiens
agctcttgggtcagaga

SEQ ID NO: 1643357 - DNA, 15 bp, Homo sapiens
agctctttccaaatt

SEQ ID NO: 1643358 - DNA, 21 bp, Homo sapiens
agctctttccaaattaaaaca

SEQ ID NO: 1643359 - DNA, 18 bp, Homo sapiens
agctcttttctcctgcag

SEQ ID NO: 1643360 - DNA, 12 bp, Homo sapiens
agctgaaaaggg

SEQ ID NO: 1643361 - DNA, 17 bp, Homo sapiens
agctgaaaagggcactc

SEQ ID NO: 1643362 - DNA, 20 bp, Homo sapiens
agctgaaattttagaaatat

SEQ ID NO: 1643363 - DNA, 22 bp, Homo sapiens
agctgaacaataggctgttccc

SEQ ID NO: 1643364 - DNA, 21 bp, Homo sapiens
agctgaaccaaagcctcttca

SEQ ID NO: 1643365 - DNA, 22 bp, Homo sapiens
agctgaagaggttgaagctaaa

SEQ ID NO: 1643366 - DNA, 22 bp, Homo sapiens
agctgaagattaggcacacaga

SEQ ID NO: 1643367 - DNA, 18 bp, Homo sapiens
agctgaagtcaaaatatg

SEQ ID NO: 1643368 - DNA, 14 bp, Homo sapiens
agctgacagtcagc

SEQ ID NO: 1643369 - DNA, 15 bp, Homo sapiens
agctgacagtcagct

SEQ ID NO: 1643370 - DNA, 23 bp, Homo sapiens
agctgacccagccccttgagaaa

SEQ ID NO: 1643371 - DNA, 20 bp, Homo sapiens
agctgacttggcacttaagt

SEQ ID NO: 1643372 - DNA, 15 bp, Homo sapiens
agctgagaagaatga

SEQ ID NO: 1643373 - DNA, 20 bp, Homo sapiens
agctgagaaggccagccctc

SEQ ID NO: 1643374 - DNA, 19 bp, Homo sapiens
agctgagactacaagtgtg

SEQ ID NO: 1643375 - DNA, 18 bp, Homo sapiens
agctgagagccctgctgt

SEQ ID NO: 1643376 - DNA, 22 bp, Homo sapiens
agctgagagccctgctgtggga

SEQ ID NO: 1643377 - DNA, 21 bp, Homo sapiens
agctgagcacttagcaggcac

SEQ ID NO: 1643378 - DNA, 14 bp, Homo sapiens
agctgagcaggtgt

SEQ ID NO: 1643379 - DNA, 15 bp, Homo sapiens
agctgagccagttgt

SEQ ID NO: 1643380 - DNA, 23 bp, Homo sapiens
agctgagcctgcagggaagcccc

SEQ ID NO: 1643381 - DNA, 22 bp, Homo sapiens
agctgagcttgagctcccctgg

SEQ ID NO: 1643382 - DNA, 23 bp, Homo sapiens
agctgaggtctcttgagggagct

SEQ ID NO: 1643383 - DNA, 16 bp, Homo sapiens
agctgagtcacctcct

SEQ ID NO: 1643384 - DNA, 18 bp, Homo sapiens
agctgagtcacctcctcc

SEQ ID NO: 1643385 - DNA, 20 bp, Homo sapiens
agctgagttacttgtctgag

SEQ ID NO: 1643386 - DNA, 22 bp, Homo sapiens
agctgagttacttgtctgaggc

SEQ ID NO: 1643387 - DNA, 21 bp, Homo sapiens
agctgatattatttcttctct

SEQ ID NO: 1643388 - DNA, 12 bp, Homo sapiens
agctgatccagt

SEQ ID NO: 1643389 - DNA, 22 bp, Homo sapiens
agctgatccagtttccggaaac

SEQ ID NO: 1643390 - DNA, 22 bp, Homo sapiens
agctgatgaacttattctgtag

SEQ ID NO: 1643391 - DNA, 21 bp, Homo sapiens
agctgatgatgtctcttgtag

SEQ ID NO: 1643392 - DNA, 20 bp, Homo sapiens
agctgatgcctccttggcca

SEQ ID NO: 1643393 - DNA, 13 bp, Homo sapiens
agctgatggcagc

SEQ ID NO: 1643394 - DNA, 20 bp, Homo sapiens
agctgatgttggaagagaaa

SEQ ID NO: 1643395 - DNA, 21 bp, Homo sapiens
agctgatgttggaagagaaag

SEQ ID NO: 1643396 - DNA, 22 bp, Homo sapiens
agctgattgcagaaaggagaga

SEQ ID NO: 1643397 - DNA, 15 bp, Homo sapiens
agctgatttccaggc

SEQ ID NO: 1643398 - DNA, 20 bp, Homo sapiens
agctgatttccaggcccctg

SEQ ID NO: 1643399 - DNA, 15 bp, Homo sapiens
agctgatttgtatat

SEQ ID NO: 1643400 - DNA, 21 bp, Homo sapiens
agctgcaaggtactctggtga

SEQ ID NO: 1643401 - DNA, 19 bp, Homo sapiens
agctgcacattcctggccc

SEQ ID NO: 1643402 - DNA, 22 bp, Homo sapiens
agctgcacctgccagcctggct

SEQ ID NO: 1643403 - DNA, 19 bp, Homo sapiens
agctgcactgatgctgccc

SEQ ID NO: 1643404 - DNA, 20 bp, Homo sapiens
agctgcactgatgctgcccc

SEQ ID NO: 1643405 - DNA, 15 bp, Homo sapiens
agctgcactgtgaac

SEQ ID NO: 1643406 - DNA, 11 bp, Homo sapiens
agctgcagaac

SEQ ID NO: 1643407 - DNA, 19 bp, Homo sapiens
agctgcagaccatgccaga

SEQ ID NO: 1643408 - DNA, 19 bp, Homo sapiens
agctgcagataagtggcct

SEQ ID NO: 1643409 - DNA, 17 bp, Homo sapiens
agctgcagatgcctctg

SEQ ID NO: 1643410 - DNA, 14 bp, Homo sapiens
agctgcagctgggc

SEQ ID NO: 1643411 - DNA, 15 bp, Homo sapiens
agctgcagctgggcc

SEQ ID NO: 1643412 - DNA, 16 bp, Homo sapiens
agctgcagctgggccc

SEQ ID NO: 1643413 - DNA, 19 bp, Homo sapiens
agctgcagctgggccccat

SEQ ID NO: 1643414 - DNA, 20 bp, Homo sapiens
agctgcatcatccttgcagg

SEQ ID NO: 1643415 - DNA, 19 bp, Homo sapiens
agctgcatcctccaagaat

SEQ ID NO: 1643416 - DNA, 14 bp, Homo sapiens
agctgccaagtgct

SEQ ID NO: 1643417 - DNA, 11 bp, Homo sapiens
agctgccactg

SEQ ID NO: 1643418 - DNA, 15 bp, Homo sapiens
agctgccactgggca

SEQ ID NO: 1643419 - DNA, 20 bp, Homo sapiens
agctgccactgggcacctgc

SEQ ID NO: 1643420 - DNA, 18 bp, Homo sapiens
agctgccatccttgctgc

SEQ ID NO: 1643421 - DNA, 19 bp, Homo sapiens
agctgccatccttgctgca

SEQ ID NO: 1643422 - DNA, 15 bp, Homo sapiens
agctgccatggctag

SEQ ID NO: 1643423 - DNA, 21 bp, Homo sapiens
agctgcccagacacatgggct

SEQ ID NO: 1643424 - DNA, 14 bp, Homo sapiens
agctgcccctggca

SEQ ID NO: 1643425 - DNA, 21 bp, Homo sapiens
agctgcccctggcacctgtgt

SEQ ID NO: 1643426 - DNA, 16 bp, Homo sapiens
agctgccctagctgac

SEQ ID NO: 1643427 - DNA, 18 bp, Homo sapiens
agctgccctagctgaccc

SEQ ID NO: 1643428 - DNA, 18 bp, Homo sapiens
agctgccctatgggcctg

SEQ ID NO: 1643429 - DNA, 19 bp, Homo sapiens
agctgccctatgggcctgc

SEQ ID NO: 1643430 - DNA, 18 bp, Homo sapiens
agctgccgggcctgattt

SEQ ID NO: 1643431 - DNA, 13 bp, Homo sapiens
agctgcctaccta

SEQ ID NO: 1643432 - DNA, 13 bp, Homo sapiens
agctgcctcactt

SEQ ID NO: 1643433 - DNA, 16 bp, Homo sapiens
agctgcctctgctccc

SEQ ID NO: 1643434 - DNA, 18 bp, Homo sapiens
agctgcctctgctccctc

SEQ ID NO: 1643435 - DNA, 10 bp, Homo sapiens
agctgcctgc

SEQ ID NO: 1643436 - DNA, 12 bp, Homo sapiens
agctgcctgcag

SEQ ID NO: 1643437 - DNA, 14 bp, Homo sapiens
agctgcctgcagca

SEQ ID NO: 1643438 - DNA, 18 bp, Homo sapiens
agctgcctgcttggcccg

SEQ ID NO: 1643439 - DNA, 13 bp, Homo sapiens
agctgcctggatg

SEQ ID NO: 1643440 - DNA, 14 bp, Homo sapiens
agctgcctggatga

SEQ ID NO: 1643441 - DNA, 23 bp, Homo sapiens
agctgcctgtccctaccccatgg

SEQ ID NO: 1643442 - DNA, 10 bp, Homo sapiens
agctgccttc

SEQ ID NO: 1643443 - DNA, 13 bp, Homo sapiens
agctgccttccct

SEQ ID NO: 1643444 - DNA, 14 bp, Homo sapiens
agctgccttcccta

SEQ ID NO: 1643445 - DNA, 19 bp, Homo sapiens
agctgccttccctagcttt

SEQ ID NO: 1643446 - DNA, 14 bp, Homo sapiens
agctgccttggctc

SEQ ID NO: 1643447 - DNA, 15 bp, Homo sapiens
tgtcatttttaatgt

SEQ ID NO: 1643448 - DNA, 18 bp, Homo sapiens
tgtcatttttaatgtatc

SEQ ID NO: 1643449 - DNA, 21 bp, Homo sapiens
tgtccaaacgtcctctttagt

SEQ ID NO: 1643450 - DNA, 15 bp, Homo sapiens
tgtccaaactgccta

SEQ ID NO: 1643451 - DNA, 11 bp, Homo sapiens
tgtccaaagag

SEQ ID NO: 1643452 - DNA, 17 bp, Homo sapiens
tgtccaaagaggctgcc

SEQ ID NO: 1643453 - DNA, 18 bp, Homo sapiens
tgtccaaagtttatttat

SEQ ID NO: 1643454 - DNA, 19 bp, Homo sapiens
tgtccaacaataaacagga

SEQ ID NO: 1643455 - DNA, 14 bp, Homo sapiens
tgtccaacagagtg

SEQ ID NO: 1643456 - DNA, 14 bp, Homo sapiens
tgtccaacatggtg

SEQ ID NO: 1643457 - DNA, 15 bp, Homo sapiens
tgtccaacctaaccc

SEQ ID NO: 1643458 - DNA, 23 bp, Homo sapiens
tgtccaagaactctaaccagtgt

SEQ ID NO: 1643459 - DNA, 14 bp, Homo sapiens
tgtccacagatgcc

SEQ ID NO: 1643460 - DNA, 18 bp, Homo sapiens
tgtccacagatgcctcca

SEQ ID NO: 1643461 - DNA, 19 bp, Homo sapiens
tgtccacagatgcctccac

SEQ ID NO: 1643462 - DNA, 18 bp, Homo sapiens
tgtccacatccccagagc

SEQ ID NO: 1643463 - DNA, 13 bp, Homo sapiens
tgtccacctggcc

SEQ ID NO: 1643464 - DNA, 18 bp, Homo sapiens
tgtccactctcggggccc

SEQ ID NO: 1643465 - DNA, 19 bp, Homo sapiens
tgtccactctcggggccct

SEQ ID NO: 1643466 - DNA, 23 bp, Homo sapiens
tgtccactgagactttcccctct

SEQ ID NO: 1643467 - DNA, 19 bp, Homo sapiens
tgtccagcaccttgtgcct

SEQ ID NO: 1643468 - DNA, 22 bp, Homo sapiens
tgtccagcaccttgtgcctggg

SEQ ID NO: 1643469 - DNA, 13 bp, Homo sapiens
tgtccagcagctg

SEQ ID NO: 1643470 - DNA, 15 bp, Homo sapiens
tgtccagcagctgcg

SEQ ID NO: 1643471 - DNA, 12 bp, Homo sapiens
tgtccagcctgg

SEQ ID NO: 1643472 - DNA, 14 bp, Homo sapiens
tgtccagcctgggc

SEQ ID NO: 1643473 - DNA, 12 bp, Homo sapiens
tgtccagctcca

SEQ ID NO: 1643474 - DNA, 20 bp, Homo sapiens
tgtccagctccaacctgcaa

SEQ ID NO: 1643475 - DNA, 15 bp, Homo sapiens
tgtccagcttccaaa

SEQ ID NO: 1643476 - DNA, 15 bp, Homo sapiens
tgtccaggcagctcc

SEQ ID NO: 1643477 - DNA, 13 bp, Homo sapiens
tgtccagggccct

SEQ ID NO: 1643478 - DNA, 20 bp, Homo sapiens
tgtccaggtctcactgcttt

SEQ ID NO: 1643479 - DNA, 20 bp, Homo sapiens
tgtccagttttggaggctga

SEQ ID NO: 1643480 - DNA, 18 bp, Homo sapiens
tgtccatgcgctcagggc

SEQ ID NO: 1643481 - DNA, 22 bp, Homo sapiens
tgtccatgcgctcagggccatg

SEQ ID NO: 1643482 - DNA, 12 bp, Homo sapiens
tgtccatgtccc

SEQ ID NO: 1643483 - DNA, 14 bp, Homo sapiens
tgtccatgtccccc

SEQ ID NO: 1643484 - DNA, 16 bp, Homo sapiens
tgtccatgtgaaattt

SEQ ID NO: 1643485 - DNA, 19 bp, Homo sapiens
tgtcccaagccgggagcca

SEQ ID NO: 1643486 - DNA, 15 bp, Homo sapiens
tgtcccaaggagctg

SEQ ID NO: 1643487 - DNA, 19 bp, Homo sapiens
tgtcccacaaaatatttct

SEQ ID NO: 1643488 - DNA, 13 bp, Homo sapiens
tgtcccaccaact

SEQ ID NO: 1643489 - DNA, 13 bp, Homo sapiens
tgtcccaccagct

SEQ ID NO: 1643490 - DNA, 18 bp, Homo sapiens
tgtcccacccacacagct

SEQ ID NO: 1643491 - DNA, 23 bp, Homo sapiens
tgtcccacccacacagctgccct

SEQ ID NO: 1643492 - DNA, 18 bp, Homo sapiens
tgtcccacccccaccccc

SEQ ID NO: 1643493 - DNA, 22 bp, Homo sapiens
tgtcccacccccacccccagct

SEQ ID NO: 1643494 - DNA, 23 bp, Homo sapiens
tgtcccagagcttattggccact

SEQ ID NO: 1643495 - DNA, 23 bp, Homo sapiens
tgtcccagaggttatctgcctgg

SEQ ID NO: 1643496 - DNA, 23 bp, Homo sapiens
tgtcccagcctggggctccctct

SEQ ID NO: 1643497 - DNA, 14 bp, Homo sapiens
tgtcccagctacca

SEQ ID NO: 1643498 - DNA, 18 bp, Homo sapiens
tgtcccagctaccaagtc

SEQ ID NO: 1643499 - DNA, 19 bp, Homo sapiens
tgtcccagggccctcccag

SEQ ID NO: 1643500 - DNA, 14 bp, Homo sapiens
tgtcccaggtcctc

SEQ ID NO: 1643501 - DNA, 23 bp, Homo sapiens
cctggctctgggccgggcctggg

SEQ ID NO: 1643502 - DNA, 16 bp, Homo sapiens
cctggctgaggttcct

SEQ ID NO: 1643503 - DNA, 22 bp, Homo sapiens
cctggctgaggttcctctgcct

SEQ ID NO: 1643504 - DNA, 12 bp, Homo sapiens
cctggctgcact

SEQ ID NO: 1643505 - DNA, 12 bp, Homo sapiens
cctggctgccag

SEQ ID NO: 1643506 - DNA, 14 bp, Homo sapiens
cctggctgccaggc

SEQ ID NO: 1643507 - DNA, 15 bp, Homo sapiens
cctggctgccaggcg

SEQ ID NO: 1643508 - DNA, 12 bp, Homo sapiens
cctggctgccca

SEQ ID NO: 1643509 - DNA, 13 bp, Homo sapiens
cctggctgctgcc

SEQ ID NO: 1643510 - DNA, 17 bp, Homo sapiens
cctggctgctgccccca

SEQ ID NO: 1643511 - DNA, 20 bp, Homo sapiens
cctggctgctgcccccaccc

SEQ ID NO: 1643512 - DNA, 13 bp, Homo sapiens
cctggctgtgagc

SEQ ID NO: 1643513 - DNA, 16 bp, Homo sapiens
cctggctgtgagcagc

SEQ ID NO: 1643514 - DNA, 17 bp, Homo sapiens
cctggctgtgcccagca

SEQ ID NO: 1643515 - DNA, 19 bp, Homo sapiens
cctggctgtgcccagcagg

SEQ ID NO: 1643516 - DNA, 23 bp, Homo sapiens
cctggctgtgcccagcaggccca

SEQ ID NO: 1643517 - DNA, 14 bp, Homo sapiens
cctggctgtggagg

SEQ ID NO: 1643518 - DNA, 15 bp, Homo sapiens
cctggcttctggagc

SEQ ID NO: 1643519 - DNA, 21 bp, Homo sapiens
cctggcttctggagcccttgg

SEQ ID NO: 1643520 - DNA, 17 bp, Homo sapiens
cctggcttgctccaggg

SEQ ID NO: 1643521 - DNA, 19 bp, Homo sapiens
cctggcttgctccagggtc

SEQ ID NO: 1643522 - DNA, 20 bp, Homo sapiens
cctggcttgctccagggtct

SEQ ID NO: 1643523 - DNA, 21 bp, Homo sapiens
cctggcttgcttgccgagcct

SEQ ID NO: 1643524 - DNA, 18 bp, Homo sapiens
cctggcttgtaactccac

SEQ ID NO: 1643525 - DNA, 22 bp, Homo sapiens
cctggcttgtaactccaccaac

SEQ ID NO: 1643526 - DNA, 14 bp, Homo sapiens
cctggctttgcctc

SEQ ID NO: 1643527 - DNA, 15 bp, Homo sapiens
cctggcttttacttt

SEQ ID NO: 1643528 - DNA, 16 bp, Homo sapiens
cctggcttttacttta

SEQ ID NO: 1643529 - DNA, 23 bp, Homo sapiens
cctggcttttcactgctggctgc

SEQ ID NO: 1643530 - DNA, 19 bp, Homo sapiens
cctgggaaagagatttaaa

SEQ ID NO: 1643531 - DNA, 21 bp, Homo sapiens
cctgggaaaggacccacccat

SEQ ID NO: 1643532 - DNA, 23 bp, Homo sapiens
cctgggaaaggacccacccatct

SEQ ID NO: 1643533 - DNA, 17 bp, Homo sapiens
cctgggaaggccacctc

SEQ ID NO: 1643534 - DNA, 14 bp, Homo sapiens
cctgggaatgtatt

SEQ ID NO: 1643535 - DNA, 22 bp, Homo sapiens
cctgggacactgcgggacagag

SEQ ID NO: 1643536 - DNA, 21 bp, Homo sapiens
cctgggacatcaggagactgg

SEQ ID NO: 1643537 - DNA, 15 bp, Homo sapiens
cctgggacccagcta

SEQ ID NO: 1643538 - DNA, 20 bp, Homo sapiens
cctgggacttccatgcctta

SEQ ID NO: 1643539 - DNA, 17 bp, Homo sapiens
cctgggagaacctcagg

SEQ ID NO: 1643540 - DNA, 19 bp, Homo sapiens
cctgggagaacctcaggct

SEQ ID NO: 1643541 - DNA, 16 bp, Homo sapiens
cctgggagcccagagg

SEQ ID NO: 1643542 - DNA, 13 bp, Homo sapiens
cctgggaggcaga

SEQ ID NO: 1643543 - DNA, 22 bp, Homo sapiens
cctgggagggaggtggtcctcc

SEQ ID NO: 1643544 - DNA, 13 bp, Homo sapiens
cctgggagggttc

SEQ ID NO: 1643545 - DNA, 18 bp, Homo sapiens
cctgggagggttcccctg

SEQ ID NO: 1643546 - DNA, 20 bp, Homo sapiens
cctgggagggttcccctggc

SEQ ID NO: 1643547 - DNA, 21 bp, Homo sapiens
cctgggagggttcccctggcc

SEQ ID NO: 1643548 - DNA, 21 bp, Homo sapiens
cctgggatctggcacactccc

SEQ ID NO: 1643549 - DNA, 20 bp, Homo sapiens
cctgggatgtccacagatgc

SEQ ID NO: 1643550 - DNA, 14 bp, Homo sapiens
cctgggatttgaga

SEQ ID NO: 1643551 - DNA, 17 bp, Homo sapiens
cctgggcaacaagagca

SEQ ID NO: 1643552 - DNA, 18 bp, Homo sapiens
cctgggcacccacctcca

SEQ ID NO: 1643553 - DNA, 13 bp, Homo sapiens
cctgggcaccggg

SEQ ID NO: 1643554 - DNA, 17 bp, Homo sapiens
cctgggcaccgggaccc

SEQ ID NO: 1643555 - DNA, 18 bp, Homo sapiens
cctgggcaccgggacccc

SEQ ID NO: 1643556 - DNA, 13 bp, Homo sapiens
cctgggcactccg

SEQ ID NO: 1643557 - DNA, 17 bp, Homo sapiens
cctgggcactccgcgcc

SEQ ID NO: 1643558 - DNA, 19 bp, Homo sapiens
cctgggcagccaggctgcc

SEQ ID NO: 1643559 - DNA, 17 bp, Homo sapiens
cctgggcaggtgggagc

SEQ ID NO: 1643560 - DNA, 18 bp, Homo sapiens
cctgggcatgggtccagg

SEQ ID NO: 1643561 - DNA, 22 bp, Homo sapiens
cctgggcatgggtccagggcct

SEQ ID NO: 1643562 - DNA, 16 bp, Homo sapiens
cctgggcattgctttc

SEQ ID NO: 1643563 - DNA, 19 bp, Homo sapiens
cctgggcatttggtgagag

SEQ ID NO: 1643564 - DNA, 13 bp, Homo sapiens
cctgggccccacc

SEQ ID NO: 1643565 - DNA, 21 bp, Homo sapiens
cctgggccccaccacctaggc

SEQ ID NO: 1643566 - DNA, 18 bp, Homo sapiens
cctgggccctgggctgga

SEQ ID NO: 1643567 - DNA, 19 bp, Homo sapiens
cctgggccctgggctggaa

SEQ ID NO: 1643568 - DNA, 13 bp, Homo sapiens
cctgggcctgccc

SEQ ID NO: 1643569 - DNA, 17 bp, Homo sapiens
cctgggcctgcccctgt

SEQ ID NO: 1643570 - DNA, 12 bp, Homo sapiens
cctgggcctgct

SEQ ID NO: 1643571 - DNA, 12 bp, Homo sapiens
cctgggcctgga

SEQ ID NO: 1643572 - DNA, 13 bp, Homo sapiens
cctgggcctggag

SEQ ID NO: 1643573 - DNA, 14 bp, Homo sapiens
cctgggcctgtccc

SEQ ID NO: 1643574 - DNA, 14 bp, Homo sapiens
cctgggcctgtgca

SEQ ID NO: 1643575 - DNA, 16 bp, Homo sapiens
cctgggcctgtgcagc

SEQ ID NO: 1643576 - DNA, 17 bp, Homo sapiens
cctgggcctgtgcagca

SEQ ID NO: 1643577 - DNA, 18 bp, Homo sapiens
cctgggcctgtgcagcag

SEQ ID NO: 1643578 - DNA, 21 bp, Homo sapiens
ctcttctagatgattttttga

SEQ ID NO: 1643579 - DNA, 19 bp, Homo sapiens
ctcttctcatttcacccct

SEQ ID NO: 1643580 - DNA, 13 bp, Homo sapiens
ctcttctccactg

SEQ ID NO: 1643581 - DNA, 17 bp, Homo sapiens
ctcttctccactggatg

SEQ ID NO: 1643582 - DNA, 13 bp, Homo sapiens
ctcttctcctttc

SEQ ID NO: 1643583 - DNA, 16 bp, Homo sapiens
ctcttctcctttcaca

SEQ ID NO: 1643584 - DNA, 14 bp, Homo sapiens
ctcttctcttccta

SEQ ID NO: 1643585 - DNA, 16 bp, Homo sapiens
ctcttctgaataaagc

SEQ ID NO: 1643586 - DNA, 19 bp, Homo sapiens
ctcttctgaataaagcaat

SEQ ID NO: 1643587 - DNA, 20 bp, Homo sapiens
ctcttctgaataaagcaatt

SEQ ID NO: 1643588 - DNA, 22 bp, Homo sapiens
ctcttctgacgtgccttttgca

SEQ ID NO: 1643589 - DNA, 12 bp, Homo sapiens
ctcttctgagct

SEQ ID NO: 1643590 - DNA, 15 bp, Homo sapiens
ctcttctgagctatt

SEQ ID NO: 1643591 - DNA, 21 bp, Homo sapiens
ctcttctgagctatttcatct

SEQ ID NO: 1643592 - DNA, 12 bp, Homo sapiens
ctcttctgctcc

SEQ ID NO: 1643593 - DNA, 14 bp, Homo sapiens
ctcttctgctccac

SEQ ID NO: 1643594 - DNA, 20 bp, Homo sapiens
ctcttctggagatggaagct

SEQ ID NO: 1643595 - DNA, 11 bp, Homo sapiens
ctcttctggct

SEQ ID NO: 1643596 - DNA, 14 bp, Homo sapiens
ctcttctggctcaa

SEQ ID NO: 1643597 - DNA, 17 bp, Homo sapiens
ctcttctgggcgtctga

SEQ ID NO: 1643598 - DNA, 21 bp, Homo sapiens
ctcttctgggcgtctgagctg

SEQ ID NO: 1643599 - DNA, 23 bp, Homo sapiens
ctcttctggggcaggctgggcca

SEQ ID NO: 1643600 - DNA, 20 bp, Homo sapiens
ctcttcttgaaattttaacc

SEQ ID NO: 1643601 - DNA, 20 bp, Homo sapiens
ctcttcttggggcccagtgc

SEQ ID NO: 1643602 - DNA, 22 bp, Homo sapiens
ctcttctttaaagggatggcaa

SEQ ID NO: 1643603 - DNA, 13 bp, Homo sapiens
ctcttctttctga

SEQ ID NO: 1643604 - DNA, 18 bp, Homo sapiens
ctcttctttgtgcctttg

SEQ ID NO: 1643605 - DNA, 19 bp, Homo sapiens
ctcttcttttggcttccat

SEQ ID NO: 1643606 - DNA, 21 bp, Homo sapiens
ctcttgaaaagttcagggacc

SEQ ID NO: 1643607 - DNA, 12 bp, Homo sapiens
ctcttgaaacct

SEQ ID NO: 1643608 - DNA, 17 bp, Homo sapiens
ctcttgaaacctgttaa

SEQ ID NO: 1643609 - DNA, 17 bp, Homo sapiens
ctcttgaagtccaggac

SEQ ID NO: 1643610 - DNA, 17 bp, Homo sapiens
ctcttgagagctcaggc

SEQ ID NO: 1643611 - DNA, 14 bp, Homo sapiens
ctcttgagctggcc

SEQ ID NO: 1643612 - DNA, 16 bp, Homo sapiens
ctcttgagctggcctc

SEQ ID NO: 1643613 - DNA, 17 bp, Homo sapiens
ctcttgaggaagcccag

SEQ ID NO: 1643614 - DNA, 18 bp, Homo sapiens
ctcttgaggaagcccagg

SEQ ID NO: 1643615 - DNA, 16 bp, Homo sapiens
ctcttgaggccaggag

SEQ ID NO: 1643616 - DNA, 21 bp, Homo sapiens
ctcttgatacccccctctgtc

SEQ ID NO: 1643617 - DNA, 12 bp, Homo sapiens
ctcttgcacccg

SEQ ID NO: 1643618 - DNA, 15 bp, Homo sapiens
ctcttgcacccgcct

SEQ ID NO: 1643619 - DNA, 19 bp, Homo sapiens
ctcttgcacccgcctctcc

SEQ ID NO: 1643620 - DNA, 21 bp, Homo sapiens
ctcttgccatttgtagctttg

SEQ ID NO: 1643621 - DNA, 20 bp, Homo sapiens
ctcttgcccatcctgactga

SEQ ID NO: 1643622 - DNA, 17 bp, Homo sapiens
ctcttgcccgcacccct

SEQ ID NO: 1643623 - DNA, 14 bp, Homo sapiens
ctcttgcccttccc

SEQ ID NO: 1643624 - DNA, 16 bp, Homo sapiens
ctcttgcccttccctg

SEQ ID NO: 1643625 - DNA, 17 bp, Homo sapiens
ctcttgcccttccctgt

SEQ ID NO: 1643626 - DNA, 18 bp, Homo sapiens
ctcttgctacctgtgagc

SEQ ID NO: 1643627 - DNA, 19 bp, Homo sapiens
ctcttgctcaaaaatctgt

SEQ ID NO: 1643628 - DNA, 20 bp, Homo sapiens
ctcttgctcaaaaatctgtt

SEQ ID NO: 1643629 - DNA, 14 bp, Homo sapiens
ctcttggagaaaat

SEQ ID NO: 1643630 - DNA, 21 bp, Homo sapiens
ctcttggagaagtctcagcta

SEQ ID NO: 1643631 - DNA, 22 bp, Homo sapiens
ctcttggccatccttctgtgta

SEQ ID NO: 1643632 - DNA, 13 bp, Homo sapiens
ctcttggcccctg

SEQ ID NO: 1643633 - DNA, 19 bp, Homo sapiens
ctcttggctatttctgtgt

SEQ ID NO: 1643634 - DNA, 13 bp, Homo sapiens
ctcttggctgacc

SEQ ID NO: 1643635 - DNA, 14 bp, Homo sapiens
ctcttggctgaccc

SEQ ID NO: 1643636 - DNA, 19 bp, Homo sapiens
ctcttggctgacccctctg

SEQ ID NO: 1643637 - DNA, 12 bp, Homo sapiens
ctcttggctgca

SEQ ID NO: 1643638 - DNA, 23 bp, Homo sapiens
ctcttgggaactccactctcctt

SEQ ID NO: 1643639 - DNA, 15 bp, Homo sapiens
ctcttggtcccatgg

SEQ ID NO: 1643640 - DNA, 16 bp, Homo sapiens
ctcttgtaccatagaa

SEQ ID NO: 1643641 - DNA, 13 bp, Homo sapiens
ctcttgtcatttt

SEQ ID NO: 1643642 - DNA, 16 bp, Homo sapiens
ctcttgtccctttccc

SEQ ID NO: 1643643 - DNA, 20 bp, Homo sapiens
ctcttgtccctttccctacc

SEQ ID NO: 1643644 - DNA, 21 bp, Homo sapiens
ctcttgtccctttccctacct

SEQ ID NO: 1643645 - DNA, 19 bp, Homo sapiens
ctcttgtcctggcccttca

SEQ ID NO: 1643646 - DNA, 20 bp, Homo sapiens
ctcttgtcctggcccttcag

SEQ ID NO: 1643647 - DNA, 23 bp, Homo sapiens
ctcttgtggtgcattgaaagaag

SEQ ID NO: 1643648 - DNA, 18 bp, Homo sapiens
ctcttgttaccatgtatg

SEQ ID NO: 1643649 - DNA, 24 bp, Homo sapiens
ctcttgtttacgatttcactagga

SEQ ID NO: 1643650 - DNA, 21 bp, Homo sapiens
ctcttgtttttattaatttat

SEQ ID NO: 1643651 - DNA, 13 bp, Homo sapiens
ctctttaaaaaca

SEQ ID NO: 1643652 - DNA, 13 bp, Homo sapiens
ctctttaaaatat

SEQ ID NO: 1643653 - DNA, 20 bp, Homo sapiens
ctctttaaactatgttccta

SEQ ID NO: 1643654 - DNA, 16 bp, Homo sapiens
ctctttaagttttgat

SEQ ID NO: 1643655 - DNA, 17 bp, Homo sapiens
ctctttaagttttgatt

SEQ ID NO: 1643656 - DNA, 15 bp, Homo sapiens
ctctttaccttctaa

SEQ ID NO: 1643657 - DNA, 16 bp, Homo sapiens
ctctttactcccttcc

SEQ ID NO: 1643658 - DNA, 15 bp, Homo sapiens
ctctttagtataatt

SEQ ID NO: 1643659 - DNA, 16 bp, Homo sapiens
ctctttagtataattg

SEQ ID NO: 1643660 - DNA, 17 bp, Homo sapiens
ctctttagtgttctgtt

SEQ ID NO: 1643661 - DNA, 15 bp, Homo sapiens
ctctttcacattgtt

SEQ ID NO: 1643662 - DNA, 22 bp, Homo sapiens
ctctttcagagaggtctcaggt

SEQ ID NO: 1643663 - DNA, 13 bp, Homo sapiens
ctctttccaaatt

SEQ ID NO: 1643664 - DNA, 16 bp, Homo sapiens
ctctttccaaattaaa

SEQ ID NO: 1643665 - DNA, 13 bp, Homo sapiens
ctctttcccagga

SEQ ID NO: 1643666 - DNA, 15 bp, Homo sapiens
ctctttcccaggacg

SEQ ID NO: 1643667 - DNA, 16 bp, Homo sapiens
ctctttccctaggaaa

SEQ ID NO: 1643668 - DNA, 20 bp, Homo sapiens
ctctttccctgcgagacgca

SEQ ID NO: 1643669 - DNA, 19 bp, Homo sapiens
ctctttcctatttcagtgt

SEQ ID NO: 1643670 - DNA, 13 bp, Homo sapiens
ctctttcctccac

SEQ ID NO: 1643671 - DNA, 11 bp, Homo sapiens
ctctttccttg

SEQ ID NO: 1643672 - DNA, 22 bp, Homo sapiens
ctctttccttgaaaataaaaag

SEQ ID NO: 1643673 - DNA, 15 bp, Homo sapiens
ctctttccttgagct

SEQ ID NO: 1643674 - DNA, 15 bp, Homo sapiens
ctctttctccctcac

SEQ ID NO: 1643675 - DNA, 12 bp, Homo sapiens
ctctttctctgg

SEQ ID NO: 1643676 - DNA, 22 bp, Homo sapiens
ctctttctctggtggtcttcct

SEQ ID NO: 1643677 - DNA, 23 bp, Homo sapiens
ctctttctctggtggtcttcctt

SEQ ID NO: 1643678 - DNA, 12 bp, Homo sapiens
ctctttctgggc

SEQ ID NO: 1643679 - DNA, 18 bp, Homo sapiens
ctctttgataacaaaaaa

SEQ ID NO: 1643680 - DNA, 18 bp, Homo sapiens
ctctttgggtttcttgtt

SEQ ID NO: 1643681 - DNA, 15 bp, Homo sapiens
ctcttttatatttgt

SEQ ID NO: 1643682 - DNA, 16 bp, Homo sapiens
ctcttttatatttgta

SEQ ID NO: 1643683 - DNA, 18 bp, Homo sapiens
ctcttttcccctttcctg

SEQ ID NO: 1643684 - DNA, 19 bp, Homo sapiens
ctcttttcccctttcctgt

SEQ ID NO: 1643685 - DNA, 14 bp, Homo sapiens
ctcttttcctcctc

SEQ ID NO: 1643686 - DNA, 15 bp, Homo sapiens
ctcttttcctcctcc

SEQ ID NO: 1643687 - DNA, 20 bp, Homo sapiens
ctcttttcctggtgctcttt

SEQ ID NO: 1643688 - DNA, 14 bp, Homo sapiens
ctcttttctctgtg

SEQ ID NO: 1643689 - DNA, 14 bp, Homo sapiens
ctcttttctgcatc

SEQ ID NO: 1643690 - DNA, 14 bp, Homo sapiens
ctcttttctttctg

SEQ ID NO: 1643691 - DNA, 14 bp, Homo sapiens
tgtcaagttgtgct

SEQ ID NO: 1643692 - DNA, 23 bp, Homo sapiens
tgtcaagttttgggggtgggctg

SEQ ID NO: 1643693 - DNA, 21 bp, Homo sapiens
tgtcaataaacagcttcatgc

SEQ ID NO: 1643694 - DNA, 22 bp, Homo sapiens
tgtcaatatcgtacctgtccct

SEQ ID NO: 1643695 - DNA, 17 bp, Homo sapiens
tgtcaatattaaataca

SEQ ID NO: 1643696 - DNA, 18 bp, Homo sapiens
tgtcaattcataaaaaca

SEQ ID NO: 1643697 - DNA, 15 bp, Homo sapiens
tgtcaatttctgtgt

SEQ ID NO: 1643698 - DNA, 19 bp, Homo sapiens
tgtcacagaaatcagagga

SEQ ID NO: 1643699 - DNA, 13 bp, Homo sapiens
tgtcacagagagc

SEQ ID NO: 1643700 - DNA, 16 bp, Homo sapiens
tgtcaccaccttccca

SEQ ID NO: 1643701 - DNA, 16 bp, Homo sapiens
tgtcacccagactgga

SEQ ID NO: 1643702 - DNA, 22 bp, Homo sapiens
tgtcacccttaggccagcacca

SEQ ID NO: 1643703 - DNA, 22 bp, Homo sapiens
tgtcaccgtgagcagctttgga

SEQ ID NO: 1643704 - DNA, 20 bp, Homo sapiens
tgtcacgctcatgtcctgtc

SEQ ID NO: 1643705 - DNA, 20 bp, Homo sapiens
tgtcacgctctggtgcagtc

SEQ ID NO: 1643706 - DNA, 22 bp, Homo sapiens
tgtcacgtgaaatatttaagta

SEQ ID NO: 1643707 - DNA, 19 bp, Homo sapiens
tgtcactaaacaagaaatc

SEQ ID NO: 1643708 - DNA, 18 bp, Homo sapiens
tgtcactagcagctgcag

SEQ ID NO: 1643709 - DNA, 22 bp, Homo sapiens
tgtcactcacatggacccaaga

SEQ ID NO: 1643710 - DNA, 15 bp, Homo sapiens
tgtcactcagctgag

SEQ ID NO: 1643711 - DNA, 15 bp, Homo sapiens
tgtcactcattgctg

SEQ ID NO: 1643712 - DNA, 16 bp, Homo sapiens
tgtcactcattgctga

SEQ ID NO: 1643713 - DNA, 21 bp, Homo sapiens
tgtcactcattgctgagcctc

SEQ ID NO: 1643714 - DNA, 13 bp, Homo sapiens
tgtcactgagctg

SEQ ID NO: 1643715 - DNA, 19 bp, Homo sapiens
tgtcactgccgacatccct

SEQ ID NO: 1643716 - DNA, 23 bp, Homo sapiens
tgtcactggtagaccaaaataaa

SEQ ID NO: 1643717 - DNA, 18 bp, Homo sapiens
tgtcacttaggttttgtc

SEQ ID NO: 1643718 - DNA, 22 bp, Homo sapiens
tgtcacttcgcgtgccctcgct

SEQ ID NO: 1643719 - DNA, 14 bp, Homo sapiens
tgtcagaaacatga

SEQ ID NO: 1643720 - DNA, 21 bp, Homo sapiens
tgtcagaacagagtgcaaccc

SEQ ID NO: 1643721 - DNA, 15 bp, Homo sapiens
tgtcagaagcctcca

SEQ ID NO: 1643722 - DNA, 18 bp, Homo sapiens
tgtcagaagcctccaagc

SEQ ID NO: 1643723 - DNA, 18 bp, Homo sapiens
tgtcagaatcctttacat

SEQ ID NO: 1643724 - DNA, 16 bp, Homo sapiens
tgtcagaccctggagg

SEQ ID NO: 1643725 - DNA, 17 bp, Homo sapiens
tgtcagaccctggaggc

SEQ ID NO: 1643726 - DNA, 12 bp, Homo sapiens
tgtcagacttta

SEQ ID NO: 1643727 - DNA, 23 bp, Homo sapiens
tgtcagactttaaagaataatat

SEQ ID NO: 1643728 - DNA, 20 bp, Homo sapiens
tgtcagagcccagcccagga

SEQ ID NO: 1643729 - DNA, 13 bp, Homo sapiens
tgtcagagccgcc

SEQ ID NO: 1643730 - DNA, 16 bp, Homo sapiens
tgtcagagttctgctc

SEQ ID NO: 1643731 - DNA, 13 bp, Homo sapiens
tgtcagatttctg

SEQ ID NO: 1643732 - DNA, 13 bp, Homo sapiens
tgtcagcatctga

SEQ ID NO: 1643733 - DNA, 15 bp, Homo sapiens
tgtcagcatctgacc

SEQ ID NO: 1643734 - DNA, 16 bp, Homo sapiens
tgtcagcatctgacca

SEQ ID NO: 1643735 - DNA, 17 bp, Homo sapiens
tgtcagcatctgaccat

SEQ ID NO: 1643736 - DNA, 20 bp, Homo sapiens
tgtcagcatctgaccatctg

SEQ ID NO: 1643737 - DNA, 15 bp, Homo sapiens
aatcattttaattat

SEQ ID NO: 1643738 - DNA, 19 bp, Homo sapiens
aatcattttaattattatt

SEQ ID NO: 1643739 - DNA, 20 bp, Homo sapiens
aatcattttacccttggctc

SEQ ID NO: 1643740 - DNA, 19 bp, Homo sapiens
aatcattttgcctcttttc

SEQ ID NO: 1643741 - DNA, 23 bp, Homo sapiens
aatcattttttatatatatgcat

SEQ ID NO: 1643742 - DNA, 22 bp, Homo sapiens
aatccaaaagacaaaaatcaaa

SEQ ID NO: 1643743 - DNA, 15 bp, Homo sapiens
aatccaaagaaaaag

SEQ ID NO: 1643744 - DNA, 11 bp, Homo sapiens
aatccaaagat

SEQ ID NO: 1643745 - DNA, 17 bp, Homo sapiens
aatccaaatctgtcctc

SEQ ID NO: 1643746 - DNA, 19 bp, Homo sapiens
aatccaaatctgtcctctg

SEQ ID NO: 1643747 - DNA, 17 bp, Homo sapiens
aatccaagcctccacag

SEQ ID NO: 1643748 - DNA, 18 bp, Homo sapiens
aatccaagcctccacagc

SEQ ID NO: 1643749 - DNA, 16 bp, Homo sapiens
aatccacatttctaaa

SEQ ID NO: 1643750 - DNA, 16 bp, Homo sapiens
aatccaggcacagctg

SEQ ID NO: 1643751 - DNA, 18 bp, Homo sapiens
aatccaggcacagctgag

SEQ ID NO: 1643752 - DNA, 20 bp, Homo sapiens
aatccaggcagatccaggac

SEQ ID NO: 1643753 - DNA, 21 bp, Homo sapiens
aatccaggcagatccaggact

SEQ ID NO: 1643754 - DNA, 17 bp, Homo sapiens
aatccagtgacctctct

SEQ ID NO: 1643755 - DNA, 17 bp, Homo sapiens
aatccagtggtgggtaa

SEQ ID NO: 1643756 - DNA, 18 bp, Homo sapiens
aatccagtggtgggtaat

SEQ ID NO: 1643757 - DNA, 21 bp, Homo sapiens
aatccagtggtgggtaattgt

SEQ ID NO: 1643758 - DNA, 19 bp, Homo sapiens
aatccatgttagtttttac

SEQ ID NO: 1643759 - DNA, 16 bp, Homo sapiens
aatccatttatttcat

SEQ ID NO: 1643760 - DNA, 23 bp, Homo sapiens
aatccattttctaaactgttttc

SEQ ID NO: 1643761 - DNA, 14 bp, Homo sapiens
aatccattttttag

SEQ ID NO: 1643762 - DNA, 14 bp, Homo sapiens
aatcccaagtaaaa

SEQ ID NO: 1643763 - DNA, 12 bp, Homo sapiens
aatcccaccaga

SEQ ID NO: 1643764 - DNA, 13 bp, Homo sapiens
aatcccagcactt

SEQ ID NO: 1643765 - DNA, 20 bp, Homo sapiens
aatcccagcactttgggagg

SEQ ID NO: 1643766 - DNA, 14 bp, Homo sapiens
aatcccagctactc

SEQ ID NO: 1643767 - DNA, 14 bp, Homo sapiens
aatcccctaaaata

SEQ ID NO: 1643768 - DNA, 15 bp, Homo sapiens
aatccccttctcccc

SEQ ID NO: 1643769 - DNA, 15 bp, Homo sapiens
aatccctctccaact

SEQ ID NO: 1643770 - DNA, 22 bp, Homo sapiens
aatcccttaacagttgtattta

SEQ ID NO: 1643771 - DNA, 23 bp, Homo sapiens
aatccctttattaccccctcctt

SEQ ID NO: 1643772 - DNA, 20 bp, Homo sapiens
aatccgaagggaattaaaaa

SEQ ID NO: 1643773 - DNA, 22 bp, Homo sapiens
aatcctagaaccaagcttcaga

SEQ ID NO: 1643774 - DNA, 21 bp, Homo sapiens
aatcctagccccgagacacca

SEQ ID NO: 1643775 - DNA, 21 bp, Homo sapiens
aatcctattaaaacacagctt

SEQ ID NO: 1643776 - DNA, 24 bp, Homo sapiens
aatcctattaaaacacagctttac

SEQ ID NO: 1643777 - DNA, 16 bp, Homo sapiens
aatcctcaacactatt

SEQ ID NO: 1643778 - DNA, 15 bp, Homo sapiens
aatcctctcctttct

SEQ ID NO: 1643779 - DNA, 11 bp, Homo sapiens
aatcctctggc

SEQ ID NO: 1643780 - DNA, 14 bp, Homo sapiens
aatcctgcaatgaa

SEQ ID NO: 1643781 - DNA, 16 bp, Homo sapiens
aatcctgccatttaaa

SEQ ID NO: 1643782 - DNA, 18 bp, Homo sapiens
aatcctggaaggacacag

SEQ ID NO: 1643783 - DNA, 12 bp, Homo sapiens
aatcctggcagc

SEQ ID NO: 1643784 - DNA, 21 bp, Homo sapiens
aatccttaacatttctctcca

SEQ ID NO: 1643785 - DNA, 20 bp, Homo sapiens
aatccttcaaaataaaaagt

SEQ ID NO: 1643786 - DNA, 21 bp, Homo sapiens
aatccttccattccacacaga

SEQ ID NO: 1643787 - DNA, 16 bp, Homo sapiens
aatccttccctgctct

SEQ ID NO: 1643788 - DNA, 19 bp, Homo sapiens
aatcgagagtgtgctctcc

SEQ ID NO: 1643789 - DNA, 17 bp, Homo sapiens
aatcgaggcagaaagat

SEQ ID NO: 1643790 - DNA, 18 bp, Homo sapiens
aatcgaggcagaaagata

SEQ ID NO: 1643791 - DNA, 20 bp, Homo sapiens
aatcgaggcagaaagataca

SEQ ID NO: 1643792 - DNA, 14 bp, Homo sapiens
aatcgattggcttt

SEQ ID NO: 1643793 - DNA, 15 bp, Homo sapiens
aatcgatttcctccc

SEQ ID NO: 1643794 - DNA, 15 bp, Homo sapiens
aatcgcaaggcctgt

SEQ ID NO: 1643795 - DNA, 16 bp, Homo sapiens
aatcggactgccaaat

SEQ ID NO: 1643796 - DNA, 22 bp, Homo sapiens
aatcggatctggggctctggga

SEQ ID NO: 1643797 - DNA, 18 bp, Homo sapiens
aatcggctggggactgct

SEQ ID NO: 1643798 - DNA, 15 bp, Homo sapiens
aatcggtttaaacat

SEQ ID NO: 1643799 - DNA, 15 bp, Homo sapiens
aatcgtgtgccatgg

SEQ ID NO: 1643800 - DNA, 14 bp, Homo sapiens
aatctaaaatttaa

SEQ ID NO: 1643801 - DNA, 14 bp, Homo sapiens
aatctaaagccagt

SEQ ID NO: 1643802 - DNA, 23 bp, Homo sapiens
aatctaacaataatatttcaagt

SEQ ID NO: 1643803 - DNA, 20 bp, Homo sapiens
aatctaagcagcttattgtt

SEQ ID NO: 1643804 - DNA, 21 bp, Homo sapiens
aatctaagcagcttattgttt

SEQ ID NO: 1643805 - DNA, 14 bp, Homo sapiens
aatctaaggataat

SEQ ID NO: 1643806 - DNA, 19 bp, Homo sapiens
aatctaatctcttattcta

SEQ ID NO: 1643807 - DNA, 16 bp, Homo sapiens
aatctacaccaatgaa

SEQ ID NO: 1643808 - DNA, 12 bp, Homo sapiens
aatctacatttg

SEQ ID NO: 1643809 - DNA, 14 bp, Homo sapiens
aatctaccagtggt

SEQ ID NO: 1643810 - DNA, 13 bp, Homo sapiens
aatctagaaatgt

SEQ ID NO: 1643811 - DNA, 23 bp, Homo sapiens
aatctagagtttatacagtgtac

SEQ ID NO: 1643812 - DNA, 17 bp, Homo sapiens
aatctaggatgtgatga

SEQ ID NO: 1643813 - DNA, 20 bp, Homo sapiens
aatctagtgggttgaccttt

SEQ ID NO: 1643814 - DNA, 15 bp, Homo sapiens
aatctagtttacaga

SEQ ID NO: 1643815 - DNA, 19 bp, Homo sapiens
aatctagtttacagaaaaa

SEQ ID NO: 1643816 - DNA, 20 bp, Homo sapiens
aatctataagtagtaaatca

SEQ ID NO: 1643817 - DNA, 19 bp, Homo sapiens
aatctatatttgtcttccg

SEQ ID NO: 1643818 - DNA, 14 bp, Homo sapiens
aatctatgaagtat

SEQ ID NO: 1643819 - DNA, 17 bp, Homo sapiens
aatctatgaagtatata

SEQ ID NO: 1643820 - DNA, 12 bp, Homo sapiens
aatctattatac

SEQ ID NO: 1643821 - DNA, 13 bp, Homo sapiens
aatctattcagac

SEQ ID NO: 1643822 - DNA, 18 bp, Homo sapiens
aatctattcctgtaaata

SEQ ID NO: 1643823 - DNA, 17 bp, Homo sapiens
aatctatttattaatat

SEQ ID NO: 1643824 - DNA, 18 bp, Homo sapiens
aatctatttattaatatt

SEQ ID NO: 1643825 - DNA, 14 bp, Homo sapiens
aatctcaaaattag

SEQ ID NO: 1643826 - DNA, 17 bp, Homo sapiens
aatctcaaaggagaaaa

SEQ ID NO: 1643827 - DNA, 22 bp, Homo sapiens
aatctcaattgaaagcttttaa

SEQ ID NO: 1643828 - DNA, 13 bp, Homo sapiens
aatctcaccccat

SEQ ID NO: 1643829 - DNA, 22 bp, Homo sapiens
aatctcaccccatcccacaccc

SEQ ID NO: 1643830 - DNA, 13 bp, Homo sapiens
aatctcagagaca

SEQ ID NO: 1643831 - DNA, 17 bp, Homo sapiens
aatctcataattggaat

SEQ ID NO: 1643832 - DNA, 18 bp, Homo sapiens
aatctcataatttataca

SEQ ID NO: 1643833 - DNA, 18 bp, Homo sapiens
aatctcatacctctgacc

SEQ ID NO: 1643834 - DNA, 19 bp, Homo sapiens
aatctcatacctctgacca

SEQ ID NO: 1643835 - DNA, 19 bp, Homo sapiens
aatctcatctctacaaaaa

SEQ ID NO: 1643836 - DNA, 14 bp, Homo sapiens
aatctccagggctc

SEQ ID NO: 1643837 - DNA, 19 bp, Homo sapiens
aatctcccgctgctgctgc

SEQ ID NO: 1643838 - DNA, 13 bp, Homo sapiens
aatctcctggctt

SEQ ID NO: 1643839 - DNA, 15 bp, Homo sapiens
aatctcctggcttta

SEQ ID NO: 1643840 - DNA, 21 bp, Homo sapiens
aatctcctggctttacagaca

SEQ ID NO: 1643841 - DNA, 15 bp, Homo sapiens
aatctcggctcactg

SEQ ID NO: 1643842 - DNA, 21 bp, Homo sapiens
aatctctatttgagaagttct

SEQ ID NO: 1643843 - DNA, 11 bp, Homo sapiens
aatctctgagc

SEQ ID NO: 1643844 - DNA, 17 bp, Homo sapiens
aatctctgattaaattt

SEQ ID NO: 1643845 - DNA, 14 bp, Homo sapiens
aatctctgtaggaa

SEQ ID NO: 1643846 - DNA, 21 bp, Homo sapiens
aatctcttcatgcttgacata

SEQ ID NO: 1643847 - DNA, 21 bp, Homo sapiens
aatctcttcattattctctgc

SEQ ID NO: 1643848 - DNA, 17 bp, Homo sapiens
aatctgaattttgcaat

SEQ ID NO: 1643849 - DNA, 23 bp, Homo sapiens
aatctgaattttgcaatgtattt

SEQ ID NO: 1643850 - DNA, 17 bp, Homo sapiens
aatctgacccagtgccc

SEQ ID NO: 1643851 - DNA, 16 bp, Homo sapiens
aatctgagggagctga

SEQ ID NO: 1643852 - DNA, 15 bp, Homo sapiens
aatgtaccttctttc

SEQ ID NO: 1643853 - DNA, 18 bp, Homo sapiens
aatgtacgtccagcctgc

SEQ ID NO: 1643854 - DNA, 18 bp, Homo sapiens
aatgtactatgtctgaac

SEQ ID NO: 1643855 - DNA, 14 bp, Homo sapiens
aatgtactcacata

SEQ ID NO: 1643856 - DNA, 19 bp, Homo sapiens
aatgtactcacatataaca

SEQ ID NO: 1643857 - DNA, 17 bp, Homo sapiens
aatgtactgatttcagt

SEQ ID NO: 1643858 - DNA, 12 bp, Homo sapiens
aatgtactgcat

SEQ ID NO: 1643859 - DNA, 18 bp, Homo sapiens
aatgtactggtaattgta

SEQ ID NO: 1643860 - DNA, 16 bp, Homo sapiens
aatgtacttaaagggt

SEQ ID NO: 1643861 - DNA, 17 bp, Homo sapiens
aatgtagaattgaaaat

SEQ ID NO: 1643862 - DNA, 23 bp, Homo sapiens
aatgtagacagatatttcaaaca

SEQ ID NO: 1643863 - DNA, 18 bp, Homo sapiens
aatgtagtttgaggaaat

SEQ ID NO: 1643864 - DNA, 16 bp, Homo sapiens
aatgtataaagattgt

SEQ ID NO: 1643865 - DNA, 20 bp, Homo sapiens
aatgtataaagattgtactt

SEQ ID NO: 1643866 - DNA, 16 bp, Homo sapiens
aatgtataaatataca

SEQ ID NO: 1643867 - DNA, 13 bp, Homo sapiens
aatgtatcaggaa

SEQ ID NO: 1643868 - DNA, 16 bp, Homo sapiens
aatgtatcatagaaat

SEQ ID NO: 1643869 - DNA, 19 bp, Homo sapiens
aatgtatcatagaaatgta

SEQ ID NO: 1643870 - DNA, 19 bp, Homo sapiens
aatgtatctatttgtacaa

SEQ ID NO: 1643871 - DNA, 22 bp, Homo sapiens
aatgtatctatttgtacaattt

SEQ ID NO: 1643872 - DNA, 13 bp, Homo sapiens
aatgtatcttatt

SEQ ID NO: 1643873 - DNA, 14 bp, Homo sapiens
aatgtatgtacaat

SEQ ID NO: 1643874 - DNA, 19 bp, Homo sapiens
aatgtatgtacaatacaat

SEQ ID NO: 1643875 - DNA, 20 bp, Homo sapiens
aatgtatgtgtaagtattct

SEQ ID NO: 1643876 - DNA, 13 bp, Homo sapiens
aatgtatgttacc

SEQ ID NO: 1643877 - DNA, 19 bp, Homo sapiens
aatgtattagtatggttca

SEQ ID NO: 1643878 - DNA, 16 bp, Homo sapiens
aatgtattattctgca

SEQ ID NO: 1643879 - DNA, 15 bp, Homo sapiens
aatgtattcatattt

SEQ ID NO: 1643880 - DNA, 19 bp, Homo sapiens
aatgtattgaacttggaaa

SEQ ID NO: 1643881 - DNA, 19 bp, Homo sapiens
aatgtattgattcaacagg

SEQ ID NO: 1643882 - DNA, 19 bp, Homo sapiens
aatgtatttagctacagct

SEQ ID NO: 1643883 - DNA, 13 bp, Homo sapiens
aatgtattttaat

SEQ ID NO: 1643884 - DNA, 22 bp, Homo sapiens
aatgtattttcatagatgtgtt

SEQ ID NO: 1643885 - DNA, 17 bp, Homo sapiens
aatgtattttcttttta

SEQ ID NO: 1643886 - DNA, 18 bp, Homo sapiens
aatgtcaccaccttccca

SEQ ID NO: 1643887 - DNA, 23 bp, Homo sapiens
aatgtcaccaccttcccagctct

SEQ ID NO: 1643888 - DNA, 17 bp, Homo sapiens
aatgtcacttaaaggct

SEQ ID NO: 1643889 - DNA, 15 bp, Homo sapiens
aatgtcagatacaat

SEQ ID NO: 1643890 - DNA, 16 bp, Homo sapiens
aatgtcagatacaatg

SEQ ID NO: 1643891 - DNA, 16 bp, Homo sapiens
aatgtcagggccaggt

SEQ ID NO: 1643892 - DNA, 13 bp, Homo sapiens
aatgtcagtatgt

SEQ ID NO: 1643893 - DNA, 15 bp, Homo sapiens
aatgtcagtatgtgg

SEQ ID NO: 1643894 - DNA, 16 bp, Homo sapiens
aatgtcattgctaaaa

SEQ ID NO: 1643895 - DNA, 13 bp, Homo sapiens
aatgtcattgtct

SEQ ID NO: 1643896 - DNA, 16 bp, Homo sapiens
aatgtcattgtctact

SEQ ID NO: 1643897 - DNA, 16 bp, Homo sapiens
aatgtccccattctat

SEQ ID NO: 1643898 - DNA, 17 bp, Homo sapiens
aatgtccccattctata

SEQ ID NO: 1643899 - DNA, 15 bp, Homo sapiens
aatgtccttattctt

SEQ ID NO: 1643900 - DNA, 15 bp, Homo sapiens
aatgtctcctttgct

SEQ ID NO: 1643901 - DNA, 16 bp, Homo sapiens
aatgtctcctttgctc

SEQ ID NO: 1643902 - DNA, 12 bp, Homo sapiens
aatgtctgctgg

SEQ ID NO: 1643903 - DNA, 20 bp, Homo sapiens
aatgtctgctggtatttcta

SEQ ID NO: 1643904 - DNA, 21 bp, Homo sapiens
aatgtctgctggtatttctaa

SEQ ID NO: 1643905 - DNA, 22 bp, Homo sapiens
aatgtctgctggtatttctaat

SEQ ID NO: 1643906 - DNA, 14 bp, Homo sapiens
aatgtctgtaaata

SEQ ID NO: 1643907 - DNA, 13 bp, Homo sapiens
aatgtctgtgcta

SEQ ID NO: 1643908 - DNA, 19 bp, Homo sapiens
aatgtcttaggtcaggagt

SEQ ID NO: 1643909 - DNA, 18 bp, Homo sapiens
aatgtctttgttggaaaa

SEQ ID NO: 1643910 - DNA, 22 bp, Homo sapiens
aatgtctttgttggaaaagaat

SEQ ID NO: 1643911 - DNA, 20 bp, Homo sapiens
aatgtgaagttcatcttgca

SEQ ID NO: 1643912 - DNA, 23 bp, Homo sapiens
aatgtgaatcagaccctacccca

SEQ ID NO: 1643913 - DNA, 12 bp, Homo sapiens
aatgtgaatttt

SEQ ID NO: 1643914 - DNA, 18 bp, Homo sapiens
aatgtgagctataatgtt

SEQ ID NO: 1643915 - DNA, 18 bp, Homo sapiens
aatgtgaggaactcacat

SEQ ID NO: 1643916 - DNA, 14 bp, Homo sapiens
aatgtgatcaactg

SEQ ID NO: 1643917 - DNA, 20 bp, Homo sapiens
aatgtgatcaactgttcagg

SEQ ID NO: 1643918 - DNA, 16 bp, Homo sapiens
aatgtgatttttctga

SEQ ID NO: 1643919 - DNA, 15 bp, Homo sapiens
aatgtgcagaaaata

SEQ ID NO: 1643920 - DNA, 20 bp, Homo sapiens
aatgtgcagaaaatatttaa

SEQ ID NO: 1643921 - DNA, 20 bp, Homo sapiens
aatgtgcagatgcaattgtt

SEQ ID NO: 1643922 - DNA, 21 bp, Homo sapiens
aatgtgcagggatattgcctt

SEQ ID NO: 1643923 - DNA, 19 bp, Homo sapiens
aatgtgctactgattgttt

SEQ ID NO: 1643924 - DNA, 22 bp, Homo sapiens
aatgtgctggtgaacactgtga

SEQ ID NO: 1643925 - DNA, 20 bp, Homo sapiens
aatgtgcttttccatctaaa

SEQ ID NO: 1643926 - DNA, 17 bp, Homo sapiens
aatgtggagcagcagcc

SEQ ID NO: 1643927 - DNA, 17 bp, Homo sapiens
aatgtggatttgattca

SEQ ID NO: 1643928 - DNA, 21 bp, Homo sapiens
aatgtggcccctgaacaagaa

SEQ ID NO: 1643929 - DNA, 20 bp, Homo sapiens
aatgtggcctaaaaatgcaa

SEQ ID NO: 1643930 - DNA, 17 bp, Homo sapiens
aatgtggtgacacctcc

SEQ ID NO: 1643931 - DNA, 21 bp, Homo sapiens
aatgtggtgacacctccccct

SEQ ID NO: 1643932 - DNA, 13 bp, Homo sapiens
aatgtgtaagaac

SEQ ID NO: 1643933 - DNA, 19 bp, Homo sapiens
aatgtgtaattgttttgga

SEQ ID NO: 1643934 - DNA, 22 bp, Homo sapiens
aatgtgtatttttcaaggcatt

SEQ ID NO: 1643935 - DNA, 14 bp, Homo sapiens
aatgtgtcattgga

SEQ ID NO: 1643936 - DNA, 18 bp, Homo sapiens
aatgtgtgagtgcatgta

SEQ ID NO: 1643937 - DNA, 16 bp, Homo sapiens
aatgtgtggcctgcac

SEQ ID NO: 1643938 - DNA, 21 bp, Homo sapiens
aatgtgtgtgtgtggcagggg

SEQ ID NO: 1643939 - DNA, 13 bp, Homo sapiens
aatgtgtttcaaa

SEQ ID NO: 1643940 - DNA, 18 bp, Homo sapiens
aatgttaaagggatattt

SEQ ID NO: 1643941 - DNA, 15 bp, Homo sapiens
aatgttaaagtcagt

SEQ ID NO: 1643942 - DNA, 16 bp, Homo sapiens
aatgttacattattat

SEQ ID NO: 1643943 - DNA, 12 bp, Homo sapiens
aatgttacctaa

SEQ ID NO: 1643944 - DNA, 22 bp, Homo sapiens
aatgttacctaattattacagc

SEQ ID NO: 1643945 - DNA, 15 bp, Homo sapiens
aatgttacctctgaa

SEQ ID NO: 1643946 - DNA, 20 bp, Homo sapiens
aatgttacggcatcacactt

SEQ ID NO: 1643947 - DNA, 18 bp, Homo sapiens
aatgttactaaattttct

SEQ ID NO: 1643948 - DNA, 21 bp, Homo sapiens
aatgttactcagatataagag

SEQ ID NO: 1643949 - DNA, 17 bp, Homo sapiens
aatgttatatcatatgt

SEQ ID NO: 1643950 - DNA, 17 bp, Homo sapiens
aatgttatatcatcaat

SEQ ID NO: 1643951 - DNA, 16 bp, Homo sapiens
aatgttatcttctcaa

SEQ ID NO: 1643952 - DNA, 14 bp, Homo sapiens
aatgttatgtatat

SEQ ID NO: 1643953 - DNA, 21 bp, Homo sapiens
aatgttattacttgtaaataa

SEQ ID NO: 1643954 - DNA, 19 bp, Homo sapiens
aatgttattttttaattat

SEQ ID NO: 1643955 - DNA, 14 bp, Homo sapiens
aatgttcacaaggt

SEQ ID NO: 1643956 - DNA, 13 bp, Homo sapiens
aatgttcatcctc

SEQ ID NO: 1643957 - DNA, 21 bp, Homo sapiens
aatgttcccaagtaggcattc

SEQ ID NO: 1643958 - DNA, 21 bp, Homo sapiens
aatgttcctgcctccttgata

SEQ ID NO: 1643959 - DNA, 21 bp, Homo sapiens
aatgttccttttttgtatatt

SEQ ID NO: 1643960 - DNA, 17 bp, Homo sapiens
aatgttctcagatttct

SEQ ID NO: 1643961 - DNA, 19 bp, Homo sapiens
aatgttctgctaaatttca

SEQ ID NO: 1643962 - DNA, 15 bp, Homo sapiens
aatgttctttaatgt

SEQ ID NO: 1643963 - DNA, 22 bp, Homo sapiens
aatgttgaacaaaataaattgg

SEQ ID NO: 1643964 - DNA, 20 bp, Homo sapiens
aatgttgcttaggatgtgtg

SEQ ID NO: 1643965 - DNA, 20 bp, Homo sapiens
aatgttggaactctgtgcag

SEQ ID NO: 1643966 - DNA, 16 bp, Homo sapiens
ccctctctgctccttc

SEQ ID NO: 1643967 - DNA, 18 bp, Homo sapiens
ccctctctgctccttcac

SEQ ID NO: 1643968 - DNA, 18 bp, Homo sapiens
ccctctcttgcacccgcc

SEQ ID NO: 1643969 - DNA, 15 bp, Homo sapiens
ccctctctttctctg

SEQ ID NO: 1643970 - DNA, 14 bp, Homo sapiens
ccctctgacctgca

SEQ ID NO: 1643971 - DNA, 16 bp, Homo sapiens
ccctctgcacccagaa

SEQ ID NO: 1643972 - DNA, 17 bp, Homo sapiens
ccctctgccccaagcag

SEQ ID NO: 1643973 - DNA, 21 bp, Homo sapiens
ccctctgccccaagcagccag

SEQ ID NO: 1643974 - DNA, 22 bp, Homo sapiens
ccctctgccggtcgggcagcca

SEQ ID NO: 1643975 - DNA, 23 bp, Homo sapiens
ccctctgccggtcgggcagccag

SEQ ID NO: 1643976 - DNA, 17 bp, Homo sapiens
ccctctgcctgcactcc

SEQ ID NO: 1643977 - DNA, 16 bp, Homo sapiens
ccctctgccttcaggc

SEQ ID NO: 1643978 - DNA, 16 bp, Homo sapiens
ccctctgctctgcctg

SEQ ID NO: 1643979 - DNA, 20 bp, Homo sapiens
ccctctgctctgcctggagt

SEQ ID NO: 1643980 - DNA, 18 bp, Homo sapiens
ccctctgctgctgcccgg

SEQ ID NO: 1643981 - DNA, 23 bp, Homo sapiens
ccctctgctgctgcccggggtgg

SEQ ID NO: 1643982 - DNA, 14 bp, Homo sapiens
ccctctgctgctgt

SEQ ID NO: 1643983 - DNA, 15 bp, Homo sapiens
ccctctgctgctgtc

SEQ ID NO: 1643984 - DNA, 12 bp, Homo sapiens
ccctctggaggg

SEQ ID NO: 1643985 - DNA, 22 bp, Homo sapiens
ccctctggaggggtgtggctcc

SEQ ID NO: 1643986 - DNA, 19 bp, Homo sapiens
ccctctggattctgaatct

SEQ ID NO: 1643987 - DNA, 13 bp, Homo sapiens
ccctctggccagg

SEQ ID NO: 1643988 - DNA, 16 bp, Homo sapiens
ccctctggccctgcct

SEQ ID NO: 1643989 - DNA, 14 bp, Homo sapiens
ccctctggcttccc

SEQ ID NO: 1643990 - DNA, 15 bp, Homo sapiens
ccctctggcttccca

SEQ ID NO: 1643991 - DNA, 14 bp, Homo sapiens
ccctctgggcctgt

SEQ ID NO: 1643992 - DNA, 20 bp, Homo sapiens
ccctctgggggtcctctctg

SEQ ID NO: 1643993 - DNA, 20 bp, Homo sapiens
ccctctggtctactctagaa

SEQ ID NO: 1643994 - DNA, 21 bp, Homo sapiens
ccctctggtctactctagaag

SEQ ID NO: 1643995 - DNA, 12 bp, Homo sapiens
ccctctggtgtg

SEQ ID NO: 1643996 - DNA, 22 bp, Homo sapiens
ccctctgtagctccctcctccc

SEQ ID NO: 1643997 - DNA, 21 bp, Homo sapiens
ccctctgtcatcactccctgg

SEQ ID NO: 1643998 - DNA, 23 bp, Homo sapiens
ccctctgtcatcactccctggat

SEQ ID NO: 1643999 - DNA, 20 bp, Homo sapiens
ccctctgtgtatttgctttt

SEQ ID NO: 1644000 - DNA, 16 bp, Homo sapiens
ccctcttaagatctga

SEQ ID NO: 1644001 - DNA, 22 bp, Homo sapiens
ccctcttaagatctgactgcca

SEQ ID NO: 1644002 - DNA, 14 bp, Homo sapiens
ccctcttccctctc

SEQ ID NO: 1644003 - DNA, 17 bp, Homo sapiens
ccctcttccctctccct

SEQ ID NO: 1644004 - DNA, 18 bp, Homo sapiens
ccctcttccctctccctc

SEQ ID NO: 1644005 - DNA, 11 bp, Homo sapiens
ccctcttcctc

SEQ ID NO: 1644006 - DNA, 17 bp, Homo sapiens
ccctcttgcccatcctg

SEQ ID NO: 1644007 - DNA, 18 bp, Homo sapiens
ccctcttgcgggcctgga

SEQ ID NO: 1644008 - DNA, 15 bp, Homo sapiens
ccctcttggagaagt

SEQ ID NO: 1644009 - DNA, 11 bp, Homo sapiens
ccctctttccc

SEQ ID NO: 1644010 - DNA, 18 bp, Homo sapiens
ccctgaaaacccagagag

SEQ ID NO: 1644011 - DNA, 23 bp, Homo sapiens
ccctgaaaatgtttttctgccag

SEQ ID NO: 1644012 - DNA, 21 bp, Homo sapiens
ccctgaaacctagtactgccc

SEQ ID NO: 1644013 - DNA, 15 bp, Homo sapiens
ccctgaaagcctcac

SEQ ID NO: 1644014 - DNA, 16 bp, Homo sapiens
ccctgaacccctggcc

SEQ ID NO: 1644015 - DNA, 24 bp, Homo sapiens
ccctgaacccctggccagctctga

SEQ ID NO: 1644016 - DNA, 21 bp, Homo sapiens
ccctgaagatttcagaggctg

SEQ ID NO: 1644017 - DNA, 17 bp, Homo sapiens
ccctgaagctgtgcgga

SEQ ID NO: 1644018 - DNA, 17 bp, Homo sapiens
ccctgaaggggccatga

SEQ ID NO: 1644019 - DNA, 20 bp, Homo sapiens
ccctgaagtgagcacagcct

SEQ ID NO: 1644020 - DNA, 19 bp, Homo sapiens
ccctgacctaccccagcca

SEQ ID NO: 1644021 - DNA, 21 bp, Homo sapiens
ccctgacctaccccagccagg

SEQ ID NO: 1644022 - DNA, 15 bp, Homo sapiens
ccctgacctccgccc

SEQ ID NO: 1644023 - DNA, 18 bp, Homo sapiens
ccctgacctccgcccctg

SEQ ID NO: 1644024 - DNA, 18 bp, Homo sapiens
ccctgaccttagcgttct

SEQ ID NO: 1644025 - DNA, 21 bp, Homo sapiens
ccctgaccttagcgttctgga

SEQ ID NO: 1644026 - DNA, 15 bp, Homo sapiens
ccctgagaaacccac

SEQ ID NO: 1644027 - DNA, 19 bp, Homo sapiens
ccctgagaaacccaccagc

SEQ ID NO: 1644028 - DNA, 17 bp, Homo sapiens
ccctgagacaaatggag

SEQ ID NO: 1644029 - DNA, 14 bp, Homo sapiens
ccctgagactccag

SEQ ID NO: 1644030 - DNA, 19 bp, Homo sapiens
ccctgagagtggtgccctg

SEQ ID NO: 1644031 - DNA, 23 bp, Homo sapiens
ccctgagagtggtgccctggaac

SEQ ID NO: 1644032 - DNA, 16 bp, Homo sapiens
ccctgagcaggaaagt

SEQ ID NO: 1644033 - DNA, 14 bp, Homo sapiens
ccctgagcaggatt

SEQ ID NO: 1644034 - DNA, 12 bp, Homo sapiens
ccctgagccggc

SEQ ID NO: 1644035 - DNA, 13 bp, Homo sapiens
ccctgaggaatga

SEQ ID NO: 1644036 - DNA, 17 bp, Homo sapiens
ccctgaggacctctcag

SEQ ID NO: 1644037 - DNA, 16 bp, Homo sapiens
ccctgaggactggaga

SEQ ID NO: 1644038 - DNA, 21 bp, Homo sapiens
ccctgaggatgggtcagagct

SEQ ID NO: 1644039 - DNA, 22 bp, Homo sapiens
ccctgaggatgggtcagagcta

SEQ ID NO: 1644040 - DNA, 18 bp, Homo sapiens
ccctgaggtgaaagggag

SEQ ID NO: 1644041 - DNA, 20 bp, Homo sapiens
ccctgaggtgaaagggagct

SEQ ID NO: 1644042 - DNA, 17 bp, Homo sapiens
ccctgaggtgcagggga

SEQ ID NO: 1644043 - DNA, 21 bp, Homo sapiens
ccctgaggtgtgggggctgca

SEQ ID NO: 1644044 - DNA, 17 bp, Homo sapiens
ccctgagtcaccaggaa

SEQ ID NO: 1644045 - DNA, 15 bp, Homo sapiens
ccctgagtgtcccaa

SEQ ID NO: 1644046 - DNA, 17 bp, Homo sapiens
ccctgagtgtcccaagc

SEQ ID NO: 1644047 - DNA, 22 bp, Homo sapiens
ccctgagttggagctcattctg

SEQ ID NO: 1644048 - DNA, 20 bp, Homo sapiens
ccctgatcccaccccctcct

SEQ ID NO: 1644049 - DNA, 14 bp, Homo sapiens
ccctgatcccagac

SEQ ID NO: 1644050 - DNA, 15 bp, Homo sapiens
ccctgatcccagacc

SEQ ID NO: 1644051 - DNA, 19 bp, Homo sapiens
ccctgatgcagcctgtggc

SEQ ID NO: 1644052 - DNA, 19 bp, Homo sapiens
ccctgattgtgccagtgca

SEQ ID NO: 1644053 - DNA, 23 bp, Homo sapiens
ccctgatttaggagaagccagga

SEQ ID NO: 1644054 - DNA, 19 bp, Homo sapiens
ccctgcaaaatgagaccct

SEQ ID NO: 1644055 - DNA, 19 bp, Homo sapiens
ccctgcacagatatttcca

SEQ ID NO: 1644056 - DNA, 12 bp, Homo sapiens
ccctgcacagcc

SEQ ID NO: 1644057 - DNA, 14 bp, Homo sapiens
ccctgcacagcctc

SEQ ID NO: 1644058 - DNA, 15 bp, Homo sapiens
ccctgcacagcctct

SEQ ID NO: 1644059 - DNA, 22 bp, Homo sapiens
ccctgcacaggcacacagggcc

SEQ ID NO: 1644060 - DNA, 20 bp, Homo sapiens
ccctgcacagtgacttctga

SEQ ID NO: 1644061 - DNA, 22 bp, Homo sapiens
ccctgcacagtgacttctgaga

SEQ ID NO: 1644062 - DNA, 12 bp, Homo sapiens
ccctgcacccac

SEQ ID NO: 1644063 - DNA, 13 bp, Homo sapiens
ccctgcacccacc

SEQ ID NO: 1644064 - DNA, 17 bp, Homo sapiens
ccctgcacccacccctg

SEQ ID NO: 1644065 - DNA, 18 bp, Homo sapiens
ccctgcacccacccctgc

SEQ ID NO: 1644066 - DNA, 16 bp, Homo sapiens
ccctgcaccctggaaa

SEQ ID NO: 1644067 - DNA, 18 bp, Homo sapiens
ccctgcaccctggaaagg

SEQ ID NO: 1644068 - DNA, 21 bp, Homo sapiens
ccctgcacctggcctgggcca

SEQ ID NO: 1644069 - DNA, 14 bp, Homo sapiens
ccctgcacgtcatg

SEQ ID NO: 1644070 - DNA, 23 bp, Homo sapiens
ccctgcactggagtccagtctct

SEQ ID NO: 1644071 - DNA, 16 bp, Homo sapiens
ccctgcactgtaaaat

SEQ ID NO: 1644072 - DNA, 14 bp, Homo sapiens
ccctgcagaaccca

SEQ ID NO: 1644073 - DNA, 23 bp, Homo sapiens
ccctgcagactccaatggggcca

SEQ ID NO: 1644074 - DNA, 18 bp, Homo sapiens
ccctgcagatgccaccct

SEQ ID NO: 1644075 - DNA, 14 bp, Homo sapiens
ccctgcatgctgcc

SEQ ID NO: 1644076 - DNA, 14 bp, Homo sapiens
ccctgcattggcct

SEQ ID NO: 1644077 - DNA, 15 bp, Homo sapiens
ccctgcattggcctg

SEQ ID NO: 1644078 - DNA, 21 bp, Homo sapiens
ccctgcattggcctggcctcc

SEQ ID NO: 1644079 - DNA, 21 bp, Homo sapiens
ccctgcattttcctcttgtcc

SEQ ID NO: 1644080 - DNA, 17 bp, Homo sapiens
gtgaagaggggcagccc

SEQ ID NO: 1644081 - DNA, 13 bp, Homo sapiens
gtgaagaggtctg

SEQ ID NO: 1644082 - DNA, 18 bp, Homo sapiens
gtgaagaggtctgattgg

SEQ ID NO: 1644083 - DNA, 14 bp, Homo sapiens
gtgaagagtaagtt

SEQ ID NO: 1644084 - DNA, 14 bp, Homo sapiens
gtgaagatgctgta

SEQ ID NO: 1644085 - DNA, 17 bp, Homo sapiens
gtgaagatgctgtaaat

SEQ ID NO: 1644086 - DNA, 23 bp, Homo sapiens
gtgaagcagtgcctcgaggcacc

SEQ ID NO: 1644087 - DNA, 13 bp, Homo sapiens
gtgaaggaccctt

SEQ ID NO: 1644088 - DNA, 14 bp, Homo sapiens
gtgaagggaagtgg

SEQ ID NO: 1644089 - DNA, 16 bp, Homo sapiens
gtgaagtacacctgtg

SEQ ID NO: 1644090 - DNA, 14 bp, Homo sapiens
gtgaagttgtgcaa

SEQ ID NO: 1644091 - DNA, 13 bp, Homo sapiens
gtgaataaaaacc

SEQ ID NO: 1644092 - DNA, 15 bp, Homo sapiens
gtgaatacattcttt

SEQ ID NO: 1644093 - DNA, 19 bp, Homo sapiens
gtgaataggttatatgcaa

SEQ ID NO: 1644094 - DNA, 15 bp, Homo sapiens
gtgaatatttttgta

SEQ ID NO: 1644095 - DNA, 14 bp, Homo sapiens
gtgaatccaggagg

SEQ ID NO: 1644096 - DNA, 22 bp, Homo sapiens
gtgaatgccatttagaatctag

SEQ ID NO: 1644097 - DNA, 16 bp, Homo sapiens
gtgaatggtctctgtc

SEQ ID NO: 1644098 - DNA, 12 bp, Homo sapiens
gtgaatggttgt

SEQ ID NO: 1644099 - DNA, 12 bp, Homo sapiens
gtgaattaaaaa

SEQ ID NO: 1644100 - DNA, 14 bp, Homo sapiens
gtgaattattgaca

SEQ ID NO: 1644101 - DNA, 14 bp, Homo sapiens
gtgaattcaataca

SEQ ID NO: 1644102 - DNA, 11 bp, Homo sapiens
gtgaattctgc

SEQ ID NO: 1644103 - DNA, 18 bp, Homo sapiens
gtgaattcttgaaggaaa

SEQ ID NO: 1644104 - DNA, 13 bp, Homo sapiens
gtgaattgactac

SEQ ID NO: 1644105 - DNA, 15 bp, Homo sapiens
gtgaattgctttatg

SEQ ID NO: 1644106 - DNA, 16 bp, Homo sapiens
gtgaattgtcttttag

SEQ ID NO: 1644107 - DNA, 14 bp, Homo sapiens
gtgaatttctaaat

SEQ ID NO: 1644108 - DNA, 17 bp, Homo sapiens
gtgaattttcaaggcct

SEQ ID NO: 1644109 - DNA, 22 bp, Homo sapiens
gtgaattttcaaggccttcagt

SEQ ID NO: 1644110 - DNA, 20 bp, Homo sapiens
gtgaattttccaagaacata

SEQ ID NO: 1644111 - DNA, 12 bp, Homo sapiens
gtgacaaaccat

SEQ ID NO: 1644112 - DNA, 16 bp, Homo sapiens
gtgacaaaccatccag

SEQ ID NO: 1644113 - DNA, 19 bp, Homo sapiens
gtgacaaagccagaggaga

SEQ ID NO: 1644114 - DNA, 14 bp, Homo sapiens
gtgacaaaggatga

SEQ ID NO: 1644115 - DNA, 15 bp, Homo sapiens
gtgacacagacattt

SEQ ID NO: 1644116 - DNA, 22 bp, Homo sapiens
gtgacacagacattttgtgtga

SEQ ID NO: 1644117 - DNA, 19 bp, Homo sapiens
gtgacacattacaaagcca

SEQ ID NO: 1644118 - DNA, 23 bp, Homo sapiens
gtgacaccagcctttctcccagg

SEQ ID NO: 1644119 - DNA, 21 bp, Homo sapiens
gtgacacctggtgcgggcctg

SEQ ID NO: 1644120 - DNA, 12 bp, Homo sapiens
gtgacagagtga

SEQ ID NO: 1644121 - DNA, 12 bp, Homo sapiens
gtgacagctttc

SEQ ID NO: 1644122 - DNA, 17 bp, Homo sapiens
gtgacagtgccttctct

SEQ ID NO: 1644123 - DNA, 18 bp, Homo sapiens
gtgacagtggattgcatt

SEQ ID NO: 1644124 - DNA, 12 bp, Homo sapiens
gtgacagtggct

SEQ ID NO: 1644125 - DNA, 16 bp, Homo sapiens
gtgacatcaaagcctg

SEQ ID NO: 1644126 - DNA, 18 bp, Homo sapiens
gtgacatcaaagcctggc

SEQ ID NO: 1644127 - DNA, 16 bp, Homo sapiens
gtgacatggtgcctga

SEQ ID NO: 1644128 - DNA, 19 bp, Homo sapiens
gtgacatggtgcctgagag

SEQ ID NO: 1644129 - DNA, 20 bp, Homo sapiens
gtgacatggtgcctgagagg

SEQ ID NO: 1644130 - DNA, 23 bp, Homo sapiens
gtgacatggtgcctgagaggcag

SEQ ID NO: 1644131 - DNA, 19 bp, Homo sapiens
gtgaccaatacatttgtat

SEQ ID NO: 1644132 - DNA, 12 bp, Homo sapiens
gtgaccaggtcc

SEQ ID NO: 1644133 - DNA, 12 bp, Homo sapiens
gtgaccatgttc

SEQ ID NO: 1644134 - DNA, 15 bp, Homo sapiens
gtgaccatttataat

SEQ ID NO: 1644135 - DNA, 16 bp, Homo sapiens
gtgacccaccagtgcc

SEQ ID NO: 1644136 - DNA, 16 bp, Homo sapiens
gtgacccagagccacc

SEQ ID NO: 1644137 - DNA, 13 bp, Homo sapiens
gtgacccatctgt

SEQ ID NO: 1644138 - DNA, 16 bp, Homo sapiens
gtgacccatctgtagt

SEQ ID NO: 1644139 - DNA, 23 bp, Homo sapiens
gtgaccccttttagtcaggagag

SEQ ID NO: 1644140 - DNA, 23 bp, Homo sapiens
gtgacccttcccaatcagcactg

SEQ ID NO: 1644141 - DNA, 17 bp, Homo sapiens
gtgacccttgtcatctc

SEQ ID NO: 1644142 - DNA, 22 bp, Homo sapiens
gtgaccgactaccccagtccca

SEQ ID NO: 1644143 - DNA, 14 bp, Homo sapiens
gtgacgcccagctc

SEQ ID NO: 1644144 - DNA, 23 bp, Homo sapiens
gtgactaactagacaccaaagtt

SEQ ID NO: 1644145 - DNA, 17 bp, Homo sapiens
gtgactaggcatacact

SEQ ID NO: 1644146 - DNA, 14 bp, Homo sapiens
gtgactataaagct

SEQ ID NO: 1644147 - DNA, 14 bp, Homo sapiens
gtgactcctgctgg

SEQ ID NO: 1644148 - DNA, 14 bp, Homo sapiens
gtgactctgggcag

SEQ ID NO: 1644149 - DNA, 16 bp, Homo sapiens
gtgactctgtccagct

SEQ ID NO: 1644150 - DNA, 14 bp, Homo sapiens
gtgactgaaaccat

SEQ ID NO: 1644151 - DNA, 18 bp, Homo sapiens
gtgactgaaaccattttc

SEQ ID NO: 1644152 - DNA, 12 bp, Homo sapiens
gtgactgaaggg

SEQ ID NO: 1644153 - DNA, 21 bp, Homo sapiens
gtgactgaaggggcacaccac

SEQ ID NO: 1644154 - DNA, 18 bp, Homo sapiens
gtgactgcatcatatatt

SEQ ID NO: 1644155 - DNA, 20 bp, Homo sapiens
gtgactgccccaactcctgg

SEQ ID NO: 1644156 - DNA, 23 bp, Homo sapiens
gtgactgccccaactcctggaag

SEQ ID NO: 1644157 - DNA, 13 bp, Homo sapiens
gtgactggcaggt

SEQ ID NO: 1644158 - DNA, 16 bp, Homo sapiens
gtgactgtgtttgcat

SEQ ID NO: 1644159 - DNA, 17 bp, Homo sapiens
gtgacttgtgtcccatg

SEQ ID NO: 1644160 - DNA, 23 bp, Homo sapiens
gtgacttgtgtcccatgatccct

SEQ ID NO: 1644161 - DNA, 16 bp, Homo sapiens
gtgactttacaggagg

SEQ ID NO: 1644162 - DNA, 16 bp, Homo sapiens
gtgagaaaatgcctca

SEQ ID NO: 1644163 - DNA, 22 bp, Homo sapiens
gtgagaaagggattgctgaggc

SEQ ID NO: 1644164 - DNA, 21 bp, Homo sapiens
gtgagaaatagctgaaaaggg

SEQ ID NO: 1644165 - DNA, 18 bp, Homo sapiens
gtgagaagctagatgccc

SEQ ID NO: 1644166 - DNA, 17 bp, Homo sapiens
gtgagaaggtttattgt

SEQ ID NO: 1644167 - DNA, 20 bp, Homo sapiens
gtgagaaggtttattgttaa

SEQ ID NO: 1644168 - DNA, 22 bp, Homo sapiens
gtgagaagtgaatgctgggact

SEQ ID NO: 1644169 - DNA, 23 bp, Homo sapiens
gtgagaatgatcaaggatctgga

SEQ ID NO: 1644170 - DNA, 14 bp, Homo sapiens
gtgagacccccaca

SEQ ID NO: 1644171 - DNA, 16 bp, Homo sapiens
gtgagacccctgtctc

SEQ ID NO: 1644172 - DNA, 18 bp, Homo sapiens
gtgagaccctgtctcaaa

SEQ ID NO: 1644173 - DNA, 15 bp, Homo sapiens
gtgagacgaggcagg

SEQ ID NO: 1644174 - DNA, 16 bp, Homo sapiens
gtgagacgaggcaggg

SEQ ID NO: 1644175 - DNA, 17 bp, Homo sapiens
gtgagactccacctcaa

SEQ ID NO: 1644176 - DNA, 14 bp, Homo sapiens
gtgagactccatct

SEQ ID NO: 1644177 - DNA, 15 bp, Homo sapiens
gtgagactccatctc

SEQ ID NO: 1644178 - DNA, 16 bp, Homo sapiens
gtgagagaatctgcct

SEQ ID NO: 1644179 - DNA, 13 bp, Homo sapiens
gtgagagaatgta

SEQ ID NO: 1644180 - DNA, 23 bp, Homo sapiens
gtgagagaatgtattttcataga

SEQ ID NO: 1644181 - DNA, 11 bp, Homo sapiens
gtgagagagga

SEQ ID NO: 1644182 - DNA, 15 bp, Homo sapiens
gtgagagccagcagc

SEQ ID NO: 1644183 - DNA, 16 bp, Homo sapiens
gtgagagtcaaagctg

SEQ ID NO: 1644184 - DNA, 21 bp, Homo sapiens
gtgagatcaacaacactactt

SEQ ID NO: 1644185 - DNA, 16 bp, Homo sapiens
gtgagatggtatgaaa

SEQ ID NO: 1644186 - DNA, 21 bp, Homo sapiens
gtgagcaagaagtcaaagtaa

SEQ ID NO: 1644187 - DNA, 19 bp, Homo sapiens
gtgagcacacccgtgtgca

SEQ ID NO: 1644188 - DNA, 15 bp, Homo sapiens
gtgagcagagcggga

SEQ ID NO: 1644189 - DNA, 12 bp, Homo sapiens
gtgagcaggctt

SEQ ID NO: 1644190 - DNA, 20 bp, Homo sapiens
gtgagcagggtcaagcctct

SEQ ID NO: 1644191 - DNA, 20 bp, Homo sapiens
gtgagcatggaacacttcga

SEQ ID NO: 1644192 - DNA, 19 bp, Homo sapiens
gtgagcatgggtgtgccct

SEQ ID NO: 1644193 - DNA, 16 bp, Homo sapiens
gtgagccaaggacagg

SEQ ID NO: 1644194 - DNA, 15 bp, Homo sapiens
gtgagccacagacca

SEQ ID NO: 1644195 - DNA, 14 bp, Homo sapiens
gtgagccaccgctg

SEQ ID NO: 1644196 - DNA, 14 bp, Homo sapiens
gtgccgctgtctct

SEQ ID NO: 1644197 - DNA, 15 bp, Homo sapiens
gtgccggcatctccc

SEQ ID NO: 1644198 - DNA, 19 bp, Homo sapiens
gtgccggcatctcccctag

SEQ ID NO: 1644199 - DNA, 19 bp, Homo sapiens
gtgccggcggcagccccac

SEQ ID NO: 1644200 - DNA, 21 bp, Homo sapiens
gtgccggcggcagccccactt

SEQ ID NO: 1644201 - DNA, 16 bp, Homo sapiens
gtgccgtgagcaggct

SEQ ID NO: 1644202 - DNA, 18 bp, Homo sapiens
gtgccgttactctccaac

SEQ ID NO: 1644203 - DNA, 21 bp, Homo sapiens
gtgccgttactctccaacctg

SEQ ID NO: 1644204 - DNA, 12 bp, Homo sapiens
gtgcctaaaata

SEQ ID NO: 1644205 - DNA, 16 bp, Homo sapiens
gtgcctaatggagaag

SEQ ID NO: 1644206 - DNA, 20 bp, Homo sapiens
gtgcctaatggagaagaccc

SEQ ID NO: 1644207 - DNA, 16 bp, Homo sapiens
gtgcctagactgttac

SEQ ID NO: 1644208 - DNA, 13 bp, Homo sapiens
gtgcctatatctg

SEQ ID NO: 1644209 - DNA, 10 bp, Homo sapiens
gtgcctcaga

SEQ ID NO: 1644210 - DNA, 15 bp, Homo sapiens
gtgcctcagagacca

SEQ ID NO: 1644211 - DNA, 19 bp, Homo sapiens
gtgcctcagagaccagggc

SEQ ID NO: 1644212 - DNA, 17 bp, Homo sapiens
gtgcctcaggccagggc

SEQ ID NO: 1644213 - DNA, 21 bp, Homo sapiens
gtgcctcaggccagggctcac

SEQ ID NO: 1644214 - DNA, 19 bp, Homo sapiens
gtgcctcagttttccttct

SEQ ID NO: 1644215 - DNA, 15 bp, Homo sapiens
gtgcctccaccacca

SEQ ID NO: 1644216 - DNA, 17 bp, Homo sapiens
gtgcctccaccaccact

SEQ ID NO: 1644217 - DNA, 21 bp, Homo sapiens
gtgcctccaccaccactggcc

SEQ ID NO: 1644218 - DNA, 23 bp, Homo sapiens
gtgcctccaccaccactggccac

SEQ ID NO: 1644219 - DNA, 13 bp, Homo sapiens
gtgcctccaggtg

SEQ ID NO: 1644220 - DNA, 17 bp, Homo sapiens
gtgcctccccccagacc

SEQ ID NO: 1644221 - DNA, 16 bp, Homo sapiens
gtgcctcgaggcaccg

SEQ ID NO: 1644222 - DNA, 15 bp, Homo sapiens
gtgcctctgggactg

SEQ ID NO: 1644223 - DNA, 19 bp, Homo sapiens
gtgcctcttccagtgaaca

SEQ ID NO: 1644224 - DNA, 15 bp, Homo sapiens
gtgcctcttgttgca

SEQ ID NO: 1644225 - DNA, 21 bp, Homo sapiens
gtgcctgacacactaaccaag

SEQ ID NO: 1644226 - DNA, 16 bp, Homo sapiens
gtgcctgagaggcagg

SEQ ID NO: 1644227 - DNA, 12 bp, Homo sapiens
gtgcctgagctg

SEQ ID NO: 1644228 - DNA, 15 bp, Homo sapiens
gtgcctgcaccagga

SEQ ID NO: 1644229 - DNA, 18 bp, Homo sapiens
gtgcctgcaccaggagac

SEQ ID NO: 1644230 - DNA, 19 bp, Homo sapiens
gtgcctgcaccaggagaca

SEQ ID NO: 1644231 - DNA, 21 bp, Homo sapiens
gtgcctgcactgagagggcaa

SEQ ID NO: 1644232 - DNA, 16 bp, Homo sapiens
gtgcctgcaggggagc

SEQ ID NO: 1644233 - DNA, 15 bp, Homo sapiens
gtgcctgccaccttc

SEQ ID NO: 1644234 - DNA, 14 bp, Homo sapiens
gtgcctgctagagc

SEQ ID NO: 1644235 - DNA, 19 bp, Homo sapiens
gtgcctgctagagcaaccc

SEQ ID NO: 1644236 - DNA, 15 bp, Homo sapiens
gtgcctgctcagcag

SEQ ID NO: 1644237 - DNA, 15 bp, Homo sapiens
gtgcctggaggtgtg

SEQ ID NO: 1644238 - DNA, 11 bp, Homo sapiens
gtgcctggagt

SEQ ID NO: 1644239 - DNA, 19 bp, Homo sapiens
gtgcctggagtcaggtgtc

SEQ ID NO: 1644240 - DNA, 11 bp, Homo sapiens
gtgcctggggt

SEQ ID NO: 1644241 - DNA, 21 bp, Homo sapiens
gtgcctgggtggggctgctcc

SEQ ID NO: 1644242 - DNA, 14 bp, Homo sapiens
gtgcctgtgctcct

SEQ ID NO: 1644243 - DNA, 18 bp, Homo sapiens
gtgcctgtgctcctgccc

SEQ ID NO: 1644244 - DNA, 15 bp, Homo sapiens
gtgccttaagtttta

SEQ ID NO: 1644245 - DNA, 19 bp, Homo sapiens
gtgccttacctcctgccca

SEQ ID NO: 1644246 - DNA, 20 bp, Homo sapiens
gtgccttacctcctgcccag

SEQ ID NO: 1644247 - DNA, 21 bp, Homo sapiens
gtgccttacctcctgcccagg

SEQ ID NO: 1644248 - DNA, 15 bp, Homo sapiens
gtgccttcagctcta

SEQ ID NO: 1644249 - DNA, 12 bp, Homo sapiens
gtgccttccata

SEQ ID NO: 1644250 - DNA, 17 bp, Homo sapiens
gtgccttccataattat

SEQ ID NO: 1644251 - DNA, 22 bp, Homo sapiens
gtgccttccataattatgacag

SEQ ID NO: 1644252 - DNA, 11 bp, Homo sapiens
gtgccttccct

SEQ ID NO: 1644253 - DNA, 20 bp, Homo sapiens
gtgccttcccttctctggtc

SEQ ID NO: 1644254 - DNA, 20 bp, Homo sapiens
gtgccttggggaatttcctc

SEQ ID NO: 1644255 - DNA, 18 bp, Homo sapiens
gtgcctttctttgcctct

SEQ ID NO: 1644256 - DNA, 13 bp, Homo sapiens
gtgcctttggcct

SEQ ID NO: 1644257 - DNA, 14 bp, Homo sapiens
gtgcctttggcctg

SEQ ID NO: 1644258 - DNA, 15 bp, Homo sapiens
gtgccttttgcaccc

SEQ ID NO: 1644259 - DNA, 18 bp, Homo sapiens
gtgccttttgcacccctc

SEQ ID NO: 1644260 - DNA, 21 bp, Homo sapiens
gtgccttttgcacccctccca

SEQ ID NO: 1644261 - DNA, 15 bp, Homo sapiens
gtgcgattctggata

SEQ ID NO: 1644262 - DNA, 14 bp, Homo sapiens
gtgcgcccagggct

SEQ ID NO: 1644263 - DNA, 18 bp, Homo sapiens
gtgcgctcttggtccctg

SEQ ID NO: 1644264 - DNA, 11 bp, Homo sapiens
gtgcgctgcct

SEQ ID NO: 1644265 - DNA, 12 bp, Homo sapiens
gtgcgctgcctg

SEQ ID NO: 1644266 - DNA, 15 bp, Homo sapiens
gtgcgctgcctggcc

SEQ ID NO: 1644267 - DNA, 13 bp, Homo sapiens
gtgcgtctccagt

SEQ ID NO: 1644268 - DNA, 23 bp, Homo sapiens
gtgcgtctctctttctccctcac

SEQ ID NO: 1644269 - DNA, 16 bp, Homo sapiens
gtgcgtgcgagcacac

SEQ ID NO: 1644270 - DNA, 13 bp, Homo sapiens
gtgcgtggctgtg

SEQ ID NO: 1644271 - DNA, 21 bp, Homo sapiens
gtgcgtggcttccctgtccca

SEQ ID NO: 1644272 - DNA, 15 bp, Homo sapiens
gtgcgtgtgtgtatg

SEQ ID NO: 1644273 - DNA, 17 bp, Homo sapiens
gtgcgtgttagtgtgtg

SEQ ID NO: 1644274 - DNA, 21 bp, Homo sapiens
gtgcgtgttagtgtgtgtgca

SEQ ID NO: 1644275 - DNA, 19 bp, Homo sapiens
gtgcgtgttcagcagaacc

SEQ ID NO: 1644276 - DNA, 13 bp, Homo sapiens
gtgctaaggttct

SEQ ID NO: 1644277 - DNA, 16 bp, Homo sapiens
gtgctaaggttctaag

SEQ ID NO: 1644278 - DNA, 17 bp, Homo sapiens
gtgctaaggttctaagg

SEQ ID NO: 1644279 - DNA, 13 bp, Homo sapiens
gtgctaagtgctt

SEQ ID NO: 1644280 - DNA, 14 bp, Homo sapiens
gtgctaggaagagg

SEQ ID NO: 1644281 - DNA, 20 bp, Homo sapiens
gtgctagggaaacttcccgt

SEQ ID NO: 1644282 - DNA, 15 bp, Homo sapiens
gtgctagtcactggc

SEQ ID NO: 1644283 - DNA, 18 bp, Homo sapiens
gtgctagtcactggcagc

SEQ ID NO: 1644284 - DNA, 22 bp, Homo sapiens
gtgctagtcactggcagcctgc

SEQ ID NO: 1644285 - DNA, 16 bp, Homo sapiens
gtgctataaatgccag

SEQ ID NO: 1644286 - DNA, 22 bp, Homo sapiens
gtgctataaatgccagagccaa

SEQ ID NO: 1644287 - DNA, 17 bp, Homo sapiens
gtgctatacacacacac

SEQ ID NO: 1644288 - DNA, 13 bp, Homo sapiens
gtgctatgaattt

SEQ ID NO: 1644289 - DNA, 19 bp, Homo sapiens
gtgctatgcaaaatagaca

SEQ ID NO: 1644290 - DNA, 12 bp, Homo sapiens
gtgctatgttct

SEQ ID NO: 1644291 - DNA, 15 bp, Homo sapiens
gtgctattctgtgtt

SEQ ID NO: 1644292 - DNA, 11 bp, Homo sapiens
gtgctatttgt

SEQ ID NO: 1644293 - DNA, 24 bp, Homo sapiens
gtgctatttgtacaaataaacctg

SEQ ID NO: 1644294 - DNA, 14 bp, Homo sapiens
gtgctcacgctccc

SEQ ID NO: 1644295 - DNA, 13 bp, Homo sapiens
gtgctcagccaaa

SEQ ID NO: 1644296 - DNA, 15 bp, Homo sapiens
gtgctcagccaaatt

SEQ ID NO: 1644297 - DNA, 23 bp, Homo sapiens
gtgctcagccaccatctggagtt

SEQ ID NO: 1644298 - DNA, 14 bp, Homo sapiens
gtgctcagctgtgg

SEQ ID NO: 1644299 - DNA, 17 bp, Homo sapiens
gtgctcagctgtggctg

SEQ ID NO: 1644300 - DNA, 13 bp, Homo sapiens
gtgctcatttaag

SEQ ID NO: 1644301 - DNA, 23 bp, Homo sapiens
gtgctccatctccgcctccacac

SEQ ID NO: 1644302 - DNA, 14 bp, Homo sapiens
gtgctcccctgcca

SEQ ID NO: 1644303 - DNA, 14 bp, Homo sapiens
gtgctccctctgtc

SEQ ID NO: 1644304 - DNA, 19 bp, Homo sapiens
gtgctccctctgtcatcct

SEQ ID NO: 1644305 - DNA, 18 bp, Homo sapiens
gtgctccgtgcctccacc

SEQ ID NO: 1644306 - DNA, 21 bp, Homo sapiens
gtgctcctcttgattcctggt

SEQ ID NO: 1644307 - DNA, 14 bp, Homo sapiens
gtgctcctgcccag

SEQ ID NO: 1644308 - DNA, 16 bp, Homo sapiens
gtgctctaggctgccc

SEQ ID NO: 1644309 - DNA, 21 bp, Homo sapiens
gtgctctccccggcaggcctg

SEQ ID NO: 1644310 - DNA, 20 bp, Homo sapiens
gtgctctgaatgggagccag

SEQ ID NO: 1644311 - DNA, 17 bp, Homo sapiens
gtgctctgaggcctcac

SEQ ID NO: 1644312 - DNA, 18 bp, Homo sapiens
atccatgttagtttttac

SEQ ID NO: 1644313 - DNA, 22 bp, Homo sapiens
atccattaaaaagttgttcttt

SEQ ID NO: 1644314 - DNA, 15 bp, Homo sapiens
atccattacctccat

SEQ ID NO: 1644315 - DNA, 19 bp, Homo sapiens
atccattaggccagcaacg

SEQ ID NO: 1644316 - DNA, 20 bp, Homo sapiens
atccattgaaagtgcttcaa

SEQ ID NO: 1644317 - DNA, 13 bp, Homo sapiens
atccattgttgtg

SEQ ID NO: 1644318 - DNA, 14 bp, Homo sapiens
atccatttatcttt

SEQ ID NO: 1644319 - DNA, 20 bp, Homo sapiens
atccatttcatctatttctg

SEQ ID NO: 1644320 - DNA, 13 bp, Homo sapiens
atccatttgtgca

SEQ ID NO: 1644321 - DNA, 12 bp, Homo sapiens
atccattttcta

SEQ ID NO: 1644322 - DNA, 15 bp, Homo sapiens
atcccaaagttgttg

SEQ ID NO: 1644323 - DNA, 20 bp, Homo sapiens
atcccaaagttgttgtaacc

SEQ ID NO: 1644324 - DNA, 17 bp, Homo sapiens
atcccaagacccagggc

SEQ ID NO: 1644325 - DNA, 19 bp, Homo sapiens
atcccaatcaaagaattac

SEQ ID NO: 1644326 - DNA, 23 bp, Homo sapiens
atcccacagtggcacggagagaa

SEQ ID NO: 1644327 - DNA, 23 bp, Homo sapiens
atcccacccccgaccctgccctg

SEQ ID NO: 1644328 - DNA, 20 bp, Homo sapiens
atcccaccccctcctccccc

SEQ ID NO: 1644329 - DNA, 17 bp, Homo sapiens
atcccacttcactgtga

SEQ ID NO: 1644330 - DNA, 11 bp, Homo sapiens
atcccagcact

SEQ ID NO: 1644331 - DNA, 21 bp, Homo sapiens
atcccagcagcagagaaccat

SEQ ID NO: 1644332 - DNA, 23 bp, Homo sapiens
atcccagccctttgggaggctga

SEQ ID NO: 1644333 - DNA, 16 bp, Homo sapiens
atcccagcctgtggtt

SEQ ID NO: 1644334 - DNA, 18 bp, Homo sapiens
atcccagcggctggtgca

SEQ ID NO: 1644335 - DNA, 20 bp, Homo sapiens
atcccagctactcaggaggc

SEQ ID NO: 1644336 - DNA, 20 bp, Homo sapiens
atcccagctactcgggaggc

SEQ ID NO: 1644337 - DNA, 19 bp, Homo sapiens
atcccaggcttcaccctga

SEQ ID NO: 1644338 - DNA, 19 bp, Homo sapiens
atcccaggggaccacacct

SEQ ID NO: 1644339 - DNA, 16 bp, Homo sapiens
gagctggggactcagg

SEQ ID NO: 1644340 - DNA, 13 bp, Homo sapiens
gagctggggccac

SEQ ID NO: 1644341 - DNA, 20 bp, Homo sapiens
gagctggggtgggagctcct

SEQ ID NO: 1644342 - DNA, 14 bp, Homo sapiens
gagctgggtactga

SEQ ID NO: 1644343 - DNA, 21 bp, Homo sapiens
gagctgggtactgactgagat

SEQ ID NO: 1644344 - DNA, 22 bp, Homo sapiens
gagctgggtactgactgagata

SEQ ID NO: 1644345 - DNA, 21 bp, Homo sapiens
gagctggtgcccggagattgg

SEQ ID NO: 1644346 - DNA, 21 bp, Homo sapiens
gagctgtaatttcgccttaaa

SEQ ID NO: 1644347 - DNA, 14 bp, Homo sapiens
gagctgtaggagag

SEQ ID NO: 1644348 - DNA, 18 bp, Homo sapiens
gagctgtcaccaaggaaa

SEQ ID NO: 1644349 - DNA, 19 bp, Homo sapiens
gagctgtcaccaaggaaac

SEQ ID NO: 1644350 - DNA, 14 bp, Homo sapiens
gagctgtcgctgcc

SEQ ID NO: 1644351 - DNA, 19 bp, Homo sapiens
gagctgtcgctgcctccat

SEQ ID NO: 1644352 - DNA, 13 bp, Homo sapiens
gagctgtgccagc

SEQ ID NO: 1644353 - DNA, 18 bp, Homo sapiens
gagctgtgccagcagggg

SEQ ID NO: 1644354 - DNA, 14 bp, Homo sapiens
gagctgtgcctgct

SEQ ID NO: 1644355 - DNA, 22 bp, Homo sapiens
gagctgtgcctgctcagcagcc

SEQ ID NO: 1644356 - DNA, 20 bp, Homo sapiens
gagctgttcacagccagact

SEQ ID NO: 1644357 - DNA, 16 bp, Homo sapiens
gagctgttggaagaaa

SEQ ID NO: 1644358 - DNA, 16 bp, Homo sapiens
gagctgtttatggcct

SEQ ID NO: 1644359 - DNA, 22 bp, Homo sapiens
gagctgtttatggcctcagctg

SEQ ID NO: 1644360 - DNA, 21 bp, Homo sapiens
gagcttaatctttgaaaggtt

SEQ ID NO: 1644361 - DNA, 20 bp, Homo sapiens
gagcttacccaagctgtggc

SEQ ID NO: 1644362 - DNA, 17 bp, Homo sapiens
gagcttagccttgtgcc

SEQ ID NO: 1644363 - DNA, 19 bp, Homo sapiens
gagcttagccttgtgccct

SEQ ID NO: 1644364 - DNA, 20 bp, Homo sapiens
gagcttagccttgtgccctg

SEQ ID NO: 1644365 - DNA, 15 bp, Homo sapiens
gagcttcaatataag

SEQ ID NO: 1644366 - DNA, 14 bp, Homo sapiens
gagcttccaaatgt

SEQ ID NO: 1644367 - DNA, 20 bp, Homo sapiens
gagcttccaaatgtgtcaga

SEQ ID NO: 1644368 - DNA, 21 bp, Homo sapiens
gagcttccaaatgtgtcagaa

SEQ ID NO: 1644369 - DNA, 17 bp, Homo sapiens
gagcttcccacacctgc

SEQ ID NO: 1644370 - DNA, 23 bp, Homo sapiens
gagcttccgctttgaaagaagca

SEQ ID NO: 1644371 - DNA, 14 bp, Homo sapiens
gagcttctctgggc

SEQ ID NO: 1644372 - DNA, 15 bp, Homo sapiens
gagcttctctgggct

SEQ ID NO: 1644373 - DNA, 14 bp, Homo sapiens
gagcttctctgtga

SEQ ID NO: 1644374 - DNA, 18 bp, Homo sapiens
gagcttcttgtttccttg

SEQ ID NO: 1644375 - DNA, 13 bp, Homo sapiens
gagcttgctccag

SEQ ID NO: 1644376 - DNA, 21 bp, Homo sapiens
gagcttgctccagattctgat

SEQ ID NO: 1644377 - DNA, 22 bp, Homo sapiens
gagcttgctccagattctgatg

SEQ ID NO: 1644378 - DNA, 20 bp, Homo sapiens
gagcttgggaagtcgaggct

SEQ ID NO: 1644379 - DNA, 12 bp, Homo sapiens
gagctttctctc

SEQ ID NO: 1644380 - DNA, 12 bp, Homo sapiens
gagctttgctgc

SEQ ID NO: 1644381 - DNA, 14 bp, Homo sapiens
gagctttgctgcta

SEQ ID NO: 1644382 - DNA, 17 bp, Homo sapiens
gagctttgctgctacag

SEQ ID NO: 1644383 - DNA, 23 bp, Homo sapiens
gagctttggggacagttggcaga

SEQ ID NO: 1644384 - DNA, 20 bp, Homo sapiens
ggcgggtacagcgcggagga

SEQ ID NO: 1644385 - DNA, 10 bp, Homo sapiens
ggcgggtgac

SEQ ID NO: 1644386 - DNA, 18 bp, Homo sapiens
ggcggtcatgtgtgcatg

SEQ ID NO: 1644387 - DNA, 12 bp, Homo sapiens
ggcggtggacca

SEQ ID NO: 1644388 - DNA, 14 bp, Homo sapiens
ggcggtggctgccc

SEQ ID NO: 1644389 - DNA, 14 bp, Homo sapiens
ggcgtactacccag

SEQ ID NO: 1644390 - DNA, 23 bp, Homo sapiens
ggcgtcaccatccaccttccctt

SEQ ID NO: 1644391 - DNA, 14 bp, Homo sapiens
ggcgtctgagctgg

SEQ ID NO: 1644392 - DNA, 15 bp, Homo sapiens
ggcgtctgctctggt

SEQ ID NO: 1644393 - DNA, 16 bp, Homo sapiens
ggcgtctgtatatttt

SEQ ID NO: 1644394 - DNA, 18 bp, Homo sapiens
ggcgtcttgcccagcagc

SEQ ID NO: 1644395 - DNA, 21 bp, Homo sapiens
ggcgtgctggtcccctcctca

SEQ ID NO: 1644396 - DNA, 18 bp, Homo sapiens
ggcgtggagggaggcccc

SEQ ID NO: 1644397 - DNA, 22 bp, Homo sapiens
ggcgtgtgcatagcgtcctgcc

SEQ ID NO: 1644398 - DNA, 22 bp, Homo sapiens
ggcgttctaggtaggaagagcc

SEQ ID NO: 1644399 - DNA, 14 bp, Homo sapiens
ggcgttctgctgcc

SEQ ID NO: 1644400 - DNA, 17 bp, Homo sapiens
ggcgttggtgccacttc

SEQ ID NO: 1644401 - DNA, 17 bp, Homo sapiens
ggcgtttatttctgcgt

SEQ ID NO: 1644402 - DNA, 19 bp, Homo sapiens
ggctaacctgttacactgg

SEQ ID NO: 1644403 - DNA, 20 bp, Homo sapiens
ggctaacctgttacactggg

SEQ ID NO: 1644404 - DNA, 22 bp, Homo sapiens
ggctaacctgttacactgggct

SEQ ID NO: 1644405 - DNA, 16 bp, Homo sapiens
ggctaagaccctgtgt

SEQ ID NO: 1644406 - DNA, 20 bp, Homo sapiens
ggctaagagctagcgctgcc

SEQ ID NO: 1644407 - DNA, 15 bp, Homo sapiens
ggctaagatgagatt

SEQ ID NO: 1644408 - DNA, 16 bp, Homo sapiens
ggctaagcatggcctg

SEQ ID NO: 1644409 - DNA, 12 bp, Homo sapiens
ggctaatttaac

SEQ ID NO: 1644410 - DNA, 20 bp, Homo sapiens
ggctacatcccagcctgtgg

SEQ ID NO: 1644411 - DNA, 18 bp, Homo sapiens
ggctaccatctgcatggg

SEQ ID NO: 1644412 - DNA, 18 bp, Homo sapiens
ggctaccattgtcactcg

SEQ ID NO: 1644413 - DNA, 15 bp, Homo sapiens
ggctactcagcagcc

SEQ ID NO: 1644414 - DNA, 17 bp, Homo sapiens
ggctactcagcagccct

SEQ ID NO: 1644415 - DNA, 17 bp, Homo sapiens
ggctactggcagctcct

SEQ ID NO: 1644416 - DNA, 23 bp, Homo sapiens
ggctactggcagctcctctcctt

SEQ ID NO: 1644417 - DNA, 13 bp, Homo sapiens
ggctacttccctt

SEQ ID NO: 1644418 - DNA, 13 bp, Homo sapiens
ggctagagaaatc

SEQ ID NO: 1644419 - DNA, 20 bp, Homo sapiens
ggctagcctttcttgtagcc

SEQ ID NO: 1644420 - DNA, 13 bp, Homo sapiens
ggctaggtacaca

SEQ ID NO: 1644421 - DNA, 23 bp, Homo sapiens
ggctaggtatcattcaactctcc

SEQ ID NO: 1644422 - DNA, 14 bp, Homo sapiens
ggctagtcagagag

SEQ ID NO: 1644423 - DNA, 18 bp, Homo sapiens
ggctagtcagagagagtg

SEQ ID NO: 1644424 - DNA, 20 bp, Homo sapiens
ggctagtgacttgtgtccca

SEQ ID NO: 1644425 - DNA, 15 bp, Homo sapiens
ggctagtgtgagtgg

SEQ ID NO: 1644426 - DNA, 23 bp, Homo sapiens
ggctagtgtgagtggcagccatg

SEQ ID NO: 1644427 - DNA, 24 bp, Homo sapiens
ggctagtgtgagtggcagccatgc

SEQ ID NO: 1644428 - DNA, 12 bp, Homo sapiens
ggctatatttac

SEQ ID NO: 1644429 - DNA, 18 bp, Homo sapiens
ggctatgaagggacagct

SEQ ID NO: 1644430 - DNA, 21 bp, Homo sapiens
ggctatggggatagatgtgtg

SEQ ID NO: 1644431 - DNA, 19 bp, Homo sapiens
ggctatgtatggaatacag

SEQ ID NO: 1644432 - DNA, 19 bp, Homo sapiens
ggctattgaagatgctgcc

SEQ ID NO: 1644433 - DNA, 15 bp, Homo sapiens
ggctatttctgtgtc

SEQ ID NO: 1644434 - DNA, 16 bp, Homo sapiens
ggctatttgtgtgtat

SEQ ID NO: 1644435 - DNA, 15 bp, Homo sapiens
ggctatttgttcaga

SEQ ID NO: 1644436 - DNA, 16 bp, Homo sapiens
ggctatttgttcagag

SEQ ID NO: 1644437 - DNA, 18 bp, Homo sapiens
ggctatttgttcagagag

SEQ ID NO: 1644438 - DNA, 17 bp, Homo sapiens
ggctatttttgaagcaa

SEQ ID NO: 1644439 - DNA, 18 bp, Homo sapiens
ggctcacactgagaatgt

SEQ ID NO: 1644440 - DNA, 22 bp, Homo sapiens
ggctcacgcctgtaatcccagc

SEQ ID NO: 1644441 - DNA, 20 bp, Homo sapiens
ggcctcatgtggctggaaga

SEQ ID NO: 1644442 - DNA, 21 bp, Homo sapiens
ggcctccaacgcccctgtggc

SEQ ID NO: 1644443 - DNA, 12 bp, Homo sapiens
ggcctccactcc

SEQ ID NO: 1644444 - DNA, 16 bp, Homo sapiens
ggcctccactccccca

SEQ ID NO: 1644445 - DNA, 15 bp, Homo sapiens
ggcctccagaactca

SEQ ID NO: 1644446 - DNA, 17 bp, Homo sapiens
ggcctccagaagctgct

SEQ ID NO: 1644447 - DNA, 18 bp, Homo sapiens
ggcctccagaagctgctc

SEQ ID NO: 1644448 - DNA, 23 bp, Homo sapiens
ggcctccagcctctcccggctgc

SEQ ID NO: 1644449 - DNA, 21 bp, Homo sapiens
ggcctccatgccccagctctg

SEQ ID NO: 1644450 - DNA, 21 bp, Homo sapiens
ggcctccattcctggagcccg

SEQ ID NO: 1644451 - DNA, 14 bp, Homo sapiens
ggcctccatttctg

SEQ ID NO: 1644452 - DNA, 15 bp, Homo sapiens
ggcctccatttctgt

SEQ ID NO: 1644453 - DNA, 18 bp, Homo sapiens
ggcctcccaaagtgctgg

SEQ ID NO: 1644454 - DNA, 18 bp, Homo sapiens
ggcctcccacagtgctgg

SEQ ID NO: 1644455 - DNA, 19 bp, Homo sapiens
ggcctcccacagtgctggg

SEQ ID NO: 1644456 - DNA, 24 bp, Homo sapiens
ggcctcccaccgcagcgtcccccg

SEQ ID NO: 1644457 - DNA, 14 bp, Homo sapiens
ggcctcccccagcc

SEQ ID NO: 1644458 - DNA, 16 bp, Homo sapiens
ggcctcccccagccag

SEQ ID NO: 1644459 - DNA, 22 bp, Homo sapiens
ggcctcccctgccaccaggcca

SEQ ID NO: 1644460 - DNA, 16 bp, Homo sapiens
ggcctccctgctgtgc

SEQ ID NO: 1644461 - DNA, 17 bp, Homo sapiens
ggcctccctgctgtgcc

SEQ ID NO: 1644462 - DNA, 22 bp, Homo sapiens
ggcctccctgctgtgccatgct

SEQ ID NO: 1644463 - DNA, 15 bp, Homo sapiens
ggcctccgaggctcc

SEQ ID NO: 1644464 - DNA, 16 bp, Homo sapiens
ggcctccgaggctccc

SEQ ID NO: 1644465 - DNA, 16 bp, Homo sapiens
ggcctccggcctcccc

SEQ ID NO: 1644466 - DNA, 20 bp, Homo sapiens
ggcctccggcgtcttgccca

SEQ ID NO: 1644467 - DNA, 22 bp, Homo sapiens
ggcctccggcgtcttgcccagc

SEQ ID NO: 1644468 - DNA, 21 bp, Homo sapiens
ggcctccgtccaggagcctgg

SEQ ID NO: 1644469 - DNA, 19 bp, Homo sapiens
ggcctcctcggagagcagc

SEQ ID NO: 1644470 - DNA, 12 bp, Homo sapiens
ggcctcctgcct

SEQ ID NO: 1644471 - DNA, 14 bp, Homo sapiens
ggcctcctgggaag

SEQ ID NO: 1644472 - DNA, 17 bp, Homo sapiens
ggcctcctgggaaggag

SEQ ID NO: 1644473 - DNA, 21 bp, Homo sapiens
ggcctccttcccatgcctgtc

SEQ ID NO: 1644474 - DNA, 19 bp, Homo sapiens
ggcctccttgtccaggtct

SEQ ID NO: 1644475 - DNA, 20 bp, Homo sapiens
ggcctccttgtccaggtctc

SEQ ID NO: 1644476 - DNA, 14 bp, Homo sapiens
ggcctcggcccctc

SEQ ID NO: 1644477 - DNA, 16 bp, Homo sapiens
ggcctcgggacctcag

SEQ ID NO: 1644478 - DNA, 17 bp, Homo sapiens
ggcctcgtgaggggcaa

SEQ ID NO: 1644479 - DNA, 15 bp, Homo sapiens
ggcctcgtgcgcccg

SEQ ID NO: 1644480 - DNA, 17 bp, Homo sapiens
ggcctctcggtgctcca

SEQ ID NO: 1644481 - DNA, 11 bp, Homo sapiens
ggcctctctct

SEQ ID NO: 1644482 - DNA, 17 bp, Homo sapiens
ggcctctctctgcctga

SEQ ID NO: 1644483 - DNA, 17 bp, Homo sapiens
ggcctctctggcctccc

SEQ ID NO: 1644484 - DNA, 13 bp, Homo sapiens
ggcctctgcctgc

SEQ ID NO: 1644485 - DNA, 14 bp, Homo sapiens
ggcctctgcctggg

SEQ ID NO: 1644486 - DNA, 18 bp, Homo sapiens
ggcctctggactggcctg

SEQ ID NO: 1644487 - DNA, 15 bp, Homo sapiens
ggcctcttccaccca

SEQ ID NO: 1644488 - DNA, 16 bp, Homo sapiens
ggcctcttccacccat

SEQ ID NO: 1644489 - DNA, 19 bp, Homo sapiens
ggcctcttccgtgacgtca

SEQ ID NO: 1644490 - DNA, 20 bp, Homo sapiens
ggcctcttggctatttctgt

SEQ ID NO: 1644491 - DNA, 21 bp, Homo sapiens
ggcctcttggctatttctgtg

SEQ ID NO: 1644492 - DNA, 15 bp, Homo sapiens
ggcctgaagccagct

SEQ ID NO: 1644493 - DNA, 19 bp, Homo sapiens
ggcctgaagccagctgccc

SEQ ID NO: 1644494 - DNA, 20 bp, Homo sapiens
ggcctgaagccagctgccct

SEQ ID NO: 1644495 - DNA, 14 bp, Homo sapiens
ggcctgacaccccc

SEQ ID NO: 1644496 - DNA, 20 bp, Homo sapiens
ggcctgaccaaacagccaac

SEQ ID NO: 1644497 - DNA, 14 bp, Homo sapiens
ggcctgactgctca

SEQ ID NO: 1644498 - DNA, 18 bp, Homo sapiens
ggcctgagcgctcctgcc

SEQ ID NO: 1644499 - DNA, 13 bp, Homo sapiens
ggcctgaggatga

SEQ ID NO: 1644500 - DNA, 21 bp, Homo sapiens
ggcctgagggtccacctggag

SEQ ID NO: 1644501 - DNA, 22 bp, Homo sapiens
ggcctgagggtccacctggaga

SEQ ID NO: 1644502 - DNA, 23 bp, Homo sapiens
ggcctgagggtccacctggagag

SEQ ID NO: 1644503 - DNA, 14 bp, Homo sapiens
ggcctgatgctccc

SEQ ID NO: 1644504 - DNA, 17 bp, Homo sapiens
ggcctgatgctccctcc

SEQ ID NO: 1644505 - DNA, 23 bp, Homo sapiens
ggcctgatgctccctcccctgcc

SEQ ID NO: 1644506 - DNA, 15 bp, Homo sapiens
ggcctgatgctgccc

SEQ ID NO: 1644507 - DNA, 22 bp, Homo sapiens
ggcctgcagtgattcagcaggc

SEQ ID NO: 1644508 - DNA, 17 bp, Homo sapiens
ggcgagccgcgggcgct

SEQ ID NO: 1644509 - DNA, 19 bp, Homo sapiens
ggcgagtcccggagcccca

SEQ ID NO: 1644510 - DNA, 17 bp, Homo sapiens
ggcgcaaaggtgcctca

SEQ ID NO: 1644511 - DNA, 22 bp, Homo sapiens
ggcgcaagcctgtaatcccagc

SEQ ID NO: 1644512 - DNA, 16 bp, Homo sapiens
ggcgcagagccctcca

SEQ ID NO: 1644513 - DNA, 17 bp, Homo sapiens
ggcgcagagccctccag

SEQ ID NO: 1644514 - DNA, 16 bp, Homo sapiens
ggcgcaggtgccatgc

SEQ ID NO: 1644515 - DNA, 19 bp, Homo sapiens
ggcgcaggtgccatgcctg

SEQ ID NO: 1644516 - DNA, 20 bp, Homo sapiens
ggcgcaggtgccatgcctgc

SEQ ID NO: 1644517 - DNA, 15 bp, Homo sapiens
ggcgccaccatcctg

SEQ ID NO: 1644518 - DNA, 19 bp, Homo sapiens
ggcgcccaccctgggctcc

SEQ ID NO: 1644519 - DNA, 16 bp, Homo sapiens
ggcgccctctctgctc

SEQ ID NO: 1644520 - DNA, 18 bp, Homo sapiens
ggcgccctctctgctcct

SEQ ID NO: 1644521 - DNA, 16 bp, Homo sapiens
ggcgccctggaagccg

SEQ ID NO: 1644522 - DNA, 19 bp, Homo sapiens
ggcgcgggaggcaccagct

SEQ ID NO: 1644523 - DNA, 14 bp, Homo sapiens
ggcgctcagacggc

SEQ ID NO: 1644524 - DNA, 20 bp, Homo sapiens
ggcgctcagacggcggccag

SEQ ID NO: 1644525 - DNA, 21 bp, Homo sapiens
ggcgctcagacggcggccagg

SEQ ID NO: 1644526 - DNA, 20 bp, Homo sapiens
ggcgctcaggacccaggccc

SEQ ID NO: 1644527 - DNA, 16 bp, Homo sapiens
ggcgctgcagcctccc

SEQ ID NO: 1644528 - DNA, 21 bp, Homo sapiens
ggcgctgcagcctcccttcca

SEQ ID NO: 1644529 - DNA, 17 bp, Homo sapiens
ggcgctttctcctgtgc

SEQ ID NO: 1644530 - DNA, 19 bp, Homo sapiens
ggcgctttctcctgtgccc

SEQ ID NO: 1644531 - DNA, 20 bp, Homo sapiens
ggcggaggggatccagccac

SEQ ID NO: 1644532 - DNA, 15 bp, Homo sapiens
ggcggaggtctctgg

SEQ ID NO: 1644533 - DNA, 21 bp, Homo sapiens
ggcggagtccccggggttccc

SEQ ID NO: 1644534 - DNA, 22 bp, Homo sapiens
ggcggcacccaggcctccctgc

SEQ ID NO: 1644535 - DNA, 18 bp, Homo sapiens
ggcggcacgtccttgggc

SEQ ID NO: 1644536 - DNA, 21 bp, Homo sapiens
ggcggcacgtccttgggcgtc

SEQ ID NO: 1644537 - DNA, 12 bp, Homo sapiens
ggcggcagcagc

SEQ ID NO: 1644538 - DNA, 14 bp, Homo sapiens
ggcggcagcagcca

SEQ ID NO: 1644539 - DNA, 12 bp, Homo sapiens
ggcggcagctgg

SEQ ID NO: 1644540 - DNA, 11 bp, Homo sapiens
ggcggccaggc

SEQ ID NO: 1644541 - DNA, 13 bp, Homo sapiens
ggcggccaggcaa

SEQ ID NO: 1644542 - DNA, 17 bp, Homo sapiens
ggcggccaggcacaggg

SEQ ID NO: 1644543 - DNA, 18 bp, Homo sapiens
ggcggccaggcacagggc

SEQ ID NO: 1644544 - DNA, 22 bp, Homo sapiens
ggcggccaggcacagggcccgc

SEQ ID NO: 1644545 - DNA, 16 bp, Homo sapiens
ggcggcccggccagcg

SEQ ID NO: 1644546 - DNA, 22 bp, Homo sapiens
ggcggcccggccagcgggcaca

SEQ ID NO: 1644547 - DNA, 17 bp, Homo sapiens
ggcggcccttctgactg

SEQ ID NO: 1644548 - DNA, 11 bp, Homo sapiens
ggcggcctctc

SEQ ID NO: 1644549 - DNA, 11 bp, Homo sapiens
ggcggcgccgg

SEQ ID NO: 1644550 - DNA, 17 bp, Homo sapiens
ggcggcttcctgtccac

SEQ ID NO: 1644551 - DNA, 18 bp, Homo sapiens
ggcggcttcctgtccact

SEQ ID NO: 1644552 - DNA, 15 bp, Homo sapiens
ggcgggagaactgaa

SEQ ID NO: 1644553 - DNA, 15 bp, Homo sapiens
ggcgggatcctccac

SEQ ID NO: 1644554 - DNA, 22 bp, Homo sapiens
ggcgggatcctccacagagagg

SEQ ID NO: 1644555 - DNA, 18 bp, Homo sapiens
ggcgggcagagggctgga

SEQ ID NO: 1644556 - DNA, 12 bp, Homo sapiens
ggcgggccaggg

SEQ ID NO: 1644557 - DNA, 22 bp, Homo sapiens
ggcgggccagggtgggaagaga

SEQ ID NO: 1644558 - DNA, 19 bp, Homo sapiens
ggcggggcttatgactgca

SEQ ID NO: 1644559 - DNA, 20 bp, Homo sapiens
tgtgtggccgcctggcaggt

SEQ ID NO: 1644560 - DNA, 20 bp, Homo sapiens
tgtgtggctcattcttttca

SEQ ID NO: 1644561 - DNA, 15 bp, Homo sapiens
tgtgtgggagtgtgt

SEQ ID NO: 1644562 - DNA, 19 bp, Homo sapiens
tgtgtggtctctgccccag

SEQ ID NO: 1644563 - DNA, 23 bp, Homo sapiens
tgtgtggtctctgccccagcctg

SEQ ID NO: 1644564 - DNA, 20 bp, Homo sapiens
tgtgtgtatttgctaatttt

SEQ ID NO: 1644565 - DNA, 14 bp, Homo sapiens
tgtgtgtatttgta

SEQ ID NO: 1644566 - DNA, 16 bp, Homo sapiens
tgtgtgtatttgtatt

SEQ ID NO: 1644567 - DNA, 19 bp, Homo sapiens
tgtgtgtcccaggcaggga

SEQ ID NO: 1644568 - DNA, 14 bp, Homo sapiens
tgtgtgtctgtcct

SEQ ID NO: 1644569 - DNA, 13 bp, Homo sapiens
tgtgtgtctgtct

SEQ ID NO: 1644570 - DNA, 21 bp, Homo sapiens
tgtgaggtgcagagtgcccag

SEQ ID NO: 1644571 - DNA, 15 bp, Homo sapiens
tgtgagtaagagctg

SEQ ID NO: 1644572 - DNA, 22 bp, Homo sapiens
tgtgagtccctgtgatggccag

SEQ ID NO: 1644573 - DNA, 14 bp, Homo sapiens
tgtgagtggcagcc

SEQ ID NO: 1644574 - DNA, 21 bp, Homo sapiens
tgtgatacattttttaagctt

SEQ ID NO: 1644575 - DNA, 22 bp, Homo sapiens
tgtgatacattttttaagcttc

SEQ ID NO: 1644576 - DNA, 15 bp, Homo sapiens
tgtgatattcccctt

SEQ ID NO: 1644577 - DNA, 14 bp, Homo sapiens
tgtgatattctaag

SEQ ID NO: 1644578 - DNA, 16 bp, Homo sapiens
tgtgatattctgttgc

SEQ ID NO: 1644579 - DNA, 17 bp, Homo sapiens
tgtgatattctgttgct

SEQ ID NO: 1644580 - DNA, 14 bp, Homo sapiens
tgtgatcagtgatt

SEQ ID NO: 1644581 - DNA, 16 bp, Homo sapiens
tgtgatcagtgatttt

SEQ ID NO: 1644582 - DNA, 22 bp, Homo sapiens
tgtgatcagtgattttcaaacc

SEQ ID NO: 1644583 - DNA, 18 bp, Homo sapiens
tgtgatcatgtgtggaag

SEQ ID NO: 1644584 - DNA, 16 bp, Homo sapiens
tgtgatgaatctacat

SEQ ID NO: 1644585 - DNA, 17 bp, Homo sapiens
tgtgatgaatctacatt

SEQ ID NO: 1644586 - DNA, 21 bp, Homo sapiens
tgtgatgaatctacatttgtt

SEQ ID NO: 1644587 - DNA, 17 bp, Homo sapiens
tgtgatgttctaaggct

SEQ ID NO: 1644588 - DNA, 21 bp, Homo sapiens
tgtgattcactgccttcctct

SEQ ID NO: 1644589 - DNA, 13 bp, Homo sapiens
tgtgattccatgg

SEQ ID NO: 1644590 - DNA, 18 bp, Homo sapiens
aatagtttgtctatttta

SEQ ID NO: 1644591 - DNA, 23 bp, Homo sapiens
aatagtttgtctattttaaaata

SEQ ID NO: 1644592 - DNA, 11 bp, Homo sapiens
aatataaaaaa

SEQ ID NO: 1644593 - DNA, 16 bp, Homo sapiens
aatataaaaaatcatg

SEQ ID NO: 1644594 - DNA, 20 bp, Homo sapiens
aatataaaaaatcatgccag

SEQ ID NO: 1644595 - DNA, 15 bp, Homo sapiens
aatataaaattatga

SEQ ID NO: 1644596 - DNA, 14 bp, Homo sapiens
aatattatatagga

SEQ ID NO: 1644597 - DNA, 21 bp, Homo sapiens
aatattatataggatattgct

SEQ ID NO: 1644598 - DNA, 22 bp, Homo sapiens
aatattatataggatattgcta

SEQ ID NO: 1644599 - DNA, 15 bp, Homo sapiens
aatattcactctcca

SEQ ID NO: 1644600 - DNA, 16 bp, Homo sapiens
aatattcagccagctt

SEQ ID NO: 1644601 - DNA, 21 bp, Homo sapiens
aatattcagccagcttaaacc

SEQ ID NO: 1644602 - DNA, 22 bp, Homo sapiens
aatattcagccagcttaaaccc

SEQ ID NO: 1644603 - DNA, 13 bp, Homo sapiens
aatattcccaagc

SEQ ID NO: 1644604 - DNA, 17 bp, Homo sapiens
aatattctacacatgta

SEQ ID NO: 1644605 - DNA, 12 bp, Homo sapiens
aatattctagaa

SEQ ID NO: 1644606 - DNA, 16 bp, Homo sapiens
aatattctatatgaat

SEQ ID NO: 1644607 - DNA, 14 bp, Homo sapiens
aatattctgtaact

SEQ ID NO: 1644608 - DNA, 14 bp, Homo sapiens
aatattctttctca

SEQ ID NO: 1644609 - DNA, 13 bp, Homo sapiens
aatattgaaaatt

SEQ ID NO: 1644610 - DNA, 16 bp, Homo sapiens
aatattgaaaattgaa

SEQ ID NO: 1644611 - DNA, 15 bp, Homo sapiens
aatattgaacttttt

SEQ ID NO: 1644612 - DNA, 21 bp, Homo sapiens
aatattgactcaaaccatatt

SEQ ID NO: 1644613 - DNA, 16 bp, Homo sapiens
aatattgagaaagaaa

SEQ ID NO: 1644614 - DNA, 16 bp, Homo sapiens
aatattgaggctgcag

SEQ ID NO: 1644615 - DNA, 19 bp, Homo sapiens
aatattgaggctgcagcag

SEQ ID NO: 1644616 - DNA, 21 bp, Homo sapiens
aatattgatgttaacaagagg

SEQ ID NO: 1644617 - DNA, 23 bp, Homo sapiens
aatattgattgggaaaacatttg

SEQ ID NO: 1644618 - DNA, 23 bp, Homo sapiens
aatattgctgtgtcttcattttc

SEQ ID NO: 1644619 - DNA, 20 bp, Homo sapiens
aatattgttgacaactgtga

SEQ ID NO: 1644620 - DNA, 13 bp, Homo sapiens
aatattgtttcta

SEQ ID NO: 1644621 - DNA, 13 bp, Homo sapiens
aatatttaagtat

SEQ ID NO: 1644622 - DNA, 18 bp, Homo sapiens
aatatttaagtatatagt

SEQ ID NO: 1644623 - DNA, 19 bp, Homo sapiens
aatatttaagtgaaggaga

SEQ ID NO: 1644624 - DNA, 13 bp, Homo sapiens
aatatttaatgtt

SEQ ID NO: 1644625 - DNA, 15 bp, Homo sapiens
aatatttaccaaagt

SEQ ID NO: 1644626 - DNA, 20 bp, Homo sapiens
aatatttactaactaaatac

SEQ ID NO: 1644627 - DNA, 21 bp, Homo sapiens
aatatttactgttagaattct

SEQ ID NO: 1644628 - DNA, 22 bp, Homo sapiens
aatatttactgttagaattctt

SEQ ID NO: 1644629 - DNA, 14 bp, Homo sapiens
aatatttatatttc

SEQ ID NO: 1644630 - DNA, 17 bp, Homo sapiens
aatatttatatttcact

SEQ ID NO: 1644631 - DNA, 14 bp, Homo sapiens
aatatttattacct

SEQ ID NO: 1644632 - DNA, 12 bp, Homo sapiens
aatatttattat

SEQ ID NO: 1644633 - DNA, 11 bp, Homo sapiens
aatatttattt

SEQ ID NO: 1644634 - DNA, 16 bp, Homo sapiens
aatatttcaagtgcct

SEQ ID NO: 1644635 - DNA, 19 bp, Homo sapiens
aatatttcctgacttgagt

SEQ ID NO: 1644636 - DNA, 15 bp, Homo sapiens
aatatttctaagctt

SEQ ID NO: 1644637 - DNA, 22 bp, Homo sapiens
aatatttctaagcttatttcta

SEQ ID NO: 1644638 - DNA, 12 bp, Homo sapiens
aatatttctatt

SEQ ID NO: 1644639 - DNA, 12 bp, Homo sapiens
aatatttcttca

SEQ ID NO: 1644640 - DNA, 18 bp, Homo sapiens
aatatttgactattctgt

SEQ ID NO: 1644641 - DNA, 20 bp, Homo sapiens
aatatttgagaataagttca

SEQ ID NO: 1644642 - DNA, 14 bp, Homo sapiens
aatatttgtacata

SEQ ID NO: 1644643 - DNA, 16 bp, Homo sapiens
aatattttaaaatcag

SEQ ID NO: 1644644 - DNA, 11 bp, Homo sapiens
aatattttaat

SEQ ID NO: 1644645 - DNA, 16 bp, Homo sapiens
aatattttatcctgta

SEQ ID NO: 1644646 - DNA, 19 bp, Homo sapiens
aatattttatcctgtattc

SEQ ID NO: 1644647 - DNA, 22 bp, Homo sapiens
aatattttatcctgtattcttg

SEQ ID NO: 1644648 - DNA, 17 bp, Homo sapiens
aatattttattatatat

SEQ ID NO: 1644649 - DNA, 12 bp, Homo sapiens
aatattttcaac

SEQ ID NO: 1644650 - DNA, 18 bp, Homo sapiens
aatattttcatacagcat

SEQ ID NO: 1644651 - DNA, 22 bp, Homo sapiens
aatattttgctaaaaaagcata

SEQ ID NO: 1644652 - DNA, 12 bp, Homo sapiens
aatattttgtaa

SEQ ID NO: 1644653 - DNA, 22 bp, Homo sapiens
aatatttttatatttcctttat

SEQ ID NO: 1644654 - DNA, 22 bp, Homo sapiens
aatatttttggggcatcctgga

SEQ ID NO: 1644655 - DNA, 11 bp, Homo sapiens
aatatttttgt

SEQ ID NO: 1644656 - DNA, 17 bp, Homo sapiens
aatattttttatatata

SEQ ID NO: 1644657 - DNA, 22 bp, Homo sapiens
aatattttttgctctaatctct

SEQ ID NO: 1644658 - DNA, 14 bp, Homo sapiens
aatatttttttaac

SEQ ID NO: 1644659 - DNA, 17 bp, Homo sapiens
aatcaaacattttctgg

SEQ ID NO: 1644660 - DNA, 16 bp, Homo sapiens
aatcaaagaacagatg

SEQ ID NO: 1644661 - DNA, 14 bp, Homo sapiens
aatcaaagaattac

SEQ ID NO: 1644662 - DNA, 15 bp, Homo sapiens
aatcaaagaattaca

SEQ ID NO: 1644663 - DNA, 13 bp, Homo sapiens
aatcaaagcaagg

SEQ ID NO: 1644664 - DNA, 14 bp, Homo sapiens
aatcaaataagtat

SEQ ID NO: 1644665 - DNA, 15 bp, Homo sapiens
aatcaaatatgcaaa

SEQ ID NO: 1644666 - DNA, 16 bp, Homo sapiens
aatcaaatgtaaatca

SEQ ID NO: 1644667 - DNA, 20 bp, Homo sapiens
aatcaaccacctatttttga

SEQ ID NO: 1644668 - DNA, 13 bp, Homo sapiens
aatcaactttact

SEQ ID NO: 1644669 - DNA, 20 bp, Homo sapiens
aatcaactttatcatatgct

SEQ ID NO: 1644670 - DNA, 13 bp, Homo sapiens
aatcaacttttat

SEQ ID NO: 1644671 - DNA, 24 bp, Homo sapiens
aatcaagaaaagaattacagactc

SEQ ID NO: 1644672 - DNA, 10 bp, Homo sapiens
aatcaagaga

SEQ ID NO: 1644673 - DNA, 19 bp, Homo sapiens
aatcaagatttttttcctg

SEQ ID NO: 1644674 - DNA, 17 bp, Homo sapiens
aatcaaggttataattt

SEQ ID NO: 1644675 - DNA, 22 bp, Homo sapiens
aatcaagttgtaacttatattg

SEQ ID NO: 1644676 - DNA, 16 bp, Homo sapiens
aatcaataagctagat

SEQ ID NO: 1644677 - DNA, 14 bp, Homo sapiens
aatcaatacactag

SEQ ID NO: 1644678 - DNA, 18 bp, Homo sapiens
aatcaatacactagttgt

SEQ ID NO: 1644679 - DNA, 22 bp, Homo sapiens
aatcaatgcaagagtgattgca

SEQ ID NO: 1644680 - DNA, 16 bp, Homo sapiens
aatcacatcctggcct

SEQ ID NO: 1644681 - DNA, 15 bp, Homo sapiens
aatcaccaaaggctc

SEQ ID NO: 1644682 - DNA, 13 bp, Homo sapiens
aatcaccatgtaa

SEQ ID NO: 1644683 - DNA, 19 bp, Homo sapiens
aatcacctgaaccccagag

SEQ ID NO: 1644684 - DNA, 22 bp, Homo sapiens
aatcacctgaaccccagaggca

SEQ ID NO: 1644685 - DNA, 20 bp, Homo sapiens
aatcactctaattaattgta

SEQ ID NO: 1644686 - DNA, 21 bp, Homo sapiens
aatcactctaattaattgtaa

SEQ ID NO: 1644687 - DNA, 18 bp, Homo sapiens
aatcactgtgctcagcca

SEQ ID NO: 1644688 - DNA, 19 bp, Homo sapiens
aatcacttcattgttttaa

SEQ ID NO: 1644689 - DNA, 18 bp, Homo sapiens
aatcactttacctgcagg

SEQ ID NO: 1644690 - DNA, 19 bp, Homo sapiens
aatcactttacctgcaggc

SEQ ID NO: 1644691 - DNA, 13 bp, Homo sapiens
aatcactttgtct

SEQ ID NO: 1644692 - DNA, 12 bp, Homo sapiens
aatcagaactca

SEQ ID NO: 1644693 - DNA, 15 bp, Homo sapiens
aatcagaagaaaggc

SEQ ID NO: 1644694 - DNA, 21 bp, Homo sapiens
aatcagaagatagtcttggaa

SEQ ID NO: 1644695 - DNA, 13 bp, Homo sapiens
aatcagaattaga

SEQ ID NO: 1644696 - DNA, 13 bp, Homo sapiens
aatcagagacaaa

SEQ ID NO: 1644697 - DNA, 23 bp, Homo sapiens
aatcagagctccagtttgcattt

SEQ ID NO: 1644698 - DNA, 14 bp, Homo sapiens
aatcagatcatttc

SEQ ID NO: 1644699 - DNA, 13 bp, Homo sapiens
aatcagcactgaa

SEQ ID NO: 1644700 - DNA, 16 bp, Homo sapiens
aatcagcactgaaaat

SEQ ID NO: 1644701 - DNA, 14 bp, Homo sapiens
aatcagcatttagt

SEQ ID NO: 1644702 - DNA, 17 bp, Homo sapiens
aatcagctattttgtga

SEQ ID NO: 1644703 - DNA, 22 bp, Homo sapiens
aatcagctgcaatccatttatt

SEQ ID NO: 1644704 - DNA, 13 bp, Homo sapiens
aatcaggaaaaat

SEQ ID NO: 1644705 - DNA, 18 bp, Homo sapiens
aatcaggaatattttcca

SEQ ID NO: 1644706 - DNA, 15 bp, Homo sapiens
aatcaggcttttgtt

SEQ ID NO: 1644707 - DNA, 20 bp, Homo sapiens
aatcaggtagacttttaata

SEQ ID NO: 1644708 - DNA, 13 bp, Homo sapiens
aatcagtcccctc

SEQ ID NO: 1644709 - DNA, 15 bp, Homo sapiens
aatcagtcccctccc

SEQ ID NO: 1644710 - DNA, 16 bp, Homo sapiens
aatcagtcccctccca

SEQ ID NO: 1644711 - DNA, 17 bp, Homo sapiens
aatcagtcccctcccat

SEQ ID NO: 1644712 - DNA, 13 bp, Homo sapiens
aaattccactgga

SEQ ID NO: 1644713 - DNA, 21 bp, Homo sapiens
aaattccagaaaggatattta

SEQ ID NO: 1644714 - DNA, 19 bp, Homo sapiens
aaattccatacttctctca

SEQ ID NO: 1644715 - DNA, 20 bp, Homo sapiens
gcattgcctggactgaccac

SEQ ID NO: 1644716 - DNA, 17 bp, Homo sapiens
gcattgctcagcccgct

SEQ ID NO: 1644717 - DNA, 13 bp, Homo sapiens
gcattgctggttc

SEQ ID NO: 1644718 - DNA, 18 bp, Homo sapiens
ttcttgtaaatctttttg

SEQ ID NO: 1644719 - DNA, 16 bp, Homo sapiens
ttcttgtaaatgtttc

SEQ ID NO: 1644720 - DNA, 14 bp, Homo sapiens
aaaaaaaaaacact

SEQ ID NO: 1644721 - DNA, 13 bp, Homo sapiens
aaaaaaaaagttc

SEQ ID NO: 1644722 - DNA, 13 bp, Homo sapiens
aaaaaaaagcttc

SEQ ID NO: 1644723 - DNA, 13 bp, Homo sapiens
aaaaaaaattgta

SEQ ID NO: 1644724 - DNA, 13 bp, Homo sapiens
aaaaaaacataaa

SEQ ID NO: 1644725 - DNA, 13 bp, Homo sapiens
aaaaaaagaataa

SEQ ID NO: 1644726 - DNA, 13 bp, Homo sapiens
aaaaaaagacaag

SEQ ID NO: 1644727 - DNA, 12 bp, Homo sapiens
aaaaaaagcata

SEQ ID NO: 1644728 - DNA, 11 bp, Homo sapiens
aaaaaaagcct

SEQ ID NO: 1644729 - DNA, 12 bp, Homo sapiens
aaaaaaatgact

SEQ ID NO: 1644730 - DNA, 13 bp, Homo sapiens
aaaaaaatgacta

SEQ ID NO: 1644731 - DNA, 13 bp, Homo sapiens
aaaaaaattttta

SEQ ID NO: 1644732 - DNA, 19 bp, Homo sapiens
aaaaaacacttggcataca

SEQ ID NO: 1644733 - DNA, 12 bp, Homo sapiens
aaaaaagactga

SEQ ID NO: 1644734 - DNA, 12 bp, Homo sapiens
aaaaaagatttt

SEQ ID NO: 1644735 - DNA, 14 bp, Homo sapiens
aaaaaagcaaaaat

SEQ ID NO: 1644736 - DNA, 12 bp, Homo sapiens
aaaaaagccttt

SEQ ID NO: 1644737 - DNA, 13 bp, Homo sapiens
aaaaaagttgaag

SEQ ID NO: 1644738 - DNA, 13 bp, Homo sapiens
aaaaaagttttta

SEQ ID NO: 1644739 - DNA, 14 bp, Homo sapiens
aaaaaataattgga

SEQ ID NO: 1644740 - DNA, 13 bp, Homo sapiens
aaaaaatctatcc

SEQ ID NO: 1644741 - DNA, 22 bp, Homo sapiens
aaaaaattagaaattggctgga

SEQ ID NO: 1644742 - DNA, 17 bp, Homo sapiens
aaaaacaaaaccagctg

SEQ ID NO: 1644743 - DNA, 15 bp, Homo sapiens
aaaaacaaacaaaca

SEQ ID NO: 1644744 - DNA, 23 bp, Homo sapiens
aaaaacaagtcatttttgtattt

SEQ ID NO: 1644745 - DNA, 18 bp, Homo sapiens
aaaaacacctagctttat

SEQ ID NO: 1644746 - DNA, 15 bp, Homo sapiens
aaaaacagcattgct

SEQ ID NO: 1644747 - DNA, 20 bp, Homo sapiens
aaaaacagcattgctttctg

SEQ ID NO: 1644748 - DNA, 21 bp, Homo sapiens
aaaaacagcattgctttctga

SEQ ID NO: 1644749 - DNA, 14 bp, Homo sapiens
aaaaacatattctt

SEQ ID NO: 1644750 - DNA, 13 bp, Homo sapiens
aaaaacatgtatg

SEQ ID NO: 1644751 - DNA, 20 bp, Homo sapiens
aaaaacatgtatgtgcattt

SEQ ID NO: 1644752 - DNA, 23 bp, Homo sapiens
aaaaaccatgttgcgttcaaaga

SEQ ID NO: 1644753 - DNA, 22 bp, Homo sapiens
aaaaacgaaactccatctcaaa

SEQ ID NO: 1644754 - DNA, 13 bp, Homo sapiens
aaaaactacacat

SEQ ID NO: 1644755 - DNA, 11 bp, Homo sapiens
aaaaactattt

SEQ ID NO: 1644756 - DNA, 20 bp, Homo sapiens
aaaaactctgggaaataaga

SEQ ID NO: 1644757 - DNA, 14 bp, Homo sapiens
aaaaactgtactgt

SEQ ID NO: 1644758 - DNA, 20 bp, Homo sapiens
aaaaactgtctttaaaagag

SEQ ID NO: 1644759 - DNA, 22 bp, Homo sapiens
aaaaacttcatgtaattttatt

SEQ ID NO: 1644760 - DNA, 23 bp, Homo sapiens
aaaaacttcatgtaattttattt

SEQ ID NO: 1644761 - DNA, 18 bp, Homo sapiens
aaaaacttgtactatgtt

SEQ ID NO: 1644762 - DNA, 21 bp, Homo sapiens
aaaaactttggaaccagactc

SEQ ID NO: 1644763 - DNA, 17 bp, Homo sapiens
aaaaagaaactttgttt

SEQ ID NO: 1644764 - DNA, 19 bp, Homo sapiens
aaaaagaaaggctgttaaa

SEQ ID NO: 1644765 - DNA, 11 bp, Homo sapiens
aaaaagaacca

SEQ ID NO: 1644766 - DNA, 15 bp, Homo sapiens
aaaaagaagccacag

SEQ ID NO: 1644767 - DNA, 16 bp, Homo sapiens
aaaaagaaggactgaa

SEQ ID NO: 1644768 - DNA, 13 bp, Homo sapiens
aaaaagacaaaca

SEQ ID NO: 1644769 - DNA, 18 bp, Homo sapiens
aaaaagactgaacatgtt

SEQ ID NO: 1644770 - DNA, 20 bp, Homo sapiens
aaaaagagtatgagtcttct

SEQ ID NO: 1644771 - DNA, 13 bp, Homo sapiens
aaaaagatttttt

SEQ ID NO: 1644772 - DNA, 22 bp, Homo sapiens
aaaaagcagaattttaatgtga

SEQ ID NO: 1644773 - DNA, 18 bp, Homo sapiens
aaaaagcatgatgggaaa

SEQ ID NO: 1644774 - DNA, 20 bp, Homo sapiens
aaaaagcatgatgggaaaat

SEQ ID NO: 1644775 - DNA, 17 bp, Homo sapiens
aaaaagccagtttgggt

SEQ ID NO: 1644776 - DNA, 20 bp, Homo sapiens
aaaaagcctacattctccag

SEQ ID NO: 1644777 - DNA, 17 bp, Homo sapiens
aaaaagcctccaagggt

SEQ ID NO: 1644778 - DNA, 9 bp, Homo sapiens
aaaaaggaa

SEQ ID NO: 1644779 - DNA, 11 bp, Homo sapiens
aaaaaggaaaa

SEQ ID NO: 1644780 - DNA, 12 bp, Homo sapiens
aaaaaggaaaaa

SEQ ID NO: 1644781 - DNA, 17 bp, Homo sapiens
aaaaaggaaaagttaaa

SEQ ID NO: 1644782 - DNA, 14 bp, Homo sapiens
aaaaaggaaatatt

SEQ ID NO: 1644783 - DNA, 15 bp, Homo sapiens
aaaaaggaaatattc

SEQ ID NO: 1644784 - DNA, 13 bp, Homo sapiens
aaaaaggctgaaa

SEQ ID NO: 1644785 - DNA, 14 bp, Homo sapiens
aaaaagtaaaaatt

SEQ ID NO: 1644786 - DNA, 15 bp, Homo sapiens
aaaaagtaaaaatta

SEQ ID NO: 1644787 - DNA, 18 bp, Homo sapiens
aaaaagtacaattcattg

SEQ ID NO: 1644788 - DNA, 20 bp, Homo sapiens
aaaaagtcagactgctggga

SEQ ID NO: 1644789 - DNA, 14 bp, Homo sapiens
aaaaagtgacacag

SEQ ID NO: 1644790 - DNA, 19 bp, Homo sapiens
aaaaagtgacacagcagct

SEQ ID NO: 1644791 - DNA, 23 bp, Homo sapiens
aaaaagtgggttttttagttgaa

SEQ ID NO: 1644792 - DNA, 14 bp, Homo sapiens
aaaaagtgtctcaa

SEQ ID NO: 1644793 - DNA, 22 bp, Homo sapiens
aaaaagtgttgatcaaccattc

SEQ ID NO: 1644794 - DNA, 17 bp, Homo sapiens
aaaaagtttgccagaag

SEQ ID NO: 1644795 - DNA, 13 bp, Homo sapiens
aaaaagtttgttt

SEQ ID NO: 1644796 - DNA, 21 bp, Homo sapiens
aaaaataaaaactgactcctt

SEQ ID NO: 1644797 - DNA, 17 bp, Homo sapiens
aaaaataaaatgcattt

SEQ ID NO: 1644798 - DNA, 12 bp, Homo sapiens
aaaaataaaatt

SEQ ID NO: 1644799 - DNA, 12 bp, Homo sapiens
aaaaataaacta

SEQ ID NO: 1644800 - DNA, 18 bp, Homo sapiens
aaaaataatcaaaagcta

SEQ ID NO: 1644801 - DNA, 18 bp, Homo sapiens
aaaaataatcaagatttt

SEQ ID NO: 1644802 - DNA, 22 bp, Homo sapiens
aaaaatacaccgtttagaaaaa

SEQ ID NO: 1644803 - DNA, 14 bp, Homo sapiens
aaaaatacatgcat

SEQ ID NO: 1644804 - DNA, 13 bp, Homo sapiens
aaaaatagaaatt

SEQ ID NO: 1644805 - DNA, 15 bp, Homo sapiens
aaaaatagtaaacat

SEQ ID NO: 1644806 - DNA, 15 bp, Homo sapiens
aaaaatatatttaat

SEQ ID NO: 1644807 - DNA, 20 bp, Homo sapiens
aaaataaccctttggttttt

SEQ ID NO: 1644808 - DNA, 13 bp, Homo sapiens
aaaataagcaggt

SEQ ID NO: 1644809 - DNA, 19 bp, Homo sapiens
aaaataagcaggtggatct

SEQ ID NO: 1644810 - DNA, 16 bp, Homo sapiens
aaaataatcaagattt

SEQ ID NO: 1644811 - DNA, 23 bp, Homo sapiens
aaaataatctatttctatgagaa

SEQ ID NO: 1644812 - DNA, 14 bp, Homo sapiens
aaaatacaaaaagc

SEQ ID NO: 1644813 - DNA, 14 bp, Homo sapiens
aaaatacaataaac

SEQ ID NO: 1644814 - DNA, 12 bp, Homo sapiens
aaaatacacacc

SEQ ID NO: 1644815 - DNA, 14 bp, Homo sapiens
aaaatacacatgaa

SEQ ID NO: 1644816 - DNA, 19 bp, Homo sapiens
aaaataccactgtaattga

SEQ ID NO: 1644817 - DNA, 23 bp, Homo sapiens
aaaataccagagccttcaagtgc

SEQ ID NO: 1644818 - DNA, 20 bp, Homo sapiens
aaaatacgatcggtttcata

SEQ ID NO: 1644819 - DNA, 22 bp, Homo sapiens
aaaatactatttaagatgtgaa

SEQ ID NO: 1644820 - DNA, 23 bp, Homo sapiens
aaaatactatttaagatgtgaaa

SEQ ID NO: 1644821 - DNA, 16 bp, Homo sapiens
aaaatacttttactct

SEQ ID NO: 1644822 - DNA, 22 bp, Homo sapiens
aaaatacttttactctgcctac

SEQ ID NO: 1644823 - DNA, 14 bp, Homo sapiens
aaaatacttttgca

SEQ ID NO: 1644824 - DNA, 20 bp, Homo sapiens
aaaatagaaattttgtaaga

SEQ ID NO: 1644825 - DNA, 16 bp, Homo sapiens
aaaatagaataattct

SEQ ID NO: 1644826 - DNA, 13 bp, Homo sapiens
aaaatagacatct

SEQ ID NO: 1644827 - DNA, 19 bp, Homo sapiens
aaaatagacatctttaaca

SEQ ID NO: 1644828 - DNA, 13 bp, Homo sapiens
aaaataggcagga

SEQ ID NO: 1644829 - DNA, 18 bp, Homo sapiens
aaaatagtaaatgctttg

SEQ ID NO: 1644830 - DNA, 19 bp, Homo sapiens
aaaatagtaaatgctttgt

SEQ ID NO: 1644831 - DNA, 19 bp, Homo sapiens
aaaatagtgtaagaactgt

SEQ ID NO: 1644832 - DNA, 15 bp, Homo sapiens
aaaatagttctattt

SEQ ID NO: 1644833 - DNA, 22 bp, Homo sapiens
aaaatagtttaggagaaaccag

SEQ ID NO: 1644834 - DNA, 16 bp, Homo sapiens
aaaatataaacaaaga

SEQ ID NO: 1644835 - DNA, 15 bp, Homo sapiens
aaaatatagagacag

SEQ ID NO: 1644836 - DNA, 19 bp, Homo sapiens
aaaatatagagacaggaca

SEQ ID NO: 1644837 - DNA, 21 bp, Homo sapiens
aaaatatagttaattgtggct

SEQ ID NO: 1644838 - DNA, 14 bp, Homo sapiens
aaaatatatttaat

SEQ ID NO: 1644839 - DNA, 19 bp, Homo sapiens
aaaatatcagacaagcact

SEQ ID NO: 1644840 - DNA, 14 bp, Homo sapiens
aaaatatcctcagg

SEQ ID NO: 1644841 - DNA, 21 bp, Homo sapiens
aaaatatgaacctattttcat

SEQ ID NO: 1644842 - DNA, 13 bp, Homo sapiens
aaaatatgatact

SEQ ID NO: 1644843 - DNA, 20 bp, Homo sapiens
aaaatatgggttgcatttgg

SEQ ID NO: 1644844 - DNA, 20 bp, Homo sapiens
aaaatatgtaagaacacatt

SEQ ID NO: 1644845 - DNA, 14 bp, Homo sapiens
aaaatatgtaattt

SEQ ID NO: 1644846 - DNA, 13 bp, Homo sapiens
aaaatatgtatta

SEQ ID NO: 1644847 - DNA, 14 bp, Homo sapiens
aaaatatgtattaa

SEQ ID NO: 1644848 - DNA, 19 bp, Homo sapiens
aaaatattataacttaaaa

SEQ ID NO: 1644849 - DNA, 14 bp, Homo sapiens
aaaatattatattt

SEQ ID NO: 1644850 - DNA, 17 bp, Homo sapiens
aaaatattcactctcca

SEQ ID NO: 1644851 - DNA, 14 bp, Homo sapiens
aaaatatttatgaa

SEQ ID NO: 1644852 - DNA, 13 bp, Homo sapiens
aaaatatttctaa

SEQ ID NO: 1644853 - DNA, 17 bp, Homo sapiens
aaaatatttctaagctt

SEQ ID NO: 1644854 - DNA, 15 bp, Homo sapiens
aaaatatttgtacat

SEQ ID NO: 1644855 - DNA, 18 bp, Homo sapiens
aaaatattttataatttt

SEQ ID NO: 1644856 - DNA, 12 bp, Homo sapiens
aaaatattttca

SEQ ID NO: 1644857 - DNA, 13 bp, Homo sapiens
aaaatattttctc

SEQ ID NO: 1644858 - DNA, 20 bp, Homo sapiens
aaaatattttgttgccttca

SEQ ID NO: 1644859 - DNA, 23 bp, Homo sapiens
aaaatattttttatatatacagt

SEQ ID NO: 1644860 - DNA, 19 bp, Homo sapiens
aaaatatttttttctagct

SEQ ID NO: 1644861 - DNA, 20 bp, Homo sapiens
aaaatatttttttctagcta

SEQ ID NO: 1644862 - DNA, 16 bp, Homo sapiens
aaaatcaaagaacaga

SEQ ID NO: 1644863 - DNA, 16 bp, Homo sapiens
aaaatcaacttgtgta

SEQ ID NO: 1644864 - DNA, 10 bp, Homo sapiens
aaaatcaaga

SEQ ID NO: 1644865 - DNA, 17 bp, Homo sapiens
aaaatcactttcataat

SEQ ID NO: 1644866 - DNA, 22 bp, Homo sapiens
aaaatcagaacagggctatttg

SEQ ID NO: 1644867 - DNA, 16 bp, Homo sapiens
aaaatcagatgaattg

SEQ ID NO: 1644868 - DNA, 17 bp, Homo sapiens
aaaatcagttgtacagt

SEQ ID NO: 1644869 - DNA, 10 bp, Homo sapiens
aaaatcattt

SEQ ID NO: 1644870 - DNA, 12 bp, Homo sapiens
aaaatcatttct

SEQ ID NO: 1644871 - DNA, 14 bp, Homo sapiens
aaaatccaaaaaga

SEQ ID NO: 1644872 - DNA, 14 bp, Homo sapiens
aaaatccatgaaca

SEQ ID NO: 1644873 - DNA, 15 bp, Homo sapiens
aaaatcctgtgcaat

SEQ ID NO: 1644874 - DNA, 22 bp, Homo sapiens
aaaatccttatgcatgaaatga

SEQ ID NO: 1644875 - DNA, 19 bp, Homo sapiens
aaaatctagttttttttgt

SEQ ID NO: 1644876 - DNA, 21 bp, Homo sapiens
aaaatctatatttgtcttccg

SEQ ID NO: 1644877 - DNA, 12 bp, Homo sapiens
aaaatctcctgg

SEQ ID NO: 1644878 - DNA, 16 bp, Homo sapiens
aaaatctgagaaactc

SEQ ID NO: 1644879 - DNA, 18 bp, Homo sapiens
aaaatctgagaaactcta

SEQ ID NO: 1644880 - DNA, 22 bp, Homo sapiens
aaaatctgagaaactctacatg

SEQ ID NO: 1644881 - DNA, 15 bp, Homo sapiens
aaaatctgtcataag

SEQ ID NO: 1644882 - DNA, 16 bp, Homo sapiens
aaaatcttaatactgt

SEQ ID NO: 1644883 - DNA, 22 bp, Homo sapiens
aaaatcttaatactgttattct

SEQ ID NO: 1644884 - DNA, 22 bp, Homo sapiens
aaaatgaaagcatgtctcaata

SEQ ID NO: 1644885 - DNA, 20 bp, Homo sapiens
aaaatgaacatctcttgaaa

SEQ ID NO: 1644886 - DNA, 18 bp, Homo sapiens
aaaatgaatatctattaa

SEQ ID NO: 1644887 - DNA, 17 bp, Homo sapiens
aaaatgacaacagaaaa

SEQ ID NO: 1644888 - DNA, 18 bp, Homo sapiens
aaaatgacagatgttgaa

SEQ ID NO: 1644889 - DNA, 18 bp, Homo sapiens
aaaatgaggaatagcaaa

SEQ ID NO: 1644890 - DNA, 20 bp, Homo sapiens
aaaatgaggaatccaaaaga

SEQ ID NO: 1644891 - DNA, 23 bp, Homo sapiens
aaaatgagtttttatggggctga

SEQ ID NO: 1644892 - DNA, 16 bp, Homo sapiens
aaaatgcaaaaaatct

SEQ ID NO: 1644893 - DNA, 11 bp, Homo sapiens
aaaatgcaaag

SEQ ID NO: 1644894 - DNA, 12 bp, Homo sapiens
aaaatgcaaagc

SEQ ID NO: 1644895 - DNA, 19 bp, Homo sapiens
aaaatgcaggtgaactttt

SEQ ID NO: 1644896 - DNA, 20 bp, Homo sapiens
aaaatgcaggtgaacttttt

SEQ ID NO: 1644897 - DNA, 20 bp, Homo sapiens
aaaatggaaaaaaacataaa

SEQ ID NO: 1644898 - DNA, 22 bp, Homo sapiens
aaaatggagctcagtaacataa

SEQ ID NO: 1644899 - DNA, 23 bp, Homo sapiens
aaaatggccatttgctttttcac

SEQ ID NO: 1644900 - DNA, 17 bp, Homo sapiens
aaaatggctaataaact

SEQ ID NO: 1644901 - DNA, 22 bp, Homo sapiens
aaaatggctaataaactgtatt

SEQ ID NO: 1644902 - DNA, 23 bp, Homo sapiens
aaaatggctaataaactgtatta

SEQ ID NO: 1644903 - DNA, 15 bp, Homo sapiens
aaaatgggaagactg

SEQ ID NO: 1644904 - DNA, 19 bp, Homo sapiens
aaaatgggaagactgagct

SEQ ID NO: 1644905 - DNA, 17 bp, Homo sapiens
aaaatgggagccaggag

SEQ ID NO: 1644906 - DNA, 18 bp, Homo sapiens
aaaatgggagccaggagt

SEQ ID NO: 1644907 - DNA, 18 bp, Homo sapiens
aaaatgtaaaggagggag

SEQ ID NO: 1644908 - DNA, 22 bp, Homo sapiens
aaaatgtaacatcataattaca

SEQ ID NO: 1644909 - DNA, 14 bp, Homo sapiens
aaaatgtaatttaa

SEQ ID NO: 1644910 - DNA, 14 bp, Homo sapiens
aaaatgtacatgta

SEQ ID NO: 1644911 - DNA, 15 bp, Homo sapiens
aaaatgtacatgtat

SEQ ID NO: 1644912 - DNA, 16 bp, Homo sapiens
aaaatgtacatgtatt

SEQ ID NO: 1644913 - DNA, 18 bp, Homo sapiens
aaaatgtacatgtattaa

SEQ ID NO: 1644914 - DNA, 21 bp, Homo sapiens
aaaatgtacatgtattaaatt

SEQ ID NO: 1644915 - DNA, 19 bp, Homo sapiens
aaaatgtagcgacagcatt

SEQ ID NO: 1644916 - DNA, 16 bp, Homo sapiens
aaaatgtattgattca

SEQ ID NO: 1644917 - DNA, 20 bp, Homo sapiens
aaaatgtcaagacagggaag

SEQ ID NO: 1644918 - DNA, 17 bp, Homo sapiens
aaaatgtcacattctat

SEQ ID NO: 1644919 - DNA, 18 bp, Homo sapiens
aaaatgtcctgcctttta

SEQ ID NO: 1644920 - DNA, 21 bp, Homo sapiens
aaaatgtctgtagctcctcaa

SEQ ID NO: 1644921 - DNA, 21 bp, Homo sapiens
aaaatgtcttcttattttggt

SEQ ID NO: 1644922 - DNA, 21 bp, Homo sapiens
aaactggcatctgacacaaaa

SEQ ID NO: 1644923 - DNA, 18 bp, Homo sapiens
aaactggcatctgctcta

SEQ ID NO: 1644924 - DNA, 12 bp, Homo sapiens
aaactggccagg

SEQ ID NO: 1644925 - DNA, 19 bp, Homo sapiens
aaactgggattaagaaacc

SEQ ID NO: 1644926 - DNA, 19 bp, Homo sapiens
aaactgggtcatcatttgt

SEQ ID NO: 1644927 - DNA, 20 bp, Homo sapiens
aaactgtaaataaaatgtgt

SEQ ID NO: 1644928 - DNA, 23 bp, Homo sapiens
aaactgtaaataaaatgtgtaca

SEQ ID NO: 1644929 - DNA, 15 bp, Homo sapiens
aaactgtacatttaa

SEQ ID NO: 1644930 - DNA, 16 bp, Homo sapiens
aaactgtagaaatgat

SEQ ID NO: 1644931 - DNA, 18 bp, Homo sapiens
aaactgtagaaatgatga

SEQ ID NO: 1644932 - DNA, 15 bp, Homo sapiens
aaactgtagtctcag

SEQ ID NO: 1644933 - DNA, 18 bp, Homo sapiens
aaactgtatcaaatctgt

SEQ ID NO: 1644934 - DNA, 19 bp, Homo sapiens
aaactgtattaaatcttaa

SEQ ID NO: 1644935 - DNA, 12 bp, Homo sapiens
aaactgtgaaaa

SEQ ID NO: 1644936 - DNA, 18 bp, Homo sapiens
aaactgtgaaaatagtgt

SEQ ID NO: 1644937 - DNA, 20 bp, Homo sapiens
aaactgtgtacataactgaa

SEQ ID NO: 1644938 - DNA, 19 bp, Homo sapiens
aaactgtgtattccaagac

SEQ ID NO: 1644939 - DNA, 16 bp, Homo sapiens
aaactgttatttttac

SEQ ID NO: 1644940 - DNA, 20 bp, Homo sapiens
aaactgttctctttaaaata

SEQ ID NO: 1644941 - DNA, 15 bp, Homo sapiens
aaactgttttcatgt

SEQ ID NO: 1644942 - DNA, 17 bp, Homo sapiens
aaacttaaaaaaaaaat

SEQ ID NO: 1644943 - DNA, 14 bp, Homo sapiens
aaacttaaacaaaa

SEQ ID NO: 1644944 - DNA, 15 bp, Homo sapiens
aaacttaaacaaaaa

SEQ ID NO: 1644945 - DNA, 14 bp, Homo sapiens
aaacttaagaaaca

SEQ ID NO: 1644946 - DNA, 14 bp, Homo sapiens
aaacttaagggcaa

SEQ ID NO: 1644947 - DNA, 14 bp, Homo sapiens
aaacttactatttt

SEQ ID NO: 1644948 - DNA, 14 bp, Homo sapiens
aaacttactgtcag

SEQ ID NO: 1644949 - DNA, 21 bp, Homo sapiens
aaacttactgtcagagaatat

SEQ ID NO: 1644950 - DNA, 13 bp, Homo sapiens
aaacttagaggaa

SEQ ID NO: 1644951 - DNA, 14 bp, Homo sapiens
aaacttagaggaaa

SEQ ID NO: 1644952 - DNA, 18 bp, Homo sapiens
aaacttatgctagtttat

SEQ ID NO: 1644953 - DNA, 16 bp, Homo sapiens
aaacttcatgtaattt

SEQ ID NO: 1644954 - DNA, 17 bp, Homo sapiens
aaacttccaaagaaagt

SEQ ID NO: 1644955 - DNA, 17 bp, Homo sapiens
aaacttcggaaacaagt

SEQ ID NO: 1644956 - DNA, 15 bp, Homo sapiens
aaacttctatgtaaa

SEQ ID NO: 1644957 - DNA, 11 bp, Homo sapiens
aaacttgaaat

SEQ ID NO: 1644958 - DNA, 15 bp, Homo sapiens
aaacttgaagcagtc

SEQ ID NO: 1644959 - DNA, 23 bp, Homo sapiens
aaacttgcagcttggtattgcag

SEQ ID NO: 1644960 - DNA, 12 bp, Homo sapiens
aaacttgtaaat

SEQ ID NO: 1644961 - DNA, 13 bp, Homo sapiens
aaacttgtcagaa

SEQ ID NO: 1644962 - DNA, 18 bp, Homo sapiens
aaacttgttactaaagaa

SEQ ID NO: 1644963 - DNA, 18 bp, Homo sapiens
aaacttgtttcactgaaa

SEQ ID NO: 1644964 - DNA, 19 bp, Homo sapiens
aaacttgtttgctgtgaac

SEQ ID NO: 1644965 - DNA, 22 bp, Homo sapiens
aaactttattttttaaaaatga

SEQ ID NO: 1644966 - DNA, 21 bp, Homo sapiens
aaactttgagatctaaaaata

SEQ ID NO: 1644967 - DNA, 18 bp, Homo sapiens
aaactttggcaacatctt

SEQ ID NO: 1644968 - DNA, 20 bp, Homo sapiens
aaactttgggaaaacatgtt

SEQ ID NO: 1644969 - DNA, 16 bp, Homo sapiens
aaacttttaaacatga

SEQ ID NO: 1644970 - DNA, 16 bp, Homo sapiens
aaacttttaattcatt

SEQ ID NO: 1644971 - DNA, 13 bp, Homo sapiens
aaacttttctgct

SEQ ID NO: 1644972 - DNA, 12 bp, Homo sapiens
aaacttttgttt

SEQ ID NO: 1644973 - DNA, 20 bp, Homo sapiens
aaacttttgtttagagccct

SEQ ID NO: 1644974 - DNA, 12 bp, Homo sapiens
aaacttttttat

SEQ ID NO: 1644975 - DNA, 14 bp, Homo sapiens
aaacttttttattt

SEQ ID NO: 1644976 - DNA, 23 bp, Homo sapiens
aaactttttttctgtaccagtta

SEQ ID NO: 1644977 - DNA, 17 bp, Homo sapiens
aaacttttttttgagaa

SEQ ID NO: 1644978 - DNA, 19 bp, Homo sapiens
aaagaaaaatgcctgtctc

SEQ ID NO: 1644979 - DNA, 19 bp, Homo sapiens
aaagaaaacaaaaaacgaa

SEQ ID NO: 1644980 - DNA, 13 bp, Homo sapiens
aaagaaaatggct

SEQ ID NO: 1644981 - DNA, 12 bp, Homo sapiens
aaagaaaattga

SEQ ID NO: 1644982 - DNA, 14 bp, Homo sapiens
aaagaaagaaggaa

SEQ ID NO: 1644983 - DNA, 23 bp, Homo sapiens
aaagaaagatactcacatgagtt

SEQ ID NO: 1644984 - DNA, 13 bp, Homo sapiens
aaagaaagcagaa

SEQ ID NO: 1644985 - DNA, 12 bp, Homo sapiens
aaagaaagtgta

SEQ ID NO: 1644986 - DNA, 12 bp, Homo sapiens
aaagaaatacag

SEQ ID NO: 1644987 - DNA, 21 bp, Homo sapiens
aaagaaatgctaatgtaatca

SEQ ID NO: 1644988 - DNA, 18 bp, Homo sapiens
aaagaacatggacttgta

SEQ ID NO: 1644989 - DNA, 23 bp, Homo sapiens
aaagaaccaacaacctcaactgc

SEQ ID NO: 1644990 - DNA, 18 bp, Homo sapiens
aaagaacctaacatttat

SEQ ID NO: 1644991 - DNA, 21 bp, Homo sapiens
aaagaactccttattttgtat

SEQ ID NO: 1644992 - DNA, 20 bp, Homo sapiens
aaagaacttgctgctgcctt

SEQ ID NO: 1644993 - DNA, 18 bp, Homo sapiens
aaagaactttaaagctca

SEQ ID NO: 1644994 - DNA, 13 bp, Homo sapiens
aaagaagaaagtc

SEQ ID NO: 1644995 - DNA, 17 bp, Homo sapiens
aaagaagaaagtctatg

SEQ ID NO: 1644996 - DNA, 19 bp, Homo sapiens
aaagaagaaatagttctgt

SEQ ID NO: 1644997 - DNA, 19 bp, Homo sapiens
aaagaagaagaagaaggag

SEQ ID NO: 1644998 - DNA, 20 bp, Homo sapiens
aaagaagcccaatattataa

SEQ ID NO: 1644999 - DNA, 16 bp, Homo sapiens
aaagaagcccccagct

SEQ ID NO: 1645000 - DNA, 12 bp, Homo sapiens
aaagaaggaagt

SEQ ID NO: 1645001 - DNA, 23 bp, Homo sapiens
aaagaagggggccctgctacctg

SEQ ID NO: 1645002 - DNA, 17 bp, Homo sapiens
aaagaatacagaaagat

SEQ ID NO: 1645003 - DNA, 15 bp, Homo sapiens
aaagaatatgacttt

SEQ ID NO: 1645004 - DNA, 19 bp, Homo sapiens
aaagaatattccattttcc

SEQ ID NO: 1645005 - DNA, 15 bp, Homo sapiens
aaagaatccttatct

SEQ ID NO: 1645006 - DNA, 20 bp, Homo sapiens
aaagaattatttttgtgttt

SEQ ID NO: 1645007 - DNA, 19 bp, Homo sapiens
aaagacaaaaatcaaagaa

SEQ ID NO: 1645008 - DNA, 23 bp, Homo sapiens
aaagacaaaaatcaaagaacaga

SEQ ID NO: 1645009 - DNA, 18 bp, Homo sapiens
aaagacaacaaaagaaat

SEQ ID NO: 1645010 - DNA, 18 bp, Homo sapiens
aaagacaatcactgccaa

SEQ ID NO: 1645011 - DNA, 18 bp, Homo sapiens
aaagacacagaacacaga

SEQ ID NO: 1645012 - DNA, 13 bp, Homo sapiens
aaagacacctact

SEQ ID NO: 1645013 - DNA, 13 bp, Homo sapiens
aaagacactgcct

SEQ ID NO: 1645014 - DNA, 14 bp, Homo sapiens
aaagacagaatggt

SEQ ID NO: 1645015 - DNA, 19 bp, Homo sapiens
aaagacagaatggtggagt

SEQ ID NO: 1645016 - DNA, 21 bp, Homo sapiens
aaagacagaatggtggagtgt

SEQ ID NO: 1645017 - DNA, 13 bp, Homo sapiens
aaagacatcaatg

SEQ ID NO: 1645018 - DNA, 20 bp, Homo sapiens
aaagacattgattcagcctg

SEQ ID NO: 1645019 - DNA, 20 bp, Homo sapiens
aaagacattttaagtttgta

SEQ ID NO: 1645020 - DNA, 19 bp, Homo sapiens
aaagaccctaaatctgagg

SEQ ID NO: 1645021 - DNA, 20 bp, Homo sapiens
aaagaccctgagactccaga

SEQ ID NO: 1645022 - DNA, 22 bp, Homo sapiens
aaagacctttggagcaaagctg

SEQ ID NO: 1645023 - DNA, 14 bp, Homo sapiens
aaagactattcaaa

SEQ ID NO: 1645024 - DNA, 15 bp, Homo sapiens
aaagactattcaaac

SEQ ID NO: 1645025 - DNA, 13 bp, Homo sapiens
aaagactccaaag

SEQ ID NO: 1645026 - DNA, 21 bp, Homo sapiens
aaagactccaaagaaatgtaa

SEQ ID NO: 1645027 - DNA, 15 bp, Homo sapiens
aaagactgaacatgt

SEQ ID NO: 1645028 - DNA, 18 bp, Homo sapiens
aaagactgaacatgttta

SEQ ID NO: 1645029 - DNA, 22 bp, Homo sapiens
aaagactgtgaacagcttgctg

SEQ ID NO: 1645030 - DNA, 20 bp, Homo sapiens
aaagactgtggaaatgccaa

SEQ ID NO: 1645031 - DNA, 12 bp, Homo sapiens
aaagacttaagc

SEQ ID NO: 1645032 - DNA, 18 bp, Homo sapiens
aaagacttagtatatttt

SEQ ID NO: 1645033 - DNA, 20 bp, Homo sapiens
aaagacttggttggtagggt

SEQ ID NO: 1645034 - DNA, 17 bp, Homo sapiens
aaagagaaaaagaaatg

SEQ ID NO: 1645035 - DNA, 19 bp, Homo sapiens
aaagagaaacagttggtaa

SEQ ID NO: 1645036 - DNA, 17 bp, Homo sapiens
aaagagaaatacataaa

SEQ ID NO: 1645037 - DNA, 16 bp, Homo sapiens
aaataaaaaagatccc

SEQ ID NO: 1645038 - DNA, 22 bp, Homo sapiens
aaataaaaactaatttcatact

SEQ ID NO: 1645039 - DNA, 13 bp, Homo sapiens
aaataaaaagaaa

SEQ ID NO: 1645040 - DNA, 19 bp, Homo sapiens
aaataaaaagaaaggctgt

SEQ ID NO: 1645041 - DNA, 15 bp, Homo sapiens
aaataaaaagtgaca

SEQ ID NO: 1645042 - DNA, 20 bp, Homo sapiens
aaataaaaagtgacacagca

SEQ ID NO: 1645043 - DNA, 14 bp, Homo sapiens
aaataaaaataaat

SEQ ID NO: 1645044 - DNA, 14 bp, Homo sapiens
aaataaaaatattg

SEQ ID NO: 1645045 - DNA, 17 bp, Homo sapiens
aaataaaatattcactc

SEQ ID NO: 1645046 - DNA, 15 bp, Homo sapiens
aaataaaatgaacat

SEQ ID NO: 1645047 - DNA, 12 bp, Homo sapiens
aaataaaattac

SEQ ID NO: 1645048 - DNA, 14 bp, Homo sapiens
aaataaacatcagt

SEQ ID NO: 1645049 - DNA, 18 bp, Homo sapiens
aaataaacatcagtttct

SEQ ID NO: 1645050 - DNA, 12 bp, Homo sapiens
aaataaactagt

SEQ ID NO: 1645051 - DNA, 14 bp, Homo sapiens
aaataaactattta

SEQ ID NO: 1645052 - DNA, 19 bp, Homo sapiens
aaataaagaagaaaataac

SEQ ID NO: 1645053 - DNA, 15 bp, Homo sapiens
aaataaagtatatat

SEQ ID NO: 1645054 - DNA, 19 bp, Homo sapiens
aaataaagttggtcttttg

SEQ ID NO: 1645055 - DNA, 20 bp, Homo sapiens
aaataaagtttgcttagaaa

SEQ ID NO: 1645056 - DNA, 19 bp, Homo sapiens
aaataaatgattatattca

SEQ ID NO: 1645057 - DNA, 12 bp, Homo sapiens
aaataaatgtac

SEQ ID NO: 1645058 - DNA, 16 bp, Homo sapiens
aaataaatgtatcata

SEQ ID NO: 1645059 - DNA, 17 bp, Homo sapiens
aaataaattagttgtta

SEQ ID NO: 1645060 - DNA, 22 bp, Homo sapiens
aaataaattcctacaacttaat

SEQ ID NO: 1645061 - DNA, 19 bp, Homo sapiens
aaataaattttgtttcaga

SEQ ID NO: 1645062 - DNA, 12 bp, Homo sapiens
aaataacaacta

SEQ ID NO: 1645063 - DNA, 19 bp, Homo sapiens
aaataacaactatttttgt

SEQ ID NO: 1645064 - DNA, 21 bp, Homo sapiens
aaataacacacatataaacat

SEQ ID NO: 1645065 - DNA, 16 bp, Homo sapiens
aaataaccaaaaaatg

SEQ ID NO: 1645066 - DNA, 22 bp, Homo sapiens
aaataaccttcatcaagaaata

SEQ ID NO: 1645067 - DNA, 17 bp, Homo sapiens
aaataactagtgttgct

SEQ ID NO: 1645068 - DNA, 20 bp, Homo sapiens
aaataactggaaaacagaac

SEQ ID NO: 1645069 - DNA, 20 bp, Homo sapiens
aaataactggaacaaattat

SEQ ID NO: 1645070 - DNA, 16 bp, Homo sapiens
aaataactgtaattat

SEQ ID NO: 1645071 - DNA, 12 bp, Homo sapiens
aaataactgtgc

SEQ ID NO: 1645072 - DNA, 18 bp, Homo sapiens
aaataacttcaagcaaac

SEQ ID NO: 1645073 - DNA, 15 bp, Homo sapiens
aaataagaaaaatca

SEQ ID NO: 1645074 - DNA, 16 bp, Homo sapiens
aaataagaaataatgc

SEQ ID NO: 1645075 - DNA, 12 bp, Homo sapiens
aaataagagatt

SEQ ID NO: 1645076 - DNA, 13 bp, Homo sapiens
aaataagattcta

SEQ ID NO: 1645077 - DNA, 15 bp, Homo sapiens
aaataagattctaac

SEQ ID NO: 1645078 - DNA, 13 bp, Homo sapiens
aaataagcaggtg

SEQ ID NO: 1645079 - DNA, 14 bp, Homo sapiens
aaataagtcaacag

SEQ ID NO: 1645080 - DNA, 18 bp, Homo sapiens
aaataagtcaacagtaaa

SEQ ID NO: 1645081 - DNA, 21 bp, Homo sapiens
aaataagtcaacagtaaacca

SEQ ID NO: 1645082 - DNA, 17 bp, Homo sapiens
aaataagtggattttgt

SEQ ID NO: 1645083 - DNA, 19 bp, Homo sapiens
aaataagttttttttctgg

SEQ ID NO: 1645084 - DNA, 14 bp, Homo sapiens
aaataatagggaaa

SEQ ID NO: 1645085 - DNA, 16 bp, Homo sapiens
aaataatatatttctt

SEQ ID NO: 1645086 - DNA, 14 bp, Homo sapiens
aaataatcaaaagc

SEQ ID NO: 1645087 - DNA, 15 bp, Homo sapiens
aaataatcggcccac

SEQ ID NO: 1645088 - DNA, 13 bp, Homo sapiens
aaataatctattt

SEQ ID NO: 1645089 - DNA, 13 bp, Homo sapiens
aaataatgctaca

SEQ ID NO: 1645090 - DNA, 20 bp, Homo sapiens
aaataatgctacaattttaa

SEQ ID NO: 1645091 - DNA, 12 bp, Homo sapiens
aaataatggaaa

SEQ ID NO: 1645092 - DNA, 23 bp, Homo sapiens
aaataattatataactgtatttg

SEQ ID NO: 1645093 - DNA, 20 bp, Homo sapiens
aaataattttaaacaaaggt

SEQ ID NO: 1645094 - DNA, 12 bp, Homo sapiens
aaataattttat

SEQ ID NO: 1645095 - DNA, 15 bp, Homo sapiens
aaataattttccaag

SEQ ID NO: 1645096 - DNA, 21 bp, Homo sapiens
aaataattttccaagtaaagt

SEQ ID NO: 1645097 - DNA, 19 bp, Homo sapiens
aaatacaacttaaataata

SEQ ID NO: 1645098 - DNA, 22 bp, Homo sapiens
aaatacaataaactattggaaa

SEQ ID NO: 1645099 - DNA, 17 bp, Homo sapiens
aaatacacaagtaaaca

SEQ ID NO: 1645100 - DNA, 16 bp, Homo sapiens
aaatacacatgaaaac

SEQ ID NO: 1645101 - DNA, 12 bp, Homo sapiens
aaatacacattt

SEQ ID NO: 1645102 - DNA, 22 bp, Homo sapiens
aaatacacatttgctactgttg

SEQ ID NO: 1645103 - DNA, 16 bp, Homo sapiens
aaatacagacactaag

SEQ ID NO: 1645104 - DNA, 22 bp, Homo sapiens
aaatacagacactaagttatag

SEQ ID NO: 1645105 - DNA, 20 bp, Homo sapiens
aaatacagataaatgattca

SEQ ID NO: 1645106 - DNA, 20 bp, Homo sapiens
aaatacagataattcatttg

SEQ ID NO: 1645107 - DNA, 13 bp, Homo sapiens
aaatacaggaaac

SEQ ID NO: 1645108 - DNA, 15 bp, Homo sapiens
aaatacatagtgaaa

SEQ ID NO: 1645109 - DNA, 23 bp, Homo sapiens
aaatacatgccacatcaaacctt

SEQ ID NO: 1645110 - DNA, 19 bp, Homo sapiens
aaatacattataacaacta

SEQ ID NO: 1645111 - DNA, 22 bp, Homo sapiens
aaatacattataacaactattt

SEQ ID NO: 1645112 - DNA, 18 bp, Homo sapiens
aaatacattctttttgct

SEQ ID NO: 1645113 - DNA, 20 bp, Homo sapiens
aaataccacaatcaccgatg

SEQ ID NO: 1645114 - DNA, 14 bp, Homo sapiens
aaataccactgtaa

SEQ ID NO: 1645115 - DNA, 22 bp, Homo sapiens
aaataccactgtaattgacaga

SEQ ID NO: 1645116 - DNA, 17 bp, Homo sapiens
aaataccatgtctctaa

SEQ ID NO: 1645117 - DNA, 15 bp, Homo sapiens
aaataccattcacta

SEQ ID NO: 1645118 - DNA, 17 bp, Homo sapiens
aaatacctcaatttttg

SEQ ID NO: 1645119 - DNA, 18 bp, Homo sapiens
aaatacctctaataaaca

SEQ ID NO: 1645120 - DNA, 15 bp, Homo sapiens
aaataccttttctca

SEQ ID NO: 1645121 - DNA, 15 bp, Homo sapiens
aaatactatttaaga

SEQ ID NO: 1645122 - DNA, 21 bp, Homo sapiens
aaatactatttaagatgtgaa

SEQ ID NO: 1645123 - DNA, 18 bp, Homo sapiens
aaatactcaccaaaatat

SEQ ID NO: 1645124 - DNA, 13 bp, Homo sapiens
aaatactctgcta

SEQ ID NO: 1645125 - DNA, 15 bp, Homo sapiens
aaatactgcaaatca

SEQ ID NO: 1645126 - DNA, 18 bp, Homo sapiens
aaatactgcctagaaaat

SEQ ID NO: 1645127 - DNA, 22 bp, Homo sapiens
aaatactgcctagaaaatgcaa

SEQ ID NO: 1645128 - DNA, 15 bp, Homo sapiens
aaatactggactcag

SEQ ID NO: 1645129 - DNA, 15 bp, Homo sapiens
aaatacttaaatgtt

SEQ ID NO: 1645130 - DNA, 18 bp, Homo sapiens
aaatacttaaatgttatg

SEQ ID NO: 1645131 - DNA, 20 bp, Homo sapiens
aaatacttaaatgttatgta

SEQ ID NO: 1645132 - DNA, 18 bp, Homo sapiens
aaatacttaacacgtgaa

SEQ ID NO: 1645133 - DNA, 19 bp, Homo sapiens
aaatacttttactctgcct

SEQ ID NO: 1645134 - DNA, 14 bp, Homo sapiens
aaatacttttgcat

SEQ ID NO: 1645135 - DNA, 14 bp, Homo sapiens
aaatagaataattc

SEQ ID NO: 1645136 - DNA, 18 bp, Homo sapiens
aaatagacaaaaagtata

SEQ ID NO: 1645137 - DNA, 16 bp, Homo sapiens
aaatagacagtatatt

SEQ ID NO: 1645138 - DNA, 14 bp, Homo sapiens
aaatagagtgtagt

SEQ ID NO: 1645139 - DNA, 18 bp, Homo sapiens
aaatagagtgtagtttac

SEQ ID NO: 1645140 - DNA, 19 bp, Homo sapiens
aaatagagtttgctattag

SEQ ID NO: 1645141 - DNA, 22 bp, Homo sapiens
aaatagatgctgtgtatatggt

SEQ ID NO: 1645142 - DNA, 20 bp, Homo sapiens
aaatagatggatttgtatca

SEQ ID NO: 1645143 - DNA, 15 bp, Homo sapiens
aaatagcttctgttt

SEQ ID NO: 1645144 - DNA, 19 bp, Homo sapiens
aaataggaatcattcagaa

SEQ ID NO: 1645145 - DNA, 20 bp, Homo sapiens
aaataggaatcattcagaaa

SEQ ID NO: 1645146 - DNA, 16 bp, Homo sapiens
aaataggatttttaga

SEQ ID NO: 1645147 - DNA, 14 bp, Homo sapiens
aaataggcagaatg

SEQ ID NO: 1645148 - DNA, 14 bp, Homo sapiens
aaataggcaggaag

SEQ ID NO: 1645149 - DNA, 19 bp, Homo sapiens
aaataggctattaaaaaag

SEQ ID NO: 1645150 - DNA, 17 bp, Homo sapiens
aaatagggaagatggag

SEQ ID NO: 1645151 - DNA, 17 bp, Homo sapiens
aaataggggatatttaa

SEQ ID NO: 1645152 - DNA, 18 bp, Homo sapiens
aaatgttagtcattgtta

SEQ ID NO: 1645153 - DNA, 23 bp, Homo sapiens
aaatgttatgtatatggtggtaa

SEQ ID NO: 1645154 - DNA, 15 bp, Homo sapiens
aaatgttcacaaggt

SEQ ID NO: 1645155 - DNA, 19 bp, Homo sapiens
aaatgttctatttaacaac

SEQ ID NO: 1645156 - DNA, 15 bp, Homo sapiens
aaatgttctttgggg

SEQ ID NO: 1645157 - DNA, 17 bp, Homo sapiens
aaatgttggaatgttat

SEQ ID NO: 1645158 - DNA, 17 bp, Homo sapiens
aaatgttggtcatttta

SEQ ID NO: 1645159 - DNA, 19 bp, Homo sapiens
aaatgttggtcattttatg

SEQ ID NO: 1645160 - DNA, 13 bp, Homo sapiens
aaatgttgtattg

SEQ ID NO: 1645161 - DNA, 22 bp, Homo sapiens
aaatgttgttctcttctttaaa

SEQ ID NO: 1645162 - DNA, 16 bp, Homo sapiens
aaatgtttactgtaaa

SEQ ID NO: 1645163 - DNA, 17 bp, Homo sapiens
aaatgtttactgtaaat

SEQ ID NO: 1645164 - DNA, 15 bp, Homo sapiens
aaatgtttccttaaa

SEQ ID NO: 1645165 - DNA, 17 bp, Homo sapiens
aaatgtttccttaaaca

SEQ ID NO: 1645166 - DNA, 10 bp, Homo sapiens
aaatgtttct

SEQ ID NO: 1645167 - DNA, 12 bp, Homo sapiens
aaatgtttctaa

SEQ ID NO: 1645168 - DNA, 20 bp, Homo sapiens
aaatgtttgttaaaaataaa

SEQ ID NO: 1645169 - DNA, 15 bp, Homo sapiens
aaatgtttttatttt

SEQ ID NO: 1645170 - DNA, 23 bp, Homo sapiens
aaatgtttttctgccagggagct

SEQ ID NO: 1645171 - DNA, 21 bp, Homo sapiens
aaatgtttttggtcttttata

SEQ ID NO: 1645172 - DNA, 15 bp, Homo sapiens
aaattaaaacaaata

SEQ ID NO: 1645173 - DNA, 19 bp, Homo sapiens
aaattaaaacaaatataca

SEQ ID NO: 1645174 - DNA, 15 bp, Homo sapiens
aaattaaacattttt

SEQ ID NO: 1645175 - DNA, 23 bp, Homo sapiens
aaattaaatgccttgtataaaat

SEQ ID NO: 1645176 - DNA, 13 bp, Homo sapiens
aaattaaattggg

SEQ ID NO: 1645177 - DNA, 14 bp, Homo sapiens
aaattaaattgggc

SEQ ID NO: 1645178 - DNA, 19 bp, Homo sapiens
aaattaacacaaaggaagt

SEQ ID NO: 1645179 - DNA, 13 bp, Homo sapiens
aaattaagacttt

SEQ ID NO: 1645180 - DNA, 15 bp, Homo sapiens
aaattaagttgaaaa

SEQ ID NO: 1645181 - DNA, 16 bp, Homo sapiens
aaattaatgaagcttt

SEQ ID NO: 1645182 - DNA, 14 bp, Homo sapiens
aaattaattttact

SEQ ID NO: 1645183 - DNA, 15 bp, Homo sapiens
aaattacaattttat

SEQ ID NO: 1645184 - DNA, 22 bp, Homo sapiens
aaattacatagacttaggcatt

SEQ ID NO: 1645185 - DNA, 21 bp, Homo sapiens
aaattacctttaattttaatg

SEQ ID NO: 1645186 - DNA, 20 bp, Homo sapiens
aaattactatctgttgaaaa

SEQ ID NO: 1645187 - DNA, 14 bp, Homo sapiens
aaattactctttct

SEQ ID NO: 1645188 - DNA, 12 bp, Homo sapiens
aaattactgttt

SEQ ID NO: 1645189 - DNA, 18 bp, Homo sapiens
aaattagaatgaatttat

SEQ ID NO: 1645190 - DNA, 19 bp, Homo sapiens
aaattagatcctaagatgt

SEQ ID NO: 1645191 - DNA, 14 bp, Homo sapiens
aaattagatttgtg

SEQ ID NO: 1645192 - DNA, 21 bp, Homo sapiens
aaattagatttgtgcaaacat

SEQ ID NO: 1645193 - DNA, 19 bp, Homo sapiens
aaattagcctaagatatac

SEQ ID NO: 1645194 - DNA, 20 bp, Homo sapiens
aaattagcctaagatatact

SEQ ID NO: 1645195 - DNA, 22 bp, Homo sapiens
aaattagcctaagatatacttg

SEQ ID NO: 1645196 - DNA, 13 bp, Homo sapiens
aaattagctgggc

SEQ ID NO: 1645197 - DNA, 18 bp, Homo sapiens
aaattagctgtgtgaaat

SEQ ID NO: 1645198 - DNA, 15 bp, Homo sapiens
aaattaggaataaat

SEQ ID NO: 1645199 - DNA, 22 bp, Homo sapiens
aaattataacttaaaatatttt

SEQ ID NO: 1645200 - DNA, 17 bp, Homo sapiens
aaattataatgtattca

SEQ ID NO: 1645201 - DNA, 16 bp, Homo sapiens
aaattatactgtagct

SEQ ID NO: 1645202 - DNA, 13 bp, Homo sapiens
aaattatcaaaaa

SEQ ID NO: 1645203 - DNA, 16 bp, Homo sapiens
aaattatcaatatcta

SEQ ID NO: 1645204 - DNA, 21 bp, Homo sapiens
aaattatgcaaaagcagctaa

SEQ ID NO: 1645205 - DNA, 13 bp, Homo sapiens
aaattatgtaact

SEQ ID NO: 1645206 - DNA, 18 bp, Homo sapiens
aaattattagagattttc

SEQ ID NO: 1645207 - DNA, 19 bp, Homo sapiens
aaattattagagattttct

SEQ ID NO: 1645208 - DNA, 23 bp, Homo sapiens
aaattattagtttacatcatttt

SEQ ID NO: 1645209 - DNA, 13 bp, Homo sapiens
aaattatttgcta

SEQ ID NO: 1645210 - DNA, 17 bp, Homo sapiens
aaattattttaatattt

SEQ ID NO: 1645211 - DNA, 22 bp, Homo sapiens
aaattattttaatattttgtat

SEQ ID NO: 1645212 - DNA, 20 bp, Homo sapiens
aaattattttgttcatacat

SEQ ID NO: 1645213 - DNA, 14 bp, Homo sapiens
aaattcaacaaatg

SEQ ID NO: 1645214 - DNA, 15 bp, Homo sapiens
aaattcaactttgta

SEQ ID NO: 1645215 - DNA, 18 bp, Homo sapiens
aaattcacaagttgtgtt

SEQ ID NO: 1645216 - DNA, 19 bp, Homo sapiens
aaattcacaagttgtgttt

SEQ ID NO: 1645217 - DNA, 16 bp, Homo sapiens
aaattcacaatagaaa

SEQ ID NO: 1645218 - DNA, 16 bp, Homo sapiens
aaattcagacaacatt

SEQ ID NO: 1645219 - DNA, 17 bp, Homo sapiens
aaattcagacaacatta

SEQ ID NO: 1645220 - DNA, 20 bp, Homo sapiens
aaattcagatatatttttca

SEQ ID NO: 1645221 - DNA, 21 bp, Homo sapiens
aaattcagcaaaccattttta

SEQ ID NO: 1645222 - DNA, 18 bp, Homo sapiens
aaattcataaccaaagag

SEQ ID NO: 1645223 - DNA, 12 bp, Homo sapiens
aaattcatttct

SEQ ID NO: 1645224 - DNA, 12 bp, Homo sapiens
aaattcatttgt

SEQ ID NO: 1645225 - DNA, 14 bp, Homo sapiens
aaattccaaagtct

SEQ ID NO: 1645226 - DNA, 21 bp, Homo sapiens
aaattccaaagtctctaattc

SEQ ID NO: 1645227 - DNA, 22 bp, Homo sapiens
aaattccaaagtctctaattct

SEQ ID NO: 1645228 - DNA, 21 bp, Homo sapiens
aaattcctgtgttcaatattt

SEQ ID NO: 1645229 - DNA, 22 bp, Homo sapiens
aaattctataggaacatatgaa

SEQ ID NO: 1645230 - DNA, 12 bp, Homo sapiens
aaattctccact

SEQ ID NO: 1645231 - DNA, 14 bp, Homo sapiens
aaattctcctggag

SEQ ID NO: 1645232 - DNA, 19 bp, Homo sapiens
aaattctgatgtttctgtg

SEQ ID NO: 1645233 - DNA, 20 bp, Homo sapiens
aaattctgatgtttctgtga

SEQ ID NO: 1645234 - DNA, 23 bp, Homo sapiens
aaattcttctgaactcaaactga

SEQ ID NO: 1645235 - DNA, 18 bp, Homo sapiens
aaattcttgaagttcatg

SEQ ID NO: 1645236 - DNA, 16 bp, Homo sapiens
aaattctttagtactc

SEQ ID NO: 1645237 - DNA, 23 bp, Homo sapiens
aaattctttagtactcaatgttt

SEQ ID NO: 1645238 - DNA, 20 bp, Homo sapiens
aaattgaaaggcattctctg

SEQ ID NO: 1645239 - DNA, 23 bp, Homo sapiens
aaattgactgatgattttccttt

SEQ ID NO: 1645240 - DNA, 20 bp, Homo sapiens
aaattgagataatgatactt

SEQ ID NO: 1645241 - DNA, 20 bp, Homo sapiens
aaattgataatgctttcaca

SEQ ID NO: 1645242 - DNA, 14 bp, Homo sapiens
aaattgatattata

SEQ ID NO: 1645243 - DNA, 21 bp, Homo sapiens
aaattgatattatattaaaca

SEQ ID NO: 1645244 - DNA, 14 bp, Homo sapiens
aaattgatgtgttt

SEQ ID NO: 1645245 - DNA, 19 bp, Homo sapiens
aaattgatttccatatttt

SEQ ID NO: 1645246 - DNA, 11 bp, Homo sapiens
aaattgatttt

SEQ ID NO: 1645247 - DNA, 17 bp, Homo sapiens
aaattgcatactttgta

SEQ ID NO: 1645248 - DNA, 23 bp, Homo sapiens
aaattgcatactttgtattttga

SEQ ID NO: 1645249 - DNA, 13 bp, Homo sapiens
aaattgccttcag

SEQ ID NO: 1645250 - DNA, 19 bp, Homo sapiens
aaattgccttcagccctaa

SEQ ID NO: 1645251 - DNA, 14 bp, Homo sapiens
aaattgcctttctg

SEQ ID NO: 1645252 - DNA, 13 bp, Homo sapiens
aaattgctatgtt

SEQ ID NO: 1645253 - DNA, 21 bp, Homo sapiens
aaattgctatgttactatttt

SEQ ID NO: 1645254 - DNA, 15 bp, Homo sapiens
aaattgctattttat

SEQ ID NO: 1645255 - DNA, 16 bp, Homo sapiens
aaattgctgcatattt

SEQ ID NO: 1645256 - DNA, 22 bp, Homo sapiens
aaattgctgtgcctcccaaaat

SEQ ID NO: 1645257 - DNA, 20 bp, Homo sapiens
aaattgcttctaaaacaata

SEQ ID NO: 1645258 - DNA, 12 bp, Homo sapiens
aaattgcttttt

SEQ ID NO: 1645259 - DNA, 16 bp, Homo sapiens
aaattggaacagaatg

SEQ ID NO: 1645260 - DNA, 13 bp, Homo sapiens
aaattggaactct

SEQ ID NO: 1645261 - DNA, 21 bp, Homo sapiens
aaattggttttccagaggcct

SEQ ID NO: 1645262 - DNA, 19 bp, Homo sapiens
aaattgtatacattttgtt

SEQ ID NO: 1645263 - DNA, 18 bp, Homo sapiens
aaattgtatctcattact

SEQ ID NO: 1645264 - DNA, 23 bp, Homo sapiens
aaattgtctgggttccaaaatat

SEQ ID NO: 1645265 - DNA, 12 bp, Homo sapiens
aaattgtgatgt

SEQ ID NO: 1645266 - DNA, 22 bp, Homo sapiens
aaattgttgtccggtttacttt

SEQ ID NO: 1645267 - DNA, 12 bp, Homo sapiens
aacatgcacatt

SEQ ID NO: 1645268 - DNA, 18 bp, Homo sapiens
aacatgcacattttgtac

SEQ ID NO: 1645269 - DNA, 20 bp, Homo sapiens
aacatgcacattttgtacat

SEQ ID NO: 1645270 - DNA, 22 bp, Homo sapiens
aacatgctggaaataaaacagc

SEQ ID NO: 1645271 - DNA, 18 bp, Homo sapiens
aacatgctggtgaatatt

SEQ ID NO: 1645272 - DNA, 20 bp, Homo sapiens
aacatgcttttactttattg

SEQ ID NO: 1645273 - DNA, 22 bp, Homo sapiens
aacatggaactcattcctgcct

SEQ ID NO: 1645274 - DNA, 18 bp, Homo sapiens
aacatggacttgtatatt

SEQ ID NO: 1645275 - DNA, 19 bp, Homo sapiens
aacatggacttgtatattt

SEQ ID NO: 1645276 - DNA, 20 bp, Homo sapiens
aacatggacttgtatatttg

SEQ ID NO: 1645277 - DNA, 23 bp, Homo sapiens
aacatggacttgtatatttgtac

SEQ ID NO: 1645278 - DNA, 14 bp, Homo sapiens
aacatggctggcct

SEQ ID NO: 1645279 - DNA, 15 bp, Homo sapiens
aacatggctggcctg

SEQ ID NO: 1645280 - DNA, 21 bp, Homo sapiens
aacatgggcattgggttctaa

SEQ ID NO: 1645281 - DNA, 21 bp, Homo sapiens
aacatgggctcttcactagtg

SEQ ID NO: 1645282 - DNA, 14 bp, Homo sapiens
aacatggtgcctat

SEQ ID NO: 1645283 - DNA, 22 bp, Homo sapiens
aacatggtggaaaacgaagctc

SEQ ID NO: 1645284 - DNA, 22 bp, Homo sapiens
aacatgtaatataaagatgtta

SEQ ID NO: 1645285 - DNA, 20 bp, Homo sapiens
aacatgtactacagctatat

SEQ ID NO: 1645286 - DNA, 11 bp, Homo sapiens
aacatgtatgt

SEQ ID NO: 1645287 - DNA, 19 bp, Homo sapiens
aacatgtctcctatcctgg

SEQ ID NO: 1645288 - DNA, 19 bp, Homo sapiens
aacatgtgccttttctgaa

SEQ ID NO: 1645289 - DNA, 20 bp, Homo sapiens
aacatgttaatgacaatatt

SEQ ID NO: 1645290 - DNA, 21 bp, Homo sapiens
aacatgttattcaatgtgaca

SEQ ID NO: 1645291 - DNA, 22 bp, Homo sapiens
aacatgttgtacatttcaccat

SEQ ID NO: 1645292 - DNA, 20 bp, Homo sapiens
aacatgtttaaatagcctaa

SEQ ID NO: 1645293 - DNA, 18 bp, Homo sapiens
aacatgtttctgttttgt

SEQ ID NO: 1645294 - DNA, 21 bp, Homo sapiens
aacattaaaacaatattgttt

SEQ ID NO: 1645295 - DNA, 23 bp, Homo sapiens
aacattaaaacaatattgtttct

SEQ ID NO: 1645296 - DNA, 15 bp, Homo sapiens
aacattaaacactgt

SEQ ID NO: 1645297 - DNA, 17 bp, Homo sapiens
aacattaagtaaatgct

SEQ ID NO: 1645298 - DNA, 18 bp, Homo sapiens
aacattaatgcctgcttt

SEQ ID NO: 1645299 - DNA, 23 bp, Homo sapiens
aacattaatgcctgctttttgga

SEQ ID NO: 1645300 - DNA, 19 bp, Homo sapiens
aacattaggaccttagaat

SEQ ID NO: 1645301 - DNA, 16 bp, Homo sapiens
aacattagttgcacta

SEQ ID NO: 1645302 - DNA, 22 bp, Homo sapiens
aacattatgatctaataaactt

SEQ ID NO: 1645303 - DNA, 22 bp, Homo sapiens
aacattcacacagggctctttg

SEQ ID NO: 1645304 - DNA, 22 bp, Homo sapiens
aacattcagctctggagaacag

SEQ ID NO: 1645305 - DNA, 18 bp, Homo sapiens
aacattgaagtaatgaat

SEQ ID NO: 1645306 - DNA, 22 bp, Homo sapiens
aacattgaccaagaactgcatg

SEQ ID NO: 1645307 - DNA, 15 bp, Homo sapiens
aacattggaatgttc

SEQ ID NO: 1645308 - DNA, 16 bp, Homo sapiens
aacattggaatgttct

SEQ ID NO: 1645309 - DNA, 21 bp, Homo sapiens
aacattggaatgttctcagat

SEQ ID NO: 1645310 - DNA, 21 bp, Homo sapiens
aacatttacaataaatattct

SEQ ID NO: 1645311 - DNA, 22 bp, Homo sapiens
aacatttatgacctaagtcagg

SEQ ID NO: 1645312 - DNA, 23 bp, Homo sapiens
aacatttctctccaccttagtac

SEQ ID NO: 1645313 - DNA, 22 bp, Homo sapiens
aacatttgatatttttccattt

SEQ ID NO: 1645314 - DNA, 14 bp, Homo sapiens
aacatttgctgttt

SEQ ID NO: 1645315 - DNA, 15 bp, Homo sapiens
aacatttgctgtttt

SEQ ID NO: 1645316 - DNA, 11 bp, Homo sapiens
aacatttgttc

SEQ ID NO: 1645317 - DNA, 13 bp, Homo sapiens
aacatttgttcct

SEQ ID NO: 1645318 - DNA, 16 bp, Homo sapiens
aacattttgaaggaaa

SEQ ID NO: 1645319 - DNA, 17 bp, Homo sapiens
aacattttgaaggaaaa

SEQ ID NO: 1645320 - DNA, 16 bp, Homo sapiens
aacattttgtcatata

SEQ ID NO: 1645321 - DNA, 23 bp, Homo sapiens
aacattttttcttctgaagattc

SEQ ID NO: 1645322 - DNA, 18 bp, Homo sapiens
aaccaaaaatagaaatta

SEQ ID NO: 1645323 - DNA, 13 bp, Homo sapiens
aaccaaaacttcc

SEQ ID NO: 1645324 - DNA, 17 bp, Homo sapiens
aaccaaaacttccaagg

SEQ ID NO: 1645325 - DNA, 18 bp, Homo sapiens
aaccaaagcctcttcaaa

SEQ ID NO: 1645326 - DNA, 23 bp, Homo sapiens
aaccaaatacctcaatttttgtt

SEQ ID NO: 1645327 - DNA, 16 bp, Homo sapiens
aaccaagccgtggctt

SEQ ID NO: 1645328 - DNA, 18 bp, Homo sapiens
aaccaagctgagtttcct

SEQ ID NO: 1645329 - DNA, 20 bp, Homo sapiens
aaccaagctgagtttcctat

SEQ ID NO: 1645330 - DNA, 16 bp, Homo sapiens
aaccaagcttcagagc

SEQ ID NO: 1645331 - DNA, 21 bp, Homo sapiens
aaccaagcttcagagcctagc

SEQ ID NO: 1645332 - DNA, 22 bp, Homo sapiens
aaccaagcttcagagcctagcc

SEQ ID NO: 1645333 - DNA, 15 bp, Homo sapiens
aaccaaggcagcctc

SEQ ID NO: 1645334 - DNA, 22 bp, Homo sapiens
aaccaaggcagcctccagagcc

SEQ ID NO: 1645335 - DNA, 16 bp, Homo sapiens
aaccaagtcatgtgca

SEQ ID NO: 1645336 - DNA, 10 bp, Homo sapiens
aaccaagttc

SEQ ID NO: 1645337 - DNA, 19 bp, Homo sapiens
aaccaatgaagaagacaaa

SEQ ID NO: 1645338 - DNA, 24 bp, Homo sapiens
aaccaatgcctttttagatgtatt

SEQ ID NO: 1645339 - DNA, 20 bp, Homo sapiens
aaccaattgaaaagtgttct

SEQ ID NO: 1645340 - DNA, 21 bp, Homo sapiens
aaccacaaacggagcccctga

SEQ ID NO: 1645341 - DNA, 17 bp, Homo sapiens
aaccacaactgacacag

SEQ ID NO: 1645342 - DNA, 13 bp, Homo sapiens
aaccacagcagga

SEQ ID NO: 1645343 - DNA, 21 bp, Homo sapiens
aaccacagctgggcagggtga

SEQ ID NO: 1645344 - DNA, 21 bp, Homo sapiens
aaccacagtcagtggagagat

SEQ ID NO: 1645345 - DNA, 22 bp, Homo sapiens
aaccacatacaacacaaagaga

SEQ ID NO: 1645346 - DNA, 22 bp, Homo sapiens
aaccaccccggccccctgcccg

SEQ ID NO: 1645347 - DNA, 15 bp, Homo sapiens
aaccacgcctcttga

SEQ ID NO: 1645348 - DNA, 12 bp, Homo sapiens
aaccactagaaa

SEQ ID NO: 1645349 - DNA, 19 bp, Homo sapiens
aaccactgaaaaaatatat

SEQ ID NO: 1645350 - DNA, 20 bp, Homo sapiens
aaccactgaaaaaatatatg

SEQ ID NO: 1645351 - DNA, 20 bp, Homo sapiens
aaccactgcttctcttttga

SEQ ID NO: 1645352 - DNA, 13 bp, Homo sapiens
aaccacttaaaaa

SEQ ID NO: 1645353 - DNA, 19 bp, Homo sapiens
aaccacttctccatgctgc

SEQ ID NO: 1645354 - DNA, 19 bp, Homo sapiens
aaccagaaacacccctctg

SEQ ID NO: 1645355 - DNA, 15 bp, Homo sapiens
aaccagacctggaag

SEQ ID NO: 1645356 - DNA, 14 bp, Homo sapiens
aaccagactcttgc

SEQ ID NO: 1645357 - DNA, 16 bp, Homo sapiens
aaccagccaggcagag

SEQ ID NO: 1645358 - DNA, 21 bp, Homo sapiens
aaccagcccgacagtgccatc

SEQ ID NO: 1645359 - DNA, 14 bp, Homo sapiens
aaccagccggggcc

SEQ ID NO: 1645360 - DNA, 20 bp, Homo sapiens
aaccagctcgtgggctggga

SEQ ID NO: 1645361 - DNA, 21 bp, Homo sapiens
aaccaggagctgatggcagct

SEQ ID NO: 1645362 - DNA, 14 bp, Homo sapiens
aaccaggccttcat

SEQ ID NO: 1645363 - DNA, 18 bp, Homo sapiens
aaccaggccttcatcctc

SEQ ID NO: 1645364 - DNA, 19 bp, Homo sapiens
aaccagggaagctgtccct

SEQ ID NO: 1645365 - DNA, 21 bp, Homo sapiens
aaccagggagcccctttgatg

SEQ ID NO: 1645366 - DNA, 13 bp, Homo sapiens
aaccagtgtacag

SEQ ID NO: 1645367 - DNA, 14 bp, Homo sapiens
aaccagttatgtga

SEQ ID NO: 1645368 - DNA, 16 bp, Homo sapiens
aaccatagaactgtcc

SEQ ID NO: 1645369 - DNA, 16 bp, Homo sapiens
aaccatagttactgta

SEQ ID NO: 1645370 - DNA, 18 bp, Homo sapiens
aaccatcagatatttctt

SEQ ID NO: 1645371 - DNA, 16 bp, Homo sapiens
aaccatcattataaac

SEQ ID NO: 1645372 - DNA, 15 bp, Homo sapiens
aaccatcctgtttga

SEQ ID NO: 1645373 - DNA, 16 bp, Homo sapiens
aaccatcctgtttgaa

SEQ ID NO: 1645374 - DNA, 19 bp, Homo sapiens
aaccatctgaagaaacttc

SEQ ID NO: 1645375 - DNA, 14 bp, Homo sapiens
aaccatgaactcag

SEQ ID NO: 1645376 - DNA, 19 bp, Homo sapiens
aaccatgcaaatgctatga

SEQ ID NO: 1645377 - DNA, 16 bp, Homo sapiens
aaccatggtgcttgtt

SEQ ID NO: 1645378 - DNA, 14 bp, Homo sapiens
aaccattacctgta

SEQ ID NO: 1645379 - DNA, 17 bp, Homo sapiens
aaccattccatttccaa

SEQ ID NO: 1645380 - DNA, 22 bp, Homo sapiens
aactcaaatggggccagatcca

SEQ ID NO: 1645381 - DNA, 12 bp, Homo sapiens
aactcaaccaga

SEQ ID NO: 1645382 - DNA, 22 bp, Homo sapiens
aactcaaggataccttcttatt

SEQ ID NO: 1645383 - DNA, 14 bp, Homo sapiens
aactcaatctccag

SEQ ID NO: 1645384 - DNA, 20 bp, Homo sapiens
aactcaccagccccactgcc

SEQ ID NO: 1645385 - DNA, 23 bp, Homo sapiens
aactcactgcctaggaggctggc

SEQ ID NO: 1645386 - DNA, 14 bp, Homo sapiens
aactcactgctcaa

SEQ ID NO: 1645387 - DNA, 22 bp, Homo sapiens
aactcactgctcaagaagacat

SEQ ID NO: 1645388 - DNA, 16 bp, Homo sapiens
aactcagaatataaca

SEQ ID NO: 1645389 - DNA, 18 bp, Homo sapiens
aactcagaattattttta

SEQ ID NO: 1645390 - DNA, 21 bp, Homo sapiens
aactcagaattatttttaaaa

SEQ ID NO: 1645391 - DNA, 13 bp, Homo sapiens
aactcagatccag

SEQ ID NO: 1645392 - DNA, 14 bp, Homo sapiens
aactcagatccagg

SEQ ID NO: 1645393 - DNA, 15 bp, Homo sapiens
aactcagatccaggg

SEQ ID NO: 1645394 - DNA, 21 bp, Homo sapiens
aactcagtagagatctatatt

SEQ ID NO: 1645395 - DNA, 16 bp, Homo sapiens
aactcagttcaaacca

SEQ ID NO: 1645396 - DNA, 17 bp, Homo sapiens
aactcagttccaaagtc

SEQ ID NO: 1645397 - DNA, 15 bp, Homo sapiens
aactcatcataaaat

SEQ ID NO: 1645398 - DNA, 18 bp, Homo sapiens
aactcatcataaaataaa

SEQ ID NO: 1645399 - DNA, 17 bp, Homo sapiens
aactcatcctcttttaa

SEQ ID NO: 1645400 - DNA, 15 bp, Homo sapiens
aactcattcctgcct

SEQ ID NO: 1645401 - DNA, 21 bp, Homo sapiens
aactcattcctgcctgtctcc

SEQ ID NO: 1645402 - DNA, 22 bp, Homo sapiens
aactcatttcctatgtaactgc

SEQ ID NO: 1645403 - DNA, 21 bp, Homo sapiens
aactcatttttgttttcatta

SEQ ID NO: 1645404 - DNA, 24 bp, Homo sapiens
aactcatttttgttttcattatct

SEQ ID NO: 1645405 - DNA, 14 bp, Homo sapiens
aactccacatctgc

SEQ ID NO: 1645406 - DNA, 17 bp, Homo sapiens
aactccacatctgcctt

SEQ ID NO: 1645407 - DNA, 16 bp, Homo sapiens
aactccactctccttc

SEQ ID NO: 1645408 - DNA, 13 bp, Homo sapiens
aactccagcaact

SEQ ID NO: 1645409 - DNA, 12 bp, Homo sapiens
aactccatgatg

SEQ ID NO: 1645410 - DNA, 20 bp, Homo sapiens
aactccatggggttcgagac

SEQ ID NO: 1645411 - DNA, 13 bp, Homo sapiens
aactccgagagca

SEQ ID NO: 1645412 - DNA, 13 bp, Homo sapiens
aactcctaatttt

SEQ ID NO: 1645413 - DNA, 17 bp, Homo sapiens
aactcctaattttaaat

SEQ ID NO: 1645414 - DNA, 19 bp, Homo sapiens
aactcctgattttgtagtt

SEQ ID NO: 1645415 - DNA, 13 bp, Homo sapiens
aactcctggcctt

SEQ ID NO: 1645416 - DNA, 19 bp, Homo sapiens
aactccttattttgtatta

SEQ ID NO: 1645417 - DNA, 17 bp, Homo sapiens
aactccttcctggcctg

SEQ ID NO: 1645418 - DNA, 19 bp, Homo sapiens
aactcctttctgcagacgt

SEQ ID NO: 1645419 - DNA, 19 bp, Homo sapiens
aactctaaaagatcctttt

SEQ ID NO: 1645420 - DNA, 22 bp, Homo sapiens
aactctaattcccattttgcaa

SEQ ID NO: 1645421 - DNA, 21 bp, Homo sapiens
aactctcccaaagggcacacc

SEQ ID NO: 1645422 - DNA, 11 bp, Homo sapiens
aactctcccca

SEQ ID NO: 1645423 - DNA, 20 bp, Homo sapiens
aactctccccagtgcctgcc

SEQ ID NO: 1645424 - DNA, 23 bp, Homo sapiens
aactctccccagtgcctgccact

SEQ ID NO: 1645425 - DNA, 15 bp, Homo sapiens
aactctcccctttct

SEQ ID NO: 1645426 - DNA, 20 bp, Homo sapiens
aactctctggaagcccctgg

SEQ ID NO: 1645427 - DNA, 16 bp, Homo sapiens
aactctgaatttatct

SEQ ID NO: 1645428 - DNA, 21 bp, Homo sapiens
aactctgaatttatctttgat

SEQ ID NO: 1645429 - DNA, 22 bp, Homo sapiens
aactctgaatttatctttgata

SEQ ID NO: 1645430 - DNA, 16 bp, Homo sapiens
aactctgcattctagt

SEQ ID NO: 1645431 - DNA, 16 bp, Homo sapiens
aactctggacactcta

SEQ ID NO: 1645432 - DNA, 21 bp, Homo sapiens
aactctggacactctatatgt

SEQ ID NO: 1645433 - DNA, 16 bp, Homo sapiens
aactctgtgcaggtgc

SEQ ID NO: 1645434 - DNA, 19 bp, Homo sapiens
aactctgttgcaagtgcaa

SEQ ID NO: 1645435 - DNA, 22 bp, Homo sapiens
aactctgttgcaagtgcaataa

SEQ ID NO: 1645436 - DNA, 12 bp, Homo sapiens
aactcttcagaa

SEQ ID NO: 1645437 - DNA, 13 bp, Homo sapiens
aactctttcggta

SEQ ID NO: 1645438 - DNA, 23 bp, Homo sapiens
aactcttttatctcctgaaaaaa

SEQ ID NO: 1645439 - DNA, 20 bp, Homo sapiens
aactgaaaagactcagtgtt

SEQ ID NO: 1645440 - DNA, 14 bp, Homo sapiens
aactgaaattcaga

SEQ ID NO: 1645441 - DNA, 21 bp, Homo sapiens
aactgaagcagcctctcccca

SEQ ID NO: 1645442 - DNA, 11 bp, Homo sapiens
aactgaagcat

SEQ ID NO: 1645443 - DNA, 19 bp, Homo sapiens
aactgaagcataaagaatt

SEQ ID NO: 1645444 - DNA, 10 bp, Homo sapiens
aactgaaggg

SEQ ID NO: 1645445 - DNA, 23 bp, Homo sapiens
aactgaaggggtgcacccacctg

SEQ ID NO: 1645446 - DNA, 22 bp, Homo sapiens
aactgaatgaatccattggaga

SEQ ID NO: 1645447 - DNA, 13 bp, Homo sapiens
aactgaatttgga

SEQ ID NO: 1645448 - DNA, 16 bp, Homo sapiens
aactgacaagccatct

SEQ ID NO: 1645449 - DNA, 13 bp, Homo sapiens
aactgacacagga

SEQ ID NO: 1645450 - DNA, 19 bp, Homo sapiens
aactgactttttcccccca

SEQ ID NO: 1645451 - DNA, 13 bp, Homo sapiens
aactgagagaaag

SEQ ID NO: 1645452 - DNA, 14 bp, Homo sapiens
aactgagagaaaga

SEQ ID NO: 1645453 - DNA, 20 bp, Homo sapiens
aactgagatgtgaacacatc

SEQ ID NO: 1645454 - DNA, 10 bp, Homo sapiens
aactgagcct

SEQ ID NO: 1645455 - DNA, 16 bp, Homo sapiens
aactgagcctagctac

SEQ ID NO: 1645456 - DNA, 17 bp, Homo sapiens
aactgagcctagctacc

SEQ ID NO: 1645457 - DNA, 12 bp, Homo sapiens
aactgaggaatt

SEQ ID NO: 1645458 - DNA, 22 bp, Homo sapiens
aactgaggagatgaccagggat

SEQ ID NO: 1645459 - DNA, 20 bp, Homo sapiens
aactgaggcagacagcagct

SEQ ID NO: 1645460 - DNA, 22 bp, Homo sapiens
aactgaggccttgtgtgtcagg

SEQ ID NO: 1645461 - DNA, 18 bp, Homo sapiens
aactgatcaaaaataaac

SEQ ID NO: 1645462 - DNA, 21 bp, Homo sapiens
aactgatcaaaaataaactag

SEQ ID NO: 1645463 - DNA, 22 bp, Homo sapiens
aactgatcaaaaataaactagt

SEQ ID NO: 1645464 - DNA, 17 bp, Homo sapiens
aactgatccagcaatta

SEQ ID NO: 1645465 - DNA, 19 bp, Homo sapiens
aactgatcctgctccagca

SEQ ID NO: 1645466 - DNA, 17 bp, Homo sapiens
aactgatggaccgggtg

SEQ ID NO: 1645467 - DNA, 13 bp, Homo sapiens
aactgatgtactg

SEQ ID NO: 1645468 - DNA, 14 bp, Homo sapiens
aactgatgtttgaa

SEQ ID NO: 1645469 - DNA, 13 bp, Homo sapiens
aactgattcataa

SEQ ID NO: 1645470 - DNA, 18 bp, Homo sapiens
aactgcaatagagactgt

SEQ ID NO: 1645471 - DNA, 16 bp, Homo sapiens
aactgcatatagataa

SEQ ID NO: 1645472 - DNA, 14 bp, Homo sapiens
aactgcattgagaa

SEQ ID NO: 1645473 - DNA, 10 bp, Homo sapiens
aactgcattt

SEQ ID NO: 1645474 - DNA, 24 bp, Homo sapiens
aactgccaggctgcctcctgccct

SEQ ID NO: 1645475 - DNA, 22 bp, Homo sapiens
aactgccctaagcccccagggc

SEQ ID NO: 1645476 - DNA, 10 bp, Homo sapiens
aactgccctt

SEQ ID NO: 1645477 - DNA, 13 bp, Homo sapiens
aactgcccttcca

SEQ ID NO: 1645478 - DNA, 14 bp, Homo sapiens
aactgcccttccag

SEQ ID NO: 1645479 - DNA, 16 bp, Homo sapiens
aactgccgtaatttaa

SEQ ID NO: 1645480 - DNA, 16 bp, Homo sapiens
aactgcctactccaaa

SEQ ID NO: 1645481 - DNA, 20 bp, Homo sapiens
aactgcctattcacgccgta

SEQ ID NO: 1645482 - DNA, 18 bp, Homo sapiens
aactgcctggggggcagg

SEQ ID NO: 1645483 - DNA, 13 bp, Homo sapiens
aactgctcctcct

SEQ ID NO: 1645484 - DNA, 10 bp, Homo sapiens
aactgctgag

SEQ ID NO: 1645485 - DNA, 13 bp, Homo sapiens
aactgctgagcca

SEQ ID NO: 1645486 - DNA, 13 bp, Homo sapiens
aactgctgcagat

SEQ ID NO: 1645487 - DNA, 17 bp, Homo sapiens
aactgctgcatactttg

SEQ ID NO: 1645488 - DNA, 14 bp, Homo sapiens
aactgctggtgatt

SEQ ID NO: 1645489 - DNA, 19 bp, Homo sapiens
aactgctgttttatgtcat

SEQ ID NO: 1645490 - DNA, 21 bp, Homo sapiens
aactgctgttttatgtcatac

SEQ ID NO: 1645491 - DNA, 17 bp, Homo sapiens
aactgcttcttggagct

SEQ ID NO: 1645492 - DNA, 20 bp, Homo sapiens
aactgcttttcctcaagcaa

SEQ ID NO: 1645493 - DNA, 20 bp, Homo sapiens
aactgcttttttttttccag

SEQ ID NO: 1645494 - DNA, 20 bp, Homo sapiens
aactggaaaacagaacactt

SEQ ID NO: 1645495 - DNA, 18 bp, Homo sapiens
aagaactgcaggccctgg

SEQ ID NO: 1645496 - DNA, 22 bp, Homo sapiens
aagaactgcaggccctggcctc

SEQ ID NO: 1645497 - DNA, 11 bp, Homo sapiens
aagaactgcat

SEQ ID NO: 1645498 - DNA, 13 bp, Homo sapiens
aagaactgcatgg

SEQ ID NO: 1645499 - DNA, 23 bp, Homo sapiens
aagaactgcatggacctaacatt

SEQ ID NO: 1645500 - DNA, 14 bp, Homo sapiens
aagaactgtacatt

SEQ ID NO: 1645501 - DNA, 12 bp, Homo sapiens
aagaactgtgtc

SEQ ID NO: 1645502 - DNA, 20 bp, Homo sapiens
aagaacttactgattatttt

SEQ ID NO: 1645503 - DNA, 15 bp, Homo sapiens
aagaacttgcatgga

SEQ ID NO: 1645504 - DNA, 14 bp, Homo sapiens
aagaagaaaaagaa

SEQ ID NO: 1645505 - DNA, 14 bp, Homo sapiens
aagaagaaaaaggt

SEQ ID NO: 1645506 - DNA, 16 bp, Homo sapiens
aagaagaaacgtctat

SEQ ID NO: 1645507 - DNA, 15 bp, Homo sapiens
aagaagaacttgcat

SEQ ID NO: 1645508 - DNA, 14 bp, Homo sapiens
aagaagaattggcc

SEQ ID NO: 1645509 - DNA, 16 bp, Homo sapiens
aagaagacatgaacca

SEQ ID NO: 1645510 - DNA, 11 bp, Homo sapiens
aagaagacatt

SEQ ID NO: 1645511 - DNA, 14 bp, Homo sapiens
aagaagacattttg

SEQ ID NO: 1645512 - DNA, 16 bp, Homo sapiens
aagaagacattttgtt

SEQ ID NO: 1645513 - DNA, 14 bp, Homo sapiens
aagaagagaagctg

SEQ ID NO: 1645514 - DNA, 16 bp, Homo sapiens
aagaagagaagctgct

SEQ ID NO: 1645515 - DNA, 17 bp, Homo sapiens
aagaagagaagctgctg

SEQ ID NO: 1645516 - DNA, 13 bp, Homo sapiens
aagaagattctaa

SEQ ID NO: 1645517 - DNA, 17 bp, Homo sapiens
aagaagcaataactatt

SEQ ID NO: 1645518 - DNA, 17 bp, Homo sapiens
aagaagcaatctttgaa

SEQ ID NO: 1645519 - DNA, 20 bp, Homo sapiens
aagaagcaatctttgaaata

SEQ ID NO: 1645520 - DNA, 12 bp, Homo sapiens
aagaagccacag

SEQ ID NO: 1645521 - DNA, 14 bp, Homo sapiens
aagaagctgtgaat

SEQ ID NO: 1645522 - DNA, 18 bp, Homo sapiens
aagaagcttccacaaaat

SEQ ID NO: 1645523 - DNA, 22 bp, Homo sapiens
aagaaggaatataccttttttg

SEQ ID NO: 1645524 - DNA, 23 bp, Homo sapiens
aagaaggaatataccttttttgt

SEQ ID NO: 1645525 - DNA, 21 bp, Homo sapiens
aagaaggagagcaagaaggaa

SEQ ID NO: 1645526 - DNA, 15 bp, Homo sapiens
aagaaggcaatatta

SEQ ID NO: 1645527 - DNA, 13 bp, Homo sapiens
aagaaggcaattt

SEQ ID NO: 1645528 - DNA, 20 bp, Homo sapiens
aagaaggcaattttagtgta

SEQ ID NO: 1645529 - DNA, 15 bp, Homo sapiens
aagaagggatcccta

SEQ ID NO: 1645530 - DNA, 17 bp, Homo sapiens
aagaagggggccctgct

SEQ ID NO: 1645531 - DNA, 14 bp, Homo sapiens
aagaagtggagaca

SEQ ID NO: 1645532 - DNA, 15 bp, Homo sapiens
aagaagtggagacag

SEQ ID NO: 1645533 - DNA, 16 bp, Homo sapiens
aagaagtggagacagt

SEQ ID NO: 1645534 - DNA, 17 bp, Homo sapiens
aagaagttcatgtccaa

SEQ ID NO: 1645535 - DNA, 14 bp, Homo sapiens
aagaagttctttga

SEQ ID NO: 1645536 - DNA, 13 bp, Homo sapiens
aagaagttttaaa

SEQ ID NO: 1645537 - DNA, 20 bp, Homo sapiens
aagaagtttttctttgtgtt

SEQ ID NO: 1645538 - DNA, 21 bp, Homo sapiens
aagaataattcaattttaaag

SEQ ID NO: 1645539 - DNA, 13 bp, Homo sapiens
aagaatacatcag

SEQ ID NO: 1645540 - DNA, 18 bp, Homo sapiens
aagaatacatcagaaaat

SEQ ID NO: 1645541 - DNA, 23 bp, Homo sapiens
aagaatacatcagaaaataaaat

SEQ ID NO: 1645542 - DNA, 18 bp, Homo sapiens
aagaatatcctttaaaat

SEQ ID NO: 1645543 - DNA, 14 bp, Homo sapiens
aagaatatgacttt

SEQ ID NO: 1645544 - DNA, 18 bp, Homo sapiens
aagaatatttttagacta

SEQ ID NO: 1645545 - DNA, 18 bp, Homo sapiens
aagaatcacagtactttc

SEQ ID NO: 1645546 - DNA, 15 bp, Homo sapiens
aagaatccacaagga

SEQ ID NO: 1645547 - DNA, 13 bp, Homo sapiens
aagaatctagaag

SEQ ID NO: 1645548 - DNA, 21 bp, Homo sapiens
aagaatctagaagatgtgtaa

SEQ ID NO: 1645549 - DNA, 17 bp, Homo sapiens
aagaatctatctgctta

SEQ ID NO: 1645550 - DNA, 13 bp, Homo sapiens
aagaatgaaaaat

SEQ ID NO: 1645551 - DNA, 21 bp, Homo sapiens
aagaatgaaggtttttgtaaa

SEQ ID NO: 1645552 - DNA, 22 bp, Homo sapiens
aagaatgaaggtttttgtaaag

SEQ ID NO: 1645553 - DNA, 14 bp, Homo sapiens
aagaatgagtttct

SEQ ID NO: 1645554 - DNA, 20 bp, Homo sapiens
aagaatgcacaagaatggat

SEQ ID NO: 1645555 - DNA, 21 bp, Homo sapiens
aagaatgcacaagaatggatc

SEQ ID NO: 1645556 - DNA, 22 bp, Homo sapiens
aagaatgcacaagaatggatca

SEQ ID NO: 1645557 - DNA, 21 bp, Homo sapiens
aagaatgcagattcctgggcc

SEQ ID NO: 1645558 - DNA, 22 bp, Homo sapiens
aagaatgcagattcctgggcct

SEQ ID NO: 1645559 - DNA, 19 bp, Homo sapiens
aagaatggaagcctgaact

SEQ ID NO: 1645560 - DNA, 18 bp, Homo sapiens
aagaatgtcgattaaaat

SEQ ID NO: 1645561 - DNA, 20 bp, Homo sapiens
aagaattctgattgatttga

SEQ ID NO: 1645562 - DNA, 20 bp, Homo sapiens
aagaattgaaaagtttttgt

SEQ ID NO: 1645563 - DNA, 16 bp, Homo sapiens
aagaattgaacccagg

SEQ ID NO: 1645564 - DNA, 18 bp, Homo sapiens
aagaattgaacccaggag

SEQ ID NO: 1645565 - DNA, 17 bp, Homo sapiens
aagaattgagtaatggt

SEQ ID NO: 1645566 - DNA, 15 bp, Homo sapiens
aagaattggaagtta

SEQ ID NO: 1645567 - DNA, 22 bp, Homo sapiens
aagaattgttagcaaatgacag

SEQ ID NO: 1645568 - DNA, 14 bp, Homo sapiens
aagaatttcataga

SEQ ID NO: 1645569 - DNA, 20 bp, Homo sapiens
aagaattttatttttctgtg

SEQ ID NO: 1645570 - DNA, 22 bp, Homo sapiens
aagaattttcagaccccagcgg

SEQ ID NO: 1645571 - DNA, 15 bp, Homo sapiens
aagaatttttttgtc

SEQ ID NO: 1645572 - DNA, 13 bp, Homo sapiens
aagacaaaaatca

SEQ ID NO: 1645573 - DNA, 22 bp, Homo sapiens
aagacaaaaatcaaagaacaga

SEQ ID NO: 1645574 - DNA, 15 bp, Homo sapiens
aagacaaacactgcc

SEQ ID NO: 1645575 - DNA, 19 bp, Homo sapiens
aagacaaacactgccatat

SEQ ID NO: 1645576 - DNA, 17 bp, Homo sapiens
aagacaaaggttttcct

SEQ ID NO: 1645577 - DNA, 21 bp, Homo sapiens
aagacaaagtcccagaattgt

SEQ ID NO: 1645578 - DNA, 17 bp, Homo sapiens
aagacaaataaatgatt

SEQ ID NO: 1645579 - DNA, 13 bp, Homo sapiens
aagacaaatggga

SEQ ID NO: 1645580 - DNA, 14 bp, Homo sapiens
aagacaaatgggac

SEQ ID NO: 1645581 - DNA, 15 bp, Homo sapiens
aagacaacagaaaga

SEQ ID NO: 1645582 - DNA, 12 bp, Homo sapiens
aagacaacatta

SEQ ID NO: 1645583 - DNA, 21 bp, Homo sapiens
aagacaacattaaaacaatat

SEQ ID NO: 1645584 - DNA, 22 bp, Homo sapiens
aagacaagaactcccctttttt

SEQ ID NO: 1645585 - DNA, 16 bp, Homo sapiens
aagacaagtatgaata

SEQ ID NO: 1645586 - DNA, 23 bp, Homo sapiens
aagacaataattctacatgttgt

SEQ ID NO: 1645587 - DNA, 16 bp, Homo sapiens
aagacaatttgataca

SEQ ID NO: 1645588 - DNA, 17 bp, Homo sapiens
aagacaatttgatacat

SEQ ID NO: 1645589 - DNA, 22 bp, Homo sapiens
aagacacaaggtgatttcagac

SEQ ID NO: 1645590 - DNA, 11 bp, Homo sapiens
aagacactgcc

SEQ ID NO: 1645591 - DNA, 15 bp, Homo sapiens
aagacactgcctggg

SEQ ID NO: 1645592 - DNA, 11 bp, Homo sapiens
aagacagaaaa

SEQ ID NO: 1645593 - DNA, 14 bp, Homo sapiens
aagacagaaaagtg

SEQ ID NO: 1645594 - DNA, 15 bp, Homo sapiens
aagacagaatggtgg

SEQ ID NO: 1645595 - DNA, 22 bp, Homo sapiens
aagacaggttacgaagacaaag

SEQ ID NO: 1645596 - DNA, 15 bp, Homo sapiens
aagacagtgtacaaa

SEQ ID NO: 1645597 - DNA, 13 bp, Homo sapiens
aagacatcaatga

SEQ ID NO: 1645598 - DNA, 14 bp, Homo sapiens
aagacatcaatgaa

SEQ ID NO: 1645599 - DNA, 15 bp, Homo sapiens
aagacatcaatgaaa

SEQ ID NO: 1645600 - DNA, 16 bp, Homo sapiens
aagacatcaatgaaac

SEQ ID NO: 1645601 - DNA, 19 bp, Homo sapiens
aagacatggagactcctgc

SEQ ID NO: 1645602 - DNA, 12 bp, Homo sapiens
aagacatgtctg

SEQ ID NO: 1645603 - DNA, 13 bp, Homo sapiens
aagacatgtctgt

SEQ ID NO: 1645604 - DNA, 21 bp, Homo sapiens
aagacatgtgaggaggaaaag

SEQ ID NO: 1645605 - DNA, 15 bp, Homo sapiens
aagacattaaatcta

SEQ ID NO: 1645606 - DNA, 18 bp, Homo sapiens
aagacattaaatctatga

SEQ ID NO: 1645607 - DNA, 18 bp, Homo sapiens
aagacattttaagtttgt

SEQ ID NO: 1645608 - DNA, 13 bp, Homo sapiens
aagacatttttat

SEQ ID NO: 1645609 - DNA, 15 bp, Homo sapiens
aagaccaaaggaagg

SEQ ID NO: 1645610 - DNA, 23 bp, Homo sapiens
aagaccaaatgatagaactgtac

SEQ ID NO: 1645611 - DNA, 18 bp, Homo sapiens
aagatggagacaccctct

SEQ ID NO: 1645612 - DNA, 21 bp, Homo sapiens
aagatggagacaccctctggg

SEQ ID NO: 1645613 - DNA, 15 bp, Homo sapiens
aagatggatgtgctt

SEQ ID NO: 1645614 - DNA, 14 bp, Homo sapiens
aagatggctgctgc

SEQ ID NO: 1645615 - DNA, 19 bp, Homo sapiens
aagatgggcatcttttgta

SEQ ID NO: 1645616 - DNA, 23 bp, Homo sapiens
aagatgggggcagggctgtgctt

SEQ ID NO: 1645617 - DNA, 21 bp, Homo sapiens
aagatggtccgtgcccaggcc

SEQ ID NO: 1645618 - DNA, 20 bp, Homo sapiens
aagatggtgtgggtgtcctg

SEQ ID NO: 1645619 - DNA, 14 bp, Homo sapiens
aagatggttgtagc

SEQ ID NO: 1645620 - DNA, 15 bp, Homo sapiens
aagatggtttatgca

SEQ ID NO: 1645621 - DNA, 13 bp, Homo sapiens
aagatgtgaaaat

SEQ ID NO: 1645622 - DNA, 11 bp, Homo sapiens
aagatgtgaat

SEQ ID NO: 1645623 - DNA, 16 bp, Homo sapiens
aagatgtgaattattg

SEQ ID NO: 1645624 - DNA, 20 bp, Homo sapiens
aagatgtgaattattgacac

SEQ ID NO: 1645625 - DNA, 17 bp, Homo sapiens
aagatgtgatattctaa

SEQ ID NO: 1645626 - DNA, 19 bp, Homo sapiens
aagatgtgcaaaatcactg

SEQ ID NO: 1645627 - DNA, 16 bp, Homo sapiens
aagatgtgttcttatt

SEQ ID NO: 1645628 - DNA, 18 bp, Homo sapiens
aagatgttgtcttgcgat

SEQ ID NO: 1645629 - DNA, 16 bp, Homo sapiens
aagatgtttgtcagat

SEQ ID NO: 1645630 - DNA, 19 bp, Homo sapiens
aagatgttttgtataaaat

SEQ ID NO: 1645631 - DNA, 20 bp, Homo sapiens
aagatgttttgtataaaatc

SEQ ID NO: 1645632 - DNA, 21 bp, Homo sapiens
aagatgttttgtataaaatct

SEQ ID NO: 1645633 - DNA, 12 bp, Homo sapiens
aagattaaagga

SEQ ID NO: 1645634 - DNA, 13 bp, Homo sapiens
aagattaaaggaa

SEQ ID NO: 1645635 - DNA, 15 bp, Homo sapiens
aagattaaaggaagg

SEQ ID NO: 1645636 - DNA, 17 bp, Homo sapiens
aagattaaaggaaggaa

SEQ ID NO: 1645637 - DNA, 18 bp, Homo sapiens
aagattaaaggaaggaaa

SEQ ID NO: 1645638 - DNA, 19 bp, Homo sapiens
aagattataattgttgcat

SEQ ID NO: 1645639 - DNA, 21 bp, Homo sapiens
aagattatagattctaaagat

SEQ ID NO: 1645640 - DNA, 22 bp, Homo sapiens
aagattattgtgacttcactgt

SEQ ID NO: 1645641 - DNA, 23 bp, Homo sapiens
aagattattgtgacttcactgta

SEQ ID NO: 1645642 - DNA, 16 bp, Homo sapiens
aagattcaagaggata

SEQ ID NO: 1645643 - DNA, 20 bp, Homo sapiens
aagattcatttttaatcatg

SEQ ID NO: 1645644 - DNA, 15 bp, Homo sapiens
aagattcccagagac

SEQ ID NO: 1645645 - DNA, 18 bp, Homo sapiens
aagattcccagagacagg

SEQ ID NO: 1645646 - DNA, 24 bp, Homo sapiens
aagattccggatcctaagcatcta

SEQ ID NO: 1645647 - DNA, 18 bp, Homo sapiens
aagattctaaaacattct

SEQ ID NO: 1645648 - DNA, 13 bp, Homo sapiens
aagattctaaagc

SEQ ID NO: 1645649 - DNA, 16 bp, Homo sapiens
aagattctaatgatga

SEQ ID NO: 1645650 - DNA, 11 bp, Homo sapiens
aagattctaga

SEQ ID NO: 1645651 - DNA, 12 bp, Homo sapiens
aagattctagat

SEQ ID NO: 1645652 - DNA, 13 bp, Homo sapiens
aagattctagatg

SEQ ID NO: 1645653 - DNA, 15 bp, Homo sapiens
aagattctagatgat

SEQ ID NO: 1645654 - DNA, 17 bp, Homo sapiens
aagattctctgcccagc

SEQ ID NO: 1645655 - DNA, 19 bp, Homo sapiens
aagattgagctctctgccc

SEQ ID NO: 1645656 - DNA, 18 bp, Homo sapiens
aagattgatagaaaatcc

SEQ ID NO: 1645657 - DNA, 16 bp, Homo sapiens
aagattgatatctata

SEQ ID NO: 1645658 - DNA, 20 bp, Homo sapiens
aagattgatatctataaaat

SEQ ID NO: 1645659 - DNA, 12 bp, Homo sapiens
aagattgctgaa

SEQ ID NO: 1645660 - DNA, 19 bp, Homo sapiens
aagattgtacttagccagt

SEQ ID NO: 1645661 - DNA, 17 bp, Homo sapiens
aagattgtgtggtgttt

SEQ ID NO: 1645662 - DNA, 21 bp, Homo sapiens
aagatttagaaaaaagtttac

SEQ ID NO: 1645663 - DNA, 18 bp, Homo sapiens
aagatttatcaaatcagt

SEQ ID NO: 1645664 - DNA, 17 bp, Homo sapiens
aagatttccaagtgcca

SEQ ID NO: 1645665 - DNA, 17 bp, Homo sapiens
aagatttccttgtgcaa

SEQ ID NO: 1645666 - DNA, 17 bp, Homo sapiens
aagatttggaataaagt

SEQ ID NO: 1645667 - DNA, 18 bp, Homo sapiens
aagatttgtgaactggaa

SEQ ID NO: 1645668 - DNA, 17 bp, Homo sapiens
aagatttgtttttgtag

SEQ ID NO: 1645669 - DNA, 16 bp, Homo sapiens
aagattttaaagacat

SEQ ID NO: 1645670 - DNA, 23 bp, Homo sapiens
aagattttattcttatttcattt

SEQ ID NO: 1645671 - DNA, 13 bp, Homo sapiens
aagattttgatct

SEQ ID NO: 1645672 - DNA, 20 bp, Homo sapiens
aagattttgatctcacattt

SEQ ID NO: 1645673 - DNA, 20 bp, Homo sapiens
aagattttgttttgttggac

SEQ ID NO: 1645674 - DNA, 19 bp, Homo sapiens
aagatttttactaatatat

SEQ ID NO: 1645675 - DNA, 18 bp, Homo sapiens
aagatttttaggagtgat

SEQ ID NO: 1645676 - DNA, 20 bp, Homo sapiens
aagcaaaacatctctgcagt

SEQ ID NO: 1645677 - DNA, 11 bp, Homo sapiens
aagcaaaagaa

SEQ ID NO: 1645678 - DNA, 13 bp, Homo sapiens
aagcaaaagagaa

SEQ ID NO: 1645679 - DNA, 16 bp, Homo sapiens
aagcaaaagcaaggga

SEQ ID NO: 1645680 - DNA, 19 bp, Homo sapiens
aagcaaacaagcttgattt

SEQ ID NO: 1645681 - DNA, 16 bp, Homo sapiens
aagcaaacgtctattt

SEQ ID NO: 1645682 - DNA, 13 bp, Homo sapiens
aagcaaagaaaat

SEQ ID NO: 1645683 - DNA, 14 bp, Homo sapiens
aagcaaaggctccc

SEQ ID NO: 1645684 - DNA, 16 bp, Homo sapiens
aagcaaaggctccctc

SEQ ID NO: 1645685 - DNA, 21 bp, Homo sapiens
aagcaaaggggacagctgtgt

SEQ ID NO: 1645686 - DNA, 17 bp, Homo sapiens
aagcaaaggtgaagaga

SEQ ID NO: 1645687 - DNA, 14 bp, Homo sapiens
aagcaaatcatttg

SEQ ID NO: 1645688 - DNA, 18 bp, Homo sapiens
aagcaaatgtgacctgtg

SEQ ID NO: 1645689 - DNA, 19 bp, Homo sapiens
aagcaaatgttaaaagttt

SEQ ID NO: 1645690 - DNA, 19 bp, Homo sapiens
aagcaactaggccttcagt

SEQ ID NO: 1645691 - DNA, 13 bp, Homo sapiens
aagcaagaaacag

SEQ ID NO: 1645692 - DNA, 14 bp, Homo sapiens
aagcaagaaacagt

SEQ ID NO: 1645693 - DNA, 17 bp, Homo sapiens
aagcaagagagatgttt

SEQ ID NO: 1645694 - DNA, 18 bp, Homo sapiens
aagcaagatgttttgtat

SEQ ID NO: 1645695 - DNA, 21 bp, Homo sapiens
aagcaagatgttttgtataaa

SEQ ID NO: 1645696 - DNA, 23 bp, Homo sapiens
aagcaagatgttttgtataaaat

SEQ ID NO: 1645697 - DNA, 17 bp, Homo sapiens
aagcaagggagaaaaga

SEQ ID NO: 1645698 - DNA, 16 bp, Homo sapiens
aagcaagggctccagc

SEQ ID NO: 1645699 - DNA, 15 bp, Homo sapiens
aagcaagggggtgat

SEQ ID NO: 1645700 - DNA, 18 bp, Homo sapiens
aagcaaggtgtccctgcc

SEQ ID NO: 1645701 - DNA, 20 bp, Homo sapiens
aagcaaggtgtccctgcctt

SEQ ID NO: 1645702 - DNA, 13 bp, Homo sapiens
aagcaagtagctt

SEQ ID NO: 1645703 - DNA, 16 bp, Homo sapiens
aagcaagtagctttcc

SEQ ID NO: 1645704 - DNA, 16 bp, Homo sapiens
aagcaataaatgaatg

SEQ ID NO: 1645705 - DNA, 13 bp, Homo sapiens
aagcaataattgt

SEQ ID NO: 1645706 - DNA, 15 bp, Homo sapiens
aagcaataattgttt

SEQ ID NO: 1645707 - DNA, 17 bp, Homo sapiens
aagcaataattgtttcc

SEQ ID NO: 1645708 - DNA, 14 bp, Homo sapiens
aagcaatactgttt

SEQ ID NO: 1645709 - DNA, 12 bp, Homo sapiens
aagcaatcaaga

SEQ ID NO: 1645710 - DNA, 19 bp, Homo sapiens
aagcaatgatgacccacta

SEQ ID NO: 1645711 - DNA, 23 bp, Homo sapiens
aagcaattagtctgaaactggct

SEQ ID NO: 1645712 - DNA, 20 bp, Homo sapiens
aagcacaacccaccacaaca

SEQ ID NO: 1645713 - DNA, 21 bp, Homo sapiens
aagcacaatgtctcacatggg

SEQ ID NO: 1645714 - DNA, 16 bp, Homo sapiens
aagcacactggaatat

SEQ ID NO: 1645715 - DNA, 22 bp, Homo sapiens
aagcacaggcaagagtgttctt

SEQ ID NO: 1645716 - DNA, 22 bp, Homo sapiens
aagcacatacggcagacctctt

SEQ ID NO: 1645717 - DNA, 19 bp, Homo sapiens
aagcacatgaataatttca

SEQ ID NO: 1645718 - DNA, 12 bp, Homo sapiens
aagcacccttga

SEQ ID NO: 1645719 - DNA, 12 bp, Homo sapiens
aagcacctgccg

SEQ ID NO: 1645720 - DNA, 20 bp, Homo sapiens
aagcacctgccgacctcgtc

SEQ ID NO: 1645721 - DNA, 19 bp, Homo sapiens
aagcaccttagctggcatt

SEQ ID NO: 1645722 - DNA, 15 bp, Homo sapiens
aagcacgaaatgtta

SEQ ID NO: 1645723 - DNA, 19 bp, Homo sapiens
aagcactatgcccttttat

SEQ ID NO: 1645724 - DNA, 19 bp, Homo sapiens
aagcactctggatgatgga

SEQ ID NO: 1645725 - DNA, 21 bp, Homo sapiens
aagcactgacctgtcatgccc

SEQ ID NO: 1645726 - DNA, 13 bp, Homo sapiens
aagctgaatacat

SEQ ID NO: 1645727 - DNA, 16 bp, Homo sapiens
aagctgacttggcact

SEQ ID NO: 1645728 - DNA, 20 bp, Homo sapiens
aagctgagaagaatgaaaat

SEQ ID NO: 1645729 - DNA, 22 bp, Homo sapiens
aagctgatattatttcttctct

SEQ ID NO: 1645730 - DNA, 23 bp, Homo sapiens
aagctgatccagtttccggaaac

SEQ ID NO: 1645731 - DNA, 13 bp, Homo sapiens
aagctgatcctgc

SEQ ID NO: 1645732 - DNA, 21 bp, Homo sapiens
aagctgatgatgtctcttgta

SEQ ID NO: 1645733 - DNA, 12 bp, Homo sapiens
aagctgcactgt

SEQ ID NO: 1645734 - DNA, 17 bp, Homo sapiens
aagctgcactgtgaacc

SEQ ID NO: 1645735 - DNA, 21 bp, Homo sapiens
aagctgccatttcccttctgg

SEQ ID NO: 1645736 - DNA, 20 bp, Homo sapiens
aagctgcccactgtttctct

SEQ ID NO: 1645737 - DNA, 20 bp, Homo sapiens
aagctgccgaaccaaaagaa

SEQ ID NO: 1645738 - DNA, 21 bp, Homo sapiens
aagctgctgaccaattgtgct

SEQ ID NO: 1645739 - DNA, 22 bp, Homo sapiens
aagctgctgaccaattgtgctg

SEQ ID NO: 1645740 - DNA, 21 bp, Homo sapiens
aagctgctttaaaaaaataca

SEQ ID NO: 1645741 - DNA, 23 bp, Homo sapiens
aagctggaagactgtgcagaaga

SEQ ID NO: 1645742 - DNA, 15 bp, Homo sapiens
aagctggaccttttc

SEQ ID NO: 1645743 - DNA, 18 bp, Homo sapiens
aagctggaccttttccct

SEQ ID NO: 1645744 - DNA, 23 bp, Homo sapiens
aagctggaccttttcccttgctg

SEQ ID NO: 1645745 - DNA, 15 bp, Homo sapiens
aagctggactgacca

SEQ ID NO: 1645746 - DNA, 16 bp, Homo sapiens
aagctggagctcttgg

SEQ ID NO: 1645747 - DNA, 18 bp, Homo sapiens
aagctggagctcttggaa

SEQ ID NO: 1645748 - DNA, 21 bp, Homo sapiens
aagctggccgagggtcctggc

SEQ ID NO: 1645749 - DNA, 22 bp, Homo sapiens
aagctggccgagggtcctggct

SEQ ID NO: 1645750 - DNA, 17 bp, Homo sapiens
aagctggctctgtttga

SEQ ID NO: 1645751 - DNA, 22 bp, Homo sapiens
aagctgggaaaaaagttttgat

SEQ ID NO: 1645752 - DNA, 13 bp, Homo sapiens
aagctgggctctt

SEQ ID NO: 1645753 - DNA, 14 bp, Homo sapiens
aagctgtactttta

SEQ ID NO: 1645754 - DNA, 20 bp, Homo sapiens
aagctgtccctgcagggcca

SEQ ID NO: 1645755 - DNA, 21 bp, Homo sapiens
aagctgtccctgcagggccat

SEQ ID NO: 1645756 - DNA, 20 bp, Homo sapiens
aagctgtgtccttgcacctg

SEQ ID NO: 1645757 - DNA, 21 bp, Homo sapiens
aagctgtgtctgcccaatgaa

SEQ ID NO: 1645758 - DNA, 18 bp, Homo sapiens
aagctgttattcttgtta

SEQ ID NO: 1645759 - DNA, 17 bp, Homo sapiens
aagctgtttggaaaaga

SEQ ID NO: 1645760 - DNA, 21 bp, Homo sapiens
aagctgtttggaaaagacagt

SEQ ID NO: 1645761 - DNA, 22 bp, Homo sapiens
aagcttaaattgcttttgttgt

SEQ ID NO: 1645762 - DNA, 10 bp, Homo sapiens
aagcttagaa

SEQ ID NO: 1645763 - DNA, 18 bp, Homo sapiens
aagcttcaaactgcatga

SEQ ID NO: 1645764 - DNA, 18 bp, Homo sapiens
aagcttcaaattaaaaca

SEQ ID NO: 1645765 - DNA, 22 bp, Homo sapiens
aagcttcaaccctcagccttga

SEQ ID NO: 1645766 - DNA, 12 bp, Homo sapiens
aagcttcagact

SEQ ID NO: 1645767 - DNA, 13 bp, Homo sapiens
aagcttcagagcc

SEQ ID NO: 1645768 - DNA, 16 bp, Homo sapiens
aagcttcagttgcttg

SEQ ID NO: 1645769 - DNA, 18 bp, Homo sapiens
aagcttcagttgcttgtc

SEQ ID NO: 1645770 - DNA, 11 bp, Homo sapiens
aagcttccctc

SEQ ID NO: 1645771 - DNA, 14 bp, Homo sapiens
aagcttccctctca

SEQ ID NO: 1645772 - DNA, 12 bp, Homo sapiens
aagcttgactcc

SEQ ID NO: 1645773 - DNA, 13 bp, Homo sapiens
aagcttgaggcca

SEQ ID NO: 1645774 - DNA, 14 bp, Homo sapiens
aagcttgaggccaa

SEQ ID NO: 1645775 - DNA, 19 bp, Homo sapiens
aagcttgaggccaagatgg

SEQ ID NO: 1645776 - DNA, 21 bp, Homo sapiens
aagcttgaggccaagatggct

SEQ ID NO: 1645777 - DNA, 22 bp, Homo sapiens
aagcttgaggccaagatggctg

SEQ ID NO: 1645778 - DNA, 23 bp, Homo sapiens
aagcttgagtctcaagggtggca

SEQ ID NO: 1645779 - DNA, 21 bp, Homo sapiens
aagcttggcagccgagctcgt

SEQ ID NO: 1645780 - DNA, 21 bp, Homo sapiens
aagcttgtggtgttcctgaag

SEQ ID NO: 1645781 - DNA, 14 bp, Homo sapiens
aagctttaaattat

SEQ ID NO: 1645782 - DNA, 17 bp, Homo sapiens
aagctttaaattatgtg

SEQ ID NO: 1645783 - DNA, 14 bp, Homo sapiens
aagctttaggcaga

SEQ ID NO: 1645784 - DNA, 20 bp, Homo sapiens
aagctttattttgagatgta

SEQ ID NO: 1645785 - DNA, 21 bp, Homo sapiens
aagctttcatgtcccagaact

SEQ ID NO: 1645786 - DNA, 16 bp, Homo sapiens
aagctttcctgcccca

SEQ ID NO: 1645787 - DNA, 22 bp, Homo sapiens
aagctttcctgccccaggcctg

SEQ ID NO: 1645788 - DNA, 20 bp, Homo sapiens
aagctttgaatactgtgaaa

SEQ ID NO: 1645789 - DNA, 20 bp, Homo sapiens
aagctttgactctataagca

SEQ ID NO: 1645790 - DNA, 16 bp, Homo sapiens
aagctttgagttgact

SEQ ID NO: 1645791 - DNA, 23 bp, Homo sapiens
aagctttgctacaaatttatgca

SEQ ID NO: 1645792 - DNA, 21 bp, Homo sapiens
aagctttgggggagtgggcgc

SEQ ID NO: 1645793 - DNA, 16 bp, Homo sapiens
aagctttgtttgttct

SEQ ID NO: 1645794 - DNA, 13 bp, Homo sapiens
aagcttttggaag

SEQ ID NO: 1645795 - DNA, 16 bp, Homo sapiens
aagctttttaaaattt

SEQ ID NO: 1645796 - DNA, 18 bp, Homo sapiens
aagctttttggaatcttt

SEQ ID NO: 1645797 - DNA, 21 bp, Homo sapiens
aaggaaaaaagaaaaaagcaa

SEQ ID NO: 1645798 - DNA, 19 bp, Homo sapiens
aaggaaaaacacaagcaaa

SEQ ID NO: 1645799 - DNA, 13 bp, Homo sapiens
aaggaaaaataac

SEQ ID NO: 1645800 - DNA, 15 bp, Homo sapiens
aaggaaaaataatca

SEQ ID NO: 1645801 - DNA, 18 bp, Homo sapiens
aaggaaaagatcattaaa

SEQ ID NO: 1645802 - DNA, 14 bp, Homo sapiens
aaggaaaatgatac

SEQ ID NO: 1645803 - DNA, 16 bp, Homo sapiens
aaggaaaattaaacca

SEQ ID NO: 1645804 - DNA, 21 bp, Homo sapiens
aaggaaaccacagtgagcctg

SEQ ID NO: 1645805 - DNA, 19 bp, Homo sapiens
aaggaaacttctatgtaaa

SEQ ID NO: 1645806 - DNA, 15 bp, Homo sapiens
aaggaaagatttgtg

SEQ ID NO: 1645807 - DNA, 16 bp, Homo sapiens
aaggaaagcaataaat

SEQ ID NO: 1645808 - DNA, 20 bp, Homo sapiens
aaggaaaggctcatttaaaa

SEQ ID NO: 1645809 - DNA, 14 bp, Homo sapiens
aaggaaataaagcg

SEQ ID NO: 1645810 - DNA, 15 bp, Homo sapiens
aaggaaatattcttt

SEQ ID NO: 1645811 - DNA, 14 bp, Homo sapiens
aaggaaatttgttt

SEQ ID NO: 1645812 - DNA, 15 bp, Homo sapiens
aaggaaatttgtttg

SEQ ID NO: 1645813 - DNA, 18 bp, Homo sapiens
aaggaaatttgtttgtat

SEQ ID NO: 1645814 - DNA, 20 bp, Homo sapiens
aaggaaatttgtttgtattt

SEQ ID NO: 1645815 - DNA, 13 bp, Homo sapiens
aaggaacaaagac

SEQ ID NO: 1645816 - DNA, 14 bp, Homo sapiens
aaggaacactgaca

SEQ ID NO: 1645817 - DNA, 13 bp, Homo sapiens
aaggaacactggc

SEQ ID NO: 1645818 - DNA, 23 bp, Homo sapiens
aaggaaccttccttcctgcttga

SEQ ID NO: 1645819 - DNA, 19 bp, Homo sapiens
aaggaagatcctgaagcag

SEQ ID NO: 1645820 - DNA, 21 bp, Homo sapiens
aaggaagatcctgaagcagtt

SEQ ID NO: 1645821 - DNA, 12 bp, Homo sapiens
aaggaaggaaaa

SEQ ID NO: 1645822 - DNA, 12 bp, Homo sapiens
aaggaaggctct

SEQ ID NO: 1645823 - DNA, 13 bp, Homo sapiens
aaggaaggctctc

SEQ ID NO: 1645824 - DNA, 18 bp, Homo sapiens
aaggaaggtaaaaagtta

SEQ ID NO: 1645825 - DNA, 17 bp, Homo sapiens
aaggaaggtggatggcc

SEQ ID NO: 1645826 - DNA, 14 bp, Homo sapiens
aaggaagtgaagag

SEQ ID NO: 1645827 - DNA, 16 bp, Homo sapiens
aaggaatagccagaga

SEQ ID NO: 1645828 - DNA, 21 bp, Homo sapiens
aaggaatctccagttttcagt

SEQ ID NO: 1645829 - DNA, 15 bp, Homo sapiens
aaggaatctgtgcag

SEQ ID NO: 1645830 - DNA, 17 bp, Homo sapiens
aaggaatttcttaactt

SEQ ID NO: 1645831 - DNA, 23 bp, Homo sapiens
aaggaatttcttaacttcttgct

SEQ ID NO: 1645832 - DNA, 13 bp, Homo sapiens
aaggacaacagtt

SEQ ID NO: 1645833 - DNA, 14 bp, Homo sapiens
aaggacaatttcaa

SEQ ID NO: 1645834 - DNA, 12 bp, Homo sapiens
aaggacacagtg

SEQ ID NO: 1645835 - DNA, 16 bp, Homo sapiens
aaggacacagtgatga

SEQ ID NO: 1645836 - DNA, 14 bp, Homo sapiens
aaggacacttcctg

SEQ ID NO: 1645837 - DNA, 20 bp, Homo sapiens
aaggaccaactggcttctgt

SEQ ID NO: 1645838 - DNA, 21 bp, Homo sapiens
aaggaccaactggcttctgtg

SEQ ID NO: 1645839 - DNA, 20 bp, Homo sapiens
aaggaccacattttatattt

SEQ ID NO: 1645840 - DNA, 16 bp, Homo sapiens
aagtaaattatgatgt

SEQ ID NO: 1645841 - DNA, 19 bp, Homo sapiens
aagtaacacagtattatgc

SEQ ID NO: 1645842 - DNA, 16 bp, Homo sapiens
aagtaactcatttgtt

SEQ ID NO: 1645843 - DNA, 14 bp, Homo sapiens
aagtaactgtgaga

SEQ ID NO: 1645844 - DNA, 15 bp, Homo sapiens
aagtaacttatttga

SEQ ID NO: 1645845 - DNA, 20 bp, Homo sapiens
aagtaagaagacatgaacca

SEQ ID NO: 1645846 - DNA, 18 bp, Homo sapiens
aagtaagtaccactcagg

SEQ ID NO: 1645847 - DNA, 21 bp, Homo sapiens
aagtaagtaccactcaggcca

SEQ ID NO: 1645848 - DNA, 21 bp, Homo sapiens
aagtaatccacctgcctcggc

SEQ ID NO: 1645849 - DNA, 17 bp, Homo sapiens
aagtaatgacttagaaa

SEQ ID NO: 1645850 - DNA, 16 bp, Homo sapiens
aagtaatgatttcttg

SEQ ID NO: 1645851 - DNA, 15 bp, Homo sapiens
aagtaatgtattagt

SEQ ID NO: 1645852 - DNA, 15 bp, Homo sapiens
aagtaattatcggga

SEQ ID NO: 1645853 - DNA, 20 bp, Homo sapiens
aagtaattgcatttctgctc

SEQ ID NO: 1645854 - DNA, 18 bp, Homo sapiens
aagtacaatgaactgctt

SEQ ID NO: 1645855 - DNA, 19 bp, Homo sapiens
aagtacagaatttgaatta

SEQ ID NO: 1645856 - DNA, 20 bp, Homo sapiens
aagtacatattaggaaaata

SEQ ID NO: 1645857 - DNA, 17 bp, Homo sapiens
aagtacattttttgaaa

SEQ ID NO: 1645858 - DNA, 18 bp, Homo sapiens
aagtaccaatgctgttgt

SEQ ID NO: 1645859 - DNA, 15 bp, Homo sapiens
aagtactatgtatca

SEQ ID NO: 1645860 - DNA, 16 bp, Homo sapiens
aagtactgtgtacaga

SEQ ID NO: 1645861 - DNA, 21 bp, Homo sapiens
aagtactgttttgaagctggg

SEQ ID NO: 1645862 - DNA, 17 bp, Homo sapiens
aagtacttatctttatt

SEQ ID NO: 1645863 - DNA, 19 bp, Homo sapiens
aagtagaagtcttagatgt

SEQ ID NO: 1645864 - DNA, 21 bp, Homo sapiens
aagtagaagtcttagatgtat

SEQ ID NO: 1645865 - DNA, 18 bp, Homo sapiens
aagtagcacatggtttaa

SEQ ID NO: 1645866 - DNA, 13 bp, Homo sapiens
aagtagctgctag

SEQ ID NO: 1645867 - DNA, 21 bp, Homo sapiens
aagtaggatgaatcatattca

SEQ ID NO: 1645868 - DNA, 16 bp, Homo sapiens
aagtaggcatatatca

SEQ ID NO: 1645869 - DNA, 23 bp, Homo sapiens
aagtaggccgctgatgatatatt

SEQ ID NO: 1645870 - DNA, 21 bp, Homo sapiens
aagtagggacttctgtcttca

SEQ ID NO: 1645871 - DNA, 18 bp, Homo sapiens
aagtaggggcagtgatgg

SEQ ID NO: 1645872 - DNA, 15 bp, Homo sapiens
aagtaggtggcttga

SEQ ID NO: 1645873 - DNA, 21 bp, Homo sapiens
aagtaggtggcttgagctaga

SEQ ID NO: 1645874 - DNA, 12 bp, Homo sapiens
aagtagtccagc

SEQ ID NO: 1645875 - DNA, 18 bp, Homo sapiens
aagtagtccagccttcca

SEQ ID NO: 1645876 - DNA, 14 bp, Homo sapiens
aagtagtcctgtga

SEQ ID NO: 1645877 - DNA, 19 bp, Homo sapiens
aagtagttgattcagccct

SEQ ID NO: 1645878 - DNA, 19 bp, Homo sapiens
aagtagttggtttgtatga

SEQ ID NO: 1645879 - DNA, 13 bp, Homo sapiens
aagtataatgttt

SEQ ID NO: 1645880 - DNA, 20 bp, Homo sapiens
aagtataatgtttattaaat

SEQ ID NO: 1645881 - DNA, 18 bp, Homo sapiens
aagtatataatggtttca

SEQ ID NO: 1645882 - DNA, 23 bp, Homo sapiens
aagtatataatggtttcaaagat

SEQ ID NO: 1645883 - DNA, 18 bp, Homo sapiens
aagtatatagtatattta

SEQ ID NO: 1645884 - DNA, 16 bp, Homo sapiens
aagtatatgtcattta

SEQ ID NO: 1645885 - DNA, 18 bp, Homo sapiens
aagtatatgtcatttact

SEQ ID NO: 1645886 - DNA, 14 bp, Homo sapiens
aagtatattaaaca

SEQ ID NO: 1645887 - DNA, 23 bp, Homo sapiens
aagtatcttctatttttatcatg

SEQ ID NO: 1645888 - DNA, 19 bp, Homo sapiens
aagtatcttgtgcttcttc

SEQ ID NO: 1645889 - DNA, 18 bp, Homo sapiens
aagtatcttttttcaaaa

SEQ ID NO: 1645890 - DNA, 16 bp, Homo sapiens
aagtatgaatctatgc

SEQ ID NO: 1645891 - DNA, 23 bp, Homo sapiens
aagtatgaatctatgccaaagat

SEQ ID NO: 1645892 - DNA, 18 bp, Homo sapiens
aagtatgcattattaaat

SEQ ID NO: 1645893 - DNA, 20 bp, Homo sapiens
aagtatgcattattaaattg

SEQ ID NO: 1645894 - DNA, 21 bp, Homo sapiens
aagtatgccttaagcagaaca

SEQ ID NO: 1645895 - DNA, 14 bp, Homo sapiens
aagtatgtattatt

SEQ ID NO: 1645896 - DNA, 23 bp, Homo sapiens
aagtattatcattgctcccctga

SEQ ID NO: 1645897 - DNA, 22 bp, Homo sapiens
aagtattatgccccagttcaga

SEQ ID NO: 1645898 - DNA, 17 bp, Homo sapiens
aagtattcaacaatttc

SEQ ID NO: 1645899 - DNA, 11 bp, Homo sapiens
aagtattcaca

SEQ ID NO: 1645900 - DNA, 16 bp, Homo sapiens
aagtattcctgttgct

SEQ ID NO: 1645901 - DNA, 15 bp, Homo sapiens
aagtattctaaattt

SEQ ID NO: 1645902 - DNA, 18 bp, Homo sapiens
aagtattctcttttcaag

SEQ ID NO: 1645903 - DNA, 18 bp, Homo sapiens
aagtattcttatttaatg

SEQ ID NO: 1645904 - DNA, 21 bp, Homo sapiens
aagtattgctgagtccaacaa

SEQ ID NO: 1645905 - DNA, 10 bp, Homo sapiens
aagtatttag

SEQ ID NO: 1645906 - DNA, 11 bp, Homo sapiens
aagtatttagg

SEQ ID NO: 1645907 - DNA, 12 bp, Homo sapiens
aagtatttataa

SEQ ID NO: 1645908 - DNA, 13 bp, Homo sapiens
aagtatttataat

SEQ ID NO: 1645909 - DNA, 12 bp, Homo sapiens
aagtatttatat

SEQ ID NO: 1645910 - DNA, 13 bp, Homo sapiens
aagtatttatata

SEQ ID NO: 1645911 - DNA, 18 bp, Homo sapiens
aagtatttatatatttat

SEQ ID NO: 1645912 - DNA, 14 bp, Homo sapiens
aagtatttcccagc

SEQ ID NO: 1645913 - DNA, 11 bp, Homo sapiens
aagtatttctg

SEQ ID NO: 1645914 - DNA, 11 bp, Homo sapiens
aagtattttgc

SEQ ID NO: 1645915 - DNA, 23 bp, Homo sapiens
aagtatttttgattaacaatgta

SEQ ID NO: 1645916 - DNA, 14 bp, Homo sapiens
aagtatttttgtct

SEQ ID NO: 1645917 - DNA, 19 bp, Homo sapiens
aagtcaaaaggtgcctgtg

SEQ ID NO: 1645918 - DNA, 14 bp, Homo sapiens
aagtcaaagtaaaa

SEQ ID NO: 1645919 - DNA, 16 bp, Homo sapiens
aagtcaacagtaaacc

SEQ ID NO: 1645920 - DNA, 17 bp, Homo sapiens
aagtcaacagtaaacca

SEQ ID NO: 1645921 - DNA, 16 bp, Homo sapiens
aagtcaaccaatgtag

SEQ ID NO: 1645922 - DNA, 17 bp, Homo sapiens
aagtcaagcacatgtaa

SEQ ID NO: 1645923 - DNA, 22 bp, Homo sapiens
aagtcaagcacatgtaataaat

SEQ ID NO: 1645924 - DNA, 17 bp, Homo sapiens
aagtcacagctgcagct

SEQ ID NO: 1645925 - DNA, 13 bp, Homo sapiens
aagtcacagttaa

SEQ ID NO: 1645926 - DNA, 14 bp, Homo sapiens
aagtcacatccctg

SEQ ID NO: 1645927 - DNA, 22 bp, Homo sapiens
aagtcacattccacatctgttt

SEQ ID NO: 1645928 - DNA, 16 bp, Homo sapiens
aagtcaccaaatagtg

SEQ ID NO: 1645929 - DNA, 22 bp, Homo sapiens
aagtcacccaaacacttctgct

SEQ ID NO: 1645930 - DNA, 21 bp, Homo sapiens
aagtcaccttagggtggcttt

SEQ ID NO: 1645931 - DNA, 18 bp, Homo sapiens
aagtcacgttgttttcag

SEQ ID NO: 1645932 - DNA, 21 bp, Homo sapiens
aagtcactagaagtcctgctg

SEQ ID NO: 1645933 - DNA, 16 bp, Homo sapiens
aagtcactcacactgg

SEQ ID NO: 1645934 - DNA, 17 bp, Homo sapiens
aagtcactgaacaaaac

SEQ ID NO: 1645935 - DNA, 15 bp, Homo sapiens
aagtcacttaatctt

SEQ ID NO: 1645936 - DNA, 12 bp, Homo sapiens
aagtcagaagtt

SEQ ID NO: 1645937 - DNA, 17 bp, Homo sapiens
aagtcagactgctggga

SEQ ID NO: 1645938 - DNA, 20 bp, Homo sapiens
aagtcagactgctgggactg

SEQ ID NO: 1645939 - DNA, 21 bp, Homo sapiens
aagtcagccacactgggcctg

SEQ ID NO: 1645940 - DNA, 20 bp, Homo sapiens
aagtcagctccagctttctg

SEQ ID NO: 1645941 - DNA, 20 bp, Homo sapiens
aagtcagctttcagagccag

SEQ ID NO: 1645942 - DNA, 21 bp, Homo sapiens
aagtcaggcccttattttcaa

SEQ ID NO: 1645943 - DNA, 17 bp, Homo sapiens
aagtcagtacgatcaag

SEQ ID NO: 1645944 - DNA, 18 bp, Homo sapiens
aagtcagtatcatattat

SEQ ID NO: 1645945 - DNA, 16 bp, Homo sapiens
aagtcagtatggtcta

SEQ ID NO: 1645946 - DNA, 20 bp, Homo sapiens
aagtcagtgcccaactgtta

SEQ ID NO: 1645947 - DNA, 21 bp, Homo sapiens
aagtcagtgcccaactgttat

SEQ ID NO: 1645948 - DNA, 20 bp, Homo sapiens
aagtcagttgctcaaaaaga

SEQ ID NO: 1645949 - DNA, 22 bp, Homo sapiens
aagtcagttgctcaaaaagaaa

SEQ ID NO: 1645950 - DNA, 21 bp, Homo sapiens
aagtcatacctttttcttaaa

SEQ ID NO: 1645951 - DNA, 17 bp, Homo sapiens
aagtcatagccataaat

SEQ ID NO: 1645952 - DNA, 18 bp, Homo sapiens
aagtcatcatgaactggc

SEQ ID NO: 1645953 - DNA, 14 bp, Homo sapiens
aagtcatctactta

SEQ ID NO: 1645954 - DNA, 23 bp, Homo sapiens
aagttggtttagctttggaaagt

SEQ ID NO: 1645955 - DNA, 14 bp, Homo sapiens
aagttgtaaagtat

SEQ ID NO: 1645956 - DNA, 12 bp, Homo sapiens
aagttgtacttt

SEQ ID NO: 1645957 - DNA, 21 bp, Homo sapiens
aagttgtactttaaaaattta

SEQ ID NO: 1645958 - DNA, 18 bp, Homo sapiens
aagttgtcaaagaagctt

SEQ ID NO: 1645959 - DNA, 14 bp, Homo sapiens
aagttgtcttaaaa

SEQ ID NO: 1645960 - DNA, 17 bp, Homo sapiens
aagttgtggatatcagg

SEQ ID NO: 1645961 - DNA, 19 bp, Homo sapiens
aagttgttaaaacatttaa

SEQ ID NO: 1645962 - DNA, 15 bp, Homo sapiens
aagttgttgactgtg

SEQ ID NO: 1645963 - DNA, 18 bp, Homo sapiens
aagttgttgtaacctgct

SEQ ID NO: 1645964 - DNA, 17 bp, Homo sapiens
aagttgtttatcaactt

SEQ ID NO: 1645965 - DNA, 18 bp, Homo sapiens
aagttgtttatcaacttc

SEQ ID NO: 1645966 - DNA, 15 bp, Homo sapiens
aagttgtttcattga

SEQ ID NO: 1645967 - DNA, 13 bp, Homo sapiens
aagttgtttgcat

SEQ ID NO: 1645968 - DNA, 17 bp, Homo sapiens
aagttgtttgtcatctt

SEQ ID NO: 1645969 - DNA, 16 bp, Homo sapiens
aagtttaattgtctca

SEQ ID NO: 1645970 - DNA, 15 bp, Homo sapiens
aagtttacaagcgag

SEQ ID NO: 1645971 - DNA, 19 bp, Homo sapiens
aagtttacattgtaaatag

SEQ ID NO: 1645972 - DNA, 21 bp, Homo sapiens
aagtttacattgtcctgtagc

SEQ ID NO: 1645973 - DNA, 13 bp, Homo sapiens
aagtttatatata

SEQ ID NO: 1645974 - DNA, 20 bp, Homo sapiens
aagtttatcagtaaataact

SEQ ID NO: 1645975 - DNA, 15 bp, Homo sapiens
aagtttatttattta

SEQ ID NO: 1645976 - DNA, 22 bp, Homo sapiens
aagtttcaaacttactattttg

SEQ ID NO: 1645977 - DNA, 21 bp, Homo sapiens
aagtttcagagaccattgcaa

SEQ ID NO: 1645978 - DNA, 19 bp, Homo sapiens
aagtttcagtattagatgc

SEQ ID NO: 1645979 - DNA, 12 bp, Homo sapiens
aagtttcagttg

SEQ ID NO: 1645980 - DNA, 16 bp, Homo sapiens
aagtttcagttgattt

SEQ ID NO: 1645981 - DNA, 18 bp, Homo sapiens
aagtttccatatgttata

SEQ ID NO: 1645982 - DNA, 18 bp, Homo sapiens
aagtttctaagattctaa

SEQ ID NO: 1645983 - DNA, 12 bp, Homo sapiens
aagtttctagaa

SEQ ID NO: 1645984 - DNA, 23 bp, Homo sapiens
aagtttctagctagaaatatgat

SEQ ID NO: 1645985 - DNA, 14 bp, Homo sapiens
aagtttctattctg

SEQ ID NO: 1645986 - DNA, 15 bp, Homo sapiens
aagtttctctgcaga

SEQ ID NO: 1645987 - DNA, 15 bp, Homo sapiens
aagtttgatttcatt

SEQ ID NO: 1645988 - DNA, 11 bp, Homo sapiens
aagtttgcaac

SEQ ID NO: 1645989 - DNA, 22 bp, Homo sapiens
aagtttgtgttctgtttgttaa

SEQ ID NO: 1645990 - DNA, 15 bp, Homo sapiens
aagttttaaagttca

SEQ ID NO: 1645991 - DNA, 20 bp, Homo sapiens
aagttttaactttaatacag

SEQ ID NO: 1645992 - DNA, 13 bp, Homo sapiens
aagttttgatgaa

SEQ ID NO: 1645993 - DNA, 21 bp, Homo sapiens
aagttttgattaatgtttctt

SEQ ID NO: 1645994 - DNA, 22 bp, Homo sapiens
aagttttgtataaataataaag

SEQ ID NO: 1645995 - DNA, 17 bp, Homo sapiens
aagttttttatgccttt

SEQ ID NO: 1645996 - DNA, 12 bp, Homo sapiens
aagtttttttgc

SEQ ID NO: 1645997 - DNA, 18 bp, Homo sapiens
aataaaaaaaagaaatga

SEQ ID NO: 1645998 - DNA, 17 bp, Homo sapiens
aataaaaactaatttca

SEQ ID NO: 1645999 - DNA, 19 bp, Homo sapiens
aataaaaactgactcctta

SEQ ID NO: 1646000 - DNA, 14 bp, Homo sapiens
aataaaaagagaaa

SEQ ID NO: 1646001 - DNA, 15 bp, Homo sapiens
aataaaaagcctctt

SEQ ID NO: 1646002 - DNA, 12 bp, Homo sapiens
aataaaaataca

SEQ ID NO: 1646003 - DNA, 19 bp, Homo sapiens
aataaaaatagttacagtg

SEQ ID NO: 1646004 - DNA, 17 bp, Homo sapiens
aataaaaatatgtaatt

SEQ ID NO: 1646005 - DNA, 21 bp, Homo sapiens
aataaaaatcaacttgtgtac

SEQ ID NO: 1646006 - DNA, 13 bp, Homo sapiens
aataaaaatggat

SEQ ID NO: 1646007 - DNA, 15 bp, Homo sapiens
aataaaaatgtttaa

SEQ ID NO: 1646008 - DNA, 22 bp, Homo sapiens
aataaaactaagctctttgaga

SEQ ID NO: 1646009 - DNA, 16 bp, Homo sapiens
aataaaagatttacat

SEQ ID NO: 1646010 - DNA, 13 bp, Homo sapiens
aataaaagcacaa

SEQ ID NO: 1646011 - DNA, 18 bp, Homo sapiens
aataaaagcagcatctgc

SEQ ID NO: 1646012 - DNA, 21 bp, Homo sapiens
aataaaagcagcatctgctaa

SEQ ID NO: 1646013 - DNA, 19 bp, Homo sapiens
aataaaatatcataaagca

SEQ ID NO: 1646014 - DNA, 15 bp, Homo sapiens
aataaaatattcact

SEQ ID NO: 1646015 - DNA, 14 bp, Homo sapiens
aataaaatgaacat

SEQ ID NO: 1646016 - DNA, 21 bp, Homo sapiens
aataaaatgccatagtttgtg

SEQ ID NO: 1646017 - DNA, 15 bp, Homo sapiens
aataaaattcctatc

SEQ ID NO: 1646018 - DNA, 12 bp, Homo sapiens
aataaaatttaa

SEQ ID NO: 1646019 - DNA, 13 bp, Homo sapiens
aataaaatttaaa

SEQ ID NO: 1646020 - DNA, 13 bp, Homo sapiens
aataaacaaataa

SEQ ID NO: 1646021 - DNA, 23 bp, Homo sapiens
aataaacaggaattttattttgc

SEQ ID NO: 1646022 - DNA, 15 bp, Homo sapiens
aataaacagtatatt

SEQ ID NO: 1646023 - DNA, 17 bp, Homo sapiens
aataaacctcaaaatgt

SEQ ID NO: 1646024 - DNA, 20 bp, Homo sapiens
aataaacctcaaaatgtcta

SEQ ID NO: 1646025 - DNA, 12 bp, Homo sapiens
aataaactacac

SEQ ID NO: 1646026 - DNA, 19 bp, Homo sapiens
aataaactagtttccagtg

SEQ ID NO: 1646027 - DNA, 13 bp, Homo sapiens
aataaactattta

SEQ ID NO: 1646028 - DNA, 19 bp, Homo sapiens
aataaactatttatatcac

SEQ ID NO: 1646029 - DNA, 20 bp, Homo sapiens
aataaacttagaggaaaatg

SEQ ID NO: 1646030 - DNA, 13 bp, Homo sapiens
aataaactttatt

SEQ ID NO: 1646031 - DNA, 12 bp, Homo sapiens
aataaagaagaa

SEQ ID NO: 1646032 - DNA, 13 bp, Homo sapiens
aataaagaagaaa

SEQ ID NO: 1646033 - DNA, 12 bp, Homo sapiens
aataaagacagg

SEQ ID NO: 1646034 - DNA, 18 bp, Homo sapiens
aataaagatatttccaag

SEQ ID NO: 1646035 - DNA, 15 bp, Homo sapiens
aataaagatgagttg

SEQ ID NO: 1646036 - DNA, 12 bp, Homo sapiens
aataaagcaatt

SEQ ID NO: 1646037 - DNA, 15 bp, Homo sapiens
aataaagcactgagc

SEQ ID NO: 1646038 - DNA, 13 bp, Homo sapiens
aataaagcattct

SEQ ID NO: 1646039 - DNA, 14 bp, Homo sapiens
aataaagcattctt

SEQ ID NO: 1646040 - DNA, 20 bp, Homo sapiens
aataaagcattctttaacag

SEQ ID NO: 1646041 - DNA, 16 bp, Homo sapiens
aataaagcgtcctctc

SEQ ID NO: 1646042 - DNA, 18 bp, Homo sapiens
aataaagcttgtggcccc

SEQ ID NO: 1646043 - DNA, 18 bp, Homo sapiens
aataaaggcagctgcctc

SEQ ID NO: 1646044 - DNA, 19 bp, Homo sapiens
aataaaggtatgaaagggt

SEQ ID NO: 1646045 - DNA, 16 bp, Homo sapiens
aataaaggtgtagaaa

SEQ ID NO: 1646046 - DNA, 14 bp, Homo sapiens
aataaagtattcta

SEQ ID NO: 1646047 - DNA, 19 bp, Homo sapiens
aataaagttggtcttttga

SEQ ID NO: 1646048 - DNA, 15 bp, Homo sapiens
aataaatatatctac

SEQ ID NO: 1646049 - DNA, 20 bp, Homo sapiens
aataaatatgtaatataaat

SEQ ID NO: 1646050 - DNA, 21 bp, Homo sapiens
aataaatcattaatactcttc

SEQ ID NO: 1646051 - DNA, 16 bp, Homo sapiens
aataaatctaggatgt

SEQ ID NO: 1646052 - DNA, 20 bp, Homo sapiens
aataaatctggtagaaaaat

SEQ ID NO: 1646053 - DNA, 15 bp, Homo sapiens
aataaatctttggaa

SEQ ID NO: 1646054 - DNA, 16 bp, Homo sapiens
aataaatgagctatgt

SEQ ID NO: 1646055 - DNA, 14 bp, Homo sapiens
aataaatgagctgt

SEQ ID NO: 1646056 - DNA, 18 bp, Homo sapiens
aataaatgagctgttgga

SEQ ID NO: 1646057 - DNA, 23 bp, Homo sapiens
aataaatggtatagcaaatgttt

SEQ ID NO: 1646058 - DNA, 21 bp, Homo sapiens
aataaatgtcaccaggtactt

SEQ ID NO: 1646059 - DNA, 14 bp, Homo sapiens
aataaattagttgt

SEQ ID NO: 1646060 - DNA, 21 bp, Homo sapiens
aataaattattagagattttc

SEQ ID NO: 1646061 - DNA, 16 bp, Homo sapiens
aataaattcaaaacct

SEQ ID NO: 1646062 - DNA, 20 bp, Homo sapiens
aataaattcaataaaaacct

SEQ ID NO: 1646063 - DNA, 17 bp, Homo sapiens
aataaattggaaatgtg

SEQ ID NO: 1646064 - DNA, 18 bp, Homo sapiens
aataaattggattatttt

SEQ ID NO: 1646065 - DNA, 20 bp, Homo sapiens
aataaattggattattttct

SEQ ID NO: 1646066 - DNA, 19 bp, Homo sapiens
aataaatttaaacttacaa

SEQ ID NO: 1646067 - DNA, 13 bp, Homo sapiens
aataaatttgact

SEQ ID NO: 1646068 - DNA, 21 bp, Homo sapiens
aataaatttgacttttctgta

SEQ ID NO: 1646069 - DNA, 21 bp, Homo sapiens
aataaatttggttctaataga

SEQ ID NO: 1646070 - DNA, 15 bp, Homo sapiens
aatatatacattttt

SEQ ID NO: 1646071 - DNA, 15 bp, Homo sapiens
aatatatagaattca

SEQ ID NO: 1646072 - DNA, 22 bp, Homo sapiens
aatatatagtgggtacatcaag

SEQ ID NO: 1646073 - DNA, 14 bp, Homo sapiens
aatatatatgatga

SEQ ID NO: 1646074 - DNA, 15 bp, Homo sapiens
aatatatatgtcaat

SEQ ID NO: 1646075 - DNA, 23 bp, Homo sapiens
aatatatattaagtgtgccaaat

SEQ ID NO: 1646076 - DNA, 18 bp, Homo sapiens
aatatatattatatatat

SEQ ID NO: 1646077 - DNA, 19 bp, Homo sapiens
aatatatattatatatatc

SEQ ID NO: 1646078 - DNA, 21 bp, Homo sapiens
aatatatattttaaggttgca

SEQ ID NO: 1646079 - DNA, 13 bp, Homo sapiens
aatatatcttaag

SEQ ID NO: 1646080 - DNA, 13 bp, Homo sapiens
aatatatgacttc

SEQ ID NO: 1646081 - DNA, 13 bp, Homo sapiens
aatatatgattct

SEQ ID NO: 1646082 - DNA, 21 bp, Homo sapiens
aatatatgccttgtataatat

SEQ ID NO: 1646083 - DNA, 12 bp, Homo sapiens
aatatatgttta

SEQ ID NO: 1646084 - DNA, 23 bp, Homo sapiens
aatatattaccagcaagaataaa

SEQ ID NO: 1646085 - DNA, 13 bp, Homo sapiens
aatatattgaact

SEQ ID NO: 1646086 - DNA, 20 bp, Homo sapiens
aatatattgaacttttgtac

SEQ ID NO: 1646087 - DNA, 23 bp, Homo sapiens
aatatattgaacttttgtactga

SEQ ID NO: 1646088 - DNA, 15 bp, Homo sapiens
aatatatttaaaggg

SEQ ID NO: 1646089 - DNA, 15 bp, Homo sapiens
aatatatttaagata

SEQ ID NO: 1646090 - DNA, 19 bp, Homo sapiens
aatatatttaagataatta

SEQ ID NO: 1646091 - DNA, 12 bp, Homo sapiens
aatatatttctt

SEQ ID NO: 1646092 - DNA, 16 bp, Homo sapiens
aatatatttcttcttc

SEQ ID NO: 1646093 - DNA, 14 bp, Homo sapiens
aatatatttttaga

SEQ ID NO: 1646094 - DNA, 18 bp, Homo sapiens
aatatatttttagactca

SEQ ID NO: 1646095 - DNA, 21 bp, Homo sapiens
aatatattttttgttattatt

SEQ ID NO: 1646096 - DNA, 16 bp, Homo sapiens
aatatcaaaagaaaat

SEQ ID NO: 1646097 - DNA, 15 bp, Homo sapiens
aatatcaactctgaa

SEQ ID NO: 1646098 - DNA, 12 bp, Homo sapiens
aatatcacctag

SEQ ID NO: 1646099 - DNA, 15 bp, Homo sapiens
aatatcagacaagca

SEQ ID NO: 1646100 - DNA, 15 bp, Homo sapiens
aatatcagtattctg

SEQ ID NO: 1646101 - DNA, 20 bp, Homo sapiens
aatatcagtattctgacatg

SEQ ID NO: 1646102 - DNA, 21 bp, Homo sapiens
aatatcagtattctgacatgt

SEQ ID NO: 1646103 - DNA, 22 bp, Homo sapiens
aatatcagtattctgacatgta

SEQ ID NO: 1646104 - DNA, 14 bp, Homo sapiens
aatatcataaagca

SEQ ID NO: 1646105 - DNA, 13 bp, Homo sapiens
aatatcatctttt

SEQ ID NO: 1646106 - DNA, 13 bp, Homo sapiens
aatatccacagta

SEQ ID NO: 1646107 - DNA, 23 bp, Homo sapiens
aatatccattctcgttttaggac

SEQ ID NO: 1646108 - DNA, 16 bp, Homo sapiens
aatatccatttatctt

SEQ ID NO: 1646109 - DNA, 19 bp, Homo sapiens
aatatccgtgaagggattt

SEQ ID NO: 1646110 - DNA, 22 bp, Homo sapiens
aatatccttgatgtacagattt

SEQ ID NO: 1646111 - DNA, 17 bp, Homo sapiens
aatatcgctgatgcaga

SEQ ID NO: 1646112 - DNA, 14 bp, Homo sapiens
aatatctaatatat

SEQ ID NO: 1646113 - DNA, 20 bp, Homo sapiens
aatatctaatatatatgaat

SEQ ID NO: 1646114 - DNA, 14 bp, Homo sapiens
aatatctattaata

SEQ ID NO: 1646115 - DNA, 18 bp, Homo sapiens
aatatctgaaaatgtatg

SEQ ID NO: 1646116 - DNA, 19 bp, Homo sapiens
aatatctgaaaatgtatgt

SEQ ID NO: 1646117 - DNA, 13 bp, Homo sapiens
aatatctgaaatg

SEQ ID NO: 1646118 - DNA, 15 bp, Homo sapiens
aatatctggcactgt

SEQ ID NO: 1646119 - DNA, 22 bp, Homo sapiens
aatatctggcactgttaataca

SEQ ID NO: 1646120 - DNA, 17 bp, Homo sapiens
aatatctgtaatggtac

SEQ ID NO: 1646121 - DNA, 21 bp, Homo sapiens
aatatctgtatttaattttga

SEQ ID NO: 1646122 - DNA, 23 bp, Homo sapiens
aatatctgtgaggtgctgatgag

SEQ ID NO: 1646123 - DNA, 22 bp, Homo sapiens
aatatctgttattcaaatttga

SEQ ID NO: 1646124 - DNA, 23 bp, Homo sapiens
aatatctgttattcaaatttgat

SEQ ID NO: 1646125 - DNA, 18 bp, Homo sapiens
aatatcttcagctctttt

SEQ ID NO: 1646126 - DNA, 17 bp, Homo sapiens
aatatcttgcttgaact

SEQ ID NO: 1646127 - DNA, 14 bp, Homo sapiens
aatatgaacaaact

SEQ ID NO: 1646128 - DNA, 19 bp, Homo sapiens
aatatgaacctattttcat

SEQ ID NO: 1646129 - DNA, 13 bp, Homo sapiens
aatatgaatctat

SEQ ID NO: 1646130 - DNA, 13 bp, Homo sapiens
aatatgaccattt

SEQ ID NO: 1646131 - DNA, 19 bp, Homo sapiens
aatatgactttttataaaa

SEQ ID NO: 1646132 - DNA, 13 bp, Homo sapiens
aatatgagcttca

SEQ ID NO: 1646133 - DNA, 14 bp, Homo sapiens
aatatgagttactg

SEQ ID NO: 1646134 - DNA, 15 bp, Homo sapiens
aatatgccatttata

SEQ ID NO: 1646135 - DNA, 20 bp, Homo sapiens
aatatgcctagtaacacata

SEQ ID NO: 1646136 - DNA, 16 bp, Homo sapiens
aatatgcttaaaataa

SEQ ID NO: 1646137 - DNA, 19 bp, Homo sapiens
aatatgcttaaaataagca

SEQ ID NO: 1646138 - DNA, 22 bp, Homo sapiens
aatatgcttaaaataagcaggt

SEQ ID NO: 1646139 - DNA, 18 bp, Homo sapiens
aatatggctataaatata

SEQ ID NO: 1646140 - DNA, 15 bp, Homo sapiens
aatatggtggaaaat

SEQ ID NO: 1646141 - DNA, 16 bp, Homo sapiens
aatatggttgatagtt

SEQ ID NO: 1646142 - DNA, 15 bp, Homo sapiens
aatatgtaatataaa

SEQ ID NO: 1646143 - DNA, 12 bp, Homo sapiens
aatatgtcctgg

SEQ ID NO: 1646144 - DNA, 21 bp, Homo sapiens
aatatgtgagtgccttttgca

SEQ ID NO: 1646145 - DNA, 16 bp, Homo sapiens
aatatgtgccttaagt

SEQ ID NO: 1646146 - DNA, 23 bp, Homo sapiens
aatatgtgccttaagttttagtc

SEQ ID NO: 1646147 - DNA, 21 bp, Homo sapiens
aatatgttagaatcaaatact

SEQ ID NO: 1646148 - DNA, 18 bp, Homo sapiens
aatatgttgagtgttcat

SEQ ID NO: 1646149 - DNA, 22 bp, Homo sapiens
aatatgttgagtgttcatttta

SEQ ID NO: 1646150 - DNA, 17 bp, Homo sapiens
aatatgtttcaaacttt

SEQ ID NO: 1646151 - DNA, 13 bp, Homo sapiens
aatattaaaattg

SEQ ID NO: 1646152 - DNA, 16 bp, Homo sapiens
aatattaaaattgtta

SEQ ID NO: 1646153 - DNA, 21 bp, Homo sapiens
aatattaacacgctgcctggt

SEQ ID NO: 1646154 - DNA, 13 bp, Homo sapiens
aatattaacattc

SEQ ID NO: 1646155 - DNA, 22 bp, Homo sapiens
aatattaacctaatcaccatgt

SEQ ID NO: 1646156 - DNA, 13 bp, Homo sapiens
aatattaagcatg

SEQ ID NO: 1646157 - DNA, 22 bp, Homo sapiens
aatattaatgcctttaaagtat

SEQ ID NO: 1646158 - DNA, 20 bp, Homo sapiens
aatattaattagtttatatt

SEQ ID NO: 1646159 - DNA, 16 bp, Homo sapiens
aatattactgtcttta

SEQ ID NO: 1646160 - DNA, 21 bp, Homo sapiens
aatattactgtctttattctt

SEQ ID NO: 1646161 - DNA, 14 bp, Homo sapiens
aatattactttgtc

SEQ ID NO: 1646162 - DNA, 18 bp, Homo sapiens
aatattagctttactgtt

SEQ ID NO: 1646163 - DNA, 21 bp, Homo sapiens
aatattagctttactgtttgt

SEQ ID NO: 1646164 - DNA, 16 bp, Homo sapiens
aatattccagatcttt

SEQ ID NO: 1646165 - DNA, 18 bp, Homo sapiens
aatattccagatctttca

SEQ ID NO: 1646166 - DNA, 22 bp, Homo sapiens
aatattccagatctttcagaaa

SEQ ID NO: 1646167 - DNA, 13 bp, Homo sapiens
aatattctagaac

SEQ ID NO: 1646168 - DNA, 23 bp, Homo sapiens
aatattctgtaactattgggtga

SEQ ID NO: 1646169 - DNA, 17 bp, Homo sapiens
aatattgaagttgttta

SEQ ID NO: 1646170 - DNA, 22 bp, Homo sapiens
aatattgaatttttatttttga

SEQ ID NO: 1646171 - DNA, 15 bp, Homo sapiens
aatattgacatttgt

SEQ ID NO: 1646172 - DNA, 18 bp, Homo sapiens
aatattgactcaaaccat

SEQ ID NO: 1646173 - DNA, 19 bp, Homo sapiens
aatattgactcaaaccata

SEQ ID NO: 1646174 - DNA, 20 bp, Homo sapiens
aatattgagaaagaaactaa

SEQ ID NO: 1646175 - DNA, 20 bp, Homo sapiens
aatattgattgggaaaacat

SEQ ID NO: 1646176 - DNA, 21 bp, Homo sapiens
aatattgattgggaaaacatt

SEQ ID NO: 1646177 - DNA, 22 bp, Homo sapiens
aatattgattgggaaaacattt

SEQ ID NO: 1646178 - DNA, 22 bp, Homo sapiens
aatattgctgtgtcttcatttt

SEQ ID NO: 1646179 - DNA, 20 bp, Homo sapiens
aatattgctttggtcatatg

SEQ ID NO: 1646180 - DNA, 10 bp, Homo sapiens
aatattgtaa

SEQ ID NO: 1646181 - DNA, 16 bp, Homo sapiens
aatattgtctgtctct

SEQ ID NO: 1646182 - DNA, 21 bp, Homo sapiens
aatattgtttggtaaatgttt

SEQ ID NO: 1646183 - DNA, 23 bp, Homo sapiens
aatattgtttggtaaatgtttct

SEQ ID NO: 1646184 - DNA, 13 bp, Homo sapiens
aattttaatgtaa

SEQ ID NO: 1646185 - DNA, 13 bp, Homo sapiens
aattttaatttat

SEQ ID NO: 1646186 - DNA, 15 bp, Homo sapiens
aattttaatttattt

SEQ ID NO: 1646187 - DNA, 13 bp, Homo sapiens
aattttacacatt

SEQ ID NO: 1646188 - DNA, 15 bp, Homo sapiens
aattttagaaatatt

SEQ ID NO: 1646189 - DNA, 13 bp, Homo sapiens
aattttagaactt

SEQ ID NO: 1646190 - DNA, 13 bp, Homo sapiens
aattttagtattc

SEQ ID NO: 1646191 - DNA, 14 bp, Homo sapiens
aattttagtgtatt

SEQ ID NO: 1646192 - DNA, 18 bp, Homo sapiens
aattttagtttttcatta

SEQ ID NO: 1646193 - DNA, 19 bp, Homo sapiens
aattttatagctcagttta

SEQ ID NO: 1646194 - DNA, 13 bp, Homo sapiens
aattttatattct

SEQ ID NO: 1646195 - DNA, 22 bp, Homo sapiens
aattttatgtcatagaaatatt

SEQ ID NO: 1646196 - DNA, 15 bp, Homo sapiens
aattttattaaatgc

SEQ ID NO: 1646197 - DNA, 16 bp, Homo sapiens
aattttattgcaaagt

SEQ ID NO: 1646198 - DNA, 17 bp, Homo sapiens
aattttatttataaact

SEQ ID NO: 1646199 - DNA, 22 bp, Homo sapiens
aattttatttgttctttttctg

SEQ ID NO: 1646200 - DNA, 15 bp, Homo sapiens
aattttattttgctg

SEQ ID NO: 1646201 - DNA, 23 bp, Homo sapiens
aattttattttgtgctcatttaa

SEQ ID NO: 1646202 - DNA, 14 bp, Homo sapiens
aattttatttttct

SEQ ID NO: 1646203 - DNA, 17 bp, Homo sapiens
aattttatttttctgtg

SEQ ID NO: 1646204 - DNA, 18 bp, Homo sapiens
aattttcaaggccttcag

SEQ ID NO: 1646205 - DNA, 22 bp, Homo sapiens
aattttcaaggccttcagttta

SEQ ID NO: 1646206 - DNA, 18 bp, Homo sapiens
aattttcattaaacttga

SEQ ID NO: 1646207 - DNA, 21 bp, Homo sapiens
aattttcattaaacttgaagc

SEQ ID NO: 1646208 - DNA, 17 bp, Homo sapiens
aattttccagtataaaa

SEQ ID NO: 1646209 - DNA, 18 bp, Homo sapiens
aattttcctttgtcattt

SEQ ID NO: 1646210 - DNA, 15 bp, Homo sapiens
aattttctaaaagct

SEQ ID NO: 1646211 - DNA, 23 bp, Homo sapiens
aattttctccttggtttgctagt

SEQ ID NO: 1646212 - DNA, 13 bp, Homo sapiens
aattttctgcagc

SEQ ID NO: 1646213 - DNA, 22 bp, Homo sapiens
aattttctggaatacatgaaat

SEQ ID NO: 1646214 - DNA, 14 bp, Homo sapiens
aattttcttcatgc

SEQ ID NO: 1646215 - DNA, 21 bp, Homo sapiens
aattttgaataaataaatgta

SEQ ID NO: 1646216 - DNA, 16 bp, Homo sapiens
aattttgagattaaga

SEQ ID NO: 1646217 - DNA, 19 bp, Homo sapiens
aattttgatatacattgtg

SEQ ID NO: 1646218 - DNA, 21 bp, Homo sapiens
aattttgatatacattgtgtg

SEQ ID NO: 1646219 - DNA, 16 bp, Homo sapiens
aattttgcaatgtatt

SEQ ID NO: 1646220 - DNA, 12 bp, Homo sapiens
aattttgctaac

SEQ ID NO: 1646221 - DNA, 17 bp, Homo sapiens
aattttgctaactgggt

SEQ ID NO: 1646222 - DNA, 20 bp, Homo sapiens
aattttgctggaattcctaa

SEQ ID NO: 1646223 - DNA, 22 bp, Homo sapiens
aattttgctggaattcctaact

SEQ ID NO: 1646224 - DNA, 13 bp, Homo sapiens
aattttggaataa

SEQ ID NO: 1646225 - DNA, 20 bp, Homo sapiens
aattttggaataatttctat

SEQ ID NO: 1646226 - DNA, 20 bp, Homo sapiens
aattttggtcatagcattca

SEQ ID NO: 1646227 - DNA, 18 bp, Homo sapiens
aattttgtaaaacaatgc

SEQ ID NO: 1646228 - DNA, 20 bp, Homo sapiens
aattttgtaaaacaatgcca

SEQ ID NO: 1646229 - DNA, 21 bp, Homo sapiens
aattttgtaaaacaatgccat

SEQ ID NO: 1646230 - DNA, 13 bp, Homo sapiens
aattttgtatatt

SEQ ID NO: 1646231 - DNA, 20 bp, Homo sapiens
aattttgtatgttaaagaga

SEQ ID NO: 1646232 - DNA, 19 bp, Homo sapiens
aattttgtcttaagtgttt

SEQ ID NO: 1646233 - DNA, 22 bp, Homo sapiens
aattttgtcttaagtgtttctc

SEQ ID NO: 1646234 - DNA, 14 bp, Homo sapiens
aattttgtgcattc

SEQ ID NO: 1646235 - DNA, 15 bp, Homo sapiens
aattttgtgcattct

SEQ ID NO: 1646236 - DNA, 16 bp, Homo sapiens
aattttgtgcattctt

SEQ ID NO: 1646237 - DNA, 14 bp, Homo sapiens
aattttgttctctg

SEQ ID NO: 1646238 - DNA, 15 bp, Homo sapiens
aattttgtttcagaa

SEQ ID NO: 1646239 - DNA, 21 bp, Homo sapiens
aattttgtttcagaattttgt

SEQ ID NO: 1646240 - DNA, 22 bp, Homo sapiens
aatttttaaagtatatatttat

SEQ ID NO: 1646241 - DNA, 20 bp, Homo sapiens
aatttttaaatgtaaaacat

SEQ ID NO: 1646242 - DNA, 14 bp, Homo sapiens
aatttttaagagaa

SEQ ID NO: 1646243 - DNA, 14 bp, Homo sapiens
aatttttccaacta

SEQ ID NO: 1646244 - DNA, 20 bp, Homo sapiens
aatttttccaactactaata

SEQ ID NO: 1646245 - DNA, 14 bp, Homo sapiens
aatttttcctgcat

SEQ ID NO: 1646246 - DNA, 17 bp, Homo sapiens
aatttttcctgcatgtt

SEQ ID NO: 1646247 - DNA, 12 bp, Homo sapiens
aatttttgcaaa

SEQ ID NO: 1646248 - DNA, 16 bp, Homo sapiens
aatttttgccttcatt

SEQ ID NO: 1646249 - DNA, 17 bp, Homo sapiens
aatttttgccttcatta

SEQ ID NO: 1646250 - DNA, 14 bp, Homo sapiens
aatttttgtacatt

SEQ ID NO: 1646251 - DNA, 19 bp, Homo sapiens
aatttttgtacattacact

SEQ ID NO: 1646252 - DNA, 13 bp, Homo sapiens
aatttttgtattt

SEQ ID NO: 1646253 - DNA, 17 bp, Homo sapiens
aatttttgtatttttag

SEQ ID NO: 1646254 - DNA, 19 bp, Homo sapiens
aatttttgtttttgagtac

SEQ ID NO: 1646255 - DNA, 18 bp, Homo sapiens
aattttttatcatgcatg

SEQ ID NO: 1646256 - DNA, 17 bp, Homo sapiens
aattttttctcattctg

SEQ ID NO: 1646257 - DNA, 23 bp, Homo sapiens
aatttttttatgttttgtttctg

SEQ ID NO: 1646258 - DNA, 17 bp, Homo sapiens
aatttttttattactga

SEQ ID NO: 1646259 - DNA, 15 bp, Homo sapiens
aatttttttcctgct

SEQ ID NO: 1646260 - DNA, 15 bp, Homo sapiens
aatttttttgtaata

SEQ ID NO: 1646261 - DNA, 20 bp, Homo sapiens
aattttttttaaaatagaaa

SEQ ID NO: 1646262 - DNA, 14 bp, Homo sapiens
aattttttttaaca

SEQ ID NO: 1646263 - DNA, 15 bp, Homo sapiens
aattttttttaacat

SEQ ID NO: 1646264 - DNA, 17 bp, Homo sapiens
aattttttttaacattc

SEQ ID NO: 1646265 - DNA, 18 bp, Homo sapiens
aattttttttaacattcc

SEQ ID NO: 1646266 - DNA, 23 bp, Homo sapiens
aattttttttagtatttatttat

SEQ ID NO: 1646267 - DNA, 21 bp, Homo sapiens
aattttttttgttttttgtaa

SEQ ID NO: 1646268 - DNA, 19 bp, Homo sapiens
aatttttttttcctagccc

SEQ ID NO: 1646269 - DNA, 20 bp, Homo sapiens
aatttttttttcctggaatt

SEQ ID NO: 1646270 - DNA, 19 bp, Homo sapiens
acaaaaaaaaaatttgcca

SEQ ID NO: 1646271 - DNA, 19 bp, Homo sapiens
acaaaaaaaaagttttatt

SEQ ID NO: 1646272 - DNA, 19 bp, Homo sapiens
acaaaaaaagttgaaggcc

SEQ ID NO: 1646273 - DNA, 17 bp, Homo sapiens
acaaaaaaatatattta

SEQ ID NO: 1646274 - DNA, 20 bp, Homo sapiens
acaaaaaaatatatttaatg

SEQ ID NO: 1646275 - DNA, 22 bp, Homo sapiens
acaaaaaaatatcagacaagca

SEQ ID NO: 1646276 - DNA, 15 bp, Homo sapiens
acaaaaaactcccct

SEQ ID NO: 1646277 - DNA, 14 bp, Homo sapiens
acaaaaaatgtttt

SEQ ID NO: 1646278 - DNA, 20 bp, Homo sapiens
acaaaaacaggtatatactt

SEQ ID NO: 1646279 - DNA, 23 bp, Homo sapiens
acaaaaaccttggcataagacag

SEQ ID NO: 1646280 - DNA, 15 bp, Homo sapiens
acaaaaagacaaaca

SEQ ID NO: 1646281 - DNA, 15 bp, Homo sapiens
acaaaaagcaaaaat

SEQ ID NO: 1646282 - DNA, 18 bp, Homo sapiens
acaaaaaggaaatgaata

SEQ ID NO: 1646283 - DNA, 12 bp, Homo sapiens
acaaaaaggcaa

SEQ ID NO: 1646284 - DNA, 19 bp, Homo sapiens
acaaaaaggcaaatattga

SEQ ID NO: 1646285 - DNA, 20 bp, Homo sapiens
acaaaaaggcaaatattgaa

SEQ ID NO: 1646286 - DNA, 15 bp, Homo sapiens
acaaaaagtaaaaat

SEQ ID NO: 1646287 - DNA, 17 bp, Homo sapiens
acaaaaatattttccta

SEQ ID NO: 1646288 - DNA, 21 bp, Homo sapiens
acaaaaatgtaatgatcataa

SEQ ID NO: 1646289 - DNA, 15 bp, Homo sapiens
acaaaacaaacaaac

SEQ ID NO: 1646290 - DNA, 16 bp, Homo sapiens
acaaaaccaaaagtta

SEQ ID NO: 1646291 - DNA, 19 bp, Homo sapiens
acaaaaccaaaagttatta

SEQ ID NO: 1646292 - DNA, 17 bp, Homo sapiens
acaaaaccaagccttgg

SEQ ID NO: 1646293 - DNA, 13 bp, Homo sapiens
acaaaaccagctg

SEQ ID NO: 1646294 - DNA, 14 bp, Homo sapiens
acaaaaccagctgc

SEQ ID NO: 1646295 - DNA, 18 bp, Homo sapiens
acaaaaccttgtgtaaga

SEQ ID NO: 1646296 - DNA, 21 bp, Homo sapiens
acaaaacttagcatctaattt

SEQ ID NO: 1646297 - DNA, 12 bp, Homo sapiens
acaaaacttgaa

SEQ ID NO: 1646298 - DNA, 21 bp, Homo sapiens
acaaaagaactaagaggccca

SEQ ID NO: 1646299 - DNA, 13 bp, Homo sapiens
acaagttttgtat

SEQ ID NO: 1646300 - DNA, 18 bp, Homo sapiens
acaataaaaacaactttc

SEQ ID NO: 1646301 - DNA, 13 bp, Homo sapiens
acaataaaaagaa

SEQ ID NO: 1646302 - DNA, 14 bp, Homo sapiens
acaataaaaatgtt

SEQ ID NO: 1646303 - DNA, 23 bp, Homo sapiens
acaataaagggagaatggtgctg

SEQ ID NO: 1646304 - DNA, 15 bp, Homo sapiens
acaataaagtttaca

SEQ ID NO: 1646305 - DNA, 18 bp, Homo sapiens
acaataaagtttacaagc

SEQ ID NO: 1646306 - DNA, 18 bp, Homo sapiens
acaataaatattctgcat

SEQ ID NO: 1646307 - DNA, 22 bp, Homo sapiens
acaataaatattctgcatggaa

SEQ ID NO: 1646308 - DNA, 12 bp, Homo sapiens
acaataaatgta

SEQ ID NO: 1646309 - DNA, 16 bp, Homo sapiens
acaataaatgtattca

SEQ ID NO: 1646310 - DNA, 15 bp, Homo sapiens
acaataataaagatg

SEQ ID NO: 1646311 - DNA, 13 bp, Homo sapiens
acaataatgagag

SEQ ID NO: 1646312 - DNA, 12 bp, Homo sapiens
acaataatgcaa

SEQ ID NO: 1646313 - DNA, 17 bp, Homo sapiens
acaataatgtactcaca

SEQ ID NO: 1646314 - DNA, 12 bp, Homo sapiens
acaataattaca

SEQ ID NO: 1646315 - DNA, 22 bp, Homo sapiens
acaataattctacatgttgtct

SEQ ID NO: 1646316 - DNA, 13 bp, Homo sapiens
acaataatttcag

SEQ ID NO: 1646317 - DNA, 22 bp, Homo sapiens
acaatacagtattatagacaaa

SEQ ID NO: 1646318 - DNA, 20 bp, Homo sapiens
acaataccactggttaaaat

SEQ ID NO: 1646319 - DNA, 16 bp, Homo sapiens
acaataggtaaagcta

SEQ ID NO: 1646320 - DNA, 18 bp, Homo sapiens
acaataggtgcttattct

SEQ ID NO: 1646321 - DNA, 22 bp, Homo sapiens
acaatagttcttagctttgaaa

SEQ ID NO: 1646322 - DNA, 21 bp, Homo sapiens
acaatataaccacaaagcaca

SEQ ID NO: 1646323 - DNA, 14 bp, Homo sapiens
acaatatagttttt

SEQ ID NO: 1646324 - DNA, 15 bp, Homo sapiens
acaatattactttgt

SEQ ID NO: 1646325 - DNA, 17 bp, Homo sapiens
acaatattttgtggctt

SEQ ID NO: 1646326 - DNA, 16 bp, Homo sapiens
acaatcagtcccctcc

SEQ ID NO: 1646327 - DNA, 18 bp, Homo sapiens
acaatcatgaaatatgca

SEQ ID NO: 1646328 - DNA, 20 bp, Homo sapiens
acaatcctgttactctgtcc

SEQ ID NO: 1646329 - DNA, 18 bp, Homo sapiens
acaatctaacaataatat

SEQ ID NO: 1646330 - DNA, 21 bp, Homo sapiens
acaatctaacaataatatttc

SEQ ID NO: 1646331 - DNA, 20 bp, Homo sapiens
acaatctatggcttatttct

SEQ ID NO: 1646332 - DNA, 22 bp, Homo sapiens
acaatctatggcttatttctat

SEQ ID NO: 1646333 - DNA, 18 bp, Homo sapiens
acaatctggaagaaaaaa

SEQ ID NO: 1646334 - DNA, 13 bp, Homo sapiens
acaatctggctca

SEQ ID NO: 1646335 - DNA, 20 bp, Homo sapiens
acaatgaagtgaaaaagttt

SEQ ID NO: 1646336 - DNA, 17 bp, Homo sapiens
acaatgacaagatgttc

SEQ ID NO: 1646337 - DNA, 16 bp, Homo sapiens
acaatgatgatgataa

SEQ ID NO: 1646338 - DNA, 22 bp, Homo sapiens
acaatgcagttctgagcaccgt

SEQ ID NO: 1646339 - DNA, 17 bp, Homo sapiens
acaatgccatgaacaaa

SEQ ID NO: 1646340 - DNA, 19 bp, Homo sapiens
acaatgcctacagctgtct

SEQ ID NO: 1646341 - DNA, 18 bp, Homo sapiens
acaatggaccctttttgt

SEQ ID NO: 1646342 - DNA, 19 bp, Homo sapiens
acaatgggaggctgtgatt

SEQ ID NO: 1646343 - DNA, 15 bp, Homo sapiens
acaatggttgaatga

SEQ ID NO: 1646344 - DNA, 18 bp, Homo sapiens
acaatggtttattcccaa

SEQ ID NO: 1646345 - DNA, 18 bp, Homo sapiens
acaatgtacaattatgtc

SEQ ID NO: 1646346 - DNA, 16 bp, Homo sapiens
acaatgtagaaaatga

SEQ ID NO: 1646347 - DNA, 15 bp, Homo sapiens
acaatgtataaagat

SEQ ID NO: 1646348 - DNA, 20 bp, Homo sapiens
acaatgtatacttcagtgct

SEQ ID NO: 1646349 - DNA, 17 bp, Homo sapiens
acaatgtatgtaatttg

SEQ ID NO: 1646350 - DNA, 14 bp, Homo sapiens
acaatgtatgtaca

SEQ ID NO: 1646351 - DNA, 21 bp, Homo sapiens
acaatgtatttatttaaaaga

SEQ ID NO: 1646352 - DNA, 12 bp, Homo sapiens
acaatgtgaaac

SEQ ID NO: 1646353 - DNA, 15 bp, Homo sapiens
acaatgttgagaagt

SEQ ID NO: 1646354 - DNA, 17 bp, Homo sapiens
acaattaatagtttgtc

SEQ ID NO: 1646355 - DNA, 15 bp, Homo sapiens
acaattactcaggtt

SEQ ID NO: 1646356 - DNA, 18 bp, Homo sapiens
acaattatatcagtcctc

SEQ ID NO: 1646357 - DNA, 17 bp, Homo sapiens
acaattatgtctcttga

SEQ ID NO: 1646358 - DNA, 20 bp, Homo sapiens
acaattcattgttttgcaaa

SEQ ID NO: 1646359 - DNA, 22 bp, Homo sapiens
acaattcctagataaaaagatg

SEQ ID NO: 1646360 - DNA, 15 bp, Homo sapiens
acaattctgttttta

SEQ ID NO: 1646361 - DNA, 16 bp, Homo sapiens
acaattgaagtaaact

SEQ ID NO: 1646362 - DNA, 18 bp, Homo sapiens
acaattgatacttcaggt

SEQ ID NO: 1646363 - DNA, 20 bp, Homo sapiens
acaattgggagctgccaaga

SEQ ID NO: 1646364 - DNA, 23 bp, Homo sapiens
acaattgttacagtactgttccc

SEQ ID NO: 1646365 - DNA, 12 bp, Homo sapiens
acaatttaaaat

SEQ ID NO: 1646366 - DNA, 18 bp, Homo sapiens
acaatttatgaattgaat

SEQ ID NO: 1646367 - DNA, 13 bp, Homo sapiens
acaatttgataca

SEQ ID NO: 1646368 - DNA, 20 bp, Homo sapiens
acaatttgcactaaatcaga

SEQ ID NO: 1646369 - DNA, 13 bp, Homo sapiens
acaattttaaagt

SEQ ID NO: 1646370 - DNA, 14 bp, Homo sapiens
acaattttctgtaa

SEQ ID NO: 1646371 - DNA, 23 bp, Homo sapiens
acaattttctgtaatcttttatt

SEQ ID NO: 1646372 - DNA, 15 bp, Homo sapiens
acaattttgtacaaa

SEQ ID NO: 1646373 - DNA, 11 bp, Homo sapiens
acaattttgtc

SEQ ID NO: 1646374 - DNA, 14 bp, Homo sapiens
acaattttgtctta

SEQ ID NO: 1646375 - DNA, 21 bp, Homo sapiens
acaattttgtcttaagtgttt

SEQ ID NO: 1646376 - DNA, 22 bp, Homo sapiens
acaattttttatcatgcatgtc

SEQ ID NO: 1646377 - DNA, 22 bp, Homo sapiens
acacaaaggtggaataaacatt

SEQ ID NO: 1646378 - DNA, 14 bp, Homo sapiens
acacaacaccagga

SEQ ID NO: 1646379 - DNA, 15 bp, Homo sapiens
acacaacaccaggac

SEQ ID NO: 1646380 - DNA, 18 bp, Homo sapiens
acacaacccaataggagt

SEQ ID NO: 1646381 - DNA, 19 bp, Homo sapiens
acacaaggatagatgctgg

SEQ ID NO: 1646382 - DNA, 18 bp, Homo sapiens
acacaagggatataaaat

SEQ ID NO: 1646383 - DNA, 14 bp, Homo sapiens
acacaatacagtat

SEQ ID NO: 1646384 - DNA, 14 bp, Homo sapiens
acacaatatgaata

SEQ ID NO: 1646385 - DNA, 23 bp, Homo sapiens
acacaatttaattcctcttttta

SEQ ID NO: 1646386 - DNA, 18 bp, Homo sapiens
acacaatttcatttccag

SEQ ID NO: 1646387 - DNA, 11 bp, Homo sapiens
acacacacaca

SEQ ID NO: 1646388 - DNA, 12 bp, Homo sapiens
acacacacacac

SEQ ID NO: 1646389 - DNA, 17 bp, Homo sapiens
acacacacacacacgat

SEQ ID NO: 1646390 - DNA, 13 bp, Homo sapiens
acacacacacacg

SEQ ID NO: 1646391 - DNA, 14 bp, Homo sapiens
acacacacacgcac

SEQ ID NO: 1646392 - DNA, 14 bp, Homo sapiens
acacacacgatgca

SEQ ID NO: 1646393 - DNA, 15 bp, Homo sapiens
acacacacgatgcat

SEQ ID NO: 1646394 - DNA, 12 bp, Homo sapiens
acacacacgcac

SEQ ID NO: 1646395 - DNA, 21 bp, Homo sapiens
acacacacgcactctccccgc

SEQ ID NO: 1646396 - DNA, 13 bp, Homo sapiens
acacacagaggaa

SEQ ID NO: 1646397 - DNA, 16 bp, Homo sapiens
acacacatctggccct

SEQ ID NO: 1646398 - DNA, 17 bp, Homo sapiens
acacacatgccctcctg

SEQ ID NO: 1646399 - DNA, 17 bp, Homo sapiens
acacaccaccacgcctg

SEQ ID NO: 1646400 - DNA, 11 bp, Homo sapiens
acacacccctc

SEQ ID NO: 1646401 - DNA, 16 bp, Homo sapiens
acacaccgcggccagg

SEQ ID NO: 1646402 - DNA, 20 bp, Homo sapiens
acacacctgtagcacttact

SEQ ID NO: 1646403 - DNA, 14 bp, Homo sapiens
acacacgagcaaac

SEQ ID NO: 1646404 - DNA, 11 bp, Homo sapiens
acacacgatgc

SEQ ID NO: 1646405 - DNA, 13 bp, Homo sapiens
acacacgcacgca

SEQ ID NO: 1646406 - DNA, 17 bp, Homo sapiens
acacacgtatttatatt

SEQ ID NO: 1646407 - DNA, 22 bp, Homo sapiens
acacacgtgcgtgcgagcacac

SEQ ID NO: 1646408 - DNA, 13 bp, Homo sapiens
acacactcagtgc

SEQ ID NO: 1646409 - DNA, 19 bp, Homo sapiens
acacactgtcatgcttcat

SEQ ID NO: 1646410 - DNA, 14 bp, Homo sapiens
acacactttttaag

SEQ ID NO: 1646411 - DNA, 14 bp, Homo sapiens
acacagaaacactg

SEQ ID NO: 1646412 - DNA, 16 bp, Homo sapiens
acacagaatgcaacca

SEQ ID NO: 1646413 - DNA, 12 bp, Homo sapiens
acacagacattt

SEQ ID NO: 1646414 - DNA, 16 bp, Homo sapiens
acacagacattttgtg

SEQ ID NO: 1646415 - DNA, 21 bp, Homo sapiens
acactttgccatttgcttgta

SEQ ID NO: 1646416 - DNA, 22 bp, Homo sapiens
acactttgccatttgcttgtac

SEQ ID NO: 1646417 - DNA, 24 bp, Homo sapiens
acactttgggcttagtatttctca

SEQ ID NO: 1646418 - DNA, 12 bp, Homo sapiens
acactttgtatt

SEQ ID NO: 1646419 - DNA, 13 bp, Homo sapiens
acactttgtatta

SEQ ID NO: 1646420 - DNA, 21 bp, Homo sapiens
acagaaaacaaaagagagaat

SEQ ID NO: 1646421 - DNA, 12 bp, Homo sapiens
acagaaaatatg

SEQ ID NO: 1646422 - DNA, 20 bp, Homo sapiens
acagaaaattgttgtgctta

SEQ ID NO: 1646423 - DNA, 12 bp, Homo sapiens
acagaaacactg

SEQ ID NO: 1646424 - DNA, 15 bp, Homo sapiens
acagaaacactgcct

SEQ ID NO: 1646425 - DNA, 18 bp, Homo sapiens
acagaaacactgcctttt

SEQ ID NO: 1646426 - DNA, 16 bp, Homo sapiens
acagaaaccaagccat

SEQ ID NO: 1646427 - DNA, 18 bp, Homo sapiens
acagaaaccttttatttt

SEQ ID NO: 1646428 - DNA, 19 bp, Homo sapiens
acagaaaccttttattttt

SEQ ID NO: 1646429 - DNA, 15 bp, Homo sapiens
acagaaagagggaca

SEQ ID NO: 1646430 - DNA, 13 bp, Homo sapiens
acagaaagcctcc

SEQ ID NO: 1646431 - DNA, 16 bp, Homo sapiens
acagaaagttggaaag

SEQ ID NO: 1646432 - DNA, 17 bp, Homo sapiens
acagaaatactgctctg

SEQ ID NO: 1646433 - DNA, 14 bp, Homo sapiens
acagaaatagactt

SEQ ID NO: 1646434 - DNA, 16 bp, Homo sapiens
acagaaattgtatatt

SEQ ID NO: 1646435 - DNA, 13 bp, Homo sapiens
acagaacacttat

SEQ ID NO: 1646436 - DNA, 18 bp, Homo sapiens
acagaaccttcaacccag

SEQ ID NO: 1646437 - DNA, 19 bp, Homo sapiens
acagaactacatatttgtg

SEQ ID NO: 1646438 - DNA, 14 bp, Homo sapiens
acagaacttcagaa

SEQ ID NO: 1646439 - DNA, 22 bp, Homo sapiens
acagaagctcttactctttcct

SEQ ID NO: 1646440 - DNA, 18 bp, Homo sapiens
acagaaggaatctgtgca

SEQ ID NO: 1646441 - DNA, 22 bp, Homo sapiens
acagaaggaatctgtgcagatg

SEQ ID NO: 1646442 - DNA, 15 bp, Homo sapiens
acagaaggactggtg

SEQ ID NO: 1646443 - DNA, 17 bp, Homo sapiens
acagaaggactggtgcg

SEQ ID NO: 1646444 - DNA, 18 bp, Homo sapiens
acagaagtcatgaagccc

SEQ ID NO: 1646445 - DNA, 15 bp, Homo sapiens
acagaataatgaatg

SEQ ID NO: 1646446 - DNA, 16 bp, Homo sapiens
acagaatatgtttcaa

SEQ ID NO: 1646447 - DNA, 19 bp, Homo sapiens
acagaatatttctattgaa

SEQ ID NO: 1646448 - DNA, 15 bp, Homo sapiens
acagaatatttttat

SEQ ID NO: 1646449 - DNA, 16 bp, Homo sapiens
acagaatatttttata

SEQ ID NO: 1646450 - DNA, 22 bp, Homo sapiens
acagaatcatatgattctgctt

SEQ ID NO: 1646451 - DNA, 13 bp, Homo sapiens
acagaatcttctg

SEQ ID NO: 1646452 - DNA, 14 bp, Homo sapiens
acagaatcttctgg

SEQ ID NO: 1646453 - DNA, 13 bp, Homo sapiens
acagaatgtgttc

SEQ ID NO: 1646454 - DNA, 16 bp, Homo sapiens
acagaatgtgttcttt

SEQ ID NO: 1646455 - DNA, 18 bp, Homo sapiens
acagaatgtgttcttttc

SEQ ID NO: 1646456 - DNA, 20 bp, Homo sapiens
acagaattatagatgtctga

SEQ ID NO: 1646457 - DNA, 23 bp, Homo sapiens
acagaatttgaattatcagcaaa

SEQ ID NO: 1646458 - DNA, 13 bp, Homo sapiens
acagaatttgaga

SEQ ID NO: 1646459 - DNA, 14 bp, Homo sapiens
acagaatttgagaa

SEQ ID NO: 1646460 - DNA, 13 bp, Homo sapiens
acagaatttttcc

SEQ ID NO: 1646461 - DNA, 18 bp, Homo sapiens
acagacaaaaacagcctc

SEQ ID NO: 1646462 - DNA, 14 bp, Homo sapiens
acagacaacagaag

SEQ ID NO: 1646463 - DNA, 12 bp, Homo sapiens
acagacaaggtt

SEQ ID NO: 1646464 - DNA, 11 bp, Homo sapiens
acagacacaca

SEQ ID NO: 1646465 - DNA, 14 bp, Homo sapiens
acagacacacacac

SEQ ID NO: 1646466 - DNA, 16 bp, Homo sapiens
acagacacacacacgc

SEQ ID NO: 1646467 - DNA, 18 bp, Homo sapiens
acagacacacacacgcac

SEQ ID NO: 1646468 - DNA, 22 bp, Homo sapiens
acagacacacacacgcacgcac

SEQ ID NO: 1646469 - DNA, 23 bp, Homo sapiens
acagacacacacacgcacgcaca

SEQ ID NO: 1646470 - DNA, 20 bp, Homo sapiens
acagacacgctcgcgggcag

SEQ ID NO: 1646471 - DNA, 16 bp, Homo sapiens
acagacagacacacac

SEQ ID NO: 1646472 - DNA, 14 bp, Homo sapiens
acagacaggagaaa

SEQ ID NO: 1646473 - DNA, 21 bp, Homo sapiens
acagacaggagaaatgcatcc

SEQ ID NO: 1646474 - DNA, 15 bp, Homo sapiens
acagacatctctgca

SEQ ID NO: 1646475 - DNA, 15 bp, Homo sapiens
acagaccacctgctt

SEQ ID NO: 1646476 - DNA, 14 bp, Homo sapiens
acagacccctggga

SEQ ID NO: 1646477 - DNA, 20 bp, Homo sapiens
acagacgttaggcatttcct

SEQ ID NO: 1646478 - DNA, 22 bp, Homo sapiens
acagacgttaggcatttcctgc

SEQ ID NO: 1646479 - DNA, 16 bp, Homo sapiens
acagactatttgctaa

SEQ ID NO: 1646480 - DNA, 14 bp, Homo sapiens
acagactccatctc

SEQ ID NO: 1646481 - DNA, 19 bp, Homo sapiens
acagactgttttactgttt

SEQ ID NO: 1646482 - DNA, 18 bp, Homo sapiens
acagacttcacagcgtct

SEQ ID NO: 1646483 - DNA, 15 bp, Homo sapiens
acagacttctccaga

SEQ ID NO: 1646484 - DNA, 17 bp, Homo sapiens
acagacttctccagacc

SEQ ID NO: 1646485 - DNA, 23 bp, Homo sapiens
acagacttctggaaggctggctg

SEQ ID NO: 1646486 - DNA, 14 bp, Homo sapiens
acagacttgagaac

SEQ ID NO: 1646487 - DNA, 16 bp, Homo sapiens
acagacttgcactgaa

SEQ ID NO: 1646488 - DNA, 21 bp, Homo sapiens
acagactttctgtgacgcaga

SEQ ID NO: 1646489 - DNA, 16 bp, Homo sapiens
acagagaaggcagcag

SEQ ID NO: 1646490 - DNA, 16 bp, Homo sapiens
acagagaaggcaggaa

SEQ ID NO: 1646491 - DNA, 22 bp, Homo sapiens
acagagaagtttgtagccaggt

SEQ ID NO: 1646492 - DNA, 14 bp, Homo sapiens
acagagacacctgc

SEQ ID NO: 1646493 - DNA, 21 bp, Homo sapiens
acagagacacctgcacctccc

SEQ ID NO: 1646494 - DNA, 21 bp, Homo sapiens
acagagacaggcccaagagat

SEQ ID NO: 1646495 - DNA, 23 bp, Homo sapiens
acagagacaggcccaagagatga

SEQ ID NO: 1646496 - DNA, 20 bp, Homo sapiens
acagagacccagatctcatg

SEQ ID NO: 1646497 - DNA, 20 bp, Homo sapiens
acagagactgaatagatatg

SEQ ID NO: 1646498 - DNA, 20 bp, Homo sapiens
acagagagacagacttgaga

SEQ ID NO: 1646499 - DNA, 23 bp, Homo sapiens
acagagagacagacttgagaact

SEQ ID NO: 1646500 - DNA, 16 bp, Homo sapiens
acagagagaggggaga

SEQ ID NO: 1646501 - DNA, 22 bp, Homo sapiens
acagagattactttgctgcctt

SEQ ID NO: 1646502 - DNA, 16 bp, Homo sapiens
acagagcacgcctgcc

SEQ ID NO: 1646503 - DNA, 14 bp, Homo sapiens
acagagccaggaga

SEQ ID NO: 1646504 - DNA, 17 bp, Homo sapiens
acagagccaggagaagc

SEQ ID NO: 1646505 - DNA, 20 bp, Homo sapiens
acagagccattcccttggaa

SEQ ID NO: 1646506 - DNA, 19 bp, Homo sapiens
acagagcgagactccatct

SEQ ID NO: 1646507 - DNA, 21 bp, Homo sapiens
acagagctactgagacttgga

SEQ ID NO: 1646508 - DNA, 12 bp, Homo sapiens
acagagctgtgg

SEQ ID NO: 1646509 - DNA, 12 bp, Homo sapiens
acagagctttcc

SEQ ID NO: 1646510 - DNA, 23 bp, Homo sapiens
acagaggacagtatttgtgggga

SEQ ID NO: 1646511 - DNA, 19 bp, Homo sapiens
acagaggatgccttttctg

SEQ ID NO: 1646512 - DNA, 21 bp, Homo sapiens
acagaggatgccttttctgtg

SEQ ID NO: 1646513 - DNA, 17 bp, Homo sapiens
acagaggccccagcctc

SEQ ID NO: 1646514 - DNA, 22 bp, Homo sapiens
acagaggccccagcctccctga

SEQ ID NO: 1646515 - DNA, 20 bp, Homo sapiens
acagaggccggggtccaggc

SEQ ID NO: 1646516 - DNA, 13 bp, Homo sapiens
acagagggagttt

SEQ ID NO: 1646517 - DNA, 24 bp, Homo sapiens
acagaggtagtctcactgcttgaa

SEQ ID NO: 1646518 - DNA, 19 bp, Homo sapiens
acagaggtattaaaactaa

SEQ ID NO: 1646519 - DNA, 22 bp, Homo sapiens
acagaggttgtagtgagccaag

SEQ ID NO: 1646520 - DNA, 14 bp, Homo sapiens
acagagtaaaagta

SEQ ID NO: 1646521 - DNA, 15 bp, Homo sapiens
acagagtcaaggcct

SEQ ID NO: 1646522 - DNA, 18 bp, Homo sapiens
acagagtcaaggcctgct

SEQ ID NO: 1646523 - DNA, 17 bp, Homo sapiens
acagagtgagccagtga

SEQ ID NO: 1646524 - DNA, 16 bp, Homo sapiens
acagagtggactcttc

SEQ ID NO: 1646525 - DNA, 14 bp, Homo sapiens
acagagtggccgtc

SEQ ID NO: 1646526 - DNA, 19 bp, Homo sapiens
acagagtggcctccctgct

SEQ ID NO: 1646527 - DNA, 20 bp, Homo sapiens
acagagtggcctccctgctg

SEQ ID NO: 1646528 - DNA, 21 bp, Homo sapiens
acagagtggcctccctgctgt

SEQ ID NO: 1646529 - DNA, 15 bp, Homo sapiens
acagagtgggccccg

SEQ ID NO: 1646530 - DNA, 18 bp, Homo sapiens
acagttagggttttgcaa

SEQ ID NO: 1646531 - DNA, 23 bp, Homo sapiens
acagttatatttttgtgttttct

SEQ ID NO: 1646532 - DNA, 16 bp, Homo sapiens
acagttatcaaaaagt

SEQ ID NO: 1646533 - DNA, 13 bp, Homo sapiens
acagttattacat

SEQ ID NO: 1646534 - DNA, 22 bp, Homo sapiens
acagttatttcatcttttattc

SEQ ID NO: 1646535 - DNA, 15 bp, Homo sapiens
acagttattttgata

SEQ ID NO: 1646536 - DNA, 13 bp, Homo sapiens
acagttcaaagaa

SEQ ID NO: 1646537 - DNA, 17 bp, Homo sapiens
acagttcaaagaagtca

SEQ ID NO: 1646538 - DNA, 12 bp, Homo sapiens
acagttcctcgc

SEQ ID NO: 1646539 - DNA, 15 bp, Homo sapiens
acagttctcactggg

SEQ ID NO: 1646540 - DNA, 12 bp, Homo sapiens
acagttctctgt

SEQ ID NO: 1646541 - DNA, 14 bp, Homo sapiens
acagttctgagctg

SEQ ID NO: 1646542 - DNA, 12 bp, Homo sapiens
acagttctgtgg

SEQ ID NO: 1646543 - DNA, 22 bp, Homo sapiens
acagttctgtggtttcatgtta

SEQ ID NO: 1646544 - DNA, 12 bp, Homo sapiens
acagttctttcc

SEQ ID NO: 1646545 - DNA, 18 bp, Homo sapiens
acagttgcagcccttgtg

SEQ ID NO: 1646546 - DNA, 23 bp, Homo sapiens
acagttgcatgtagtaacactaa

SEQ ID NO: 1646547 - DNA, 21 bp, Homo sapiens
acagttggcagagaaggcctc

SEQ ID NO: 1646548 - DNA, 16 bp, Homo sapiens
acagttgtatgtttgc

SEQ ID NO: 1646549 - DNA, 13 bp, Homo sapiens
acagttgtattta

SEQ ID NO: 1646550 - DNA, 18 bp, Homo sapiens
acagttgtatttaacaga

SEQ ID NO: 1646551 - DNA, 19 bp, Homo sapiens
acagttgtctattctgagc

SEQ ID NO: 1646552 - DNA, 23 bp, Homo sapiens
acagttgtctattctgagccttg

SEQ ID NO: 1646553 - DNA, 13 bp, Homo sapiens
acagtttccaaat

SEQ ID NO: 1646554 - DNA, 19 bp, Homo sapiens
acagtttcttgcttggaag

SEQ ID NO: 1646555 - DNA, 16 bp, Homo sapiens
acagtttggggactca

SEQ ID NO: 1646556 - DNA, 13 bp, Homo sapiens
acagttttaactg

SEQ ID NO: 1646557 - DNA, 15 bp, Homo sapiens
acagttttataattt

SEQ ID NO: 1646558 - DNA, 16 bp, Homo sapiens
acagttttctagcaat

SEQ ID NO: 1646559 - DNA, 18 bp, Homo sapiens
acagttttctgagaaaga

SEQ ID NO: 1646560 - DNA, 20 bp, Homo sapiens
acagtttttttctttgtgta

SEQ ID NO: 1646561 - DNA, 19 bp, Homo sapiens
acataaaaacaactttata

SEQ ID NO: 1646562 - DNA, 21 bp, Homo sapiens
acataaaaacaactttatacc

SEQ ID NO: 1646563 - DNA, 21 bp, Homo sapiens
acataaaaagcagaattttaa

SEQ ID NO: 1646564 - DNA, 18 bp, Homo sapiens
acataaaagccccagctt

SEQ ID NO: 1646565 - DNA, 17 bp, Homo sapiens
acataaaatctgtgaat

SEQ ID NO: 1646566 - DNA, 18 bp, Homo sapiens
acataaagcaaatagaca

SEQ ID NO: 1646567 - DNA, 15 bp, Homo sapiens
acataaagttgtatt

SEQ ID NO: 1646568 - DNA, 17 bp, Homo sapiens
acataaatctgtctgat

SEQ ID NO: 1646569 - DNA, 22 bp, Homo sapiens
acataaatctgtctgattctat

SEQ ID NO: 1646570 - DNA, 13 bp, Homo sapiens
acataaattagag

SEQ ID NO: 1646571 - DNA, 14 bp, Homo sapiens
acataacaaagggc

SEQ ID NO: 1646572 - DNA, 21 bp, Homo sapiens
acataacaaagggcagccctc

SEQ ID NO: 1646573 - DNA, 20 bp, Homo sapiens
acataactgaaaatgtgcta

SEQ ID NO: 1646574 - DNA, 21 bp, Homo sapiens
acataactgcttcttggagct

SEQ ID NO: 1646575 - DNA, 12 bp, Homo sapiens
acataagaaggc

SEQ ID NO: 1646576 - DNA, 14 bp, Homo sapiens
acataagaaggcaa

SEQ ID NO: 1646577 - DNA, 14 bp, Homo sapiens
acataagagaaaga

SEQ ID NO: 1646578 - DNA, 15 bp, Homo sapiens
acataagcttccatt

SEQ ID NO: 1646579 - DNA, 15 bp, Homo sapiens
acataaggatgactt

SEQ ID NO: 1646580 - DNA, 13 bp, Homo sapiens
acataaggctgga

SEQ ID NO: 1646581 - DNA, 21 bp, Homo sapiens
acataagtaattcaagaaaac

SEQ ID NO: 1646582 - DNA, 17 bp, Homo sapiens
acataataaaaaattat

SEQ ID NO: 1646583 - DNA, 20 bp, Homo sapiens
acataatgtattgttggtaa

SEQ ID NO: 1646584 - DNA, 21 bp, Homo sapiens
acataattaacacttaaggtt

SEQ ID NO: 1646585 - DNA, 23 bp, Homo sapiens
acataattgtgaccaatacattt

SEQ ID NO: 1646586 - DNA, 13 bp, Homo sapiens
acatacaagaaaa

SEQ ID NO: 1646587 - DNA, 14 bp, Homo sapiens
acatacaagaaaat

SEQ ID NO: 1646588 - DNA, 16 bp, Homo sapiens
acatacaagaaaatgt

SEQ ID NO: 1646589 - DNA, 23 bp, Homo sapiens
acatacagaggatgccttttctg

SEQ ID NO: 1646590 - DNA, 23 bp, Homo sapiens
acatacagagtgggccccgggct

SEQ ID NO: 1646591 - DNA, 12 bp, Homo sapiens
acatacagattt

SEQ ID NO: 1646592 - DNA, 14 bp, Homo sapiens
acataccctccccc

SEQ ID NO: 1646593 - DNA, 21 bp, Homo sapiens
acataccctggccgccccctg

SEQ ID NO: 1646594 - DNA, 14 bp, Homo sapiens
acatacgaaacaca

SEQ ID NO: 1646595 - DNA, 15 bp, Homo sapiens
acatacgatttaagg

SEQ ID NO: 1646596 - DNA, 19 bp, Homo sapiens
acatacgatttaaggtatt

SEQ ID NO: 1646597 - DNA, 13 bp, Homo sapiens
acatacgtgcaca

SEQ ID NO: 1646598 - DNA, 15 bp, Homo sapiens
acatacgtgtgcatg

SEQ ID NO: 1646599 - DNA, 22 bp, Homo sapiens
acatacgtgtgcatgtgtcttt

SEQ ID NO: 1646600 - DNA, 24 bp, Homo sapiens
acatacgtgttaggaggctgcatg

SEQ ID NO: 1646601 - DNA, 17 bp, Homo sapiens
acatactccccaattta

SEQ ID NO: 1646602 - DNA, 24 bp, Homo sapiens
acatactccttccatcaaatagaa

SEQ ID NO: 1646603 - DNA, 13 bp, Homo sapiens
acatactgcatgt

SEQ ID NO: 1646604 - DNA, 19 bp, Homo sapiens
acatactgcatgtaagcca

SEQ ID NO: 1646605 - DNA, 12 bp, Homo sapiens
acatactgctgt

SEQ ID NO: 1646606 - DNA, 16 bp, Homo sapiens
acatacttgaagggcc

SEQ ID NO: 1646607 - DNA, 19 bp, Homo sapiens
acatacttgaagggccaga

SEQ ID NO: 1646608 - DNA, 20 bp, Homo sapiens
acatacttgaagggccagag

SEQ ID NO: 1646609 - DNA, 20 bp, Homo sapiens
acatagaaatggaaattttg

SEQ ID NO: 1646610 - DNA, 22 bp, Homo sapiens
acatagaaatggaaattttgct

SEQ ID NO: 1646611 - DNA, 13 bp, Homo sapiens
acatagaccctct

SEQ ID NO: 1646612 - DNA, 22 bp, Homo sapiens
acatagaccctctttcttgttt

SEQ ID NO: 1646613 - DNA, 22 bp, Homo sapiens
acatagacttaggcattaacat

SEQ ID NO: 1646614 - DNA, 15 bp, Homo sapiens
acatagagcaatgtt

SEQ ID NO: 1646615 - DNA, 22 bp, Homo sapiens
acatagagctttttaatagcac

SEQ ID NO: 1646616 - DNA, 13 bp, Homo sapiens
acatagatgtccc

SEQ ID NO: 1646617 - DNA, 15 bp, Homo sapiens
acatagatgtccctt

SEQ ID NO: 1646618 - DNA, 14 bp, Homo sapiens
acatagattaatgg

SEQ ID NO: 1646619 - DNA, 16 bp, Homo sapiens
acatagcatgacattt

SEQ ID NO: 1646620 - DNA, 17 bp, Homo sapiens
acatagccctaactcct

SEQ ID NO: 1646621 - DNA, 21 bp, Homo sapiens
acataggcttcaattggtgga

SEQ ID NO: 1646622 - DNA, 20 bp, Homo sapiens
acataggtctgtatggctgt

SEQ ID NO: 1646623 - DNA, 18 bp, Homo sapiens
acatagtaaagtattttt

SEQ ID NO: 1646624 - DNA, 18 bp, Homo sapiens
acatagtgaaaattgttt

SEQ ID NO: 1646625 - DNA, 21 bp, Homo sapiens
acatagtgatggttcccctgt

SEQ ID NO: 1646626 - DNA, 15 bp, Homo sapiens
acatagttatttatt

SEQ ID NO: 1646627 - DNA, 14 bp, Homo sapiens
acatatacatatga

SEQ ID NO: 1646628 - DNA, 17 bp, Homo sapiens
acatatatatatataac

SEQ ID NO: 1646629 - DNA, 23 bp, Homo sapiens
acatatatatatatttttttttg

SEQ ID NO: 1646630 - DNA, 20 bp, Homo sapiens
acatatatatattttttaat

SEQ ID NO: 1646631 - DNA, 14 bp, Homo sapiens
acatatatattaca

SEQ ID NO: 1646632 - DNA, 20 bp, Homo sapiens
acatatatgtataatatata

SEQ ID NO: 1646633 - DNA, 22 bp, Homo sapiens
acatatatgtataatatatatc

SEQ ID NO: 1646634 - DNA, 23 bp, Homo sapiens
acatatatgtataatatatatct

SEQ ID NO: 1646635 - DNA, 14 bp, Homo sapiens
acatatatttattg

SEQ ID NO: 1646636 - DNA, 18 bp, Homo sapiens
acatatccaaaataatga

SEQ ID NO: 1646637 - DNA, 22 bp, Homo sapiens
acatatctagtatgaaattata

SEQ ID NO: 1646638 - DNA, 13 bp, Homo sapiens
acatatgaacaca

SEQ ID NO: 1646639 - DNA, 14 bp, Homo sapiens
acatatgacttgat

SEQ ID NO: 1646640 - DNA, 21 bp, Homo sapiens
acatatgagaatataccttat

SEQ ID NO: 1646641 - DNA, 24 bp, Homo sapiens
acatatgctgatcttttaaaatca

SEQ ID NO: 1646642 - DNA, 13 bp, Homo sapiens
acatatgtaaaat

SEQ ID NO: 1646643 - DNA, 16 bp, Homo sapiens
acatatgtatacatgt

SEQ ID NO: 1646644 - DNA, 14 bp, Homo sapiens
acatattcatgaaa

SEQ ID NO: 1646645 - DNA, 18 bp, Homo sapiens
acattctaaagagagtga

SEQ ID NO: 1646646 - DNA, 22 bp, Homo sapiens
acattctattttgggtattaat

SEQ ID NO: 1646647 - DNA, 22 bp, Homo sapiens
acattctctaggagaaacttag

SEQ ID NO: 1646648 - DNA, 13 bp, Homo sapiens
acattctctttga

SEQ ID NO: 1646649 - DNA, 16 bp, Homo sapiens
acattctctttgataa

SEQ ID NO: 1646650 - DNA, 21 bp, Homo sapiens
acattctctttgataacaaaa

SEQ ID NO: 1646651 - DNA, 19 bp, Homo sapiens
acattctgatttggaaaaa

SEQ ID NO: 1646652 - DNA, 19 bp, Homo sapiens
acattctgcctagagtgta

SEQ ID NO: 1646653 - DNA, 22 bp, Homo sapiens
acattctgcctagagtgtagcc

SEQ ID NO: 1646654 - DNA, 20 bp, Homo sapiens
acattctggggaaacaacat

SEQ ID NO: 1646655 - DNA, 23 bp, Homo sapiens
acattctggggaaacaacattta

SEQ ID NO: 1646656 - DNA, 14 bp, Homo sapiens
acattcttcaaaga

SEQ ID NO: 1646657 - DNA, 14 bp, Homo sapiens
acattcttccatca

SEQ ID NO: 1646658 - DNA, 22 bp, Homo sapiens
acattcttggcttaatcatttt

SEQ ID NO: 1646659 - DNA, 23 bp, Homo sapiens
acattcttggcttaatcattttc

SEQ ID NO: 1646660 - DNA, 18 bp, Homo sapiens
acattctttttgctctaa

SEQ ID NO: 1646661 - DNA, 15 bp, Homo sapiens
acattgaaaacagat

SEQ ID NO: 1646662 - DNA, 15 bp, Homo sapiens
acattgaagtaatga

SEQ ID NO: 1646663 - DNA, 20 bp, Homo sapiens
acattgaagtaatgaatttt

SEQ ID NO: 1646664 - DNA, 18 bp, Homo sapiens
acattgaatggatcaata

SEQ ID NO: 1646665 - DNA, 20 bp, Homo sapiens
acattgaatggatcaataca

SEQ ID NO: 1646666 - DNA, 16 bp, Homo sapiens
acattgaccaagaact

SEQ ID NO: 1646667 - DNA, 20 bp, Homo sapiens
acattgaccaagaactgcat

SEQ ID NO: 1646668 - DNA, 16 bp, Homo sapiens
acattgacttcttggt

SEQ ID NO: 1646669 - DNA, 22 bp, Homo sapiens
acattgagggaacacaaattta

SEQ ID NO: 1646670 - DNA, 16 bp, Homo sapiens
acattgattcagcctg

SEQ ID NO: 1646671 - DNA, 20 bp, Homo sapiens
acattgcccatggctgggaa

SEQ ID NO: 1646672 - DNA, 13 bp, Homo sapiens
acattgcctgttc

SEQ ID NO: 1646673 - DNA, 15 bp, Homo sapiens
acattgcctgttctg

SEQ ID NO: 1646674 - DNA, 19 bp, Homo sapiens
acattgcctgttctgcttc

SEQ ID NO: 1646675 - DNA, 21 bp, Homo sapiens
acattgcctgttctgcttcga

SEQ ID NO: 1646676 - DNA, 21 bp, Homo sapiens
acattgctctatgtctgcctt

SEQ ID NO: 1646677 - DNA, 15 bp, Homo sapiens
acattgctctctggg

SEQ ID NO: 1646678 - DNA, 12 bp, Homo sapiens
acattgctgtat

SEQ ID NO: 1646679 - DNA, 18 bp, Homo sapiens
acattgctttactgtcaa

SEQ ID NO: 1646680 - DNA, 15 bp, Homo sapiens
acattggaaagcaca

SEQ ID NO: 1646681 - DNA, 21 bp, Homo sapiens
acattggcacctaatccaggc

SEQ ID NO: 1646682 - DNA, 22 bp, Homo sapiens
acattggcacctaatccaggca

SEQ ID NO: 1646683 - DNA, 21 bp, Homo sapiens
acattggtgaaggatccagga

SEQ ID NO: 1646684 - DNA, 23 bp, Homo sapiens
acattggtgaaggatccaggaat

SEQ ID NO: 1646685 - DNA, 14 bp, Homo sapiens
acattgtaaaataa

SEQ ID NO: 1646686 - DNA, 13 bp, Homo sapiens
acattgtactgtt

SEQ ID NO: 1646687 - DNA, 15 bp, Homo sapiens
acattgtcatttata

SEQ ID NO: 1646688 - DNA, 19 bp, Homo sapiens
acattgtcatttatataga

SEQ ID NO: 1646689 - DNA, 15 bp, Homo sapiens
acattgtcctgtagc

SEQ ID NO: 1646690 - DNA, 22 bp, Homo sapiens
acattgtctcctatatatttct

SEQ ID NO: 1646691 - DNA, 13 bp, Homo sapiens
acattgtgactgt

SEQ ID NO: 1646692 - DNA, 19 bp, Homo sapiens
acattgtgtgaaaaaagaa

SEQ ID NO: 1646693 - DNA, 22 bp, Homo sapiens
acattgtgtgaaaaaagaaaat

SEQ ID NO: 1646694 - DNA, 20 bp, Homo sapiens
acattgttctttccggccaa

SEQ ID NO: 1646695 - DNA, 20 bp, Homo sapiens
acattgttgtttttttaata

SEQ ID NO: 1646696 - DNA, 17 bp, Homo sapiens
acattgtttgctgctat

SEQ ID NO: 1646697 - DNA, 18 bp, Homo sapiens
acattgttttaaaaagaa

SEQ ID NO: 1646698 - DNA, 14 bp, Homo sapiens
acatttaataaaac

SEQ ID NO: 1646699 - DNA, 16 bp, Homo sapiens
acatttaatatcttca

SEQ ID NO: 1646700 - DNA, 14 bp, Homo sapiens
acatttacatgtat

SEQ ID NO: 1646701 - DNA, 13 bp, Homo sapiens
acatttagaaaag

SEQ ID NO: 1646702 - DNA, 17 bp, Homo sapiens
acatttagaaaagtgaa

SEQ ID NO: 1646703 - DNA, 22 bp, Homo sapiens
acatttagaaaagtgaattgaa

SEQ ID NO: 1646704 - DNA, 16 bp, Homo sapiens
acatttagaagaaaga

SEQ ID NO: 1646705 - DNA, 20 bp, Homo sapiens
acatttagctgtgctcagaa

SEQ ID NO: 1646706 - DNA, 22 bp, Homo sapiens
acatttatcaatcagtataatt

SEQ ID NO: 1646707 - DNA, 23 bp, Homo sapiens
acatttatcaatcagtataattc

SEQ ID NO: 1646708 - DNA, 14 bp, Homo sapiens
acatttcaaagctg

SEQ ID NO: 1646709 - DNA, 18 bp, Homo sapiens
acatttcatacaacagaa

SEQ ID NO: 1646710 - DNA, 12 bp, Homo sapiens
acatttctataa

SEQ ID NO: 1646711 - DNA, 14 bp, Homo sapiens
acatttctctaact

SEQ ID NO: 1646712 - DNA, 14 bp, Homo sapiens
acatttctctgagc

SEQ ID NO: 1646713 - DNA, 14 bp, Homo sapiens
acatttctggacag

SEQ ID NO: 1646714 - DNA, 13 bp, Homo sapiens
acatttctggatt

SEQ ID NO: 1646715 - DNA, 16 bp, Homo sapiens
acatttcttgttgata

SEQ ID NO: 1646716 - DNA, 17 bp, Homo sapiens
acatttgatatttttcc

SEQ ID NO: 1646717 - DNA, 19 bp, Homo sapiens
acatttgatatttttccat

SEQ ID NO: 1646718 - DNA, 17 bp, Homo sapiens
acatttgatgcatgtct

SEQ ID NO: 1646719 - DNA, 22 bp, Homo sapiens
acatttgatggagggtggaaat

SEQ ID NO: 1646720 - DNA, 12 bp, Homo sapiens
acatttgatgta

SEQ ID NO: 1646721 - DNA, 18 bp, Homo sapiens
acatttgatgtacatgtg

SEQ ID NO: 1646722 - DNA, 19 bp, Homo sapiens
acatttgctactgttgtaa

SEQ ID NO: 1646723 - DNA, 19 bp, Homo sapiens
acatttgctgaactcagca

SEQ ID NO: 1646724 - DNA, 21 bp, Homo sapiens
acatttgctgaactcagcaca

SEQ ID NO: 1646725 - DNA, 15 bp, Homo sapiens
acatttgctgccatt

SEQ ID NO: 1646726 - DNA, 23 bp, Homo sapiens
acatttgctgttttaaacattaa

SEQ ID NO: 1646727 - DNA, 14 bp, Homo sapiens
acatttgggctcag

SEQ ID NO: 1646728 - DNA, 17 bp, Homo sapiens
acatttgggctcagggt

SEQ ID NO: 1646729 - DNA, 14 bp, Homo sapiens
acatttggtaatgt

SEQ ID NO: 1646730 - DNA, 23 bp, Homo sapiens
acatttggtggtactttattctt

SEQ ID NO: 1646731 - DNA, 13 bp, Homo sapiens
acatttgtatatt

SEQ ID NO: 1646732 - DNA, 19 bp, Homo sapiens
acatttgtattttgtgatg

SEQ ID NO: 1646733 - DNA, 18 bp, Homo sapiens
acatttgtcactgaataa

SEQ ID NO: 1646734 - DNA, 15 bp, Homo sapiens
acatttgtcagtatt

SEQ ID NO: 1646735 - DNA, 16 bp, Homo sapiens
acatttgtcagtattt

SEQ ID NO: 1646736 - DNA, 13 bp, Homo sapiens
acatttgttcctg

SEQ ID NO: 1646737 - DNA, 14 bp, Homo sapiens
acatttgttcctgg

SEQ ID NO: 1646738 - DNA, 17 bp, Homo sapiens
acatttgtttgtattca

SEQ ID NO: 1646739 - DNA, 18 bp, Homo sapiens
acattttaaaaacataga

SEQ ID NO: 1646740 - DNA, 23 bp, Homo sapiens
acattttaaaaacatagaaaaat

SEQ ID NO: 1646741 - DNA, 16 bp, Homo sapiens
acattttaaatactct

SEQ ID NO: 1646742 - DNA, 21 bp, Homo sapiens
acattttaaatactctactta

SEQ ID NO: 1646743 - DNA, 18 bp, Homo sapiens
acattttactttttcctg

SEQ ID NO: 1646744 - DNA, 18 bp, Homo sapiens
acattttagtttctaaag

SEQ ID NO: 1646745 - DNA, 10 bp, Homo sapiens
acattttata

SEQ ID NO: 1646746 - DNA, 19 bp, Homo sapiens
acattttatcattaaaaat

SEQ ID NO: 1646747 - DNA, 22 bp, Homo sapiens
acattttatcattaaaaattac

SEQ ID NO: 1646748 - DNA, 13 bp, Homo sapiens
acattttattaag

SEQ ID NO: 1646749 - DNA, 22 bp, Homo sapiens
acattttcactggaagatttat

SEQ ID NO: 1646750 - DNA, 12 bp, Homo sapiens
acattttccttt

SEQ ID NO: 1646751 - DNA, 19 bp, Homo sapiens
acattttctaaataaaaat

SEQ ID NO: 1646752 - DNA, 18 bp, Homo sapiens
acattttctcttagaaaa

SEQ ID NO: 1646753 - DNA, 17 bp, Homo sapiens
acattttcttaatccag

SEQ ID NO: 1646754 - DNA, 19 bp, Homo sapiens
acattttctttttttaact

SEQ ID NO: 1646755 - DNA, 18 bp, Homo sapiens
acattttgtatattaact

SEQ ID NO: 1646756 - DNA, 17 bp, Homo sapiens
acattttgtatggagtt

SEQ ID NO: 1646757 - DNA, 15 bp, Homo sapiens
acattttgttacata

SEQ ID NO: 1646758 - DNA, 16 bp, Homo sapiens
acatttttatacctgt

SEQ ID NO: 1646759 - DNA, 11 bp, Homo sapiens
accagccagcg

SEQ ID NO: 1646760 - DNA, 16 bp, Homo sapiens
accagccccactgcca

SEQ ID NO: 1646761 - DNA, 21 bp, Homo sapiens
accagccccactgccagcagc

SEQ ID NO: 1646762 - DNA, 18 bp, Homo sapiens
accagccccccgcgcgcc

SEQ ID NO: 1646763 - DNA, 14 bp, Homo sapiens
accagccccctgga

SEQ ID NO: 1646764 - DNA, 18 bp, Homo sapiens
accagcccgacagtgcca

SEQ ID NO: 1646765 - DNA, 22 bp, Homo sapiens
accagcccgacagtgccatccc

SEQ ID NO: 1646766 - DNA, 14 bp, Homo sapiens
accagccctagctg

SEQ ID NO: 1646767 - DNA, 15 bp, Homo sapiens
accagccgctgcagg

SEQ ID NO: 1646768 - DNA, 13 bp, Homo sapiens
accagcctgctga

SEQ ID NO: 1646769 - DNA, 14 bp, Homo sapiens
accagcctggccaa

SEQ ID NO: 1646770 - DNA, 18 bp, Homo sapiens
accagcctggccaacatg

SEQ ID NO: 1646771 - DNA, 20 bp, Homo sapiens
accagcctggccaacatggt

SEQ ID NO: 1646772 - DNA, 13 bp, Homo sapiens
accagcctgggca

SEQ ID NO: 1646773 - DNA, 13 bp, Homo sapiens
accagcctgtacc

SEQ ID NO: 1646774 - DNA, 18 bp, Homo sapiens
accagcctgtaccttgct

SEQ ID NO: 1646775 - DNA, 13 bp, Homo sapiens
accagcctgtcca

SEQ ID NO: 1646776 - DNA, 22 bp, Homo sapiens
accagccttcctgtgggcccct

SEQ ID NO: 1646777 - DNA, 13 bp, Homo sapiens
accagcctttggg

SEQ ID NO: 1646778 - DNA, 19 bp, Homo sapiens
accagcctttgggtcctgg

SEQ ID NO: 1646779 - DNA, 23 bp, Homo sapiens
accagcctttgggtcctgggcag

SEQ ID NO: 1646780 - DNA, 15 bp, Homo sapiens
accagcgcccgctgg

SEQ ID NO: 1646781 - DNA, 20 bp, Homo sapiens
accagctaaggagtccctgg

SEQ ID NO: 1646782 - DNA, 14 bp, Homo sapiens
accagctcaggaca

SEQ ID NO: 1646783 - DNA, 20 bp, Homo sapiens
accagctcccaacagaggcc

SEQ ID NO: 1646784 - DNA, 20 bp, Homo sapiens
accagctcgtgggctgggaa

SEQ ID NO: 1646785 - DNA, 16 bp, Homo sapiens
accagctctcttcctg

SEQ ID NO: 1646786 - DNA, 12 bp, Homo sapiens
accagctctgtg

SEQ ID NO: 1646787 - DNA, 13 bp, Homo sapiens
accagctctgtgg

SEQ ID NO: 1646788 - DNA, 16 bp, Homo sapiens
accagctctgtggcct

SEQ ID NO: 1646789 - DNA, 19 bp, Homo sapiens
accagctctgtggcctgtg

SEQ ID NO: 1646790 - DNA, 23 bp, Homo sapiens
accagctgaagttgcagatgtta

SEQ ID NO: 1646791 - DNA, 13 bp, Homo sapiens
accagctgctctg

SEQ ID NO: 1646792 - DNA, 18 bp, Homo sapiens
accagctgctctgcccct

SEQ ID NO: 1646793 - DNA, 14 bp, Homo sapiens
accagctgctgctg

SEQ ID NO: 1646794 - DNA, 20 bp, Homo sapiens
accagctggggcgtggggag

SEQ ID NO: 1646795 - DNA, 21 bp, Homo sapiens
accagctggggcgtggggagg

SEQ ID NO: 1646796 - DNA, 12 bp, Homo sapiens
accaggaccctg

SEQ ID NO: 1646797 - DNA, 16 bp, Homo sapiens
accaggactccctcct

SEQ ID NO: 1646798 - DNA, 18 bp, Homo sapiens
accaggagaaccactaca

SEQ ID NO: 1646799 - DNA, 19 bp, Homo sapiens
accaggagaaccactacat

SEQ ID NO: 1646800 - DNA, 12 bp, Homo sapiens
accaggagacag

SEQ ID NO: 1646801 - DNA, 14 bp, Homo sapiens
accaggagcagcag

SEQ ID NO: 1646802 - DNA, 17 bp, Homo sapiens
accaggagcagcagcca

SEQ ID NO: 1646803 - DNA, 18 bp, Homo sapiens
accaggagcagcagccag

SEQ ID NO: 1646804 - DNA, 21 bp, Homo sapiens
accaggagctagcccagtccc

SEQ ID NO: 1646805 - DNA, 15 bp, Homo sapiens
accaggcaaattcac

SEQ ID NO: 1646806 - DNA, 18 bp, Homo sapiens
accaggcaacctcccatc

SEQ ID NO: 1646807 - DNA, 19 bp, Homo sapiens
accaggcaacctcccatcc

SEQ ID NO: 1646808 - DNA, 17 bp, Homo sapiens
accaggcacctcttcct

SEQ ID NO: 1646809 - DNA, 16 bp, Homo sapiens
accaggcctggcctct

SEQ ID NO: 1646810 - DNA, 18 bp, Homo sapiens
accaggcctggcctctgg

SEQ ID NO: 1646811 - DNA, 19 bp, Homo sapiens
accaggcctggcctctggg

SEQ ID NO: 1646812 - DNA, 22 bp, Homo sapiens
accaggcctggcctctgggcag

SEQ ID NO: 1646813 - DNA, 15 bp, Homo sapiens
accaggctgcagcct

SEQ ID NO: 1646814 - DNA, 19 bp, Homo sapiens
accaggctggacaccctct

SEQ ID NO: 1646815 - DNA, 21 bp, Homo sapiens
accaggctggacaccctctgc

SEQ ID NO: 1646816 - DNA, 17 bp, Homo sapiens
accaggctggcgcagcc

SEQ ID NO: 1646817 - DNA, 14 bp, Homo sapiens
accagggacacctc

SEQ ID NO: 1646818 - DNA, 16 bp, Homo sapiens
accagggaggagagga

SEQ ID NO: 1646819 - DNA, 23 bp, Homo sapiens
accagggatgctgggctgggccc

SEQ ID NO: 1646820 - DNA, 16 bp, Homo sapiens
accagggccttttctg

SEQ ID NO: 1646821 - DNA, 22 bp, Homo sapiens
accagggcgaacgacaatagct

SEQ ID NO: 1646822 - DNA, 15 bp, Homo sapiens
accaggggaggagcc

SEQ ID NO: 1646823 - DNA, 14 bp, Homo sapiens
accaggggtttctc

SEQ ID NO: 1646824 - DNA, 19 bp, Homo sapiens
accagggtccgcaccagct

SEQ ID NO: 1646825 - DNA, 21 bp, Homo sapiens
accagggtccttttgacactg

SEQ ID NO: 1646826 - DNA, 17 bp, Homo sapiens
accaggtccagatgtgc

SEQ ID NO: 1646827 - DNA, 16 bp, Homo sapiens
accaggtgagaagtga

SEQ ID NO: 1646828 - DNA, 22 bp, Homo sapiens
accaggtgggagcgttttgttg

SEQ ID NO: 1646829 - DNA, 19 bp, Homo sapiens
accaggtgttctacactca

SEQ ID NO: 1646830 - DNA, 20 bp, Homo sapiens
accaggtgttctacactcat

SEQ ID NO: 1646831 - DNA, 14 bp, Homo sapiens
accaggttgaaaga

SEQ ID NO: 1646832 - DNA, 16 bp, Homo sapiens
accaggtttcattttg

SEQ ID NO: 1646833 - DNA, 20 bp, Homo sapiens
accagtatcgctcatagatc

SEQ ID NO: 1646834 - DNA, 19 bp, Homo sapiens
accagtatttagaagccaa

SEQ ID NO: 1646835 - DNA, 15 bp, Homo sapiens
accagtccccccacc

SEQ ID NO: 1646836 - DNA, 13 bp, Homo sapiens
accagtgaaagaa

SEQ ID NO: 1646837 - DNA, 22 bp, Homo sapiens
accagtgagaactctctccctg

SEQ ID NO: 1646838 - DNA, 11 bp, Homo sapiens
accagtggccg

SEQ ID NO: 1646839 - DNA, 15 bp, Homo sapiens
accagtggctggtct

SEQ ID NO: 1646840 - DNA, 23 bp, Homo sapiens
accagtggtgctcaatgcaaata

SEQ ID NO: 1646841 - DNA, 13 bp, Homo sapiens
accagtgtacagg

SEQ ID NO: 1646842 - DNA, 14 bp, Homo sapiens
accagtgtacaggt

SEQ ID NO: 1646843 - DNA, 19 bp, Homo sapiens
accagtgtacaggtcaccc

SEQ ID NO: 1646844 - DNA, 19 bp, Homo sapiens
accagtgttgggttttttt

SEQ ID NO: 1646845 - DNA, 15 bp, Homo sapiens
accagttaaagccac

SEQ ID NO: 1646846 - DNA, 18 bp, Homo sapiens
accagttaaagccacaga

SEQ ID NO: 1646847 - DNA, 12 bp, Homo sapiens
accagttaattt

SEQ ID NO: 1646848 - DNA, 13 bp, Homo sapiens
accagttaatttt

SEQ ID NO: 1646849 - DNA, 16 bp, Homo sapiens
accagttaatttttcc

SEQ ID NO: 1646850 - DNA, 16 bp, Homo sapiens
accagttctcatgggt

SEQ ID NO: 1646851 - DNA, 21 bp, Homo sapiens
accagttctcatgggtggcac

SEQ ID NO: 1646852 - DNA, 13 bp, Homo sapiens
accagttgccttt

SEQ ID NO: 1646853 - DNA, 15 bp, Homo sapiens
accagttgcctttta

SEQ ID NO: 1646854 - DNA, 16 bp, Homo sapiens
accagttggccatgat

SEQ ID NO: 1646855 - DNA, 19 bp, Homo sapiens
accagttgggagcactgga

SEQ ID NO: 1646856 - DNA, 18 bp, Homo sapiens
accagtttgtccatcttg

SEQ ID NO: 1646857 - DNA, 23 bp, Homo sapiens
accataacaccgtcccagggctc

SEQ ID NO: 1646858 - DNA, 22 bp, Homo sapiens
accataagtgacaccaataaat

SEQ ID NO: 1646859 - DNA, 16 bp, Homo sapiens
accataatcctagccc

SEQ ID NO: 1646860 - DNA, 15 bp, Homo sapiens
accataatgttacat

SEQ ID NO: 1646861 - DNA, 13 bp, Homo sapiens
accatacccagct

SEQ ID NO: 1646862 - DNA, 17 bp, Homo sapiens
accataccttccttccc

SEQ ID NO: 1646863 - DNA, 18 bp, Homo sapiens
accatactccttgcttcc

SEQ ID NO: 1646864 - DNA, 18 bp, Homo sapiens
accatagtgtcacagaga

SEQ ID NO: 1646865 - DNA, 21 bp, Homo sapiens
accatagtgtcacagagagct

SEQ ID NO: 1646866 - DNA, 18 bp, Homo sapiens
accatagttactgtaaaa

SEQ ID NO: 1646867 - DNA, 22 bp, Homo sapiens
accatagttactgtaaaatgca

SEQ ID NO: 1646868 - DNA, 13 bp, Homo sapiens
accatatgatact

SEQ ID NO: 1646869 - DNA, 18 bp, Homo sapiens
accatatgattgaaaaga

SEQ ID NO: 1646870 - DNA, 14 bp, Homo sapiens
accatcaaggcggg

SEQ ID NO: 1646871 - DNA, 18 bp, Homo sapiens
accatccaccttcccttc

SEQ ID NO: 1646872 - DNA, 22 bp, Homo sapiens
accatccactctaccctcccac

SEQ ID NO: 1646873 - DNA, 17 bp, Homo sapiens
accatccccaactccat

SEQ ID NO: 1646874 - DNA, 21 bp, Homo sapiens
accccagcctggccacgcagc

SEQ ID NO: 1646875 - DNA, 13 bp, Homo sapiens
accccagctggga

SEQ ID NO: 1646876 - DNA, 17 bp, Homo sapiens
accccagctgggaggca

SEQ ID NO: 1646877 - DNA, 21 bp, Homo sapiens
accccaggacctcttctggag

SEQ ID NO: 1646878 - DNA, 19 bp, Homo sapiens
accccaggtttttcatctg

SEQ ID NO: 1646879 - DNA, 16 bp, Homo sapiens
accccatccagccaga

SEQ ID NO: 1646880 - DNA, 17 bp, Homo sapiens
accccatccctccccag

SEQ ID NO: 1646881 - DNA, 19 bp, Homo sapiens
accccatggagctgggcta

SEQ ID NO: 1646882 - DNA, 14 bp, Homo sapiens
accccatgggcttg

SEQ ID NO: 1646883 - DNA, 17 bp, Homo sapiens
accccatgggcttggac

SEQ ID NO: 1646884 - DNA, 16 bp, Homo sapiens
acccccaaattttctt

SEQ ID NO: 1646885 - DNA, 19 bp, Homo sapiens
acccccaagcttccacctg

SEQ ID NO: 1646886 - DNA, 17 bp, Homo sapiens
acccccacacctcagtt

SEQ ID NO: 1646887 - DNA, 14 bp, Homo sapiens
acccccaccccaca

SEQ ID NO: 1646888 - DNA, 17 bp, Homo sapiens
acccccactctcattcc

SEQ ID NO: 1646889 - DNA, 18 bp, Homo sapiens
acccccactctcattccc

SEQ ID NO: 1646890 - DNA, 22 bp, Homo sapiens
acccccactctcattccccagg

SEQ ID NO: 1646891 - DNA, 19 bp, Homo sapiens
acccccagctaataaacca

SEQ ID NO: 1646892 - DNA, 16 bp, Homo sapiens
acccccagctttgcta

SEQ ID NO: 1646893 - DNA, 17 bp, Homo sapiens
acccccaggcctgtcca

SEQ ID NO: 1646894 - DNA, 17 bp, Homo sapiens
acccccaggtggcctgc

SEQ ID NO: 1646895 - DNA, 18 bp, Homo sapiens
acccccaggtggcctgcg

SEQ ID NO: 1646896 - DNA, 15 bp, Homo sapiens
acccccatccagcct

SEQ ID NO: 1646897 - DNA, 23 bp, Homo sapiens
acccccatccagcctccagggca

SEQ ID NO: 1646898 - DNA, 17 bp, Homo sapiens
acccccatccctcggga

SEQ ID NO: 1646899 - DNA, 20 bp, Homo sapiens
acccccatggccccaggccc

SEQ ID NO: 1646900 - DNA, 17 bp, Homo sapiens
acccccatttctattta

SEQ ID NO: 1646901 - DNA, 18 bp, Homo sapiens
acccccatttctatttat

SEQ ID NO: 1646902 - DNA, 14 bp, Homo sapiens
accccccaagctgt

SEQ ID NO: 1646903 - DNA, 12 bp, Homo sapiens
accccccacctg

SEQ ID NO: 1646904 - DNA, 18 bp, Homo sapiens
accccccagaacctgtcc

SEQ ID NO: 1646905 - DNA, 21 bp, Homo sapiens
accccccagctcgctggcttt

SEQ ID NO: 1646906 - DNA, 18 bp, Homo sapiens
acccccccccaatcggac

SEQ ID NO: 1646907 - DNA, 14 bp, Homo sapiens
acccccctcctgct

SEQ ID NO: 1646908 - DNA, 19 bp, Homo sapiens
acccccctctctttctctg

SEQ ID NO: 1646909 - DNA, 21 bp, Homo sapiens
acccccctctctttctctggt

SEQ ID NO: 1646910 - DNA, 17 bp, Homo sapiens
acccccgccacctcagg

SEQ ID NO: 1646911 - DNA, 19 bp, Homo sapiens
acccccgccacctcagggc

SEQ ID NO: 1646912 - DNA, 14 bp, Homo sapiens
acccccgccacggc

SEQ ID NO: 1646913 - DNA, 21 bp, Homo sapiens
acccccgccacggccaccctc

SEQ ID NO: 1646914 - DNA, 13 bp, Homo sapiens
acccccgccatgc

SEQ ID NO: 1646915 - DNA, 20 bp, Homo sapiens
acccccgtggggcagggagc

SEQ ID NO: 1646916 - DNA, 19 bp, Homo sapiens
accccctcaagccaatccc

SEQ ID NO: 1646917 - DNA, 17 bp, Homo sapiens
accccctcaccatccag

SEQ ID NO: 1646918 - DNA, 12 bp, Homo sapiens
accccctcccca

SEQ ID NO: 1646919 - DNA, 14 bp, Homo sapiens
accccctccccagg

SEQ ID NO: 1646920 - DNA, 20 bp, Homo sapiens
accccctccccgcccctgtg

SEQ ID NO: 1646921 - DNA, 17 bp, Homo sapiens
accccctccttcagaca

SEQ ID NO: 1646922 - DNA, 23 bp, Homo sapiens
accccctgaaagtgacagagacc

SEQ ID NO: 1646923 - DNA, 22 bp, Homo sapiens
accccctgagtcaactggagca

SEQ ID NO: 1646924 - DNA, 19 bp, Homo sapiens
accccctgctccaccagca

SEQ ID NO: 1646925 - DNA, 22 bp, Homo sapiens
accccctgctccaccagcagca

SEQ ID NO: 1646926 - DNA, 17 bp, Homo sapiens
acccccttaaatttaat

SEQ ID NO: 1646927 - DNA, 16 bp, Homo sapiens
acccccttcagtgccc

SEQ ID NO: 1646928 - DNA, 20 bp, Homo sapiens
acccccttcagtgcccacca

SEQ ID NO: 1646929 - DNA, 19 bp, Homo sapiens
acccccttctactgagcct

SEQ ID NO: 1646930 - DNA, 14 bp, Homo sapiens
acccccttctctgc

SEQ ID NO: 1646931 - DNA, 18 bp, Homo sapiens
acccccttctctgctcca

SEQ ID NO: 1646932 - DNA, 23 bp, Homo sapiens
acccccttctctgctccaccaca

SEQ ID NO: 1646933 - DNA, 20 bp, Homo sapiens
accccctttggtttgacaat

SEQ ID NO: 1646934 - DNA, 16 bp, Homo sapiens
accccgacgccacagc

SEQ ID NO: 1646935 - DNA, 16 bp, Homo sapiens
accccgagaaccctga

SEQ ID NO: 1646936 - DNA, 20 bp, Homo sapiens
accccgagaagtgctcttgg

SEQ ID NO: 1646937 - DNA, 15 bp, Homo sapiens
accccgcagcccgtg

SEQ ID NO: 1646938 - DNA, 22 bp, Homo sapiens
accccgcaggatccctcctgag

SEQ ID NO: 1646939 - DNA, 19 bp, Homo sapiens
accccgcctgccctcatgg

SEQ ID NO: 1646940 - DNA, 13 bp, Homo sapiens
accccgcctgcct

SEQ ID NO: 1646941 - DNA, 18 bp, Homo sapiens
accccgcggtgctctggc

SEQ ID NO: 1646942 - DNA, 15 bp, Homo sapiens
accccggcctcaggg

SEQ ID NO: 1646943 - DNA, 17 bp, Homo sapiens
accccgggctctctgct

SEQ ID NO: 1646944 - DNA, 18 bp, Homo sapiens
accccgggctctctgctg

SEQ ID NO: 1646945 - DNA, 16 bp, Homo sapiens
accccggggaccctgt

SEQ ID NO: 1646946 - DNA, 16 bp, Homo sapiens
accccgtctctactaa

SEQ ID NO: 1646947 - DNA, 22 bp, Homo sapiens
accccgtctggggttcagcccc

SEQ ID NO: 1646948 - DNA, 14 bp, Homo sapiens
acccctaagagact

SEQ ID NO: 1646949 - DNA, 18 bp, Homo sapiens
acccctatacctgagcct

SEQ ID NO: 1646950 - DNA, 16 bp, Homo sapiens
acccctcccaacctca

SEQ ID NO: 1646951 - DNA, 11 bp, Homo sapiens
acccctcccat

SEQ ID NO: 1646952 - DNA, 15 bp, Homo sapiens
acccctccccattca

SEQ ID NO: 1646953 - DNA, 21 bp, Homo sapiens
acccctccccattcacagagc

SEQ ID NO: 1646954 - DNA, 17 bp, Homo sapiens
acccctcccctcccacc

SEQ ID NO: 1646955 - DNA, 22 bp, Homo sapiens
acccctcccctcccacccacag

SEQ ID NO: 1646956 - DNA, 11 bp, Homo sapiens
acccctccctg

SEQ ID NO: 1646957 - DNA, 14 bp, Homo sapiens
acccctccctttct

SEQ ID NO: 1646958 - DNA, 18 bp, Homo sapiens
acccctccctttctcccc

SEQ ID NO: 1646959 - DNA, 23 bp, Homo sapiens
acccctccctttctcccctgccc

SEQ ID NO: 1646960 - DNA, 23 bp, Homo sapiens
acccctccttccttgaccagcag

SEQ ID NO: 1646961 - DNA, 15 bp, Homo sapiens
acccctctggccagg

SEQ ID NO: 1646962 - DNA, 11 bp, Homo sapiens
acccctctggt

SEQ ID NO: 1646963 - DNA, 12 bp, Homo sapiens
acccctctggtg

SEQ ID NO: 1646964 - DNA, 20 bp, Homo sapiens
acccctgacctaccccagcc

SEQ ID NO: 1646965 - DNA, 14 bp, Homo sapiens
acccctgcccaggc

SEQ ID NO: 1646966 - DNA, 13 bp, Homo sapiens
acccctgccccca

SEQ ID NO: 1646967 - DNA, 17 bp, Homo sapiens
acccctgcccccagccc

SEQ ID NO: 1646968 - DNA, 13 bp, Homo sapiens
acccctgccctgg

SEQ ID NO: 1646969 - DNA, 14 bp, Homo sapiens
acccctgccctggg

SEQ ID NO: 1646970 - DNA, 23 bp, Homo sapiens
acccctgcctgttggcaggccca

SEQ ID NO: 1646971 - DNA, 11 bp, Homo sapiens
acccctgctcc

SEQ ID NO: 1646972 - DNA, 22 bp, Homo sapiens
acccctgctcccattcctccct

SEQ ID NO: 1646973 - DNA, 14 bp, Homo sapiens
acccctgcttctga

SEQ ID NO: 1646974 - DNA, 23 bp, Homo sapiens
acccctggaagagcccagtctgt

SEQ ID NO: 1646975 - DNA, 15 bp, Homo sapiens
acccctggccagctc

SEQ ID NO: 1646976 - DNA, 17 bp, Homo sapiens
acccctggccagctctg

SEQ ID NO: 1646977 - DNA, 21 bp, Homo sapiens
acccctggccagctctgaggg

SEQ ID NO: 1646978 - DNA, 12 bp, Homo sapiens
acccctggctct

SEQ ID NO: 1646979 - DNA, 12 bp, Homo sapiens
acccctgtaccc

SEQ ID NO: 1646980 - DNA, 11 bp, Homo sapiens
acccctgtagg

SEQ ID NO: 1646981 - DNA, 23 bp, Homo sapiens
acccctgtagggaaaccttggag

SEQ ID NO: 1646982 - DNA, 16 bp, Homo sapiens
acccctgtcccaccca

SEQ ID NO: 1646983 - DNA, 17 bp, Homo sapiens
acccctgtgctcccctg

SEQ ID NO: 1646984 - DNA, 10 bp, Homo sapiens
acccctgtgt

SEQ ID NO: 1646985 - DNA, 13 bp, Homo sapiens
acccctgtttctg

SEQ ID NO: 1646986 - DNA, 17 bp, Homo sapiens
accccttaatcttgctt

SEQ ID NO: 1646987 - DNA, 18 bp, Homo sapiens
accccttaatcttgcttt

SEQ ID NO: 1646988 - DNA, 14 bp, Homo sapiens
accccttacccatc

SEQ ID NO: 1646989 - DNA, 15 bp, Homo sapiens
accgtccaggcccca

SEQ ID NO: 1646990 - DNA, 12 bp, Homo sapiens
accgtccctcag

SEQ ID NO: 1646991 - DNA, 17 bp, Homo sapiens
accgtggacaggcccag

SEQ ID NO: 1646992 - DNA, 15 bp, Homo sapiens
accgtggccctgccc

SEQ ID NO: 1646993 - DNA, 19 bp, Homo sapiens
accgtggccctgccctctc

SEQ ID NO: 1646994 - DNA, 17 bp, Homo sapiens
accgtgtcaagctgctc

SEQ ID NO: 1646995 - DNA, 15 bp, Homo sapiens
accgtgtccagcaca

SEQ ID NO: 1646996 - DNA, 17 bp, Homo sapiens
accgtgtccagcacaga

SEQ ID NO: 1646997 - DNA, 20 bp, Homo sapiens
accgtgtcccaaggagctga

SEQ ID NO: 1646998 - DNA, 13 bp, Homo sapiens
acctaaaaatttt

SEQ ID NO: 1646999 - DNA, 21 bp, Homo sapiens
acctaaaagttgaaaagccaa

SEQ ID NO: 1647000 - DNA, 23 bp, Homo sapiens
acctaaaagttgaaaagccaaag

SEQ ID NO: 1647001 - DNA, 16 bp, Homo sapiens
acctaaaggtgtattt

SEQ ID NO: 1647002 - DNA, 17 bp, Homo sapiens
acctaaatccattttct

SEQ ID NO: 1647003 - DNA, 18 bp, Homo sapiens
acctaaatccattttcta

SEQ ID NO: 1647004 - DNA, 20 bp, Homo sapiens
acctaaatccattttctaaa

SEQ ID NO: 1647005 - DNA, 12 bp, Homo sapiens
acctaacattcg

SEQ ID NO: 1647006 - DNA, 20 bp, Homo sapiens
acctaactcttttctatttt

SEQ ID NO: 1647007 - DNA, 19 bp, Homo sapiens
acctaagtccttccacctg

SEQ ID NO: 1647008 - DNA, 18 bp, Homo sapiens
acctaagtcctttatgtg

SEQ ID NO: 1647009 - DNA, 15 bp, Homo sapiens
acctaagtctctgtg

SEQ ID NO: 1647010 - DNA, 16 bp, Homo sapiens
acctaagtctctgtga

SEQ ID NO: 1647011 - DNA, 18 bp, Homo sapiens
acctaagtctctgtgaat

SEQ ID NO: 1647012 - DNA, 15 bp, Homo sapiens
acctaatccaggcag

SEQ ID NO: 1647013 - DNA, 21 bp, Homo sapiens
acctaatccaggcagatccag

SEQ ID NO: 1647014 - DNA, 20 bp, Homo sapiens
acctacacacataccttcat

SEQ ID NO: 1647015 - DNA, 20 bp, Homo sapiens
acctacacacgtaccttcat

SEQ ID NO: 1647016 - DNA, 16 bp, Homo sapiens
acctacacactgtcat

SEQ ID NO: 1647017 - DNA, 15 bp, Homo sapiens
acctacacaggagtc

SEQ ID NO: 1647018 - DNA, 17 bp, Homo sapiens
acctacagacctggctc

SEQ ID NO: 1647019 - DNA, 23 bp, Homo sapiens
acctacagacctggctctcagag

SEQ ID NO: 1647020 - DNA, 16 bp, Homo sapiens
acctacagactccatc

SEQ ID NO: 1647021 - DNA, 19 bp, Homo sapiens
acctacagactccatctct

SEQ ID NO: 1647022 - DNA, 16 bp, Homo sapiens
acctacagttttaact

SEQ ID NO: 1647023 - DNA, 17 bp, Homo sapiens
acctacagttttaactg

SEQ ID NO: 1647024 - DNA, 19 bp, Homo sapiens
acctacagttttaactgtg

SEQ ID NO: 1647025 - DNA, 13 bp, Homo sapiens
acctacccagctg

SEQ ID NO: 1647026 - DNA, 15 bp, Homo sapiens
acctacccagctgat

SEQ ID NO: 1647027 - DNA, 15 bp, Homo sapiens
acctaccccagccag

SEQ ID NO: 1647028 - DNA, 20 bp, Homo sapiens
acctacgtttgcaccgcctg

SEQ ID NO: 1647029 - DNA, 21 bp, Homo sapiens
acctacgtttgcaccgcctgc

SEQ ID NO: 1647030 - DNA, 13 bp, Homo sapiens
acctactgcccac

SEQ ID NO: 1647031 - DNA, 18 bp, Homo sapiens
acctactgttctaaagct

SEQ ID NO: 1647032 - DNA, 23 bp, Homo sapiens
acctactgttctaaagctctgac

SEQ ID NO: 1647033 - DNA, 15 bp, Homo sapiens
acctagaacgtgcat

SEQ ID NO: 1647034 - DNA, 20 bp, Homo sapiens
acctagaagtaagaagagga

SEQ ID NO: 1647035 - DNA, 18 bp, Homo sapiens
acctagaagtctccctgc

SEQ ID NO: 1647036 - DNA, 20 bp, Homo sapiens
acctagaatgtcagatttct

SEQ ID NO: 1647037 - DNA, 21 bp, Homo sapiens
acctagaatgtcagatttctg

SEQ ID NO: 1647038 - DNA, 20 bp, Homo sapiens
acctagagacttcacccggg

SEQ ID NO: 1647039 - DNA, 20 bp, Homo sapiens
acctagggatgttctggccc

SEQ ID NO: 1647040 - DNA, 18 bp, Homo sapiens
acctagtactctctgctc

SEQ ID NO: 1647041 - DNA, 14 bp, Homo sapiens
acctagtactgccc

SEQ ID NO: 1647042 - DNA, 18 bp, Homo sapiens
acctagtcccctttcctc

SEQ ID NO: 1647043 - DNA, 13 bp, Homo sapiens
acctagtctaagg

SEQ ID NO: 1647044 - DNA, 15 bp, Homo sapiens
acctagtgccccaga

SEQ ID NO: 1647045 - DNA, 17 bp, Homo sapiens
acctagtgccccagact

SEQ ID NO: 1647046 - DNA, 16 bp, Homo sapiens
acctatagtcccagct

SEQ ID NO: 1647047 - DNA, 14 bp, Homo sapiens
acctatcccacctc

SEQ ID NO: 1647048 - DNA, 17 bp, Homo sapiens
acctatctgtggaaagc

SEQ ID NO: 1647049 - DNA, 19 bp, Homo sapiens
acctatgatattttctgtg

SEQ ID NO: 1647050 - DNA, 18 bp, Homo sapiens
acctatggaagtggttct

SEQ ID NO: 1647051 - DNA, 17 bp, Homo sapiens
acctatgtcctaaggac

SEQ ID NO: 1647052 - DNA, 22 bp, Homo sapiens
acctatgtcctaaggacacact

SEQ ID NO: 1647053 - DNA, 23 bp, Homo sapiens
acctattcaccctccacttcccg

SEQ ID NO: 1647054 - DNA, 19 bp, Homo sapiens
acctatttccagaaataca

SEQ ID NO: 1647055 - DNA, 14 bp, Homo sapiens
acctatttgacata

SEQ ID NO: 1647056 - DNA, 19 bp, Homo sapiens
acctcaaaatgtctaagat

SEQ ID NO: 1647057 - DNA, 23 bp, Homo sapiens
acctcaaacttccagtcaggtag

SEQ ID NO: 1647058 - DNA, 17 bp, Homo sapiens
acctcaaccatcctggc

SEQ ID NO: 1647059 - DNA, 19 bp, Homo sapiens
acctcaacccccatttcta

SEQ ID NO: 1647060 - DNA, 10 bp, Homo sapiens
acctcaaggg

SEQ ID NO: 1647061 - DNA, 19 bp, Homo sapiens
acctcaagtgatctgccca

SEQ ID NO: 1647062 - DNA, 16 bp, Homo sapiens
acctcaatgccctgcc

SEQ ID NO: 1647063 - DNA, 19 bp, Homo sapiens
acctcaatgccctgccatt

SEQ ID NO: 1647064 - DNA, 13 bp, Homo sapiens
acctcaatgtccc

SEQ ID NO: 1647065 - DNA, 14 bp, Homo sapiens
acctcaatttttgt

SEQ ID NO: 1647066 - DNA, 20 bp, Homo sapiens
acctcaatttttgtttttga

SEQ ID NO: 1647067 - DNA, 15 bp, Homo sapiens
acctcacatttgtga

SEQ ID NO: 1647068 - DNA, 19 bp, Homo sapiens
acctcacctgagacctcca

SEQ ID NO: 1647069 - DNA, 13 bp, Homo sapiens
acctcacctggtc

SEQ ID NO: 1647070 - DNA, 22 bp, Homo sapiens
acctcacgcaggctgagtccag

SEQ ID NO: 1647071 - DNA, 20 bp, Homo sapiens
acctcactgagaggcctgga

SEQ ID NO: 1647072 - DNA, 21 bp, Homo sapiens
acctcactgagaggcctggag

SEQ ID NO: 1647073 - DNA, 22 bp, Homo sapiens
acctcacttcccgtagctgcca

SEQ ID NO: 1647074 - DNA, 23 bp, Homo sapiens
acctcagagtggagttgaaactg

SEQ ID NO: 1647075 - DNA, 13 bp, Homo sapiens
acctcagccctgg

SEQ ID NO: 1647076 - DNA, 15 bp, Homo sapiens
acctcagccctggcc

SEQ ID NO: 1647077 - DNA, 18 bp, Homo sapiens
acctcagccctggccctg

SEQ ID NO: 1647078 - DNA, 20 bp, Homo sapiens
acctcagccctggccctgcc

SEQ ID NO: 1647079 - DNA, 17 bp, Homo sapiens
acctcagcctggccaga

SEQ ID NO: 1647080 - DNA, 20 bp, Homo sapiens
acctcagcctggccagacac

SEQ ID NO: 1647081 - DNA, 16 bp, Homo sapiens
acctcagcctgtgctg

SEQ ID NO: 1647082 - DNA, 19 bp, Homo sapiens
acctcagcctgtgctgccc

SEQ ID NO: 1647083 - DNA, 20 bp, Homo sapiens
acctcagccttccccttgcc

SEQ ID NO: 1647084 - DNA, 14 bp, Homo sapiens
acctcagccttgga

SEQ ID NO: 1647085 - DNA, 16 bp, Homo sapiens
acctcagctgcacatt

SEQ ID NO: 1647086 - DNA, 23 bp, Homo sapiens
acctcagctgcacattcctggcc

SEQ ID NO: 1647087 - DNA, 12 bp, Homo sapiens
acctcaggcagc

SEQ ID NO: 1647088 - DNA, 16 bp, Homo sapiens
acctcaggcagctcaa

SEQ ID NO: 1647089 - DNA, 15 bp, Homo sapiens
acctcaggcaggaag

SEQ ID NO: 1647090 - DNA, 21 bp, Homo sapiens
acctcaggccaggtgcagtgg

SEQ ID NO: 1647091 - DNA, 13 bp, Homo sapiens
acctcagggctcc

SEQ ID NO: 1647092 - DNA, 12 bp, Homo sapiens
acctcagtagaa

SEQ ID NO: 1647093 - DNA, 14 bp, Homo sapiens
acctcagtagaaaa

SEQ ID NO: 1647094 - DNA, 12 bp, Homo sapiens
acctcagtggga

SEQ ID NO: 1647095 - DNA, 16 bp, Homo sapiens
acctcagtgtcattta

SEQ ID NO: 1647096 - DNA, 18 bp, Homo sapiens
acctcagttattacatgt

SEQ ID NO: 1647097 - DNA, 18 bp, Homo sapiens
acctcagttcattgtggt

SEQ ID NO: 1647098 - DNA, 16 bp, Homo sapiens
acctcatcactggact

SEQ ID NO: 1647099 - DNA, 18 bp, Homo sapiens
acctcatcactggactgc

SEQ ID NO: 1647100 - DNA, 22 bp, Homo sapiens
acctcatcactggactgcatgg

SEQ ID NO: 1647101 - DNA, 14 bp, Homo sapiens
acctcatcattaat

SEQ ID NO: 1647102 - DNA, 13 bp, Homo sapiens
acctcatcctgct

SEQ ID NO: 1647103 - DNA, 21 bp, Homo sapiens
acctcatctgtggagctgcca

SEQ ID NO: 1647104 - DNA, 18 bp, Homo sapiens
acggctggtcactctgcc

SEQ ID NO: 1647105 - DNA, 23 bp, Homo sapiens
acggctggtcactctgccctctg

SEQ ID NO: 1647106 - DNA, 22 bp, Homo sapiens
acggctgtggaccgtggacagg

SEQ ID NO: 1647107 - DNA, 22 bp, Homo sapiens
acggctgttcccctcacccaaa

SEQ ID NO: 1647108 - DNA, 17 bp, Homo sapiens
acgggaagtttagagag

SEQ ID NO: 1647109 - DNA, 15 bp, Homo sapiens
acgggaccagctcac

SEQ ID NO: 1647110 - DNA, 21 bp, Homo sapiens
acgggacccacatgctccaga

SEQ ID NO: 1647111 - DNA, 20 bp, Homo sapiens
acgggagcattggcccctga

SEQ ID NO: 1647112 - DNA, 24 bp, Homo sapiens
acgggatgattgcttgagctcagg

SEQ ID NO: 1647113 - DNA, 23 bp, Homo sapiens
acgggcatgcacacggctggtca

SEQ ID NO: 1647114 - DNA, 17 bp, Homo sapiens
acgggcattcacaaccc

SEQ ID NO: 1647115 - DNA, 16 bp, Homo sapiens
acgggcgagctttctc

SEQ ID NO: 1647116 - DNA, 15 bp, Homo sapiens
acgggcgctgcagcc

SEQ ID NO: 1647117 - DNA, 20 bp, Homo sapiens
acgggcgctgcagcctccct

SEQ ID NO: 1647118 - DNA, 15 bp, Homo sapiens
acgggggctgtgact

SEQ ID NO: 1647119 - DNA, 20 bp, Homo sapiens
acggggttggctgttccaga

SEQ ID NO: 1647120 - DNA, 21 bp, Homo sapiens
acggggttggctgttccagac

SEQ ID NO: 1647121 - DNA, 18 bp, Homo sapiens
acgggtctgagactgaaa

SEQ ID NO: 1647122 - DNA, 22 bp, Homo sapiens
acgggtgcccgtaatcccagct

SEQ ID NO: 1647123 - DNA, 13 bp, Homo sapiens
acgggtggtcccc

SEQ ID NO: 1647124 - DNA, 14 bp, Homo sapiens
acgggtggtccccg

SEQ ID NO: 1647125 - DNA, 18 bp, Homo sapiens
acgggttcaccatgttgc

SEQ ID NO: 1647126 - DNA, 16 bp, Homo sapiens
acgggttgaaagacat

SEQ ID NO: 1647127 - DNA, 22 bp, Homo sapiens
acgggttgaaagacatcaatga

SEQ ID NO: 1647128 - DNA, 15 bp, Homo sapiens
acggtaagtgttctc

SEQ ID NO: 1647129 - DNA, 15 bp, Homo sapiens
acggtctggaggccg

SEQ ID NO: 1647130 - DNA, 16 bp, Homo sapiens
acggtgaaggtgacag

SEQ ID NO: 1647131 - DNA, 15 bp, Homo sapiens
acggtgcccaagcca

SEQ ID NO: 1647132 - DNA, 15 bp, Homo sapiens
acggtgcgtggctgt

SEQ ID NO: 1647133 - DNA, 20 bp, Homo sapiens
acggtgcgtggctgtggcac

SEQ ID NO: 1647134 - DNA, 18 bp, Homo sapiens
acggtgctgtgagggagg

SEQ ID NO: 1647135 - DNA, 20 bp, Homo sapiens
acggtgctgtgagggagggg

SEQ ID NO: 1647136 - DNA, 19 bp, Homo sapiens
acggtgggcatttgtgagg

SEQ ID NO: 1647137 - DNA, 19 bp, Homo sapiens
acggtgttaattttgctaa

SEQ ID NO: 1647138 - DNA, 20 bp, Homo sapiens
acggtgttaattttgctaac

SEQ ID NO: 1647139 - DNA, 21 bp, Homo sapiens
acggtgttaattttgctaact

SEQ ID NO: 1647140 - DNA, 22 bp, Homo sapiens
acggtgttaattttgctaactg

SEQ ID NO: 1647141 - DNA, 17 bp, Homo sapiens
acggttaacttgtatat

SEQ ID NO: 1647142 - DNA, 16 bp, Homo sapiens
acggttcaatggtaga

SEQ ID NO: 1647143 - DNA, 14 bp, Homo sapiens
acggtttccaggga

SEQ ID NO: 1647144 - DNA, 15 bp, Homo sapiens
acggtttccagggag

SEQ ID NO: 1647145 - DNA, 17 bp, Homo sapiens
acggtttccagggaggg

SEQ ID NO: 1647146 - DNA, 21 bp, Homo sapiens
acggtttttttctttggctgc

SEQ ID NO: 1647147 - DNA, 18 bp, Homo sapiens
acgtaaccacggaaaaga

SEQ ID NO: 1647148 - DNA, 17 bp, Homo sapiens
acgtaatgcattgcctg

SEQ ID NO: 1647149 - DNA, 19 bp, Homo sapiens
acgtaatgcattgcctgta

SEQ ID NO: 1647150 - DNA, 22 bp, Homo sapiens
acgtacaaaactctgtataagt

SEQ ID NO: 1647151 - DNA, 15 bp, Homo sapiens
acgtatttataatag

SEQ ID NO: 1647152 - DNA, 17 bp, Homo sapiens
acgtatttatatttgga

SEQ ID NO: 1647153 - DNA, 17 bp, Homo sapiens
acgtcaagtctccttcc

SEQ ID NO: 1647154 - DNA, 21 bp, Homo sapiens
acgtcactggaccactgggca

SEQ ID NO: 1647155 - DNA, 17 bp, Homo sapiens
acgtcagcgcaccaaaa

SEQ ID NO: 1647156 - DNA, 17 bp, Homo sapiens
acgtcatctcagggtcc

SEQ ID NO: 1647157 - DNA, 18 bp, Homo sapiens
acgtcatgtatttgagca

SEQ ID NO: 1647158 - DNA, 20 bp, Homo sapiens
acgtcccagcatccctggag

SEQ ID NO: 1647159 - DNA, 13 bp, Homo sapiens
acgtccccctggg

SEQ ID NO: 1647160 - DNA, 14 bp, Homo sapiens
acgtcccctccgcc

SEQ ID NO: 1647161 - DNA, 22 bp, Homo sapiens
acgtcccctccgccgtgccggc

SEQ ID NO: 1647162 - DNA, 15 bp, Homo sapiens
acgtccgcgggtccc

SEQ ID NO: 1647163 - DNA, 21 bp, Homo sapiens
acgtccttgggcgtctctaat

SEQ ID NO: 1647164 - DNA, 12 bp, Homo sapiens
acgtctcctcct

SEQ ID NO: 1647165 - DNA, 20 bp, Homo sapiens
acgtctgaagcttgactccc

SEQ ID NO: 1647166 - DNA, 22 bp, Homo sapiens
acgtctgaagcttgactcccaa

SEQ ID NO: 1647167 - DNA, 12 bp, Homo sapiens
acgtctggctcc

SEQ ID NO: 1647168 - DNA, 16 bp, Homo sapiens
acgtctggctccctgc

SEQ ID NO: 1647169 - DNA, 18 bp, Homo sapiens
acgtctggctccctgccc

SEQ ID NO: 1647170 - DNA, 20 bp, Homo sapiens
acgtctggctccctgcccct

SEQ ID NO: 1647171 - DNA, 15 bp, Homo sapiens
acgtgaaatatttaa

SEQ ID NO: 1647172 - DNA, 11 bp, Homo sapiens
acgtgaaattc

SEQ ID NO: 1647173 - DNA, 15 bp, Homo sapiens
acgtgaatattttgc

SEQ ID NO: 1647174 - DNA, 21 bp, Homo sapiens
acgtgactgtggcacacgcct

SEQ ID NO: 1647175 - DNA, 14 bp, Homo sapiens
acgtgagagaaaga

SEQ ID NO: 1647176 - DNA, 18 bp, Homo sapiens
acgtgagagaaagagaga

SEQ ID NO: 1647177 - DNA, 16 bp, Homo sapiens
acgtgagagaatctgc

SEQ ID NO: 1647178 - DNA, 17 bp, Homo sapiens
acgtgagggggagctga

SEQ ID NO: 1647179 - DNA, 23 bp, Homo sapiens
acgtgcactgtgaatcctggcaa

SEQ ID NO: 1647180 - DNA, 19 bp, Homo sapiens
acgtgcaggacagctcttg

SEQ ID NO: 1647181 - DNA, 17 bp, Homo sapiens
acgtgccagatataact

SEQ ID NO: 1647182 - DNA, 19 bp, Homo sapiens
acgtgccaggcccggggct

SEQ ID NO: 1647183 - DNA, 21 bp, Homo sapiens
acgtgccaggcccggggctgg

SEQ ID NO: 1647184 - DNA, 15 bp, Homo sapiens
acgtgccttttgcac

SEQ ID NO: 1647185 - DNA, 17 bp, Homo sapiens
acgtgccttttgcaccc

SEQ ID NO: 1647186 - DNA, 20 bp, Homo sapiens
acgtgccttttgcacccctc

SEQ ID NO: 1647187 - DNA, 21 bp, Homo sapiens
acgtgccttttgcacccctcc

SEQ ID NO: 1647188 - DNA, 17 bp, Homo sapiens
acgtgctgtgggcctca

SEQ ID NO: 1647189 - DNA, 11 bp, Homo sapiens
acgtgcttctt

SEQ ID NO: 1647190 - DNA, 15 bp, Homo sapiens
acgtggactcctctt

SEQ ID NO: 1647191 - DNA, 14 bp, Homo sapiens
acgtggagagctgg

SEQ ID NO: 1647192 - DNA, 16 bp, Homo sapiens
acgtggagctcttggc

SEQ ID NO: 1647193 - DNA, 21 bp, Homo sapiens
acgtggcctcgtgaggggcaa

SEQ ID NO: 1647194 - DNA, 14 bp, Homo sapiens
acgtggggcccact

SEQ ID NO: 1647195 - DNA, 19 bp, Homo sapiens
acgtggtcaccttcgagta

SEQ ID NO: 1647196 - DNA, 19 bp, Homo sapiens
acgtggtcagggcagggct

SEQ ID NO: 1647197 - DNA, 19 bp, Homo sapiens
acgtgtaaccagttataaa

SEQ ID NO: 1647198 - DNA, 17 bp, Homo sapiens
acgtgtatagtatctgt

SEQ ID NO: 1647199 - DNA, 18 bp, Homo sapiens
acgtgtatagtatctgta

SEQ ID NO: 1647200 - DNA, 15 bp, Homo sapiens
acgtgtgtggctggg

SEQ ID NO: 1647201 - DNA, 19 bp, Homo sapiens
acgtgtgtggctgggacct

SEQ ID NO: 1647202 - DNA, 16 bp, Homo sapiens
acgttaggcatttcct

SEQ ID NO: 1647203 - DNA, 21 bp, Homo sapiens
acgttaggcatttcctgctga

SEQ ID NO: 1647204 - DNA, 18 bp, Homo sapiens
acgttccttactgcagaa

SEQ ID NO: 1647205 - DNA, 19 bp, Homo sapiens
acgttccttactgcagaat

SEQ ID NO: 1647206 - DNA, 15 bp, Homo sapiens
acgttgccaggggct

SEQ ID NO: 1647207 - DNA, 13 bp, Homo sapiens
acgttgctcccca

SEQ ID NO: 1647208 - DNA, 12 bp, Homo sapiens
acgttggacttt

SEQ ID NO: 1647209 - DNA, 19 bp, Homo sapiens
acgttggacttttcgttaa

SEQ ID NO: 1647210 - DNA, 23 bp, Homo sapiens
acgttggacttttcgttaacatt

SEQ ID NO: 1647211 - DNA, 18 bp, Homo sapiens
acgttggagaagcccgtg

SEQ ID NO: 1647212 - DNA, 20 bp, Homo sapiens
acgtttaatcccagcacttt

SEQ ID NO: 1647213 - DNA, 17 bp, Homo sapiens
acgtttcttctttctag

SEQ ID NO: 1647214 - DNA, 15 bp, Homo sapiens
acgtttgcaccgcct

SEQ ID NO: 1647215 - DNA, 20 bp, Homo sapiens
acgtttggactgatttgtgg

SEQ ID NO: 1647216 - DNA, 13 bp, Homo sapiens
acgtttgtatgtg

SEQ ID NO: 1647217 - DNA, 13 bp, Homo sapiens
acgtttgtgcaga

SEQ ID NO: 1647218 - DNA, 22 bp, Homo sapiens
actcagggccccagcactaaag

SEQ ID NO: 1647219 - DNA, 13 bp, Homo sapiens
actcaggtgggcc

SEQ ID NO: 1647220 - DNA, 17 bp, Homo sapiens
actcagtaaaacataat

SEQ ID NO: 1647221 - DNA, 23 bp, Homo sapiens
actcagtatgctttccctgagga

SEQ ID NO: 1647222 - DNA, 19 bp, Homo sapiens
actcagtccactgttgagc

SEQ ID NO: 1647223 - DNA, 16 bp, Homo sapiens
actcagtcccccacca

SEQ ID NO: 1647224 - DNA, 11 bp, Homo sapiens
actcagtgcag

SEQ ID NO: 1647225 - DNA, 17 bp, Homo sapiens
actcagtggggctggca

SEQ ID NO: 1647226 - DNA, 16 bp, Homo sapiens
actcagtgttagagaa

SEQ ID NO: 1647227 - DNA, 21 bp, Homo sapiens
actcagtgttagagaaatcct

SEQ ID NO: 1647228 - DNA, 21 bp, Homo sapiens
actcagttcaaaccatttcag

SEQ ID NO: 1647229 - DNA, 22 bp, Homo sapiens
actcagttccaaagtcacagga

SEQ ID NO: 1647230 - DNA, 17 bp, Homo sapiens
actcagttccaggcctg

SEQ ID NO: 1647231 - DNA, 22 bp, Homo sapiens
actcagttccaggcctgatctt

SEQ ID NO: 1647232 - DNA, 14 bp, Homo sapiens
actcagtttgtcag

SEQ ID NO: 1647233 - DNA, 22 bp, Homo sapiens
actcagtttgtcagactttaaa

SEQ ID NO: 1647234 - DNA, 20 bp, Homo sapiens
actcatcaatcaaataagta

SEQ ID NO: 1647235 - DNA, 15 bp, Homo sapiens
actcatcataaaata

SEQ ID NO: 1647236 - DNA, 16 bp, Homo sapiens
actcatcataaaataa

SEQ ID NO: 1647237 - DNA, 13 bp, Homo sapiens
actcatcatttgt

SEQ ID NO: 1647238 - DNA, 13 bp, Homo sapiens
actcatccagacc

SEQ ID NO: 1647239 - DNA, 14 bp, Homo sapiens
actcatcctctttt

SEQ ID NO: 1647240 - DNA, 16 bp, Homo sapiens
actcatcctcttttaa

SEQ ID NO: 1647241 - DNA, 14 bp, Homo sapiens
actcatctgttatc

SEQ ID NO: 1647242 - DNA, 20 bp, Homo sapiens
actcatctgttatcctgcta

SEQ ID NO: 1647243 - DNA, 18 bp, Homo sapiens
actcatcttagtgcctga

SEQ ID NO: 1647244 - DNA, 22 bp, Homo sapiens
actcatcttagtgcctgagagt

SEQ ID NO: 1647245 - DNA, 13 bp, Homo sapiens
actcatggcagct

SEQ ID NO: 1647246 - DNA, 15 bp, Homo sapiens
actcatggcagctgt

SEQ ID NO: 1647247 - DNA, 22 bp, Homo sapiens
actcatggcagctgtttctcat

SEQ ID NO: 1647248 - DNA, 18 bp, Homo sapiens
actcatggccttgtctaa

SEQ ID NO: 1647249 - DNA, 19 bp, Homo sapiens
actcattctcttcttgcta

SEQ ID NO: 1647250 - DNA, 18 bp, Homo sapiens
actcattgctgagcctct

SEQ ID NO: 1647251 - DNA, 22 bp, Homo sapiens
actcattgctgagcctctgctc

SEQ ID NO: 1647252 - DNA, 22 bp, Homo sapiens
actcatttaaagctaaattttg

SEQ ID NO: 1647253 - DNA, 18 bp, Homo sapiens
actcatttatctcctctt

SEQ ID NO: 1647254 - DNA, 21 bp, Homo sapiens
actcatttttcattagataca

SEQ ID NO: 1647255 - DNA, 13 bp, Homo sapiens
actccaaaatgtt

SEQ ID NO: 1647256 - DNA, 22 bp, Homo sapiens
actccaaaatgttggtcatttt

SEQ ID NO: 1647257 - DNA, 22 bp, Homo sapiens
actccaaacagacccctgttca

SEQ ID NO: 1647258 - DNA, 16 bp, Homo sapiens
actccaaacctgtctt

SEQ ID NO: 1647259 - DNA, 18 bp, Homo sapiens
actccaatggggccagca

SEQ ID NO: 1647260 - DNA, 20 bp, Homo sapiens
actccaatggggccagcact

SEQ ID NO: 1647261 - DNA, 21 bp, Homo sapiens
actccaatggggccagcactg

SEQ ID NO: 1647262 - DNA, 23 bp, Homo sapiens
actccacaccttttatgaatcaa

SEQ ID NO: 1647263 - DNA, 23 bp, Homo sapiens
actccacagcggaggagaccagc

SEQ ID NO: 1647264 - DNA, 15 bp, Homo sapiens
actccacatctgcct

SEQ ID NO: 1647265 - DNA, 14 bp, Homo sapiens
actccaccacccaa

SEQ ID NO: 1647266 - DNA, 21 bp, Homo sapiens
actccaccatccccaccccac

SEQ ID NO: 1647267 - DNA, 19 bp, Homo sapiens
actccaccgaccaactgcc

SEQ ID NO: 1647268 - DNA, 12 bp, Homo sapiens
actccacctcaa

SEQ ID NO: 1647269 - DNA, 13 bp, Homo sapiens
actccacctcaaa

SEQ ID NO: 1647270 - DNA, 13 bp, Homo sapiens
actccactcccag

SEQ ID NO: 1647271 - DNA, 18 bp, Homo sapiens
actccactcccagcagct

SEQ ID NO: 1647272 - DNA, 22 bp, Homo sapiens
actccactctccttcgtgtctc

SEQ ID NO: 1647273 - DNA, 20 bp, Homo sapiens
actccactctgattcacctc

SEQ ID NO: 1647274 - DNA, 23 bp, Homo sapiens
actccagaatctgctgttgccat

SEQ ID NO: 1647275 - DNA, 15 bp, Homo sapiens
actccagacccctgg

SEQ ID NO: 1647276 - DNA, 18 bp, Homo sapiens
actccagacccctggctt

SEQ ID NO: 1647277 - DNA, 14 bp, Homo sapiens
actccagagtctga

SEQ ID NO: 1647278 - DNA, 16 bp, Homo sapiens
actccagagtctgagc

SEQ ID NO: 1647279 - DNA, 15 bp, Homo sapiens
actccagatagagaa

SEQ ID NO: 1647280 - DNA, 16 bp, Homo sapiens
actccagatagagaaa

SEQ ID NO: 1647281 - DNA, 15 bp, Homo sapiens
actccagcaacttct

SEQ ID NO: 1647282 - DNA, 10 bp, Homo sapiens
actccagccc

SEQ ID NO: 1647283 - DNA, 13 bp, Homo sapiens
actccagccctgt

SEQ ID NO: 1647284 - DNA, 14 bp, Homo sapiens
actccagccctgtc

SEQ ID NO: 1647285 - DNA, 15 bp, Homo sapiens
actccagcctgagca

SEQ ID NO: 1647286 - DNA, 19 bp, Homo sapiens
actccagcctggcgacaga

SEQ ID NO: 1647287 - DNA, 18 bp, Homo sapiens
actccagcctgggcaaca

SEQ ID NO: 1647288 - DNA, 21 bp, Homo sapiens
actccagcctgggcaacacag

SEQ ID NO: 1647289 - DNA, 18 bp, Homo sapiens
actccagcctgggcgaca

SEQ ID NO: 1647290 - DNA, 13 bp, Homo sapiens
actccaggattta

SEQ ID NO: 1647291 - DNA, 14 bp, Homo sapiens
actccaggcccaag

SEQ ID NO: 1647292 - DNA, 17 bp, Homo sapiens
actccaggcccaaggct

SEQ ID NO: 1647293 - DNA, 19 bp, Homo sapiens
actccaggcccaaggctcc

SEQ ID NO: 1647294 - DNA, 18 bp, Homo sapiens
actccaggccctcctctc

SEQ ID NO: 1647295 - DNA, 17 bp, Homo sapiens
actccaggcctgaccag

SEQ ID NO: 1647296 - DNA, 22 bp, Homo sapiens
actccaggcctgaccagggggc

SEQ ID NO: 1647297 - DNA, 21 bp, Homo sapiens
actccagggaagattttatat

SEQ ID NO: 1647298 - DNA, 15 bp, Homo sapiens
actccagtcaacaga

SEQ ID NO: 1647299 - DNA, 16 bp, Homo sapiens
actccagtcaacagat

SEQ ID NO: 1647300 - DNA, 19 bp, Homo sapiens
actccagtcaacagattca

SEQ ID NO: 1647301 - DNA, 17 bp, Homo sapiens
actccagtgctcagctg

SEQ ID NO: 1647302 - DNA, 19 bp, Homo sapiens
actccagtgctcagctgtg

SEQ ID NO: 1647303 - DNA, 23 bp, Homo sapiens
actccagtgctcagctgtggctg

SEQ ID NO: 1647304 - DNA, 16 bp, Homo sapiens
actccatacataactt

SEQ ID NO: 1647305 - DNA, 21 bp, Homo sapiens
actccatacataacttgatat

SEQ ID NO: 1647306 - DNA, 17 bp, Homo sapiens
actccatcatggctgct

SEQ ID NO: 1647307 - DNA, 19 bp, Homo sapiens
actccatctcaaaaaataa

SEQ ID NO: 1647308 - DNA, 16 bp, Homo sapiens
actccatctctttaaa

SEQ ID NO: 1647309 - DNA, 17 bp, Homo sapiens
actccatcttggtagtt

SEQ ID NO: 1647310 - DNA, 19 bp, Homo sapiens
actccatgctccttgagag

SEQ ID NO: 1647311 - DNA, 17 bp, Homo sapiens
actccatggccaccccg

SEQ ID NO: 1647312 - DNA, 21 bp, Homo sapiens
actccatggctaagaccacag

SEQ ID NO: 1647313 - DNA, 16 bp, Homo sapiens
actccattactgtgat

SEQ ID NO: 1647314 - DNA, 17 bp, Homo sapiens
actccattactgtgatt

SEQ ID NO: 1647315 - DNA, 20 bp, Homo sapiens
actccattactgtgatttct

SEQ ID NO: 1647316 - DNA, 12 bp, Homo sapiens
actccattgtcg

SEQ ID NO: 1647317 - DNA, 19 bp, Homo sapiens
actcccaaagctcagactt

SEQ ID NO: 1647318 - DNA, 15 bp, Homo sapiens
actcccaacttcttc

SEQ ID NO: 1647319 - DNA, 16 bp, Homo sapiens
actcccacacccaaga

SEQ ID NO: 1647320 - DNA, 13 bp, Homo sapiens
actcccattcctg

SEQ ID NO: 1647321 - DNA, 20 bp, Homo sapiens
actccccacatcccatcgtc

SEQ ID NO: 1647322 - DNA, 17 bp, Homo sapiens
actccccagccccagcc

SEQ ID NO: 1647323 - DNA, 18 bp, Homo sapiens
actcccggcactccatgc

SEQ ID NO: 1647324 - DNA, 19 bp, Homo sapiens
actcccggcactccatgct

SEQ ID NO: 1647325 - DNA, 22 bp, Homo sapiens
actcccggcctaggcacctccc

SEQ ID NO: 1647326 - DNA, 13 bp, Homo sapiens
actccctccacca

SEQ ID NO: 1647327 - DNA, 14 bp, Homo sapiens
actccctccaccag

SEQ ID NO: 1647328 - DNA, 16 bp, Homo sapiens
actccctcctcacctc

SEQ ID NO: 1647329 - DNA, 19 bp, Homo sapiens
actccctcctcacctctgg

SEQ ID NO: 1647330 - DNA, 20 bp, Homo sapiens
actccctcctcacctctgga

SEQ ID NO: 1647331 - DNA, 21 bp, Homo sapiens
actccctctcaggatccaagc

SEQ ID NO: 1647332 - DNA, 18 bp, Homo sapiens
actgatgtacaattaaaa

SEQ ID NO: 1647333 - DNA, 12 bp, Homo sapiens
actgatgtcatc

SEQ ID NO: 1647334 - DNA, 15 bp, Homo sapiens
actgatgtcatcttg

SEQ ID NO: 1647335 - DNA, 18 bp, Homo sapiens
actgatgttgtgttttta

SEQ ID NO: 1647336 - DNA, 16 bp, Homo sapiens
actgatgtttgtgcag

SEQ ID NO: 1647337 - DNA, 16 bp, Homo sapiens
actgattacctgccaa

SEQ ID NO: 1647338 - DNA, 17 bp, Homo sapiens
actgattacctgccaat

SEQ ID NO: 1647339 - DNA, 16 bp, Homo sapiens
actgattcaagaacaa

SEQ ID NO: 1647340 - DNA, 17 bp, Homo sapiens
actgattcaattataat

SEQ ID NO: 1647341 - DNA, 13 bp, Homo sapiens
actgatttaattt

SEQ ID NO: 1647342 - DNA, 14 bp, Homo sapiens
actgatttcagtaa

SEQ ID NO: 1647343 - DNA, 15 bp, Homo sapiens
actgatttcagtaag

SEQ ID NO: 1647344 - DNA, 12 bp, Homo sapiens
actgatttgtgg

SEQ ID NO: 1647345 - DNA, 22 bp, Homo sapiens
actgattttgttatttttatat

SEQ ID NO: 1647346 - DNA, 15 bp, Homo sapiens
actgatttttgtaag

SEQ ID NO: 1647347 - DNA, 18 bp, Homo sapiens
actgcaaaaaaagcctcc

SEQ ID NO: 1647348 - DNA, 18 bp, Homo sapiens
actgcaaagtcgccagtc

SEQ ID NO: 1647349 - DNA, 22 bp, Homo sapiens
actgcaaagtcgccagtcactg

SEQ ID NO: 1647350 - DNA, 18 bp, Homo sapiens
actgcaaatcaggctttt

SEQ ID NO: 1647351 - DNA, 16 bp, Homo sapiens
actgcaacctccacct

SEQ ID NO: 1647352 - DNA, 16 bp, Homo sapiens
actgcaacctctgcct

SEQ ID NO: 1647353 - DNA, 21 bp, Homo sapiens
actgcaacttccgcctcctgt

SEQ ID NO: 1647354 - DNA, 22 bp, Homo sapiens
actgcaagagccaagttccaaa

SEQ ID NO: 1647355 - DNA, 18 bp, Homo sapiens
actgcaatagagactgta

SEQ ID NO: 1647356 - DNA, 20 bp, Homo sapiens
actgcacacagtgacttcct

SEQ ID NO: 1647357 - DNA, 16 bp, Homo sapiens
actgcacagtggcaca

SEQ ID NO: 1647358 - DNA, 17 bp, Homo sapiens
actgcacatgaaagttt

SEQ ID NO: 1647359 - DNA, 15 bp, Homo sapiens
actgcactccagcct

SEQ ID NO: 1647360 - DNA, 16 bp, Homo sapiens
actgcactccagcctg

SEQ ID NO: 1647361 - DNA, 19 bp, Homo sapiens
actgcactccagcctgggc

SEQ ID NO: 1647362 - DNA, 20 bp, Homo sapiens
actgcactccagcctgggtc

SEQ ID NO: 1647363 - DNA, 16 bp, Homo sapiens
actgcactgctgtttg

SEQ ID NO: 1647364 - DNA, 16 bp, Homo sapiens
actgcactttccccct

SEQ ID NO: 1647365 - DNA, 18 bp, Homo sapiens
actgcactttcccccttc

SEQ ID NO: 1647366 - DNA, 20 bp, Homo sapiens
actgcactttcccccttccc

SEQ ID NO: 1647367 - DNA, 18 bp, Homo sapiens
actgcagaacccccaggt

SEQ ID NO: 1647368 - DNA, 19 bp, Homo sapiens
actgcagaacccccaggtg

SEQ ID NO: 1647369 - DNA, 22 bp, Homo sapiens
actgcagaacccccaggtggcc

SEQ ID NO: 1647370 - DNA, 13 bp, Homo sapiens
actgcagaagcaa

SEQ ID NO: 1647371 - DNA, 21 bp, Homo sapiens
actgcagaatacagtaagctg

SEQ ID NO: 1647372 - DNA, 15 bp, Homo sapiens
actgcagaggggaaa

SEQ ID NO: 1647373 - DNA, 14 bp, Homo sapiens
actgcagcacctcc

SEQ ID NO: 1647374 - DNA, 15 bp, Homo sapiens
actgcagcacctcca

SEQ ID NO: 1647375 - DNA, 14 bp, Homo sapiens
actgcagccctctc

SEQ ID NO: 1647376 - DNA, 21 bp, Homo sapiens
actgcagccctctccaccctc

SEQ ID NO: 1647377 - DNA, 23 bp, Homo sapiens
actgcagccctctccaccctccg

SEQ ID NO: 1647378 - DNA, 22 bp, Homo sapiens
actgcagcctccgcctcccggg

SEQ ID NO: 1647379 - DNA, 23 bp, Homo sapiens
actgcaggccccgcttgtccagc

SEQ ID NO: 1647380 - DNA, 14 bp, Homo sapiens
actgcaggccctgg

SEQ ID NO: 1647381 - DNA, 15 bp, Homo sapiens
actgcaggccctggc

SEQ ID NO: 1647382 - DNA, 22 bp, Homo sapiens
actgcagggacacgggcagcct

SEQ ID NO: 1647383 - DNA, 20 bp, Homo sapiens
actgcagtcggcatgccagg

SEQ ID NO: 1647384 - DNA, 20 bp, Homo sapiens
actgcagtttactattgcta

SEQ ID NO: 1647385 - DNA, 16 bp, Homo sapiens
actgcatactttttaa

SEQ ID NO: 1647386 - DNA, 18 bp, Homo sapiens
actgcatactttttaaat

SEQ ID NO: 1647387 - DNA, 17 bp, Homo sapiens
actgcatctcaaaaaaa

SEQ ID NO: 1647388 - DNA, 14 bp, Homo sapiens
actgcatggaccta

SEQ ID NO: 1647389 - DNA, 20 bp, Homo sapiens
actgcatggacctaacattc

SEQ ID NO: 1647390 - DNA, 17 bp, Homo sapiens
actgcatggggaggcag

SEQ ID NO: 1647391 - DNA, 21 bp, Homo sapiens
actgcatgtaccatttgcatg

SEQ ID NO: 1647392 - DNA, 16 bp, Homo sapiens
actgcattagaaatta

SEQ ID NO: 1647393 - DNA, 16 bp, Homo sapiens
actgcattctctccca

SEQ ID NO: 1647394 - DNA, 15 bp, Homo sapiens
actgcattgagaact

SEQ ID NO: 1647395 - DNA, 20 bp, Homo sapiens
actgcatttaaatttgattt

SEQ ID NO: 1647396 - DNA, 23 bp, Homo sapiens
actgccaatatagaaaaataaaa

SEQ ID NO: 1647397 - DNA, 15 bp, Homo sapiens
actgccacaccctcc

SEQ ID NO: 1647398 - DNA, 19 bp, Homo sapiens
actgccacaccctccccat

SEQ ID NO: 1647399 - DNA, 21 bp, Homo sapiens
actgccacactctccatcacc

SEQ ID NO: 1647400 - DNA, 15 bp, Homo sapiens
actgccagaagagaa

SEQ ID NO: 1647401 - DNA, 21 bp, Homo sapiens
actgccagaagagaattcagt

SEQ ID NO: 1647402 - DNA, 13 bp, Homo sapiens
actgccagcagca

SEQ ID NO: 1647403 - DNA, 14 bp, Homo sapiens
actgccagcagcag

SEQ ID NO: 1647404 - DNA, 16 bp, Homo sapiens
actgccagcagcagca

SEQ ID NO: 1647405 - DNA, 16 bp, Homo sapiens
actgccaggccagcct

SEQ ID NO: 1647406 - DNA, 19 bp, Homo sapiens
actgccaggccagcctccg

SEQ ID NO: 1647407 - DNA, 18 bp, Homo sapiens
actgccaggctgcctcct

SEQ ID NO: 1647408 - DNA, 24 bp, Homo sapiens
actgccagggccgcggccgcccgc

SEQ ID NO: 1647409 - DNA, 17 bp, Homo sapiens
actgccatattgtgtaa

SEQ ID NO: 1647410 - DNA, 21 bp, Homo sapiens
actgccatgtactagttttag

SEQ ID NO: 1647411 - DNA, 20 bp, Homo sapiens
actgccattagactgaattt

SEQ ID NO: 1647412 - DNA, 15 bp, Homo sapiens
actgcccaccccctc

SEQ ID NO: 1647413 - DNA, 16 bp, Homo sapiens
actgcccaccccctca

SEQ ID NO: 1647414 - DNA, 17 bp, Homo sapiens
actgccccaactcctgg

SEQ ID NO: 1647415 - DNA, 18 bp, Homo sapiens
actgccccacggccctgt

SEQ ID NO: 1647416 - DNA, 20 bp, Homo sapiens
actgccccacggccctgtca

SEQ ID NO: 1647417 - DNA, 22 bp, Homo sapiens
actgccccccatgaggaaggaa

SEQ ID NO: 1647418 - DNA, 20 bp, Homo sapiens
actgccccccgaggctgcta

SEQ ID NO: 1647419 - DNA, 16 bp, Homo sapiens
actgccccctgctgcc

SEQ ID NO: 1647420 - DNA, 17 bp, Homo sapiens
actgccccctgctgcca

SEQ ID NO: 1647421 - DNA, 18 bp, Homo sapiens
actgccccctgctgccat

SEQ ID NO: 1647422 - DNA, 16 bp, Homo sapiens
actgcccgctcctcgg

SEQ ID NO: 1647423 - DNA, 20 bp, Homo sapiens
actgccctaagcccccaggg

SEQ ID NO: 1647424 - DNA, 14 bp, Homo sapiens
actgccctcccctt

SEQ ID NO: 1647425 - DNA, 11 bp, Homo sapiens
actgccctgcc

SEQ ID NO: 1647426 - DNA, 14 bp, Homo sapiens
actgccctggcagc

SEQ ID NO: 1647427 - DNA, 12 bp, Homo sapiens
actgcccttcca

SEQ ID NO: 1647428 - DNA, 17 bp, Homo sapiens
actgccgacatccctcc

SEQ ID NO: 1647429 - DNA, 24 bp, Homo sapiens
actgcctgcagaggtctgtgctga

SEQ ID NO: 1647430 - DNA, 15 bp, Homo sapiens
actgcctgcatgagc

SEQ ID NO: 1647431 - DNA, 19 bp, Homo sapiens
actgcctgcatgagctggc

SEQ ID NO: 1647432 - DNA, 21 bp, Homo sapiens
actgcctgcctcccctccgca

SEQ ID NO: 1647433 - DNA, 18 bp, Homo sapiens
actgcctgtagagacaat

SEQ ID NO: 1647434 - DNA, 17 bp, Homo sapiens
actgcctgtctccatga

SEQ ID NO: 1647435 - DNA, 12 bp, Homo sapiens
actgccttcctc

SEQ ID NO: 1647436 - DNA, 13 bp, Homo sapiens
actgccttcctct

SEQ ID NO: 1647437 - DNA, 12 bp, Homo sapiens
actgccttgaaa

SEQ ID NO: 1647438 - DNA, 20 bp, Homo sapiens
actgccttgggcaaggacac

SEQ ID NO: 1647439 - DNA, 21 bp, Homo sapiens
actgcgaagaccctcttgccc

SEQ ID NO: 1647440 - DNA, 22 bp, Homo sapiens
actgcgaagaccctcttgccca

SEQ ID NO: 1647441 - DNA, 17 bp, Homo sapiens
actgcgactttctgcct

SEQ ID NO: 1647442 - DNA, 21 bp, Homo sapiens
actgcgactttctgcctggag

SEQ ID NO: 1647443 - DNA, 19 bp, Homo sapiens
actgcgaggacatcaaagt

SEQ ID NO: 1647444 - DNA, 15 bp, Homo sapiens
actgcggaagccaaa

SEQ ID NO: 1647445 - DNA, 22 bp, Homo sapiens
actgcggaagccaaaggcagct

SEQ ID NO: 1647446 - DNA, 15 bp, Homo sapiens
actgttgtcaccatt

SEQ ID NO: 1647447 - DNA, 16 bp, Homo sapiens
actgttgttaagcaac

SEQ ID NO: 1647448 - DNA, 19 bp, Homo sapiens
actgtttatttaaggatgg

SEQ ID NO: 1647449 - DNA, 21 bp, Homo sapiens
actgtttcactgaaatgtttg

SEQ ID NO: 1647450 - DNA, 14 bp, Homo sapiens
actgtttccctgct

SEQ ID NO: 1647451 - DNA, 15 bp, Homo sapiens
actgtttccctgctg

SEQ ID NO: 1647452 - DNA, 17 bp, Homo sapiens
actgtttctcttgagct

SEQ ID NO: 1647453 - DNA, 19 bp, Homo sapiens
actgtttctcttgagctgg

SEQ ID NO: 1647454 - DNA, 20 bp, Homo sapiens
actgtttctcttgagctggc

SEQ ID NO: 1647455 - DNA, 21 bp, Homo sapiens
actgtttgccttctactttta

SEQ ID NO: 1647456 - DNA, 13 bp, Homo sapiens
actgtttgtaata

SEQ ID NO: 1647457 - DNA, 20 bp, Homo sapiens
actgttttaataaaagattt

SEQ ID NO: 1647458 - DNA, 15 bp, Homo sapiens
actgttttaattgta

SEQ ID NO: 1647459 - DNA, 22 bp, Homo sapiens
acttaaaaaaatgacagatgtt

SEQ ID NO: 1647460 - DNA, 15 bp, Homo sapiens
acttaaaaaatgtcc

SEQ ID NO: 1647461 - DNA, 17 bp, Homo sapiens
acttaaaaatgtaaata

SEQ ID NO: 1647462 - DNA, 18 bp, Homo sapiens
acttaaaaatgtaaatat

SEQ ID NO: 1647463 - DNA, 23 bp, Homo sapiens
acttaaaaattagcatgctgctt

SEQ ID NO: 1647464 - DNA, 11 bp, Homo sapiens
acttaaaacat

SEQ ID NO: 1647465 - DNA, 14 bp, Homo sapiens
acttaaaagagctc

SEQ ID NO: 1647466 - DNA, 19 bp, Homo sapiens
acttaaacagaagcagagg

SEQ ID NO: 1647467 - DNA, 20 bp, Homo sapiens
acttaaacagaagcagaggc

SEQ ID NO: 1647468 - DNA, 19 bp, Homo sapiens
acttaaagggcccaatgaa

SEQ ID NO: 1647469 - DNA, 18 bp, Homo sapiens
acttaaatgttattatct

SEQ ID NO: 1647470 - DNA, 15 bp, Homo sapiens
acttaaatttgttct

SEQ ID NO: 1647471 - DNA, 14 bp, Homo sapiens
acttaacagatgca

SEQ ID NO: 1647472 - DNA, 17 bp, Homo sapiens
acttaacggctccagga

SEQ ID NO: 1647473 - DNA, 23 bp, Homo sapiens
acttaactattcaggagagtaga

SEQ ID NO: 1647474 - DNA, 19 bp, Homo sapiens
acttaagacaaatgggact

SEQ ID NO: 1647475 - DNA, 22 bp, Homo sapiens
acttaagacaaatgggactgat

SEQ ID NO: 1647476 - DNA, 13 bp, Homo sapiens
acttaagcaaaag

SEQ ID NO: 1647477 - DNA, 14 bp, Homo sapiens
acttaagcaaaaga

SEQ ID NO: 1647478 - DNA, 16 bp, Homo sapiens
acttaagcaaaagaaa

SEQ ID NO: 1647479 - DNA, 19 bp, Homo sapiens
acttaagcaaaagaaaaag

SEQ ID NO: 1647480 - DNA, 15 bp, Homo sapiens
acttaagcacaagca

SEQ ID NO: 1647481 - DNA, 20 bp, Homo sapiens
acttaagcatctggctctaa

SEQ ID NO: 1647482 - DNA, 21 bp, Homo sapiens
acttaagcccagtgcactgaa

SEQ ID NO: 1647483 - DNA, 17 bp, Homo sapiens
acttaagtgcacttttt

SEQ ID NO: 1647484 - DNA, 19 bp, Homo sapiens
acttaagttggtcctttac

SEQ ID NO: 1647485 - DNA, 15 bp, Homo sapiens
acttaataactgtgt

SEQ ID NO: 1647486 - DNA, 20 bp, Homo sapiens
acttaataatttttacctaa

SEQ ID NO: 1647487 - DNA, 12 bp, Homo sapiens
acttaatggaaa

SEQ ID NO: 1647488 - DNA, 16 bp, Homo sapiens
acttacaaaatgccaa

SEQ ID NO: 1647489 - DNA, 23 bp, Homo sapiens
acttacaaactttgtttgtcaca

SEQ ID NO: 1647490 - DNA, 19 bp, Homo sapiens
acttacacttataaaataa

SEQ ID NO: 1647491 - DNA, 21 bp, Homo sapiens
acttacacttataaaataact

SEQ ID NO: 1647492 - DNA, 15 bp, Homo sapiens
acttacacttggagc

SEQ ID NO: 1647493 - DNA, 19 bp, Homo sapiens
acttacctaaacagatata

SEQ ID NO: 1647494 - DNA, 20 bp, Homo sapiens
acttacctgagttgaagagg

SEQ ID NO: 1647495 - DNA, 14 bp, Homo sapiens
acttactatccatt

SEQ ID NO: 1647496 - DNA, 19 bp, Homo sapiens
acttactgtcagagaatat

SEQ ID NO: 1647497 - DNA, 13 bp, Homo sapiens
acttacttgctta

SEQ ID NO: 1647498 - DNA, 21 bp, Homo sapiens
acttactttaattactggaat

SEQ ID NO: 1647499 - DNA, 12 bp, Homo sapiens
acttagaggaaa

SEQ ID NO: 1647500 - DNA, 16 bp, Homo sapiens
acttagaggaaaatga

SEQ ID NO: 1647501 - DNA, 16 bp, Homo sapiens
acttagattgtgttcc

SEQ ID NO: 1647502 - DNA, 22 bp, Homo sapiens
acttagccagttcaaagtgtat

SEQ ID NO: 1647503 - DNA, 13 bp, Homo sapiens
acttagcccaaga

SEQ ID NO: 1647504 - DNA, 22 bp, Homo sapiens
acttagcccaagaggtctgagc

SEQ ID NO: 1647505 - DNA, 23 bp, Homo sapiens
acttagcccaagaggtctgagcc

SEQ ID NO: 1647506 - DNA, 21 bp, Homo sapiens
acttagccgcaccctgcacct

SEQ ID NO: 1647507 - DNA, 12 bp, Homo sapiens
acttagcctgag

SEQ ID NO: 1647508 - DNA, 15 bp, Homo sapiens
acttagcctgagtca

SEQ ID NO: 1647509 - DNA, 17 bp, Homo sapiens
acttagcctttacctgt

SEQ ID NO: 1647510 - DNA, 15 bp, Homo sapiens
acttagctgtactat

SEQ ID NO: 1647511 - DNA, 18 bp, Homo sapiens
acttagctgtactataag

SEQ ID NO: 1647512 - DNA, 18 bp, Homo sapiens
acttaggactagaagatt

SEQ ID NO: 1647513 - DNA, 20 bp, Homo sapiens
acttaggactagaagattag

SEQ ID NO: 1647514 - DNA, 17 bp, Homo sapiens
acttagggtttggagct

SEQ ID NO: 1647515 - DNA, 20 bp, Homo sapiens
acttagtgcggacaagtttt

SEQ ID NO: 1647516 - DNA, 15 bp, Homo sapiens
acttataaaataact

SEQ ID NO: 1647517 - DNA, 18 bp, Homo sapiens
acttataaagaaggttgg

SEQ ID NO: 1647518 - DNA, 16 bp, Homo sapiens
acttatattgaagaca

SEQ ID NO: 1647519 - DNA, 18 bp, Homo sapiens
acttatattgaagacaat

SEQ ID NO: 1647520 - DNA, 22 bp, Homo sapiens
acttatattttatgaacattgt

SEQ ID NO: 1647521 - DNA, 19 bp, Homo sapiens
acttatcatccacattgtt

SEQ ID NO: 1647522 - DNA, 22 bp, Homo sapiens
acttatcatccacattgtttta

SEQ ID NO: 1647523 - DNA, 18 bp, Homo sapiens
acttatccatctttgaac

SEQ ID NO: 1647524 - DNA, 19 bp, Homo sapiens
acttatcctaaaacaaata

SEQ ID NO: 1647525 - DNA, 18 bp, Homo sapiens
acttatctaccattgaag

SEQ ID NO: 1647526 - DNA, 14 bp, Homo sapiens
acttatcttctgga

SEQ ID NO: 1647527 - DNA, 17 bp, Homo sapiens
acttatgatttcatgtg

SEQ ID NO: 1647528 - DNA, 16 bp, Homo sapiens
acttatgctagtttat

SEQ ID NO: 1647529 - DNA, 18 bp, Homo sapiens
acttattcatagttttat

SEQ ID NO: 1647530 - DNA, 15 bp, Homo sapiens
acttattgaccattt

SEQ ID NO: 1647531 - DNA, 21 bp, Homo sapiens
acttattttctgaattcataa

SEQ ID NO: 1647532 - DNA, 22 bp, Homo sapiens
acttattttctgaattcataaa

SEQ ID NO: 1647533 - DNA, 16 bp, Homo sapiens
acttattttctgttca

SEQ ID NO: 1647534 - DNA, 12 bp, Homo sapiens
acttatttttct

SEQ ID NO: 1647535 - DNA, 14 bp, Homo sapiens
acttatttttgaca

SEQ ID NO: 1647536 - DNA, 19 bp, Homo sapiens
acttatttttgacagtgtt

SEQ ID NO: 1647537 - DNA, 13 bp, Homo sapiens
acttcaaggccca

SEQ ID NO: 1647538 - DNA, 22 bp, Homo sapiens
acttcaagtgcatgctctctgc

SEQ ID NO: 1647539 - DNA, 19 bp, Homo sapiens
acttcaatgggctcttcca

SEQ ID NO: 1647540 - DNA, 22 bp, Homo sapiens
acttcaatgggctcttccaaca

SEQ ID NO: 1647541 - DNA, 15 bp, Homo sapiens
acttcacactgcaag

SEQ ID NO: 1647542 - DNA, 16 bp, Homo sapiens
acttcacactgcaaga

SEQ ID NO: 1647543 - DNA, 16 bp, Homo sapiens
acttcacagcgtctgc

SEQ ID NO: 1647544 - DNA, 11 bp, Homo sapiens
acttcactgta

SEQ ID NO: 1647545 - DNA, 12 bp, Homo sapiens
acttcactgtat

SEQ ID NO: 1647546 - DNA, 15 bp, Homo sapiens
acttcactgtatata

SEQ ID NO: 1647547 - DNA, 16 bp, Homo sapiens
acttcactgtatataa

SEQ ID NO: 1647548 - DNA, 23 bp, Homo sapiens
acttcactgtcaggaagaaatca

SEQ ID NO: 1647549 - DNA, 21 bp, Homo sapiens
acttcactgtgaggggaaggc

SEQ ID NO: 1647550 - DNA, 22 bp, Homo sapiens
acttcaggaacaagtaatgtat

SEQ ID NO: 1647551 - DNA, 14 bp, Homo sapiens
acttcaggctcttc

SEQ ID NO: 1647552 - DNA, 20 bp, Homo sapiens
acttcaggctcttctccttt

SEQ ID NO: 1647553 - DNA, 23 bp, Homo sapiens
acttcagggcagggctctgatat

SEQ ID NO: 1647554 - DNA, 12 bp, Homo sapiens
acttcaggtgct

SEQ ID NO: 1647555 - DNA, 17 bp, Homo sapiens
acttcaggtgcttttga

SEQ ID NO: 1647556 - DNA, 21 bp, Homo sapiens
acttcaggtgtgactctagca

SEQ ID NO: 1647557 - DNA, 18 bp, Homo sapiens
acttcagtcttgcctagg

SEQ ID NO: 1647558 - DNA, 22 bp, Homo sapiens
acttcagtttcacagaaaataa

SEQ ID NO: 1647559 - DNA, 22 bp, Homo sapiens
acttcatagaaacctctctatt

SEQ ID NO: 1647560 - DNA, 16 bp, Homo sapiens
actttatgtgtaaata

SEQ ID NO: 1647561 - DNA, 13 bp, Homo sapiens
actttatgttgta

SEQ ID NO: 1647562 - DNA, 16 bp, Homo sapiens
actttatgttgtatga

SEQ ID NO: 1647563 - DNA, 23 bp, Homo sapiens
actttatgttgtatgattccaat

SEQ ID NO: 1647564 - DNA, 15 bp, Homo sapiens
actttattcttgctg

SEQ ID NO: 1647565 - DNA, 22 bp, Homo sapiens
actttattgcaactcttttaag

SEQ ID NO: 1647566 - DNA, 21 bp, Homo sapiens
actttattgccttttaatttt

SEQ ID NO: 1647567 - DNA, 13 bp, Homo sapiens
actttattgctat

SEQ ID NO: 1647568 - DNA, 22 bp, Homo sapiens
actttattgctatcgccctcct

SEQ ID NO: 1647569 - DNA, 21 bp, Homo sapiens
actttattgtacagactgttt

SEQ ID NO: 1647570 - DNA, 15 bp, Homo sapiens
actttatttatttct

SEQ ID NO: 1647571 - DNA, 16 bp, Homo sapiens
actttatttatttcta

SEQ ID NO: 1647572 - DNA, 19 bp, Homo sapiens
actttatttttctgataga

SEQ ID NO: 1647573 - DNA, 15 bp, Homo sapiens
actttattttttaaa

SEQ ID NO: 1647574 - DNA, 23 bp, Homo sapiens
actttcacgtggcctccgcagtg

SEQ ID NO: 1647575 - DNA, 20 bp, Homo sapiens
actttcagagcccccagccc

SEQ ID NO: 1647576 - DNA, 15 bp, Homo sapiens
actttcatctacctt

SEQ ID NO: 1647577 - DNA, 17 bp, Homo sapiens
actttcatcttaaacta

SEQ ID NO: 1647578 - DNA, 22 bp, Homo sapiens
actttcatcttaaactaatacg

SEQ ID NO: 1647579 - DNA, 24 bp, Homo sapiens
actttcatcttaaactaatacgtg

SEQ ID NO: 1647580 - DNA, 21 bp, Homo sapiens
actttcatttttttccaggct

SEQ ID NO: 1647581 - DNA, 18 bp, Homo sapiens
actttccagcagtcagtc

SEQ ID NO: 1647582 - DNA, 21 bp, Homo sapiens
actttccatctctgcctgtca

SEQ ID NO: 1647583 - DNA, 21 bp, Homo sapiens
actttcccaggttctgtttat

SEQ ID NO: 1647584 - DNA, 14 bp, Homo sapiens
actttcccccttcc

SEQ ID NO: 1647585 - DNA, 15 bp, Homo sapiens
actttcccctctcgc

SEQ ID NO: 1647586 - DNA, 21 bp, Homo sapiens
actttccgaaaaataaagaca

SEQ ID NO: 1647587 - DNA, 14 bp, Homo sapiens
actttcctgagctg

SEQ ID NO: 1647588 - DNA, 19 bp, Homo sapiens
actttcctgagctgtcgct

SEQ ID NO: 1647589 - DNA, 21 bp, Homo sapiens
actttccttagacccgccagg

SEQ ID NO: 1647590 - DNA, 17 bp, Homo sapiens
actttccttccctctcc

SEQ ID NO: 1647591 - DNA, 20 bp, Homo sapiens
actttcgaccgactttcccc

SEQ ID NO: 1647592 - DNA, 21 bp, Homo sapiens
actttcgaccgactttcccca

SEQ ID NO: 1647593 - DNA, 15 bp, Homo sapiens
actttctaatgtttc

SEQ ID NO: 1647594 - DNA, 17 bp, Homo sapiens
actttctaatgtttctg

SEQ ID NO: 1647595 - DNA, 17 bp, Homo sapiens
actttctcagttttcat

SEQ ID NO: 1647596 - DNA, 22 bp, Homo sapiens
actttctcttaagattaatttt

SEQ ID NO: 1647597 - DNA, 15 bp, Homo sapiens
actttctggcaaacg

SEQ ID NO: 1647598 - DNA, 22 bp, Homo sapiens
actttctggcaaacgtttctca

SEQ ID NO: 1647599 - DNA, 12 bp, Homo sapiens
actttctgttaa

SEQ ID NO: 1647600 - DNA, 14 bp, Homo sapiens
actttctgttatgg

SEQ ID NO: 1647601 - DNA, 17 bp, Homo sapiens
actttcttattctgtat

SEQ ID NO: 1647602 - DNA, 20 bp, Homo sapiens
actttcttcaccaagtgcaa

SEQ ID NO: 1647603 - DNA, 15 bp, Homo sapiens
actttcttgcatgaa

SEQ ID NO: 1647604 - DNA, 16 bp, Homo sapiens
actttgaaaagttgga

SEQ ID NO: 1647605 - DNA, 23 bp, Homo sapiens
actttgaaatgtgtttctgtata

SEQ ID NO: 1647606 - DNA, 16 bp, Homo sapiens
actttgacaattactc

SEQ ID NO: 1647607 - DNA, 18 bp, Homo sapiens
actttgagaggctgaggt

SEQ ID NO: 1647608 - DNA, 16 bp, Homo sapiens
actttgagatctaaaa

SEQ ID NO: 1647609 - DNA, 18 bp, Homo sapiens
actttgagatctaaaaat

SEQ ID NO: 1647610 - DNA, 19 bp, Homo sapiens
actttgagatctaaaaata

SEQ ID NO: 1647611 - DNA, 16 bp, Homo sapiens
actttgagtacagata

SEQ ID NO: 1647612 - DNA, 17 bp, Homo sapiens
actttgagtacagatac

SEQ ID NO: 1647613 - DNA, 17 bp, Homo sapiens
actttgcagcataccaa

SEQ ID NO: 1647614 - DNA, 19 bp, Homo sapiens
actttgccatttttctata

SEQ ID NO: 1647615 - DNA, 21 bp, Homo sapiens
actttgcccagggtcctgtgc

SEQ ID NO: 1647616 - DNA, 18 bp, Homo sapiens
actttgcccctttcagta

SEQ ID NO: 1647617 - DNA, 19 bp, Homo sapiens
actttgctggtgtagtctt

SEQ ID NO: 1647618 - DNA, 23 bp, Homo sapiens
actttgcttccgccactcagcca

SEQ ID NO: 1647619 - DNA, 13 bp, Homo sapiens
actttgcttgctt

SEQ ID NO: 1647620 - DNA, 20 bp, Homo sapiens
actttgcttgctttgaagta

SEQ ID NO: 1647621 - DNA, 22 bp, Homo sapiens
actttgctttctgaattggaag

SEQ ID NO: 1647622 - DNA, 17 bp, Homo sapiens
actttggaagtttgtgt

SEQ ID NO: 1647623 - DNA, 22 bp, Homo sapiens
actttggagtcccctcacctcc

SEQ ID NO: 1647624 - DNA, 19 bp, Homo sapiens
actttggcaatttcctggc

SEQ ID NO: 1647625 - DNA, 17 bp, Homo sapiens
actttggcttctcctgt

SEQ ID NO: 1647626 - DNA, 14 bp, Homo sapiens
actttgggaggcca

SEQ ID NO: 1647627 - DNA, 19 bp, Homo sapiens
actttgggaggctgaggcg

SEQ ID NO: 1647628 - DNA, 19 bp, Homo sapiens
actttggtacatggccagt

SEQ ID NO: 1647629 - DNA, 23 bp, Homo sapiens
actttggtagctgggaaagcata

SEQ ID NO: 1647630 - DNA, 21 bp, Homo sapiens
actttgtaaaaatcttttgaa

SEQ ID NO: 1647631 - DNA, 17 bp, Homo sapiens
actttgtacatttggga

SEQ ID NO: 1647632 - DNA, 15 bp, Homo sapiens
actttgtattactta

SEQ ID NO: 1647633 - DNA, 22 bp, Homo sapiens
actttgtattacttaggttatt

SEQ ID NO: 1647634 - DNA, 17 bp, Homo sapiens
actttgtctgaaaaatt

SEQ ID NO: 1647635 - DNA, 16 bp, Homo sapiens
actttgtgctcataaa

SEQ ID NO: 1647636 - DNA, 18 bp, Homo sapiens
actttgtgttcatttcat

SEQ ID NO: 1647637 - DNA, 14 bp, Homo sapiens
actttgttctgttg

SEQ ID NO: 1647638 - DNA, 19 bp, Homo sapiens
actttgttctgttgtctgc

SEQ ID NO: 1647639 - DNA, 15 bp, Homo sapiens
actttgttgcaagat

SEQ ID NO: 1647640 - DNA, 23 bp, Homo sapiens
actttgttggtagccatttggta

SEQ ID NO: 1647641 - DNA, 20 bp, Homo sapiens
actttgtttcgtggggaggt

SEQ ID NO: 1647642 - DNA, 17 bp, Homo sapiens
acttttaaaaaaatttt

SEQ ID NO: 1647643 - DNA, 23 bp, Homo sapiens
acttttaaaaaaatttttataaa

SEQ ID NO: 1647644 - DNA, 17 bp, Homo sapiens
acttttaaactgtgtac

SEQ ID NO: 1647645 - DNA, 15 bp, Homo sapiens
acttttaaagaaaaa

SEQ ID NO: 1647646 - DNA, 19 bp, Homo sapiens
acttttaaggataaatcat

SEQ ID NO: 1647647 - DNA, 20 bp, Homo sapiens
acttttaaggataaatcata

SEQ ID NO: 1647648 - DNA, 14 bp, Homo sapiens
acttttaaggcagt

SEQ ID NO: 1647649 - DNA, 17 bp, Homo sapiens
acttttaataaactttt

SEQ ID NO: 1647650 - DNA, 19 bp, Homo sapiens
acttttactctgcctacag

SEQ ID NO: 1647651 - DNA, 21 bp, Homo sapiens
acttttactctgcctacagaa

SEQ ID NO: 1647652 - DNA, 22 bp, Homo sapiens
acttttaggatgggggagaggg

SEQ ID NO: 1647653 - DNA, 16 bp, Homo sapiens
acttttataaagcatg

SEQ ID NO: 1647654 - DNA, 21 bp, Homo sapiens
acttttatgcagcaaatatat

SEQ ID NO: 1647655 - DNA, 22 bp, Homo sapiens
acttttatggctctatcttttc

SEQ ID NO: 1647656 - DNA, 20 bp, Homo sapiens
acttttattttacacagaaa

SEQ ID NO: 1647657 - DNA, 19 bp, Homo sapiens
acttttcacactgtcttcc

SEQ ID NO: 1647658 - DNA, 20 bp, Homo sapiens
acttttcattctcttttaat

SEQ ID NO: 1647659 - DNA, 21 bp, Homo sapiens
acttttccaatatgtgatttt

SEQ ID NO: 1647660 - DNA, 21 bp, Homo sapiens
acttttccattgaccagctct

SEQ ID NO: 1647661 - DNA, 16 bp, Homo sapiens
acttttctaagaaaag

SEQ ID NO: 1647662 - DNA, 20 bp, Homo sapiens
acttttctaagaaaagcatt

SEQ ID NO: 1647663 - DNA, 17 bp, Homo sapiens
acttttctgtaattcag

SEQ ID NO: 1647664 - DNA, 20 bp, Homo sapiens
acttttctgtaattcaggtt

SEQ ID NO: 1647665 - DNA, 13 bp, Homo sapiens
acttttgaaaaga

SEQ ID NO: 1647666 - DNA, 12 bp, Homo sapiens
acttttgagtgt

SEQ ID NO: 1647667 - DNA, 21 bp, Homo sapiens
acttttgagtgtgtgtgtgca

SEQ ID NO: 1647668 - DNA, 17 bp, Homo sapiens
acttttgcatttttcct

SEQ ID NO: 1647669 - DNA, 18 bp, Homo sapiens
acttttgcatttttcctt

SEQ ID NO: 1647670 - DNA, 16 bp, Homo sapiens
acttttggattttatg

SEQ ID NO: 1647671 - DNA, 12 bp, Homo sapiens
acttttgtaaga

SEQ ID NO: 1647672 - DNA, 16 bp, Homo sapiens
acttttgtgtattctg

SEQ ID NO: 1647673 - DNA, 13 bp, Homo sapiens
agaagaacatcca

SEQ ID NO: 1647674 - DNA, 17 bp, Homo sapiens
agaagaaccaaatacct

SEQ ID NO: 1647675 - DNA, 20 bp, Homo sapiens
agaagaagagaagctgctga

SEQ ID NO: 1647676 - DNA, 18 bp, Homo sapiens
agaagaagaggaagaaat

SEQ ID NO: 1647677 - DNA, 19 bp, Homo sapiens
agaagaatattcaggactt

SEQ ID NO: 1647678 - DNA, 14 bp, Homo sapiens
agaagaatggcttt

SEQ ID NO: 1647679 - DNA, 18 bp, Homo sapiens
agaagaatggctttcaat

SEQ ID NO: 1647680 - DNA, 17 bp, Homo sapiens
agaagaattgaacccag

SEQ ID NO: 1647681 - DNA, 19 bp, Homo sapiens
agaagaattgaacccagga

SEQ ID NO: 1647682 - DNA, 20 bp, Homo sapiens
agaagaattgaacccaggag

SEQ ID NO: 1647683 - DNA, 13 bp, Homo sapiens
agaagaattttat

SEQ ID NO: 1647684 - DNA, 22 bp, Homo sapiens
agaagaattttcagaccccagc

SEQ ID NO: 1647685 - DNA, 23 bp, Homo sapiens
agaagaattttcagaccccagcg

SEQ ID NO: 1647686 - DNA, 13 bp, Homo sapiens
agaagacaaaaag

SEQ ID NO: 1647687 - DNA, 15 bp, Homo sapiens
agaagacaaactgct

SEQ ID NO: 1647688 - DNA, 14 bp, Homo sapiens
agaagacaaagtct

SEQ ID NO: 1647689 - DNA, 16 bp, Homo sapiens
agaagacatggagact

SEQ ID NO: 1647690 - DNA, 11 bp, Homo sapiens
agaagacattt

SEQ ID NO: 1647691 - DNA, 16 bp, Homo sapiens
agaagagaagctgctg

SEQ ID NO: 1647692 - DNA, 13 bp, Homo sapiens
agaagagaattca

SEQ ID NO: 1647693 - DNA, 16 bp, Homo sapiens
agaagagaattcagta

SEQ ID NO: 1647694 - DNA, 19 bp, Homo sapiens
agaagagaggaaataacag

SEQ ID NO: 1647695 - DNA, 15 bp, Homo sapiens
agaagagatgtggca

SEQ ID NO: 1647696 - DNA, 22 bp, Homo sapiens
agaagagccatcttggcagggt

SEQ ID NO: 1647697 - DNA, 24 bp, Homo sapiens
agaagagcgagagatcaaagatga

SEQ ID NO: 1647698 - DNA, 21 bp, Homo sapiens
agaagagctgttcacagccag

SEQ ID NO: 1647699 - DNA, 20 bp, Homo sapiens
agaagagcttgcacagccaa

SEQ ID NO: 1647700 - DNA, 19 bp, Homo sapiens
agaagaggagcctcagaag

SEQ ID NO: 1647701 - DNA, 21 bp, Homo sapiens
agaagaggagcctcagaagaa

SEQ ID NO: 1647702 - DNA, 16 bp, Homo sapiens
agaagagggcctgtgg

SEQ ID NO: 1647703 - DNA, 20 bp, Homo sapiens
agaagaggttgggcttccat

SEQ ID NO: 1647704 - DNA, 12 bp, Homo sapiens
agaagataataa

SEQ ID NO: 1647705 - DNA, 17 bp, Homo sapiens
agaagatagtcttggaa

SEQ ID NO: 1647706 - DNA, 18 bp, Homo sapiens
agaagatcggaacagctc

SEQ ID NO: 1647707 - DNA, 20 bp, Homo sapiens
agaagatgaaagattcagtg

SEQ ID NO: 1647708 - DNA, 16 bp, Homo sapiens
agaagatgccagcttc

SEQ ID NO: 1647709 - DNA, 23 bp, Homo sapiens
agaagatgccagcttctctctcc

SEQ ID NO: 1647710 - DNA, 14 bp, Homo sapiens
agaagattctaaaa

SEQ ID NO: 1647711 - DNA, 15 bp, Homo sapiens
agaagattctaaaac

SEQ ID NO: 1647712 - DNA, 22 bp, Homo sapiens
agaagattgttggtgaattttc

SEQ ID NO: 1647713 - DNA, 12 bp, Homo sapiens
agaagcaagaca

SEQ ID NO: 1647714 - DNA, 19 bp, Homo sapiens
agaagcaatctttgaaata

SEQ ID NO: 1647715 - DNA, 18 bp, Homo sapiens
agaagcacagctcctgcc

SEQ ID NO: 1647716 - DNA, 13 bp, Homo sapiens
agaagcacatgtg

SEQ ID NO: 1647717 - DNA, 13 bp, Homo sapiens
agaagcaggttct

SEQ ID NO: 1647718 - DNA, 16 bp, Homo sapiens
agaagcattgcctgga

SEQ ID NO: 1647719 - DNA, 15 bp, Homo sapiens
agaagccaagggaaa

SEQ ID NO: 1647720 - DNA, 16 bp, Homo sapiens
agaagccacaggcctg

SEQ ID NO: 1647721 - DNA, 19 bp, Homo sapiens
agaagccacaggcctgaga

SEQ ID NO: 1647722 - DNA, 14 bp, Homo sapiens
agaagccaccttcc

SEQ ID NO: 1647723 - DNA, 12 bp, Homo sapiens
agaagccaggaa

SEQ ID NO: 1647724 - DNA, 22 bp, Homo sapiens
agaagccaggaatttcccagga

SEQ ID NO: 1647725 - DNA, 18 bp, Homo sapiens
agaagcccaatattataa

SEQ ID NO: 1647726 - DNA, 13 bp, Homo sapiens
agaagccctgatg

SEQ ID NO: 1647727 - DNA, 22 bp, Homo sapiens
agaagcctagtgtgtgtgcttt

SEQ ID NO: 1647728 - DNA, 12 bp, Homo sapiens
agaagcctgagg

SEQ ID NO: 1647729 - DNA, 22 bp, Homo sapiens
agaagcctgtaacactcctctg

SEQ ID NO: 1647730 - DNA, 12 bp, Homo sapiens
agaagccttcag

SEQ ID NO: 1647731 - DNA, 19 bp, Homo sapiens
agaagccttcagctccagg

SEQ ID NO: 1647732 - DNA, 14 bp, Homo sapiens
agaagcgagcactg

SEQ ID NO: 1647733 - DNA, 18 bp, Homo sapiens
agaagctagatgcccctg

SEQ ID NO: 1647734 - DNA, 22 bp, Homo sapiens
agaagctatattagctgaaaca

SEQ ID NO: 1647735 - DNA, 13 bp, Homo sapiens
agaagctcagctg

SEQ ID NO: 1647736 - DNA, 13 bp, Homo sapiens
agaagctcctgct

SEQ ID NO: 1647737 - DNA, 16 bp, Homo sapiens
agaagctcctgctact

SEQ ID NO: 1647738 - DNA, 18 bp, Homo sapiens
agaagctctgattttgct

SEQ ID NO: 1647739 - DNA, 20 bp, Homo sapiens
agaagctcttactctttcct

SEQ ID NO: 1647740 - DNA, 19 bp, Homo sapiens
agaagctgcatccagaggc

SEQ ID NO: 1647741 - DNA, 11 bp, Homo sapiens
agaagctgctc

SEQ ID NO: 1647742 - DNA, 16 bp, Homo sapiens
agaagctgctgaccaa

SEQ ID NO: 1647743 - DNA, 22 bp, Homo sapiens
agaagcttgtggtgttcctgaa

SEQ ID NO: 1647744 - DNA, 13 bp, Homo sapiens
agaaggaaagaag

SEQ ID NO: 1647745 - DNA, 17 bp, Homo sapiens
agaaggaagtgaagagg

SEQ ID NO: 1647746 - DNA, 21 bp, Homo sapiens
agaaggaatggtgcgtggctt

SEQ ID NO: 1647747 - DNA, 15 bp, Homo sapiens
agaaggagggcagag

SEQ ID NO: 1647748 - DNA, 18 bp, Homo sapiens
agaaggagggcagagcca

SEQ ID NO: 1647749 - DNA, 19 bp, Homo sapiens
agaaggagggcagagccat

SEQ ID NO: 1647750 - DNA, 14 bp, Homo sapiens
agaaggcaatatta

SEQ ID NO: 1647751 - DNA, 13 bp, Homo sapiens
agaaggcacacag

SEQ ID NO: 1647752 - DNA, 18 bp, Homo sapiens
agaaggcagtagttttca

SEQ ID NO: 1647753 - DNA, 20 bp, Homo sapiens
agaaggcagtagttttcaaa

SEQ ID NO: 1647754 - DNA, 16 bp, Homo sapiens
agaaggcatgagaaag

SEQ ID NO: 1647755 - DNA, 17 bp, Homo sapiens
agaaggccccagagaga

SEQ ID NO: 1647756 - DNA, 19 bp, Homo sapiens
agaaggccccagagagacc

SEQ ID NO: 1647757 - DNA, 15 bp, Homo sapiens
agaaggccgctgccc

SEQ ID NO: 1647758 - DNA, 13 bp, Homo sapiens
agaaggcgaggag

SEQ ID NO: 1647759 - DNA, 15 bp, Homo sapiens
agaaggcgaggagag

SEQ ID NO: 1647760 - DNA, 15 bp, Homo sapiens
agaaggcgtccatgt

SEQ ID NO: 1647761 - DNA, 16 bp, Homo sapiens
agaagggaatcctcct

SEQ ID NO: 1647762 - DNA, 18 bp, Homo sapiens
agaagggaatcctcctcc

SEQ ID NO: 1647763 - DNA, 23 bp, Homo sapiens
agaagggagactctatttaagat

SEQ ID NO: 1647764 - DNA, 19 bp, Homo sapiens
agaagggccagtcctgcct

SEQ ID NO: 1647765 - DNA, 20 bp, Homo sapiens
agaagggctgcatgatgttt

SEQ ID NO: 1647766 - DNA, 16 bp, Homo sapiens
agaaggggaagcactc

SEQ ID NO: 1647767 - DNA, 18 bp, Homo sapiens
agaaggggctgttcttcc

SEQ ID NO: 1647768 - DNA, 15 bp, Homo sapiens
agaagggggccctgc

SEQ ID NO: 1647769 - DNA, 17 bp, Homo sapiens
agaagggggccctgcta

SEQ ID NO: 1647770 - DNA, 20 bp, Homo sapiens
agaagggggccctgctacct

SEQ ID NO: 1647771 - DNA, 19 bp, Homo sapiens
agaagggggctctgcccca

SEQ ID NO: 1647772 - DNA, 16 bp, Homo sapiens
agaagggggtctctgt

SEQ ID NO: 1647773 - DNA, 13 bp, Homo sapiens
agaagggggtggt

SEQ ID NO: 1647774 - DNA, 14 bp, Homo sapiens
agaagggtggatga

SEQ ID NO: 1647775 - DNA, 22 bp, Homo sapiens
agaagggttctgccctgcctga

SEQ ID NO: 1647776 - DNA, 24 bp, Homo sapiens
agaagggttctgccctgcctgagg

SEQ ID NO: 1647777 - DNA, 22 bp, Homo sapiens
agaagggttttccaccctggaa

SEQ ID NO: 1647778 - DNA, 17 bp, Homo sapiens
agaaggttgacacagtt

SEQ ID NO: 1647779 - DNA, 14 bp, Homo sapiens
agaaggtttattgt

SEQ ID NO: 1647780 - DNA, 22 bp, Homo sapiens
agaaggtttggtccagcctggt

SEQ ID NO: 1647781 - DNA, 16 bp, Homo sapiens
agaagtaagaagagga

SEQ ID NO: 1647782 - DNA, 22 bp, Homo sapiens
agaagtaagaagaggagcctca

SEQ ID NO: 1647783 - DNA, 16 bp, Homo sapiens
agaagtaccagactag

SEQ ID NO: 1647784 - DNA, 21 bp, Homo sapiens
agaagtactgcccttttgtgt

SEQ ID NO: 1647785 - DNA, 19 bp, Homo sapiens
agaagtaggaggaaacagt

SEQ ID NO: 1647786 - DNA, 21 bp, Homo sapiens
agaagtaggcatgagggatca

SEQ ID NO: 1647787 - DNA, 21 bp, Homo sapiens
agaagtaggttctgttttgtt

SEQ ID NO: 1647788 - DNA, 22 bp, Homo sapiens
agacaagagatctacacatgtt

SEQ ID NO: 1647789 - DNA, 13 bp, Homo sapiens
agacaagagctgc

SEQ ID NO: 1647790 - DNA, 20 bp, Homo sapiens
agacaagagctgctgtcctt

SEQ ID NO: 1647791 - DNA, 17 bp, Homo sapiens
agacaagatattgtaca

SEQ ID NO: 1647792 - DNA, 18 bp, Homo sapiens
agacaagatattgtacat

SEQ ID NO: 1647793 - DNA, 16 bp, Homo sapiens
agacaagcactatttt

SEQ ID NO: 1647794 - DNA, 18 bp, Homo sapiens
agacaagcactattttat

SEQ ID NO: 1647795 - DNA, 18 bp, Homo sapiens
agacaagcagcccttgct

SEQ ID NO: 1647796 - DNA, 14 bp, Homo sapiens
agacaagccctggc

SEQ ID NO: 1647797 - DNA, 15 bp, Homo sapiens
agacaagccctggca

SEQ ID NO: 1647798 - DNA, 12 bp, Homo sapiens
agacaaggtgct

SEQ ID NO: 1647799 - DNA, 20 bp, Homo sapiens
agacaagtgactgtatctgt

SEQ ID NO: 1647800 - DNA, 22 bp, Homo sapiens
agacaagtgactgtatctgtgt

SEQ ID NO: 1647801 - DNA, 15 bp, Homo sapiens
agacaataattctac

SEQ ID NO: 1647802 - DNA, 21 bp, Homo sapiens
agacaatatgtgagtgccttt

SEQ ID NO: 1647803 - DNA, 20 bp, Homo sapiens
agacaatcactgccaacccc

SEQ ID NO: 1647804 - DNA, 18 bp, Homo sapiens
agacaatggacccttttt

SEQ ID NO: 1647805 - DNA, 20 bp, Homo sapiens
agacacaactatttttccaa

SEQ ID NO: 1647806 - DNA, 22 bp, Homo sapiens
agacacaaggtgatttcagact

SEQ ID NO: 1647807 - DNA, 19 bp, Homo sapiens
agacacaatttcatttcca

SEQ ID NO: 1647808 - DNA, 11 bp, Homo sapiens
agacacacaca

SEQ ID NO: 1647809 - DNA, 18 bp, Homo sapiens
agacacaccgcggccagg

SEQ ID NO: 1647810 - DNA, 22 bp, Homo sapiens
agacacaccgcggccaggcacc

SEQ ID NO: 1647811 - DNA, 14 bp, Homo sapiens
agacacagaacaca

SEQ ID NO: 1647812 - DNA, 16 bp, Homo sapiens
agacacagaacacaga

SEQ ID NO: 1647813 - DNA, 21 bp, Homo sapiens
agacacatgaaggtaaataaa

SEQ ID NO: 1647814 - DNA, 15 bp, Homo sapiens
agacacattgccttc

SEQ ID NO: 1647815 - DNA, 16 bp, Homo sapiens
agacacattgccttct

SEQ ID NO: 1647816 - DNA, 19 bp, Homo sapiens
agacaccaaactgccaaaa

SEQ ID NO: 1647817 - DNA, 16 bp, Homo sapiens
agacaccaaagttcta

SEQ ID NO: 1647818 - DNA, 17 bp, Homo sapiens
agacaccaaagttctaa

SEQ ID NO: 1647819 - DNA, 13 bp, Homo sapiens
agacaccatcctg

SEQ ID NO: 1647820 - DNA, 18 bp, Homo sapiens
agacaccatcctgagcca

SEQ ID NO: 1647821 - DNA, 20 bp, Homo sapiens
agacaccatcctgagccagg

SEQ ID NO: 1647822 - DNA, 15 bp, Homo sapiens
agacaccatgtgcaa

SEQ ID NO: 1647823 - DNA, 18 bp, Homo sapiens
agacaccatgtgcaataa

SEQ ID NO: 1647824 - DNA, 13 bp, Homo sapiens
agacaccctctgg

SEQ ID NO: 1647825 - DNA, 22 bp, Homo sapiens
agacaccctctgggggtcctct

SEQ ID NO: 1647826 - DNA, 22 bp, Homo sapiens
agacaccttggacatcctcctc

SEQ ID NO: 1647827 - DNA, 15 bp, Homo sapiens
agacacgacagcaca

SEQ ID NO: 1647828 - DNA, 21 bp, Homo sapiens
agacacgacagcacacacagt

SEQ ID NO: 1647829 - DNA, 17 bp, Homo sapiens
agacacgtggcctcgtg

SEQ ID NO: 1647830 - DNA, 15 bp, Homo sapiens
agacactaagttata

SEQ ID NO: 1647831 - DNA, 16 bp, Homo sapiens
agacactacatatcta

SEQ ID NO: 1647832 - DNA, 18 bp, Homo sapiens
agacactgatctggctgc

SEQ ID NO: 1647833 - DNA, 12 bp, Homo sapiens
agacactgcctg

SEQ ID NO: 1647834 - DNA, 15 bp, Homo sapiens
agacacttcagatct

SEQ ID NO: 1647835 - DNA, 17 bp, Homo sapiens
agacacttgctcccaac

SEQ ID NO: 1647836 - DNA, 13 bp, Homo sapiens
agacactttggaa

SEQ ID NO: 1647837 - DNA, 23 bp, Homo sapiens
agacactttggaagtttgtgttc

SEQ ID NO: 1647838 - DNA, 20 bp, Homo sapiens
agacactttgtctagtgtat

SEQ ID NO: 1647839 - DNA, 12 bp, Homo sapiens
agacagaaaagt

SEQ ID NO: 1647840 - DNA, 13 bp, Homo sapiens
agacagaaaagtg

SEQ ID NO: 1647841 - DNA, 20 bp, Homo sapiens
agacagaaaagtgcctgagc

SEQ ID NO: 1647842 - DNA, 21 bp, Homo sapiens
agacagaaaagtgcctgagct

SEQ ID NO: 1647843 - DNA, 22 bp, Homo sapiens
agacagaaaagtgcctgagctg

SEQ ID NO: 1647844 - DNA, 23 bp, Homo sapiens
agacagaaagcctccgctgggct

SEQ ID NO: 1647845 - DNA, 12 bp, Homo sapiens
agacagaacacc

SEQ ID NO: 1647846 - DNA, 14 bp, Homo sapiens
agacagaacaccta

SEQ ID NO: 1647847 - DNA, 15 bp, Homo sapiens
agacagaccctctgc

SEQ ID NO: 1647848 - DNA, 15 bp, Homo sapiens
agacagacttgagaa

SEQ ID NO: 1647849 - DNA, 14 bp, Homo sapiens
agacagagaatctt

SEQ ID NO: 1647850 - DNA, 15 bp, Homo sapiens
agacagagacaagta

SEQ ID NO: 1647851 - DNA, 16 bp, Homo sapiens
agacagagacgcagga

SEQ ID NO: 1647852 - DNA, 15 bp, Homo sapiens
agacagagaggactg

SEQ ID NO: 1647853 - DNA, 16 bp, Homo sapiens
agacagagccaggaga

SEQ ID NO: 1647854 - DNA, 19 bp, Homo sapiens
agacagagccaggagaagc

SEQ ID NO: 1647855 - DNA, 22 bp, Homo sapiens
agacagaggggatggggataga

SEQ ID NO: 1647856 - DNA, 20 bp, Homo sapiens
agacagagtccctggctcct

SEQ ID NO: 1647857 - DNA, 23 bp, Homo sapiens
agacagagtccctggctcctcta

SEQ ID NO: 1647858 - DNA, 20 bp, Homo sapiens
agacagagtcttactctgtt

SEQ ID NO: 1647859 - DNA, 16 bp, Homo sapiens
agacagatgccccaga

SEQ ID NO: 1647860 - DNA, 14 bp, Homo sapiens
agacagcagcctgt

SEQ ID NO: 1647861 - DNA, 17 bp, Homo sapiens
agacagcccaggatact

SEQ ID NO: 1647862 - DNA, 15 bp, Homo sapiens
agacagcttttctca

SEQ ID NO: 1647863 - DNA, 19 bp, Homo sapiens
agacagcttttctcaactg

SEQ ID NO: 1647864 - DNA, 21 bp, Homo sapiens
agacaggaaaatcctctggct

SEQ ID NO: 1647865 - DNA, 22 bp, Homo sapiens
agacaggacagaatgtgttctt

SEQ ID NO: 1647866 - DNA, 22 bp, Homo sapiens
agacaggcccaagagatgaaga

SEQ ID NO: 1647867 - DNA, 23 bp, Homo sapiens
agacaggcccaagagatgaagag

SEQ ID NO: 1647868 - DNA, 17 bp, Homo sapiens
agacaggcggggcccag

SEQ ID NO: 1647869 - DNA, 22 bp, Homo sapiens
agacagggaaaggtcagcccgt

SEQ ID NO: 1647870 - DNA, 19 bp, Homo sapiens
agacagggtctgaaggact

SEQ ID NO: 1647871 - DNA, 15 bp, Homo sapiens
agacaggtcctgatt

SEQ ID NO: 1647872 - DNA, 15 bp, Homo sapiens
agacaggtggcctag

SEQ ID NO: 1647873 - DNA, 18 bp, Homo sapiens
agacagtatatttatagt

SEQ ID NO: 1647874 - DNA, 17 bp, Homo sapiens
agacagtctgttatgca

SEQ ID NO: 1647875 - DNA, 11 bp, Homo sapiens
agacagtgtac

SEQ ID NO: 1647876 - DNA, 14 bp, Homo sapiens
agacagttctctgt

SEQ ID NO: 1647877 - DNA, 16 bp, Homo sapiens
agacatacagctgcct

SEQ ID NO: 1647878 - DNA, 19 bp, Homo sapiens
agacataggccatgaaaaa

SEQ ID NO: 1647879 - DNA, 14 bp, Homo sapiens
agacatcaatgaaa

SEQ ID NO: 1647880 - DNA, 23 bp, Homo sapiens
agacatcagtctccaacatgttt

SEQ ID NO: 1647881 - DNA, 14 bp, Homo sapiens
agacatctctgcac

SEQ ID NO: 1647882 - DNA, 23 bp, Homo sapiens
agacatgccacaaggacttcctg

SEQ ID NO: 1647883 - DNA, 19 bp, Homo sapiens
agacatggaggttctaagg

SEQ ID NO: 1647884 - DNA, 18 bp, Homo sapiens
agacatggtgtctcacac

SEQ ID NO: 1647885 - DNA, 16 bp, Homo sapiens
agacatgtaggtgttt

SEQ ID NO: 1647886 - DNA, 19 bp, Homo sapiens
agacatgtaggtgtttgtt

SEQ ID NO: 1647887 - DNA, 19 bp, Homo sapiens
agacatgtgaggaggaaaa

SEQ ID NO: 1647888 - DNA, 20 bp, Homo sapiens
agacatgtggaggggcagcc

SEQ ID NO: 1647889 - DNA, 17 bp, Homo sapiens
agacatgtggtgggaca

SEQ ID NO: 1647890 - DNA, 14 bp, Homo sapiens
agacattaaatcta

SEQ ID NO: 1647891 - DNA, 22 bp, Homo sapiens
agacattaaatctatgaagtat

SEQ ID NO: 1647892 - DNA, 14 bp, Homo sapiens
agacattctcacat

SEQ ID NO: 1647893 - DNA, 23 bp, Homo sapiens
agacattgatggggacatttctt

SEQ ID NO: 1647894 - DNA, 15 bp, Homo sapiens
agacattggcaccta

SEQ ID NO: 1647895 - DNA, 23 bp, Homo sapiens
agacatttatactcttttttcat

SEQ ID NO: 1647896 - DNA, 17 bp, Homo sapiens
agacatttgctgaactc

SEQ ID NO: 1647897 - DNA, 18 bp, Homo sapiens
agacatttgctgaactca

SEQ ID NO: 1647898 - DNA, 15 bp, Homo sapiens
agacattttaagttt

SEQ ID NO: 1647899 - DNA, 17 bp, Homo sapiens
agacattttgtgtgaga

SEQ ID NO: 1647900 - DNA, 18 bp, Homo sapiens
agacattttgtgtgagac

SEQ ID NO: 1647901 - DNA, 19 bp, Homo sapiens
agacattttgtgtgagact

SEQ ID NO: 1647902 - DNA, 13 bp, Homo sapiens
agagaaaagctgg

SEQ ID NO: 1647903 - DNA, 18 bp, Homo sapiens
agagaaaatattacttat

SEQ ID NO: 1647904 - DNA, 18 bp, Homo sapiens
agagaaaatgtaaaggag

SEQ ID NO: 1647905 - DNA, 14 bp, Homo sapiens
agagaaaattgaga

SEQ ID NO: 1647906 - DNA, 13 bp, Homo sapiens
agagaaacagttg

SEQ ID NO: 1647907 - DNA, 10 bp, Homo sapiens
agagaaagaa

SEQ ID NO: 1647908 - DNA, 16 bp, Homo sapiens
agagaaagaaatagaa

SEQ ID NO: 1647909 - DNA, 13 bp, Homo sapiens
agagaaagagaga

SEQ ID NO: 1647910 - DNA, 14 bp, Homo sapiens
agagaaagagagaa

SEQ ID NO: 1647911 - DNA, 18 bp, Homo sapiens
agagaaagagagaagcca

SEQ ID NO: 1647912 - DNA, 18 bp, Homo sapiens
agagaaagcacgtgtctc

SEQ ID NO: 1647913 - DNA, 18 bp, Homo sapiens
agagaaaggggagcccac

SEQ ID NO: 1647914 - DNA, 19 bp, Homo sapiens
agagaaaggggagcccact

SEQ ID NO: 1647915 - DNA, 14 bp, Homo sapiens
agagaaatatgaag

SEQ ID NO: 1647916 - DNA, 23 bp, Homo sapiens
agagaaatattttaatttttaaa

SEQ ID NO: 1647917 - DNA, 14 bp, Homo sapiens
agagaaatcacagg

SEQ ID NO: 1647918 - DNA, 20 bp, Homo sapiens
agagaaatttttatttttga

SEQ ID NO: 1647919 - DNA, 21 bp, Homo sapiens
agagaaatttttatttttgaa

SEQ ID NO: 1647920 - DNA, 15 bp, Homo sapiens
agagaaccgagcaaa

SEQ ID NO: 1647921 - DNA, 21 bp, Homo sapiens
agagaaccgagcaaagatcaa

SEQ ID NO: 1647922 - DNA, 20 bp, Homo sapiens
agagaagaatccacaaggac

SEQ ID NO: 1647923 - DNA, 18 bp, Homo sapiens
agagaagagggcccagcc

SEQ ID NO: 1647924 - DNA, 19 bp, Homo sapiens
agagaagagggcccagccc

SEQ ID NO: 1647925 - DNA, 16 bp, Homo sapiens
agagaagcaagtggtg

SEQ ID NO: 1647926 - DNA, 12 bp, Homo sapiens
agagaagcaggc

SEQ ID NO: 1647927 - DNA, 15 bp, Homo sapiens
agagaagcaggcaga

SEQ ID NO: 1647928 - DNA, 16 bp, Homo sapiens
agagaagccagccaca

SEQ ID NO: 1647929 - DNA, 12 bp, Homo sapiens
agagaagctcct

SEQ ID NO: 1647930 - DNA, 16 bp, Homo sapiens
agagaagctcctgcta

SEQ ID NO: 1647931 - DNA, 23 bp, Homo sapiens
agagaaggaaaagactgaatcta

SEQ ID NO: 1647932 - DNA, 13 bp, Homo sapiens
agagaaggcagga

SEQ ID NO: 1647933 - DNA, 20 bp, Homo sapiens
agagaaggcaggaatgtgtg

SEQ ID NO: 1647934 - DNA, 12 bp, Homo sapiens
agagaaggcctt

SEQ ID NO: 1647935 - DNA, 21 bp, Homo sapiens
agagaaggccttacagaaaat

SEQ ID NO: 1647936 - DNA, 22 bp, Homo sapiens
agagaaggggaagcactcgtgt

SEQ ID NO: 1647937 - DNA, 20 bp, Homo sapiens
agagaaggtggacctggcag

SEQ ID NO: 1647938 - DNA, 17 bp, Homo sapiens
agagaagtgagtggtgt

SEQ ID NO: 1647939 - DNA, 16 bp, Homo sapiens
agagaataaattggat

SEQ ID NO: 1647940 - DNA, 22 bp, Homo sapiens
agagaataaattggattatttt

SEQ ID NO: 1647941 - DNA, 19 bp, Homo sapiens
agagaatagagctgccact

SEQ ID NO: 1647942 - DNA, 20 bp, Homo sapiens
agagaatagagctgccactg

SEQ ID NO: 1647943 - DNA, 23 bp, Homo sapiens
agagaatagagctgccactgggc

SEQ ID NO: 1647944 - DNA, 21 bp, Homo sapiens
agagaatatgtatgcctgcaa

SEQ ID NO: 1647945 - DNA, 14 bp, Homo sapiens
agagaatgagagcg

SEQ ID NO: 1647946 - DNA, 14 bp, Homo sapiens
agagaatgaggaag

SEQ ID NO: 1647947 - DNA, 18 bp, Homo sapiens
agagaatgagtccttgat

SEQ ID NO: 1647948 - DNA, 14 bp, Homo sapiens
agagaatggagaca

SEQ ID NO: 1647949 - DNA, 16 bp, Homo sapiens
agagaatgtctgatct

SEQ ID NO: 1647950 - DNA, 20 bp, Homo sapiens
agagaatgtgtgtgtgtggc

SEQ ID NO: 1647951 - DNA, 14 bp, Homo sapiens
agagaatgttccta

SEQ ID NO: 1647952 - DNA, 15 bp, Homo sapiens
agagaatgttcctac

SEQ ID NO: 1647953 - DNA, 20 bp, Homo sapiens
agagaattagacaaatttgt

SEQ ID NO: 1647954 - DNA, 14 bp, Homo sapiens
agagaattcagtat

SEQ ID NO: 1647955 - DNA, 18 bp, Homo sapiens
agagaattcagtattttt

SEQ ID NO: 1647956 - DNA, 22 bp, Homo sapiens
agagaatttctaccatttcaga

SEQ ID NO: 1647957 - DNA, 13 bp, Homo sapiens
agagacaaaatat

SEQ ID NO: 1647958 - DNA, 20 bp, Homo sapiens
agagacaaacacctcccagg

SEQ ID NO: 1647959 - DNA, 14 bp, Homo sapiens
agagacaagtaatt

SEQ ID NO: 1647960 - DNA, 20 bp, Homo sapiens
agagacaagtaatttcagtg

SEQ ID NO: 1647961 - DNA, 17 bp, Homo sapiens
agagacacatacagagt

SEQ ID NO: 1647962 - DNA, 14 bp, Homo sapiens
agagacacctgcac

SEQ ID NO: 1647963 - DNA, 15 bp, Homo sapiens
agagacacctgcacc

SEQ ID NO: 1647964 - DNA, 18 bp, Homo sapiens
agagacacctgcacctcc

SEQ ID NO: 1647965 - DNA, 20 bp, Homo sapiens
agagacacctgcacctcccc

SEQ ID NO: 1647966 - DNA, 22 bp, Homo sapiens
agagacacctgcacctcccccc

SEQ ID NO: 1647967 - DNA, 18 bp, Homo sapiens
agagacagacttgagaac

SEQ ID NO: 1647968 - DNA, 16 bp, Homo sapiens
agagacagcccaggat

SEQ ID NO: 1647969 - DNA, 18 bp, Homo sapiens
agagacaggcccaagaga

SEQ ID NO: 1647970 - DNA, 20 bp, Homo sapiens
agagacaggcccaagagatg

SEQ ID NO: 1647971 - DNA, 23 bp, Homo sapiens
agagacatacttgaagggccaga

SEQ ID NO: 1647972 - DNA, 13 bp, Homo sapiens
agagaccacacca

SEQ ID NO: 1647973 - DNA, 12 bp, Homo sapiens
agagaccagcac

SEQ ID NO: 1647974 - DNA, 21 bp, Homo sapiens
agagaccagcactcagcctca

SEQ ID NO: 1647975 - DNA, 14 bp, Homo sapiens
agagaccagggctc

SEQ ID NO: 1647976 - DNA, 16 bp, Homo sapiens
agagacccaaggagga

SEQ ID NO: 1647977 - DNA, 21 bp, Homo sapiens
agagacccaaggaggaaaaac

SEQ ID NO: 1647978 - DNA, 17 bp, Homo sapiens
agagacccagatctcat

SEQ ID NO: 1647979 - DNA, 21 bp, Homo sapiens
agagaccctcactgctgggga

SEQ ID NO: 1647980 - DNA, 20 bp, Homo sapiens
agagaccgtcgggggctgag

SEQ ID NO: 1647981 - DNA, 15 bp, Homo sapiens
agagacctcatcctg

SEQ ID NO: 1647982 - DNA, 15 bp, Homo sapiens
agagacctctgccta

SEQ ID NO: 1647983 - DNA, 17 bp, Homo sapiens
agagacctgccctctct

SEQ ID NO: 1647984 - DNA, 18 bp, Homo sapiens
agagacgccctatttcta

SEQ ID NO: 1647985 - DNA, 20 bp, Homo sapiens
agagactcagggccccagca

SEQ ID NO: 1647986 - DNA, 21 bp, Homo sapiens
agagactcatttcacagcctt

SEQ ID NO: 1647987 - DNA, 24 bp, Homo sapiens
agagactgaaagcagcagctagga

SEQ ID NO: 1647988 - DNA, 22 bp, Homo sapiens
agagactgaatagatatgaaag

SEQ ID NO: 1647989 - DNA, 22 bp, Homo sapiens
agagactgcgttctgcaagcat

SEQ ID NO: 1647990 - DNA, 14 bp, Homo sapiens
agagactgtagatt

SEQ ID NO: 1647991 - DNA, 22 bp, Homo sapiens
agagactgtagattgcttctgt

SEQ ID NO: 1647992 - DNA, 23 bp, Homo sapiens
agagactgtgaggcggcagctgg

SEQ ID NO: 1647993 - DNA, 18 bp, Homo sapiens
agagacttgttttggatg

SEQ ID NO: 1647994 - DNA, 19 bp, Homo sapiens
agagagaaaaaaaaaatag

SEQ ID NO: 1647995 - DNA, 14 bp, Homo sapiens
agagagaagcaggc

SEQ ID NO: 1647996 - DNA, 15 bp, Homo sapiens
agagagaagccagcc

SEQ ID NO: 1647997 - DNA, 11 bp, Homo sapiens
agagagaataa

SEQ ID NO: 1647998 - DNA, 13 bp, Homo sapiens
agagagaataaat

SEQ ID NO: 1647999 - DNA, 23 bp, Homo sapiens
agagagaatgagagcgacacaga

SEQ ID NO: 1648000 - DNA, 17 bp, Homo sapiens
agagagaccccgcaccc

SEQ ID NO: 1648001 - DNA, 21 bp, Homo sapiens
agagagaccccgcacccggct

SEQ ID NO: 1648002 - DNA, 22 bp, Homo sapiens
agagagaccccgcacccggctc

SEQ ID NO: 1648003 - DNA, 13 bp, Homo sapiens
agagagactgatg

SEQ ID NO: 1648004 - DNA, 15 bp, Homo sapiens
agagagagaccctca

SEQ ID NO: 1648005 - DNA, 15 bp, Homo sapiens
agagagagagagaga

SEQ ID NO: 1648006 - DNA, 14 bp, Homo sapiens
agagagaggcagaa

SEQ ID NO: 1648007 - DNA, 14 bp, Homo sapiens
agagagaggctgcc

SEQ ID NO: 1648008 - DNA, 18 bp, Homo sapiens
agagagaggctgcctcag

SEQ ID NO: 1648009 - DNA, 13 bp, Homo sapiens
agagagaggggag

SEQ ID NO: 1648010 - DNA, 14 bp, Homo sapiens
agagagagtgtttg

SEQ ID NO: 1648011 - DNA, 17 bp, Homo sapiens
agagagccaagacggag

SEQ ID NO: 1648012 - DNA, 13 bp, Homo sapiens
agagagcctgtca

SEQ ID NO: 1648013 - DNA, 20 bp, Homo sapiens
agagagcctgtcaccagagc

SEQ ID NO: 1648014 - DNA, 13 bp, Homo sapiens
agagagccttaac

SEQ ID NO: 1648015 - DNA, 15 bp, Homo sapiens
agagaggaccaggtt

SEQ ID NO: 1648016 - DNA, 22 bp, Homo sapiens
agagaggcagaagaaccctggc

SEQ ID NO: 1648017 - DNA, 14 bp, Homo sapiens
agaggccagcctgg

SEQ ID NO: 1648018 - DNA, 17 bp, Homo sapiens
agaggccagtaggagac

SEQ ID NO: 1648019 - DNA, 15 bp, Homo sapiens
agaggccatggcaga

SEQ ID NO: 1648020 - DNA, 18 bp, Homo sapiens
agaggcccactagagggc

SEQ ID NO: 1648021 - DNA, 21 bp, Homo sapiens
agaggcccactagagggccca

SEQ ID NO: 1648022 - DNA, 20 bp, Homo sapiens
agaggcccagatattagaaa

SEQ ID NO: 1648023 - DNA, 16 bp, Homo sapiens
agaggcccagccctca

SEQ ID NO: 1648024 - DNA, 17 bp, Homo sapiens
agaggcccaggcaccac

SEQ ID NO: 1648025 - DNA, 12 bp, Homo sapiens
agaggccccagc

SEQ ID NO: 1648026 - DNA, 16 bp, Homo sapiens
agaggccccagcctcc

SEQ ID NO: 1648027 - DNA, 16 bp, Homo sapiens
agaggcccccagccca

SEQ ID NO: 1648028 - DNA, 21 bp, Homo sapiens
agaggcccccagcccagggct

SEQ ID NO: 1648029 - DNA, 15 bp, Homo sapiens
agaggccctggaggt

SEQ ID NO: 1648030 - DNA, 16 bp, Homo sapiens
agaggccctggaggtc

SEQ ID NO: 1648031 - DNA, 16 bp, Homo sapiens
agaggcctgctgccag

SEQ ID NO: 1648032 - DNA, 19 bp, Homo sapiens
agaggcctggcatcttctg

SEQ ID NO: 1648033 - DNA, 14 bp, Homo sapiens
agaggcctgggctg

SEQ ID NO: 1648034 - DNA, 22 bp, Homo sapiens
agaggcctgggggacccctggc

SEQ ID NO: 1648035 - DNA, 18 bp, Homo sapiens
agaggcctgtttggcctc

SEQ ID NO: 1648036 - DNA, 21 bp, Homo sapiens
agaggcctttaaccatggtgc

SEQ ID NO: 1648037 - DNA, 19 bp, Homo sapiens
agaggccttttggaatgtg

SEQ ID NO: 1648038 - DNA, 14 bp, Homo sapiens
agaggccttttgtt

SEQ ID NO: 1648039 - DNA, 14 bp, Homo sapiens
agaggcgagccagg

SEQ ID NO: 1648040 - DNA, 16 bp, Homo sapiens
agaggcgagccaggca

SEQ ID NO: 1648041 - DNA, 17 bp, Homo sapiens
agaggcgggagaactga

SEQ ID NO: 1648042 - DNA, 18 bp, Homo sapiens
agaggcgggagaactgaa

SEQ ID NO: 1648043 - DNA, 15 bp, Homo sapiens
agaggcgggccagcc

SEQ ID NO: 1648044 - DNA, 17 bp, Homo sapiens
agaggcgggccagccag

SEQ ID NO: 1648045 - DNA, 20 bp, Homo sapiens
agaggcgggccagccaggcg

SEQ ID NO: 1648046 - DNA, 21 bp, Homo sapiens
agaggcgtactacccagctct

SEQ ID NO: 1648047 - DNA, 22 bp, Homo sapiens
agaggcgtactacccagctctg

SEQ ID NO: 1648048 - DNA, 16 bp, Homo sapiens
agaggcgtctgtatat

SEQ ID NO: 1648049 - DNA, 16 bp, Homo sapiens
agaggctaagatgaga

SEQ ID NO: 1648050 - DNA, 21 bp, Homo sapiens
agaggctaattcagtgtcaca

SEQ ID NO: 1648051 - DNA, 17 bp, Homo sapiens
agaggctagcttctgct

SEQ ID NO: 1648052 - DNA, 16 bp, Homo sapiens
agaggctctccgtgca

SEQ ID NO: 1648053 - DNA, 13 bp, Homo sapiens
agaggctgaaaga

SEQ ID NO: 1648054 - DNA, 17 bp, Homo sapiens
agaggctgaggcctgga

SEQ ID NO: 1648055 - DNA, 18 bp, Homo sapiens
agaggctgaggcctggac

SEQ ID NO: 1648056 - DNA, 13 bp, Homo sapiens
agaggctgcattg

SEQ ID NO: 1648057 - DNA, 12 bp, Homo sapiens
agaggctgcccc

SEQ ID NO: 1648058 - DNA, 19 bp, Homo sapiens
agaggctgcccctctcacc

SEQ ID NO: 1648059 - DNA, 20 bp, Homo sapiens
agaggctgcccctctcacca

SEQ ID NO: 1648060 - DNA, 16 bp, Homo sapiens
agaggctgcctcagcc

SEQ ID NO: 1648061 - DNA, 17 bp, Homo sapiens
agaggctgcctcagcca

SEQ ID NO: 1648062 - DNA, 22 bp, Homo sapiens
agaggctgcctctcccatcact

SEQ ID NO: 1648063 - DNA, 17 bp, Homo sapiens
agaggctgcttctctac

SEQ ID NO: 1648064 - DNA, 19 bp, Homo sapiens
agaggctggaggcagggcc

SEQ ID NO: 1648065 - DNA, 20 bp, Homo sapiens
agaggctggaggcagggcct

SEQ ID NO: 1648066 - DNA, 12 bp, Homo sapiens
agaggcttctcc

SEQ ID NO: 1648067 - DNA, 17 bp, Homo sapiens
agaggcttctccgccag

SEQ ID NO: 1648068 - DNA, 12 bp, Homo sapiens
agagggaatgtg

SEQ ID NO: 1648069 - DNA, 21 bp, Homo sapiens
agagggacagcccactgagaa

SEQ ID NO: 1648070 - DNA, 13 bp, Homo sapiens
agagggacagggt

SEQ ID NO: 1648071 - DNA, 21 bp, Homo sapiens
agagggacggccaagaatgta

SEQ ID NO: 1648072 - DNA, 22 bp, Homo sapiens
agagggacggccaagaatgtac

SEQ ID NO: 1648073 - DNA, 19 bp, Homo sapiens
agagggactcaagggaaag

SEQ ID NO: 1648074 - DNA, 19 bp, Homo sapiens
agagggagaagcatgaaaa

SEQ ID NO: 1648075 - DNA, 12 bp, Homo sapiens
agagggagctgt

SEQ ID NO: 1648076 - DNA, 22 bp, Homo sapiens
agagggaggtcactggaaaggg

SEQ ID NO: 1648077 - DNA, 21 bp, Homo sapiens
agagggcaaacccaaaacctc

SEQ ID NO: 1648078 - DNA, 20 bp, Homo sapiens
agagggcagtacctgggaaa

SEQ ID NO: 1648079 - DNA, 13 bp, Homo sapiens
agagggccagcag

SEQ ID NO: 1648080 - DNA, 14 bp, Homo sapiens
agagggccagcagg

SEQ ID NO: 1648081 - DNA, 21 bp, Homo sapiens
agagggccagcaggctcctgg

SEQ ID NO: 1648082 - DNA, 13 bp, Homo sapiens
agagggcccagcc

SEQ ID NO: 1648083 - DNA, 14 bp, Homo sapiens
agagggcccagccc

SEQ ID NO: 1648084 - DNA, 14 bp, Homo sapiens
agagggcccagctg

SEQ ID NO: 1648085 - DNA, 15 bp, Homo sapiens
agagggcccagctgt

SEQ ID NO: 1648086 - DNA, 20 bp, Homo sapiens
agagggcccagctgtagcca

SEQ ID NO: 1648087 - DNA, 20 bp, Homo sapiens
agagggcctctgcctgggac

SEQ ID NO: 1648088 - DNA, 15 bp, Homo sapiens
agagggcctgtggga

SEQ ID NO: 1648089 - DNA, 19 bp, Homo sapiens
agagggcctgtgggagcct

SEQ ID NO: 1648090 - DNA, 18 bp, Homo sapiens
agagggctggaggcccag

SEQ ID NO: 1648091 - DNA, 15 bp, Homo sapiens
agaggggaaggaaat

SEQ ID NO: 1648092 - DNA, 14 bp, Homo sapiens
agaggggaggggcc

SEQ ID NO: 1648093 - DNA, 18 bp, Homo sapiens
agaggggaggggcctagg

SEQ ID NO: 1648094 - DNA, 20 bp, Homo sapiens
agaggggaggggcctaggga

SEQ ID NO: 1648095 - DNA, 13 bp, Homo sapiens
agaggggcagccc

SEQ ID NO: 1648096 - DNA, 14 bp, Homo sapiens
agaggggcagccct

SEQ ID NO: 1648097 - DNA, 13 bp, Homo sapiens
agaggggcagccg

SEQ ID NO: 1648098 - DNA, 15 bp, Homo sapiens
agaggggcctgcagg

SEQ ID NO: 1648099 - DNA, 13 bp, Homo sapiens
agaggggctgggg

SEQ ID NO: 1648100 - DNA, 15 bp, Homo sapiens
agaggggctggggca

SEQ ID NO: 1648101 - DNA, 16 bp, Homo sapiens
agagggggagtagcca

SEQ ID NO: 1648102 - DNA, 12 bp, Homo sapiens
agagggggcctg

SEQ ID NO: 1648103 - DNA, 22 bp, Homo sapiens
agagggggcctgggacttccat

SEQ ID NO: 1648104 - DNA, 15 bp, Homo sapiens
agagggggctctcca

SEQ ID NO: 1648105 - DNA, 12 bp, Homo sapiens
agagggggtgga

SEQ ID NO: 1648106 - DNA, 16 bp, Homo sapiens
agaggggtggagactg

SEQ ID NO: 1648107 - DNA, 18 bp, Homo sapiens
agagggtctggagaagca

SEQ ID NO: 1648108 - DNA, 22 bp, Homo sapiens
agagggtctggagaagcagtga

SEQ ID NO: 1648109 - DNA, 14 bp, Homo sapiens
agaggtaccctggg

SEQ ID NO: 1648110 - DNA, 17 bp, Homo sapiens
agaggtaccctgggtgt

SEQ ID NO: 1648111 - DNA, 15 bp, Homo sapiens
agaggtagtgtgaat

SEQ ID NO: 1648112 - DNA, 13 bp, Homo sapiens
agaggtataattg

SEQ ID NO: 1648113 - DNA, 14 bp, Homo sapiens
agaggtcaccagct

SEQ ID NO: 1648114 - DNA, 13 bp, Homo sapiens
agaggtctccaaa

SEQ ID NO: 1648115 - DNA, 14 bp, Homo sapiens
agaggtctgagccc

SEQ ID NO: 1648116 - DNA, 14 bp, Homo sapiens
agaggtctgtgctg

SEQ ID NO: 1648117 - DNA, 15 bp, Homo sapiens
agaggtgcaagacct

SEQ ID NO: 1648118 - DNA, 12 bp, Homo sapiens
agaggtggatgt

SEQ ID NO: 1648119 - DNA, 21 bp, Homo sapiens
agaggtggatgttatgaacag

SEQ ID NO: 1648120 - DNA, 22 bp, Homo sapiens
agaggtggatgttatgaacagc

SEQ ID NO: 1648121 - DNA, 14 bp, Homo sapiens
agaggtgggagggc

SEQ ID NO: 1648122 - DNA, 14 bp, Homo sapiens
agaggtgggcaggt

SEQ ID NO: 1648123 - DNA, 24 bp, Homo sapiens
agaggtgggccagtctgtggatca

SEQ ID NO: 1648124 - DNA, 16 bp, Homo sapiens
agaggtgttatttgga

SEQ ID NO: 1648125 - DNA, 23 bp, Homo sapiens
agaggttaaggtgggtccaggaa

SEQ ID NO: 1648126 - DNA, 16 bp, Homo sapiens
agaggttactttagtt

SEQ ID NO: 1648127 - DNA, 20 bp, Homo sapiens
agaggttactttagttagca

SEQ ID NO: 1648128 - DNA, 24 bp, Homo sapiens
agaggttactttagttagcatgcg

SEQ ID NO: 1648129 - DNA, 21 bp, Homo sapiens
agaggttatctgcctggcctg

SEQ ID NO: 1648130 - DNA, 22 bp, Homo sapiens
agaggttatctgcctggcctgg

SEQ ID NO: 1648131 - DNA, 20 bp, Homo sapiens
agaggttgggcttccatgcc

SEQ ID NO: 1648132 - DNA, 21 bp, Homo sapiens
agatctcataatgctttgtta

SEQ ID NO: 1648133 - DNA, 14 bp, Homo sapiens
agatctcctggcaa

SEQ ID NO: 1648134 - DNA, 12 bp, Homo sapiens
agatctctctct

SEQ ID NO: 1648135 - DNA, 12 bp, Homo sapiens
agatctgactgc

SEQ ID NO: 1648136 - DNA, 16 bp, Homo sapiens
agatctgatggtgagc

SEQ ID NO: 1648137 - DNA, 19 bp, Homo sapiens
agatctgatggtgagctgg

SEQ ID NO: 1648138 - DNA, 23 bp, Homo sapiens
agatctgatggtgagctgggaag

SEQ ID NO: 1648139 - DNA, 22 bp, Homo sapiens
agatctgcctgggcctgtgcag

SEQ ID NO: 1648140 - DNA, 16 bp, Homo sapiens
agatctggggaggcag

SEQ ID NO: 1648141 - DNA, 17 bp, Homo sapiens
agatctggggaggcagg

SEQ ID NO: 1648142 - DNA, 14 bp, Homo sapiens
agatctggtttcta

SEQ ID NO: 1648143 - DNA, 18 bp, Homo sapiens
agatctgtcctcagcctt

SEQ ID NO: 1648144 - DNA, 19 bp, Homo sapiens
agatctgtgccccatgcct

SEQ ID NO: 1648145 - DNA, 17 bp, Homo sapiens
agatctgtgtggctcct

SEQ ID NO: 1648146 - DNA, 18 bp, Homo sapiens
agatctgtgtggctcctg

SEQ ID NO: 1648147 - DNA, 20 bp, Homo sapiens
agatctgtgtggctcctggg

SEQ ID NO: 1648148 - DNA, 23 bp, Homo sapiens
agatctgtgttttagtttaatag

SEQ ID NO: 1648149 - DNA, 19 bp, Homo sapiens
agatcttcaaacagaataa

SEQ ID NO: 1648150 - DNA, 17 bp, Homo sapiens
agatcttccgtggtcag

SEQ ID NO: 1648151 - DNA, 18 bp, Homo sapiens
agatcttccgtggtcaga

SEQ ID NO: 1648152 - DNA, 19 bp, Homo sapiens
agatcttgagagctgctga

SEQ ID NO: 1648153 - DNA, 13 bp, Homo sapiens
agatctttctctt

SEQ ID NO: 1648154 - DNA, 17 bp, Homo sapiens
agatctttctcttccct

SEQ ID NO: 1648155 - DNA, 19 bp, Homo sapiens
agatctttctcttccctga

SEQ ID NO: 1648156 - DNA, 19 bp, Homo sapiens
agatctttggaacactgtt

SEQ ID NO: 1648157 - DNA, 20 bp, Homo sapiens
agatcttttagaagtgagag

SEQ ID NO: 1648158 - DNA, 14 bp, Homo sapiens
agatgaaatgcctt

SEQ ID NO: 1648159 - DNA, 20 bp, Homo sapiens
agatgaactgactgaaggaa

SEQ ID NO: 1648160 - DNA, 19 bp, Homo sapiens
agatgaagagtgagagggc

SEQ ID NO: 1648161 - DNA, 20 bp, Homo sapiens
agatgaagagtgagagggca

SEQ ID NO: 1648162 - DNA, 14 bp, Homo sapiens
agatgaagttttat

SEQ ID NO: 1648163 - DNA, 16 bp, Homo sapiens
agatgaatacaaacaa

SEQ ID NO: 1648164 - DNA, 16 bp, Homo sapiens
agatgaatatgagctc

SEQ ID NO: 1648165 - DNA, 18 bp, Homo sapiens
agatgaatatgagctcat

SEQ ID NO: 1648166 - DNA, 18 bp, Homo sapiens
agatgaatggtctggcaa

SEQ ID NO: 1648167 - DNA, 17 bp, Homo sapiens
agatgaatgtcctgaaa

SEQ ID NO: 1648168 - DNA, 15 bp, Homo sapiens
agatgaattgataaa

SEQ ID NO: 1648169 - DNA, 18 bp, Homo sapiens
agatgacacataaatctg

SEQ ID NO: 1648170 - DNA, 21 bp, Homo sapiens
agatgacacataaatctgtct

SEQ ID NO: 1648171 - DNA, 23 bp, Homo sapiens
agatgacacataaatctgtctga

SEQ ID NO: 1648172 - DNA, 19 bp, Homo sapiens
agatgaccagggatgctgg

SEQ ID NO: 1648173 - DNA, 13 bp, Homo sapiens
agatgactctctc

SEQ ID NO: 1648174 - DNA, 14 bp, Homo sapiens
agatgactgagtcc

SEQ ID NO: 1648175 - DNA, 21 bp, Homo sapiens
agatgagaacagataaagatt

SEQ ID NO: 1648176 - DNA, 19 bp, Homo sapiens
agatgagattggcatggct

SEQ ID NO: 1648177 - DNA, 21 bp, Homo sapiens
agatgagatttgccagcacag

SEQ ID NO: 1648178 - DNA, 20 bp, Homo sapiens
agatgagccccacgtggagc

SEQ ID NO: 1648179 - DNA, 20 bp, Homo sapiens
agatgaggagtaaaattcag

SEQ ID NO: 1648180 - DNA, 14 bp, Homo sapiens
agatgaggggttga

SEQ ID NO: 1648181 - DNA, 18 bp, Homo sapiens
agatgaggggttgaggga

SEQ ID NO: 1648182 - DNA, 17 bp, Homo sapiens
agatgagtgtctggagc

SEQ ID NO: 1648183 - DNA, 19 bp, Homo sapiens
agatgatgatgatctttaa

SEQ ID NO: 1648184 - DNA, 13 bp, Homo sapiens
agatgatggattt

SEQ ID NO: 1648185 - DNA, 19 bp, Homo sapiens
agatgcaatgtgctactga

SEQ ID NO: 1648186 - DNA, 20 bp, Homo sapiens
agatgcaccaccaagccaag

SEQ ID NO: 1648187 - DNA, 21 bp, Homo sapiens
agatgcaccaccaagccaagg

SEQ ID NO: 1648188 - DNA, 23 bp, Homo sapiens
agatgcaccaccaagccaaggga

SEQ ID NO: 1648189 - DNA, 22 bp, Homo sapiens
agatgcactgaaaacttagcca

SEQ ID NO: 1648190 - DNA, 19 bp, Homo sapiens
agatgcagagtaagtatta

SEQ ID NO: 1648191 - DNA, 15 bp, Homo sapiens
agatgcaggacagga

SEQ ID NO: 1648192 - DNA, 18 bp, Homo sapiens
agatgcaggacaggaggc

SEQ ID NO: 1648193 - DNA, 19 bp, Homo sapiens
agatgcaggacaggaggcg

SEQ ID NO: 1648194 - DNA, 15 bp, Homo sapiens
agatgcagtcctcag

SEQ ID NO: 1648195 - DNA, 17 bp, Homo sapiens
agatgcagtcctcagga

SEQ ID NO: 1648196 - DNA, 20 bp, Homo sapiens
agatgcagtcctcaggaagg

SEQ ID NO: 1648197 - DNA, 17 bp, Homo sapiens
agatgcatgacttgtgt

SEQ ID NO: 1648198 - DNA, 17 bp, Homo sapiens
agatgccaccctagcca

SEQ ID NO: 1648199 - DNA, 21 bp, Homo sapiens
agatgccagcttctctctcca

SEQ ID NO: 1648200 - DNA, 23 bp, Homo sapiens
agatgccagcttctctctccagg

SEQ ID NO: 1648201 - DNA, 21 bp, Homo sapiens
agatgccatggcctgtgctgg

SEQ ID NO: 1648202 - DNA, 17 bp, Homo sapiens
agatgccccagagctgt

SEQ ID NO: 1648203 - DNA, 13 bp, Homo sapiens
agatgcctccacc

SEQ ID NO: 1648204 - DNA, 21 bp, Homo sapiens
agatgcctccaccccccagaa

SEQ ID NO: 1648205 - DNA, 22 bp, Homo sapiens
agatgcctccaccccccagaac

SEQ ID NO: 1648206 - DNA, 17 bp, Homo sapiens
agatgcctccaccgctg

SEQ ID NO: 1648207 - DNA, 21 bp, Homo sapiens
agatgcctccaccgctgccta

SEQ ID NO: 1648208 - DNA, 19 bp, Homo sapiens
agatgcctcctgatgggac

SEQ ID NO: 1648209 - DNA, 16 bp, Homo sapiens
agatgcctgcttgata

SEQ ID NO: 1648210 - DNA, 11 bp, Homo sapiens
agatgcctggg

SEQ ID NO: 1648211 - DNA, 21 bp, Homo sapiens
agatgccttctagattcactg

SEQ ID NO: 1648212 - DNA, 22 bp, Homo sapiens
agatgccttttttgtagttttt

SEQ ID NO: 1648213 - DNA, 20 bp, Homo sapiens
agatgcgtcccaagatgttg

SEQ ID NO: 1648214 - DNA, 20 bp, Homo sapiens
agatgcgttcagcagactgg

SEQ ID NO: 1648215 - DNA, 17 bp, Homo sapiens
agatgctaggctgtctg

SEQ ID NO: 1648216 - DNA, 14 bp, Homo sapiens
agatgctgaggccc

SEQ ID NO: 1648217 - DNA, 14 bp, Homo sapiens
agatgctggcccag

SEQ ID NO: 1648218 - DNA, 19 bp, Homo sapiens
agatgctggcccagggccc

SEQ ID NO: 1648219 - DNA, 13 bp, Homo sapiens
agatgctgggttg

SEQ ID NO: 1648220 - DNA, 20 bp, Homo sapiens
agatgctgtaacttaaaata

SEQ ID NO: 1648221 - DNA, 22 bp, Homo sapiens
agatgctgtaacttaaaatagg

SEQ ID NO: 1648222 - DNA, 16 bp, Homo sapiens
agatgctgtgtatatg

SEQ ID NO: 1648223 - DNA, 22 bp, Homo sapiens
agatgcttgcggcaaaaggaaa

SEQ ID NO: 1648224 - DNA, 15 bp, Homo sapiens
agatgcttggagcaa

SEQ ID NO: 1648225 - DNA, 20 bp, Homo sapiens
agatgcttggagcaatcaga

SEQ ID NO: 1648226 - DNA, 22 bp, Homo sapiens
agatggaaaattcattttttaa

SEQ ID NO: 1648227 - DNA, 15 bp, Homo sapiens
agatggaaatacagt

SEQ ID NO: 1648228 - DNA, 18 bp, Homo sapiens
agatggaaattctgaaaa

SEQ ID NO: 1648229 - DNA, 18 bp, Homo sapiens
agatggaagagataaacg

SEQ ID NO: 1648230 - DNA, 13 bp, Homo sapiens
agatggaagcttg

SEQ ID NO: 1648231 - DNA, 19 bp, Homo sapiens
agatggaagcttgttgaaa

SEQ ID NO: 1648232 - DNA, 22 bp, Homo sapiens
agatggaagttgcagtgagctg

SEQ ID NO: 1648233 - DNA, 15 bp, Homo sapiens
agatggaatgctgtg

SEQ ID NO: 1648234 - DNA, 15 bp, Homo sapiens
agatggaatggaaaa

SEQ ID NO: 1648235 - DNA, 17 bp, Homo sapiens
agatggacacgagccac

SEQ ID NO: 1648236 - DNA, 14 bp, Homo sapiens
agatggaccccagc

SEQ ID NO: 1648237 - DNA, 15 bp, Homo sapiens
agatggaccccagca

SEQ ID NO: 1648238 - DNA, 22 bp, Homo sapiens
agatggagacaccctctggggg

SEQ ID NO: 1648239 - DNA, 23 bp, Homo sapiens
agatggagacaccctctgggggt

SEQ ID NO: 1648240 - DNA, 14 bp, Homo sapiens
agatggagaggctg

SEQ ID NO: 1648241 - DNA, 22 bp, Homo sapiens
agatggagaggctgagggacag

SEQ ID NO: 1648242 - DNA, 16 bp, Homo sapiens
agatggagggcttggc

SEQ ID NO: 1648243 - DNA, 17 bp, Homo sapiens
agatggagttcttgtgc

SEQ ID NO: 1648244 - DNA, 15 bp, Homo sapiens
agatggataaactga

SEQ ID NO: 1648245 - DNA, 18 bp, Homo sapiens
agatggattctccactca

SEQ ID NO: 1648246 - DNA, 17 bp, Homo sapiens
agcaactgctggtgatt

SEQ ID NO: 1648247 - DNA, 21 bp, Homo sapiens
agcaacttcttctccatccct

SEQ ID NO: 1648248 - DNA, 21 bp, Homo sapiens
agcaacttgtctttttctgga

SEQ ID NO: 1648249 - DNA, 17 bp, Homo sapiens
agcaagaactgcacggt

SEQ ID NO: 1648250 - DNA, 16 bp, Homo sapiens
agcaagaagattctaa

SEQ ID NO: 1648251 - DNA, 22 bp, Homo sapiens
agcaagaaggaaagatttgtga

SEQ ID NO: 1648252 - DNA, 15 bp, Homo sapiens
agcaagacagagacg

SEQ ID NO: 1648253 - DNA, 23 bp, Homo sapiens
agcaagacagagacgcaggaatg

SEQ ID NO: 1648254 - DNA, 13 bp, Homo sapiens
agcaagacctcat

SEQ ID NO: 1648255 - DNA, 19 bp, Homo sapiens
agcaagacgtaaagaattt

SEQ ID NO: 1648256 - DNA, 17 bp, Homo sapiens
agcaagactgttagccc

SEQ ID NO: 1648257 - DNA, 12 bp, Homo sapiens
agcaagagagat

SEQ ID NO: 1648258 - DNA, 15 bp, Homo sapiens
agcaagagagatgtt

SEQ ID NO: 1648259 - DNA, 13 bp, Homo sapiens
agcaagagcacaa

SEQ ID NO: 1648260 - DNA, 16 bp, Homo sapiens
agcaagatcttgtctc

SEQ ID NO: 1648261 - DNA, 15 bp, Homo sapiens
agcaagatgttttgt

SEQ ID NO: 1648262 - DNA, 20 bp, Homo sapiens
agcaagcatttatgtttatt

SEQ ID NO: 1648263 - DNA, 13 bp, Homo sapiens
agcaagccatcat

SEQ ID NO: 1648264 - DNA, 13 bp, Homo sapiens
agcaagcgggagc

SEQ ID NO: 1648265 - DNA, 16 bp, Homo sapiens
agcaaggaaggtaaaa

SEQ ID NO: 1648266 - DNA, 22 bp, Homo sapiens
agcaaggccttggtggagcagc

SEQ ID NO: 1648267 - DNA, 23 bp, Homo sapiens
agcaaggccttggtggagcagcc

SEQ ID NO: 1648268 - DNA, 21 bp, Homo sapiens
agcaaggcgcctgccttggga

SEQ ID NO: 1648269 - DNA, 13 bp, Homo sapiens
agcaagggacctg

SEQ ID NO: 1648270 - DNA, 19 bp, Homo sapiens
agcaagggaccttcatgcc

SEQ ID NO: 1648271 - DNA, 12 bp, Homo sapiens
agcaagggagaa

SEQ ID NO: 1648272 - DNA, 16 bp, Homo sapiens
agcaagggagaaaaga

SEQ ID NO: 1648273 - DNA, 20 bp, Homo sapiens
agcaagggagatttttgaat

SEQ ID NO: 1648274 - DNA, 18 bp, Homo sapiens
agcaagggctccagcatc

SEQ ID NO: 1648275 - DNA, 13 bp, Homo sapiens
agcaagggggccc

SEQ ID NO: 1648276 - DNA, 20 bp, Homo sapiens
agcaagggtgatgggaaagc

SEQ ID NO: 1648277 - DNA, 20 bp, Homo sapiens
agcaaggtgggtggaaacta

SEQ ID NO: 1648278 - DNA, 20 bp, Homo sapiens
agcaagtcccttcagactgg

SEQ ID NO: 1648279 - DNA, 22 bp, Homo sapiens
agcaagtcccttcagactggcc

SEQ ID NO: 1648280 - DNA, 20 bp, Homo sapiens
agcaagtcttaacaaaccaa

SEQ ID NO: 1648281 - DNA, 16 bp, Homo sapiens
agcaagtgagcagaga

SEQ ID NO: 1648282 - DNA, 16 bp, Homo sapiens
agcaagttacagtgat

SEQ ID NO: 1648283 - DNA, 14 bp, Homo sapiens
agcaataaagctct

SEQ ID NO: 1648284 - DNA, 14 bp, Homo sapiens
agcaataaatgaat

SEQ ID NO: 1648285 - DNA, 16 bp, Homo sapiens
agcaataaatgctttt

SEQ ID NO: 1648286 - DNA, 20 bp, Homo sapiens
agcaataatggtcccatcca

SEQ ID NO: 1648287 - DNA, 15 bp, Homo sapiens
agcaataattgtttc

SEQ ID NO: 1648288 - DNA, 19 bp, Homo sapiens
agcaatacgtttgtgcaga

SEQ ID NO: 1648289 - DNA, 22 bp, Homo sapiens
agcaatatattaccagcaagaa

SEQ ID NO: 1648290 - DNA, 23 bp, Homo sapiens
agcaatatattaccagcaagaat

SEQ ID NO: 1648291 - DNA, 24 bp, Homo sapiens
agcaatatattaccagcaagaata

SEQ ID NO: 1648292 - DNA, 14 bp, Homo sapiens
agcaatattatact

SEQ ID NO: 1648293 - DNA, 18 bp, Homo sapiens
agcaatattttttattca

SEQ ID NO: 1648294 - DNA, 17 bp, Homo sapiens
agcaatcagaacttcag

SEQ ID NO: 1648295 - DNA, 20 bp, Homo sapiens
agcaatccatgttagttttt

SEQ ID NO: 1648296 - DNA, 22 bp, Homo sapiens
agcaatccatgttagtttttac

SEQ ID NO: 1648297 - DNA, 23 bp, Homo sapiens
agcaatccatgttagtttttact

SEQ ID NO: 1648298 - DNA, 23 bp, Homo sapiens
agcaatctcttcattattctctg

SEQ ID NO: 1648299 - DNA, 13 bp, Homo sapiens
agcaatctttgaa

SEQ ID NO: 1648300 - DNA, 23 bp, Homo sapiens
agcaatgatgtccagaagaatat

SEQ ID NO: 1648301 - DNA, 20 bp, Homo sapiens
agcaatgccatttcagtggc

SEQ ID NO: 1648302 - DNA, 23 bp, Homo sapiens
agcaatgccatttcagtggcttc

SEQ ID NO: 1648303 - DNA, 14 bp, Homo sapiens
agcaatgtctgtgc

SEQ ID NO: 1648304 - DNA, 16 bp, Homo sapiens
agcaatgtctgtgcta

SEQ ID NO: 1648305 - DNA, 14 bp, Homo sapiens
agcaatgttggttt

SEQ ID NO: 1648306 - DNA, 21 bp, Homo sapiens
agcaattacaacggagtcaaa

SEQ ID NO: 1648307 - DNA, 15 bp, Homo sapiens
agcaattccaggctg

SEQ ID NO: 1648308 - DNA, 17 bp, Homo sapiens
agcaattccaggctgag

SEQ ID NO: 1648309 - DNA, 19 bp, Homo sapiens
agcaattccaggctgagcc

SEQ ID NO: 1648310 - DNA, 17 bp, Homo sapiens
agcaattcccaggtcat

SEQ ID NO: 1648311 - DNA, 16 bp, Homo sapiens
agcaattctcctgcct

SEQ ID NO: 1648312 - DNA, 23 bp, Homo sapiens
agcaattctcctgcctcagcctc

SEQ ID NO: 1648313 - DNA, 15 bp, Homo sapiens
agcaattctgactgt

SEQ ID NO: 1648314 - DNA, 21 bp, Homo sapiens
agcaatttcgccgttgaagag

SEQ ID NO: 1648315 - DNA, 14 bp, Homo sapiens
agcacaaaattcaa

SEQ ID NO: 1648316 - DNA, 16 bp, Homo sapiens
agcacaacccaccaca

SEQ ID NO: 1648317 - DNA, 23 bp, Homo sapiens
agcacaagcagagtgcacagctg

SEQ ID NO: 1648318 - DNA, 22 bp, Homo sapiens
agcacaaggccttgcctggcct

SEQ ID NO: 1648319 - DNA, 23 bp, Homo sapiens
agcacaataactagtaataccaa

SEQ ID NO: 1648320 - DNA, 21 bp, Homo sapiens
agcacaatctgtaaattttta

SEQ ID NO: 1648321 - DNA, 19 bp, Homo sapiens
agcacaatttgcactaaat

SEQ ID NO: 1648322 - DNA, 21 bp, Homo sapiens
agcacacacacataagcactg

SEQ ID NO: 1648323 - DNA, 20 bp, Homo sapiens
agcacacacatctggccctg

SEQ ID NO: 1648324 - DNA, 20 bp, Homo sapiens
agcacaccagccgctgcagg

SEQ ID NO: 1648325 - DNA, 13 bp, Homo sapiens
agcacaccgggcc

SEQ ID NO: 1648326 - DNA, 14 bp, Homo sapiens
agcacactggaata

SEQ ID NO: 1648327 - DNA, 19 bp, Homo sapiens
agcacactggaatataaaa

SEQ ID NO: 1648328 - DNA, 19 bp, Homo sapiens
agcacactgtagcattaca

SEQ ID NO: 1648329 - DNA, 23 bp, Homo sapiens
agcacagaaggaatctgtgcaga

SEQ ID NO: 1648330 - DNA, 18 bp, Homo sapiens
agcacagccagacttgct

SEQ ID NO: 1648331 - DNA, 12 bp, Homo sapiens
agcacagccctg

SEQ ID NO: 1648332 - DNA, 14 bp, Homo sapiens
agcacagccctggg

SEQ ID NO: 1648333 - DNA, 22 bp, Homo sapiens
agcacagccctgggagggggct

SEQ ID NO: 1648334 - DNA, 16 bp, Homo sapiens
agcacagcgctgagca

SEQ ID NO: 1648335 - DNA, 15 bp, Homo sapiens
agcacagctcctgcc

SEQ ID NO: 1648336 - DNA, 17 bp, Homo sapiens
agcacagctcctgccag

SEQ ID NO: 1648337 - DNA, 19 bp, Homo sapiens
agcacagctcctgccaggg

SEQ ID NO: 1648338 - DNA, 17 bp, Homo sapiens
agcacagctgggcatgc

SEQ ID NO: 1648339 - DNA, 19 bp, Homo sapiens
agcacaggaattctcaaga

SEQ ID NO: 1648340 - DNA, 12 bp, Homo sapiens
agcacaggcagc

SEQ ID NO: 1648341 - DNA, 12 bp, Homo sapiens
agcacaggggcc

SEQ ID NO: 1648342 - DNA, 15 bp, Homo sapiens
agcacaggggcccca

SEQ ID NO: 1648343 - DNA, 14 bp, Homo sapiens
agcacagtttgaac

SEQ ID NO: 1648344 - DNA, 19 bp, Homo sapiens
agcacatacggcagacctc

SEQ ID NO: 1648345 - DNA, 13 bp, Homo sapiens
agcacatactacc

SEQ ID NO: 1648346 - DNA, 17 bp, Homo sapiens
agcacatactacctaga

SEQ ID NO: 1648347 - DNA, 19 bp, Homo sapiens
agcacatactacctagaag

SEQ ID NO: 1648348 - DNA, 19 bp, Homo sapiens
agcacatagagctttttaa

SEQ ID NO: 1648349 - DNA, 21 bp, Homo sapiens
agcacatagagctttttaata

SEQ ID NO: 1648350 - DNA, 16 bp, Homo sapiens
agcacatctgcatttt

SEQ ID NO: 1648351 - DNA, 23 bp, Homo sapiens
agcacatgaaaccttattttttc

SEQ ID NO: 1648352 - DNA, 13 bp, Homo sapiens
agcacatgaataa

SEQ ID NO: 1648353 - DNA, 15 bp, Homo sapiens
agcacatgaataatt

SEQ ID NO: 1648354 - DNA, 19 bp, Homo sapiens
agcacatgcgtatatgtgc

SEQ ID NO: 1648355 - DNA, 23 bp, Homo sapiens
agcacatggtttaaatatgaatg

SEQ ID NO: 1648356 - DNA, 15 bp, Homo sapiens
agcacatgtaataaa

SEQ ID NO: 1648357 - DNA, 18 bp, Homo sapiens
agcacatgtgtatttata

SEQ ID NO: 1648358 - DNA, 17 bp, Homo sapiens
agcaccacctacacagg

SEQ ID NO: 1648359 - DNA, 18 bp, Homo sapiens
agcaccacctacacagga

SEQ ID NO: 1648360 - DNA, 14 bp, Homo sapiens
agcagtcgtgcctg

SEQ ID NO: 1648361 - DNA, 19 bp, Homo sapiens
agcagtcgtgcctgtgtcc

SEQ ID NO: 1648362 - DNA, 18 bp, Homo sapiens
agcagtctgataaactga

SEQ ID NO: 1648363 - DNA, 15 bp, Homo sapiens
agcagtgagcagggt

SEQ ID NO: 1648364 - DNA, 21 bp, Homo sapiens
agcagtgcacatttcatagtt

SEQ ID NO: 1648365 - DNA, 23 bp, Homo sapiens
agcagtgcacatttcatagtttc

SEQ ID NO: 1648366 - DNA, 15 bp, Homo sapiens
agcagtgcctcgagg

SEQ ID NO: 1648367 - DNA, 19 bp, Homo sapiens
agcagtgccttccataatt

SEQ ID NO: 1648368 - DNA, 15 bp, Homo sapiens
agcagtggacaccag

SEQ ID NO: 1648369 - DNA, 12 bp, Homo sapiens
agcagtggctgg

SEQ ID NO: 1648370 - DNA, 21 bp, Homo sapiens
agcagtggctggtccagggct

SEQ ID NO: 1648371 - DNA, 16 bp, Homo sapiens
agcagtgggcaggtgg

SEQ ID NO: 1648372 - DNA, 17 bp, Homo sapiens
agcagtgggcaggtggc

SEQ ID NO: 1648373 - DNA, 19 bp, Homo sapiens
agcagtgggcaggtggccg

SEQ ID NO: 1648374 - DNA, 15 bp, Homo sapiens
agcagtgtcatcaga

SEQ ID NO: 1648375 - DNA, 19 bp, Homo sapiens
agcagtgtcatcagaagat

SEQ ID NO: 1648376 - DNA, 20 bp, Homo sapiens
agcagtgtcatcagaagata

SEQ ID NO: 1648377 - DNA, 19 bp, Homo sapiens
agcagtgttacttgcaggt

SEQ ID NO: 1648378 - DNA, 19 bp, Homo sapiens
agcagttacagctctgtag

SEQ ID NO: 1648379 - DNA, 20 bp, Homo sapiens
agcagttacagctctgtagt

SEQ ID NO: 1648380 - DNA, 20 bp, Homo sapiens
agcagttatggtgatgactt

SEQ ID NO: 1648381 - DNA, 13 bp, Homo sapiens
agcagttgaaaag

SEQ ID NO: 1648382 - DNA, 21 bp, Homo sapiens
agcagttgaaaagactccaaa

SEQ ID NO: 1648383 - DNA, 20 bp, Homo sapiens
agcagttgctcacatgtctt

SEQ ID NO: 1648384 - DNA, 14 bp, Homo sapiens
agcagttttcccct

SEQ ID NO: 1648385 - DNA, 17 bp, Homo sapiens
agcagttttgtaaatgt

SEQ ID NO: 1648386 - DNA, 19 bp, Homo sapiens
agcataaaagatcaccttg

SEQ ID NO: 1648387 - DNA, 13 bp, Homo sapiens
agcataaagctca

SEQ ID NO: 1648388 - DNA, 14 bp, Homo sapiens
agcataaatgcaaa

SEQ ID NO: 1648389 - DNA, 18 bp, Homo sapiens
agcataatgctcccatct

SEQ ID NO: 1648390 - DNA, 19 bp, Homo sapiens
agcataccaacacgagcag

SEQ ID NO: 1648391 - DNA, 11 bp, Homo sapiens
agcatacttaa

SEQ ID NO: 1648392 - DNA, 13 bp, Homo sapiens
agcatacttcaaa

SEQ ID NO: 1648393 - DNA, 22 bp, Homo sapiens
agcatactttgtaaataggatt

SEQ ID NO: 1648394 - DNA, 16 bp, Homo sapiens
agcatagaaaccacta

SEQ ID NO: 1648395 - DNA, 20 bp, Homo sapiens
agcatagaaaccactagaaa

SEQ ID NO: 1648396 - DNA, 13 bp, Homo sapiens
agcatagccagca

SEQ ID NO: 1648397 - DNA, 12 bp, Homo sapiens
agcatatactgg

SEQ ID NO: 1648398 - DNA, 15 bp, Homo sapiens
agcatatgcagccaa

SEQ ID NO: 1648399 - DNA, 18 bp, Homo sapiens
agcatatttgtatagttg

SEQ ID NO: 1648400 - DNA, 16 bp, Homo sapiens
agcatcaaaaacatca

SEQ ID NO: 1648401 - DNA, 15 bp, Homo sapiens
agcatcaatcttgtt

SEQ ID NO: 1648402 - DNA, 14 bp, Homo sapiens
agcatcacctcagg

SEQ ID NO: 1648403 - DNA, 13 bp, Homo sapiens
agcatcactgccc

SEQ ID NO: 1648404 - DNA, 20 bp, Homo sapiens
agcatcaggctaagaccctg

SEQ ID NO: 1648405 - DNA, 22 bp, Homo sapiens
agcatcagggttaagaagactt

SEQ ID NO: 1648406 - DNA, 20 bp, Homo sapiens
agcatcagtacttgtttcta

SEQ ID NO: 1648407 - DNA, 21 bp, Homo sapiens
agcatcattatttgcagagac

SEQ ID NO: 1648408 - DNA, 14 bp, Homo sapiens
agcatccagcctgt

SEQ ID NO: 1648409 - DNA, 18 bp, Homo sapiens
agcatccaggctggccag

SEQ ID NO: 1648410 - DNA, 20 bp, Homo sapiens
agcatcccccaaagttcaca

SEQ ID NO: 1648411 - DNA, 17 bp, Homo sapiens
agcatccctcagcctgt

SEQ ID NO: 1648412 - DNA, 14 bp, Homo sapiens
agcatccctggagc

SEQ ID NO: 1648413 - DNA, 21 bp, Homo sapiens
agcatccctggagcaggagcc

SEQ ID NO: 1648414 - DNA, 18 bp, Homo sapiens
agcatcccttctgccccc

SEQ ID NO: 1648415 - DNA, 16 bp, Homo sapiens
agcatccgcaggtgct

SEQ ID NO: 1648416 - DNA, 15 bp, Homo sapiens
agcatcctcctcctg

SEQ ID NO: 1648417 - DNA, 16 bp, Homo sapiens
agcatcctcctcctgg

SEQ ID NO: 1648418 - DNA, 19 bp, Homo sapiens
agcatccttttctgcagag

SEQ ID NO: 1648419 - DNA, 21 bp, Homo sapiens
agcatccttttctgcagaggg

SEQ ID NO: 1648420 - DNA, 22 bp, Homo sapiens
agcatcggacaagacccccagc

SEQ ID NO: 1648421 - DNA, 12 bp, Homo sapiens
agcatcgggagc

SEQ ID NO: 1648422 - DNA, 18 bp, Homo sapiens
agcatcgggagcacccag

SEQ ID NO: 1648423 - DNA, 12 bp, Homo sapiens
agcatctaagtt

SEQ ID NO: 1648424 - DNA, 15 bp, Homo sapiens
agcatctatctcatc

SEQ ID NO: 1648425 - DNA, 17 bp, Homo sapiens
agcatctcttgaggcca

SEQ ID NO: 1648426 - DNA, 19 bp, Homo sapiens
agcatctcttgaggccagg

SEQ ID NO: 1648427 - DNA, 17 bp, Homo sapiens
agcatctgaccatctgt

SEQ ID NO: 1648428 - DNA, 20 bp, Homo sapiens
agcatctgaccatctgtgac

SEQ ID NO: 1648429 - DNA, 21 bp, Homo sapiens
agcatctgaccatctgtgact

SEQ ID NO: 1648430 - DNA, 22 bp, Homo sapiens
agcatctgaccatctgtgacta

SEQ ID NO: 1648431 - DNA, 13 bp, Homo sapiens
agcatctgctaat

SEQ ID NO: 1648432 - DNA, 18 bp, Homo sapiens
agcatctggctctaattc

SEQ ID NO: 1648433 - DNA, 12 bp, Homo sapiens
agcatctggctg

SEQ ID NO: 1648434 - DNA, 20 bp, Homo sapiens
agcatctggctgtctagaat

SEQ ID NO: 1648435 - DNA, 23 bp, Homo sapiens
agcatgaataaaacactcatccc

SEQ ID NO: 1648436 - DNA, 22 bp, Homo sapiens
agcatgaatggtatggaactct

SEQ ID NO: 1648437 - DNA, 15 bp, Homo sapiens
agcatgacaactttt

SEQ ID NO: 1648438 - DNA, 21 bp, Homo sapiens
agcatgacagaaaatatgtat

SEQ ID NO: 1648439 - DNA, 14 bp, Homo sapiens
agcatgacagcctg

SEQ ID NO: 1648440 - DNA, 20 bp, Homo sapiens
agcatgacagcctgcagcag

SEQ ID NO: 1648441 - DNA, 14 bp, Homo sapiens
agcatgacatttct

SEQ ID NO: 1648442 - DNA, 15 bp, Homo sapiens
agcatgacatttctt

SEQ ID NO: 1648443 - DNA, 18 bp, Homo sapiens
agcatgacctgtgaccag

SEQ ID NO: 1648444 - DNA, 22 bp, Homo sapiens
agcatgacctgtgaccagcact

SEQ ID NO: 1648445 - DNA, 15 bp, Homo sapiens
agcatgagactttct

SEQ ID NO: 1648446 - DNA, 20 bp, Homo sapiens
agcatgcacagctgcttgtc

SEQ ID NO: 1648447 - DNA, 15 bp, Homo sapiens
agcatgcttcctttc

SEQ ID NO: 1648448 - DNA, 15 bp, Homo sapiens
agcatgcttgggctg

SEQ ID NO: 1648449 - DNA, 16 bp, Homo sapiens
agcatgcttgggctga

SEQ ID NO: 1648450 - DNA, 17 bp, Homo sapiens
agcatgctttgctgcta

SEQ ID NO: 1648451 - DNA, 13 bp, Homo sapiens
agcatggaaaaat

SEQ ID NO: 1648452 - DNA, 16 bp, Homo sapiens
agcatggaaaaatggt

SEQ ID NO: 1648453 - DNA, 17 bp, Homo sapiens
agcatggaacacttcga

SEQ ID NO: 1648454 - DNA, 14 bp, Homo sapiens
agcatggacagtgt

SEQ ID NO: 1648455 - DNA, 18 bp, Homo sapiens
agcatggacatttagaag

SEQ ID NO: 1648456 - DNA, 22 bp, Homo sapiens
agcatggagagcctcttagtga

SEQ ID NO: 1648457 - DNA, 19 bp, Homo sapiens
agcatggcatatttttcac

SEQ ID NO: 1648458 - DNA, 13 bp, Homo sapiens
agcatggcctgga

SEQ ID NO: 1648459 - DNA, 15 bp, Homo sapiens
agcatggggcccctg

SEQ ID NO: 1648460 - DNA, 18 bp, Homo sapiens
agcatgggggctgccagc

SEQ ID NO: 1648461 - DNA, 20 bp, Homo sapiens
agcatgggtgtgcccttggg

SEQ ID NO: 1648462 - DNA, 13 bp, Homo sapiens
agcatgtaatggt

SEQ ID NO: 1648463 - DNA, 21 bp, Homo sapiens
agcatgtactgagccttgtaa

SEQ ID NO: 1648464 - DNA, 22 bp, Homo sapiens
agcatgtatgaatgtaaggatg

SEQ ID NO: 1648465 - DNA, 22 bp, Homo sapiens
agcatgtcaattcataaaaaca

SEQ ID NO: 1648466 - DNA, 23 bp, Homo sapiens
agcatgtcaattcataaaaacaa

SEQ ID NO: 1648467 - DNA, 17 bp, Homo sapiens
agcatgtctattcagct

SEQ ID NO: 1648468 - DNA, 16 bp, Homo sapiens
agcatgtctctctgcc

SEQ ID NO: 1648469 - DNA, 17 bp, Homo sapiens
agcatgtggcatgttca

SEQ ID NO: 1648470 - DNA, 16 bp, Homo sapiens
agcatgtgttgaaaaa

SEQ ID NO: 1648471 - DNA, 22 bp, Homo sapiens
agcatgttcctccttttcttca

SEQ ID NO: 1648472 - DNA, 15 bp, Homo sapiens
agcattacaaattgc

SEQ ID NO: 1648473 - DNA, 17 bp, Homo sapiens
agcattacaaattgctt

SEQ ID NO: 1648474 - DNA, 17 bp, Homo sapiens
agcattacattattaaa

SEQ ID NO: 1648475 - DNA, 15 bp, Homo sapiens
agccatgggcctggg

SEQ ID NO: 1648476 - DNA, 21 bp, Homo sapiens
agccatgggcctgggcctgct

SEQ ID NO: 1648477 - DNA, 18 bp, Homo sapiens
agccattaccatggagac

SEQ ID NO: 1648478 - DNA, 13 bp, Homo sapiens
agccatttccccc

SEQ ID NO: 1648479 - DNA, 16 bp, Homo sapiens
agccatttccccctcc

SEQ ID NO: 1648480 - DNA, 14 bp, Homo sapiens
agccatttcttgtt

SEQ ID NO: 1648481 - DNA, 12 bp, Homo sapiens
agccatttttaa

SEQ ID NO: 1648482 - DNA, 15 bp, Homo sapiens
agcccaaaacccagg

SEQ ID NO: 1648483 - DNA, 15 bp, Homo sapiens
agcccaaaatttgat

SEQ ID NO: 1648484 - DNA, 20 bp, Homo sapiens
agcccaagaggtctgagccc

SEQ ID NO: 1648485 - DNA, 18 bp, Homo sapiens
agcccaagcatcactgcc

SEQ ID NO: 1648486 - DNA, 14 bp, Homo sapiens
agcccaagcttccc

SEQ ID NO: 1648487 - DNA, 15 bp, Homo sapiens
agcccaagcttccct

SEQ ID NO: 1648488 - DNA, 16 bp, Homo sapiens
agcccaagcttccctc

SEQ ID NO: 1648489 - DNA, 19 bp, Homo sapiens
agcccaagcttccctccat

SEQ ID NO: 1648490 - DNA, 14 bp, Homo sapiens
agcccaataaaggt

SEQ ID NO: 1648491 - DNA, 15 bp, Homo sapiens
agcccaatattataa

SEQ ID NO: 1648492 - DNA, 20 bp, Homo sapiens
agcccaatattataattttt

SEQ ID NO: 1648493 - DNA, 23 bp, Homo sapiens
agcccacattggattcatcagca

SEQ ID NO: 1648494 - DNA, 13 bp, Homo sapiens
agcccaccaccct

SEQ ID NO: 1648495 - DNA, 18 bp, Homo sapiens
agcccacccccctcccca

SEQ ID NO: 1648496 - DNA, 12 bp, Homo sapiens
agcccaccctgc

SEQ ID NO: 1648497 - DNA, 13 bp, Homo sapiens
agcccactccctg

SEQ ID NO: 1648498 - DNA, 16 bp, Homo sapiens
agcccactccctgcct

SEQ ID NO: 1648499 - DNA, 19 bp, Homo sapiens
agcccactgcccaccccct

SEQ ID NO: 1648500 - DNA, 17 bp, Homo sapiens
agcccactgtcctgggc

SEQ ID NO: 1648501 - DNA, 18 bp, Homo sapiens
agcccactgtcctgggcc

SEQ ID NO: 1648502 - DNA, 22 bp, Homo sapiens
agcccactgtcctgggcctgca

SEQ ID NO: 1648503 - DNA, 12 bp, Homo sapiens
agcccagacaaa

SEQ ID NO: 1648504 - DNA, 22 bp, Homo sapiens
agcccagagacatacttgaagg

SEQ ID NO: 1648505 - DNA, 20 bp, Homo sapiens
agcccagagactttgtagat

SEQ ID NO: 1648506 - DNA, 15 bp, Homo sapiens
agcccagagccacct

SEQ ID NO: 1648507 - DNA, 16 bp, Homo sapiens
agcccagagccacctg

SEQ ID NO: 1648508 - DNA, 20 bp, Homo sapiens
agcccagattcccctgtgtc

SEQ ID NO: 1648509 - DNA, 21 bp, Homo sapiens
agcccagattcccctgtgtca

SEQ ID NO: 1648510 - DNA, 16 bp, Homo sapiens
agcccagcacctgctc

SEQ ID NO: 1648511 - DNA, 12 bp, Homo sapiens
agcccagcactg

SEQ ID NO: 1648512 - DNA, 15 bp, Homo sapiens
agcccagcactgtga

SEQ ID NO: 1648513 - DNA, 20 bp, Homo sapiens
agcccagcactgtgaagacc

SEQ ID NO: 1648514 - DNA, 15 bp, Homo sapiens
agcccagccacggac

SEQ ID NO: 1648515 - DNA, 14 bp, Homo sapiens
agcccagccaggcc

SEQ ID NO: 1648516 - DNA, 20 bp, Homo sapiens
agcccagccaggccaacagc

SEQ ID NO: 1648517 - DNA, 15 bp, Homo sapiens
agcccagcccagctg

SEQ ID NO: 1648518 - DNA, 13 bp, Homo sapiens
agcccagcccagg

SEQ ID NO: 1648519 - DNA, 12 bp, Homo sapiens
agcccagcccct

SEQ ID NO: 1648520 - DNA, 17 bp, Homo sapiens
agcccagcccctactgc

SEQ ID NO: 1648521 - DNA, 13 bp, Homo sapiens
agcccagcctggg

SEQ ID NO: 1648522 - DNA, 14 bp, Homo sapiens
agcccagcctggga

SEQ ID NO: 1648523 - DNA, 15 bp, Homo sapiens
agcccagctacattc

SEQ ID NO: 1648524 - DNA, 19 bp, Homo sapiens
agcccagctacattcctca

SEQ ID NO: 1648525 - DNA, 22 bp, Homo sapiens
agcccagctacattcctcagct

SEQ ID NO: 1648526 - DNA, 13 bp, Homo sapiens
agcccagctccag

SEQ ID NO: 1648527 - DNA, 15 bp, Homo sapiens
agcccagctccaggg

SEQ ID NO: 1648528 - DNA, 18 bp, Homo sapiens
agcccagctcctgaataa

SEQ ID NO: 1648529 - DNA, 12 bp, Homo sapiens
agcccagctctt

SEQ ID NO: 1648530 - DNA, 14 bp, Homo sapiens
agcccagctcttgc

SEQ ID NO: 1648531 - DNA, 15 bp, Homo sapiens
agcccagctcttgct

SEQ ID NO: 1648532 - DNA, 17 bp, Homo sapiens
agcccagctggccacct

SEQ ID NO: 1648533 - DNA, 16 bp, Homo sapiens
agcccagctggtggga

SEQ ID NO: 1648534 - DNA, 23 bp, Homo sapiens
agcccagcttggccctttccttc

SEQ ID NO: 1648535 - DNA, 23 bp, Homo sapiens
agcccaggagctgagtcacctcc

SEQ ID NO: 1648536 - DNA, 11 bp, Homo sapiens
agcccaggagt

SEQ ID NO: 1648537 - DNA, 20 bp, Homo sapiens
agcccaggagtttgagacaa

SEQ ID NO: 1648538 - DNA, 23 bp, Homo sapiens
agcccaggccgttccccttggct

SEQ ID NO: 1648539 - DNA, 23 bp, Homo sapiens
agcccaggctcggaggaccctgg

SEQ ID NO: 1648540 - DNA, 13 bp, Homo sapiens
agcccaggcttcc

SEQ ID NO: 1648541 - DNA, 22 bp, Homo sapiens
agcccagggcatcttgctggct

SEQ ID NO: 1648542 - DNA, 15 bp, Homo sapiens
agcccagggctcctg

SEQ ID NO: 1648543 - DNA, 17 bp, Homo sapiens
agcccagggctcctgca

SEQ ID NO: 1648544 - DNA, 18 bp, Homo sapiens
agcccagtagaccttgtt

SEQ ID NO: 1648545 - DNA, 17 bp, Homo sapiens
agcccagtccctggagc

SEQ ID NO: 1648546 - DNA, 20 bp, Homo sapiens
agcccagtccctggagctgt

SEQ ID NO: 1648547 - DNA, 15 bp, Homo sapiens
agcccagtgaagcct

SEQ ID NO: 1648548 - DNA, 14 bp, Homo sapiens
agcccataaggcca

SEQ ID NO: 1648549 - DNA, 15 bp, Homo sapiens
agcccatcctgacca

SEQ ID NO: 1648550 - DNA, 17 bp, Homo sapiens
agcccatgagtccttga

SEQ ID NO: 1648551 - DNA, 11 bp, Homo sapiens
agcccatgccc

SEQ ID NO: 1648552 - DNA, 16 bp, Homo sapiens
agcccatgcccacctg

SEQ ID NO: 1648553 - DNA, 20 bp, Homo sapiens
agcccatgcccacctgccca

SEQ ID NO: 1648554 - DNA, 22 bp, Homo sapiens
agcccatgcccacctgcccatc

SEQ ID NO: 1648555 - DNA, 18 bp, Homo sapiens
agcccatggcccccaata

SEQ ID NO: 1648556 - DNA, 23 bp, Homo sapiens
agcccatggcccccaataaaggc

SEQ ID NO: 1648557 - DNA, 15 bp, Homo sapiens
agcccatggcctctg

SEQ ID NO: 1648558 - DNA, 15 bp, Homo sapiens
agcccattctctctc

SEQ ID NO: 1648559 - DNA, 17 bp, Homo sapiens
agcccattctctctcct

SEQ ID NO: 1648560 - DNA, 21 bp, Homo sapiens
agcccattctctctcctgtcc

SEQ ID NO: 1648561 - DNA, 16 bp, Homo sapiens
agcccattgctgccaa

SEQ ID NO: 1648562 - DNA, 17 bp, Homo sapiens
agcccattgctgccaag

SEQ ID NO: 1648563 - DNA, 15 bp, Homo sapiens
agccccaacctccca

SEQ ID NO: 1648564 - DNA, 13 bp, Homo sapiens
agccccaagctgg

SEQ ID NO: 1648565 - DNA, 17 bp, Homo sapiens
agccccacatgtccagc

SEQ ID NO: 1648566 - DNA, 13 bp, Homo sapiens
agccccacccagg

SEQ ID NO: 1648567 - DNA, 14 bp, Homo sapiens
agccccactgccag

SEQ ID NO: 1648568 - DNA, 20 bp, Homo sapiens
agccccactgccagcagcag

SEQ ID NO: 1648569 - DNA, 12 bp, Homo sapiens
agccccacttca

SEQ ID NO: 1648570 - DNA, 12 bp, Homo sapiens
agccccagactg

SEQ ID NO: 1648571 - DNA, 16 bp, Homo sapiens
agccccagactgggcc

SEQ ID NO: 1648572 - DNA, 21 bp, Homo sapiens
agccccagactgggcccaggc

SEQ ID NO: 1648573 - DNA, 13 bp, Homo sapiens
agccccagcccct

SEQ ID NO: 1648574 - DNA, 13 bp, Homo sapiens
agccccagcttcc

SEQ ID NO: 1648575 - DNA, 13 bp, Homo sapiens
agccccagcttgg

SEQ ID NO: 1648576 - DNA, 22 bp, Homo sapiens
agccccagggtcttccctacct

SEQ ID NO: 1648577 - DNA, 13 bp, Homo sapiens
agccccagtgcca

SEQ ID NO: 1648578 - DNA, 20 bp, Homo sapiens
agccccagtgccaagcacag

SEQ ID NO: 1648579 - DNA, 17 bp, Homo sapiens
agccccatcagctccag

SEQ ID NO: 1648580 - DNA, 20 bp, Homo sapiens
agccccatctcatcctggca

SEQ ID NO: 1648581 - DNA, 15 bp, Homo sapiens
agccccatttcctca

SEQ ID NO: 1648582 - DNA, 16 bp, Homo sapiens
agcccccaccagggga

SEQ ID NO: 1648583 - DNA, 20 bp, Homo sapiens
agcccccaccaggggaagga

SEQ ID NO: 1648584 - DNA, 14 bp, Homo sapiens
agcccccagccctg

SEQ ID NO: 1648585 - DNA, 16 bp, Homo sapiens
agcccccagccctggg

SEQ ID NO: 1648586 - DNA, 19 bp, Homo sapiens
agcccccagctaagaacct

SEQ ID NO: 1648587 - DNA, 22 bp, Homo sapiens
agcccccagctaagaacctgga

SEQ ID NO: 1648588 - DNA, 18 bp, Homo sapiens
agcccccatcacccaagc

SEQ ID NO: 1648589 - DNA, 19 bp, Homo sapiens
agcccccccaacactgtgc

SEQ ID NO: 1648590 - DNA, 22 bp, Homo sapiens
agcccccccaacactgtgccct

SEQ ID NO: 1648591 - DNA, 17 bp, Homo sapiens
agcctccgcctcccggg

SEQ ID NO: 1648592 - DNA, 19 bp, Homo sapiens
agcctccgtttatgggcct

SEQ ID NO: 1648593 - DNA, 13 bp, Homo sapiens
agcctcctctctc

SEQ ID NO: 1648594 - DNA, 13 bp, Homo sapiens
agcctcctctgga

SEQ ID NO: 1648595 - DNA, 20 bp, Homo sapiens
agcctcctgagtagatggga

SEQ ID NO: 1648596 - DNA, 21 bp, Homo sapiens
agcctcgcacaggccctagct

SEQ ID NO: 1648597 - DNA, 14 bp, Homo sapiens
agcctcgggtgggg

SEQ ID NO: 1648598 - DNA, 21 bp, Homo sapiens
agcctcgttggagagcagcag

SEQ ID NO: 1648599 - DNA, 22 bp, Homo sapiens
agcctcgttggagagcagcagg

SEQ ID NO: 1648600 - DNA, 12 bp, Homo sapiens
agcctctccagg

SEQ ID NO: 1648601 - DNA, 23 bp, Homo sapiens
agcctctccaggaatgcctcctc

SEQ ID NO: 1648602 - DNA, 11 bp, Homo sapiens
agcctctccca

SEQ ID NO: 1648603 - DNA, 17 bp, Homo sapiens
agcctctcccacccggc

SEQ ID NO: 1648604 - DNA, 22 bp, Homo sapiens
agcctctcccacccggccacag

SEQ ID NO: 1648605 - DNA, 23 bp, Homo sapiens
agcctctccccaggtccagctct

SEQ ID NO: 1648606 - DNA, 15 bp, Homo sapiens
agcctctcccggctg

SEQ ID NO: 1648607 - DNA, 17 bp, Homo sapiens
agcctctcccggctgcc

SEQ ID NO: 1648608 - DNA, 18 bp, Homo sapiens
agcctctcccggctgcct

SEQ ID NO: 1648609 - DNA, 19 bp, Homo sapiens
agcctctcccggctgcctg

SEQ ID NO: 1648610 - DNA, 20 bp, Homo sapiens
agcctctcccggctgcctgc

SEQ ID NO: 1648611 - DNA, 20 bp, Homo sapiens
agcctctccgactctgcacc

SEQ ID NO: 1648612 - DNA, 21 bp, Homo sapiens
agcctctctccttggccacag

SEQ ID NO: 1648613 - DNA, 22 bp, Homo sapiens
agcctctctccttggccacaga

SEQ ID NO: 1648614 - DNA, 15 bp, Homo sapiens
agcctctgccaggcc

SEQ ID NO: 1648615 - DNA, 16 bp, Homo sapiens
agcctctgcctcccta

SEQ ID NO: 1648616 - DNA, 15 bp, Homo sapiens
agcctctgctcccca

SEQ ID NO: 1648617 - DNA, 12 bp, Homo sapiens
agcctctgctgc

SEQ ID NO: 1648618 - DNA, 18 bp, Homo sapiens
agcctctgctgccatggc

SEQ ID NO: 1648619 - DNA, 19 bp, Homo sapiens
agcctctggatctagaagg

SEQ ID NO: 1648620 - DNA, 16 bp, Homo sapiens
agcctctgtccgcctt

SEQ ID NO: 1648621 - DNA, 17 bp, Homo sapiens
agcctcttattccagga

SEQ ID NO: 1648622 - DNA, 18 bp, Homo sapiens
agcctcttgctcagagct

SEQ ID NO: 1648623 - DNA, 14 bp, Homo sapiens
agcctcttgtgtaa

SEQ ID NO: 1648624 - DNA, 20 bp, Homo sapiens
agcctgaaagatacagggga

SEQ ID NO: 1648625 - DNA, 23 bp, Homo sapiens
agcctgaaagatacaggggatca

SEQ ID NO: 1648626 - DNA, 14 bp, Homo sapiens
agcctgaagcctgg

SEQ ID NO: 1648627 - DNA, 19 bp, Homo sapiens
agcctgacccggaggaaag

SEQ ID NO: 1648628 - DNA, 18 bp, Homo sapiens
agcctgactttctctcca

SEQ ID NO: 1648629 - DNA, 17 bp, Homo sapiens
agcctgaggctgagact

SEQ ID NO: 1648630 - DNA, 16 bp, Homo sapiens
agcctgagtcacctgc

SEQ ID NO: 1648631 - DNA, 16 bp, Homo sapiens
agcctgatattgatat

SEQ ID NO: 1648632 - DNA, 18 bp, Homo sapiens
agcctgatgagattttta

SEQ ID NO: 1648633 - DNA, 19 bp, Homo sapiens
agcctgatgagatttttaa

SEQ ID NO: 1648634 - DNA, 19 bp, Homo sapiens
agcctgcaaactcactgct

SEQ ID NO: 1648635 - DNA, 15 bp, Homo sapiens
agcctgcacacacct

SEQ ID NO: 1648636 - DNA, 21 bp, Homo sapiens
agcctgccctcactccctctg

SEQ ID NO: 1648637 - DNA, 22 bp, Homo sapiens
agcctgccctcactccctctgc

SEQ ID NO: 1648638 - DNA, 21 bp, Homo sapiens
agcctgcgccaccgcccagag

SEQ ID NO: 1648639 - DNA, 14 bp, Homo sapiens
agcctgctccccca

SEQ ID NO: 1648640 - DNA, 17 bp, Homo sapiens
agcctgctcccccaccc

SEQ ID NO: 1648641 - DNA, 17 bp, Homo sapiens
agcctgctggcacccac

SEQ ID NO: 1648642 - DNA, 14 bp, Homo sapiens
agcctgctggctgc

SEQ ID NO: 1648643 - DNA, 18 bp, Homo sapiens
agcctgctggctgcggcc

SEQ ID NO: 1648644 - DNA, 22 bp, Homo sapiens
agcctggactctaagctggagc

SEQ ID NO: 1648645 - DNA, 23 bp, Homo sapiens
agcctggactctaagctggagct

SEQ ID NO: 1648646 - DNA, 21 bp, Homo sapiens
agcctggactttggttctctc

SEQ ID NO: 1648647 - DNA, 16 bp, Homo sapiens
agcctggattccagca

SEQ ID NO: 1648648 - DNA, 19 bp, Homo sapiens
agcctggcacaggactgat

SEQ ID NO: 1648649 - DNA, 18 bp, Homo sapiens
agcctggcacagggcagt

SEQ ID NO: 1648650 - DNA, 12 bp, Homo sapiens
agcctggccaga

SEQ ID NO: 1648651 - DNA, 13 bp, Homo sapiens
agcctggccagac

SEQ ID NO: 1648652 - DNA, 18 bp, Homo sapiens
agcctggccagacacagg

SEQ ID NO: 1648653 - DNA, 17 bp, Homo sapiens
agcctggcccatagaaa

SEQ ID NO: 1648654 - DNA, 16 bp, Homo sapiens
agcctggccctgaagc

SEQ ID NO: 1648655 - DNA, 11 bp, Homo sapiens
agcctggctcc

SEQ ID NO: 1648656 - DNA, 21 bp, Homo sapiens
agcctggctggagagctgcta

SEQ ID NO: 1648657 - DNA, 15 bp, Homo sapiens
agcctggcttctgga

SEQ ID NO: 1648658 - DNA, 18 bp, Homo sapiens
agcctggcttctggagcc

SEQ ID NO: 1648659 - DNA, 19 bp, Homo sapiens
agcctgggactcccagtga

SEQ ID NO: 1648660 - DNA, 17 bp, Homo sapiens
agcctgggagcccagag

SEQ ID NO: 1648661 - DNA, 15 bp, Homo sapiens
agcctgggcaacaga

SEQ ID NO: 1648662 - DNA, 20 bp, Homo sapiens
agcctgggcagcatagcaag

SEQ ID NO: 1648663 - DNA, 15 bp, Homo sapiens
agcctgggcagccag

SEQ ID NO: 1648664 - DNA, 19 bp, Homo sapiens
agcctgggcagccaggctg

SEQ ID NO: 1648665 - DNA, 15 bp, Homo sapiens
agcctgggccagaga

SEQ ID NO: 1648666 - DNA, 16 bp, Homo sapiens
agcctgggccccagct

SEQ ID NO: 1648667 - DNA, 14 bp, Homo sapiens
agcctgggcgacag

SEQ ID NO: 1648668 - DNA, 15 bp, Homo sapiens
agcctgggctcactg

SEQ ID NO: 1648669 - DNA, 22 bp, Homo sapiens
agcctgggctcactgtgctggg

SEQ ID NO: 1648670 - DNA, 21 bp, Homo sapiens
agcctggggcctggggatgta

SEQ ID NO: 1648671 - DNA, 11 bp, Homo sapiens
agcctggggct

SEQ ID NO: 1648672 - DNA, 16 bp, Homo sapiens
agcctggggtgacctc

SEQ ID NO: 1648673 - DNA, 15 bp, Homo sapiens
agcctgggtcacaga

SEQ ID NO: 1648674 - DNA, 17 bp, Homo sapiens
agcctggtgcccatcct

SEQ ID NO: 1648675 - DNA, 22 bp, Homo sapiens
agcctggtgggcctcctctgtc

SEQ ID NO: 1648676 - DNA, 22 bp, Homo sapiens
agcctgtagggaactttctgga

SEQ ID NO: 1648677 - DNA, 16 bp, Homo sapiens
agcctgtcaccagagc

SEQ ID NO: 1648678 - DNA, 18 bp, Homo sapiens
agcctgtcaccagagctt

SEQ ID NO: 1648679 - DNA, 20 bp, Homo sapiens
agcctgtcaccagagcttct

SEQ ID NO: 1648680 - DNA, 22 bp, Homo sapiens
agcctgtgaataaaaaccctgt

SEQ ID NO: 1648681 - DNA, 21 bp, Homo sapiens
agcctgtgcatgtatgtcttg

SEQ ID NO: 1648682 - DNA, 12 bp, Homo sapiens
agcctgtgcctc

SEQ ID NO: 1648683 - DNA, 21 bp, Homo sapiens
agcctgtgcctctgggactgg

SEQ ID NO: 1648684 - DNA, 23 bp, Homo sapiens
agcctgtggcttggagtggccaa

SEQ ID NO: 1648685 - DNA, 20 bp, Homo sapiens
agcctgtgggagtagaaaaa

SEQ ID NO: 1648686 - DNA, 16 bp, Homo sapiens
agcctgttcattctga

SEQ ID NO: 1648687 - DNA, 19 bp, Homo sapiens
agcctgttcattctgatgt

SEQ ID NO: 1648688 - DNA, 11 bp, Homo sapiens
agccttaaaaa

SEQ ID NO: 1648689 - DNA, 17 bp, Homo sapiens
agccttaaagacaaaaa

SEQ ID NO: 1648690 - DNA, 15 bp, Homo sapiens
agccttaatttgcac

SEQ ID NO: 1648691 - DNA, 14 bp, Homo sapiens
agccttagggaagc

SEQ ID NO: 1648692 - DNA, 20 bp, Homo sapiens
agccttagggaagctggcct

SEQ ID NO: 1648693 - DNA, 22 bp, Homo sapiens
agccttagggaagctggcctga

SEQ ID NO: 1648694 - DNA, 17 bp, Homo sapiens
agccttattctaaggtg

SEQ ID NO: 1648695 - DNA, 22 bp, Homo sapiens
agccttcaaaactatagcttgc

SEQ ID NO: 1648696 - DNA, 21 bp, Homo sapiens
agccttcaagaatcagaagaa

SEQ ID NO: 1648697 - DNA, 12 bp, Homo sapiens
agccttcaagtg

SEQ ID NO: 1648698 - DNA, 15 bp, Homo sapiens
agccttcaagtgcca

SEQ ID NO: 1648699 - DNA, 17 bp, Homo sapiens
agccttcaagtgccaaa

SEQ ID NO: 1648700 - DNA, 15 bp, Homo sapiens
agccttcagaatgct

SEQ ID NO: 1648701 - DNA, 19 bp, Homo sapiens
agccttcagcagcagctca

SEQ ID NO: 1648702 - DNA, 19 bp, Homo sapiens
agccttccaacatttcttg

SEQ ID NO: 1648703 - DNA, 22 bp, Homo sapiens
agccttccccttgcccagggct

SEQ ID NO: 1648704 - DNA, 23 bp, Homo sapiens
agccttcctccacatcctttcta

SEQ ID NO: 1648705 - DNA, 13 bp, Homo sapiens
agctctgaccctt

SEQ ID NO: 1648706 - DNA, 20 bp, Homo sapiens
agctctgaggggaggcacct

SEQ ID NO: 1648707 - DNA, 13 bp, Homo sapiens
agctctgcccccg

SEQ ID NO: 1648708 - DNA, 11 bp, Homo sapiens
agctctgcctc

SEQ ID NO: 1648709 - DNA, 13 bp, Homo sapiens
agctctgcgccag

SEQ ID NO: 1648710 - DNA, 17 bp, Homo sapiens
agctctgcgccaggcag

SEQ ID NO: 1648711 - DNA, 18 bp, Homo sapiens
agctctgcgccaggcaga

SEQ ID NO: 1648712 - DNA, 20 bp, Homo sapiens
agctctgcgccaggcagagc

SEQ ID NO: 1648713 - DNA, 21 bp, Homo sapiens
agctctgcgccaggcagagct

SEQ ID NO: 1648714 - DNA, 12 bp, Homo sapiens
agctctgcttgc

SEQ ID NO: 1648715 - DNA, 18 bp, Homo sapiens
agctctggacagccccac

SEQ ID NO: 1648716 - DNA, 20 bp, Homo sapiens
agctctggacgtgaaatact

SEQ ID NO: 1648717 - DNA, 23 bp, Homo sapiens
agctctggacgtgaaatacttcg

SEQ ID NO: 1648718 - DNA, 20 bp, Homo sapiens
agctctggaggggaggggga

SEQ ID NO: 1648719 - DNA, 17 bp, Homo sapiens
agctctggatgaaggca

SEQ ID NO: 1648720 - DNA, 18 bp, Homo sapiens
agctctggatgaaggcaa

SEQ ID NO: 1648721 - DNA, 12 bp, Homo sapiens
agctctggctga

SEQ ID NO: 1648722 - DNA, 19 bp, Homo sapiens
agctctggctgaaccctgt

SEQ ID NO: 1648723 - DNA, 23 bp, Homo sapiens
agctctggctgaaccctgtgctg

SEQ ID NO: 1648724 - DNA, 12 bp, Homo sapiens
agctctggcttc

SEQ ID NO: 1648725 - DNA, 12 bp, Homo sapiens
agctctggggac

SEQ ID NO: 1648726 - DNA, 18 bp, Homo sapiens
agctctggggacagcttc

SEQ ID NO: 1648727 - DNA, 22 bp, Homo sapiens
agctctggggacagcttcctca

SEQ ID NO: 1648728 - DNA, 22 bp, Homo sapiens
agctctgggttgtgcacatttc

SEQ ID NO: 1648729 - DNA, 18 bp, Homo sapiens
agctctggttatttttct

SEQ ID NO: 1648730 - DNA, 13 bp, Homo sapiens
agctctgtagttt

SEQ ID NO: 1648731 - DNA, 17 bp, Homo sapiens
agctctgtggcctgtgt

SEQ ID NO: 1648732 - DNA, 20 bp, Homo sapiens
agctctgtgggtctctggaa

SEQ ID NO: 1648733 - DNA, 22 bp, Homo sapiens
agctctgttccatgcaactgga

SEQ ID NO: 1648734 - DNA, 20 bp, Homo sapiens
agctctgtttataaaaacaa

SEQ ID NO: 1648735 - DNA, 15 bp, Homo sapiens
agctctgtttcggtt

SEQ ID NO: 1648736 - DNA, 20 bp, Homo sapiens
agctcttaattgttcatttt

SEQ ID NO: 1648737 - DNA, 18 bp, Homo sapiens
agctcttagtctctttgg

SEQ ID NO: 1648738 - DNA, 14 bp, Homo sapiens
agctcttcattcca

SEQ ID NO: 1648739 - DNA, 18 bp, Homo sapiens
agctcttcattccattga

SEQ ID NO: 1648740 - DNA, 20 bp, Homo sapiens
agctcttcggtttctgagca

SEQ ID NO: 1648741 - DNA, 12 bp, Homo sapiens
agctcttctctt

SEQ ID NO: 1648742 - DNA, 14 bp, Homo sapiens
agctcttctcttcc

SEQ ID NO: 1648743 - DNA, 15 bp, Homo sapiens
agctcttctcttcct

SEQ ID NO: 1648744 - DNA, 17 bp, Homo sapiens
agctcttctcttcctag

SEQ ID NO: 1648745 - DNA, 14 bp, Homo sapiens
agctcttgcccttc

SEQ ID NO: 1648746 - DNA, 16 bp, Homo sapiens
agctcttgcccttccc

SEQ ID NO: 1648747 - DNA, 17 bp, Homo sapiens
agctcttggcccctgtg

SEQ ID NO: 1648748 - DNA, 14 bp, Homo sapiens
agctcttgggtcag

SEQ ID NO: 1648749 - DNA, 18 bp, Homo sapiens
agctcttgggtcagagaa

SEQ ID NO: 1648750 - DNA, 13 bp, Homo sapiens
agctctttccaaa

SEQ ID NO: 1648751 - DNA, 17 bp, Homo sapiens
agctctttccaaattaa

SEQ ID NO: 1648752 - DNA, 22 bp, Homo sapiens
agctctttccaaattaaaacaa

SEQ ID NO: 1648753 - DNA, 21 bp, Homo sapiens
agctctttgggcctctcctgc

SEQ ID NO: 1648754 - DNA, 21 bp, Homo sapiens
agctgaaaaatcacatcctgg

SEQ ID NO: 1648755 - DNA, 21 bp, Homo sapiens
agctgaaaagggcactcccaa

SEQ ID NO: 1648756 - DNA, 22 bp, Homo sapiens
agctgaaacattccgaagaggg

SEQ ID NO: 1648757 - DNA, 14 bp, Homo sapiens
agctgaaagttggg

SEQ ID NO: 1648758 - DNA, 13 bp, Homo sapiens
agctgaaatgctg

SEQ ID NO: 1648759 - DNA, 19 bp, Homo sapiens
agctgaaattgaaaagtta

SEQ ID NO: 1648760 - DNA, 14 bp, Homo sapiens
agctgaacacattt

SEQ ID NO: 1648761 - DNA, 16 bp, Homo sapiens
agctgaaccccctcca

SEQ ID NO: 1648762 - DNA, 19 bp, Homo sapiens
agctgaaggcagtggcagg

SEQ ID NO: 1648763 - DNA, 15 bp, Homo sapiens
agctgaatacattct

SEQ ID NO: 1648764 - DNA, 11 bp, Homo sapiens
agctgaattca

SEQ ID NO: 1648765 - DNA, 17 bp, Homo sapiens
agctgacccagagtgga

SEQ ID NO: 1648766 - DNA, 16 bp, Homo sapiens
agctgacccagcccct

SEQ ID NO: 1648767 - DNA, 17 bp, Homo sapiens
agctgaccccgagaagt

SEQ ID NO: 1648768 - DNA, 22 bp, Homo sapiens
agctgaccccgagaagtgctct

SEQ ID NO: 1648769 - DNA, 23 bp, Homo sapiens
agctgactaaactttttttctgt

SEQ ID NO: 1648770 - DNA, 11 bp, Homo sapiens
agctgactgtg

SEQ ID NO: 1648771 - DNA, 19 bp, Homo sapiens
agctgactgtggccccctc

SEQ ID NO: 1648772 - DNA, 23 bp, Homo sapiens
agctgacttggcacttaagtgca

SEQ ID NO: 1648773 - DNA, 16 bp, Homo sapiens
agctgagatgagcccc

SEQ ID NO: 1648774 - DNA, 17 bp, Homo sapiens
agctgagatgagcccca

SEQ ID NO: 1648775 - DNA, 14 bp, Homo sapiens
agctgagcctgcag

SEQ ID NO: 1648776 - DNA, 16 bp, Homo sapiens
agctgagcctgcaggg

SEQ ID NO: 1648777 - DNA, 17 bp, Homo sapiens
agctgagcctgcaggga

SEQ ID NO: 1648778 - DNA, 15 bp, Homo sapiens
agctgagctggaagg

SEQ ID NO: 1648779 - DNA, 19 bp, Homo sapiens
agctgagctggaaggggcc

SEQ ID NO: 1648780 - DNA, 20 bp, Homo sapiens
agctgagctggaaggggcca

SEQ ID NO: 1648781 - DNA, 18 bp, Homo sapiens
agctgagcttgagctccc

SEQ ID NO: 1648782 - DNA, 15 bp, Homo sapiens
agctgaggagccctt

SEQ ID NO: 1648783 - DNA, 21 bp, Homo sapiens
agctgagggccctgtggagtc

SEQ ID NO: 1648784 - DNA, 18 bp, Homo sapiens
agctgaggtctcttgagg

SEQ ID NO: 1648785 - DNA, 15 bp, Homo sapiens
agctgagtgaaaaat

SEQ ID NO: 1648786 - DNA, 13 bp, Homo sapiens
agctgagtttcct

SEQ ID NO: 1648787 - DNA, 14 bp, Homo sapiens
agctgagtttccta

SEQ ID NO: 1648788 - DNA, 18 bp, Homo sapiens
agctgatattatttcttc

SEQ ID NO: 1648789 - DNA, 19 bp, Homo sapiens
agctgatattatttcttct

SEQ ID NO: 1648790 - DNA, 22 bp, Homo sapiens
agctgatattatttcttctctt

SEQ ID NO: 1648791 - DNA, 19 bp, Homo sapiens
agctgatccagagcacaga

SEQ ID NO: 1648792 - DNA, 22 bp, Homo sapiens
agctgattactgtcaataaaca

SEQ ID NO: 1648793 - DNA, 17 bp, Homo sapiens
agctgatttccaggccc

SEQ ID NO: 1648794 - DNA, 19 bp, Homo sapiens
agctgatttccaggcccct

SEQ ID NO: 1648795 - DNA, 21 bp, Homo sapiens
agctgatttccaggcccctga

SEQ ID NO: 1648796 - DNA, 16 bp, Homo sapiens
agctgcaaatctgatg

SEQ ID NO: 1648797 - DNA, 23 bp, Homo sapiens
agctgcaaggtactctggtgagt

SEQ ID NO: 1648798 - DNA, 11 bp, Homo sapiens
agctgcacatg

SEQ ID NO: 1648799 - DNA, 15 bp, Homo sapiens
agctgcacattcctg

SEQ ID NO: 1648800 - DNA, 20 bp, Homo sapiens
agctgcacattcctggcccc

SEQ ID NO: 1648801 - DNA, 17 bp, Homo sapiens
agctgcactgatgctgc

SEQ ID NO: 1648802 - DNA, 14 bp, Homo sapiens
agctgcactgtgaa

SEQ ID NO: 1648803 - DNA, 21 bp, Homo sapiens
agctgcagaaacgaagccatc

SEQ ID NO: 1648804 - DNA, 19 bp, Homo sapiens
agctgcagagatttctcat

SEQ ID NO: 1648805 - DNA, 12 bp, Homo sapiens
agctgcagctgg

SEQ ID NO: 1648806 - DNA, 17 bp, Homo sapiens
agctgcagctgggcccc

SEQ ID NO: 1648807 - DNA, 21 bp, Homo sapiens
agctgcagctgggccccatgc

SEQ ID NO: 1648808 - DNA, 18 bp, Homo sapiens
agctgcaggggcctctgt

SEQ ID NO: 1648809 - DNA, 15 bp, Homo sapiens
agctgcataatgtcc

SEQ ID NO: 1648810 - DNA, 23 bp, Homo sapiens
agctgcatcatccttgcaggtgg

SEQ ID NO: 1648811 - DNA, 17 bp, Homo sapiens
agctgcatctgttactt

SEQ ID NO: 1648812 - DNA, 15 bp, Homo sapiens
agctgcattccgcag

SEQ ID NO: 1648813 - DNA, 18 bp, Homo sapiens
agctgcattccgcagccc

SEQ ID NO: 1648814 - DNA, 22 bp, Homo sapiens
agctgcatttcacatgccttgc

SEQ ID NO: 1648815 - DNA, 23 bp, Homo sapiens
agctgcatttcacatgccttgca

SEQ ID NO: 1648816 - DNA, 13 bp, Homo sapiens
agctgccacagag

SEQ ID NO: 1648817 - DNA, 23 bp, Homo sapiens
agctgccactgggcacctgcgca

SEQ ID NO: 1648818 - DNA, 24 bp, Homo sapiens
agctgccactgggcacctgcgcac

SEQ ID NO: 1648819 - DNA, 18 bp, Homo sapiens
aggaaaaaatggtataaa

SEQ ID NO: 1648820 - DNA, 20 bp, Homo sapiens
aggaaaaaatggtataaaag

SEQ ID NO: 1648821 - DNA, 21 bp, Homo sapiens
aggaaaaaattgaaagaactt

SEQ ID NO: 1648822 - DNA, 20 bp, Homo sapiens
aggaaaacactatttccaaa

SEQ ID NO: 1648823 - DNA, 19 bp, Homo sapiens
aggaaaaccaagccgtggc

SEQ ID NO: 1648824 - DNA, 20 bp, Homo sapiens
aggaaaaccaagccgtggct

SEQ ID NO: 1648825 - DNA, 12 bp, Homo sapiens
aggaaaagcaag

SEQ ID NO: 1648826 - DNA, 12 bp, Homo sapiens
aggaaaaggaaa

SEQ ID NO: 1648827 - DNA, 14 bp, Homo sapiens
aggaaaaggaggag

SEQ ID NO: 1648828 - DNA, 22 bp, Homo sapiens
aggaaaaggttgaataatatat

SEQ ID NO: 1648829 - DNA, 22 bp, Homo sapiens
aggaaaagtacatttaatacag

SEQ ID NO: 1648830 - DNA, 20 bp, Homo sapiens
aggaaaataatacttatctt

SEQ ID NO: 1648831 - DNA, 16 bp, Homo sapiens
aggaaaatagtttagg

SEQ ID NO: 1648832 - DNA, 23 bp, Homo sapiens
aggaaaatataatatttactgtt

SEQ ID NO: 1648833 - DNA, 12 bp, Homo sapiens
aggaaaatattg

SEQ ID NO: 1648834 - DNA, 16 bp, Homo sapiens
aggaaaatgagtattt

SEQ ID NO: 1648835 - DNA, 15 bp, Homo sapiens
aggaaaatgtattga

SEQ ID NO: 1648836 - DNA, 14 bp, Homo sapiens
aggaaacaagtgaa

SEQ ID NO: 1648837 - DNA, 12 bp, Homo sapiens
aggaaacagtta

SEQ ID NO: 1648838 - DNA, 19 bp, Homo sapiens
aggaaacagttctcactgg

SEQ ID NO: 1648839 - DNA, 22 bp, Homo sapiens
aggaaacagttgcatgtagtaa

SEQ ID NO: 1648840 - DNA, 14 bp, Homo sapiens
aggaaacattttat

SEQ ID NO: 1648841 - DNA, 18 bp, Homo sapiens
aggaaacattttatcatt

SEQ ID NO: 1648842 - DNA, 17 bp, Homo sapiens
aggaaaccagctcgtgg

SEQ ID NO: 1648843 - DNA, 16 bp, Homo sapiens
aggaaactccacatct

SEQ ID NO: 1648844 - DNA, 20 bp, Homo sapiens
aggaaactccacatctgcct

SEQ ID NO: 1648845 - DNA, 21 bp, Homo sapiens
aggaaactccacatctgcctt

SEQ ID NO: 1648846 - DNA, 15 bp, Homo sapiens
aggaaacttttaact

SEQ ID NO: 1648847 - DNA, 12 bp, Homo sapiens
aggaaagaaaac

SEQ ID NO: 1648848 - DNA, 13 bp, Homo sapiens
aggaaagaaaaca

SEQ ID NO: 1648849 - DNA, 17 bp, Homo sapiens
aggaaagaaagaaggaa

SEQ ID NO: 1648850 - DNA, 17 bp, Homo sapiens
aggaaagaggaagcaaa

SEQ ID NO: 1648851 - DNA, 17 bp, Homo sapiens
aggaaagagtggtttct

SEQ ID NO: 1648852 - DNA, 19 bp, Homo sapiens
aggaaagcaataaatgaat

SEQ ID NO: 1648853 - DNA, 14 bp, Homo sapiens
aggaaaggagatca

SEQ ID NO: 1648854 - DNA, 22 bp, Homo sapiens
aggaaaggattttaccaaagca

SEQ ID NO: 1648855 - DNA, 16 bp, Homo sapiens
aggaaaggctcattta

SEQ ID NO: 1648856 - DNA, 18 bp, Homo sapiens
aggaaaggggagaaggga

SEQ ID NO: 1648857 - DNA, 19 bp, Homo sapiens
aggaaagggggtcccagtg

SEQ ID NO: 1648858 - DNA, 17 bp, Homo sapiens
aggaaataacagagaga

SEQ ID NO: 1648859 - DNA, 16 bp, Homo sapiens
aggaaataagaaaaat

SEQ ID NO: 1648860 - DNA, 18 bp, Homo sapiens
aggaaataagaaaaatca

SEQ ID NO: 1648861 - DNA, 20 bp, Homo sapiens
aggaaataagaaaaatcatg

SEQ ID NO: 1648862 - DNA, 21 bp, Homo sapiens
aggaaatcaaatatgcaaagc

SEQ ID NO: 1648863 - DNA, 22 bp, Homo sapiens
aggaaatcaaatatgcaaagca

SEQ ID NO: 1648864 - DNA, 14 bp, Homo sapiens
aggaaatctcaccc

SEQ ID NO: 1648865 - DNA, 22 bp, Homo sapiens
aggaaatgttggaactctgtgc

SEQ ID NO: 1648866 - DNA, 16 bp, Homo sapiens
aggaaatttgtttgta

SEQ ID NO: 1648867 - DNA, 22 bp, Homo sapiens
aggaaatttgtttgtatttttt

SEQ ID NO: 1648868 - DNA, 17 bp, Homo sapiens
aggaacaatctttgctg

SEQ ID NO: 1648869 - DNA, 23 bp, Homo sapiens
aggaacacccgactcctcaaaag

SEQ ID NO: 1648870 - DNA, 13 bp, Homo sapiens
aggaacagaagga

SEQ ID NO: 1648871 - DNA, 14 bp, Homo sapiens
aggaacagaaggat

SEQ ID NO: 1648872 - DNA, 13 bp, Homo sapiens
aggaacagccaca

SEQ ID NO: 1648873 - DNA, 21 bp, Homo sapiens
aggaacagctatgggagcccc

SEQ ID NO: 1648874 - DNA, 21 bp, Homo sapiens
aggaacagtgtggtttgggaa

SEQ ID NO: 1648875 - DNA, 13 bp, Homo sapiens
aggaactcacata

SEQ ID NO: 1648876 - DNA, 17 bp, Homo sapiens
aggaactcgcctcagcc

SEQ ID NO: 1648877 - DNA, 22 bp, Homo sapiens
aggaactgctgggcttggcagc

SEQ ID NO: 1648878 - DNA, 19 bp, Homo sapiens
aggaactgggtgactggag

SEQ ID NO: 1648879 - DNA, 20 bp, Homo sapiens
aggaactgtctcaaaaggat

SEQ ID NO: 1648880 - DNA, 23 bp, Homo sapiens
aggaactttctggtcccttcagt

SEQ ID NO: 1648881 - DNA, 17 bp, Homo sapiens
aggaagaacaacaaaga

SEQ ID NO: 1648882 - DNA, 16 bp, Homo sapiens
aggaagagccacctgc

SEQ ID NO: 1648883 - DNA, 17 bp, Homo sapiens
aggaagagccacctgca

SEQ ID NO: 1648884 - DNA, 14 bp, Homo sapiens
aggaagaggcccac

SEQ ID NO: 1648885 - DNA, 14 bp, Homo sapiens
aggaagagggacag

SEQ ID NO: 1648886 - DNA, 14 bp, Homo sapiens
aggaagagtttatg

SEQ ID NO: 1648887 - DNA, 23 bp, Homo sapiens
aggaagatggctcccaaggttcc

SEQ ID NO: 1648888 - DNA, 16 bp, Homo sapiens
aggaagcaaagagtga

SEQ ID NO: 1648889 - DNA, 18 bp, Homo sapiens
aggaagcaccccatgcca

SEQ ID NO: 1648890 - DNA, 19 bp, Homo sapiens
aggaagcattgtaaaataa

SEQ ID NO: 1648891 - DNA, 21 bp, Homo sapiens
aggaagcattgtaaaataatt

SEQ ID NO: 1648892 - DNA, 19 bp, Homo sapiens
aggaagccaggctgagtga

SEQ ID NO: 1648893 - DNA, 20 bp, Homo sapiens
aggaagccaggctgagtgag

SEQ ID NO: 1648894 - DNA, 19 bp, Homo sapiens
aggaagcccaattgctgga

SEQ ID NO: 1648895 - DNA, 15 bp, Homo sapiens
aggaagcccacatat

SEQ ID NO: 1648896 - DNA, 17 bp, Homo sapiens
aggaaggagagcctgct

SEQ ID NO: 1648897 - DNA, 14 bp, Homo sapiens
aggaaggaggcaga

SEQ ID NO: 1648898 - DNA, 15 bp, Homo sapiens
aggaaggcagctgct

SEQ ID NO: 1648899 - DNA, 16 bp, Homo sapiens
aggaaggcagctgctc

SEQ ID NO: 1648900 - DNA, 18 bp, Homo sapiens
aggaaggcagctgctctt

SEQ ID NO: 1648901 - DNA, 19 bp, Homo sapiens
aggaaggcagctgctctta

SEQ ID NO: 1648902 - DNA, 15 bp, Homo sapiens
aggaaggcaggaggg

SEQ ID NO: 1648903 - DNA, 18 bp, Homo sapiens
aggaaggcctttcttctg

SEQ ID NO: 1648904 - DNA, 12 bp, Homo sapiens
aggaaggctctc

SEQ ID NO: 1648905 - DNA, 17 bp, Homo sapiens
aggaagggcaggaagga

SEQ ID NO: 1648906 - DNA, 19 bp, Homo sapiens
aggaaggggggttgcagtg

SEQ ID NO: 1648907 - DNA, 15 bp, Homo sapiens
aggaaggtgctgagc

SEQ ID NO: 1648908 - DNA, 15 bp, Homo sapiens
aggaaggtggatggc

SEQ ID NO: 1648909 - DNA, 17 bp, Homo sapiens
aggaagtgtaacagctg

SEQ ID NO: 1648910 - DNA, 18 bp, Homo sapiens
aggaagtgtaacagctga

SEQ ID NO: 1648911 - DNA, 21 bp, Homo sapiens
aggaagtgttgaagggaggtg

SEQ ID NO: 1648912 - DNA, 16 bp, Homo sapiens
aggaagttttttctac

SEQ ID NO: 1648913 - DNA, 14 bp, Homo sapiens
aggaataaatgaga

SEQ ID NO: 1648914 - DNA, 14 bp, Homo sapiens
aggaataacactgc

SEQ ID NO: 1648915 - DNA, 15 bp, Homo sapiens
aggaataacactgca

SEQ ID NO: 1648916 - DNA, 17 bp, Homo sapiens
aggaatatatgtgtgcc

SEQ ID NO: 1648917 - DNA, 23 bp, Homo sapiens
aggaatatcccaaacttcggaaa

SEQ ID NO: 1648918 - DNA, 15 bp, Homo sapiens
aggaatatgttcaat

SEQ ID NO: 1648919 - DNA, 15 bp, Homo sapiens
aggaatattttccaa

SEQ ID NO: 1648920 - DNA, 15 bp, Homo sapiens
aggaatcagacttca

SEQ ID NO: 1648921 - DNA, 13 bp, Homo sapiens
aggaatcctggca

SEQ ID NO: 1648922 - DNA, 15 bp, Homo sapiens
aggaatcctggcagc

SEQ ID NO: 1648923 - DNA, 19 bp, Homo sapiens
aggaatcctggcagcccag

SEQ ID NO: 1648924 - DNA, 19 bp, Homo sapiens
aggaatccttactgatatt

SEQ ID NO: 1648925 - DNA, 15 bp, Homo sapiens
aggaatcctttgaga

SEQ ID NO: 1648926 - DNA, 17 bp, Homo sapiens
aggaatcggctggggac

SEQ ID NO: 1648927 - DNA, 14 bp, Homo sapiens
aggaatctcagaga

SEQ ID NO: 1648928 - DNA, 15 bp, Homo sapiens
aggaatctcagagac

SEQ ID NO: 1648929 - DNA, 13 bp, Homo sapiens
aggaatctcttca

SEQ ID NO: 1648930 - DNA, 15 bp, Homo sapiens
aggaatctcttcact

SEQ ID NO: 1648931 - DNA, 22 bp, Homo sapiens
aggaatctcttcactaccctga

SEQ ID NO: 1648932 - DNA, 20 bp, Homo sapiens
aggaatctgtgcagatgagc

SEQ ID NO: 1648933 - DNA, 19 bp, Homo sapiens
aggaatctgtgggtctggg

SEQ ID NO: 1648934 - DNA, 15 bp, Homo sapiens
aggatccgctgccac

SEQ ID NO: 1648935 - DNA, 22 bp, Homo sapiens
aggatcgaagggtttttagaga

SEQ ID NO: 1648936 - DNA, 15 bp, Homo sapiens
aggatcgaggcatgg

SEQ ID NO: 1648937 - DNA, 21 bp, Homo sapiens
aggatcgaggcatggggcatg

SEQ ID NO: 1648938 - DNA, 15 bp, Homo sapiens
aggatctctcaggag

SEQ ID NO: 1648939 - DNA, 22 bp, Homo sapiens
aggatctgcaaacaatgaagaa

SEQ ID NO: 1648940 - DNA, 16 bp, Homo sapiens
aggatctgctgaggcc

SEQ ID NO: 1648941 - DNA, 14 bp, Homo sapiens
aggatctggagaac

SEQ ID NO: 1648942 - DNA, 16 bp, Homo sapiens
aggatctgtgattggc

SEQ ID NO: 1648943 - DNA, 19 bp, Homo sapiens
aggatgaagaacacagcat

SEQ ID NO: 1648944 - DNA, 22 bp, Homo sapiens
aggatgaagagaaggcacacag

SEQ ID NO: 1648945 - DNA, 17 bp, Homo sapiens
aggatgaattttctgca

SEQ ID NO: 1648946 - DNA, 11 bp, Homo sapiens
aggatgacttt

SEQ ID NO: 1648947 - DNA, 23 bp, Homo sapiens
aggatgaggccgctagaggcctg

SEQ ID NO: 1648948 - DNA, 13 bp, Homo sapiens
aggatgagggaag

SEQ ID NO: 1648949 - DNA, 14 bp, Homo sapiens
aggatgagggaagc

SEQ ID NO: 1648950 - DNA, 13 bp, Homo sapiens
aggatgcccaggg

SEQ ID NO: 1648951 - DNA, 17 bp, Homo sapiens
aggatgctaaaccttag

SEQ ID NO: 1648952 - DNA, 15 bp, Homo sapiens
aggatgctaaagatg

SEQ ID NO: 1648953 - DNA, 16 bp, Homo sapiens
aggatggagagagggg

SEQ ID NO: 1648954 - DNA, 17 bp, Homo sapiens
aggatggagagagggga

SEQ ID NO: 1648955 - DNA, 19 bp, Homo sapiens
aggatggaggggtggtcct

SEQ ID NO: 1648956 - DNA, 16 bp, Homo sapiens
aggatggatggcaccc

SEQ ID NO: 1648957 - DNA, 18 bp, Homo sapiens
aggatggatggcaccctg

SEQ ID NO: 1648958 - DNA, 20 bp, Homo sapiens
aggatggatggcaccctgga

SEQ ID NO: 1648959 - DNA, 18 bp, Homo sapiens
aggatggctttgaatgcg

SEQ ID NO: 1648960 - DNA, 17 bp, Homo sapiens
aggatgggatctttctg

SEQ ID NO: 1648961 - DNA, 21 bp, Homo sapiens
aggatgggatgggttccagag

SEQ ID NO: 1648962 - DNA, 17 bp, Homo sapiens
aggatggggttctggaa

SEQ ID NO: 1648963 - DNA, 22 bp, Homo sapiens
aggatggtctcgatctcctgac

SEQ ID NO: 1648964 - DNA, 23 bp, Homo sapiens
aggatggtctcgatctcctgacc

SEQ ID NO: 1648965 - DNA, 23 bp, Homo sapiens
aggatggtgctgagtaaacataa

SEQ ID NO: 1648966 - DNA, 23 bp, Homo sapiens
aggatggttttgggactagaggc

SEQ ID NO: 1648967 - DNA, 23 bp, Homo sapiens
aggatgtaggggttaacttggtc

SEQ ID NO: 1648968 - DNA, 16 bp, Homo sapiens
aggatgtggaagagca

SEQ ID NO: 1648969 - DNA, 14 bp, Homo sapiens
aggatgtgtgcatg

SEQ ID NO: 1648970 - DNA, 15 bp, Homo sapiens
aggatgtgtgcatgt

SEQ ID NO: 1648971 - DNA, 16 bp, Homo sapiens
aggattacatgcatgt

SEQ ID NO: 1648972 - DNA, 22 bp, Homo sapiens
aggattacttagattgtgttcc

SEQ ID NO: 1648973 - DNA, 21 bp, Homo sapiens
aggattatgggtcctgcaatt

SEQ ID NO: 1648974 - DNA, 14 bp, Homo sapiens
aggattcaggcagc

SEQ ID NO: 1648975 - DNA, 17 bp, Homo sapiens
aggattcaggcagcagt

SEQ ID NO: 1648976 - DNA, 18 bp, Homo sapiens
aggattcaggcagcagtg

SEQ ID NO: 1648977 - DNA, 12 bp, Homo sapiens
aggattctaaaa

SEQ ID NO: 1648978 - DNA, 13 bp, Homo sapiens
aggattcttcccg

SEQ ID NO: 1648979 - DNA, 15 bp, Homo sapiens
aggattctttcccca

SEQ ID NO: 1648980 - DNA, 18 bp, Homo sapiens
aggattctttccccagag

SEQ ID NO: 1648981 - DNA, 21 bp, Homo sapiens
aggattctttccccagaggct

SEQ ID NO: 1648982 - DNA, 17 bp, Homo sapiens
aggattgcttgagccca

SEQ ID NO: 1648983 - DNA, 18 bp, Homo sapiens
aggattgcttgagcccag

SEQ ID NO: 1648984 - DNA, 21 bp, Homo sapiens
aggattgcttgagcccaggag

SEQ ID NO: 1648985 - DNA, 15 bp, Homo sapiens
aggattgtggaaaac

SEQ ID NO: 1648986 - DNA, 18 bp, Homo sapiens
aggattgtggaaaaccag

SEQ ID NO: 1648987 - DNA, 16 bp, Homo sapiens
aggatttaaaaactgg

SEQ ID NO: 1648988 - DNA, 18 bp, Homo sapiens
aggatttaacagtcattt

SEQ ID NO: 1648989 - DNA, 13 bp, Homo sapiens
aggatttaagcaa

SEQ ID NO: 1648990 - DNA, 14 bp, Homo sapiens
aggatttaggcctt

SEQ ID NO: 1648991 - DNA, 15 bp, Homo sapiens
aggatttaggcctta

SEQ ID NO: 1648992 - DNA, 12 bp, Homo sapiens
aggatttcaagc

SEQ ID NO: 1648993 - DNA, 20 bp, Homo sapiens
aggatttcatgatttcattt

SEQ ID NO: 1648994 - DNA, 15 bp, Homo sapiens
aggatttcctacccc

SEQ ID NO: 1648995 - DNA, 16 bp, Homo sapiens
aggattttaatttcag

SEQ ID NO: 1648996 - DNA, 14 bp, Homo sapiens
aggattttaccaaa

SEQ ID NO: 1648997 - DNA, 21 bp, Homo sapiens
aggattttggatgttgagagg

SEQ ID NO: 1648998 - DNA, 19 bp, Homo sapiens
aggcaaaatccttgcttat

SEQ ID NO: 1648999 - DNA, 19 bp, Homo sapiens
aggcaaacattttctctta

SEQ ID NO: 1649000 - DNA, 23 bp, Homo sapiens
aggcaaacattttctcttagaaa

SEQ ID NO: 1649001 - DNA, 21 bp, Homo sapiens
aggcaaagtttacagatgttt

SEQ ID NO: 1649002 - DNA, 22 bp, Homo sapiens
aggcaaagtttacagatgtttt

SEQ ID NO: 1649003 - DNA, 13 bp, Homo sapiens
aggcaaagtttta

SEQ ID NO: 1649004 - DNA, 21 bp, Homo sapiens
aggcaaatattgaagttgttt

SEQ ID NO: 1649005 - DNA, 18 bp, Homo sapiens
aggcaaatctaaaattta

SEQ ID NO: 1649006 - DNA, 17 bp, Homo sapiens
aggcaaatgtgtacatg

SEQ ID NO: 1649007 - DNA, 13 bp, Homo sapiens
aggcaacctccca

SEQ ID NO: 1649008 - DNA, 14 bp, Homo sapiens
aggcaacctcccat

SEQ ID NO: 1649009 - DNA, 21 bp, Homo sapiens
aggcaacctcccatcccaccc

SEQ ID NO: 1649010 - DNA, 16 bp, Homo sapiens
aggcaactgaggcaga

SEQ ID NO: 1649011 - DNA, 18 bp, Homo sapiens
aggcaagaaaaggacaaa

SEQ ID NO: 1649012 - DNA, 13 bp, Homo sapiens
aggcaagaggggt

SEQ ID NO: 1649013 - DNA, 24 bp, Homo sapiens
aggcaagaggggtggagactgctt

SEQ ID NO: 1649014 - DNA, 20 bp, Homo sapiens
aggcaagagtgttcttttct

SEQ ID NO: 1649015 - DNA, 14 bp, Homo sapiens
aggcaagccaggct

SEQ ID NO: 1649016 - DNA, 16 bp, Homo sapiens
aggcaagccaggctca

SEQ ID NO: 1649017 - DNA, 13 bp, Homo sapiens
aggcaagcccctc

SEQ ID NO: 1649018 - DNA, 14 bp, Homo sapiens
aggcaagcccctca

SEQ ID NO: 1649019 - DNA, 15 bp, Homo sapiens
aggcaagcccctcag

SEQ ID NO: 1649020 - DNA, 19 bp, Homo sapiens
aggcaagcccctcagccct

SEQ ID NO: 1649021 - DNA, 12 bp, Homo sapiens
aggcaagcttga

SEQ ID NO: 1649022 - DNA, 20 bp, Homo sapiens
aggcaagcttgaggccaaga

SEQ ID NO: 1649023 - DNA, 20 bp, Homo sapiens
aggcaaggcaggtgcctcca

SEQ ID NO: 1649024 - DNA, 12 bp, Homo sapiens
aggcaaggggca

SEQ ID NO: 1649025 - DNA, 22 bp, Homo sapiens
aggcaaggtttacactgcggaa

SEQ ID NO: 1649026 - DNA, 18 bp, Homo sapiens
aggcaagtttctagctag

SEQ ID NO: 1649027 - DNA, 17 bp, Homo sapiens
aggcaataaaaatcata

SEQ ID NO: 1649028 - DNA, 23 bp, Homo sapiens
aggcaatgactcgttacctgccg

SEQ ID NO: 1649029 - DNA, 22 bp, Homo sapiens
aggcaatgattgttaatttaca

SEQ ID NO: 1649030 - DNA, 17 bp, Homo sapiens
aggcaatgtcaggaaca

SEQ ID NO: 1649031 - DNA, 12 bp, Homo sapiens
aggcaattagac

SEQ ID NO: 1649032 - DNA, 19 bp, Homo sapiens
aggcaattttagtgtatta

SEQ ID NO: 1649033 - DNA, 14 bp, Homo sapiens
aggcacaatatggg

SEQ ID NO: 1649034 - DNA, 23 bp, Homo sapiens
aggcacacaccaccacgcctggc

SEQ ID NO: 1649035 - DNA, 15 bp, Homo sapiens
aggcacacttcttct

SEQ ID NO: 1649036 - DNA, 20 bp, Homo sapiens
aggcacacttcttcttggtc

SEQ ID NO: 1649037 - DNA, 12 bp, Homo sapiens
aggcacagagct

SEQ ID NO: 1649038 - DNA, 21 bp, Homo sapiens
aggcacagtgggagctgagct

SEQ ID NO: 1649039 - DNA, 23 bp, Homo sapiens
aggcacatgttgttctcattgac

SEQ ID NO: 1649040 - DNA, 16 bp, Homo sapiens
aggcaccaccaggagc

SEQ ID NO: 1649041 - DNA, 18 bp, Homo sapiens
aggcaccaccaggagcag

SEQ ID NO: 1649042 - DNA, 16 bp, Homo sapiens
aggcaccagctctgtg

SEQ ID NO: 1649043 - DNA, 22 bp, Homo sapiens
aggcaccagctctgtggcctgt

SEQ ID NO: 1649044 - DNA, 13 bp, Homo sapiens
aggcaccaggaag

SEQ ID NO: 1649045 - DNA, 22 bp, Homo sapiens
aggcacccatgtgggcgcccac

SEQ ID NO: 1649046 - DNA, 23 bp, Homo sapiens
aggcacccgccctttccttgcct

SEQ ID NO: 1649047 - DNA, 13 bp, Homo sapiens
aggcaccggcgct

SEQ ID NO: 1649048 - DNA, 21 bp, Homo sapiens
aggctatgaagggacagctgc

SEQ ID NO: 1649049 - DNA, 18 bp, Homo sapiens
aggctatgtataaaatac

SEQ ID NO: 1649050 - DNA, 16 bp, Homo sapiens
aggctattattttcac

SEQ ID NO: 1649051 - DNA, 22 bp, Homo sapiens
aggctatttgtaaatctgccac

SEQ ID NO: 1649052 - DNA, 15 bp, Homo sapiens
aggctcaaggctgtg

SEQ ID NO: 1649053 - DNA, 22 bp, Homo sapiens
aggctcactgcaacttctgcct

SEQ ID NO: 1649054 - DNA, 12 bp, Homo sapiens
aggctcactgcc

SEQ ID NO: 1649055 - DNA, 14 bp, Homo sapiens
aggctcactgccag

SEQ ID NO: 1649056 - DNA, 23 bp, Homo sapiens
aggctcactgccaggccagcctc

SEQ ID NO: 1649057 - DNA, 24 bp, Homo sapiens
aggctcactgccaggccagcctcc

SEQ ID NO: 1649058 - DNA, 18 bp, Homo sapiens
aggctcagtctcaggagc

SEQ ID NO: 1649059 - DNA, 20 bp, Homo sapiens
aggctcatagggaagacctg

SEQ ID NO: 1649060 - DNA, 22 bp, Homo sapiens
aggctccaccccatccagttca

SEQ ID NO: 1649061 - DNA, 14 bp, Homo sapiens
aggctccattagga

SEQ ID NO: 1649062 - DNA, 18 bp, Homo sapiens
aggctcccaatcagcttt

SEQ ID NO: 1649063 - DNA, 15 bp, Homo sapiens
aggctccccgcctcc

SEQ ID NO: 1649064 - DNA, 16 bp, Homo sapiens
aggctccccgcctcca

SEQ ID NO: 1649065 - DNA, 17 bp, Homo sapiens
aggctccccgcctccac

SEQ ID NO: 1649066 - DNA, 18 bp, Homo sapiens
aggctccccgcctccact

SEQ ID NO: 1649067 - DNA, 16 bp, Homo sapiens
aggctccctcgccctg

SEQ ID NO: 1649068 - DNA, 18 bp, Homo sapiens
aggctcctacctgtctgc

SEQ ID NO: 1649069 - DNA, 18 bp, Homo sapiens
aggctcctggctgtgccc

SEQ ID NO: 1649070 - DNA, 16 bp, Homo sapiens
aggctcctgttttgca

SEQ ID NO: 1649071 - DNA, 23 bp, Homo sapiens
aggctccttcctgtcttcctgca

SEQ ID NO: 1649072 - DNA, 17 bp, Homo sapiens
aggctcggagcaccctt

SEQ ID NO: 1649073 - DNA, 17 bp, Homo sapiens
aggctctagatcataag

SEQ ID NO: 1649074 - DNA, 20 bp, Homo sapiens
aggctctatgagtctagatg

SEQ ID NO: 1649075 - DNA, 22 bp, Homo sapiens
aggctctcgggtgggggagcca

SEQ ID NO: 1649076 - DNA, 22 bp, Homo sapiens
aggctctctctttctagaggtg

SEQ ID NO: 1649077 - DNA, 18 bp, Homo sapiens
aggctctctgtaggcaca

SEQ ID NO: 1649078 - DNA, 13 bp, Homo sapiens
aggctctgaaata

SEQ ID NO: 1649079 - DNA, 13 bp, Homo sapiens
aggctctgagagt

SEQ ID NO: 1649080 - DNA, 20 bp, Homo sapiens
aggctctgagagtctagatt

SEQ ID NO: 1649081 - DNA, 17 bp, Homo sapiens
aggctctgcacagatgg

SEQ ID NO: 1649082 - DNA, 13 bp, Homo sapiens
aggctctgccctg

SEQ ID NO: 1649083 - DNA, 23 bp, Homo sapiens
aggctctgccctgccctagctcc

SEQ ID NO: 1649084 - DNA, 13 bp, Homo sapiens
aggctctgggctc

SEQ ID NO: 1649085 - DNA, 14 bp, Homo sapiens
aggctctgggctca

SEQ ID NO: 1649086 - DNA, 18 bp, Homo sapiens
aggctctgggctcagggc

SEQ ID NO: 1649087 - DNA, 21 bp, Homo sapiens
aggctctgggctcagggctgg

SEQ ID NO: 1649088 - DNA, 23 bp, Homo sapiens
aggctctgggctcagggctggag

SEQ ID NO: 1649089 - DNA, 15 bp, Homo sapiens
aggctctgtgccttg

SEQ ID NO: 1649090 - DNA, 19 bp, Homo sapiens
aggctcttatgtgtgcctt

SEQ ID NO: 1649091 - DNA, 17 bp, Homo sapiens
aggctcttcctggacct

SEQ ID NO: 1649092 - DNA, 19 bp, Homo sapiens
aggctcttcctggacctga

SEQ ID NO: 1649093 - DNA, 13 bp, Homo sapiens
aggctcttctcct

SEQ ID NO: 1649094 - DNA, 14 bp, Homo sapiens
aggctcttctcctt

SEQ ID NO: 1649095 - DNA, 16 bp, Homo sapiens
aggctgaactcttcag

SEQ ID NO: 1649096 - DNA, 17 bp, Homo sapiens
aggctgaactcttcaga

SEQ ID NO: 1649097 - DNA, 18 bp, Homo sapiens
aggctgaactcttcagaa

SEQ ID NO: 1649098 - DNA, 20 bp, Homo sapiens
aggctgaactcttcagaaca

SEQ ID NO: 1649099 - DNA, 17 bp, Homo sapiens
aggctgaattacagtga

SEQ ID NO: 1649100 - DNA, 18 bp, Homo sapiens
aggctgacatgctcacac

SEQ ID NO: 1649101 - DNA, 18 bp, Homo sapiens
aggctgaccaagagagaa

SEQ ID NO: 1649102 - DNA, 20 bp, Homo sapiens
aggctgacgtgtgagggagg

SEQ ID NO: 1649103 - DNA, 16 bp, Homo sapiens
aggctgacttttccaa

SEQ ID NO: 1649104 - DNA, 13 bp, Homo sapiens
aggctgagaagga

SEQ ID NO: 1649105 - DNA, 16 bp, Homo sapiens
aggctgagactgcggg

SEQ ID NO: 1649106 - DNA, 14 bp, Homo sapiens
aggctgagagccag

SEQ ID NO: 1649107 - DNA, 11 bp, Homo sapiens
aggctgagcca

SEQ ID NO: 1649108 - DNA, 14 bp, Homo sapiens
aggctgaggcagaa

SEQ ID NO: 1649109 - DNA, 15 bp, Homo sapiens
aggctgaggcagaag

SEQ ID NO: 1649110 - DNA, 15 bp, Homo sapiens
aggctgaggcaggag

SEQ ID NO: 1649111 - DNA, 16 bp, Homo sapiens
aggctgaggcaggtgg

SEQ ID NO: 1649112 - DNA, 14 bp, Homo sapiens
aggctgaggcctgg

SEQ ID NO: 1649113 - DNA, 11 bp, Homo sapiens
aggctgaggcg

SEQ ID NO: 1649114 - DNA, 21 bp, Homo sapiens
aggctgaggcgggtggatcac

SEQ ID NO: 1649115 - DNA, 17 bp, Homo sapiens
aggctgagtccagagct

SEQ ID NO: 1649116 - DNA, 21 bp, Homo sapiens
aggctgatgtcaatttctgtg

SEQ ID NO: 1649117 - DNA, 23 bp, Homo sapiens
aggctgcacctctggctagagcc

SEQ ID NO: 1649118 - DNA, 16 bp, Homo sapiens
aggctgcactgcagtg

SEQ ID NO: 1649119 - DNA, 17 bp, Homo sapiens
aggctgcactgcagtga

SEQ ID NO: 1649120 - DNA, 21 bp, Homo sapiens
aggctgcactgcagtgatggc

SEQ ID NO: 1649121 - DNA, 18 bp, Homo sapiens
aggctgcagagctgaccc

SEQ ID NO: 1649122 - DNA, 19 bp, Homo sapiens
aggctgcagagctgaccca

SEQ ID NO: 1649123 - DNA, 20 bp, Homo sapiens
aggctgcagcaggtgctggg

SEQ ID NO: 1649124 - DNA, 12 bp, Homo sapiens
aggctgcagcct

SEQ ID NO: 1649125 - DNA, 15 bp, Homo sapiens
aggctgcatgctctg

SEQ ID NO: 1649126 - DNA, 20 bp, Homo sapiens
aggctgcatgctctggaagc

SEQ ID NO: 1649127 - DNA, 13 bp, Homo sapiens
aggctgccccagg

SEQ ID NO: 1649128 - DNA, 14 bp, Homo sapiens
aggctgccccaggc

SEQ ID NO: 1649129 - DNA, 17 bp, Homo sapiens
aggctgccccaggccgg

SEQ ID NO: 1649130 - DNA, 20 bp, Homo sapiens
aggctgccccaggccggagc

SEQ ID NO: 1649131 - DNA, 18 bp, Homo sapiens
aggctgcctcagccagtg

SEQ ID NO: 1649132 - DNA, 14 bp, Homo sapiens
aggctgcctcctgc

SEQ ID NO: 1649133 - DNA, 19 bp, Homo sapiens
aggctgcctgagcacctcc

SEQ ID NO: 1649134 - DNA, 10 bp, Homo sapiens
aggctgctag

SEQ ID NO: 1649135 - DNA, 15 bp, Homo sapiens
aggctgctcagggct

SEQ ID NO: 1649136 - DNA, 16 bp, Homo sapiens
aggctgctcagggctg

SEQ ID NO: 1649137 - DNA, 17 bp, Homo sapiens
aggctgctcagggctgg

SEQ ID NO: 1649138 - DNA, 13 bp, Homo sapiens
aggctgctgccat

SEQ ID NO: 1649139 - DNA, 12 bp, Homo sapiens
aggctgctgccg

SEQ ID NO: 1649140 - DNA, 14 bp, Homo sapiens
aggctgctgccgga

SEQ ID NO: 1649141 - DNA, 12 bp, Homo sapiens
aggctgctgtga

SEQ ID NO: 1649142 - DNA, 21 bp, Homo sapiens
aggctgctgtgaaaactctgg

SEQ ID NO: 1649143 - DNA, 22 bp, Homo sapiens
aggctgctgtgaaaactctggt

SEQ ID NO: 1649144 - DNA, 14 bp, Homo sapiens
aggctgctttctgc

SEQ ID NO: 1649145 - DNA, 15 bp, Homo sapiens
aggctgctttctgcc

SEQ ID NO: 1649146 - DNA, 15 bp, Homo sapiens
aggctggaagagcca

SEQ ID NO: 1649147 - DNA, 18 bp, Homo sapiens
aggctggccaaggtgtcc

SEQ ID NO: 1649148 - DNA, 19 bp, Homo sapiens
aggctggccaaggtgtcca

SEQ ID NO: 1649149 - DNA, 15 bp, Homo sapiens
aggctggccagtcca

SEQ ID NO: 1649150 - DNA, 17 bp, Homo sapiens
aggctggccagtccagg

SEQ ID NO: 1649151 - DNA, 18 bp, Homo sapiens
aggctggccagtccaggc

SEQ ID NO: 1649152 - DNA, 17 bp, Homo sapiens
aggctggccagtgctgc

SEQ ID NO: 1649153 - DNA, 15 bp, Homo sapiens
aggctggcgcagcca

SEQ ID NO: 1649154 - DNA, 17 bp, Homo sapiens
aggctggcgcagccaag

SEQ ID NO: 1649155 - DNA, 22 bp, Homo sapiens
aggctggcgcagccaaggccga

SEQ ID NO: 1649156 - DNA, 11 bp, Homo sapiens
aggctggctga

SEQ ID NO: 1649157 - DNA, 13 bp, Homo sapiens
aggctggctggcc

SEQ ID NO: 1649158 - DNA, 12 bp, Homo sapiens
aggctggctgtt

SEQ ID NO: 1649159 - DNA, 13 bp, Homo sapiens
aggctgggcatca

SEQ ID NO: 1649160 - DNA, 12 bp, Homo sapiens
aggctgggccat

SEQ ID NO: 1649161 - DNA, 20 bp, Homo sapiens
aggctgggccatgtccaaag

SEQ ID NO: 1649162 - DNA, 19 bp, Homo sapiens
aggctgggcctcccctggg

SEQ ID NO: 1649163 - DNA, 13 bp, Homo sapiens
agggccagcaggc

SEQ ID NO: 1649164 - DNA, 18 bp, Homo sapiens
agggccagcaggctcctg

SEQ ID NO: 1649165 - DNA, 17 bp, Homo sapiens
agggccagggacccagg

SEQ ID NO: 1649166 - DNA, 23 bp, Homo sapiens
agggccagggacccaggtgtgcc

SEQ ID NO: 1649167 - DNA, 14 bp, Homo sapiens
agggccagggccct

SEQ ID NO: 1649168 - DNA, 19 bp, Homo sapiens
agggccagggccctgcaga

SEQ ID NO: 1649169 - DNA, 16 bp, Homo sapiens
agggccagtcctgcct

SEQ ID NO: 1649170 - DNA, 18 bp, Homo sapiens
agggccagtcctgcctgg

SEQ ID NO: 1649171 - DNA, 22 bp, Homo sapiens
agggccagtcctgcctggccag

SEQ ID NO: 1649172 - DNA, 22 bp, Homo sapiens
agggccatctgactgccaagcc

SEQ ID NO: 1649173 - DNA, 21 bp, Homo sapiens
agggccatgctgaggcctggg

SEQ ID NO: 1649174 - DNA, 22 bp, Homo sapiens
agggccatgctgaggcctgggc

SEQ ID NO: 1649175 - DNA, 23 bp, Homo sapiens
agggccatgctgaggcctgggcc

SEQ ID NO: 1649176 - DNA, 14 bp, Homo sapiens
agggccatggctca

SEQ ID NO: 1649177 - DNA, 21 bp, Homo sapiens
agggccattgaactctgagag

SEQ ID NO: 1649178 - DNA, 16 bp, Homo sapiens
agggcccaagtccctg

SEQ ID NO: 1649179 - DNA, 16 bp, Homo sapiens
agggcccagaccctgg

SEQ ID NO: 1649180 - DNA, 19 bp, Homo sapiens
agggcccagaccctgggca

SEQ ID NO: 1649181 - DNA, 14 bp, Homo sapiens
agggcccagagccc

SEQ ID NO: 1649182 - DNA, 16 bp, Homo sapiens
agggcccagagcccag

SEQ ID NO: 1649183 - DNA, 19 bp, Homo sapiens
agggcccagagcccagctc

SEQ ID NO: 1649184 - DNA, 20 bp, Homo sapiens
agggcccagagcccagctcc

SEQ ID NO: 1649185 - DNA, 12 bp, Homo sapiens
agggcccagagt

SEQ ID NO: 1649186 - DNA, 13 bp, Homo sapiens
agggcccagccca

SEQ ID NO: 1649187 - DNA, 15 bp, Homo sapiens
agggcccagctgtag

SEQ ID NO: 1649188 - DNA, 23 bp, Homo sapiens
agggcccagctgtagccatggct

SEQ ID NO: 1649189 - DNA, 17 bp, Homo sapiens
agggcccaggcaggcca

SEQ ID NO: 1649190 - DNA, 18 bp, Homo sapiens
agggcccatcaggcagtg

SEQ ID NO: 1649191 - DNA, 13 bp, Homo sapiens
agggcccccacag

SEQ ID NO: 1649192 - DNA, 22 bp, Homo sapiens
agggcccccggccacgctccct

SEQ ID NO: 1649193 - DNA, 19 bp, Homo sapiens
agggcccctctgcccagct

SEQ ID NO: 1649194 - DNA, 12 bp, Homo sapiens
agggcccctgcg

SEQ ID NO: 1649195 - DNA, 15 bp, Homo sapiens
agggccctaggcccc

SEQ ID NO: 1649196 - DNA, 16 bp, Homo sapiens
agggccctcccagccc

SEQ ID NO: 1649197 - DNA, 17 bp, Homo sapiens
agggccctcccagccca

SEQ ID NO: 1649198 - DNA, 12 bp, Homo sapiens
agggccctgcag

SEQ ID NO: 1649199 - DNA, 15 bp, Homo sapiens
agggccctgtggagt

SEQ ID NO: 1649200 - DNA, 19 bp, Homo sapiens
agggccctgtggagtccag

SEQ ID NO: 1649201 - DNA, 13 bp, Homo sapiens
agggcccttctct

SEQ ID NO: 1649202 - DNA, 22 bp, Homo sapiens
agggccgaccagaggagccttt

SEQ ID NO: 1649203 - DNA, 19 bp, Homo sapiens
agggccgactaagagaagt

SEQ ID NO: 1649204 - DNA, 18 bp, Homo sapiens
agggccggcttctgcctg

SEQ ID NO: 1649205 - DNA, 21 bp, Homo sapiens
agggccggcttctgcctgggg

SEQ ID NO: 1649206 - DNA, 18 bp, Homo sapiens
agggccggggatggatct

SEQ ID NO: 1649207 - DNA, 16 bp, Homo sapiens
agggccgtaccccacc

SEQ ID NO: 1649208 - DNA, 19 bp, Homo sapiens
agggccgtaccccaccctc

SEQ ID NO: 1649209 - DNA, 22 bp, Homo sapiens
agggccgtgcccttgcccttgg

SEQ ID NO: 1649210 - DNA, 12 bp, Homo sapiens
agggcctccagg

SEQ ID NO: 1649211 - DNA, 13 bp, Homo sapiens
agggcctctgcct

SEQ ID NO: 1649212 - DNA, 17 bp, Homo sapiens
agggcctgacaccccct

SEQ ID NO: 1649213 - DNA, 18 bp, Homo sapiens
agggcctgacaccccctc

SEQ ID NO: 1649214 - DNA, 19 bp, Homo sapiens
agggcctgacaccccctcc

SEQ ID NO: 1649215 - DNA, 15 bp, Homo sapiens
agggcctgagcagct

SEQ ID NO: 1649216 - DNA, 15 bp, Homo sapiens
agggcctgcagtgat

SEQ ID NO: 1649217 - DNA, 14 bp, Homo sapiens
agggcctgctggag

SEQ ID NO: 1649218 - DNA, 21 bp, Homo sapiens
agggcctgctggaggcctcag

SEQ ID NO: 1649219 - DNA, 13 bp, Homo sapiens
agggcctggagcc

SEQ ID NO: 1649220 - DNA, 13 bp, Homo sapiens
agggcctggccag

SEQ ID NO: 1649221 - DNA, 15 bp, Homo sapiens
agggcctggccagtc

SEQ ID NO: 1649222 - DNA, 23 bp, Homo sapiens
agggccttgcccagagatgcctc

SEQ ID NO: 1649223 - DNA, 21 bp, Homo sapiens
agggccttggaaattcctgta

SEQ ID NO: 1649224 - DNA, 15 bp, Homo sapiens
agggccttttctggc

SEQ ID NO: 1649225 - DNA, 19 bp, Homo sapiens
agggccttttctggcaccg

SEQ ID NO: 1649226 - DNA, 20 bp, Homo sapiens
agggcgaacgacaatagctt

SEQ ID NO: 1649227 - DNA, 19 bp, Homo sapiens
agggcgagactctgtctca

SEQ ID NO: 1649228 - DNA, 21 bp, Homo sapiens
agggcgcccattcgtctgtcc

SEQ ID NO: 1649229 - DNA, 22 bp, Homo sapiens
agggcgcccattcgtctgtccc

SEQ ID NO: 1649230 - DNA, 14 bp, Homo sapiens
agggcgcctactct

SEQ ID NO: 1649231 - DNA, 20 bp, Homo sapiens
agggcgctcagacggcggcc

SEQ ID NO: 1649232 - DNA, 12 bp, Homo sapiens
agggcggaagag

SEQ ID NO: 1649233 - DNA, 17 bp, Homo sapiens
agggcggaagagttaca

SEQ ID NO: 1649234 - DNA, 17 bp, Homo sapiens
agggcgtgactcaccca

SEQ ID NO: 1649235 - DNA, 13 bp, Homo sapiens
agggctaagagct

SEQ ID NO: 1649236 - DNA, 22 bp, Homo sapiens
agggctaagagctagcgctgcc

SEQ ID NO: 1649237 - DNA, 23 bp, Homo sapiens
agggctaagagctagcgctgccg

SEQ ID NO: 1649238 - DNA, 22 bp, Homo sapiens
agggctaattatatattttgtt

SEQ ID NO: 1649239 - DNA, 16 bp, Homo sapiens
agggctagcatccctg

SEQ ID NO: 1649240 - DNA, 15 bp, Homo sapiens
agggctcagcctggt

SEQ ID NO: 1649241 - DNA, 22 bp, Homo sapiens
agggctccaaatctgcctagaa

SEQ ID NO: 1649242 - DNA, 15 bp, Homo sapiens
agggctccagcatcc

SEQ ID NO: 1649243 - DNA, 21 bp, Homo sapiens
agggctccagcatccagcctg

SEQ ID NO: 1649244 - DNA, 22 bp, Homo sapiens
agggctccagcatccagcctgt

SEQ ID NO: 1649245 - DNA, 14 bp, Homo sapiens
agggctccagcccc

SEQ ID NO: 1649246 - DNA, 23 bp, Homo sapiens
agggctccagcccctcttggaga

SEQ ID NO: 1649247 - DNA, 12 bp, Homo sapiens
agggctcccatg

SEQ ID NO: 1649248 - DNA, 15 bp, Homo sapiens
agggctctaaaaaaa

SEQ ID NO: 1649249 - DNA, 15 bp, Homo sapiens
agggctctgatattc

SEQ ID NO: 1649250 - DNA, 17 bp, Homo sapiens
agggctctgatctaaca

SEQ ID NO: 1649251 - DNA, 19 bp, Homo sapiens
agggctctgtttgtgggac

SEQ ID NO: 1649252 - DNA, 17 bp, Homo sapiens
agggctgagctctctgt

SEQ ID NO: 1649253 - DNA, 16 bp, Homo sapiens
agggctgagctgggga

SEQ ID NO: 1649254 - DNA, 18 bp, Homo sapiens
agggctgatggaggaaaa

SEQ ID NO: 1649255 - DNA, 19 bp, Homo sapiens
agggctgatggaggaaaaa

SEQ ID NO: 1649256 - DNA, 19 bp, Homo sapiens
agggctgcacattgcctgt

SEQ ID NO: 1649257 - DNA, 12 bp, Homo sapiens
agggctgcaggg

SEQ ID NO: 1649258 - DNA, 15 bp, Homo sapiens
agggctgcagtcaca

SEQ ID NO: 1649259 - DNA, 16 bp, Homo sapiens
agggctgcatgatgtt

SEQ ID NO: 1649260 - DNA, 14 bp, Homo sapiens
agggctgcttttct

SEQ ID NO: 1649261 - DNA, 18 bp, Homo sapiens
agggctgcttttcttaag

SEQ ID NO: 1649262 - DNA, 15 bp, Homo sapiens
agggctggactgagg

SEQ ID NO: 1649263 - DNA, 15 bp, Homo sapiens
agggctggaggccca

SEQ ID NO: 1649264 - DNA, 19 bp, Homo sapiens
agggctggagtgcgctctt

SEQ ID NO: 1649265 - DNA, 17 bp, Homo sapiens
agggctggctcctctgc

SEQ ID NO: 1649266 - DNA, 16 bp, Homo sapiens
agggctgggaggaagg

SEQ ID NO: 1649267 - DNA, 14 bp, Homo sapiens
agggctgggccagg

SEQ ID NO: 1649268 - DNA, 15 bp, Homo sapiens
agggctgggccaggt

SEQ ID NO: 1649269 - DNA, 17 bp, Homo sapiens
agggctgggccaggtct

SEQ ID NO: 1649270 - DNA, 10 bp, Homo sapiens
agggctgggg

SEQ ID NO: 1649271 - DNA, 15 bp, Homo sapiens
agggctggggacaga

SEQ ID NO: 1649272 - DNA, 17 bp, Homo sapiens
agggctggtccttattt

SEQ ID NO: 1649273 - DNA, 19 bp, Homo sapiens
agggctggtccttatttat

SEQ ID NO: 1649274 - DNA, 15 bp, Homo sapiens
agggctgtcattgca

SEQ ID NO: 1649275 - DNA, 19 bp, Homo sapiens
agggctgtgagcatcctgg

SEQ ID NO: 1649276 - DNA, 23 bp, Homo sapiens
agggctgtgagcatcctggcagg

SEQ ID NO: 1649277 - DNA, 19 bp, Homo sapiens
agggctgtggcctccctgc

SEQ ID NO: 1649278 - DNA, 24 bp, Homo sapiens
aggtctccttactctgagcccagg

SEQ ID NO: 1649279 - DNA, 16 bp, Homo sapiens
aggtctctccactgct

SEQ ID NO: 1649280 - DNA, 14 bp, Homo sapiens
aggtctctgggagc

SEQ ID NO: 1649281 - DNA, 18 bp, Homo sapiens
aggtctctgggagcccag

SEQ ID NO: 1649282 - DNA, 14 bp, Homo sapiens
aggtctcttctggg

SEQ ID NO: 1649283 - DNA, 15 bp, Homo sapiens
aggtctgaatctgcg

SEQ ID NO: 1649284 - DNA, 14 bp, Homo sapiens
aggtctgagccctg

SEQ ID NO: 1649285 - DNA, 14 bp, Homo sapiens
aggtctgattggct

SEQ ID NO: 1649286 - DNA, 15 bp, Homo sapiens
aggtctgattggctg

SEQ ID NO: 1649287 - DNA, 20 bp, Homo sapiens
aggtctgcaagggcccagag

SEQ ID NO: 1649288 - DNA, 21 bp, Homo sapiens
aggtctgcaagggcccagagt

SEQ ID NO: 1649289 - DNA, 17 bp, Homo sapiens
aggtctgtatggctgta

SEQ ID NO: 1649290 - DNA, 14 bp, Homo sapiens
aggtctgtgctgag

SEQ ID NO: 1649291 - DNA, 19 bp, Homo sapiens
aggtcttcttaatatgttc

SEQ ID NO: 1649292 - DNA, 15 bp, Homo sapiens
aggtcttgactcatg

SEQ ID NO: 1649293 - DNA, 19 bp, Homo sapiens
aggtcttgactcatggcag

SEQ ID NO: 1649294 - DNA, 22 bp, Homo sapiens
aggtcttgactcatggcagctg

SEQ ID NO: 1649295 - DNA, 21 bp, Homo sapiens
aggtcttgcagtggcttttca

SEQ ID NO: 1649296 - DNA, 16 bp, Homo sapiens
aggtgaaagggagcta

SEQ ID NO: 1649297 - DNA, 15 bp, Homo sapiens
aggtgaacaaggtaa

SEQ ID NO: 1649298 - DNA, 15 bp, Homo sapiens
aggtgaacattaaaa

SEQ ID NO: 1649299 - DNA, 21 bp, Homo sapiens
aggtgaattttccgggaactt

SEQ ID NO: 1649300 - DNA, 15 bp, Homo sapiens
aggtgacagcagtcg

SEQ ID NO: 1649301 - DNA, 19 bp, Homo sapiens
aggtgacatcggaaaaata

SEQ ID NO: 1649302 - DNA, 18 bp, Homo sapiens
aggtgaccctgatgaaaa

SEQ ID NO: 1649303 - DNA, 14 bp, Homo sapiens
aggtgactgtgctg

SEQ ID NO: 1649304 - DNA, 16 bp, Homo sapiens
aggtgagaacccagag

SEQ ID NO: 1649305 - DNA, 20 bp, Homo sapiens
aggtgagtttgagctgcctt

SEQ ID NO: 1649306 - DNA, 17 bp, Homo sapiens
aggtgatagcattgctt

SEQ ID NO: 1649307 - DNA, 10 bp, Homo sapiens
aggtgatctt

SEQ ID NO: 1649308 - DNA, 17 bp, Homo sapiens
aggtgatgtttccagct

SEQ ID NO: 1649309 - DNA, 20 bp, Homo sapiens
aggtgatgtttccagctgcc

SEQ ID NO: 1649310 - DNA, 16 bp, Homo sapiens
aggtgattaacttgga

SEQ ID NO: 1649311 - DNA, 18 bp, Homo sapiens
aggtgcaatttcaaggtt

SEQ ID NO: 1649312 - DNA, 16 bp, Homo sapiens
aggtgcagaccttggg

SEQ ID NO: 1649313 - DNA, 20 bp, Homo sapiens
aggtgcagagtgcccagaac

SEQ ID NO: 1649314 - DNA, 17 bp, Homo sapiens
aggtgcagatgggctgt

SEQ ID NO: 1649315 - DNA, 23 bp, Homo sapiens
aggtgcatctggggaactagagg

SEQ ID NO: 1649316 - DNA, 19 bp, Homo sapiens
aggtgccaccaccctgccc

SEQ ID NO: 1649317 - DNA, 16 bp, Homo sapiens
aggtgccactccctga

SEQ ID NO: 1649318 - DNA, 19 bp, Homo sapiens
aggtgccactccctgagct

SEQ ID NO: 1649319 - DNA, 17 bp, Homo sapiens
aggtgccatctcaggag

SEQ ID NO: 1649320 - DNA, 14 bp, Homo sapiens
aggtgccatgcctg

SEQ ID NO: 1649321 - DNA, 16 bp, Homo sapiens
aggtgccatgcctgct

SEQ ID NO: 1649322 - DNA, 17 bp, Homo sapiens
aggtgccatgcctgctc

SEQ ID NO: 1649323 - DNA, 19 bp, Homo sapiens
aggtgccatgcctgctccc

SEQ ID NO: 1649324 - DNA, 21 bp, Homo sapiens
aggtgccatgcctgctccctg

SEQ ID NO: 1649325 - DNA, 22 bp, Homo sapiens
aggtgccatgcctgctccctgt

SEQ ID NO: 1649326 - DNA, 15 bp, Homo sapiens
aggtgcccagggcca

SEQ ID NO: 1649327 - DNA, 16 bp, Homo sapiens
aggtgcccagggccag

SEQ ID NO: 1649328 - DNA, 17 bp, Homo sapiens
aggtgccccaaaatgca

SEQ ID NO: 1649329 - DNA, 19 bp, Homo sapiens
aggtgccgccagctgccgc

SEQ ID NO: 1649330 - DNA, 20 bp, Homo sapiens
aggtgccgccagctgccgca

SEQ ID NO: 1649331 - DNA, 16 bp, Homo sapiens
aggtgccgtgagcagg

SEQ ID NO: 1649332 - DNA, 18 bp, Homo sapiens
aggtgccgtgagcaggct

SEQ ID NO: 1649333 - DNA, 12 bp, Homo sapiens
aggtgcctcaga

SEQ ID NO: 1649334 - DNA, 14 bp, Homo sapiens
aggtgcctcagact

SEQ ID NO: 1649335 - DNA, 15 bp, Homo sapiens
aggtgcctcagactc

SEQ ID NO: 1649336 - DNA, 22 bp, Homo sapiens
aggtgcctcagttttccttctg

SEQ ID NO: 1649337 - DNA, 16 bp, Homo sapiens
aggtgcctccaggtgt

SEQ ID NO: 1649338 - DNA, 18 bp, Homo sapiens
aggtgcctccaggtgtgc

SEQ ID NO: 1649339 - DNA, 18 bp, Homo sapiens
aggtgcctgtgaggcagg

SEQ ID NO: 1649340 - DNA, 20 bp, Homo sapiens
aggtgcctgtgaggcagggg

SEQ ID NO: 1649341 - DNA, 21 bp, Homo sapiens
aggtgcctgtgaggcaggggc

SEQ ID NO: 1649342 - DNA, 20 bp, Homo sapiens
aggtgccttacatcttttct

SEQ ID NO: 1649343 - DNA, 23 bp, Homo sapiens
aggtgccttacatcttttctaat

SEQ ID NO: 1649344 - DNA, 13 bp, Homo sapiens
aggtgccttctta

SEQ ID NO: 1649345 - DNA, 23 bp, Homo sapiens
aggtgccttcttattctcactcc

SEQ ID NO: 1649346 - DNA, 22 bp, Homo sapiens
aggtgcgctcacctcagagcag

SEQ ID NO: 1649347 - DNA, 19 bp, Homo sapiens
aggtgcgtgttcagcagaa

SEQ ID NO: 1649348 - DNA, 22 bp, Homo sapiens
aggtgcgtgttcagcagaacct

SEQ ID NO: 1649349 - DNA, 23 bp, Homo sapiens
aggtgctaaatggtcgcccagga

SEQ ID NO: 1649350 - DNA, 17 bp, Homo sapiens
aggtgctaatttgtttt

SEQ ID NO: 1649351 - DNA, 23 bp, Homo sapiens
aggtgctacaaaaacacagcaag

SEQ ID NO: 1649352 - DNA, 24 bp, Homo sapiens
aggtgctacaaaaacacagcaagg

SEQ ID NO: 1649353 - DNA, 17 bp, Homo sapiens
aggtgctcccctgacag

SEQ ID NO: 1649354 - DNA, 18 bp, Homo sapiens
aggtgctctctttctgtc

SEQ ID NO: 1649355 - DNA, 18 bp, Homo sapiens
aggtgctgaactgtgcat

SEQ ID NO: 1649356 - DNA, 18 bp, Homo sapiens
aggtgctgaatgaagctg

SEQ ID NO: 1649357 - DNA, 14 bp, Homo sapiens
aggtgctgaatggg

SEQ ID NO: 1649358 - DNA, 17 bp, Homo sapiens
aggtgctgacggccagg

SEQ ID NO: 1649359 - DNA, 12 bp, Homo sapiens
aggtgctgagct

SEQ ID NO: 1649360 - DNA, 17 bp, Homo sapiens
aggtgctgagcttagcc

SEQ ID NO: 1649361 - DNA, 23 bp, Homo sapiens
aggtgctgatgtcaaagtgtaac

SEQ ID NO: 1649362 - DNA, 13 bp, Homo sapiens
aggtgctgccttg

SEQ ID NO: 1649363 - DNA, 23 bp, Homo sapiens
aggtgctgggctggactggccat

SEQ ID NO: 1649364 - DNA, 20 bp, Homo sapiens
aggtgcttctcaccacggga

SEQ ID NO: 1649365 - DNA, 12 bp, Homo sapiens
aggtgcttgagg

SEQ ID NO: 1649366 - DNA, 23 bp, Homo sapiens
aggtgctttagagataattgctt

SEQ ID NO: 1649367 - DNA, 13 bp, Homo sapiens
aggtggaaaaaca

SEQ ID NO: 1649368 - DNA, 16 bp, Homo sapiens
aggtggaagaagggag

SEQ ID NO: 1649369 - DNA, 16 bp, Homo sapiens
aggtggaagccctcct

SEQ ID NO: 1649370 - DNA, 17 bp, Homo sapiens
aggtggaagccctcctt

SEQ ID NO: 1649371 - DNA, 21 bp, Homo sapiens
aggtggaagccctccttccac

SEQ ID NO: 1649372 - DNA, 15 bp, Homo sapiens
aggtggaataaacat

SEQ ID NO: 1649373 - DNA, 17 bp, Homo sapiens
aggtggaataaacatta

SEQ ID NO: 1649374 - DNA, 16 bp, Homo sapiens
aggtggacctggcagt

SEQ ID NO: 1649375 - DNA, 19 bp, Homo sapiens
aggtggagaaaattggaac

SEQ ID NO: 1649376 - DNA, 23 bp, Homo sapiens
aggtggagagacacacctgctcc

SEQ ID NO: 1649377 - DNA, 19 bp, Homo sapiens
aggtggagggaaggataaa

SEQ ID NO: 1649378 - DNA, 16 bp, Homo sapiens
aggtggagggcacagc

SEQ ID NO: 1649379 - DNA, 20 bp, Homo sapiens
aggtggagggcacagccctc

SEQ ID NO: 1649380 - DNA, 20 bp, Homo sapiens
aggtggagggtttgcactcc

SEQ ID NO: 1649381 - DNA, 16 bp, Homo sapiens
aggtggatcacagagg

SEQ ID NO: 1649382 - DNA, 16 bp, Homo sapiens
aggtggatctatttca

SEQ ID NO: 1649383 - DNA, 15 bp, Homo sapiens
aggtggatggcccca

SEQ ID NO: 1649384 - DNA, 23 bp, Homo sapiens
aggtggattttgtttaaaaaatc

SEQ ID NO: 1649385 - DNA, 15 bp, Homo sapiens
aggtggccacagcag

SEQ ID NO: 1649386 - DNA, 15 bp, Homo sapiens
aggtggccatgttat

SEQ ID NO: 1649387 - DNA, 15 bp, Homo sapiens
aggtggccgcccctg

SEQ ID NO: 1649388 - DNA, 19 bp, Homo sapiens
aggtggccgcccctgaggc

SEQ ID NO: 1649389 - DNA, 20 bp, Homo sapiens
aggtggctgacccagtccct

SEQ ID NO: 1649390 - DNA, 13 bp, Homo sapiens
aggtgggagctga

SEQ ID NO: 1649391 - DNA, 17 bp, Homo sapiens
aggtgggatcctccctc

SEQ ID NO: 1649392 - DNA, 15 bp, Homo sapiens
agtactctctgctct

SEQ ID NO: 1649393 - DNA, 20 bp, Homo sapiens
agtactctctgctctagcca

SEQ ID NO: 1649394 - DNA, 23 bp, Homo sapiens
agtactctctgctctagccagga

SEQ ID NO: 1649395 - DNA, 14 bp, Homo sapiens
agtactctttaaca

SEQ ID NO: 1649396 - DNA, 17 bp, Homo sapiens
agtactgctcttgtttc

SEQ ID NO: 1649397 - DNA, 15 bp, Homo sapiens
agtactggcatggta

SEQ ID NO: 1649398 - DNA, 12 bp, Homo sapiens
agtacttatctt

SEQ ID NO: 1649399 - DNA, 13 bp, Homo sapiens
agtacttccagat

SEQ ID NO: 1649400 - DNA, 16 bp, Homo sapiens
agtacttgaaaaagta

SEQ ID NO: 1649401 - DNA, 22 bp, Homo sapiens
agtacttgtgaaacacagctgt

SEQ ID NO: 1649402 - DNA, 19 bp, Homo sapiens
agtactttaaaaaggaaat

SEQ ID NO: 1649403 - DNA, 17 bp, Homo sapiens
agtactttattgtacag

SEQ ID NO: 1649404 - DNA, 22 bp, Homo sapiens
agtactttattgtacagactgt

SEQ ID NO: 1649405 - DNA, 13 bp, Homo sapiens
agtactttgtgca

SEQ ID NO: 1649406 - DNA, 16 bp, Homo sapiens
agtactttgtgcattc

SEQ ID NO: 1649407 - DNA, 16 bp, Homo sapiens
agtacttttttaaata

SEQ ID NO: 1649408 - DNA, 19 bp, Homo sapiens
agtagaaaaatctcattcc

SEQ ID NO: 1649409 - DNA, 17 bp, Homo sapiens
agtagaaaagtcgggga

SEQ ID NO: 1649410 - DNA, 14 bp, Homo sapiens
agtagaaattttac

SEQ ID NO: 1649411 - DNA, 13 bp, Homo sapiens
agtagaacagata

SEQ ID NO: 1649412 - DNA, 15 bp, Homo sapiens
agtagaagcatgttt

SEQ ID NO: 1649413 - DNA, 19 bp, Homo sapiens
agtagaagtcttagatgta

SEQ ID NO: 1649414 - DNA, 18 bp, Homo sapiens
agtagaattaccattaat

SEQ ID NO: 1649415 - DNA, 23 bp, Homo sapiens
agtagacagcaataactcggtgt

SEQ ID NO: 1649416 - DNA, 14 bp, Homo sapiens
agtagacatttata

SEQ ID NO: 1649417 - DNA, 14 bp, Homo sapiens
agtagagaggcccg

SEQ ID NO: 1649418 - DNA, 19 bp, Homo sapiens
agtagagctagctgccact

SEQ ID NO: 1649419 - DNA, 18 bp, Homo sapiens
agtagaggtataattgtg

SEQ ID NO: 1649420 - DNA, 20 bp, Homo sapiens
agtagaggtataattgtgtg

SEQ ID NO: 1649421 - DNA, 22 bp, Homo sapiens
agtagaggtataattgtgtgat

SEQ ID NO: 1649422 - DNA, 18 bp, Homo sapiens
agtagatgaacctgcagc

SEQ ID NO: 1649423 - DNA, 20 bp, Homo sapiens
agtagatttacagaacaaag

SEQ ID NO: 1649424 - DNA, 15 bp, Homo sapiens
agtagcaatgtgcct

SEQ ID NO: 1649425 - DNA, 23 bp, Homo sapiens
agtagcacatggtttaaatatga

SEQ ID NO: 1649426 - DNA, 23 bp, Homo sapiens
agtagcatgagagaattgtatca

SEQ ID NO: 1649427 - DNA, 22 bp, Homo sapiens
agtagccagggtgtggccctgc

SEQ ID NO: 1649428 - DNA, 23 bp, Homo sapiens
agtagccagggtgtggccctgcc

SEQ ID NO: 1649429 - DNA, 17 bp, Homo sapiens
agtagccgagagcctgc

SEQ ID NO: 1649430 - DNA, 15 bp, Homo sapiens
agtagctgctaccta

SEQ ID NO: 1649431 - DNA, 17 bp, Homo sapiens
agtagctggattacagg

SEQ ID NO: 1649432 - DNA, 21 bp, Homo sapiens
agtagctgggactacaggcgc

SEQ ID NO: 1649433 - DNA, 13 bp, Homo sapiens
agtagctgggatg

SEQ ID NO: 1649434 - DNA, 21 bp, Homo sapiens
agtagctgggattacaggcgc

SEQ ID NO: 1649435 - DNA, 20 bp, Homo sapiens
agtagctgtcagatgtcaca

SEQ ID NO: 1649436 - DNA, 23 bp, Homo sapiens
agtaggagacacgacagcacaca

SEQ ID NO: 1649437 - DNA, 14 bp, Homo sapiens
agtaggccctggtt

SEQ ID NO: 1649438 - DNA, 14 bp, Homo sapiens
agtaggctgggcct

SEQ ID NO: 1649439 - DNA, 14 bp, Homo sapiens
agtaggctgtattt

SEQ ID NO: 1649440 - DNA, 18 bp, Homo sapiens
agtaggctgtattttctt

SEQ ID NO: 1649441 - DNA, 23 bp, Homo sapiens
agtagggatgcggatcctgctgg

SEQ ID NO: 1649442 - DNA, 17 bp, Homo sapiens
agtaggtccaagggcca

SEQ ID NO: 1649443 - DNA, 23 bp, Homo sapiens
agtaggtcccggccagctctgga

SEQ ID NO: 1649444 - DNA, 22 bp, Homo sapiens
agtaggtggcttgagctagaga

SEQ ID NO: 1649445 - DNA, 17 bp, Homo sapiens
agtagtcagaagcaggt

SEQ ID NO: 1649446 - DNA, 14 bp, Homo sapiens
agtagtcctgtgaa

SEQ ID NO: 1649447 - DNA, 19 bp, Homo sapiens
agtagttgattcagccctc

SEQ ID NO: 1649448 - DNA, 15 bp, Homo sapiens
agtagttttcaaaac

SEQ ID NO: 1649449 - DNA, 21 bp, Homo sapiens
agtagtttttacagctgtgtt

SEQ ID NO: 1649450 - DNA, 17 bp, Homo sapiens
agtataatcaataagct

SEQ ID NO: 1649451 - DNA, 18 bp, Homo sapiens
agtataatgtttattaaa

SEQ ID NO: 1649452 - DNA, 16 bp, Homo sapiens
agtataatttcaagga

SEQ ID NO: 1649453 - DNA, 18 bp, Homo sapiens
agtatacattgtcttgat

SEQ ID NO: 1649454 - DNA, 15 bp, Homo sapiens
agtatacctgatttt

SEQ ID NO: 1649455 - DNA, 17 bp, Homo sapiens
agtatacgtataaatat

SEQ ID NO: 1649456 - DNA, 14 bp, Homo sapiens
agtatactgtgtgg

SEQ ID NO: 1649457 - DNA, 17 bp, Homo sapiens
agtatagcctatggcag

SEQ ID NO: 1649458 - DNA, 19 bp, Homo sapiens
agtatataatggtttcaaa

SEQ ID NO: 1649459 - DNA, 15 bp, Homo sapiens
agtatatagtatatt

SEQ ID NO: 1649460 - DNA, 17 bp, Homo sapiens
agtatatagtatattta

SEQ ID NO: 1649461 - DNA, 21 bp, Homo sapiens
agtatatagtatatttatact

SEQ ID NO: 1649462 - DNA, 20 bp, Homo sapiens
agtatatcccaagtgcactt

SEQ ID NO: 1649463 - DNA, 13 bp, Homo sapiens
agtatatctggac

SEQ ID NO: 1649464 - DNA, 18 bp, Homo sapiens
agtatatctggacaagcc

SEQ ID NO: 1649465 - DNA, 20 bp, Homo sapiens
agtatattgttgaagagaca

SEQ ID NO: 1649466 - DNA, 13 bp, Homo sapiens
agtatatttatac

SEQ ID NO: 1649467 - DNA, 13 bp, Homo sapiens
agtatattttctt

SEQ ID NO: 1649468 - DNA, 15 bp, Homo sapiens
agtatccaatgtctt

SEQ ID NO: 1649469 - DNA, 14 bp, Homo sapiens
agtatccactttgc

SEQ ID NO: 1649470 - DNA, 23 bp, Homo sapiens
agtatccaggctttgtacagagt

SEQ ID NO: 1649471 - DNA, 16 bp, Homo sapiens
agtatccatgcatgtg

SEQ ID NO: 1649472 - DNA, 18 bp, Homo sapiens
agtatcccacatccaact

SEQ ID NO: 1649473 - DNA, 16 bp, Homo sapiens
agtatctaacatgtat

SEQ ID NO: 1649474 - DNA, 22 bp, Homo sapiens
agtatctatatatgtgtatgta

SEQ ID NO: 1649475 - DNA, 21 bp, Homo sapiens
agtatctcgtaatagcttctg

SEQ ID NO: 1649476 - DNA, 22 bp, Homo sapiens
agtatctcgtaatagcttctgt

SEQ ID NO: 1649477 - DNA, 21 bp, Homo sapiens
agtatctgtatataagttgct

SEQ ID NO: 1649478 - DNA, 15 bp, Homo sapiens
agtatcttctatttt

SEQ ID NO: 1649479 - DNA, 22 bp, Homo sapiens
agtatcttgaaatcctggaaaa

SEQ ID NO: 1649480 - DNA, 13 bp, Homo sapiens
agtatcttgtgct

SEQ ID NO: 1649481 - DNA, 17 bp, Homo sapiens
agtatcttttttcaaaa

SEQ ID NO: 1649482 - DNA, 20 bp, Homo sapiens
agtatgaatattactctcaa

SEQ ID NO: 1649483 - DNA, 13 bp, Homo sapiens
agtatgaatctat

SEQ ID NO: 1649484 - DNA, 18 bp, Homo sapiens
agtatgaatctatgccaa

SEQ ID NO: 1649485 - DNA, 17 bp, Homo sapiens
agtatgatggcaggaga

SEQ ID NO: 1649486 - DNA, 13 bp, Homo sapiens
agtatgccttaag

SEQ ID NO: 1649487 - DNA, 18 bp, Homo sapiens
agtatgccttaagcagaa

SEQ ID NO: 1649488 - DNA, 21 bp, Homo sapiens
agtatgccttaagcagaacaa

SEQ ID NO: 1649489 - DNA, 20 bp, Homo sapiens
agtatgcttggactgaaggg

SEQ ID NO: 1649490 - DNA, 18 bp, Homo sapiens
agtatgcttgggccctgc

SEQ ID NO: 1649491 - DNA, 20 bp, Homo sapiens
agtatgcttgggccctgcat

SEQ ID NO: 1649492 - DNA, 19 bp, Homo sapiens
agtatgctttccctgagga

SEQ ID NO: 1649493 - DNA, 18 bp, Homo sapiens
agtatggttcaagattgt

SEQ ID NO: 1649494 - DNA, 21 bp, Homo sapiens
agtatggttcaagattgttga

SEQ ID NO: 1649495 - DNA, 17 bp, Homo sapiens
agtatgtggaagtgtgg

SEQ ID NO: 1649496 - DNA, 14 bp, Homo sapiens
agtatgtgtaaaat

SEQ ID NO: 1649497 - DNA, 19 bp, Homo sapiens
agtattaaaagttgcattt

SEQ ID NO: 1649498 - DNA, 13 bp, Homo sapiens
agtattaaggttt

SEQ ID NO: 1649499 - DNA, 17 bp, Homo sapiens
agtattatcaaagggat

SEQ ID NO: 1649500 - DNA, 21 bp, Homo sapiens
agtattatgcctgagttataa

SEQ ID NO: 1649501 - DNA, 22 bp, Homo sapiens
agtattcctttatacacagtgg

SEQ ID NO: 1649502 - DNA, 16 bp, Homo sapiens
agtattctcattcttc

SEQ ID NO: 1649503 - DNA, 17 bp, Homo sapiens
agtattctgacatgtaa

SEQ ID NO: 1649504 - DNA, 15 bp, Homo sapiens
agtattgaaagccaa

SEQ ID NO: 1649505 - DNA, 21 bp, Homo sapiens
agtattgaaagccaacaactc

SEQ ID NO: 1649506 - DNA, 16 bp, Homo sapiens
agtgactcctgctggt

SEQ ID NO: 1649507 - DNA, 22 bp, Homo sapiens
agtgactcctgctggtacctgc

SEQ ID NO: 1649508 - DNA, 18 bp, Homo sapiens
agtgactgaaaccatttt

SEQ ID NO: 1649509 - DNA, 22 bp, Homo sapiens
agtgactgaaaccattttccca

SEQ ID NO: 1649510 - DNA, 13 bp, Homo sapiens
agtgactggcagg

SEQ ID NO: 1649511 - DNA, 14 bp, Homo sapiens
agtgactggcaggt

SEQ ID NO: 1649512 - DNA, 17 bp, Homo sapiens
agtgactgtatctgtgt

SEQ ID NO: 1649513 - DNA, 15 bp, Homo sapiens
agtgacttctgagat

SEQ ID NO: 1649514 - DNA, 17 bp, Homo sapiens
agtgacttctggagaaa

SEQ ID NO: 1649515 - DNA, 18 bp, Homo sapiens
agtgactttacaggaggt

SEQ ID NO: 1649516 - DNA, 19 bp, Homo sapiens
agtgactttttctgagctt

SEQ ID NO: 1649517 - DNA, 20 bp, Homo sapiens
agtgagaaaagttcaatact

SEQ ID NO: 1649518 - DNA, 17 bp, Homo sapiens
agtgagactccacctca

SEQ ID NO: 1649519 - DNA, 18 bp, Homo sapiens
agtgagactccacctcaa

SEQ ID NO: 1649520 - DNA, 12 bp, Homo sapiens
agtgagagccag

SEQ ID NO: 1649521 - DNA, 17 bp, Homo sapiens
agtgagagccagcagca

SEQ ID NO: 1649522 - DNA, 14 bp, Homo sapiens
agtgagagggcatg

SEQ ID NO: 1649523 - DNA, 22 bp, Homo sapiens
agtgagagggcatgcgcacaag

SEQ ID NO: 1649524 - DNA, 14 bp, Homo sapiens
agtgagcaaggggg

SEQ ID NO: 1649525 - DNA, 13 bp, Homo sapiens
agtgagcagaaca

SEQ ID NO: 1649526 - DNA, 22 bp, Homo sapiens
agtgagcagagatgtactgcaa

SEQ ID NO: 1649527 - DNA, 21 bp, Homo sapiens
agtgagcatggaacacttcga

SEQ ID NO: 1649528 - DNA, 19 bp, Homo sapiens
agtgagccacagaccacct

SEQ ID NO: 1649529 - DNA, 21 bp, Homo sapiens
agtgagccagaaattgattaa

SEQ ID NO: 1649530 - DNA, 20 bp, Homo sapiens
agtgagccgcatcttctcca

SEQ ID NO: 1649531 - DNA, 24 bp, Homo sapiens
agtgagccgcatcttctccatctg

SEQ ID NO: 1649532 - DNA, 19 bp, Homo sapiens
agtgagctctggtggagac

SEQ ID NO: 1649533 - DNA, 17 bp, Homo sapiens
agtgagctgtaggtgtg

SEQ ID NO: 1649534 - DNA, 16 bp, Homo sapiens
agtgagctttgctgct

SEQ ID NO: 1649535 - DNA, 19 bp, Homo sapiens
agtgagctttgctgctaca

SEQ ID NO: 1649536 - DNA, 16 bp, Homo sapiens
agtgaggaaccctgat

SEQ ID NO: 1649537 - DNA, 21 bp, Homo sapiens
agtgaggaaccctgatctctc

SEQ ID NO: 1649538 - DNA, 18 bp, Homo sapiens
agtgaggagggatgtggg

SEQ ID NO: 1649539 - DNA, 15 bp, Homo sapiens
agtgaggcaggagaa

SEQ ID NO: 1649540 - DNA, 15 bp, Homo sapiens
agtgaggcttccagg

SEQ ID NO: 1649541 - DNA, 16 bp, Homo sapiens
agtgaggcttccaggc

SEQ ID NO: 1649542 - DNA, 18 bp, Homo sapiens
agtgaggcttccaggctc

SEQ ID NO: 1649543 - DNA, 20 bp, Homo sapiens
agtgaggttagttctgtgtg

SEQ ID NO: 1649544 - DNA, 16 bp, Homo sapiens
agtgagtacctgcaaa

SEQ ID NO: 1649545 - DNA, 22 bp, Homo sapiens
agtgagtacctgcaaaaatgag

SEQ ID NO: 1649546 - DNA, 17 bp, Homo sapiens
agtgagtcacctgctcc

SEQ ID NO: 1649547 - DNA, 18 bp, Homo sapiens
agtgagtcacctgctcca

SEQ ID NO: 1649548 - DNA, 15 bp, Homo sapiens
agtgatacactgtat

SEQ ID NO: 1649549 - DNA, 18 bp, Homo sapiens
agtgatacactgtatcta

SEQ ID NO: 1649550 - DNA, 16 bp, Homo sapiens
agtgatcaataaaatg

SEQ ID NO: 1649551 - DNA, 20 bp, Homo sapiens
agtgatcaataaaatgtgat

SEQ ID NO: 1649552 - DNA, 12 bp, Homo sapiens
agtgatcactgg

SEQ ID NO: 1649553 - DNA, 18 bp, Homo sapiens
agtgatctatgtttgtgt

SEQ ID NO: 1649554 - DNA, 13 bp, Homo sapiens
agtgatcttgaga

SEQ ID NO: 1649555 - DNA, 23 bp, Homo sapiens
agtgatgaatgtactatgtctga

SEQ ID NO: 1649556 - DNA, 20 bp, Homo sapiens
agtgatgcctgcccgcaccc

SEQ ID NO: 1649557 - DNA, 20 bp, Homo sapiens
agtgatgggaaggtttttaa

SEQ ID NO: 1649558 - DNA, 13 bp, Homo sapiens
agtgatggtcaga

SEQ ID NO: 1649559 - DNA, 13 bp, Homo sapiens
agtgatgtgctga

SEQ ID NO: 1649560 - DNA, 15 bp, Homo sapiens
agtgatgttagcaga

SEQ ID NO: 1649561 - DNA, 14 bp, Homo sapiens
agtgattatgggag

SEQ ID NO: 1649562 - DNA, 12 bp, Homo sapiens
agtgattcagca

SEQ ID NO: 1649563 - DNA, 12 bp, Homo sapiens
agtgattctgat

SEQ ID NO: 1649564 - DNA, 17 bp, Homo sapiens
agtgattctgatttcag

SEQ ID NO: 1649565 - DNA, 19 bp, Homo sapiens
agtgattctgatttcagtt

SEQ ID NO: 1649566 - DNA, 18 bp, Homo sapiens
agtgcaacatctctgaat

SEQ ID NO: 1649567 - DNA, 14 bp, Homo sapiens
agtgcaagctgaag

SEQ ID NO: 1649568 - DNA, 20 bp, Homo sapiens
agtgcaataaatctgaccca

SEQ ID NO: 1649569 - DNA, 22 bp, Homo sapiens
agtgcaatggtataaatttcaa

SEQ ID NO: 1649570 - DNA, 12 bp, Homo sapiens
agtgcacagctg

SEQ ID NO: 1649571 - DNA, 12 bp, Homo sapiens
agtgcacctgcc

SEQ ID NO: 1649572 - DNA, 21 bp, Homo sapiens
agtgcacctgcctccaccagc

SEQ ID NO: 1649573 - DNA, 20 bp, Homo sapiens
agtgcactccggcctgggtg

SEQ ID NO: 1649574 - DNA, 21 bp, Homo sapiens
agtgcactgaaagtcacggct

SEQ ID NO: 1649575 - DNA, 18 bp, Homo sapiens
agtgcacttttttatgaa

SEQ ID NO: 1649576 - DNA, 15 bp, Homo sapiens
agtgcagcagaggac

SEQ ID NO: 1649577 - DNA, 21 bp, Homo sapiens
agtgcagcaggttaagaattt

SEQ ID NO: 1649578 - DNA, 12 bp, Homo sapiens
agtgcagccact

SEQ ID NO: 1649579 - DNA, 14 bp, Homo sapiens
agtgcagccactgg

SEQ ID NO: 1649580 - DNA, 18 bp, Homo sapiens
agtgcagccgtttgagaa

SEQ ID NO: 1649581 - DNA, 17 bp, Homo sapiens
agtgcagctgaaattga

SEQ ID NO: 1649582 - DNA, 23 bp, Homo sapiens
agtgcagtggcgcgatctcagct

SEQ ID NO: 1649583 - DNA, 19 bp, Homo sapiens
agtgcagtggtgccatcac

SEQ ID NO: 1649584 - DNA, 17 bp, Homo sapiens
agtgcagttgtgatttc

SEQ ID NO: 1649585 - DNA, 21 bp, Homo sapiens
agtgcatagttgtagacaaag

SEQ ID NO: 1649586 - DNA, 22 bp, Homo sapiens
agtgcatagttgtagacaaagt

SEQ ID NO: 1649587 - DNA, 15 bp, Homo sapiens
agtgcatctcagccc

SEQ ID NO: 1649588 - DNA, 17 bp, Homo sapiens
agtgcatctcagcccac

SEQ ID NO: 1649589 - DNA, 15 bp, Homo sapiens
agtgcatggggaggc

SEQ ID NO: 1649590 - DNA, 20 bp, Homo sapiens
agtgcatgtgaagcatgctt

SEQ ID NO: 1649591 - DNA, 12 bp, Homo sapiens
agtgcatttgac

SEQ ID NO: 1649592 - DNA, 15 bp, Homo sapiens
agtgcatttttaaac

SEQ ID NO: 1649593 - DNA, 23 bp, Homo sapiens
agtgcatttttaaacttgaaata

SEQ ID NO: 1649594 - DNA, 13 bp, Homo sapiens
agtgcatttttct

SEQ ID NO: 1649595 - DNA, 21 bp, Homo sapiens
agtgccaatttcttactagta

SEQ ID NO: 1649596 - DNA, 17 bp, Homo sapiens
agtgccactgttgtttt

SEQ ID NO: 1649597 - DNA, 14 bp, Homo sapiens
agtgccacttaatg

SEQ ID NO: 1649598 - DNA, 16 bp, Homo sapiens
agtgccacttaatgta

SEQ ID NO: 1649599 - DNA, 17 bp, Homo sapiens
agtgccacttgacattc

SEQ ID NO: 1649600 - DNA, 21 bp, Homo sapiens
agtgccacttgacattccttg

SEQ ID NO: 1649601 - DNA, 23 bp, Homo sapiens
agtgccacttgacattccttgtc

SEQ ID NO: 1649602 - DNA, 18 bp, Homo sapiens
agtgccagaggtgggcag

SEQ ID NO: 1649603 - DNA, 20 bp, Homo sapiens
agtgccagaggtgggcaggt

SEQ ID NO: 1649604 - DNA, 21 bp, Homo sapiens
agtgccagaggtgggcaggtg

SEQ ID NO: 1649605 - DNA, 18 bp, Homo sapiens
agtgccagcacctgccca

SEQ ID NO: 1649606 - DNA, 15 bp, Homo sapiens
agtgccagctccctc

SEQ ID NO: 1649607 - DNA, 16 bp, Homo sapiens
agtgccaggaaagagt

SEQ ID NO: 1649608 - DNA, 17 bp, Homo sapiens
agtgcccaaagtgggga

SEQ ID NO: 1649609 - DNA, 18 bp, Homo sapiens
agtgcccaaagtggggag

SEQ ID NO: 1649610 - DNA, 17 bp, Homo sapiens
agtgcccacatttgatg

SEQ ID NO: 1649611 - DNA, 16 bp, Homo sapiens
agtgcccaccaacatc

SEQ ID NO: 1649612 - DNA, 20 bp, Homo sapiens
agtgcccaccaacatcccat

SEQ ID NO: 1649613 - DNA, 14 bp, Homo sapiens
agtgcccagcccct

SEQ ID NO: 1649614 - DNA, 18 bp, Homo sapiens
agtgcccagcccctgccc

SEQ ID NO: 1649615 - DNA, 18 bp, Homo sapiens
agtgcccccactgaccag

SEQ ID NO: 1649616 - DNA, 21 bp, Homo sapiens
agtgccctccacagccgcagc

SEQ ID NO: 1649617 - DNA, 22 bp, Homo sapiens
agtgccgtagggagtacctgct

SEQ ID NO: 1649618 - DNA, 22 bp, Homo sapiens
agtgccgtgtgttgcatgcagc

SEQ ID NO: 1649619 - DNA, 19 bp, Homo sapiens
agtgcctaaaataagaata

SEQ ID NO: 1649620 - DNA, 14 bp, Homo sapiens
agtgtcactgagct

SEQ ID NO: 1649621 - DNA, 14 bp, Homo sapiens
agtgtcataaagat

SEQ ID NO: 1649622 - DNA, 14 bp, Homo sapiens
agtgtcatcactct

SEQ ID NO: 1649623 - DNA, 19 bp, Homo sapiens
agtgtcatgaagtgcacag

SEQ ID NO: 1649624 - DNA, 18 bp, Homo sapiens
agtgtccagcttccaaag

SEQ ID NO: 1649625 - DNA, 19 bp, Homo sapiens
agtgtccagcttccaaagc

SEQ ID NO: 1649626 - DNA, 13 bp, Homo sapiens
agtgtcccctgcc

SEQ ID NO: 1649627 - DNA, 17 bp, Homo sapiens
agtgtcccctgccccag

SEQ ID NO: 1649628 - DNA, 18 bp, Homo sapiens
agtgtcctaccactctaa

SEQ ID NO: 1649629 - DNA, 21 bp, Homo sapiens
agtgtcctcccctcaaggaca

SEQ ID NO: 1649630 - DNA, 22 bp, Homo sapiens
agtgtcctcttccctctctgca

SEQ ID NO: 1649631 - DNA, 12 bp, Homo sapiens
agtgtcctgccc

SEQ ID NO: 1649632 - DNA, 15 bp, Homo sapiens
agtgtcctgcccatg

SEQ ID NO: 1649633 - DNA, 21 bp, Homo sapiens
agtgtctgacttttgttaaat

SEQ ID NO: 1649634 - DNA, 22 bp, Homo sapiens
agtgtctgccagctgggcccag

SEQ ID NO: 1649635 - DNA, 19 bp, Homo sapiens
agtgtctggagcgcttcag

SEQ ID NO: 1649636 - DNA, 16 bp, Homo sapiens
agtgtctgtgttttga

SEQ ID NO: 1649637 - DNA, 22 bp, Homo sapiens
agtgtctgtgttttgaaagaat

SEQ ID NO: 1649638 - DNA, 13 bp, Homo sapiens
agtgtctgttcag

SEQ ID NO: 1649639 - DNA, 16 bp, Homo sapiens
agtgtcttttgacatt

SEQ ID NO: 1649640 - DNA, 19 bp, Homo sapiens
agtgtgacttcccttctaa

SEQ ID NO: 1649641 - DNA, 19 bp, Homo sapiens
agtgtgagctcttccctta

SEQ ID NO: 1649642 - DNA, 17 bp, Homo sapiens
agtgtgagtggcagcca

SEQ ID NO: 1649643 - DNA, 22 bp, Homo sapiens
agtgtgagtggcagccatgcct

SEQ ID NO: 1649644 - DNA, 16 bp, Homo sapiens
agtgtgcacgagtggg

SEQ ID NO: 1649645 - DNA, 19 bp, Homo sapiens
agtgtgcacgagtgggaag

SEQ ID NO: 1649646 - DNA, 22 bp, Homo sapiens
agtgtgcacgcctgcaggctgg

SEQ ID NO: 1649647 - DNA, 14 bp, Homo sapiens
agtgtgcagacagc

SEQ ID NO: 1649648 - DNA, 17 bp, Homo sapiens
agtgtgcagacagccat

SEQ ID NO: 1649649 - DNA, 13 bp, Homo sapiens
agtgtgcccatct

SEQ ID NO: 1649650 - DNA, 13 bp, Homo sapiens
agtgtgctgctat

SEQ ID NO: 1649651 - DNA, 14 bp, Homo sapiens
agtgtggactctgg

SEQ ID NO: 1649652 - DNA, 17 bp, Homo sapiens
agtgtggacttggcagg

SEQ ID NO: 1649653 - DNA, 19 bp, Homo sapiens
agtgtggaggggagatata

SEQ ID NO: 1649654 - DNA, 12 bp, Homo sapiens
agtgtggagtgg

SEQ ID NO: 1649655 - DNA, 17 bp, Homo sapiens
agtgtggagtgggtaat

SEQ ID NO: 1649656 - DNA, 18 bp, Homo sapiens
agtgtgggcgctctccct

SEQ ID NO: 1649657 - DNA, 19 bp, Homo sapiens
agtgtgggcgctctcccta

SEQ ID NO: 1649658 - DNA, 15 bp, Homo sapiens
agtgtgggctgccct

SEQ ID NO: 1649659 - DNA, 16 bp, Homo sapiens
agtgtgggctgccctt

SEQ ID NO: 1649660 - DNA, 18 bp, Homo sapiens
agtgtgggcttgaccagg

SEQ ID NO: 1649661 - DNA, 15 bp, Homo sapiens
agtgtgggtctgtgt

SEQ ID NO: 1649662 - DNA, 19 bp, Homo sapiens
agtgtgggtctgtgtgtgt

SEQ ID NO: 1649663 - DNA, 23 bp, Homo sapiens
agtgtgggtctgtgtgtgtgtat

SEQ ID NO: 1649664 - DNA, 21 bp, Homo sapiens
agtgtggtagggacttaaaaa

SEQ ID NO: 1649665 - DNA, 15 bp, Homo sapiens
agtgtggtctgtaat

SEQ ID NO: 1649666 - DNA, 16 bp, Homo sapiens
agtgtggtggttattt

SEQ ID NO: 1649667 - DNA, 14 bp, Homo sapiens
agtgtggtttcttt

SEQ ID NO: 1649668 - DNA, 22 bp, Homo sapiens
agtgtggtttctttttgaatct

SEQ ID NO: 1649669 - DNA, 18 bp, Homo sapiens
agtgtgtatatattttgt

SEQ ID NO: 1649670 - DNA, 11 bp, Homo sapiens
agtgtgtctgc

SEQ ID NO: 1649671 - DNA, 12 bp, Homo sapiens
agtgtgtctgct

SEQ ID NO: 1649672 - DNA, 13 bp, Homo sapiens
agtgtgtctgctg

SEQ ID NO: 1649673 - DNA, 14 bp, Homo sapiens
agtgtgtctgctga

SEQ ID NO: 1649674 - DNA, 16 bp, Homo sapiens
agtgtgtctgctgagt

SEQ ID NO: 1649675 - DNA, 19 bp, Homo sapiens
agtgtgtgcataatagcta

SEQ ID NO: 1649676 - DNA, 12 bp, Homo sapiens
agtgtgtgtctt

SEQ ID NO: 1649677 - DNA, 20 bp, Homo sapiens
agtgtgtgtgcagagtccat

SEQ ID NO: 1649678 - DNA, 13 bp, Homo sapiens
agtgtgtgtgcat

SEQ ID NO: 1649679 - DNA, 21 bp, Homo sapiens
agtgttaaaaaatttttgaaa

SEQ ID NO: 1649680 - DNA, 13 bp, Homo sapiens
agtgttagagaaa

SEQ ID NO: 1649681 - DNA, 17 bp, Homo sapiens
agtgttagtgctggtca

SEQ ID NO: 1649682 - DNA, 16 bp, Homo sapiens
agtgttatcagtcata

SEQ ID NO: 1649683 - DNA, 15 bp, Homo sapiens
agtgttcacaaactg

SEQ ID NO: 1649684 - DNA, 18 bp, Homo sapiens
agtgttccctgagaaacc

SEQ ID NO: 1649685 - DNA, 22 bp, Homo sapiens
agtgttcctttttaaatgtgaa

SEQ ID NO: 1649686 - DNA, 23 bp, Homo sapiens
agtgttcctttttaaatgtgaat

SEQ ID NO: 1649687 - DNA, 15 bp, Homo sapiens
agtgttctgcatgga

SEQ ID NO: 1649688 - DNA, 15 bp, Homo sapiens
agtgttctgctcctg

SEQ ID NO: 1649689 - DNA, 17 bp, Homo sapiens
agtgttctgctcctgct

SEQ ID NO: 1649690 - DNA, 19 bp, Homo sapiens
agtgttctgtttgaaacta

SEQ ID NO: 1649691 - DNA, 14 bp, Homo sapiens
agtgttcttaggtt

SEQ ID NO: 1649692 - DNA, 15 bp, Homo sapiens
agtgttcttaggttt

SEQ ID NO: 1649693 - DNA, 12 bp, Homo sapiens
agtgttgaaggg

SEQ ID NO: 1649694 - DNA, 17 bp, Homo sapiens
agtgttgagccttttcc

SEQ ID NO: 1649695 - DNA, 18 bp, Homo sapiens
agtgttgcatatgagcct

SEQ ID NO: 1649696 - DNA, 14 bp, Homo sapiens
agtgttgctgtggc

SEQ ID NO: 1649697 - DNA, 17 bp, Homo sapiens
agtgttggctgtgtgac

SEQ ID NO: 1649698 - DNA, 16 bp, Homo sapiens
agtgttggggttgaca

SEQ ID NO: 1649699 - DNA, 21 bp, Homo sapiens
agtgttggtatattttatatt

SEQ ID NO: 1649700 - DNA, 17 bp, Homo sapiens
agtgttgtgttaaaagg

SEQ ID NO: 1649701 - DNA, 21 bp, Homo sapiens
agtgttgtttgtaaataagag

SEQ ID NO: 1649702 - DNA, 15 bp, Homo sapiens
agtgtttaaaacttc

SEQ ID NO: 1649703 - DNA, 15 bp, Homo sapiens
agtgtttcccataat

SEQ ID NO: 1649704 - DNA, 18 bp, Homo sapiens
agtgtttctcaaaagagg

SEQ ID NO: 1649705 - DNA, 11 bp, Homo sapiens
agtgtttcttt

SEQ ID NO: 1649706 - DNA, 20 bp, Homo sapiens
agtgttttaagataaattat

SEQ ID NO: 1649707 - DNA, 15 bp, Homo sapiens
agtgttttctgggat

SEQ ID NO: 1649708 - DNA, 19 bp, Homo sapiens
agtgttttggactccatct

SEQ ID NO: 1649709 - DNA, 22 bp, Homo sapiens
agttaaaagtgttgattacata

SEQ ID NO: 1649710 - DNA, 22 bp, Homo sapiens
agttaaactaaaaaaaaaaagg

SEQ ID NO: 1649711 - DNA, 15 bp, Homo sapiens
agttaaactgtgaag

SEQ ID NO: 1649712 - DNA, 18 bp, Homo sapiens
agttaaagaaaggaaaag

SEQ ID NO: 1649713 - DNA, 23 bp, Homo sapiens
agttaaagggaagaaaacactgt

SEQ ID NO: 1649714 - DNA, 16 bp, Homo sapiens
agttaaagtgaataac

SEQ ID NO: 1649715 - DNA, 13 bp, Homo sapiens
agttaaatatgta

SEQ ID NO: 1649716 - DNA, 12 bp, Homo sapiens
agttaaatctca

SEQ ID NO: 1649717 - DNA, 14 bp, Homo sapiens
agttaaatctcaaa

SEQ ID NO: 1649718 - DNA, 16 bp, Homo sapiens
agttaacaaggaatgc

SEQ ID NO: 1649719 - DNA, 23 bp, Homo sapiens
agttaacaaggaatgcctgtgcc

SEQ ID NO: 1649720 - DNA, 16 bp, Homo sapiens
agttaacaatgatata

SEQ ID NO: 1649721 - DNA, 15 bp, Homo sapiens
agttaacaggatatt

SEQ ID NO: 1649722 - DNA, 19 bp, Homo sapiens
agttaacaggatattagac

SEQ ID NO: 1649723 - DNA, 22 bp, Homo sapiens
agttaaggagaatcatgtttct

SEQ ID NO: 1649724 - DNA, 16 bp, Homo sapiens
agttaaggtgtgcaaa

SEQ ID NO: 1649725 - DNA, 18 bp, Homo sapiens
agttaatactccagagac

SEQ ID NO: 1649726 - DNA, 19 bp, Homo sapiens
agttaatactccagagaca

SEQ ID NO: 1649727 - DNA, 21 bp, Homo sapiens
agttaataggagtatttttgg

SEQ ID NO: 1649728 - DNA, 15 bp, Homo sapiens
agttaatattgtgaa

SEQ ID NO: 1649729 - DNA, 16 bp, Homo sapiens
agttaatgagccatca

SEQ ID NO: 1649730 - DNA, 15 bp, Homo sapiens
agttaatttttccaa

SEQ ID NO: 1649731 - DNA, 17 bp, Homo sapiens
agttaatttttccaact

SEQ ID NO: 1649732 - DNA, 14 bp, Homo sapiens
agttacaataaagt

SEQ ID NO: 1649733 - DNA, 20 bp, Homo sapiens
agttacaataaagtttacaa

SEQ ID NO: 1649734 - DNA, 18 bp, Homo sapiens
agttacatgctgtatatg

SEQ ID NO: 1649735 - DNA, 19 bp, Homo sapiens
agtttgcatacttcctgga

SEQ ID NO: 1649736 - DNA, 16 bp, Homo sapiens
agtttgcatttcagaa

SEQ ID NO: 1649737 - DNA, 17 bp, Homo sapiens
agtttgcatttcagaaa

SEQ ID NO: 1649738 - DNA, 18 bp, Homo sapiens
agtttgcttgatatattt

SEQ ID NO: 1649739 - DNA, 23 bp, Homo sapiens
agtttgctttttgcgtacacaga

SEQ ID NO: 1649740 - DNA, 18 bp, Homo sapiens
agtttggctataagtgct

SEQ ID NO: 1649741 - DNA, 18 bp, Homo sapiens
agtttgggtaaaatactt

SEQ ID NO: 1649742 - DNA, 12 bp, Homo sapiens
agtttgtaaagt

SEQ ID NO: 1649743 - DNA, 19 bp, Homo sapiens
agtttgtattttgcatact

SEQ ID NO: 1649744 - DNA, 21 bp, Homo sapiens
agtttgtcgctcatgtgtgca

SEQ ID NO: 1649745 - DNA, 22 bp, Homo sapiens
agtttgtgtgtatttgtattaa

SEQ ID NO: 1649746 - DNA, 23 bp, Homo sapiens
agtttgtgttgttgttgctgctg

SEQ ID NO: 1649747 - DNA, 13 bp, Homo sapiens
agttttaactgtg

SEQ ID NO: 1649748 - DNA, 18 bp, Homo sapiens
agttttaactgtggatat

SEQ ID NO: 1649749 - DNA, 19 bp, Homo sapiens
agttttaactttaatacag

SEQ ID NO: 1649750 - DNA, 13 bp, Homo sapiens
agttttaataaga

SEQ ID NO: 1649751 - DNA, 14 bp, Homo sapiens
agttttaataagaa

SEQ ID NO: 1649752 - DNA, 21 bp, Homo sapiens
agttttaataagaacagatca

SEQ ID NO: 1649753 - DNA, 19 bp, Homo sapiens
agttttacttttaaactgt

SEQ ID NO: 1649754 - DNA, 15 bp, Homo sapiens
agttttagttgcaga

SEQ ID NO: 1649755 - DNA, 14 bp, Homo sapiens
agttttagttttct

SEQ ID NO: 1649756 - DNA, 14 bp, Homo sapiens
agttttatatgctt

SEQ ID NO: 1649757 - DNA, 15 bp, Homo sapiens
agttttatatgcttt

SEQ ID NO: 1649758 - DNA, 12 bp, Homo sapiens
agttttatcatt

SEQ ID NO: 1649759 - DNA, 13 bp, Homo sapiens
agttttatcattt

SEQ ID NO: 1649760 - DNA, 20 bp, Homo sapiens
agttttatcattttcaaaat

SEQ ID NO: 1649761 - DNA, 21 bp, Homo sapiens
agttttattgagaattttaaa

SEQ ID NO: 1649762 - DNA, 13 bp, Homo sapiens
agttttatttgta

SEQ ID NO: 1649763 - DNA, 15 bp, Homo sapiens
agttttatttgtatt

SEQ ID NO: 1649764 - DNA, 16 bp, Homo sapiens
agttttatttgtatta

SEQ ID NO: 1649765 - DNA, 13 bp, Homo sapiens
agttttcccctgg

SEQ ID NO: 1649766 - DNA, 16 bp, Homo sapiens
agttttcccctggcct

SEQ ID NO: 1649767 - DNA, 14 bp, Homo sapiens
agttttccctgcac

SEQ ID NO: 1649768 - DNA, 21 bp, Homo sapiens
agttttccctgcactgtgtca

SEQ ID NO: 1649769 - DNA, 10 bp, Homo sapiens
agttttccta

SEQ ID NO: 1649770 - DNA, 19 bp, Homo sapiens
agttttctagcaattttct

SEQ ID NO: 1649771 - DNA, 22 bp, Homo sapiens
agttttctccttgatatcattc

SEQ ID NO: 1649772 - DNA, 13 bp, Homo sapiens
agttttctgagaa

SEQ ID NO: 1649773 - DNA, 17 bp, Homo sapiens
agttttctgagaaagac

SEQ ID NO: 1649774 - DNA, 15 bp, Homo sapiens
agttttgaaagaaaa

SEQ ID NO: 1649775 - DNA, 17 bp, Homo sapiens
agttttgacacttccca

SEQ ID NO: 1649776 - DNA, 14 bp, Homo sapiens
agttttgatgaaat

SEQ ID NO: 1649777 - DNA, 15 bp, Homo sapiens
agttttgatgaaatt

SEQ ID NO: 1649778 - DNA, 21 bp, Homo sapiens
agttttgatgaaattcttgaa

SEQ ID NO: 1649779 - DNA, 14 bp, Homo sapiens
agttttgctgtctc

SEQ ID NO: 1649780 - DNA, 15 bp, Homo sapiens
agttttgctgtctct

SEQ ID NO: 1649781 - DNA, 15 bp, Homo sapiens
agttttggaggctga

SEQ ID NO: 1649782 - DNA, 14 bp, Homo sapiens
agttttgtcattca

SEQ ID NO: 1649783 - DNA, 12 bp, Homo sapiens
agttttgtctgt

SEQ ID NO: 1649784 - DNA, 17 bp, Homo sapiens
agttttgtctgtctccc

SEQ ID NO: 1649785 - DNA, 12 bp, Homo sapiens
agttttgtgttt

SEQ ID NO: 1649786 - DNA, 19 bp, Homo sapiens
agttttgtgtttgttgtag

SEQ ID NO: 1649787 - DNA, 21 bp, Homo sapiens
agttttgtgtttgttgtagat

SEQ ID NO: 1649788 - DNA, 22 bp, Homo sapiens
agttttgtgtttgttgtagatt

SEQ ID NO: 1649789 - DNA, 13 bp, Homo sapiens
agttttgttgtac

SEQ ID NO: 1649790 - DNA, 21 bp, Homo sapiens
agtttttaacaatctaacaat

SEQ ID NO: 1649791 - DNA, 17 bp, Homo sapiens
agtttttacaagatgta

SEQ ID NO: 1649792 - DNA, 17 bp, Homo sapiens
agtttttacctaccaca

SEQ ID NO: 1649793 - DNA, 22 bp, Homo sapiens
agtttttacctaccacagtgtc

SEQ ID NO: 1649794 - DNA, 20 bp, Homo sapiens
agtttttatcagccttgctt

SEQ ID NO: 1649795 - DNA, 18 bp, Homo sapiens
agtttttattccttgtga

SEQ ID NO: 1649796 - DNA, 22 bp, Homo sapiens
agtttttcagagtggaatgctt

SEQ ID NO: 1649797 - DNA, 23 bp, Homo sapiens
agtttttcaggagcgcaagatag

SEQ ID NO: 1649798 - DNA, 23 bp, Homo sapiens
agtttttccaaaacctcagttaa

SEQ ID NO: 1649799 - DNA, 22 bp, Homo sapiens
agtttttctgttttgtttggca

SEQ ID NO: 1649800 - DNA, 14 bp, Homo sapiens
agtttttgaaaatt

SEQ ID NO: 1649801 - DNA, 22 bp, Homo sapiens
agtttttgaaaattatgcaaaa

SEQ ID NO: 1649802 - DNA, 19 bp, Homo sapiens
agtttttgtttttgcatga

SEQ ID NO: 1649803 - DNA, 22 bp, Homo sapiens
agtttttgtttttgcatgaaat

SEQ ID NO: 1649804 - DNA, 20 bp, Homo sapiens
agttttttatgcctttatat

SEQ ID NO: 1649805 - DNA, 16 bp, Homo sapiens
agtttttttctttgtg

SEQ ID NO: 1649806 - DNA, 16 bp, Homo sapiens
agttttttttctgggt

SEQ ID NO: 1649807 - DNA, 21 bp, Homo sapiens
ataaaaaaaaaaggatgaaag

SEQ ID NO: 1649808 - DNA, 19 bp, Homo sapiens
ataaaaaaaagaaatgaaa

SEQ ID NO: 1649809 - DNA, 17 bp, Homo sapiens
ataaaaaagatcccaaa

SEQ ID NO: 1649810 - DNA, 13 bp, Homo sapiens
ataaaaaatggtt

SEQ ID NO: 1649811 - DNA, 13 bp, Homo sapiens
ataaaaaatgtaa

SEQ ID NO: 1649812 - DNA, 16 bp, Homo sapiens
ataaaaaatgtaacat

SEQ ID NO: 1649813 - DNA, 13 bp, Homo sapiens
ataaaaaatttta

SEQ ID NO: 1649814 - DNA, 16 bp, Homo sapiens
ataaaaactaatttca

SEQ ID NO: 1649815 - DNA, 14 bp, Homo sapiens
ataaaaactgattt

SEQ ID NO: 1649816 - DNA, 22 bp, Homo sapiens
ataaaaagaaaaaaatggaaaa

SEQ ID NO: 1649817 - DNA, 20 bp, Homo sapiens
ataaaaagacattcttccaa

SEQ ID NO: 1649818 - DNA, 12 bp, Homo sapiens
ataaaaagagaa

SEQ ID NO: 1649819 - DNA, 15 bp, Homo sapiens
ataaaaattatcaaa

SEQ ID NO: 1649820 - DNA, 22 bp, Homo sapiens
ataaaacaaaaccaagccttgg

SEQ ID NO: 1649821 - DNA, 21 bp, Homo sapiens
ataaaacagtcatggcctgag

SEQ ID NO: 1649822 - DNA, 11 bp, Homo sapiens
ataaaactctg

SEQ ID NO: 1649823 - DNA, 18 bp, Homo sapiens
ataaaacttaaaaacaag

SEQ ID NO: 1649824 - DNA, 14 bp, Homo sapiens
ataaaacttatgct

SEQ ID NO: 1649825 - DNA, 19 bp, Homo sapiens
ataaaacttatgctagttt

SEQ ID NO: 1649826 - DNA, 17 bp, Homo sapiens
ataaaactttgctgcca

SEQ ID NO: 1649827 - DNA, 17 bp, Homo sapiens
ataaaagcaaaagagaa

SEQ ID NO: 1649828 - DNA, 18 bp, Homo sapiens
ataaaagcaaaagagaaa

SEQ ID NO: 1649829 - DNA, 23 bp, Homo sapiens
ataaaagcaaaagagaaatacat

SEQ ID NO: 1649830 - DNA, 20 bp, Homo sapiens
ataaaagcacaagtactttt

SEQ ID NO: 1649831 - DNA, 20 bp, Homo sapiens
ataaaagcagcatctgctaa

SEQ ID NO: 1649832 - DNA, 15 bp, Homo sapiens
ataaaagcataaatg

SEQ ID NO: 1649833 - DNA, 18 bp, Homo sapiens
ataaaagcataaatgcaa

SEQ ID NO: 1649834 - DNA, 20 bp, Homo sapiens
ataaaagcataaatgcaaac

SEQ ID NO: 1649835 - DNA, 19 bp, Homo sapiens
ataaaagctgaagttactt

SEQ ID NO: 1649836 - DNA, 20 bp, Homo sapiens
ataaaaggcaaatgtgtaca

SEQ ID NO: 1649837 - DNA, 16 bp, Homo sapiens
ataaaaggttgccaaa

SEQ ID NO: 1649838 - DNA, 18 bp, Homo sapiens
ataaaaggttgccaaatt

SEQ ID NO: 1649839 - DNA, 15 bp, Homo sapiens
ataaaagtgaagtga

SEQ ID NO: 1649840 - DNA, 13 bp, Homo sapiens
ataaaagtgactc

SEQ ID NO: 1649841 - DNA, 16 bp, Homo sapiens
ataaaagtgcacacct

SEQ ID NO: 1649842 - DNA, 13 bp, Homo sapiens
ataaaataaagta

SEQ ID NO: 1649843 - DNA, 16 bp, Homo sapiens
ataaaataaagtatat

SEQ ID NO: 1649844 - DNA, 22 bp, Homo sapiens
ataaaatactctagcctgggcc

SEQ ID NO: 1649845 - DNA, 15 bp, Homo sapiens
ataaaatagaataat

SEQ ID NO: 1649846 - DNA, 19 bp, Homo sapiens
ataaaatagaataattctt

SEQ ID NO: 1649847 - DNA, 21 bp, Homo sapiens
ataaaatagaataattctttt

SEQ ID NO: 1649848 - DNA, 14 bp, Homo sapiens
ataaaatatcataa

SEQ ID NO: 1649849 - DNA, 14 bp, Homo sapiens
ataaaatattcact

SEQ ID NO: 1649850 - DNA, 17 bp, Homo sapiens
ataagcaatcaaggtta

SEQ ID NO: 1649851 - DNA, 13 bp, Homo sapiens
ataagcaggtgga

SEQ ID NO: 1649852 - DNA, 15 bp, Homo sapiens
ataagcattacttta

SEQ ID NO: 1649853 - DNA, 16 bp, Homo sapiens
ataagctaaagaggct

SEQ ID NO: 1649854 - DNA, 17 bp, Homo sapiens
ataagctaaagaggctg

SEQ ID NO: 1649855 - DNA, 23 bp, Homo sapiens
ataagctagatacgaaatcagtt

SEQ ID NO: 1649856 - DNA, 16 bp, Homo sapiens
ataagctcagaatcca

SEQ ID NO: 1649857 - DNA, 18 bp, Homo sapiens
ataaggaaagcaataaat

SEQ ID NO: 1649858 - DNA, 17 bp, Homo sapiens
ataaggacagcagctgg

SEQ ID NO: 1649859 - DNA, 19 bp, Homo sapiens
ataaggaggaggagggaga

SEQ ID NO: 1649860 - DNA, 20 bp, Homo sapiens
ataaggatcaattgtaatat

SEQ ID NO: 1649861 - DNA, 14 bp, Homo sapiens
ataaggatcagaac

SEQ ID NO: 1649862 - DNA, 14 bp, Homo sapiens
ataaggatgacttt

SEQ ID NO: 1649863 - DNA, 15 bp, Homo sapiens
ataaggatgactttt

SEQ ID NO: 1649864 - DNA, 17 bp, Homo sapiens
ataaggccttaatatgt

SEQ ID NO: 1649865 - DNA, 13 bp, Homo sapiens
ataagggaaaaga

SEQ ID NO: 1649866 - DNA, 16 bp, Homo sapiens
ataagggaaaagataa

SEQ ID NO: 1649867 - DNA, 12 bp, Homo sapiens
ataagggagagc

SEQ ID NO: 1649868 - DNA, 20 bp, Homo sapiens
ataagggagagctgagccag

SEQ ID NO: 1649869 - DNA, 17 bp, Homo sapiens
ataaggtcaagggaaaa

SEQ ID NO: 1649870 - DNA, 20 bp, Homo sapiens
ataaggtgctctctttctgt

SEQ ID NO: 1649871 - DNA, 16 bp, Homo sapiens
ataagtactgtgtaca

SEQ ID NO: 1649872 - DNA, 18 bp, Homo sapiens
ataagtactgtgtacaga

SEQ ID NO: 1649873 - DNA, 19 bp, Homo sapiens
ataagtactgtgtacagaa

SEQ ID NO: 1649874 - DNA, 13 bp, Homo sapiens
ataagtagttggt

SEQ ID NO: 1649875 - DNA, 18 bp, Homo sapiens
ataagtagttggtttgta

SEQ ID NO: 1649876 - DNA, 22 bp, Homo sapiens
ataagtagttggtttgtatgag

SEQ ID NO: 1649877 - DNA, 15 bp, Homo sapiens
ataagtcaacagtaa

SEQ ID NO: 1649878 - DNA, 14 bp, Homo sapiens
ataagtcaagcaca

SEQ ID NO: 1649879 - DNA, 22 bp, Homo sapiens
ataagtcaagcacatgtaataa

SEQ ID NO: 1649880 - DNA, 20 bp, Homo sapiens
ataagtgacaccaataaatg

SEQ ID NO: 1649881 - DNA, 19 bp, Homo sapiens
ataagtgactttaaacttt

SEQ ID NO: 1649882 - DNA, 19 bp, Homo sapiens
ataagtggccttgacacat

SEQ ID NO: 1649883 - DNA, 21 bp, Homo sapiens
ataagtggccttgacacatta

SEQ ID NO: 1649884 - DNA, 12 bp, Homo sapiens
ataagtgttctt

SEQ ID NO: 1649885 - DNA, 19 bp, Homo sapiens
ataagtgttcttcagtgta

SEQ ID NO: 1649886 - DNA, 12 bp, Homo sapiens
ataagttatttt

SEQ ID NO: 1649887 - DNA, 18 bp, Homo sapiens
ataagttcatacaatcgt

SEQ ID NO: 1649888 - DNA, 21 bp, Homo sapiens
ataagttcatacattgtacga

SEQ ID NO: 1649889 - DNA, 16 bp, Homo sapiens
ataagttcctttcctt

SEQ ID NO: 1649890 - DNA, 14 bp, Homo sapiens
ataagttggagcag

SEQ ID NO: 1649891 - DNA, 18 bp, Homo sapiens
ataagtttgcaatttggg

SEQ ID NO: 1649892 - DNA, 17 bp, Homo sapiens
ataagttttttttctgg

SEQ ID NO: 1649893 - DNA, 19 bp, Homo sapiens
ataataaacttttttgaaa

SEQ ID NO: 1649894 - DNA, 21 bp, Homo sapiens
ataataaagaactccttattt

SEQ ID NO: 1649895 - DNA, 15 bp, Homo sapiens
ataataaagatgtga

SEQ ID NO: 1649896 - DNA, 17 bp, Homo sapiens
ataataaagatgtgaaa

SEQ ID NO: 1649897 - DNA, 19 bp, Homo sapiens
ataataaatactcagtgat

SEQ ID NO: 1649898 - DNA, 15 bp, Homo sapiens
ataataagctaaaga

SEQ ID NO: 1649899 - DNA, 22 bp, Homo sapiens
ataatacacaaaatcaaataat

SEQ ID NO: 1649900 - DNA, 18 bp, Homo sapiens
ataatacagaatcttgtt

SEQ ID NO: 1649901 - DNA, 19 bp, Homo sapiens
ataatacataacattcaat

SEQ ID NO: 1649902 - DNA, 21 bp, Homo sapiens
ataatagcaacttttgtgtaa

SEQ ID NO: 1649903 - DNA, 22 bp, Homo sapiens
ataataggaacaatctttgctg

SEQ ID NO: 1649904 - DNA, 16 bp, Homo sapiens
ataataggtatataga

SEQ ID NO: 1649905 - DNA, 20 bp, Homo sapiens
ataataggtatatagaacac

SEQ ID NO: 1649906 - DNA, 22 bp, Homo sapiens
ataataggtatatagaacacaa

SEQ ID NO: 1649907 - DNA, 21 bp, Homo sapiens
ataatatatatctacaatata

SEQ ID NO: 1649908 - DNA, 15 bp, Homo sapiens
ataatatctgtgagg

SEQ ID NO: 1649909 - DNA, 12 bp, Homo sapiens
ataatatgagaa

SEQ ID NO: 1649910 - DNA, 15 bp, Homo sapiens
ataatatgagaatca

SEQ ID NO: 1649911 - DNA, 15 bp, Homo sapiens
ataatattagtgatt

SEQ ID NO: 1649912 - DNA, 21 bp, Homo sapiens
ataatattcagccagcttaaa

SEQ ID NO: 1649913 - DNA, 19 bp, Homo sapiens
ataatattgaaaattgaaa

SEQ ID NO: 1649914 - DNA, 20 bp, Homo sapiens
ataatattgtctgtctctat

SEQ ID NO: 1649915 - DNA, 22 bp, Homo sapiens
ataatattgtttggtaaatgtt

SEQ ID NO: 1649916 - DNA, 14 bp, Homo sapiens
ataatatttcaagt

SEQ ID NO: 1649917 - DNA, 18 bp, Homo sapiens
ataatatttcaagtgcct

SEQ ID NO: 1649918 - DNA, 19 bp, Homo sapiens
ataatatttcaagtgccta

SEQ ID NO: 1649919 - DNA, 19 bp, Homo sapiens
ataatatttcagtggaata

SEQ ID NO: 1649920 - DNA, 12 bp, Homo sapiens
ataatcaagatt

SEQ ID NO: 1649921 - DNA, 16 bp, Homo sapiens
ataatcacgctttcct

SEQ ID NO: 1649922 - DNA, 18 bp, Homo sapiens
ataatcacgctttcctga

SEQ ID NO: 1649923 - DNA, 13 bp, Homo sapiens
ataatcaggaaaa

SEQ ID NO: 1649924 - DNA, 14 bp, Homo sapiens
ataatcaggaaaaa

SEQ ID NO: 1649925 - DNA, 13 bp, Homo sapiens
ataatcagtaaat

SEQ ID NO: 1649926 - DNA, 15 bp, Homo sapiens
ataatcagtaaatag

SEQ ID NO: 1649927 - DNA, 20 bp, Homo sapiens
ataatcagtgtgtctaaatt

SEQ ID NO: 1649928 - DNA, 19 bp, Homo sapiens
ataatcatgtgaaatgttt

SEQ ID NO: 1649929 - DNA, 23 bp, Homo sapiens
ataatcattagttttagaggcat

SEQ ID NO: 1649930 - DNA, 17 bp, Homo sapiens
ataatcccagcactttg

SEQ ID NO: 1649931 - DNA, 15 bp, Homo sapiens
ataatctagaacaca

SEQ ID NO: 1649932 - DNA, 14 bp, Homo sapiens
ataatctatttcta

SEQ ID NO: 1649933 - DNA, 21 bp, Homo sapiens
ataatctatttctatgagaaa

SEQ ID NO: 1649934 - DNA, 22 bp, Homo sapiens
ataatctcaaaggagaaaaaaa

SEQ ID NO: 1649935 - DNA, 17 bp, Homo sapiens
ataatctccatttcaaa

SEQ ID NO: 1649936 - DNA, 19 bp, Homo sapiens
ataatctggtgacaaatat

SEQ ID NO: 1649937 - DNA, 21 bp, Homo sapiens
ataatgaaaataaaacacacc

SEQ ID NO: 1649938 - DNA, 22 bp, Homo sapiens
ataatgaaaataaaacacacct

SEQ ID NO: 1649939 - DNA, 12 bp, Homo sapiens
ataatgaatgac

SEQ ID NO: 1649940 - DNA, 13 bp, Homo sapiens
ataatgagagcaa

SEQ ID NO: 1649941 - DNA, 17 bp, Homo sapiens
ataatgcagaagtattc

SEQ ID NO: 1649942 - DNA, 21 bp, Homo sapiens
ataatgctaatttaaagagac

SEQ ID NO: 1649943 - DNA, 15 bp, Homo sapiens
ataatgcttcagata

SEQ ID NO: 1649944 - DNA, 16 bp, Homo sapiens
ataatggaaaaatagt

SEQ ID NO: 1649945 - DNA, 17 bp, Homo sapiens
ataatggaaaaatagta

SEQ ID NO: 1649946 - DNA, 16 bp, Homo sapiens
ataatggaaaatgcca

SEQ ID NO: 1649947 - DNA, 17 bp, Homo sapiens
ataatggaaacatttac

SEQ ID NO: 1649948 - DNA, 22 bp, Homo sapiens
ataatggtcccatccaggcagt

SEQ ID NO: 1649949 - DNA, 14 bp, Homo sapiens
ataatggttgactg

SEQ ID NO: 1649950 - DNA, 14 bp, Homo sapiens
ataatgtactcaca

SEQ ID NO: 1649951 - DNA, 22 bp, Homo sapiens
ataatgtataaagaacaaggta

SEQ ID NO: 1649952 - DNA, 18 bp, Homo sapiens
ataatgtattcatatttg

SEQ ID NO: 1649953 - DNA, 21 bp, Homo sapiens
ataatgtccctctcttggcta

SEQ ID NO: 1649954 - DNA, 15 bp, Homo sapiens
ataatgtctctgtga

SEQ ID NO: 1649955 - DNA, 14 bp, Homo sapiens
ataatgttctgcta

SEQ ID NO: 1649956 - DNA, 22 bp, Homo sapiens
ataatgttctgctaaatttcaa

SEQ ID NO: 1649957 - DNA, 19 bp, Homo sapiens
ataatgttgttatttaaag

SEQ ID NO: 1649958 - DNA, 22 bp, Homo sapiens
ataatgtttaatattgagaaag

SEQ ID NO: 1649959 - DNA, 17 bp, Homo sapiens
ataatgtttattaaatg

SEQ ID NO: 1649960 - DNA, 16 bp, Homo sapiens
ataattaattgtcatt

SEQ ID NO: 1649961 - DNA, 14 bp, Homo sapiens
ataattacattcct

SEQ ID NO: 1649962 - DNA, 15 bp, Homo sapiens
ataattatataactg

SEQ ID NO: 1649963 - DNA, 17 bp, Homo sapiens
ataattatataactgta

SEQ ID NO: 1649964 - DNA, 19 bp, Homo sapiens
ataattatcggaagcagtg

SEQ ID NO: 1649965 - DNA, 13 bp, Homo sapiens
atacagtgcagag

SEQ ID NO: 1649966 - DNA, 13 bp, Homo sapiens
atacagtgtacat

SEQ ID NO: 1649967 - DNA, 15 bp, Homo sapiens
atacagtgtacatgt

SEQ ID NO: 1649968 - DNA, 23 bp, Homo sapiens
atacagtgttattttctttgaaa

SEQ ID NO: 1649969 - DNA, 20 bp, Homo sapiens
atacagttgttggcctccgg

SEQ ID NO: 1649970 - DNA, 14 bp, Homo sapiens
atacataaaaaagt

SEQ ID NO: 1649971 - DNA, 17 bp, Homo sapiens
atacataaacttttgca

SEQ ID NO: 1649972 - DNA, 21 bp, Homo sapiens
atacataagcggcgtaagttt

SEQ ID NO: 1649973 - DNA, 15 bp, Homo sapiens
atacatagtgaaaat

SEQ ID NO: 1649974 - DNA, 20 bp, Homo sapiens
atacatatatatatataaca

SEQ ID NO: 1649975 - DNA, 23 bp, Homo sapiens
atacatatatgtatatatatgca

SEQ ID NO: 1649976 - DNA, 14 bp, Homo sapiens
atacatcagaaaat

SEQ ID NO: 1649977 - DNA, 17 bp, Homo sapiens
atacatcagaaaataaa

SEQ ID NO: 1649978 - DNA, 19 bp, Homo sapiens
atacatcagcttggtagtt

SEQ ID NO: 1649979 - DNA, 14 bp, Homo sapiens
atacatctgtgtat

SEQ ID NO: 1649980 - DNA, 20 bp, Homo sapiens
atacatgggtgaattatgtt

SEQ ID NO: 1649981 - DNA, 23 bp, Homo sapiens
atacatgtcacatttagctgtgc

SEQ ID NO: 1649982 - DNA, 16 bp, Homo sapiens
atacatgtgtacatat

SEQ ID NO: 1649983 - DNA, 19 bp, Homo sapiens
atacatgtgtacatatatg

SEQ ID NO: 1649984 - DNA, 20 bp, Homo sapiens
atacatgtgtacatatatgt

SEQ ID NO: 1649985 - DNA, 21 bp, Homo sapiens
atacatgtgtacatatatgta

SEQ ID NO: 1649986 - DNA, 22 bp, Homo sapiens
atacatgtttatgtaaacaaat

SEQ ID NO: 1649987 - DNA, 16 bp, Homo sapiens
atacatgtttttctat

SEQ ID NO: 1649988 - DNA, 23 bp, Homo sapiens
atacatgtttttctattaaaaat

SEQ ID NO: 1649989 - DNA, 19 bp, Homo sapiens
atacattaacggtgctaaa

SEQ ID NO: 1649990 - DNA, 15 bp, Homo sapiens
atacattctttgcta

SEQ ID NO: 1649991 - DNA, 18 bp, Homo sapiens
atacattctttgctagtt

SEQ ID NO: 1649992 - DNA, 14 bp, Homo sapiens
atacattgtacgaa

SEQ ID NO: 1649993 - DNA, 20 bp, Homo sapiens
atacattgtatatatgtgta

SEQ ID NO: 1649994 - DNA, 14 bp, Homo sapiens
atacattgtcttga

SEQ ID NO: 1649995 - DNA, 20 bp, Homo sapiens
atacattgtgtgaaaaaaga

SEQ ID NO: 1649996 - DNA, 20 bp, Homo sapiens
atacatttataatgtttgct

SEQ ID NO: 1649997 - DNA, 23 bp, Homo sapiens
atacatttataatgtttgctatt

SEQ ID NO: 1649998 - DNA, 12 bp, Homo sapiens
atacatttgtaa

SEQ ID NO: 1649999 - DNA, 16 bp, Homo sapiens
atacatttgtattttg

SEQ ID NO: 1650000 - DNA, 13 bp, Homo sapiens
atacattttctaa

SEQ ID NO: 1650001 - DNA, 22 bp, Homo sapiens
atacattttctaaataaaaata

SEQ ID NO: 1650002 - DNA, 19 bp, Homo sapiens
atacattttgtatattaac

SEQ ID NO: 1650003 - DNA, 20 bp, Homo sapiens
atacattttgtatattaact

SEQ ID NO: 1650004 - DNA, 18 bp, Homo sapiens
atacattttgttatagaa

SEQ ID NO: 1650005 - DNA, 19 bp, Homo sapiens
atacattttgttatagaat

SEQ ID NO: 1650006 - DNA, 22 bp, Homo sapiens
atacattttttaggacatctta

SEQ ID NO: 1650007 - DNA, 12 bp, Homo sapiens
ataccaataaag

SEQ ID NO: 1650008 - DNA, 13 bp, Homo sapiens
ataccaataaagt

SEQ ID NO: 1650009 - DNA, 21 bp, Homo sapiens
ataccaattacccataaacag

SEQ ID NO: 1650010 - DNA, 18 bp, Homo sapiens
ataccacaaaccctgctg

SEQ ID NO: 1650011 - DNA, 13 bp, Homo sapiens
ataccacatcaaa

SEQ ID NO: 1650012 - DNA, 16 bp, Homo sapiens
ataccacctttactgt

SEQ ID NO: 1650013 - DNA, 17 bp, Homo sapiens
ataccacctttactgtg

SEQ ID NO: 1650014 - DNA, 16 bp, Homo sapiens
ataccactgtaattga

SEQ ID NO: 1650015 - DNA, 15 bp, Homo sapiens
ataccagagccttca

SEQ ID NO: 1650016 - DNA, 22 bp, Homo sapiens
ataccagagccttcaagtgcca

SEQ ID NO: 1650017 - DNA, 17 bp, Homo sapiens
ataccagcttaatagct

SEQ ID NO: 1650018 - DNA, 22 bp, Homo sapiens
ataccaggcaacctcccatccc

SEQ ID NO: 1650019 - DNA, 16 bp, Homo sapiens
ataccaggttgaaaga

SEQ ID NO: 1650020 - DNA, 22 bp, Homo sapiens
ataccatttagtaagaatacca

SEQ ID NO: 1650021 - DNA, 17 bp, Homo sapiens
ataccatttcctcagct

SEQ ID NO: 1650022 - DNA, 20 bp, Homo sapiens
ataccattttttaaggaaac

SEQ ID NO: 1650023 - DNA, 22 bp, Homo sapiens
atacccaaaaccctgaagccat

SEQ ID NO: 1650024 - DNA, 13 bp, Homo sapiens
atacccacccaga

SEQ ID NO: 1650025 - DNA, 17 bp, Homo sapiens
atacccagaaagttatt

SEQ ID NO: 1650026 - DNA, 17 bp, Homo sapiens
atacccccccatgcagt

SEQ ID NO: 1650027 - DNA, 18 bp, Homo sapiens
ataccgcaggcgggcgag

SEQ ID NO: 1650028 - DNA, 22 bp, Homo sapiens
ataccgcctcgtgccagcagcc

SEQ ID NO: 1650029 - DNA, 15 bp, Homo sapiens
atacctaattgtgga

SEQ ID NO: 1650030 - DNA, 14 bp, Homo sapiens
atacctcaattttt

SEQ ID NO: 1650031 - DNA, 13 bp, Homo sapiens
atacctcagccct

SEQ ID NO: 1650032 - DNA, 16 bp, Homo sapiens
atacctcagccctggc

SEQ ID NO: 1650033 - DNA, 17 bp, Homo sapiens
atacctccattaaatgg

SEQ ID NO: 1650034 - DNA, 17 bp, Homo sapiens
atacctctaataaacac

SEQ ID NO: 1650035 - DNA, 12 bp, Homo sapiens
atacctctgtgt

SEQ ID NO: 1650036 - DNA, 13 bp, Homo sapiens
atacctctgtgtg

SEQ ID NO: 1650037 - DNA, 13 bp, Homo sapiens
atacctgagcctc

SEQ ID NO: 1650038 - DNA, 23 bp, Homo sapiens
atacctgattgatcacacagtgt

SEQ ID NO: 1650039 - DNA, 20 bp, Homo sapiens
atacctgattttttttcctt

SEQ ID NO: 1650040 - DNA, 17 bp, Homo sapiens
atacctgtttaaattgc

SEQ ID NO: 1650041 - DNA, 20 bp, Homo sapiens
ataccttccttccctgggct

SEQ ID NO: 1650042 - DNA, 20 bp, Homo sapiens
atacgagagcagaggtctcc

SEQ ID NO: 1650043 - DNA, 23 bp, Homo sapiens
atacgcaacataattaaattttg

SEQ ID NO: 1650044 - DNA, 21 bp, Homo sapiens
atacgctggcaacacagaggc

SEQ ID NO: 1650045 - DNA, 17 bp, Homo sapiens
atacgtgccagatataa

SEQ ID NO: 1650046 - DNA, 21 bp, Homo sapiens
atacgtgttaggaggctgcat

SEQ ID NO: 1650047 - DNA, 22 bp, Homo sapiens
atacgttttggtgttgcttttc

SEQ ID NO: 1650048 - DNA, 23 bp, Homo sapiens
atactacctagaagtaagaagag

SEQ ID NO: 1650049 - DNA, 13 bp, Homo sapiens
atactactcctgt

SEQ ID NO: 1650050 - DNA, 17 bp, Homo sapiens
atactaggatacagaaa

SEQ ID NO: 1650051 - DNA, 18 bp, Homo sapiens
atactaggatacagaaat

SEQ ID NO: 1650052 - DNA, 20 bp, Homo sapiens
atactaggatacagaaatgc

SEQ ID NO: 1650053 - DNA, 23 bp, Homo sapiens
atactaggatacagaaatgcaaa

SEQ ID NO: 1650054 - DNA, 16 bp, Homo sapiens
atactagggagccatt

SEQ ID NO: 1650055 - DNA, 21 bp, Homo sapiens
atactagggagccatttgaga

SEQ ID NO: 1650056 - DNA, 12 bp, Homo sapiens
atactattctca

SEQ ID NO: 1650057 - DNA, 20 bp, Homo sapiens
atactcaaatgagtaacatt

SEQ ID NO: 1650058 - DNA, 12 bp, Homo sapiens
atactcaaggtg

SEQ ID NO: 1650059 - DNA, 17 bp, Homo sapiens
atactcaccaaaatata

SEQ ID NO: 1650060 - DNA, 20 bp, Homo sapiens
atactccactcccagcagct

SEQ ID NO: 1650061 - DNA, 15 bp, Homo sapiens
atactccatacataa

SEQ ID NO: 1650062 - DNA, 22 bp, Homo sapiens
atactctagaacatgcacattt

SEQ ID NO: 1650063 - DNA, 16 bp, Homo sapiens
atactctgcttagaat

SEQ ID NO: 1650064 - DNA, 22 bp, Homo sapiens
atactctgtgtaatctctgatt

SEQ ID NO: 1650065 - DNA, 23 bp, Homo sapiens
atactctgtgtaatctctgatta

SEQ ID NO: 1650066 - DNA, 14 bp, Homo sapiens
atactcttctaaaa

SEQ ID NO: 1650067 - DNA, 14 bp, Homo sapiens
atactcttgaaagg

SEQ ID NO: 1650068 - DNA, 14 bp, Homo sapiens
atactcttgaaatg

SEQ ID NO: 1650069 - DNA, 12 bp, Homo sapiens
atactgaaggaa

SEQ ID NO: 1650070 - DNA, 13 bp, Homo sapiens
atactgaaggaaa

SEQ ID NO: 1650071 - DNA, 15 bp, Homo sapiens
atactgaaggaaaaa

SEQ ID NO: 1650072 - DNA, 14 bp, Homo sapiens
atactgaagtcttt

SEQ ID NO: 1650073 - DNA, 22 bp, Homo sapiens
atactgagggaccaactgggcc

SEQ ID NO: 1650074 - DNA, 22 bp, Homo sapiens
atactgattgggaggtgcgtgt

SEQ ID NO: 1650075 - DNA, 18 bp, Homo sapiens
atactgcacagtggcaca

SEQ ID NO: 1650076 - DNA, 19 bp, Homo sapiens
atactgcgactttctgcct

SEQ ID NO: 1650077 - DNA, 19 bp, Homo sapiens
atactgctacagcaatttc

SEQ ID NO: 1650078 - DNA, 22 bp, Homo sapiens
atactgctctgaatattttgta

SEQ ID NO: 1650079 - DNA, 12 bp, Homo sapiens
atatatttaaca

SEQ ID NO: 1650080 - DNA, 14 bp, Homo sapiens
atatatttataact

SEQ ID NO: 1650081 - DNA, 15 bp, Homo sapiens
atatatttataactc

SEQ ID NO: 1650082 - DNA, 21 bp, Homo sapiens
atatatttataactcatcata

SEQ ID NO: 1650083 - DNA, 15 bp, Homo sapiens
atatatttattttat

SEQ ID NO: 1650084 - DNA, 18 bp, Homo sapiens
atatatttattttattct

SEQ ID NO: 1650085 - DNA, 17 bp, Homo sapiens
atatatttctattatta

SEQ ID NO: 1650086 - DNA, 14 bp, Homo sapiens
atatatttctttgt

SEQ ID NO: 1650087 - DNA, 13 bp, Homo sapiens
atatatttgaaat

SEQ ID NO: 1650088 - DNA, 22 bp, Homo sapiens
atatatttgtttcatttctgca

SEQ ID NO: 1650089 - DNA, 12 bp, Homo sapiens
atatattttaag

SEQ ID NO: 1650090 - DNA, 21 bp, Homo sapiens
atatattttaaggttgcacac

SEQ ID NO: 1650091 - DNA, 19 bp, Homo sapiens
atatattttgtgtgaaatt

SEQ ID NO: 1650092 - DNA, 20 bp, Homo sapiens
atatattttgtgtgaaattg

SEQ ID NO: 1650093 - DNA, 22 bp, Homo sapiens
atatattttgtgtgaaattgca

SEQ ID NO: 1650094 - DNA, 18 bp, Homo sapiens
atatattttgttgttcct

SEQ ID NO: 1650095 - DNA, 16 bp, Homo sapiens
atatattttgtttaca

SEQ ID NO: 1650096 - DNA, 16 bp, Homo sapiens
atatatttttaagata

SEQ ID NO: 1650097 - DNA, 19 bp, Homo sapiens
atatattttttaatttgat

SEQ ID NO: 1650098 - DNA, 15 bp, Homo sapiens
atatcaaaattctag

SEQ ID NO: 1650099 - DNA, 13 bp, Homo sapiens
atatcacacaata

SEQ ID NO: 1650100 - DNA, 21 bp, Homo sapiens
atatcactaatttcttcttta

SEQ ID NO: 1650101 - DNA, 14 bp, Homo sapiens
atatcagacaagca

SEQ ID NO: 1650102 - DNA, 16 bp, Homo sapiens
atatcagacaagcact

SEQ ID NO: 1650103 - DNA, 21 bp, Homo sapiens
atatcagagctcttaatgttg

SEQ ID NO: 1650104 - DNA, 20 bp, Homo sapiens
atatcagcctgagtctcctg

SEQ ID NO: 1650105 - DNA, 17 bp, Homo sapiens
atatcagtcgttttagt

SEQ ID NO: 1650106 - DNA, 16 bp, Homo sapiens
atatcagtgacagttg

SEQ ID NO: 1650107 - DNA, 20 bp, Homo sapiens
atatcagttactcagccctg

SEQ ID NO: 1650108 - DNA, 23 bp, Homo sapiens
atatcagttactcagccctgggc

SEQ ID NO: 1650109 - DNA, 13 bp, Homo sapiens
atatcagtttgct

SEQ ID NO: 1650110 - DNA, 13 bp, Homo sapiens
atatcataactat

SEQ ID NO: 1650111 - DNA, 16 bp, Homo sapiens
atatcatatttctgtg

SEQ ID NO: 1650112 - DNA, 17 bp, Homo sapiens
atatcatatttctgtgg

SEQ ID NO: 1650113 - DNA, 17 bp, Homo sapiens
atatcatcaatactttt

SEQ ID NO: 1650114 - DNA, 14 bp, Homo sapiens
atatcatgaaacac

SEQ ID NO: 1650115 - DNA, 13 bp, Homo sapiens
atatcatgtacct

SEQ ID NO: 1650116 - DNA, 17 bp, Homo sapiens
atatcattctaaagata

SEQ ID NO: 1650117 - DNA, 20 bp, Homo sapiens
atatcccaaacttcggaaac

SEQ ID NO: 1650118 - DNA, 16 bp, Homo sapiens
atatcccaagtgcact

SEQ ID NO: 1650119 - DNA, 13 bp, Homo sapiens
atatcccttccag

SEQ ID NO: 1650120 - DNA, 22 bp, Homo sapiens
atatccgtgaagggatttctta

SEQ ID NO: 1650121 - DNA, 11 bp, Homo sapiens
atatcctgcct

SEQ ID NO: 1650122 - DNA, 14 bp, Homo sapiens
atatcctgcctcag

SEQ ID NO: 1650123 - DNA, 16 bp, Homo sapiens
atatcctttctaacaa

SEQ ID NO: 1650124 - DNA, 17 bp, Homo sapiens
atatcgacttgtttttg

SEQ ID NO: 1650125 - DNA, 16 bp, Homo sapiens
atatcgtacctgtccc

SEQ ID NO: 1650126 - DNA, 13 bp, Homo sapiens
atatctaaagtca

SEQ ID NO: 1650127 - DNA, 12 bp, Homo sapiens
atatctaagact

SEQ ID NO: 1650128 - DNA, 14 bp, Homo sapiens
atatctaatatata

SEQ ID NO: 1650129 - DNA, 17 bp, Homo sapiens
atatctaatatatatga

SEQ ID NO: 1650130 - DNA, 20 bp, Homo sapiens
atatctaattattttgcagt

SEQ ID NO: 1650131 - DNA, 18 bp, Homo sapiens
atatctacaatatatatt

SEQ ID NO: 1650132 - DNA, 23 bp, Homo sapiens
atatctaccccagactagatgta

SEQ ID NO: 1650133 - DNA, 17 bp, Homo sapiens
atatctagtatgaaatt

SEQ ID NO: 1650134 - DNA, 14 bp, Homo sapiens
atatctataaaata

SEQ ID NO: 1650135 - DNA, 17 bp, Homo sapiens
atatctataaaatagat

SEQ ID NO: 1650136 - DNA, 23 bp, Homo sapiens
atatctataaaatagatataaat

SEQ ID NO: 1650137 - DNA, 19 bp, Homo sapiens
atatctatatatataattt

SEQ ID NO: 1650138 - DNA, 14 bp, Homo sapiens
atatctattaatat

SEQ ID NO: 1650139 - DNA, 15 bp, Homo sapiens
atatctattaatata

SEQ ID NO: 1650140 - DNA, 18 bp, Homo sapiens
atatctattaatatatgt

SEQ ID NO: 1650141 - DNA, 20 bp, Homo sapiens
atatctatttgagagcagat

SEQ ID NO: 1650142 - DNA, 22 bp, Homo sapiens
atatctatttgagagcagatgc

SEQ ID NO: 1650143 - DNA, 23 bp, Homo sapiens
atatctcaatgaaccataaattc

SEQ ID NO: 1650144 - DNA, 22 bp, Homo sapiens
atatctccatgaagttttccca

SEQ ID NO: 1650145 - DNA, 16 bp, Homo sapiens
atatctctatttgaga

SEQ ID NO: 1650146 - DNA, 20 bp, Homo sapiens
atatctgaagagtatccttc

SEQ ID NO: 1650147 - DNA, 14 bp, Homo sapiens
atatctgagcaagg

SEQ ID NO: 1650148 - DNA, 13 bp, Homo sapiens
atatctgcatgtg

SEQ ID NO: 1650149 - DNA, 17 bp, Homo sapiens
atatctgcatgtgtcat

SEQ ID NO: 1650150 - DNA, 19 bp, Homo sapiens
atatctgccccagtagtca

SEQ ID NO: 1650151 - DNA, 16 bp, Homo sapiens
atatctggagcctgat

SEQ ID NO: 1650152 - DNA, 13 bp, Homo sapiens
atatctggcctct

SEQ ID NO: 1650153 - DNA, 23 bp, Homo sapiens
atatctgtaaatttaactgcata

SEQ ID NO: 1650154 - DNA, 15 bp, Homo sapiens
atatctgtaatggta

SEQ ID NO: 1650155 - DNA, 20 bp, Homo sapiens
atatctgtacagatcaagaa

SEQ ID NO: 1650156 - DNA, 15 bp, Homo sapiens
atatctgtatataaa

SEQ ID NO: 1650157 - DNA, 24 bp, Homo sapiens
atatctgtatttaattttgacact

SEQ ID NO: 1650158 - DNA, 16 bp, Homo sapiens
atatctgttggagaaa

SEQ ID NO: 1650159 - DNA, 22 bp, Homo sapiens
atatcttaattctttgttctgt

SEQ ID NO: 1650160 - DNA, 17 bp, Homo sapiens
atatcttactaaggcct

SEQ ID NO: 1650161 - DNA, 15 bp, Homo sapiens
atatcttctgtttca

SEQ ID NO: 1650162 - DNA, 16 bp, Homo sapiens
atatcttctgtttcat

SEQ ID NO: 1650163 - DNA, 14 bp, Homo sapiens
atatcttgcttgaa

SEQ ID NO: 1650164 - DNA, 23 bp, Homo sapiens
atatcttgcttgaacttacaggt

SEQ ID NO: 1650165 - DNA, 20 bp, Homo sapiens
atatcttggacaaatcacat

SEQ ID NO: 1650166 - DNA, 13 bp, Homo sapiens
atatctttatgta

SEQ ID NO: 1650167 - DNA, 14 bp, Homo sapiens
atatctttctctta

SEQ ID NO: 1650168 - DNA, 20 bp, Homo sapiens
atatcttttgtaagacattt

SEQ ID NO: 1650169 - DNA, 16 bp, Homo sapiens
atatgaaaatacaact

SEQ ID NO: 1650170 - DNA, 19 bp, Homo sapiens
atatgaacatattgttgaa

SEQ ID NO: 1650171 - DNA, 22 bp, Homo sapiens
atatgaacctattttcatttgt

SEQ ID NO: 1650172 - DNA, 16 bp, Homo sapiens
atatgacaaatgtttc

SEQ ID NO: 1650173 - DNA, 17 bp, Homo sapiens
atatgacaaatgtttct

SEQ ID NO: 1650174 - DNA, 18 bp, Homo sapiens
atatgacaaatgtttcta

SEQ ID NO: 1650175 - DNA, 14 bp, Homo sapiens
atatgacagctgtc

SEQ ID NO: 1650176 - DNA, 16 bp, Homo sapiens
atatgacatttaaatg

SEQ ID NO: 1650177 - DNA, 16 bp, Homo sapiens
atatgacccacactgc

SEQ ID NO: 1650178 - DNA, 18 bp, Homo sapiens
atatgacggaagaacata

SEQ ID NO: 1650179 - DNA, 13 bp, Homo sapiens
atatgactcacat

SEQ ID NO: 1650180 - DNA, 22 bp, Homo sapiens
atatgacttcctagggatctga

SEQ ID NO: 1650181 - DNA, 24 bp, Homo sapiens
atatgagcttcaatataagaagca

SEQ ID NO: 1650182 - DNA, 19 bp, Homo sapiens
atatgatcaggtaactttc

SEQ ID NO: 1650183 - DNA, 17 bp, Homo sapiens
atatgatgggggaaaaa

SEQ ID NO: 1650184 - DNA, 16 bp, Homo sapiens
atatgatttaaaacat

SEQ ID NO: 1650185 - DNA, 14 bp, Homo sapiens
atatgcaaagcact

SEQ ID NO: 1650186 - DNA, 15 bp, Homo sapiens
atatgcacaatagca

SEQ ID NO: 1650187 - DNA, 17 bp, Homo sapiens
atatgcagttttcctta

SEQ ID NO: 1650188 - DNA, 15 bp, Homo sapiens
atatgcatatatata

SEQ ID NO: 1650189 - DNA, 21 bp, Homo sapiens
atatgcatctggcccaggaat

SEQ ID NO: 1650190 - DNA, 16 bp, Homo sapiens
atatgctctgcatgtt

SEQ ID NO: 1650191 - DNA, 15 bp, Homo sapiens
atatgctgatctttt

SEQ ID NO: 1650192 - DNA, 19 bp, Homo sapiens
atatgctgttatgtccaga

SEQ ID NO: 1650193 - DNA, 18 bp, Homo sapiens
atatgcttaaaataagca

SEQ ID NO: 1650194 - DNA, 21 bp, Homo sapiens
atatttttgtcatgaactgta

SEQ ID NO: 1650195 - DNA, 21 bp, Homo sapiens
atatttttgtgttttcttgta

SEQ ID NO: 1650196 - DNA, 15 bp, Homo sapiens
atattttttgtctgt

SEQ ID NO: 1650197 - DNA, 17 bp, Homo sapiens
atatttttttaatttaa

SEQ ID NO: 1650198 - DNA, 14 bp, Homo sapiens
atatttttttctag

SEQ ID NO: 1650199 - DNA, 11 bp, Homo sapiens
atcaaaaataa

SEQ ID NO: 1650200 - DNA, 19 bp, Homo sapiens
atcaaaaataaactagttt

SEQ ID NO: 1650201 - DNA, 22 bp, Homo sapiens
atcaaaaataaactagtttcca

SEQ ID NO: 1650202 - DNA, 16 bp, Homo sapiens
atcaaaaatattccat

SEQ ID NO: 1650203 - DNA, 12 bp, Homo sapiens
atcaaaacatgc

SEQ ID NO: 1650204 - DNA, 21 bp, Homo sapiens
atcaaaactttcttttctgga

SEQ ID NO: 1650205 - DNA, 13 bp, Homo sapiens
atcaaaagaaaat

SEQ ID NO: 1650206 - DNA, 18 bp, Homo sapiens
atcaaaataaaaagtgac

SEQ ID NO: 1650207 - DNA, 19 bp, Homo sapiens
atcaaacagtaatctaggt

SEQ ID NO: 1650208 - DNA, 17 bp, Homo sapiens
atcaaacatttgccaag

SEQ ID NO: 1650209 - DNA, 15 bp, Homo sapiens
atcaaacattttctg

SEQ ID NO: 1650210 - DNA, 17 bp, Homo sapiens
atcaaaccctagccttg

SEQ ID NO: 1650211 - DNA, 21 bp, Homo sapiens
atcaaaccctagccttgcttg

SEQ ID NO: 1650212 - DNA, 15 bp, Homo sapiens
atcaaacctttgagt

SEQ ID NO: 1650213 - DNA, 14 bp, Homo sapiens
atcaaactgaagcc

SEQ ID NO: 1650214 - DNA, 17 bp, Homo sapiens
atcaaactgaagccaga

SEQ ID NO: 1650215 - DNA, 17 bp, Homo sapiens
atcaaagaaattcagaa

SEQ ID NO: 1650216 - DNA, 15 bp, Homo sapiens
atcaaagaacagatg

SEQ ID NO: 1650217 - DNA, 14 bp, Homo sapiens
atcaaagcaagggc

SEQ ID NO: 1650218 - DNA, 20 bp, Homo sapiens
atcaaagcaagggctccagc

SEQ ID NO: 1650219 - DNA, 20 bp, Homo sapiens
atcaaagggataaagaaaaa

SEQ ID NO: 1650220 - DNA, 15 bp, Homo sapiens
atcaaagtaaaaaat

SEQ ID NO: 1650221 - DNA, 22 bp, Homo sapiens
atcaaagtggtaaatactgtga

SEQ ID NO: 1650222 - DNA, 23 bp, Homo sapiens
atcaaagtggtaaatactgtgaa

SEQ ID NO: 1650223 - DNA, 21 bp, Homo sapiens
atcaaataaaatatcataaag

SEQ ID NO: 1650224 - DNA, 17 bp, Homo sapiens
atcaaataagtatttat

SEQ ID NO: 1650225 - DNA, 20 bp, Homo sapiens
atcaaataataccttagaag

SEQ ID NO: 1650226 - DNA, 21 bp, Homo sapiens
atcaaatagaaccactatgaa

SEQ ID NO: 1650227 - DNA, 14 bp, Homo sapiens
atcaaatagcgatg

SEQ ID NO: 1650228 - DNA, 15 bp, Homo sapiens
atcaaatatgcaaag

SEQ ID NO: 1650229 - DNA, 20 bp, Homo sapiens
atcaaatctaccactgtatg

SEQ ID NO: 1650230 - DNA, 21 bp, Homo sapiens
atcaaatctgtatatgttgta

SEQ ID NO: 1650231 - DNA, 18 bp, Homo sapiens
atcaaattctacaacttt

SEQ ID NO: 1650232 - DNA, 15 bp, Homo sapiens
atcaacaagatttcc

SEQ ID NO: 1650233 - DNA, 17 bp, Homo sapiens
atcaacatgttattcaa

SEQ ID NO: 1650234 - DNA, 14 bp, Homo sapiens
atcaacatttatga

SEQ ID NO: 1650235 - DNA, 14 bp, Homo sapiens
atcaaccaggaaga

SEQ ID NO: 1650236 - DNA, 16 bp, Homo sapiens
atcaaccctctcctgt

SEQ ID NO: 1650237 - DNA, 21 bp, Homo sapiens
atcaactaaagttgtacttta

SEQ ID NO: 1650238 - DNA, 13 bp, Homo sapiens
atcaactctgaag

SEQ ID NO: 1650239 - DNA, 11 bp, Homo sapiens
atcaactgaat

SEQ ID NO: 1650240 - DNA, 15 bp, Homo sapiens
atcaacttaaaagtc

SEQ ID NO: 1650241 - DNA, 15 bp, Homo sapiens
atcaactttactgta

SEQ ID NO: 1650242 - DNA, 20 bp, Homo sapiens
atcaagaagggctgcatgat

SEQ ID NO: 1650243 - DNA, 14 bp, Homo sapiens
atcaagagaaactt

SEQ ID NO: 1650244 - DNA, 16 bp, Homo sapiens
atcaagagaaacttca

SEQ ID NO: 1650245 - DNA, 18 bp, Homo sapiens
atcaagatgtcagactgg

SEQ ID NO: 1650246 - DNA, 16 bp, Homo sapiens
atcaaggaaaggctca

SEQ ID NO: 1650247 - DNA, 18 bp, Homo sapiens
atcaagggagacaccagt

SEQ ID NO: 1650248 - DNA, 17 bp, Homo sapiens
atcaagtagactactgt

SEQ ID NO: 1650249 - DNA, 18 bp, Homo sapiens
atcaagtagactactgtt

SEQ ID NO: 1650250 - DNA, 19 bp, Homo sapiens
atcaagtagactactgttc

SEQ ID NO: 1650251 - DNA, 14 bp, Homo sapiens
atcaagtattataa

SEQ ID NO: 1650252 - DNA, 16 bp, Homo sapiens
atcaagtccatctgac

SEQ ID NO: 1650253 - DNA, 20 bp, Homo sapiens
atcaagtccatctgacaaaa

SEQ ID NO: 1650254 - DNA, 22 bp, Homo sapiens
atcaagtccatgttattctctc

SEQ ID NO: 1650255 - DNA, 16 bp, Homo sapiens
atcaagttgttgactg

SEQ ID NO: 1650256 - DNA, 20 bp, Homo sapiens
atcaagttgttgactgtgat

SEQ ID NO: 1650257 - DNA, 12 bp, Homo sapiens
atcaatacacta

SEQ ID NO: 1650258 - DNA, 14 bp, Homo sapiens
atcaatacttttgt

SEQ ID NO: 1650259 - DNA, 18 bp, Homo sapiens
atcaatacttttgtgtat

SEQ ID NO: 1650260 - DNA, 17 bp, Homo sapiens
atcaatagttgaattag

SEQ ID NO: 1650261 - DNA, 13 bp, Homo sapiens
atcaatcatgccc

SEQ ID NO: 1650262 - DNA, 16 bp, Homo sapiens
atcaatcttgttactg

SEQ ID NO: 1650263 - DNA, 19 bp, Homo sapiens
atcaatgtttcttctaggt

SEQ ID NO: 1650264 - DNA, 18 bp, Homo sapiens
atcaatttgtttgtgttc

SEQ ID NO: 1650265 - DNA, 12 bp, Homo sapiens
atcaattttcat

SEQ ID NO: 1650266 - DNA, 19 bp, Homo sapiens
atcaattttcattaaactt

SEQ ID NO: 1650267 - DNA, 22 bp, Homo sapiens
atcaattttcattaaacttgaa

SEQ ID NO: 1650268 - DNA, 20 bp, Homo sapiens
atcaatttttcccagtattt

SEQ ID NO: 1650269 - DNA, 16 bp, Homo sapiens
atcacaagatggaatt

SEQ ID NO: 1650270 - DNA, 16 bp, Homo sapiens
atcacacaatatagtt

SEQ ID NO: 1650271 - DNA, 11 bp, Homo sapiens
atcacacacac

SEQ ID NO: 1650272 - DNA, 13 bp, Homo sapiens
atcacacagtgtt

SEQ ID NO: 1650273 - DNA, 17 bp, Homo sapiens
atcacaccactgtactc

SEQ ID NO: 1650274 - DNA, 19 bp, Homo sapiens
atcacacttatattttatg

SEQ ID NO: 1650275 - DNA, 23 bp, Homo sapiens
atcacacttatattttatgaaca

SEQ ID NO: 1650276 - DNA, 23 bp, Homo sapiens
atcacacttcattgtaaatcact

SEQ ID NO: 1650277 - DNA, 18 bp, Homo sapiens
atcacacttctgtgagac

SEQ ID NO: 1650278 - DNA, 14 bp, Homo sapiens
atcacagatgtaaa

SEQ ID NO: 1650279 - DNA, 21 bp, Homo sapiens
atcacagcttcagccaggagc

SEQ ID NO: 1650280 - DNA, 15 bp, Homo sapiens
atcacagggcagagc

SEQ ID NO: 1650281 - DNA, 19 bp, Homo sapiens
atcacagggcagagccggg

SEQ ID NO: 1650282 - DNA, 22 bp, Homo sapiens
atcacagggccccagaaggcag

SEQ ID NO: 1650283 - DNA, 15 bp, Homo sapiens
atcacaggggcgggg

SEQ ID NO: 1650284 - DNA, 21 bp, Homo sapiens
atcacagggtgggcctcggcc

SEQ ID NO: 1650285 - DNA, 18 bp, Homo sapiens
atcacagggttgggccca

SEQ ID NO: 1650286 - DNA, 19 bp, Homo sapiens
atcacagggttgggcccag

SEQ ID NO: 1650287 - DNA, 20 bp, Homo sapiens
atcacagggttgggcccaga

SEQ ID NO: 1650288 - DNA, 16 bp, Homo sapiens
atcacattatttgcat

SEQ ID NO: 1650289 - DNA, 16 bp, Homo sapiens
atcacattcttcaaag

SEQ ID NO: 1650290 - DNA, 22 bp, Homo sapiens
atcacattttattaaacacagg

SEQ ID NO: 1650291 - DNA, 21 bp, Homo sapiens
atcacatttttttatgctctt

SEQ ID NO: 1650292 - DNA, 12 bp, Homo sapiens
atcaccaccctt

SEQ ID NO: 1650293 - DNA, 22 bp, Homo sapiens
atcaccagtcctagctcttaca

SEQ ID NO: 1650294 - DNA, 14 bp, Homo sapiens
atcaccattatatt

SEQ ID NO: 1650295 - DNA, 20 bp, Homo sapiens
atcaccccaaccccccaaaa

SEQ ID NO: 1650296 - DNA, 21 bp, Homo sapiens
atcaccctgggagtttcctga

SEQ ID NO: 1650297 - DNA, 14 bp, Homo sapiens
atcacctcaggcca

SEQ ID NO: 1650298 - DNA, 15 bp, Homo sapiens
atcacctcattctga

SEQ ID NO: 1650299 - DNA, 18 bp, Homo sapiens
atcacctcattctgaacc

SEQ ID NO: 1650300 - DNA, 22 bp, Homo sapiens
atcacctctctgtagtttatgg

SEQ ID NO: 1650301 - DNA, 15 bp, Homo sapiens
atcacctgaacccca

SEQ ID NO: 1650302 - DNA, 20 bp, Homo sapiens
atcacctgaaccccagaggc

SEQ ID NO: 1650303 - DNA, 14 bp, Homo sapiens
atcacctgcctgtt

SEQ ID NO: 1650304 - DNA, 17 bp, Homo sapiens
atcacgccactgcactc

SEQ ID NO: 1650305 - DNA, 22 bp, Homo sapiens
atcacgccattgtactccagcc

SEQ ID NO: 1650306 - DNA, 18 bp, Homo sapiens
atcacgctttcctgaatc

SEQ ID NO: 1650307 - DNA, 15 bp, Homo sapiens
atcactatctttctg

SEQ ID NO: 1650308 - DNA, 12 bp, Homo sapiens
atcactcaccat

SEQ ID NO: 1650309 - DNA, 18 bp, Homo sapiens
atccctcccccccatgca

SEQ ID NO: 1650310 - DNA, 21 bp, Homo sapiens
atccctcccccccatgcactg

SEQ ID NO: 1650311 - DNA, 13 bp, Homo sapiens
atccctccctccc

SEQ ID NO: 1650312 - DNA, 22 bp, Homo sapiens
atccctccctcccgtccttccc

SEQ ID NO: 1650313 - DNA, 13 bp, Homo sapiens
atccctcctgagc

SEQ ID NO: 1650314 - DNA, 22 bp, Homo sapiens
atccctcggaagccgtctgact

SEQ ID NO: 1650315 - DNA, 23 bp, Homo sapiens
atccctcgggaagcagccagctc

SEQ ID NO: 1650316 - DNA, 23 bp, Homo sapiens
atccctctaatgagactgaccat

SEQ ID NO: 1650317 - DNA, 12 bp, Homo sapiens
atccctctcttc

SEQ ID NO: 1650318 - DNA, 18 bp, Homo sapiens
atccctctcttccccttc

SEQ ID NO: 1650319 - DNA, 21 bp, Homo sapiens
atccctctcttccccttccct

SEQ ID NO: 1650320 - DNA, 14 bp, Homo sapiens
atccctcttgtaag

SEQ ID NO: 1650321 - DNA, 16 bp, Homo sapiens
atccctgcggcctcca

SEQ ID NO: 1650322 - DNA, 14 bp, Homo sapiens
atccctgctctctg

SEQ ID NO: 1650323 - DNA, 16 bp, Homo sapiens
atccctgggcattgct

SEQ ID NO: 1650324 - DNA, 18 bp, Homo sapiens
atcccttcggagccaaca

SEQ ID NO: 1650325 - DNA, 23 bp, Homo sapiens
atcccttcggagccaacaagacc

SEQ ID NO: 1650326 - DNA, 19 bp, Homo sapiens
atccctttttttacatttc

SEQ ID NO: 1650327 - DNA, 12 bp, Homo sapiens
atccgaggcagg

SEQ ID NO: 1650328 - DNA, 13 bp, Homo sapiens
atccgaggcaggg

SEQ ID NO: 1650329 - DNA, 16 bp, Homo sapiens
atccgcaatgtggagc

SEQ ID NO: 1650330 - DNA, 19 bp, Homo sapiens
atccgcctacctcagcctc

SEQ ID NO: 1650331 - DNA, 14 bp, Homo sapiens
atccgcctgtgggc

SEQ ID NO: 1650332 - DNA, 15 bp, Homo sapiens
atccgcgtgtgcctg

SEQ ID NO: 1650333 - DNA, 14 bp, Homo sapiens
atccgctgccacca

SEQ ID NO: 1650334 - DNA, 23 bp, Homo sapiens
atccgctgccaccacgtctgcca

SEQ ID NO: 1650335 - DNA, 20 bp, Homo sapiens
atccgctgccagccttgagc

SEQ ID NO: 1650336 - DNA, 12 bp, Homo sapiens
atccggtttctt

SEQ ID NO: 1650337 - DNA, 16 bp, Homo sapiens
atccgtagttccctga

SEQ ID NO: 1650338 - DNA, 17 bp, Homo sapiens
atcctaagcatctaagt

SEQ ID NO: 1650339 - DNA, 12 bp, Homo sapiens
atcctaagctat

SEQ ID NO: 1650340 - DNA, 15 bp, Homo sapiens
atcctaatttctcct

SEQ ID NO: 1650341 - DNA, 23 bp, Homo sapiens
atcctaatttctcctcccttcct

SEQ ID NO: 1650342 - DNA, 21 bp, Homo sapiens
atcctaccctcgggcccacct

SEQ ID NO: 1650343 - DNA, 19 bp, Homo sapiens
atcctagaaccaagcttca

SEQ ID NO: 1650344 - DNA, 17 bp, Homo sapiens
atcctagaggtagagaa

SEQ ID NO: 1650345 - DNA, 18 bp, Homo sapiens
atcctagaggtagagaaa

SEQ ID NO: 1650346 - DNA, 21 bp, Homo sapiens
atcctagtaattgcctagaaa

SEQ ID NO: 1650347 - DNA, 15 bp, Homo sapiens
atcctagtcttcaca

SEQ ID NO: 1650348 - DNA, 16 bp, Homo sapiens
atcctagtcttcacaa

SEQ ID NO: 1650349 - DNA, 17 bp, Homo sapiens
atcctagtcttcacaac

SEQ ID NO: 1650350 - DNA, 21 bp, Homo sapiens
atcctagtcttcacaactttg

SEQ ID NO: 1650351 - DNA, 21 bp, Homo sapiens
atcctattaaaacacagcttt

SEQ ID NO: 1650352 - DNA, 15 bp, Homo sapiens
atcctcaaagaaagt

SEQ ID NO: 1650353 - DNA, 16 bp, Homo sapiens
atcctcaaagaaagtg

SEQ ID NO: 1650354 - DNA, 21 bp, Homo sapiens
atcctcaaagaaagtgtattg

SEQ ID NO: 1650355 - DNA, 23 bp, Homo sapiens
atcctcaccatccacagcaagat

SEQ ID NO: 1650356 - DNA, 15 bp, Homo sapiens
atcctcactgggtgg

SEQ ID NO: 1650357 - DNA, 21 bp, Homo sapiens
atcctcatatggcccagtgtc

SEQ ID NO: 1650358 - DNA, 15 bp, Homo sapiens
atcctcatccctgac

SEQ ID NO: 1650359 - DNA, 16 bp, Homo sapiens
atcctcatccctgact

SEQ ID NO: 1650360 - DNA, 17 bp, Homo sapiens
atcctcattgcctcctg

SEQ ID NO: 1650361 - DNA, 13 bp, Homo sapiens
atcctccacagag

SEQ ID NO: 1650362 - DNA, 21 bp, Homo sapiens
atcctccagtaccttgcttct

SEQ ID NO: 1650363 - DNA, 23 bp, Homo sapiens
atcctccctacttccaagaaaaa

SEQ ID NO: 1650364 - DNA, 16 bp, Homo sapiens
atcctccctggcagac

SEQ ID NO: 1650365 - DNA, 20 bp, Homo sapiens
atcctccctggcagacacaa

SEQ ID NO: 1650366 - DNA, 18 bp, Homo sapiens
atcctcccttcccaggag

SEQ ID NO: 1650367 - DNA, 16 bp, Homo sapiens
atcctccgtccagccg

SEQ ID NO: 1650368 - DNA, 13 bp, Homo sapiens
atcctcctccagg

SEQ ID NO: 1650369 - DNA, 11 bp, Homo sapiens
atcctcctccc

SEQ ID NO: 1650370 - DNA, 14 bp, Homo sapiens
atcctcctccccag

SEQ ID NO: 1650371 - DNA, 15 bp, Homo sapiens
atcctcctccccagc

SEQ ID NO: 1650372 - DNA, 20 bp, Homo sapiens
atcctcctccccagctcttc

SEQ ID NO: 1650373 - DNA, 23 bp, Homo sapiens
atcctcctccccagctcttctct

SEQ ID NO: 1650374 - DNA, 14 bp, Homo sapiens
atcctcctgttctg

SEQ ID NO: 1650375 - DNA, 16 bp, Homo sapiens
atcctctatttcctga

SEQ ID NO: 1650376 - DNA, 15 bp, Homo sapiens
atcctctcctttctt

SEQ ID NO: 1650377 - DNA, 10 bp, Homo sapiens
atcctctctc

SEQ ID NO: 1650378 - DNA, 16 bp, Homo sapiens
atcctctctcccctct

SEQ ID NO: 1650379 - DNA, 15 bp, Homo sapiens
atcctctctctcttc

SEQ ID NO: 1650380 - DNA, 17 bp, Homo sapiens
atcctctctctcttcta

SEQ ID NO: 1650381 - DNA, 17 bp, Homo sapiens
atcctctcttcctcttc

SEQ ID NO: 1650382 - DNA, 14 bp, Homo sapiens
atcctctggctggc

SEQ ID NO: 1650383 - DNA, 12 bp, Homo sapiens
atcctcttccat

SEQ ID NO: 1650384 - DNA, 22 bp, Homo sapiens
atcctcttttaatggcatttct

SEQ ID NO: 1650385 - DNA, 21 bp, Homo sapiens
atcctgaaatagaggctaaat

SEQ ID NO: 1650386 - DNA, 14 bp, Homo sapiens
atcctgaaatttca

SEQ ID NO: 1650387 - DNA, 24 bp, Homo sapiens
atcctgaccagctgctccgaggac

SEQ ID NO: 1650388 - DNA, 15 bp, Homo sapiens
atcctgagccaggga

SEQ ID NO: 1650389 - DNA, 23 bp, Homo sapiens
atcctgagccagggaacagcccc

SEQ ID NO: 1650390 - DNA, 14 bp, Homo sapiens
atcctgagctcaaa

SEQ ID NO: 1650391 - DNA, 12 bp, Homo sapiens
atcctgataaac

SEQ ID NO: 1650392 - DNA, 19 bp, Homo sapiens
atcctgattattgaatgtt

SEQ ID NO: 1650393 - DNA, 19 bp, Homo sapiens
atcctgcagggcttctcct

SEQ ID NO: 1650394 - DNA, 14 bp, Homo sapiens
atcctgcccagtgt

SEQ ID NO: 1650395 - DNA, 12 bp, Homo sapiens
atcctgcctgcc

SEQ ID NO: 1650396 - DNA, 16 bp, Homo sapiens
atcctgcgggtggggc

SEQ ID NO: 1650397 - DNA, 15 bp, Homo sapiens
atcctgctagctgta

SEQ ID NO: 1650398 - DNA, 16 bp, Homo sapiens
atcctgctagctgtag

SEQ ID NO: 1650399 - DNA, 19 bp, Homo sapiens
atcctgctagctgtagaaa

SEQ ID NO: 1650400 - DNA, 15 bp, Homo sapiens
atcctgctccagcag

SEQ ID NO: 1650401 - DNA, 16 bp, Homo sapiens
atcctgctccagcagc

SEQ ID NO: 1650402 - DNA, 17 bp, Homo sapiens
atcctgctccagcagca

SEQ ID NO: 1650403 - DNA, 19 bp, Homo sapiens
atcctgctccagcagcaca

SEQ ID NO: 1650404 - DNA, 20 bp, Homo sapiens
atcctgctcttttgtgatga

SEQ ID NO: 1650405 - DNA, 18 bp, Homo sapiens
atcctgctgacctcactg

SEQ ID NO: 1650406 - DNA, 14 bp, Homo sapiens
atcctgcttcagtg

SEQ ID NO: 1650407 - DNA, 19 bp, Homo sapiens
atcctgcttctgatatgca

SEQ ID NO: 1650408 - DNA, 21 bp, Homo sapiens
atcctgcttcttcttccaaat

SEQ ID NO: 1650409 - DNA, 17 bp, Homo sapiens
atcctggaaggacacag

SEQ ID NO: 1650410 - DNA, 21 bp, Homo sapiens
atcctggaaggacacagtgat

SEQ ID NO: 1650411 - DNA, 16 bp, Homo sapiens
atcctggattcactca

SEQ ID NO: 1650412 - DNA, 21 bp, Homo sapiens
atcctggcaagaaagcttgag

SEQ ID NO: 1650413 - DNA, 18 bp, Homo sapiens
atcctggcagcccagaga

SEQ ID NO: 1650414 - DNA, 20 bp, Homo sapiens
atcctggcagcccagagact

SEQ ID NO: 1650415 - DNA, 20 bp, Homo sapiens
atcctggcccctccagaccc

SEQ ID NO: 1650416 - DNA, 22 bp, Homo sapiens
atcctggcccctccagaccctg

SEQ ID NO: 1650417 - DNA, 16 bp, Homo sapiens
atcctgggcaatcaga

SEQ ID NO: 1650418 - DNA, 16 bp, Homo sapiens
atcctggggctccctt

SEQ ID NO: 1650419 - DNA, 20 bp, Homo sapiens
atcctggggctcccttcatc

SEQ ID NO: 1650420 - DNA, 16 bp, Homo sapiens
atcctggtgtctagtt

SEQ ID NO: 1650421 - DNA, 20 bp, Homo sapiens
atcctgtattcttgtttgaa

SEQ ID NO: 1650422 - DNA, 15 bp, Homo sapiens
atcctgtctttctga

SEQ ID NO: 1650423 - DNA, 23 bp, Homo sapiens
atcctgtctttctgagcacactt

SEQ ID NO: 1650424 - DNA, 17 bp, Homo sapiens
atctcctgacctcgtga

SEQ ID NO: 1650425 - DNA, 22 bp, Homo sapiens
atctcctggctttacagacaaa

SEQ ID NO: 1650426 - DNA, 13 bp, Homo sapiens
atctcctggtgtt

SEQ ID NO: 1650427 - DNA, 22 bp, Homo sapiens
atctcctgtcctgggccaggga

SEQ ID NO: 1650428 - DNA, 14 bp, Homo sapiens
atctcctgtgcatg

SEQ ID NO: 1650429 - DNA, 21 bp, Homo sapiens
atctccttcaccgtggctacc

SEQ ID NO: 1650430 - DNA, 14 bp, Homo sapiens
atctccttccccca

SEQ ID NO: 1650431 - DNA, 22 bp, Homo sapiens
atctccttcccccagcccaata

SEQ ID NO: 1650432 - DNA, 13 bp, Homo sapiens
atctccttccctt

SEQ ID NO: 1650433 - DNA, 15 bp, Homo sapiens
atctcgagccccctg

SEQ ID NO: 1650434 - DNA, 18 bp, Homo sapiens
atctcgagccccctggat

SEQ ID NO: 1650435 - DNA, 19 bp, Homo sapiens
atctcggctcactgcaacc

SEQ ID NO: 1650436 - DNA, 15 bp, Homo sapiens
atctcgtaatagctt

SEQ ID NO: 1650437 - DNA, 18 bp, Homo sapiens
atctcgtaatagcttctg

SEQ ID NO: 1650438 - DNA, 19 bp, Homo sapiens
atctcgtaatagcttctgt

SEQ ID NO: 1650439 - DNA, 15 bp, Homo sapiens
atctctaaaattcta

SEQ ID NO: 1650440 - DNA, 16 bp, Homo sapiens
atctctaaaattctag

SEQ ID NO: 1650441 - DNA, 20 bp, Homo sapiens
atctctactaccacaaggaa

SEQ ID NO: 1650442 - DNA, 16 bp, Homo sapiens
atctctatttgagaag

SEQ ID NO: 1650443 - DNA, 14 bp, Homo sapiens
atctctcaaaacaa

SEQ ID NO: 1650444 - DNA, 13 bp, Homo sapiens
atctctcaggagc

SEQ ID NO: 1650445 - DNA, 17 bp, Homo sapiens
atctctcaggagcacag

SEQ ID NO: 1650446 - DNA, 18 bp, Homo sapiens
atctctcaggagcacagg

SEQ ID NO: 1650447 - DNA, 21 bp, Homo sapiens
atctctcaggagcacaggcag

SEQ ID NO: 1650448 - DNA, 16 bp, Homo sapiens
atctctctacctccac

SEQ ID NO: 1650449 - DNA, 17 bp, Homo sapiens
atctctctacctccacc

SEQ ID NO: 1650450 - DNA, 15 bp, Homo sapiens
atctctctgcagctg

SEQ ID NO: 1650451 - DNA, 16 bp, Homo sapiens
atctctctgcagctgc

SEQ ID NO: 1650452 - DNA, 16 bp, Homo sapiens
atctctgaatgcccca

SEQ ID NO: 1650453 - DNA, 21 bp, Homo sapiens
atctctgattaaatttaatat

SEQ ID NO: 1650454 - DNA, 23 bp, Homo sapiens
atctctgcaccctggggcctgga

SEQ ID NO: 1650455 - DNA, 20 bp, Homo sapiens
atctctgccaacatgaggac

SEQ ID NO: 1650456 - DNA, 17 bp, Homo sapiens
atctctggaaaaataag

SEQ ID NO: 1650457 - DNA, 18 bp, Homo sapiens
atctctgtactttgcttg

SEQ ID NO: 1650458 - DNA, 20 bp, Homo sapiens
atctctgtagtggccccctc

SEQ ID NO: 1650459 - DNA, 13 bp, Homo sapiens
atctctgtgcctt

SEQ ID NO: 1650460 - DNA, 14 bp, Homo sapiens
atctctgtgccttc

SEQ ID NO: 1650461 - DNA, 15 bp, Homo sapiens
atctctgtgtgcaca

SEQ ID NO: 1650462 - DNA, 19 bp, Homo sapiens
atctctgtgtgcacaaata

SEQ ID NO: 1650463 - DNA, 21 bp, Homo sapiens
atctctgttctgtttggcact

SEQ ID NO: 1650464 - DNA, 23 bp, Homo sapiens
atctcttagctcccctccaacct

SEQ ID NO: 1650465 - DNA, 13 bp, Homo sapiens
atctcttcattat

SEQ ID NO: 1650466 - DNA, 12 bp, Homo sapiens
atctcttctgca

SEQ ID NO: 1650467 - DNA, 13 bp, Homo sapiens
atctcttgaaacc

SEQ ID NO: 1650468 - DNA, 13 bp, Homo sapiens
atctctttcacat

SEQ ID NO: 1650469 - DNA, 17 bp, Homo sapiens
atctctttcacattgtt

SEQ ID NO: 1650470 - DNA, 14 bp, Homo sapiens
atctctttcccttc

SEQ ID NO: 1650471 - DNA, 19 bp, Homo sapiens
atctcttttatatttgtag

SEQ ID NO: 1650472 - DNA, 23 bp, Homo sapiens
atctcttttccactccattgtcg

SEQ ID NO: 1650473 - DNA, 19 bp, Homo sapiens
atctgaaaaatacttttgg

SEQ ID NO: 1650474 - DNA, 14 bp, Homo sapiens
atctgaaaatgtat

SEQ ID NO: 1650475 - DNA, 19 bp, Homo sapiens
atctgaaaatgtatgtgta

SEQ ID NO: 1650476 - DNA, 20 bp, Homo sapiens
atctgaaaatgtatgtgtaa

SEQ ID NO: 1650477 - DNA, 22 bp, Homo sapiens
atctgaaaatgtatgtgtaagt

SEQ ID NO: 1650478 - DNA, 13 bp, Homo sapiens
atctgaaatgtga

SEQ ID NO: 1650479 - DNA, 18 bp, Homo sapiens
atctgaacacagtttagt

SEQ ID NO: 1650480 - DNA, 21 bp, Homo sapiens
atctgaataaagtgtaacaat

SEQ ID NO: 1650481 - DNA, 14 bp, Homo sapiens
atctgaatcccggg

SEQ ID NO: 1650482 - DNA, 11 bp, Homo sapiens
atctgaatttt

SEQ ID NO: 1650483 - DNA, 21 bp, Homo sapiens
atctgaattttgcaatgtatt

SEQ ID NO: 1650484 - DNA, 13 bp, Homo sapiens
atctgacacaaaa

SEQ ID NO: 1650485 - DNA, 22 bp, Homo sapiens
atctgacactaccttatcaggc

SEQ ID NO: 1650486 - DNA, 16 bp, Homo sapiens
atctgaccatctgtga

SEQ ID NO: 1650487 - DNA, 18 bp, Homo sapiens
atctgaccatctgtgact

SEQ ID NO: 1650488 - DNA, 19 bp, Homo sapiens
atctgaccatctgtgacta

SEQ ID NO: 1650489 - DNA, 20 bp, Homo sapiens
atctgaccatctgtgactat

SEQ ID NO: 1650490 - DNA, 18 bp, Homo sapiens
atctgacccactttgtaa

SEQ ID NO: 1650491 - DNA, 14 bp, Homo sapiens
atctgacccagtgc

SEQ ID NO: 1650492 - DNA, 18 bp, Homo sapiens
atctgacccagtgccccc

SEQ ID NO: 1650493 - DNA, 21 bp, Homo sapiens
atctgacccagtgcccccact

SEQ ID NO: 1650494 - DNA, 17 bp, Homo sapiens
atctgactatgacataa

SEQ ID NO: 1650495 - DNA, 17 bp, Homo sapiens
atctgactgccaaataa

SEQ ID NO: 1650496 - DNA, 19 bp, Homo sapiens
atctgactgccaagccaga

SEQ ID NO: 1650497 - DNA, 20 bp, Homo sapiens
atctgagagacctgtgtgaa

SEQ ID NO: 1650498 - DNA, 22 bp, Homo sapiens
atctgagattgtgtttgttcat

SEQ ID NO: 1650499 - DNA, 12 bp, Homo sapiens
atctgagcaagg

SEQ ID NO: 1650500 - DNA, 19 bp, Homo sapiens
atctgagctcccacctccc

SEQ ID NO: 1650501 - DNA, 23 bp, Homo sapiens
atctgagctcccacctcccttcc

SEQ ID NO: 1650502 - DNA, 22 bp, Homo sapiens
atctgaggaatcaacagggcag

SEQ ID NO: 1650503 - DNA, 14 bp, Homo sapiens
atctgagggaggag

SEQ ID NO: 1650504 - DNA, 16 bp, Homo sapiens
atctgagggaggaggc

SEQ ID NO: 1650505 - DNA, 19 bp, Homo sapiens
atctgagggaggaggccac

SEQ ID NO: 1650506 - DNA, 20 bp, Homo sapiens
atctgagggaggaggccacc

SEQ ID NO: 1650507 - DNA, 21 bp, Homo sapiens
atctgagggaggaggccacct

SEQ ID NO: 1650508 - DNA, 22 bp, Homo sapiens
atctgagggaggaggccacctc

SEQ ID NO: 1650509 - DNA, 16 bp, Homo sapiens
atctgaggttggattt

SEQ ID NO: 1650510 - DNA, 19 bp, Homo sapiens
atctgatggccttaatttc

SEQ ID NO: 1650511 - DNA, 21 bp, Homo sapiens
atctgatggccttaatttcct

SEQ ID NO: 1650512 - DNA, 23 bp, Homo sapiens
atctgatggccttaatttccttt

SEQ ID NO: 1650513 - DNA, 13 bp, Homo sapiens
atctgatgtttca

SEQ ID NO: 1650514 - DNA, 11 bp, Homo sapiens
atctgatttac

SEQ ID NO: 1650515 - DNA, 14 bp, Homo sapiens
atctgatttactta

SEQ ID NO: 1650516 - DNA, 16 bp, Homo sapiens
atctgcaaacaatgaa

SEQ ID NO: 1650517 - DNA, 18 bp, Homo sapiens
atctgcaaatagtttcaa

SEQ ID NO: 1650518 - DNA, 12 bp, Homo sapiens
atctgcacagtc

SEQ ID NO: 1650519 - DNA, 18 bp, Homo sapiens
atctgcacagtcagaagg

SEQ ID NO: 1650520 - DNA, 10 bp, Homo sapiens
atctgcaccc

SEQ ID NO: 1650521 - DNA, 13 bp, Homo sapiens
atctgcaggctgc

SEQ ID NO: 1650522 - DNA, 15 bp, Homo sapiens
atctgcatgtctact

SEQ ID NO: 1650523 - DNA, 23 bp, Homo sapiens
atctgcattttcaccccaccctt

SEQ ID NO: 1650524 - DNA, 19 bp, Homo sapiens
atctgccaagagagatgta

SEQ ID NO: 1650525 - DNA, 15 bp, Homo sapiens
atctgccacaaaaac

SEQ ID NO: 1650526 - DNA, 23 bp, Homo sapiens
atctgcccacctcagcctcccaa

SEQ ID NO: 1650527 - DNA, 21 bp, Homo sapiens
atctgcccaggggtgccccct

SEQ ID NO: 1650528 - DNA, 15 bp, Homo sapiens
atctgcccctccccc

SEQ ID NO: 1650529 - DNA, 15 bp, Homo sapiens
atctgcctggcctgg

SEQ ID NO: 1650530 - DNA, 16 bp, Homo sapiens
atctgcctggcctggc

SEQ ID NO: 1650531 - DNA, 18 bp, Homo sapiens
atctgcctggcctggctc

SEQ ID NO: 1650532 - DNA, 23 bp, Homo sapiens
atctgcctggcctggctccccac

SEQ ID NO: 1650533 - DNA, 11 bp, Homo sapiens
atctgcctggg

SEQ ID NO: 1650534 - DNA, 15 bp, Homo sapiens
atctgcctgggcctg

SEQ ID NO: 1650535 - DNA, 20 bp, Homo sapiens
atctgcctgggcctgtgcag

SEQ ID NO: 1650536 - DNA, 15 bp, Homo sapiens
atctgcctgtggcct

SEQ ID NO: 1650537 - DNA, 20 bp, Homo sapiens
atctgcctgtggccttgccc

SEQ ID NO: 1650538 - DNA, 18 bp, Homo sapiens
atctgccttaaaaccaaa

SEQ ID NO: 1650539 - DNA, 18 bp, Homo sapiens
atgactgtttttgtagtg

SEQ ID NO: 1650540 - DNA, 20 bp, Homo sapiens
atgacttagcgtcaagacat

SEQ ID NO: 1650541 - DNA, 23 bp, Homo sapiens
atgacttagcgtcaagacatttg

SEQ ID NO: 1650542 - DNA, 19 bp, Homo sapiens
atgacttatttctgctctg

SEQ ID NO: 1650543 - DNA, 19 bp, Homo sapiens
atgacttccccaatatctt

SEQ ID NO: 1650544 - DNA, 16 bp, Homo sapiens
atgacttccctgctcc

SEQ ID NO: 1650545 - DNA, 14 bp, Homo sapiens
atgactttatgtat

SEQ ID NO: 1650546 - DNA, 14 bp, Homo sapiens
atgacttttcttaa

SEQ ID NO: 1650547 - DNA, 13 bp, Homo sapiens
atgactttttata

SEQ ID NO: 1650548 - DNA, 15 bp, Homo sapiens
atgactttttataaa

SEQ ID NO: 1650549 - DNA, 11 bp, Homo sapiens
atgagaaagga

SEQ ID NO: 1650550 - DNA, 17 bp, Homo sapiens
atgagaaaggacagagc

SEQ ID NO: 1650551 - DNA, 20 bp, Homo sapiens
atgagaaaggacagagccag

SEQ ID NO: 1650552 - DNA, 18 bp, Homo sapiens
atgagaacagataaagat

SEQ ID NO: 1650553 - DNA, 22 bp, Homo sapiens
atgagaacagataaagattgtg

SEQ ID NO: 1650554 - DNA, 18 bp, Homo sapiens
atgagaagaaaaatggaa

SEQ ID NO: 1650555 - DNA, 13 bp, Homo sapiens
atgagaagccaag

SEQ ID NO: 1650556 - DNA, 22 bp, Homo sapiens
atgagagcaaatgcaaaaataa

SEQ ID NO: 1650557 - DNA, 16 bp, Homo sapiens
atgagagcgacacaga

SEQ ID NO: 1650558 - DNA, 15 bp, Homo sapiens
atgagagttccttct

SEQ ID NO: 1650559 - DNA, 17 bp, Homo sapiens
atgagataatatgagat

SEQ ID NO: 1650560 - DNA, 14 bp, Homo sapiens
atgagatacactga

SEQ ID NO: 1650561 - DNA, 19 bp, Homo sapiens
atgagatcccgcctcttct

SEQ ID NO: 1650562 - DNA, 13 bp, Homo sapiens
atgagatggttaa

SEQ ID NO: 1650563 - DNA, 20 bp, Homo sapiens
atgagatgttattactgttt

SEQ ID NO: 1650564 - DNA, 19 bp, Homo sapiens
atgagatttgccagcacag

SEQ ID NO: 1650565 - DNA, 16 bp, Homo sapiens
atgagcagtcacactg

SEQ ID NO: 1650566 - DNA, 17 bp, Homo sapiens
atgagcagtcacactgt

SEQ ID NO: 1650567 - DNA, 21 bp, Homo sapiens
atgagccaccgcgcccagcct

SEQ ID NO: 1650568 - DNA, 11 bp, Homo sapiens
atgagccagac

SEQ ID NO: 1650569 - DNA, 23 bp, Homo sapiens
atgagccagtgattattcttgtt

SEQ ID NO: 1650570 - DNA, 17 bp, Homo sapiens
atgagccatccccaggg

SEQ ID NO: 1650571 - DNA, 12 bp, Homo sapiens
atgagcctgctg

SEQ ID NO: 1650572 - DNA, 14 bp, Homo sapiens
atgagcctgctgga

SEQ ID NO: 1650573 - DNA, 17 bp, Homo sapiens
atgagcctgctggaagc

SEQ ID NO: 1650574 - DNA, 14 bp, Homo sapiens
atgagcgccacctc

SEQ ID NO: 1650575 - DNA, 15 bp, Homo sapiens
atgagctatgtatta

SEQ ID NO: 1650576 - DNA, 12 bp, Homo sapiens
atgagctcctgc

SEQ ID NO: 1650577 - DNA, 21 bp, Homo sapiens
atgagctcgcatttgtcaatg

SEQ ID NO: 1650578 - DNA, 22 bp, Homo sapiens
atgagctcgcatttgtcaatga

SEQ ID NO: 1650579 - DNA, 17 bp, Homo sapiens
atgagctctgaaatctt

SEQ ID NO: 1650580 - DNA, 13 bp, Homo sapiens
atgagctggaagg

SEQ ID NO: 1650581 - DNA, 23 bp, Homo sapiens
atgagctggcaaccagccagcgt

SEQ ID NO: 1650582 - DNA, 19 bp, Homo sapiens
atgagcttcaatataagaa

SEQ ID NO: 1650583 - DNA, 22 bp, Homo sapiens
atgagcttcaatataagaagca

SEQ ID NO: 1650584 - DNA, 22 bp, Homo sapiens
atgaggaaaaaatggtataaaa

SEQ ID NO: 1650585 - DNA, 19 bp, Homo sapiens
atgaggaaaattcttaaaa

SEQ ID NO: 1650586 - DNA, 21 bp, Homo sapiens
atgaggaaaattcttaaaagg

SEQ ID NO: 1650587 - DNA, 19 bp, Homo sapiens
atgaggaagcaaagagtga

SEQ ID NO: 1650588 - DNA, 17 bp, Homo sapiens
atgaggaatccaaaaga

SEQ ID NO: 1650589 - DNA, 14 bp, Homo sapiens
atgaggagcgtgga

SEQ ID NO: 1650590 - DNA, 15 bp, Homo sapiens
atgaggaggggaggg

SEQ ID NO: 1650591 - DNA, 17 bp, Homo sapiens
atgaggaggggagggta

SEQ ID NO: 1650592 - DNA, 14 bp, Homo sapiens
atgaggagggtggg

SEQ ID NO: 1650593 - DNA, 23 bp, Homo sapiens
atgaggatccgaaacggcagcct

SEQ ID NO: 1650594 - DNA, 14 bp, Homo sapiens
atgaggcaaacagc

SEQ ID NO: 1650595 - DNA, 15 bp, Homo sapiens
atgaggcaaacagca

SEQ ID NO: 1650596 - DNA, 21 bp, Homo sapiens
atgaggcaatgtcaggaacag

SEQ ID NO: 1650597 - DNA, 15 bp, Homo sapiens
atgaggccgctagag

SEQ ID NO: 1650598 - DNA, 21 bp, Homo sapiens
atgaggccgctagaggcctga

SEQ ID NO: 1650599 - DNA, 23 bp, Homo sapiens
atgagggaaatctgtaaagccag

SEQ ID NO: 1650600 - DNA, 12 bp, Homo sapiens
atgaggggagag

SEQ ID NO: 1650601 - DNA, 13 bp, Homo sapiens
atgagggggtggt

SEQ ID NO: 1650602 - DNA, 18 bp, Homo sapiens
atgaggtcaccaggggag

SEQ ID NO: 1650603 - DNA, 14 bp, Homo sapiens
atgaggtcccaggc

SEQ ID NO: 1650604 - DNA, 16 bp, Homo sapiens
atgaggtcccaggcag

SEQ ID NO: 1650605 - DNA, 13 bp, Homo sapiens
atgaggtgggagg

SEQ ID NO: 1650606 - DNA, 22 bp, Homo sapiens
atgaggttcaactgttgattgc

SEQ ID NO: 1650607 - DNA, 17 bp, Homo sapiens
atgagtaaaaactagaa

SEQ ID NO: 1650608 - DNA, 19 bp, Homo sapiens
atgagtaaaaactagaagg

SEQ ID NO: 1650609 - DNA, 24 bp, Homo sapiens
atgagtagatactctcagcaccaa

SEQ ID NO: 1650610 - DNA, 23 bp, Homo sapiens
atgagtatttggtccaaaaaaag

SEQ ID NO: 1650611 - DNA, 14 bp, Homo sapiens
atgagtcaaaacaa

SEQ ID NO: 1650612 - DNA, 19 bp, Homo sapiens
atgagtgattgacacacag

SEQ ID NO: 1650613 - DNA, 22 bp, Homo sapiens
atgagtgattgacacacagcac

SEQ ID NO: 1650614 - DNA, 23 bp, Homo sapiens
atgagtgattgacacacagcact

SEQ ID NO: 1650615 - DNA, 19 bp, Homo sapiens
atgagtgcaggtttctatt

SEQ ID NO: 1650616 - DNA, 21 bp, Homo sapiens
atgagtggaaattaagacttt

SEQ ID NO: 1650617 - DNA, 19 bp, Homo sapiens
atgagtgtctggagcgctt

SEQ ID NO: 1650618 - DNA, 14 bp, Homo sapiens
atgagttggacttc

SEQ ID NO: 1650619 - DNA, 18 bp, Homo sapiens
atgagttggacttcagtc

SEQ ID NO: 1650620 - DNA, 20 bp, Homo sapiens
atgagttgttttcagactca

SEQ ID NO: 1650621 - DNA, 23 bp, Homo sapiens
atgagttgttttcagactcagac

SEQ ID NO: 1650622 - DNA, 13 bp, Homo sapiens
atgagtttcactg

SEQ ID NO: 1650623 - DNA, 16 bp, Homo sapiens
atgagtttcactgtac

SEQ ID NO: 1650624 - DNA, 14 bp, Homo sapiens
atgagtttcttaga

SEQ ID NO: 1650625 - DNA, 20 bp, Homo sapiens
atgagttttgggaagttaaa

SEQ ID NO: 1650626 - DNA, 19 bp, Homo sapiens
atgagtttttgatagcttt

SEQ ID NO: 1650627 - DNA, 20 bp, Homo sapiens
atgagtttttgatagcttta

SEQ ID NO: 1650628 - DNA, 16 bp, Homo sapiens
atgataaactcagatc

SEQ ID NO: 1650629 - DNA, 22 bp, Homo sapiens
atgataaactcagatctgatca

SEQ ID NO: 1650630 - DNA, 20 bp, Homo sapiens
atgataagttcctttccttt

SEQ ID NO: 1650631 - DNA, 17 bp, Homo sapiens
atgatacaagattagaa

SEQ ID NO: 1650632 - DNA, 20 bp, Homo sapiens
atgataccacctttactgtg

SEQ ID NO: 1650633 - DNA, 22 bp, Homo sapiens
atgatagaactgtactgttttc

SEQ ID NO: 1650634 - DNA, 13 bp, Homo sapiens
atgatagttttct

SEQ ID NO: 1650635 - DNA, 21 bp, Homo sapiens
atgatagttttctagatgaca

SEQ ID NO: 1650636 - DNA, 12 bp, Homo sapiens
atgatatttctt

SEQ ID NO: 1650637 - DNA, 13 bp, Homo sapiens
atgatcaaaacat

SEQ ID NO: 1650638 - DNA, 19 bp, Homo sapiens
atgatcaaaacctgtgcca

SEQ ID NO: 1650639 - DNA, 18 bp, Homo sapiens
atgatcacagtgacttta

SEQ ID NO: 1650640 - DNA, 18 bp, Homo sapiens
atgatcagacatacagct

SEQ ID NO: 1650641 - DNA, 17 bp, Homo sapiens
atgatcaggtaactttc

SEQ ID NO: 1650642 - DNA, 21 bp, Homo sapiens
atgatccaactaatgccttac

SEQ ID NO: 1650643 - DNA, 15 bp, Homo sapiens
atgatccagaacagt

SEQ ID NO: 1650644 - DNA, 16 bp, Homo sapiens
atgatccagaacagtg

SEQ ID NO: 1650645 - DNA, 21 bp, Homo sapiens
atgatccagaacagtggctcg

SEQ ID NO: 1650646 - DNA, 13 bp, Homo sapiens
atgatccctgtgt

SEQ ID NO: 1650647 - DNA, 13 bp, Homo sapiens
atgatcctcaagg

SEQ ID NO: 1650648 - DNA, 12 bp, Homo sapiens
atgatcctccca

SEQ ID NO: 1650649 - DNA, 13 bp, Homo sapiens
atgatcctcccac

SEQ ID NO: 1650650 - DNA, 16 bp, Homo sapiens
atgatctaataaactt

SEQ ID NO: 1650651 - DNA, 19 bp, Homo sapiens
atgatctaataaactttat

SEQ ID NO: 1650652 - DNA, 18 bp, Homo sapiens
atgatctactcagaaatt

SEQ ID NO: 1650653 - DNA, 22 bp, Homo sapiens
atgatctcggatgaccaaacca

SEQ ID NO: 1650654 - DNA, 17 bp, Homo sapiens
atgcccaccccctgccc

SEQ ID NO: 1650655 - DNA, 19 bp, Homo sapiens
atgcccaccccctgccctg

SEQ ID NO: 1650656 - DNA, 20 bp, Homo sapiens
atgcccagagggcccaggca

SEQ ID NO: 1650657 - DNA, 21 bp, Homo sapiens
atgcccagagggcccaggcag

SEQ ID NO: 1650658 - DNA, 15 bp, Homo sapiens
atgcccagctaattt

SEQ ID NO: 1650659 - DNA, 16 bp, Homo sapiens
atgcccagctctctga

SEQ ID NO: 1650660 - DNA, 18 bp, Homo sapiens
atgcccagctctctgacg

SEQ ID NO: 1650661 - DNA, 13 bp, Homo sapiens
atgccccaaagtt

SEQ ID NO: 1650662 - DNA, 14 bp, Homo sapiens
atgccccagctctg

SEQ ID NO: 1650663 - DNA, 15 bp, Homo sapiens
atgccccagctctgg

SEQ ID NO: 1650664 - DNA, 18 bp, Homo sapiens
atgccccaggatcactct

SEQ ID NO: 1650665 - DNA, 17 bp, Homo sapiens
atgccccctccaggaga

SEQ ID NO: 1650666 - DNA, 18 bp, Homo sapiens
atgccccctttcagatgt

SEQ ID NO: 1650667 - DNA, 21 bp, Homo sapiens
atgcccctgcagtttggccct

SEQ ID NO: 1650668 - DNA, 23 bp, Homo sapiens
atgcccctgcagtttggccctgg

SEQ ID NO: 1650669 - DNA, 19 bp, Homo sapiens
atgccctccactccactgc

SEQ ID NO: 1650670 - DNA, 21 bp, Homo sapiens
atgccctgccttgtccctctc

SEQ ID NO: 1650671 - DNA, 15 bp, Homo sapiens
atgccgcagggaggg

SEQ ID NO: 1650672 - DNA, 19 bp, Homo sapiens
atgccgcagggagggctgt

SEQ ID NO: 1650673 - DNA, 20 bp, Homo sapiens
atgccgcagggagggctgtg

SEQ ID NO: 1650674 - DNA, 15 bp, Homo sapiens
atgccgctgtctctg

SEQ ID NO: 1650675 - DNA, 20 bp, Homo sapiens
atgccggtgagaataagaga

SEQ ID NO: 1650676 - DNA, 16 bp, Homo sapiens
atgccgtcttctgccc

SEQ ID NO: 1650677 - DNA, 15 bp, Homo sapiens
atgccgttctgttcc

SEQ ID NO: 1650678 - DNA, 14 bp, Homo sapiens
atgcctacagctgt

SEQ ID NO: 1650679 - DNA, 22 bp, Homo sapiens
atgcctcaattcacatagattt

SEQ ID NO: 1650680 - DNA, 15 bp, Homo sapiens
atgcctcactaattt

SEQ ID NO: 1650681 - DNA, 16 bp, Homo sapiens
atgcctcactaatttt

SEQ ID NO: 1650682 - DNA, 20 bp, Homo sapiens
atgcctcactaatttttgta

SEQ ID NO: 1650683 - DNA, 21 bp, Homo sapiens
atgcctcactaatttttgtat

SEQ ID NO: 1650684 - DNA, 21 bp, Homo sapiens
atgcctccaccgctgcctaag

SEQ ID NO: 1650685 - DNA, 12 bp, Homo sapiens
atgcctccccaa

SEQ ID NO: 1650686 - DNA, 13 bp, Homo sapiens
atgcctccccaag

SEQ ID NO: 1650687 - DNA, 13 bp, Homo sapiens
atgcctccttggc

SEQ ID NO: 1650688 - DNA, 15 bp, Homo sapiens
atgcctccttggcca

SEQ ID NO: 1650689 - DNA, 20 bp, Homo sapiens
atgcctctcccgcaccaggc

SEQ ID NO: 1650690 - DNA, 20 bp, Homo sapiens
atgcctctgacagtccacag

SEQ ID NO: 1650691 - DNA, 12 bp, Homo sapiens
atgcctgagggt

SEQ ID NO: 1650692 - DNA, 15 bp, Homo sapiens
atgcctgagggtgga

SEQ ID NO: 1650693 - DNA, 20 bp, Homo sapiens
atgcctgagttataaatatt

SEQ ID NO: 1650694 - DNA, 21 bp, Homo sapiens
atgcctgagttataaatattt

SEQ ID NO: 1650695 - DNA, 21 bp, Homo sapiens
atgcctgattcggacggccaa

SEQ ID NO: 1650696 - DNA, 19 bp, Homo sapiens
atgcctgcatgctgaaaca

SEQ ID NO: 1650697 - DNA, 22 bp, Homo sapiens
atgcctgcccgcaccctggcct

SEQ ID NO: 1650698 - DNA, 15 bp, Homo sapiens
atgcctgctccctgt

SEQ ID NO: 1650699 - DNA, 20 bp, Homo sapiens
atgcctgctccctgtctgtg

SEQ ID NO: 1650700 - DNA, 23 bp, Homo sapiens
atgcctgctttttggaaagtcag

SEQ ID NO: 1650701 - DNA, 14 bp, Homo sapiens
atgcctggtatttt

SEQ ID NO: 1650702 - DNA, 16 bp, Homo sapiens
atgcctgtaatcccag

SEQ ID NO: 1650703 - DNA, 20 bp, Homo sapiens
atgcctgtaatcccagaact

SEQ ID NO: 1650704 - DNA, 20 bp, Homo sapiens
atgcctgtagctttcctggt

SEQ ID NO: 1650705 - DNA, 19 bp, Homo sapiens
atgcctgtagtctcagcta

SEQ ID NO: 1650706 - DNA, 17 bp, Homo sapiens
atgcctgtatttccaac

SEQ ID NO: 1650707 - DNA, 19 bp, Homo sapiens
atgcctgtatttccaacaa

SEQ ID NO: 1650708 - DNA, 13 bp, Homo sapiens
atgcctgtctctg

SEQ ID NO: 1650709 - DNA, 21 bp, Homo sapiens
atgcctgtctctgttcagatg

SEQ ID NO: 1650710 - DNA, 12 bp, Homo sapiens
atgcctgtgcca

SEQ ID NO: 1650711 - DNA, 24 bp, Homo sapiens
atgccttggtttttactgctctga

SEQ ID NO: 1650712 - DNA, 17 bp, Homo sapiens
atgcctttaaagtatga

SEQ ID NO: 1650713 - DNA, 21 bp, Homo sapiens
atgcctttaaagtatgaatct

SEQ ID NO: 1650714 - DNA, 20 bp, Homo sapiens
atgcctttaaatctgtgatg

SEQ ID NO: 1650715 - DNA, 13 bp, Homo sapiens
atgccttttctgt

SEQ ID NO: 1650716 - DNA, 15 bp, Homo sapiens
atgccttttgaatac

SEQ ID NO: 1650717 - DNA, 23 bp, Homo sapiens
atgccttttgaatacatttgtat

SEQ ID NO: 1650718 - DNA, 22 bp, Homo sapiens
atgcctttttagatgtattttt

SEQ ID NO: 1650719 - DNA, 18 bp, Homo sapiens
atgcgccccctccgccct

SEQ ID NO: 1650720 - DNA, 15 bp, Homo sapiens
atgcgctcagggcca

SEQ ID NO: 1650721 - DNA, 23 bp, Homo sapiens
atgcgctcagggccatgctgagg

SEQ ID NO: 1650722 - DNA, 19 bp, Homo sapiens
atgcggccgcattccctga

SEQ ID NO: 1650723 - DNA, 15 bp, Homo sapiens
atgcgggctcgccca

SEQ ID NO: 1650724 - DNA, 18 bp, Homo sapiens
atgcgtatatgtgcgtct

SEQ ID NO: 1650725 - DNA, 19 bp, Homo sapiens
atgcgtcccaagatgttga

SEQ ID NO: 1650726 - DNA, 19 bp, Homo sapiens
atgcgtgcccttttcatat

SEQ ID NO: 1650727 - DNA, 19 bp, Homo sapiens
atgcgtgccgcctgctcct

SEQ ID NO: 1650728 - DNA, 16 bp, Homo sapiens
atgcgtgtttctgact

SEQ ID NO: 1650729 - DNA, 12 bp, Homo sapiens
atgctaaacctt

SEQ ID NO: 1650730 - DNA, 17 bp, Homo sapiens
atgctaaacctttgagt

SEQ ID NO: 1650731 - DNA, 14 bp, Homo sapiens
atgctaaactgtga

SEQ ID NO: 1650732 - DNA, 20 bp, Homo sapiens
atgctaaagatgatgatgtt

SEQ ID NO: 1650733 - DNA, 19 bp, Homo sapiens
atgctaagaaatgctgaaa

SEQ ID NO: 1650734 - DNA, 13 bp, Homo sapiens
atgctaagctgat

SEQ ID NO: 1650735 - DNA, 23 bp, Homo sapiens
atgctaatgtaatcatttatctt

SEQ ID NO: 1650736 - DNA, 16 bp, Homo sapiens
atgctaatttaaagag

SEQ ID NO: 1650737 - DNA, 17 bp, Homo sapiens
atgctaatttaaagaga

SEQ ID NO: 1650738 - DNA, 18 bp, Homo sapiens
atgctaatttaaagagac

SEQ ID NO: 1650739 - DNA, 16 bp, Homo sapiens
atgctaccaggatgct

SEQ ID NO: 1650740 - DNA, 19 bp, Homo sapiens
atgctaccaggatgctaaa

SEQ ID NO: 1650741 - DNA, 23 bp, Homo sapiens
atgctaccaggatgctaaagatg

SEQ ID NO: 1650742 - DNA, 19 bp, Homo sapiens
atgctaccccactatgaca

SEQ ID NO: 1650743 - DNA, 14 bp, Homo sapiens
atgctaccggggac

SEQ ID NO: 1650744 - DNA, 20 bp, Homo sapiens
atgctactgtctcactgaaa

SEQ ID NO: 1650745 - DNA, 19 bp, Homo sapiens
atgctagaaaaatgttctt

SEQ ID NO: 1650746 - DNA, 18 bp, Homo sapiens
atgctaggttaattccaa

SEQ ID NO: 1650747 - DNA, 12 bp, Homo sapiens
atgctagtttat

SEQ ID NO: 1650748 - DNA, 18 bp, Homo sapiens
atgctatatatcttttgt

SEQ ID NO: 1650749 - DNA, 13 bp, Homo sapiens
atgctatctctgt

SEQ ID NO: 1650750 - DNA, 20 bp, Homo sapiens
atgctatgagttttctcctt

SEQ ID NO: 1650751 - DNA, 21 bp, Homo sapiens
atgctatggaacataaagttg

SEQ ID NO: 1650752 - DNA, 19 bp, Homo sapiens
atgctattgttgtgggctt

SEQ ID NO: 1650753 - DNA, 12 bp, Homo sapiens
atgctatttctg

SEQ ID NO: 1650754 - DNA, 14 bp, Homo sapiens
atgctatttggaca

SEQ ID NO: 1650755 - DNA, 14 bp, Homo sapiens
atgctcagagcttt

SEQ ID NO: 1650756 - DNA, 16 bp, Homo sapiens
atgctcagccttgctg

SEQ ID NO: 1650757 - DNA, 18 bp, Homo sapiens
atgctcagccttgctgct

SEQ ID NO: 1650758 - DNA, 20 bp, Homo sapiens
atgctcagccttgctgctct

SEQ ID NO: 1650759 - DNA, 17 bp, Homo sapiens
atgctcagggtcactga

SEQ ID NO: 1650760 - DNA, 19 bp, Homo sapiens
atgctcagggtcactgaac

SEQ ID NO: 1650761 - DNA, 21 bp, Homo sapiens
atgctcagggtcactgaacca

SEQ ID NO: 1650762 - DNA, 16 bp, Homo sapiens
atgctcatctgctggt

SEQ ID NO: 1650763 - DNA, 16 bp, Homo sapiens
atgctcattttctggt

SEQ ID NO: 1650764 - DNA, 16 bp, Homo sapiens
atgctccaagattcta

SEQ ID NO: 1650765 - DNA, 22 bp, Homo sapiens
atgctccagattagagcctgta

SEQ ID NO: 1650766 - DNA, 13 bp, Homo sapiens
atgctccagtcaa

SEQ ID NO: 1650767 - DNA, 21 bp, Homo sapiens
atgctcccatctcctgatttc

SEQ ID NO: 1650768 - DNA, 22 bp, Homo sapiens
atggcaccagccccctggatgg

SEQ ID NO: 1650769 - DNA, 21 bp, Homo sapiens
atggcagaaaaaatgtctgta

SEQ ID NO: 1650770 - DNA, 20 bp, Homo sapiens
atggcagaaagggggcatct

SEQ ID NO: 1650771 - DNA, 12 bp, Homo sapiens
atggcagaaggg

SEQ ID NO: 1650772 - DNA, 12 bp, Homo sapiens
atggcagagcca

SEQ ID NO: 1650773 - DNA, 22 bp, Homo sapiens
atggcagagccaggctgttgga

SEQ ID NO: 1650774 - DNA, 19 bp, Homo sapiens
atggcagaggaatatcaat

SEQ ID NO: 1650775 - DNA, 14 bp, Homo sapiens
atggcagcagccag

SEQ ID NO: 1650776 - DNA, 15 bp, Homo sapiens
atggcagcagccagg

SEQ ID NO: 1650777 - DNA, 24 bp, Homo sapiens
atggcagggggtggaattattact

SEQ ID NO: 1650778 - DNA, 15 bp, Homo sapiens
atggcaggtgtcata

SEQ ID NO: 1650779 - DNA, 16 bp, Homo sapiens
atggcaggtgtcatat

SEQ ID NO: 1650780 - DNA, 16 bp, Homo sapiens
atggcagtccagccag

SEQ ID NO: 1650781 - DNA, 21 bp, Homo sapiens
atggcagtccagccagctcct

SEQ ID NO: 1650782 - DNA, 14 bp, Homo sapiens
atggcagtcctgga

SEQ ID NO: 1650783 - DNA, 15 bp, Homo sapiens
atggcagtcctggag

SEQ ID NO: 1650784 - DNA, 21 bp, Homo sapiens
atggcatagccccggcccccc

SEQ ID NO: 1650785 - DNA, 21 bp, Homo sapiens
atggcatatttttcacatatc

SEQ ID NO: 1650786 - DNA, 22 bp, Homo sapiens
atggcatatttttcacatatct

SEQ ID NO: 1650787 - DNA, 19 bp, Homo sapiens
atggcatttggtctcaggc

SEQ ID NO: 1650788 - DNA, 15 bp, Homo sapiens
atggccaagagcatc

SEQ ID NO: 1650789 - DNA, 20 bp, Homo sapiens
atggccaccccgtgccaccc

SEQ ID NO: 1650790 - DNA, 16 bp, Homo sapiens
atggccaggtggccac

SEQ ID NO: 1650791 - DNA, 22 bp, Homo sapiens
atggccaggtggccactccaga

SEQ ID NO: 1650792 - DNA, 18 bp, Homo sapiens
atggccatagaggcccag

SEQ ID NO: 1650793 - DNA, 10 bp, Homo sapiens
atggccatgc

SEQ ID NO: 1650794 - DNA, 19 bp, Homo sapiens
atggcccaaaatgaccaac

SEQ ID NO: 1650795 - DNA, 14 bp, Homo sapiens
atggcccagtgtca

SEQ ID NO: 1650796 - DNA, 14 bp, Homo sapiens
atggccccagcaca

SEQ ID NO: 1650797 - DNA, 16 bp, Homo sapiens
atggcccccaataaag

SEQ ID NO: 1650798 - DNA, 19 bp, Homo sapiens
atggcccccaataaaggca

SEQ ID NO: 1650799 - DNA, 20 bp, Homo sapiens
atggcccccaataaaggcag

SEQ ID NO: 1650800 - DNA, 15 bp, Homo sapiens
atggcccctccagca

SEQ ID NO: 1650801 - DNA, 16 bp, Homo sapiens
atggcccctccagcac

SEQ ID NO: 1650802 - DNA, 11 bp, Homo sapiens
atggcccctct

SEQ ID NO: 1650803 - DNA, 23 bp, Homo sapiens
atggcccctctgacctgcactgg

SEQ ID NO: 1650804 - DNA, 23 bp, Homo sapiens
atggccctcggaggtccagctgg

SEQ ID NO: 1650805 - DNA, 16 bp, Homo sapiens
atggccgggccctctg

SEQ ID NO: 1650806 - DNA, 16 bp, Homo sapiens
atggccgggctgctgc

SEQ ID NO: 1650807 - DNA, 18 bp, Homo sapiens
atggccgggctgctgctg

SEQ ID NO: 1650808 - DNA, 13 bp, Homo sapiens
atggcctcagctg

SEQ ID NO: 1650809 - DNA, 14 bp, Homo sapiens
atggcctcagctgc

SEQ ID NO: 1650810 - DNA, 15 bp, Homo sapiens
atggcctcagctgcc

SEQ ID NO: 1650811 - DNA, 16 bp, Homo sapiens
atggcctcagctgcct

SEQ ID NO: 1650812 - DNA, 21 bp, Homo sapiens
atggcctcagctgcctcactt

SEQ ID NO: 1650813 - DNA, 13 bp, Homo sapiens
atggcctcatgtg

SEQ ID NO: 1650814 - DNA, 18 bp, Homo sapiens
atggcctcatgtggctgg

SEQ ID NO: 1650815 - DNA, 22 bp, Homo sapiens
atggcctggattcacgccctct

SEQ ID NO: 1650816 - DNA, 18 bp, Homo sapiens
atggccttaatttccttt

SEQ ID NO: 1650817 - DNA, 18 bp, Homo sapiens
atggcctttgataaatgt

SEQ ID NO: 1650818 - DNA, 13 bp, Homo sapiens
atggcctttgctt

SEQ ID NO: 1650819 - DNA, 18 bp, Homo sapiens
atggcgattccctctcac

SEQ ID NO: 1650820 - DNA, 19 bp, Homo sapiens
atggcgctattgcactcca

SEQ ID NO: 1650821 - DNA, 21 bp, Homo sapiens
atggcgtaatgggcctgccca

SEQ ID NO: 1650822 - DNA, 13 bp, Homo sapiens
atggcgtctgctc

SEQ ID NO: 1650823 - DNA, 17 bp, Homo sapiens
atggcgtctgctctggt

SEQ ID NO: 1650824 - DNA, 19 bp, Homo sapiens
atggcgtctgctctggtgg

SEQ ID NO: 1650825 - DNA, 23 bp, Homo sapiens
atggctaacctgttacactgggc

SEQ ID NO: 1650826 - DNA, 15 bp, Homo sapiens
atggctaataaactg

SEQ ID NO: 1650827 - DNA, 16 bp, Homo sapiens
atggctaataaactgt

SEQ ID NO: 1650828 - DNA, 17 bp, Homo sapiens
atggctaataaactgta

SEQ ID NO: 1650829 - DNA, 15 bp, Homo sapiens
atggctataaatata

SEQ ID NO: 1650830 - DNA, 21 bp, Homo sapiens
atggctataaatatataaaaa

SEQ ID NO: 1650831 - DNA, 19 bp, Homo sapiens
atggctatttttgaagcaa

SEQ ID NO: 1650832 - DNA, 17 bp, Homo sapiens
atggctcccacaggagt

SEQ ID NO: 1650833 - DNA, 18 bp, Homo sapiens
atggctcctgtctggctc

SEQ ID NO: 1650834 - DNA, 23 bp, Homo sapiens
atggctgaagctggagcagcgga

SEQ ID NO: 1650835 - DNA, 15 bp, Homo sapiens
atggctgctagattt

SEQ ID NO: 1650836 - DNA, 15 bp, Homo sapiens
atggctgctgttgct

SEQ ID NO: 1650837 - DNA, 12 bp, Homo sapiens
atggctggcctg

SEQ ID NO: 1650838 - DNA, 13 bp, Homo sapiens
atggctggcctgg

SEQ ID NO: 1650839 - DNA, 18 bp, Homo sapiens
atggctggcctggtaagg

SEQ ID NO: 1650840 - DNA, 17 bp, Homo sapiens
atggctggggccgctgg

SEQ ID NO: 1650841 - DNA, 19 bp, Homo sapiens
atggctgtatttgctgttg

SEQ ID NO: 1650842 - DNA, 14 bp, Homo sapiens
atggcttaatctta

SEQ ID NO: 1650843 - DNA, 21 bp, Homo sapiens
atggcttaatgtttattcctg

SEQ ID NO: 1650844 - DNA, 22 bp, Homo sapiens
atggcttatttctatgacaaat

SEQ ID NO: 1650845 - DNA, 13 bp, Homo sapiens
atggcttgtctat

SEQ ID NO: 1650846 - DNA, 21 bp, Homo sapiens
atggcttttcttacccagatt

SEQ ID NO: 1650847 - DNA, 13 bp, Homo sapiens
atgggaaaatatt

SEQ ID NO: 1650848 - DNA, 17 bp, Homo sapiens
atgggaaaatatttcct

SEQ ID NO: 1650849 - DNA, 16 bp, Homo sapiens
atgggaaactgctttt

SEQ ID NO: 1650850 - DNA, 20 bp, Homo sapiens
atgggaaagcattgtaaatg

SEQ ID NO: 1650851 - DNA, 21 bp, Homo sapiens
atgggaaagcggcgccacaga

SEQ ID NO: 1650852 - DNA, 19 bp, Homo sapiens
atgggaaatagtctgattt

SEQ ID NO: 1650853 - DNA, 18 bp, Homo sapiens
atgggaacaaattagagg

SEQ ID NO: 1650854 - DNA, 13 bp, Homo sapiens
atgggaagcaata

SEQ ID NO: 1650855 - DNA, 17 bp, Homo sapiens
atgggaataattgcttt

SEQ ID NO: 1650856 - DNA, 13 bp, Homo sapiens
atgggacaagcag

SEQ ID NO: 1650857 - DNA, 17 bp, Homo sapiens
atgggactgatgtcatc

SEQ ID NO: 1650858 - DNA, 21 bp, Homo sapiens
atgggactggagtccctgtga

SEQ ID NO: 1650859 - DNA, 11 bp, Homo sapiens
atgggagccag

SEQ ID NO: 1650860 - DNA, 12 bp, Homo sapiens
atgggagccaga

SEQ ID NO: 1650861 - DNA, 15 bp, Homo sapiens
atgggagccaggagt

SEQ ID NO: 1650862 - DNA, 20 bp, Homo sapiens
atgggagctggttagaaatg

SEQ ID NO: 1650863 - DNA, 21 bp, Homo sapiens
atgggagctggttagaaatgc

SEQ ID NO: 1650864 - DNA, 22 bp, Homo sapiens
atgggagctggttagaaatgca

SEQ ID NO: 1650865 - DNA, 13 bp, Homo sapiens
atgggaggcagcc

SEQ ID NO: 1650866 - DNA, 16 bp, Homo sapiens
atgggagtgagacaga

SEQ ID NO: 1650867 - DNA, 21 bp, Homo sapiens
atgggatggtcggatctcaca

SEQ ID NO: 1650868 - DNA, 23 bp, Homo sapiens
atgggattcagtgcttcttaaag

SEQ ID NO: 1650869 - DNA, 20 bp, Homo sapiens
atgggcaaagcttgtcaaag

SEQ ID NO: 1650870 - DNA, 16 bp, Homo sapiens
atgggcagcccaacag

SEQ ID NO: 1650871 - DNA, 13 bp, Homo sapiens
atgggcagctggg

SEQ ID NO: 1650872 - DNA, 20 bp, Homo sapiens
atgggcagctggggggctgt

SEQ ID NO: 1650873 - DNA, 20 bp, Homo sapiens
atgggcatcttttgtattaa

SEQ ID NO: 1650874 - DNA, 15 bp, Homo sapiens
atgggcattgggctg

SEQ ID NO: 1650875 - DNA, 21 bp, Homo sapiens
atgggcattgggctgacacct

SEQ ID NO: 1650876 - DNA, 12 bp, Homo sapiens
atgggcccctgg

SEQ ID NO: 1650877 - DNA, 19 bp, Homo sapiens
atgggccctatgtctcagg

SEQ ID NO: 1650878 - DNA, 13 bp, Homo sapiens
atgggcgagtccc

SEQ ID NO: 1650879 - DNA, 23 bp, Homo sapiens
atgggctagtgtgagtggcagcc

SEQ ID NO: 1650880 - DNA, 21 bp, Homo sapiens
atgggctcgccgtgtctcagc

SEQ ID NO: 1650881 - DNA, 14 bp, Homo sapiens
atgggctcttcact

SEQ ID NO: 1650882 - DNA, 14 bp, Homo sapiens
atgggctcttccaa

SEQ ID NO: 1650883 - DNA, 13 bp, Homo sapiens
atgtcatttcctt

SEQ ID NO: 1650884 - DNA, 22 bp, Homo sapiens
atgtcatttttaatgtatctat

SEQ ID NO: 1650885 - DNA, 12 bp, Homo sapiens
atgtccaaagag

SEQ ID NO: 1650886 - DNA, 15 bp, Homo sapiens
atgtccaaagaggct

SEQ ID NO: 1650887 - DNA, 19 bp, Homo sapiens
atgtccaaagaggctgccc

SEQ ID NO: 1650888 - DNA, 22 bp, Homo sapiens
atgtccaaagaggctgcccctc

SEQ ID NO: 1650889 - DNA, 14 bp, Homo sapiens
atgtccactgtgta

SEQ ID NO: 1650890 - DNA, 12 bp, Homo sapiens
atgtccagaaga

SEQ ID NO: 1650891 - DNA, 21 bp, Homo sapiens
atgtccagaagaatattcagg

SEQ ID NO: 1650892 - DNA, 23 bp, Homo sapiens
atgtccagaagaatattcaggac

SEQ ID NO: 1650893 - DNA, 16 bp, Homo sapiens
atgtccagcaccttgt

SEQ ID NO: 1650894 - DNA, 14 bp, Homo sapiens
atgtccattctcat

SEQ ID NO: 1650895 - DNA, 14 bp, Homo sapiens
atgtcccacccacc

SEQ ID NO: 1650896 - DNA, 21 bp, Homo sapiens
atgtccccattctataaattc

SEQ ID NO: 1650897 - DNA, 22 bp, Homo sapiens
atgtccccattctataaattca

SEQ ID NO: 1650898 - DNA, 14 bp, Homo sapiens
atgtcccctgtccc

SEQ ID NO: 1650899 - DNA, 16 bp, Homo sapiens
atgtcccctgtcccac

SEQ ID NO: 1650900 - DNA, 21 bp, Homo sapiens
atgtccctacacccctcccct

SEQ ID NO: 1650901 - DNA, 16 bp, Homo sapiens
atgtccctctcttggc

SEQ ID NO: 1650902 - DNA, 18 bp, Homo sapiens
atgtccctctcttggcta

SEQ ID NO: 1650903 - DNA, 23 bp, Homo sapiens
atgtccctctcttggctattgac

SEQ ID NO: 1650904 - DNA, 20 bp, Homo sapiens
atgtccctttcttggccagt

SEQ ID NO: 1650905 - DNA, 21 bp, Homo sapiens
atgtcctaaggacacactaat

SEQ ID NO: 1650906 - DNA, 22 bp, Homo sapiens
atgtcctccagaagcctctggc

SEQ ID NO: 1650907 - DNA, 16 bp, Homo sapiens
atgtcctgcctattat

SEQ ID NO: 1650908 - DNA, 21 bp, Homo sapiens
atgtcctgcctattatctgtc

SEQ ID NO: 1650909 - DNA, 14 bp, Homo sapiens
atgtcctgtaaagg

SEQ ID NO: 1650910 - DNA, 19 bp, Homo sapiens
atgtcgaggctagaggcat

SEQ ID NO: 1650911 - DNA, 19 bp, Homo sapiens
atgtcgtggacacacacag

SEQ ID NO: 1650912 - DNA, 17 bp, Homo sapiens
atgtctaaatgctgaaa

SEQ ID NO: 1650913 - DNA, 15 bp, Homo sapiens
atgtctattcagctt

SEQ ID NO: 1650914 - DNA, 13 bp, Homo sapiens
atgtctcctcccc

SEQ ID NO: 1650915 - DNA, 11 bp, Homo sapiens
atgtctctgcc

SEQ ID NO: 1650916 - DNA, 23 bp, Homo sapiens
atgtctctgtgagactcgagaac

SEQ ID NO: 1650917 - DNA, 17 bp, Homo sapiens
atgtctcttctgagcta

SEQ ID NO: 1650918 - DNA, 23 bp, Homo sapiens
atgtctcttgagcatcaatcttg

SEQ ID NO: 1650919 - DNA, 18 bp, Homo sapiens
atgtctgaaacagagaac

SEQ ID NO: 1650920 - DNA, 23 bp, Homo sapiens
atgtctgcagctcaagggctggc

SEQ ID NO: 1650921 - DNA, 13 bp, Homo sapiens
atgtctgccttac

SEQ ID NO: 1650922 - DNA, 20 bp, Homo sapiens
atgtctgctgaataataaac

SEQ ID NO: 1650923 - DNA, 19 bp, Homo sapiens
atgtctgctggtatttcta

SEQ ID NO: 1650924 - DNA, 18 bp, Homo sapiens
atgtctgtatactcctgt

SEQ ID NO: 1650925 - DNA, 16 bp, Homo sapiens
atgtctgtctacagga

SEQ ID NO: 1650926 - DNA, 11 bp, Homo sapiens
atgtctgtgct

SEQ ID NO: 1650927 - DNA, 16 bp, Homo sapiens
atgtctgttctacata

SEQ ID NO: 1650928 - DNA, 16 bp, Homo sapiens
atgtctgtttttgtat

SEQ ID NO: 1650929 - DNA, 18 bp, Homo sapiens
atgtctgtttttgtatct

SEQ ID NO: 1650930 - DNA, 20 bp, Homo sapiens
atgtctgtttttgtatcttt

SEQ ID NO: 1650931 - DNA, 19 bp, Homo sapiens
atgtcttaacgaataaagg

SEQ ID NO: 1650932 - DNA, 15 bp, Homo sapiens
atgtcttctagctgc

SEQ ID NO: 1650933 - DNA, 12 bp, Homo sapiens
atgtcttctgcc

SEQ ID NO: 1650934 - DNA, 14 bp, Homo sapiens
atgtcttctgcctg

SEQ ID NO: 1650935 - DNA, 15 bp, Homo sapiens
atgtcttctgcctgt

SEQ ID NO: 1650936 - DNA, 19 bp, Homo sapiens
atgtcttctgcctgttata

SEQ ID NO: 1650937 - DNA, 16 bp, Homo sapiens
atgtcttggacactgt

SEQ ID NO: 1650938 - DNA, 17 bp, Homo sapiens
atgtcttgtacatgtgt

SEQ ID NO: 1650939 - DNA, 20 bp, Homo sapiens
atgtctttgttggaaaagaa

SEQ ID NO: 1650940 - DNA, 18 bp, Homo sapiens
atgtgaaaatcaaataca

SEQ ID NO: 1650941 - DNA, 17 bp, Homo sapiens
atgtgaaacatcttctc

SEQ ID NO: 1650942 - DNA, 19 bp, Homo sapiens
atgtgaacagcataagttt

SEQ ID NO: 1650943 - DNA, 20 bp, Homo sapiens
atgtgaagacattttttgct

SEQ ID NO: 1650944 - DNA, 21 bp, Homo sapiens
atgtgaagctgaaccccctcc

SEQ ID NO: 1650945 - DNA, 19 bp, Homo sapiens
atgtgaataggttatatgc

SEQ ID NO: 1650946 - DNA, 12 bp, Homo sapiens
atgtgaatcaga

SEQ ID NO: 1650947 - DNA, 16 bp, Homo sapiens
atgtgaatcagaccct

SEQ ID NO: 1650948 - DNA, 23 bp, Homo sapiens
atgtgaatcgcaaggcctgtgct

SEQ ID NO: 1650949 - DNA, 14 bp, Homo sapiens
atgtgaattattga

SEQ ID NO: 1650950 - DNA, 10 bp, Homo sapiens
atgtgaattt

SEQ ID NO: 1650951 - DNA, 12 bp, Homo sapiens
atgtgaattttt

SEQ ID NO: 1650952 - DNA, 13 bp, Homo sapiens
atgtgaattttta

SEQ ID NO: 1650953 - DNA, 14 bp, Homo sapiens
atgtgaatttttaa

SEQ ID NO: 1650954 - DNA, 18 bp, Homo sapiens
atgtgaatttttatttct

SEQ ID NO: 1650955 - DNA, 18 bp, Homo sapiens
atgtgacaattttgtaca

SEQ ID NO: 1650956 - DNA, 18 bp, Homo sapiens
atgtgaccacatacgtgt

SEQ ID NO: 1650957 - DNA, 15 bp, Homo sapiens
atgtgaccataatgt

SEQ ID NO: 1650958 - DNA, 18 bp, Homo sapiens
atgtgacccaccagtgcc

SEQ ID NO: 1650959 - DNA, 22 bp, Homo sapiens
atgtgactaaaggaaaaaactt

SEQ ID NO: 1650960 - DNA, 16 bp, Homo sapiens
atgtgacttgcgctta

SEQ ID NO: 1650961 - DNA, 20 bp, Homo sapiens
atgtgacttttatatgcttt

SEQ ID NO: 1650962 - DNA, 14 bp, Homo sapiens
atgtgagaagccag

SEQ ID NO: 1650963 - DNA, 15 bp, Homo sapiens
atgtgagagaaagtg

SEQ ID NO: 1650964 - DNA, 19 bp, Homo sapiens
atgtgagcacatgcgtata

SEQ ID NO: 1650965 - DNA, 21 bp, Homo sapiens
atgtgagccaccgctgccagc

SEQ ID NO: 1650966 - DNA, 19 bp, Homo sapiens
atgtgagctataatgtttc

SEQ ID NO: 1650967 - DNA, 20 bp, Homo sapiens
atgtgaggaactcacatact

SEQ ID NO: 1650968 - DNA, 17 bp, Homo sapiens
atgtgaggaggaaaagg

SEQ ID NO: 1650969 - DNA, 18 bp, Homo sapiens
atgtgaggaggaaaagga

SEQ ID NO: 1650970 - DNA, 19 bp, Homo sapiens
atgtgaggaggaaaaggaa

SEQ ID NO: 1650971 - DNA, 21 bp, Homo sapiens
atgtgagtcccagagcccgct

SEQ ID NO: 1650972 - DNA, 18 bp, Homo sapiens
atgtgagtgccttttgca

SEQ ID NO: 1650973 - DNA, 20 bp, Homo sapiens
atgtgagtgccttttgcaga

SEQ ID NO: 1650974 - DNA, 22 bp, Homo sapiens
atgtgagtgccttttgcagaag

SEQ ID NO: 1650975 - DNA, 14 bp, Homo sapiens
atgtgatattctaa

SEQ ID NO: 1650976 - DNA, 19 bp, Homo sapiens
atgtgatattctgttgctt

SEQ ID NO: 1650977 - DNA, 21 bp, Homo sapiens
atgtgatattctgttgcttta

SEQ ID NO: 1650978 - DNA, 20 bp, Homo sapiens
atgtgatcatgtgtggaagt

SEQ ID NO: 1650979 - DNA, 17 bp, Homo sapiens
atgtgatgttctaaggc

SEQ ID NO: 1650980 - DNA, 23 bp, Homo sapiens
atgtgattaacatctacaatcag

SEQ ID NO: 1650981 - DNA, 16 bp, Homo sapiens
atgtgattaactctta

SEQ ID NO: 1650982 - DNA, 19 bp, Homo sapiens
atgtgattaactcttagaa

SEQ ID NO: 1650983 - DNA, 15 bp, Homo sapiens
atgtgattccttttg

SEQ ID NO: 1650984 - DNA, 14 bp, Homo sapiens
atgtgatttttctg

SEQ ID NO: 1650985 - DNA, 19 bp, Homo sapiens
atgtgcaaaatctgttata

SEQ ID NO: 1650986 - DNA, 15 bp, Homo sapiens
atgtgcaagtttatc

SEQ ID NO: 1650987 - DNA, 16 bp, Homo sapiens
atgtgcaatacatttt

SEQ ID NO: 1650988 - DNA, 23 bp, Homo sapiens
atgtgcagaaaatatttaatatc

SEQ ID NO: 1650989 - DNA, 15 bp, Homo sapiens
atgtgcagggatatt

SEQ ID NO: 1650990 - DNA, 17 bp, Homo sapiens
atgtgcagggatattgc

SEQ ID NO: 1650991 - DNA, 21 bp, Homo sapiens
atgtgcagggatattgcctta

SEQ ID NO: 1650992 - DNA, 14 bp, Homo sapiens
atgtgcatctggtg

SEQ ID NO: 1650993 - DNA, 17 bp, Homo sapiens
atgtgcatttcacctgt

SEQ ID NO: 1650994 - DNA, 22 bp, Homo sapiens
atgtgcctgcaccaggagacag

SEQ ID NO: 1650995 - DNA, 21 bp, Homo sapiens
atgtgccttaagttttagtct

SEQ ID NO: 1650996 - DNA, 19 bp, Homo sapiens
atgtgcctttctttgcctc

SEQ ID NO: 1650997 - DNA, 20 bp, Homo sapiens
atgttttttctgtaatgtaa

SEQ ID NO: 1650998 - DNA, 12 bp, Homo sapiens
atgttttttgcc

SEQ ID NO: 1650999 - DNA, 22 bp, Homo sapiens
atgttttttgccacagcttttg

SEQ ID NO: 1651000 - DNA, 15 bp, Homo sapiens
attaaaaaaaaattg

SEQ ID NO: 1651001 - DNA, 22 bp, Homo sapiens
attaaaaaacttcatgtaattt

SEQ ID NO: 1651002 - DNA, 14 bp, Homo sapiens
attaaaaacatgac

SEQ ID NO: 1651003 - DNA, 21 bp, Homo sapiens
attaaaaagttgttctttgtt

SEQ ID NO: 1651004 - DNA, 15 bp, Homo sapiens
attaaaaatagacag

SEQ ID NO: 1651005 - DNA, 22 bp, Homo sapiens
attaaaaatgaccactctttta

SEQ ID NO: 1651006 - DNA, 16 bp, Homo sapiens
attaaaacaaaagggt

SEQ ID NO: 1651007 - DNA, 14 bp, Homo sapiens
attaaaacaatatt

SEQ ID NO: 1651008 - DNA, 16 bp, Homo sapiens
attaaaacacaaagtc

SEQ ID NO: 1651009 - DNA, 15 bp, Homo sapiens
attaaaacacagctt

SEQ ID NO: 1651010 - DNA, 21 bp, Homo sapiens
attaaaacctgggattatata

SEQ ID NO: 1651011 - DNA, 12 bp, Homo sapiens
attaaaactgct

SEQ ID NO: 1651012 - DNA, 14 bp, Homo sapiens
attaaaactgcttt

SEQ ID NO: 1651013 - DNA, 22 bp, Homo sapiens
attaaaagcaaatcatttgttt

SEQ ID NO: 1651014 - DNA, 15 bp, Homo sapiens
attaaaatctacaga

SEQ ID NO: 1651015 - DNA, 14 bp, Homo sapiens
attaaaatctgatg

SEQ ID NO: 1651016 - DNA, 12 bp, Homo sapiens
attaaaatctta

SEQ ID NO: 1651017 - DNA, 15 bp, Homo sapiens
attaaaatcttaaac

SEQ ID NO: 1651018 - DNA, 23 bp, Homo sapiens
attaaaatgtcggatttatcttt

SEQ ID NO: 1651019 - DNA, 22 bp, Homo sapiens
attaaaccaatgaagaagacaa

SEQ ID NO: 1651020 - DNA, 14 bp, Homo sapiens
attaaaccctggat

SEQ ID NO: 1651021 - DNA, 14 bp, Homo sapiens
attaaaccgcatgt

SEQ ID NO: 1651022 - DNA, 17 bp, Homo sapiens
attaaacttccaaagaa

SEQ ID NO: 1651023 - DNA, 22 bp, Homo sapiens
attaaagcttatttttctgtga

SEQ ID NO: 1651024 - DNA, 18 bp, Homo sapiens
attaaagtgctaaggttc

SEQ ID NO: 1651025 - DNA, 21 bp, Homo sapiens
attaaagttgtttcccactct

SEQ ID NO: 1651026 - DNA, 14 bp, Homo sapiens
attaaataaataaa

SEQ ID NO: 1651027 - DNA, 17 bp, Homo sapiens
attaaatacagacacta

SEQ ID NO: 1651028 - DNA, 15 bp, Homo sapiens
attaaatataatatg

SEQ ID NO: 1651029 - DNA, 17 bp, Homo sapiens
attaaatcctccagctt

SEQ ID NO: 1651030 - DNA, 18 bp, Homo sapiens
attaaatctatgaagtat

SEQ ID NO: 1651031 - DNA, 17 bp, Homo sapiens
attaaatcttaaacaat

SEQ ID NO: 1651032 - DNA, 21 bp, Homo sapiens
attaaatcttaaacaatgtat

SEQ ID NO: 1651033 - DNA, 23 bp, Homo sapiens
attaaatcttaaacaatgtataa

SEQ ID NO: 1651034 - DNA, 15 bp, Homo sapiens
attaaatgccttgta

SEQ ID NO: 1651035 - DNA, 16 bp, Homo sapiens
attaaatgccttgtat

SEQ ID NO: 1651036 - DNA, 16 bp, Homo sapiens
attaaatgtgtcattg

SEQ ID NO: 1651037 - DNA, 19 bp, Homo sapiens
attaaattaattgaatcta

SEQ ID NO: 1651038 - DNA, 18 bp, Homo sapiens
attaaattaggaataaat

SEQ ID NO: 1651039 - DNA, 15 bp, Homo sapiens
attaaattgtaaaac

SEQ ID NO: 1651040 - DNA, 16 bp, Homo sapiens
attaaatttatttgaa

SEQ ID NO: 1651041 - DNA, 13 bp, Homo sapiens
attaacacaaagg

SEQ ID NO: 1651042 - DNA, 16 bp, Homo sapiens
attaacacgctgcctg

SEQ ID NO: 1651043 - DNA, 17 bp, Homo sapiens
attaacctctcacagtt

SEQ ID NO: 1651044 - DNA, 20 bp, Homo sapiens
attaactactgaataatgct

SEQ ID NO: 1651045 - DNA, 20 bp, Homo sapiens
attaactagatacagaataa

SEQ ID NO: 1651046 - DNA, 20 bp, Homo sapiens
attaactcaccagatttact

SEQ ID NO: 1651047 - DNA, 22 bp, Homo sapiens
attaactcttagaagtgttgta

SEQ ID NO: 1651048 - DNA, 12 bp, Homo sapiens
attaacttattt

SEQ ID NO: 1651049 - DNA, 18 bp, Homo sapiens
attaacttttaaatgttt

SEQ ID NO: 1651050 - DNA, 14 bp, Homo sapiens
attaagaaagacta

SEQ ID NO: 1651051 - DNA, 13 bp, Homo sapiens
attaagaaaggaa

SEQ ID NO: 1651052 - DNA, 17 bp, Homo sapiens
attaagaaaggaagcat

SEQ ID NO: 1651053 - DNA, 20 bp, Homo sapiens
attaagaacacttttaataa

SEQ ID NO: 1651054 - DNA, 16 bp, Homo sapiens
attaagacagtgtaca

SEQ ID NO: 1651055 - DNA, 16 bp, Homo sapiens
attaagatacaaatta

SEQ ID NO: 1651056 - DNA, 17 bp, Homo sapiens
attaagatacaaattaa

SEQ ID NO: 1651057 - DNA, 15 bp, Homo sapiens
attaagatgttgtct

SEQ ID NO: 1651058 - DNA, 13 bp, Homo sapiens
attaagattataa

SEQ ID NO: 1651059 - DNA, 15 bp, Homo sapiens
attaagattataatt

SEQ ID NO: 1651060 - DNA, 16 bp, Homo sapiens
attaagattataattg

SEQ ID NO: 1651061 - DNA, 14 bp, Homo sapiens
attaagcaaatgtt

SEQ ID NO: 1651062 - DNA, 15 bp, Homo sapiens
attaagcagtaaaaa

SEQ ID NO: 1651063 - DNA, 20 bp, Homo sapiens
attaagcatgacagaaaata

SEQ ID NO: 1651064 - DNA, 20 bp, Homo sapiens
attaagcattttgaaacaaa

SEQ ID NO: 1651065 - DNA, 21 bp, Homo sapiens
attaagcattttgaaacaaag

SEQ ID NO: 1651066 - DNA, 15 bp, Homo sapiens
attaagcccttattt

SEQ ID NO: 1651067 - DNA, 11 bp, Homo sapiens
attaaggaagt

SEQ ID NO: 1651068 - DNA, 12 bp, Homo sapiens
attaaggttttc

SEQ ID NO: 1651069 - DNA, 18 bp, Homo sapiens
attaagtactatgtatca

SEQ ID NO: 1651070 - DNA, 14 bp, Homo sapiens
attaagtagaacaa

SEQ ID NO: 1651071 - DNA, 14 bp, Homo sapiens
attaagttgaaaaa

SEQ ID NO: 1651072 - DNA, 13 bp, Homo sapiens
attaagtttgaaa

SEQ ID NO: 1651073 - DNA, 18 bp, Homo sapiens
attaagttttaaataaac

SEQ ID NO: 1651074 - DNA, 13 bp, Homo sapiens
attaataatattt

SEQ ID NO: 1651075 - DNA, 16 bp, Homo sapiens
attaataatatttatg

SEQ ID NO: 1651076 - DNA, 16 bp, Homo sapiens
attaatagctgccttc

SEQ ID NO: 1651077 - DNA, 16 bp, Homo sapiens
attaatatatgtatta

SEQ ID NO: 1651078 - DNA, 22 bp, Homo sapiens
attaatatatgtattatttata

SEQ ID NO: 1651079 - DNA, 12 bp, Homo sapiens
attaatatatta

SEQ ID NO: 1651080 - DNA, 18 bp, Homo sapiens
attaatatcaactctgaa

SEQ ID NO: 1651081 - DNA, 14 bp, Homo sapiens
attaatatcttgct

SEQ ID NO: 1651082 - DNA, 19 bp, Homo sapiens
attaatattcccattttat

SEQ ID NO: 1651083 - DNA, 20 bp, Homo sapiens
attaatattcccattttatt

SEQ ID NO: 1651084 - DNA, 12 bp, Homo sapiens
attaatatttaa

SEQ ID NO: 1651085 - DNA, 13 bp, Homo sapiens
attaatcaagaga

SEQ ID NO: 1651086 - DNA, 16 bp, Homo sapiens
attaatcaagagaaac

SEQ ID NO: 1651087 - DNA, 21 bp, Homo sapiens
attaatcaagagaaacttcaa

SEQ ID NO: 1651088 - DNA, 16 bp, Homo sapiens
attaatcagttcatta

SEQ ID NO: 1651089 - DNA, 18 bp, Homo sapiens
attaatcatacaaactct

SEQ ID NO: 1651090 - DNA, 15 bp, Homo sapiens
attaatcatgaatgt

SEQ ID NO: 1651091 - DNA, 23 bp, Homo sapiens
attaatccccatcattactggta

SEQ ID NO: 1651092 - DNA, 20 bp, Homo sapiens
attaatctctaaaattctag

SEQ ID NO: 1651093 - DNA, 17 bp, Homo sapiens
attaatcttagtgtatg

SEQ ID NO: 1651094 - DNA, 20 bp, Homo sapiens
attaatcttagtgtatgatt

SEQ ID NO: 1651095 - DNA, 16 bp, Homo sapiens
attaatcttattgttt

SEQ ID NO: 1651096 - DNA, 21 bp, Homo sapiens
attaatcttgcttcattgtta

SEQ ID NO: 1651097 - DNA, 12 bp, Homo sapiens
attaatgaaata

SEQ ID NO: 1651098 - DNA, 20 bp, Homo sapiens
attaatgactttatgtatta

SEQ ID NO: 1651099 - DNA, 21 bp, Homo sapiens
attaatgattaaagactgtga

SEQ ID NO: 1651100 - DNA, 18 bp, Homo sapiens
attaatgcctctcccgca

SEQ ID NO: 1651101 - DNA, 16 bp, Homo sapiens
attaatgcctttaaag

SEQ ID NO: 1651102 - DNA, 14 bp, Homo sapiens
attaatgttttgta

SEQ ID NO: 1651103 - DNA, 13 bp, Homo sapiens
attaattagttta

SEQ ID NO: 1651104 - DNA, 14 bp, Homo sapiens
attaattgaatcta

SEQ ID NO: 1651105 - DNA, 18 bp, Homo sapiens
attaattgttttgcactt

SEQ ID NO: 1651106 - DNA, 18 bp, Homo sapiens
attaattttgtgcattct

SEQ ID NO: 1651107 - DNA, 20 bp, Homo sapiens
attaattttgtgcattcttt

SEQ ID NO: 1651108 - DNA, 24 bp, Homo sapiens
attaattttgtgcattctttggta

SEQ ID NO: 1651109 - DNA, 20 bp, Homo sapiens
attaattttttttttaaaca

SEQ ID NO: 1651110 - DNA, 11 bp, Homo sapiens
attacaaagcc

SEQ ID NO: 1651111 - DNA, 16 bp, Homo sapiens
attacaaatcagaagt

SEQ ID NO: 1651112 - DNA, 21 bp, Homo sapiens
attacaaatcagaagtcatct

SEQ ID NO: 1651113 - DNA, 13 bp, Homo sapiens
attattaattgca

SEQ ID NO: 1651114 - DNA, 12 bp, Homo sapiens
attattagaaat

SEQ ID NO: 1651115 - DNA, 16 bp, Homo sapiens
attattagagattttc

SEQ ID NO: 1651116 - DNA, 15 bp, Homo sapiens
attattagcatttgt

SEQ ID NO: 1651117 - DNA, 17 bp, Homo sapiens
attattagcatttgttt

SEQ ID NO: 1651118 - DNA, 17 bp, Homo sapiens
attattataaactataa

SEQ ID NO: 1651119 - DNA, 15 bp, Homo sapiens
attattatatacata

SEQ ID NO: 1651120 - DNA, 16 bp, Homo sapiens
attattatcgctttat

SEQ ID NO: 1651121 - DNA, 12 bp, Homo sapiens
attattatgttt

SEQ ID NO: 1651122 - DNA, 17 bp, Homo sapiens
attattattaaaaatat

SEQ ID NO: 1651123 - DNA, 15 bp, Homo sapiens
attattatttgtgtt

SEQ ID NO: 1651124 - DNA, 16 bp, Homo sapiens
attattcaagaatgaa

SEQ ID NO: 1651125 - DNA, 23 bp, Homo sapiens
attattcaagaatgaaaaatata

SEQ ID NO: 1651126 - DNA, 14 bp, Homo sapiens
attattcatttaaa

SEQ ID NO: 1651127 - DNA, 19 bp, Homo sapiens
attattcatttaaaatgat

SEQ ID NO: 1651128 - DNA, 16 bp, Homo sapiens
attattgaatgttata

SEQ ID NO: 1651129 - DNA, 13 bp, Homo sapiens
attattgacactg

SEQ ID NO: 1651130 - DNA, 14 bp, Homo sapiens
attattgacactga

SEQ ID NO: 1651131 - DNA, 20 bp, Homo sapiens
attattgagttccagttgaa

SEQ ID NO: 1651132 - DNA, 21 bp, Homo sapiens
attattgagttccagttgaag

SEQ ID NO: 1651133 - DNA, 15 bp, Homo sapiens
attattgatagtact

SEQ ID NO: 1651134 - DNA, 17 bp, Homo sapiens
attattgatagtactct

SEQ ID NO: 1651135 - DNA, 23 bp, Homo sapiens
attattgtgacttcactgtatat

SEQ ID NO: 1651136 - DNA, 11 bp, Homo sapiens
attatttaaac

SEQ ID NO: 1651137 - DNA, 22 bp, Homo sapiens
attatttaaatgtttaacatca

SEQ ID NO: 1651138 - DNA, 13 bp, Homo sapiens
attatttatatgg

SEQ ID NO: 1651139 - DNA, 15 bp, Homo sapiens
attatttatgacctg

SEQ ID NO: 1651140 - DNA, 18 bp, Homo sapiens
attatttcaccagcagca

SEQ ID NO: 1651141 - DNA, 12 bp, Homo sapiens
attatttctgtt

SEQ ID NO: 1651142 - DNA, 14 bp, Homo sapiens
attatttcttctct

SEQ ID NO: 1651143 - DNA, 12 bp, Homo sapiens
attatttgctat

SEQ ID NO: 1651144 - DNA, 22 bp, Homo sapiens
attatttggagcctgccaagag

SEQ ID NO: 1651145 - DNA, 11 bp, Homo sapiens
attatttgtat

SEQ ID NO: 1651146 - DNA, 22 bp, Homo sapiens
attatttgtgttttaatttaaa

SEQ ID NO: 1651147 - DNA, 15 bp, Homo sapiens
attattttaaaatat

SEQ ID NO: 1651148 - DNA, 17 bp, Homo sapiens
attattttaaaatatat

SEQ ID NO: 1651149 - DNA, 20 bp, Homo sapiens
attattttagagttctaata

SEQ ID NO: 1651150 - DNA, 13 bp, Homo sapiens
attattttcaagg

SEQ ID NO: 1651151 - DNA, 21 bp, Homo sapiens
attattttgaatgtcacaaat

SEQ ID NO: 1651152 - DNA, 19 bp, Homo sapiens
attattttggtacttttat

SEQ ID NO: 1651153 - DNA, 16 bp, Homo sapiens
attattttgttcatac

SEQ ID NO: 1651154 - DNA, 18 bp, Homo sapiens
attattttgttcatacat

SEQ ID NO: 1651155 - DNA, 19 bp, Homo sapiens
attattttgttcatacata

SEQ ID NO: 1651156 - DNA, 22 bp, Homo sapiens
attatttttttaaaattttgta

SEQ ID NO: 1651157 - DNA, 12 bp, Homo sapiens
attcaaaaagtc

SEQ ID NO: 1651158 - DNA, 13 bp, Homo sapiens
attcaaaagttcc

SEQ ID NO: 1651159 - DNA, 19 bp, Homo sapiens
attcaaaatagttctattt

SEQ ID NO: 1651160 - DNA, 12 bp, Homo sapiens
attcaaaatctt

SEQ ID NO: 1651161 - DNA, 19 bp, Homo sapiens
attcaaacagtctcaggaa

SEQ ID NO: 1651162 - DNA, 15 bp, Homo sapiens
attcaaactgctcca

SEQ ID NO: 1651163 - DNA, 17 bp, Homo sapiens
attcaaactgctccaag

SEQ ID NO: 1651164 - DNA, 13 bp, Homo sapiens
attcaaagaagta

SEQ ID NO: 1651165 - DNA, 13 bp, Homo sapiens
attcaaagcataa

SEQ ID NO: 1651166 - DNA, 19 bp, Homo sapiens
attcaaagcataaaacttt

SEQ ID NO: 1651167 - DNA, 20 bp, Homo sapiens
attcaaagcataaaactttg

SEQ ID NO: 1651168 - DNA, 13 bp, Homo sapiens
attcaaaggttct

SEQ ID NO: 1651169 - DNA, 17 bp, Homo sapiens
attcaaaggttctaggt

SEQ ID NO: 1651170 - DNA, 21 bp, Homo sapiens
attcaaagtgttgtgttcctg

SEQ ID NO: 1651171 - DNA, 23 bp, Homo sapiens
attcaaagtgttgtgttcctggc

SEQ ID NO: 1651172 - DNA, 18 bp, Homo sapiens
attcaaatcagtgatcta

SEQ ID NO: 1651173 - DNA, 19 bp, Homo sapiens
attcaaatcagtgatctat

SEQ ID NO: 1651174 - DNA, 17 bp, Homo sapiens
attcaaatttgtacagg

SEQ ID NO: 1651175 - DNA, 22 bp, Homo sapiens
attcaaatttgtacaggactgt

SEQ ID NO: 1651176 - DNA, 15 bp, Homo sapiens
attcaacaatttcaa

SEQ ID NO: 1651177 - DNA, 14 bp, Homo sapiens
attcaacacttatt

SEQ ID NO: 1651178 - DNA, 16 bp, Homo sapiens
attcaaccactgtaaa

SEQ ID NO: 1651179 - DNA, 19 bp, Homo sapiens
attcaaccactgtaaaatg

SEQ ID NO: 1651180 - DNA, 13 bp, Homo sapiens
attcaactttgta

SEQ ID NO: 1651181 - DNA, 18 bp, Homo sapiens
attcaactttgtaaaaat

SEQ ID NO: 1651182 - DNA, 18 bp, Homo sapiens
attcaagaatgaaaaata

SEQ ID NO: 1651183 - DNA, 18 bp, Homo sapiens
attcaagagcctcccctg

SEQ ID NO: 1651184 - DNA, 13 bp, Homo sapiens
attcaagctattt

SEQ ID NO: 1651185 - DNA, 18 bp, Homo sapiens
attcaagctatttaatat

SEQ ID NO: 1651186 - DNA, 17 bp, Homo sapiens
attcaaggaatttctta

SEQ ID NO: 1651187 - DNA, 18 bp, Homo sapiens
attcaaggaatttcttaa

SEQ ID NO: 1651188 - DNA, 19 bp, Homo sapiens
attcaaggaatttcttaac

SEQ ID NO: 1651189 - DNA, 20 bp, Homo sapiens
attcaaggaatttcttaact

SEQ ID NO: 1651190 - DNA, 19 bp, Homo sapiens
attcaaggagaatatgata

SEQ ID NO: 1651191 - DNA, 13 bp, Homo sapiens
attcaaggctcag

SEQ ID NO: 1651192 - DNA, 12 bp, Homo sapiens
attcaataaaaa

SEQ ID NO: 1651193 - DNA, 18 bp, Homo sapiens
attcaataaaaaaaagaa

SEQ ID NO: 1651194 - DNA, 13 bp, Homo sapiens
attcaataccgct

SEQ ID NO: 1651195 - DNA, 19 bp, Homo sapiens
attcaataccgctcagtat

SEQ ID NO: 1651196 - DNA, 20 bp, Homo sapiens
attcaataccgctcagtatt

SEQ ID NO: 1651197 - DNA, 21 bp, Homo sapiens
attcaataccgctcagtattt

SEQ ID NO: 1651198 - DNA, 17 bp, Homo sapiens
attcaatagtaatataa

SEQ ID NO: 1651199 - DNA, 15 bp, Homo sapiens
attcaatattgacat

SEQ ID NO: 1651200 - DNA, 20 bp, Homo sapiens
attcaatattgacatttgta

SEQ ID NO: 1651201 - DNA, 20 bp, Homo sapiens
attcaatcagagctccagtt

SEQ ID NO: 1651202 - DNA, 16 bp, Homo sapiens
attcaatcatttattc

SEQ ID NO: 1651203 - DNA, 15 bp, Homo sapiens
attcaatgcatttaa

SEQ ID NO: 1651204 - DNA, 17 bp, Homo sapiens
attcaatgcatttaaaa

SEQ ID NO: 1651205 - DNA, 18 bp, Homo sapiens
attcaatgcatttaaaat

SEQ ID NO: 1651206 - DNA, 19 bp, Homo sapiens
attcaatgcatttaaaata

SEQ ID NO: 1651207 - DNA, 23 bp, Homo sapiens
attcaatgtttatgcaaggaagg

SEQ ID NO: 1651208 - DNA, 12 bp, Homo sapiens
attcaattagtg

SEQ ID NO: 1651209 - DNA, 18 bp, Homo sapiens
attcaattataattgtaa

SEQ ID NO: 1651210 - DNA, 14 bp, Homo sapiens
attcacaatagaaa

SEQ ID NO: 1651211 - DNA, 14 bp, Homo sapiens
attcacacacccct

SEQ ID NO: 1651212 - DNA, 20 bp, Homo sapiens
attcacacacccctcaaaaa

SEQ ID NO: 1651213 - DNA, 13 bp, Homo sapiens
attcacagagcct

SEQ ID NO: 1651214 - DNA, 20 bp, Homo sapiens
attcacagtgctcttttctc

SEQ ID NO: 1651215 - DNA, 21 bp, Homo sapiens
attcacagtgctcttttctcc

SEQ ID NO: 1651216 - DNA, 22 bp, Homo sapiens
attcacagttctttgggccaga

SEQ ID NO: 1651217 - DNA, 14 bp, Homo sapiens
attcacatttagaa

SEQ ID NO: 1651218 - DNA, 16 bp, Homo sapiens
attcacatttgatgta

SEQ ID NO: 1651219 - DNA, 17 bp, Homo sapiens
attcacatttgatgtac

SEQ ID NO: 1651220 - DNA, 19 bp, Homo sapiens
attcacatttgatgtacat

SEQ ID NO: 1651221 - DNA, 16 bp, Homo sapiens
attcaccaaaattatc

SEQ ID NO: 1651222 - DNA, 19 bp, Homo sapiens
attcacccccctctgctgc

SEQ ID NO: 1651223 - DNA, 21 bp, Homo sapiens
attcacccccctctgctgccg

SEQ ID NO: 1651224 - DNA, 17 bp, Homo sapiens
attcacccgaagcgctt

SEQ ID NO: 1651225 - DNA, 24 bp, Homo sapiens
attcacctcttcctctggttcctt

SEQ ID NO: 1651226 - DNA, 21 bp, Homo sapiens
attcacgccgtaattctttct

SEQ ID NO: 1651227 - DNA, 23 bp, Homo sapiens
attcacgtgctttgtgttcagtt

SEQ ID NO: 1651228 - DNA, 14 bp, Homo sapiens
attcttatgttgaa

SEQ ID NO: 1651229 - DNA, 14 bp, Homo sapiens
attcttatttaatg

SEQ ID NO: 1651230 - DNA, 16 bp, Homo sapiens
attcttattttttaaa

SEQ ID NO: 1651231 - DNA, 13 bp, Homo sapiens
attcttcagcttg

SEQ ID NO: 1651232 - DNA, 13 bp, Homo sapiens
attcttccagaat

SEQ ID NO: 1651233 - DNA, 15 bp, Homo sapiens
attcttccatcatca

SEQ ID NO: 1651234 - DNA, 20 bp, Homo sapiens
attcttccatcatcactgta

SEQ ID NO: 1651235 - DNA, 22 bp, Homo sapiens
attcttccatcatcactgtaaa

SEQ ID NO: 1651236 - DNA, 21 bp, Homo sapiens
attcttcccaacttgcctttg

SEQ ID NO: 1651237 - DNA, 22 bp, Homo sapiens
attcttcctaatgtcagaacag

SEQ ID NO: 1651238 - DNA, 12 bp, Homo sapiens
attcttctagag

SEQ ID NO: 1651239 - DNA, 13 bp, Homo sapiens
attcttctagagt

SEQ ID NO: 1651240 - DNA, 14 bp, Homo sapiens
attcttctagagtt

SEQ ID NO: 1651241 - DNA, 21 bp, Homo sapiens
attcttctgaactcaaactga

SEQ ID NO: 1651242 - DNA, 14 bp, Homo sapiens
attcttctgtgttt

SEQ ID NO: 1651243 - DNA, 16 bp, Homo sapiens
attcttgaaagctgtg

SEQ ID NO: 1651244 - DNA, 17 bp, Homo sapiens
attcttgatcagtagtt

SEQ ID NO: 1651245 - DNA, 22 bp, Homo sapiens
attcttgatcagtagtttgcat

SEQ ID NO: 1651246 - DNA, 10 bp, Homo sapiens
attcttgatg

SEQ ID NO: 1651247 - DNA, 14 bp, Homo sapiens
attcttgatgaaaa

SEQ ID NO: 1651248 - DNA, 18 bp, Homo sapiens
attcttgatgaaaagctt

SEQ ID NO: 1651249 - DNA, 17 bp, Homo sapiens
attcttgatgtaaaatc

SEQ ID NO: 1651250 - DNA, 19 bp, Homo sapiens
attcttgatgtaaaatctt

SEQ ID NO: 1651251 - DNA, 20 bp, Homo sapiens
attcttgatgtaaaatcttg

SEQ ID NO: 1651252 - DNA, 15 bp, Homo sapiens
attcttgattcctgg

SEQ ID NO: 1651253 - DNA, 16 bp, Homo sapiens
attcttgattttcaag

SEQ ID NO: 1651254 - DNA, 21 bp, Homo sapiens
attcttgattttcaagctttc

SEQ ID NO: 1651255 - DNA, 19 bp, Homo sapiens
attcttgctttcacaaata

SEQ ID NO: 1651256 - DNA, 15 bp, Homo sapiens
attcttgtggttaaa

SEQ ID NO: 1651257 - DNA, 16 bp, Homo sapiens
attcttgtggttaaaa

SEQ ID NO: 1651258 - DNA, 14 bp, Homo sapiens
attctttaaggaga

SEQ ID NO: 1651259 - DNA, 20 bp, Homo sapiens
attctttagtactcaatgtt

SEQ ID NO: 1651260 - DNA, 22 bp, Homo sapiens
attctttcacaaggtacaaaat

SEQ ID NO: 1651261 - DNA, 15 bp, Homo sapiens
attctttcagttctt

SEQ ID NO: 1651262 - DNA, 14 bp, Homo sapiens
attctttctccttt

SEQ ID NO: 1651263 - DNA, 14 bp, Homo sapiens
attctttctgtctc

SEQ ID NO: 1651264 - DNA, 20 bp, Homo sapiens
attctttctgttgaaaagca

SEQ ID NO: 1651265 - DNA, 19 bp, Homo sapiens
attctttgacctgttggga

SEQ ID NO: 1651266 - DNA, 13 bp, Homo sapiens
attctttggtaat

SEQ ID NO: 1651267 - DNA, 17 bp, Homo sapiens
attctttggtaattttt

SEQ ID NO: 1651268 - DNA, 23 bp, Homo sapiens
attcttttcagcttgtttctata

SEQ ID NO: 1651269 - DNA, 13 bp, Homo sapiens
attcttttctcag

SEQ ID NO: 1651270 - DNA, 18 bp, Homo sapiens
attctttttctgttgaaa

SEQ ID NO: 1651271 - DNA, 20 bp, Homo sapiens
attctttttgctctaaaata

SEQ ID NO: 1651272 - DNA, 21 bp, Homo sapiens
attctttttgctctaaaatat

SEQ ID NO: 1651273 - DNA, 16 bp, Homo sapiens
attgaaaaacaatttt

SEQ ID NO: 1651274 - DNA, 18 bp, Homo sapiens
attgaaaacttttctcag

SEQ ID NO: 1651275 - DNA, 22 bp, Homo sapiens
attgaaaagaagaaagtctatg

SEQ ID NO: 1651276 - DNA, 13 bp, Homo sapiens
attgaaaaggaca

SEQ ID NO: 1651277 - DNA, 12 bp, Homo sapiens
attgaaaagtac

SEQ ID NO: 1651278 - DNA, 21 bp, Homo sapiens
attgaaaatagtaaatgcttt

SEQ ID NO: 1651279 - DNA, 15 bp, Homo sapiens
attgaaaatcttgtg

SEQ ID NO: 1651280 - DNA, 16 bp, Homo sapiens
attgaaaattgaaaag

SEQ ID NO: 1651281 - DNA, 17 bp, Homo sapiens
attgaaactgagtataa

SEQ ID NO: 1651282 - DNA, 13 bp, Homo sapiens
attgaaagaactt

SEQ ID NO: 1651283 - DNA, 16 bp, Homo sapiens
attgaaagcttttaaa

SEQ ID NO: 1651284 - DNA, 16 bp, Homo sapiens
attgaaagttctggaa

SEQ ID NO: 1651285 - DNA, 19 bp, Homo sapiens
attgaaataaataaaaatg

SEQ ID NO: 1651286 - DNA, 16 bp, Homo sapiens
attgaaatgactaaaa

SEQ ID NO: 1651287 - DNA, 15 bp, Homo sapiens
attgaaattaacttt

SEQ ID NO: 1651288 - DNA, 22 bp, Homo sapiens
attgaaattaacttttaaatgt

SEQ ID NO: 1651289 - DNA, 22 bp, Homo sapiens
attgaacaagttgtttcattga

SEQ ID NO: 1651290 - DNA, 21 bp, Homo sapiens
attgaaccaagggatcctccc

SEQ ID NO: 1651291 - DNA, 17 bp, Homo sapiens
attgaacttttgtactg

SEQ ID NO: 1651292 - DNA, 18 bp, Homo sapiens
attgaacttttgtactga

SEQ ID NO: 1651293 - DNA, 19 bp, Homo sapiens
attgaacttttgtactgaa

SEQ ID NO: 1651294 - DNA, 23 bp, Homo sapiens
attgaacttttgtactgaatttt

SEQ ID NO: 1651295 - DNA, 14 bp, Homo sapiens
attgaagacaattt

SEQ ID NO: 1651296 - DNA, 20 bp, Homo sapiens
attgaagacaatttgataca

SEQ ID NO: 1651297 - DNA, 22 bp, Homo sapiens
attgaagacaatttgatacata

SEQ ID NO: 1651298 - DNA, 15 bp, Homo sapiens
attgaagatgctgcc

SEQ ID NO: 1651299 - DNA, 19 bp, Homo sapiens
attgaaggcttaaacccat

SEQ ID NO: 1651300 - DNA, 20 bp, Homo sapiens
attgaaggtgataagggaaa

SEQ ID NO: 1651301 - DNA, 14 bp, Homo sapiens
attgaagtaatgaa

SEQ ID NO: 1651302 - DNA, 17 bp, Homo sapiens
attgaagttgtttatca

SEQ ID NO: 1651303 - DNA, 22 bp, Homo sapiens
attgaagttgtttatcaacttc

SEQ ID NO: 1651304 - DNA, 14 bp, Homo sapiens
attgaatctgattg

SEQ ID NO: 1651305 - DNA, 23 bp, Homo sapiens
attgaatctgattggacattttc

SEQ ID NO: 1651306 - DNA, 21 bp, Homo sapiens
attgaatgttatatcatcaat

SEQ ID NO: 1651307 - DNA, 13 bp, Homo sapiens
attgaattatctt

SEQ ID NO: 1651308 - DNA, 21 bp, Homo sapiens
attgaattatcttggttgaaa

SEQ ID NO: 1651309 - DNA, 21 bp, Homo sapiens
attgacaaacccggaagatca

SEQ ID NO: 1651310 - DNA, 17 bp, Homo sapiens
attgacaataatttcag

SEQ ID NO: 1651311 - DNA, 20 bp, Homo sapiens
attgacaataatttcaggtt

SEQ ID NO: 1651312 - DNA, 16 bp, Homo sapiens
attgacacacagcact

SEQ ID NO: 1651313 - DNA, 20 bp, Homo sapiens
attgacacacagcactctct

SEQ ID NO: 1651314 - DNA, 22 bp, Homo sapiens
attgacacacagcactctctaa

SEQ ID NO: 1651315 - DNA, 15 bp, Homo sapiens
attgaccaagaactg

SEQ ID NO: 1651316 - DNA, 16 bp, Homo sapiens
attgaccaagaactgc

SEQ ID NO: 1651317 - DNA, 17 bp, Homo sapiens
attgaccaagaactgca

SEQ ID NO: 1651318 - DNA, 18 bp, Homo sapiens
attgaccaagaactgcat

SEQ ID NO: 1651319 - DNA, 13 bp, Homo sapiens
attgaccattttt

SEQ ID NO: 1651320 - DNA, 16 bp, Homo sapiens
attgacctcagctgca

SEQ ID NO: 1651321 - DNA, 19 bp, Homo sapiens
attgacctcagctgcacat

SEQ ID NO: 1651322 - DNA, 23 bp, Homo sapiens
attgacctcagctgcacattcct

SEQ ID NO: 1651323 - DNA, 15 bp, Homo sapiens
attgacctcatcatt

SEQ ID NO: 1651324 - DNA, 20 bp, Homo sapiens
attgacctcatcattaataa

SEQ ID NO: 1651325 - DNA, 23 bp, Homo sapiens
attgacctcatcattaataagtg

SEQ ID NO: 1651326 - DNA, 14 bp, Homo sapiens
attgacgaactggc

SEQ ID NO: 1651327 - DNA, 22 bp, Homo sapiens
attgacgacaagtgctgaacag

SEQ ID NO: 1651328 - DNA, 15 bp, Homo sapiens
attgactgaagcaca

SEQ ID NO: 1651329 - DNA, 16 bp, Homo sapiens
attgactgaagcacag

SEQ ID NO: 1651330 - DNA, 15 bp, Homo sapiens
attgactgatgattt

SEQ ID NO: 1651331 - DNA, 17 bp, Homo sapiens
attgactttatgttgta

SEQ ID NO: 1651332 - DNA, 13 bp, Homo sapiens
attgactttgaca

SEQ ID NO: 1651333 - DNA, 18 bp, Homo sapiens
attgagaactgcatatgt

SEQ ID NO: 1651334 - DNA, 20 bp, Homo sapiens
attgagagttttgtcttgaa

SEQ ID NO: 1651335 - DNA, 23 bp, Homo sapiens
attgagatcagcattcaaaatag

SEQ ID NO: 1651336 - DNA, 12 bp, Homo sapiens
attgagatttct

SEQ ID NO: 1651337 - DNA, 20 bp, Homo sapiens
attgagccttacgacacttt

SEQ ID NO: 1651338 - DNA, 14 bp, Homo sapiens
attgagcttgcatg

SEQ ID NO: 1651339 - DNA, 14 bp, Homo sapiens
attgaggaattaac

SEQ ID NO: 1651340 - DNA, 14 bp, Homo sapiens
attgaggctgcagc

SEQ ID NO: 1651341 - DNA, 17 bp, Homo sapiens
attgagtttaacaataa

SEQ ID NO: 1651342 - DNA, 21 bp, Homo sapiens
attgataaaagagttccctgc

SEQ ID NO: 1651343 - DNA, 18 bp, Homo sapiens
attgtgtagcctttttgt

SEQ ID NO: 1651344 - DNA, 18 bp, Homo sapiens
attgtgtataactggatt

SEQ ID NO: 1651345 - DNA, 15 bp, Homo sapiens
attgtgtattgatgc

SEQ ID NO: 1651346 - DNA, 18 bp, Homo sapiens
attgtgtattgatgcaat

SEQ ID NO: 1651347 - DNA, 18 bp, Homo sapiens
attgtgtcagaaacatga

SEQ ID NO: 1651348 - DNA, 20 bp, Homo sapiens
attgtgtgaaaaaagaaaat

SEQ ID NO: 1651349 - DNA, 21 bp, Homo sapiens
attgtgtgaattaatttctaa

SEQ ID NO: 1651350 - DNA, 18 bp, Homo sapiens
attgtgtgatatttcaga

SEQ ID NO: 1651351 - DNA, 20 bp, Homo sapiens
attgtgtgatatttcagaaa

SEQ ID NO: 1651352 - DNA, 17 bp, Homo sapiens
attgtgtgcgctgcctg

SEQ ID NO: 1651353 - DNA, 19 bp, Homo sapiens
attgtgtgcgctgcctggc

SEQ ID NO: 1651354 - DNA, 22 bp, Homo sapiens
attgtgtgcgctgcctggccag

SEQ ID NO: 1651355 - DNA, 17 bp, Homo sapiens
attgtgtgtctggtaac

SEQ ID NO: 1651356 - DNA, 16 bp, Homo sapiens
attgtgtgttatttaa

SEQ ID NO: 1651357 - DNA, 15 bp, Homo sapiens
attgtgttcccattt

SEQ ID NO: 1651358 - DNA, 14 bp, Homo sapiens
attgtgttgtgaat

SEQ ID NO: 1651359 - DNA, 12 bp, Homo sapiens
attgtgtttcta

SEQ ID NO: 1651360 - DNA, 17 bp, Homo sapiens
attgttaaacaaatgat

SEQ ID NO: 1651361 - DNA, 23 bp, Homo sapiens
attgttaagtctaaatatttcct

SEQ ID NO: 1651362 - DNA, 14 bp, Homo sapiens
attgttaatacaag

SEQ ID NO: 1651363 - DNA, 20 bp, Homo sapiens
attgttacaagtgttcttag

SEQ ID NO: 1651364 - DNA, 17 bp, Homo sapiens
attgttacatgtaatat

SEQ ID NO: 1651365 - DNA, 21 bp, Homo sapiens
attgttacctgtcattttgca

SEQ ID NO: 1651366 - DNA, 23 bp, Homo sapiens
attgttacctgtcattttgcact

SEQ ID NO: 1651367 - DNA, 19 bp, Homo sapiens
attgttacgtagcctaagg

SEQ ID NO: 1651368 - DNA, 16 bp, Homo sapiens
attgttagaaaatgac

SEQ ID NO: 1651369 - DNA, 23 bp, Homo sapiens
attgttaggagtggttctcattt

SEQ ID NO: 1651370 - DNA, 19 bp, Homo sapiens
attgttagggtcagccatt

SEQ ID NO: 1651371 - DNA, 12 bp, Homo sapiens
attgttagttta

SEQ ID NO: 1651372 - DNA, 18 bp, Homo sapiens
attgttcattttgagctg

SEQ ID NO: 1651373 - DNA, 16 bp, Homo sapiens
attgttcccttcctct

SEQ ID NO: 1651374 - DNA, 21 bp, Homo sapiens
attgttcctgaatacaagcct

SEQ ID NO: 1651375 - DNA, 17 bp, Homo sapiens
attgttctcagaatccc

SEQ ID NO: 1651376 - DNA, 19 bp, Homo sapiens
attgttcttagtttgcagt

SEQ ID NO: 1651377 - DNA, 18 bp, Homo sapiens
attgttcttattctggca

SEQ ID NO: 1651378 - DNA, 18 bp, Homo sapiens
attgttgaaaaagtttgt

SEQ ID NO: 1651379 - DNA, 17 bp, Homo sapiens
attgttgacagttctga

SEQ ID NO: 1651380 - DNA, 22 bp, Homo sapiens
attgttgacagttctgaagaat

SEQ ID NO: 1651381 - DNA, 20 bp, Homo sapiens
attgttgcataggttagata

SEQ ID NO: 1651382 - DNA, 16 bp, Homo sapiens
attgttgggaaaggaa

SEQ ID NO: 1651383 - DNA, 15 bp, Homo sapiens
attgttgtgcttaga

SEQ ID NO: 1651384 - DNA, 22 bp, Homo sapiens
attgttgtttgccatactttgt

SEQ ID NO: 1651385 - DNA, 12 bp, Homo sapiens
attgtttatgta

SEQ ID NO: 1651386 - DNA, 14 bp, Homo sapiens
attgtttattcttt

SEQ ID NO: 1651387 - DNA, 15 bp, Homo sapiens
attgtttatttatca

SEQ ID NO: 1651388 - DNA, 19 bp, Homo sapiens
attgtttatttatcagtga

SEQ ID NO: 1651389 - DNA, 13 bp, Homo sapiens
attgtttccaact

SEQ ID NO: 1651390 - DNA, 18 bp, Homo sapiens
attgtttccaacttgtct

SEQ ID NO: 1651391 - DNA, 17 bp, Homo sapiens
attgtttcctcttccaa

SEQ ID NO: 1651392 - DNA, 20 bp, Homo sapiens
attgtttcctcttccaaagt

SEQ ID NO: 1651393 - DNA, 16 bp, Homo sapiens
attgtttctctgaaag

SEQ ID NO: 1651394 - DNA, 20 bp, Homo sapiens
attgtttggcttcctcctga

SEQ ID NO: 1651395 - DNA, 17 bp, Homo sapiens
attgtttggtaaatgtt

SEQ ID NO: 1651396 - DNA, 18 bp, Homo sapiens
attgttttaccagctccc

SEQ ID NO: 1651397 - DNA, 15 bp, Homo sapiens
attgttttcacttgt

SEQ ID NO: 1651398 - DNA, 16 bp, Homo sapiens
attgttttcacttgta

SEQ ID NO: 1651399 - DNA, 19 bp, Homo sapiens
attgttttcacttgtattg

SEQ ID NO: 1651400 - DNA, 18 bp, Homo sapiens
attgttttcagtgtacat

SEQ ID NO: 1651401 - DNA, 19 bp, Homo sapiens
attgttttcagtgtacatg

SEQ ID NO: 1651402 - DNA, 12 bp, Homo sapiens
attgttttctgt

SEQ ID NO: 1651403 - DNA, 17 bp, Homo sapiens
attgttttctgtaaata

SEQ ID NO: 1651404 - DNA, 20 bp, Homo sapiens
attgttttgagctttccatg

SEQ ID NO: 1651405 - DNA, 13 bp, Homo sapiens
attgttttgcaaa

SEQ ID NO: 1651406 - DNA, 19 bp, Homo sapiens
attgttttgcaaaagtgta

SEQ ID NO: 1651407 - DNA, 22 bp, Homo sapiens
attgtttttaagaaaaacatgt

SEQ ID NO: 1651408 - DNA, 16 bp, Homo sapiens
attgtttttgaattta

SEQ ID NO: 1651409 - DNA, 15 bp, Homo sapiens
attgttttttaaaga

SEQ ID NO: 1651410 - DNA, 17 bp, Homo sapiens
atttaaaaaataaataa

SEQ ID NO: 1651411 - DNA, 22 bp, Homo sapiens
atttaaaaacaaccaacagaaa

SEQ ID NO: 1651412 - DNA, 14 bp, Homo sapiens
atttaaaaactgga

SEQ ID NO: 1651413 - DNA, 16 bp, Homo sapiens
atttaaaaatatttca

SEQ ID NO: 1651414 - DNA, 18 bp, Homo sapiens
atttaaaaatatttcaga

SEQ ID NO: 1651415 - DNA, 19 bp, Homo sapiens
atttaaaaatatttcagat

SEQ ID NO: 1651416 - DNA, 22 bp, Homo sapiens
atttaaaaatatttcagatatc

SEQ ID NO: 1651417 - DNA, 16 bp, Homo sapiens
atttaaaacagacact

SEQ ID NO: 1651418 - DNA, 14 bp, Homo sapiens
atttaaaacaggca

SEQ ID NO: 1651419 - DNA, 13 bp, Homo sapiens
atttaaaacatgt

SEQ ID NO: 1651420 - DNA, 14 bp, Homo sapiens
atttaaaacatgta

SEQ ID NO: 1651421 - DNA, 13 bp, Homo sapiens
atttaaaactgtt

SEQ ID NO: 1651422 - DNA, 13 bp, Homo sapiens
atttaaaagattc

SEQ ID NO: 1651423 - DNA, 16 bp, Homo sapiens
atttaaaagattcatt

SEQ ID NO: 1651424 - DNA, 23 bp, Homo sapiens
atttaaaataccactgtaattga

SEQ ID NO: 1651425 - DNA, 20 bp, Homo sapiens
atttaaaatggaaaattttc

SEQ ID NO: 1651426 - DNA, 19 bp, Homo sapiens
atttaaaattaagtagaac

SEQ ID NO: 1651427 - DNA, 15 bp, Homo sapiens
atttaaaattaatct

SEQ ID NO: 1651428 - DNA, 20 bp, Homo sapiens
atttaaaattaatcttgctt

SEQ ID NO: 1651429 - DNA, 19 bp, Homo sapiens
atttaaaattgtgatgtgt

SEQ ID NO: 1651430 - DNA, 22 bp, Homo sapiens
atttaaaatttcgttgtccaat

SEQ ID NO: 1651431 - DNA, 17 bp, Homo sapiens
atttaaacaggcccagc

SEQ ID NO: 1651432 - DNA, 19 bp, Homo sapiens
atttaaacaggcccagcat

SEQ ID NO: 1651433 - DNA, 16 bp, Homo sapiens
atttaaacctttttct

SEQ ID NO: 1651434 - DNA, 19 bp, Homo sapiens
atttaaacctttttcttga

SEQ ID NO: 1651435 - DNA, 17 bp, Homo sapiens
atttaaactatcttgtg

SEQ ID NO: 1651436 - DNA, 21 bp, Homo sapiens
atttaaactctgaatttatct

SEQ ID NO: 1651437 - DNA, 17 bp, Homo sapiens
atttaaactgtgtttta

SEQ ID NO: 1651438 - DNA, 16 bp, Homo sapiens
atttaaagacaaagac

SEQ ID NO: 1651439 - DNA, 16 bp, Homo sapiens
atttaaagttgtatct

SEQ ID NO: 1651440 - DNA, 23 bp, Homo sapiens
atttaaagttgtatcttgacaca

SEQ ID NO: 1651441 - DNA, 11 bp, Homo sapiens
atttaaataaa

SEQ ID NO: 1651442 - DNA, 22 bp, Homo sapiens
atttaaatataattctgtaaat

SEQ ID NO: 1651443 - DNA, 19 bp, Homo sapiens
atttaaatcgtactacaga

SEQ ID NO: 1651444 - DNA, 17 bp, Homo sapiens
atttaaatgaaagaaaa

SEQ ID NO: 1651445 - DNA, 18 bp, Homo sapiens
atttaaatgtaacttatt

SEQ ID NO: 1651446 - DNA, 19 bp, Homo sapiens
atttaaatttgatttccat

SEQ ID NO: 1651447 - DNA, 22 bp, Homo sapiens
atttaaatttgatttccatctt

SEQ ID NO: 1651448 - DNA, 16 bp, Homo sapiens
atttaacagaaattgt

SEQ ID NO: 1651449 - DNA, 17 bp, Homo sapiens
atttaacagaaattgta

SEQ ID NO: 1651450 - DNA, 22 bp, Homo sapiens
atttaacagaaattgtatattg

SEQ ID NO: 1651451 - DNA, 17 bp, Homo sapiens
atttaacagtcatttaa

SEQ ID NO: 1651452 - DNA, 20 bp, Homo sapiens
atttaacattatttatatgg

SEQ ID NO: 1651453 - DNA, 14 bp, Homo sapiens
atttaacccagctc

SEQ ID NO: 1651454 - DNA, 13 bp, Homo sapiens
atttaactgcctt

SEQ ID NO: 1651455 - DNA, 17 bp, Homo sapiens
atttaagaaaatacaat

SEQ ID NO: 1651456 - DNA, 14 bp, Homo sapiens
atttaagatgtgaa

SEQ ID NO: 1651457 - DNA, 18 bp, Homo sapiens
atttccagggcagcagcc

SEQ ID NO: 1651458 - DNA, 13 bp, Homo sapiens
atttccagtacct

SEQ ID NO: 1651459 - DNA, 20 bp, Homo sapiens
atttccagtacctttgtcac

SEQ ID NO: 1651460 - DNA, 12 bp, Homo sapiens
atttccatctta

SEQ ID NO: 1651461 - DNA, 18 bp, Homo sapiens
atttccatcttaatgtta

SEQ ID NO: 1651462 - DNA, 17 bp, Homo sapiens
atttcccaaagtcctct

SEQ ID NO: 1651463 - DNA, 20 bp, Homo sapiens
atttcccaaagtcctctgct

SEQ ID NO: 1651464 - DNA, 23 bp, Homo sapiens
atttcccaaagtcctctgctcca

SEQ ID NO: 1651465 - DNA, 17 bp, Homo sapiens
atttcccaattaggaag

SEQ ID NO: 1651466 - DNA, 15 bp, Homo sapiens
atttcccacatcttt

SEQ ID NO: 1651467 - DNA, 12 bp, Homo sapiens
atttcccaggac

SEQ ID NO: 1651468 - DNA, 14 bp, Homo sapiens
atttcccaggaccc

SEQ ID NO: 1651469 - DNA, 13 bp, Homo sapiens
atttcccatctgc

SEQ ID NO: 1651470 - DNA, 20 bp, Homo sapiens
atttccccacccccctctct

SEQ ID NO: 1651471 - DNA, 12 bp, Homo sapiens
atttccccagcc

SEQ ID NO: 1651472 - DNA, 15 bp, Homo sapiens
atttccccagccaca

SEQ ID NO: 1651473 - DNA, 15 bp, Homo sapiens
atttccccctcctca

SEQ ID NO: 1651474 - DNA, 16 bp, Homo sapiens
atttccccctcctcag

SEQ ID NO: 1651475 - DNA, 22 bp, Homo sapiens
atttcccctcccaatcctctct

SEQ ID NO: 1651476 - DNA, 18 bp, Homo sapiens
atttcccctcttctgcta

SEQ ID NO: 1651477 - DNA, 14 bp, Homo sapiens
atttccccttggac

SEQ ID NO: 1651478 - DNA, 14 bp, Homo sapiens
atttccctaaaaat

SEQ ID NO: 1651479 - DNA, 14 bp, Homo sapiens
atttccctctctca

SEQ ID NO: 1651480 - DNA, 14 bp, Homo sapiens
atttcccttccaaa

SEQ ID NO: 1651481 - DNA, 23 bp, Homo sapiens
atttccctttagctgtgttatta

SEQ ID NO: 1651482 - DNA, 21 bp, Homo sapiens
atttcctcagcttatctcttt

SEQ ID NO: 1651483 - DNA, 14 bp, Homo sapiens
atttcctccatggt

SEQ ID NO: 1651484 - DNA, 23 bp, Homo sapiens
atttcctccatggtggaaggggg

SEQ ID NO: 1651485 - DNA, 11 bp, Homo sapiens
atttcctctat

SEQ ID NO: 1651486 - DNA, 18 bp, Homo sapiens
atttcctctattgatgta

SEQ ID NO: 1651487 - DNA, 19 bp, Homo sapiens
atttcctctattgatgtac

SEQ ID NO: 1651488 - DNA, 22 bp, Homo sapiens
atttcctctattgatgtacagt

SEQ ID NO: 1651489 - DNA, 16 bp, Homo sapiens
atttcctctccactgc

SEQ ID NO: 1651490 - DNA, 21 bp, Homo sapiens
atttcctgaacctggaaatga

SEQ ID NO: 1651491 - DNA, 19 bp, Homo sapiens
atttcctgatacattaaaa

SEQ ID NO: 1651492 - DNA, 13 bp, Homo sapiens
atttcctgccctt

SEQ ID NO: 1651493 - DNA, 13 bp, Homo sapiens
atttcctgctgaa

SEQ ID NO: 1651494 - DNA, 13 bp, Homo sapiens
atttcctggccct

SEQ ID NO: 1651495 - DNA, 14 bp, Homo sapiens
atttcctgtttgaa

SEQ ID NO: 1651496 - DNA, 18 bp, Homo sapiens
atttccttaaactgtgtg

SEQ ID NO: 1651497 - DNA, 16 bp, Homo sapiens
atttccttggaggcca

SEQ ID NO: 1651498 - DNA, 16 bp, Homo sapiens
atttcctttatgtgaa

SEQ ID NO: 1651499 - DNA, 18 bp, Homo sapiens
atttcctttatgtgaatt

SEQ ID NO: 1651500 - DNA, 20 bp, Homo sapiens
atttcctttatgtgaatttt

SEQ ID NO: 1651501 - DNA, 21 bp, Homo sapiens
atttcctttatgtgaattttt

SEQ ID NO: 1651502 - DNA, 16 bp, Homo sapiens
atttccttttcttccc

SEQ ID NO: 1651503 - DNA, 21 bp, Homo sapiens
atttccttttcttccctgacc

SEQ ID NO: 1651504 - DNA, 18 bp, Homo sapiens
atttcctttttgacactg

SEQ ID NO: 1651505 - DNA, 19 bp, Homo sapiens
atttcgttgtccaatttgt

SEQ ID NO: 1651506 - DNA, 21 bp, Homo sapiens
atttctaaaaaacagaggcca

SEQ ID NO: 1651507 - DNA, 18 bp, Homo sapiens
atttctaacagtccttgc

SEQ ID NO: 1651508 - DNA, 20 bp, Homo sapiens
atttctaacagtccttgctt

SEQ ID NO: 1651509 - DNA, 14 bp, Homo sapiens
atttctaactatat

SEQ ID NO: 1651510 - DNA, 21 bp, Homo sapiens
atttctaagcgcctattgttt

SEQ ID NO: 1651511 - DNA, 13 bp, Homo sapiens
atttctaattgta

SEQ ID NO: 1651512 - DNA, 19 bp, Homo sapiens
atttctacaactggagttt

SEQ ID NO: 1651513 - DNA, 17 bp, Homo sapiens
atttctaccatttcaga

SEQ ID NO: 1651514 - DNA, 21 bp, Homo sapiens
atttctactttttgcacctta

SEQ ID NO: 1651515 - DNA, 15 bp, Homo sapiens
atttctagtaggcag

SEQ ID NO: 1651516 - DNA, 20 bp, Homo sapiens
atttctagtaggcagcaaaa

SEQ ID NO: 1651517 - DNA, 20 bp, Homo sapiens
atttctagtccaaaattaca

SEQ ID NO: 1651518 - DNA, 14 bp, Homo sapiens
atttctataaatag

SEQ ID NO: 1651519 - DNA, 20 bp, Homo sapiens
atttctatactttacaggaa

SEQ ID NO: 1651520 - DNA, 15 bp, Homo sapiens
atttctatatttatt

SEQ ID NO: 1651521 - DNA, 16 bp, Homo sapiens
atttctatctgcaaat

SEQ ID NO: 1651522 - DNA, 17 bp, Homo sapiens
atttctatctgcaaata

SEQ ID NO: 1651523 - DNA, 15 bp, Homo sapiens
atttctatgacaaat

SEQ ID NO: 1651524 - DNA, 19 bp, Homo sapiens
atttctatgacaaattcaa

SEQ ID NO: 1651525 - DNA, 12 bp, Homo sapiens
atttctatgtca

SEQ ID NO: 1651526 - DNA, 13 bp, Homo sapiens
atttctatgtcat

SEQ ID NO: 1651527 - DNA, 13 bp, Homo sapiens
atttctattaata

SEQ ID NO: 1651528 - DNA, 16 bp, Homo sapiens
atttctatttatttac

SEQ ID NO: 1651529 - DNA, 16 bp, Homo sapiens
atttctccatctttat

SEQ ID NO: 1651530 - DNA, 12 bp, Homo sapiens
atttctcctccc

SEQ ID NO: 1651531 - DNA, 19 bp, Homo sapiens
atttctcctcccttccttt

SEQ ID NO: 1651532 - DNA, 20 bp, Homo sapiens
atttctctaactcctgccat

SEQ ID NO: 1651533 - DNA, 23 bp, Homo sapiens
atttctctattttcataatcagt

SEQ ID NO: 1651534 - DNA, 14 bp, Homo sapiens
atttctctccccac

SEQ ID NO: 1651535 - DNA, 15 bp, Homo sapiens
atttctcttgtcctt

SEQ ID NO: 1651536 - DNA, 19 bp, Homo sapiens
atttctctttaaactatgt

SEQ ID NO: 1651537 - DNA, 17 bp, Homo sapiens
atttctgagaaggtcct

SEQ ID NO: 1651538 - DNA, 15 bp, Homo sapiens
atttctgataaagtt

SEQ ID NO: 1651539 - DNA, 21 bp, Homo sapiens
atttctgcagatcttccgtgg

SEQ ID NO: 1651540 - DNA, 13 bp, Homo sapiens
atttctgccagcg

SEQ ID NO: 1651541 - DNA, 13 bp, Homo sapiens
atttctgctctgg

SEQ ID NO: 1651542 - DNA, 18 bp, Homo sapiens
atttctgctctggaataa

SEQ ID NO: 1651543 - DNA, 15 bp, Homo sapiens
atttctgctcttcca

SEQ ID NO: 1651544 - DNA, 20 bp, Homo sapiens
atttctgctcttccaaagct

SEQ ID NO: 1651545 - DNA, 18 bp, Homo sapiens
atttctggcatatgtttc

SEQ ID NO: 1651546 - DNA, 17 bp, Homo sapiens
atttctggctgggtcac

SEQ ID NO: 1651547 - DNA, 23 bp, Homo sapiens
atttctgtctctaaccattcaaa

SEQ ID NO: 1651548 - DNA, 13 bp, Homo sapiens
atttctgtgggag

SEQ ID NO: 1651549 - DNA, 23 bp, Homo sapiens
atttctgtgttgccaagctccaa

SEQ ID NO: 1651550 - DNA, 22 bp, Homo sapiens
atttctgtttcctatttaatac

SEQ ID NO: 1651551 - DNA, 23 bp, Homo sapiens
atttcttaaataatgcttcagat

SEQ ID NO: 1651552 - DNA, 19 bp, Homo sapiens
atttcttaacttcttgctt

SEQ ID NO: 1651553 - DNA, 17 bp, Homo sapiens
atttcttaatgtaacat

SEQ ID NO: 1651554 - DNA, 21 bp, Homo sapiens
atttcttaatgtaacatgttt

SEQ ID NO: 1651555 - DNA, 22 bp, Homo sapiens
atttcttagtgcttcagagttt

SEQ ID NO: 1651556 - DNA, 14 bp, Homo sapiens
atttcttatatatg

SEQ ID NO: 1651557 - DNA, 18 bp, Homo sapiens
atttcttatcaccacagt

SEQ ID NO: 1651558 - DNA, 19 bp, Homo sapiens
atttcttatcaccacagta

SEQ ID NO: 1651559 - DNA, 18 bp, Homo sapiens
atttcttatgtgacatta

SEQ ID NO: 1651560 - DNA, 17 bp, Homo sapiens
atttcttcacttcaagc

SEQ ID NO: 1651561 - DNA, 15 bp, Homo sapiens
atttcttcagagttt

SEQ ID NO: 1651562 - DNA, 21 bp, Homo sapiens
atttcttcccagaatctctga

SEQ ID NO: 1651563 - DNA, 15 bp, Homo sapiens
atttcttccctgctt

SEQ ID NO: 1651564 - DNA, 19 bp, Homo sapiens
atttcttccctgctttgca

SEQ ID NO: 1651565 - DNA, 16 bp, Homo sapiens
atttcttcctcactat

SEQ ID NO: 1651566 - DNA, 20 bp, Homo sapiens
atttcttctcttatcctctc

SEQ ID NO: 1651567 - DNA, 22 bp, Homo sapiens
atttcttctcttatcctctctc

SEQ ID NO: 1651568 - DNA, 13 bp, Homo sapiens
atttcttcttaga

SEQ ID NO: 1651569 - DNA, 21 bp, Homo sapiens
atttcttctttagatgccaaa

SEQ ID NO: 1651570 - DNA, 21 bp, Homo sapiens
atttcttgagttttgttttaa

SEQ ID NO: 1651571 - DNA, 12 bp, Homo sapiens
atttcttgcttt

SEQ ID NO: 1651572 - DNA, 13 bp, Homo sapiens
attttagtgtatt

SEQ ID NO: 1651573 - DNA, 19 bp, Homo sapiens
attttagtttttcattaaa

SEQ ID NO: 1651574 - DNA, 18 bp, Homo sapiens
attttatagctcagttta

SEQ ID NO: 1651575 - DNA, 15 bp, Homo sapiens
attttatatcattgg

SEQ ID NO: 1651576 - DNA, 14 bp, Homo sapiens
attttatatcttgt

SEQ ID NO: 1651577 - DNA, 13 bp, Homo sapiens
attttatatgatg

SEQ ID NO: 1651578 - DNA, 15 bp, Homo sapiens
attttatatgcttac

SEQ ID NO: 1651579 - DNA, 22 bp, Homo sapiens
attttatattactgacatttct

SEQ ID NO: 1651580 - DNA, 19 bp, Homo sapiens
attttatatttttgtacat

SEQ ID NO: 1651581 - DNA, 13 bp, Homo sapiens
attttatcattaa

SEQ ID NO: 1651582 - DNA, 14 bp, Homo sapiens
attttatcctgtat

SEQ ID NO: 1651583 - DNA, 20 bp, Homo sapiens
attttatctttgattctcct

SEQ ID NO: 1651584 - DNA, 21 bp, Homo sapiens
attttatctttgattctcctt

SEQ ID NO: 1651585 - DNA, 21 bp, Homo sapiens
attttatgaaaggtttacatt

SEQ ID NO: 1651586 - DNA, 18 bp, Homo sapiens
attttatgaacattgtac

SEQ ID NO: 1651587 - DNA, 16 bp, Homo sapiens
attttatgaatgtctt

SEQ ID NO: 1651588 - DNA, 17 bp, Homo sapiens
attttatgatcagtgtt

SEQ ID NO: 1651589 - DNA, 18 bp, Homo sapiens
attttatgatcagtgttg

SEQ ID NO: 1651590 - DNA, 19 bp, Homo sapiens
attttatggctcactatga

SEQ ID NO: 1651591 - DNA, 22 bp, Homo sapiens
attttatgtattctttctgcct

SEQ ID NO: 1651592 - DNA, 22 bp, Homo sapiens
attttatgttaagggaagaatt

SEQ ID NO: 1651593 - DNA, 20 bp, Homo sapiens
attttattaaaaataaaata

SEQ ID NO: 1651594 - DNA, 15 bp, Homo sapiens
attttattaaatgca

SEQ ID NO: 1651595 - DNA, 20 bp, Homo sapiens
attttattacatctttcaca

SEQ ID NO: 1651596 - DNA, 14 bp, Homo sapiens
attttattctatgt

SEQ ID NO: 1651597 - DNA, 11 bp, Homo sapiens
attttattctt

SEQ ID NO: 1651598 - DNA, 14 bp, Homo sapiens
attttattcttgat

SEQ ID NO: 1651599 - DNA, 20 bp, Homo sapiens
attttattctttaagttcac

SEQ ID NO: 1651600 - DNA, 17 bp, Homo sapiens
attttatttagacaaga

SEQ ID NO: 1651601 - DNA, 19 bp, Homo sapiens
attttatttagacaagaga

SEQ ID NO: 1651602 - DNA, 17 bp, Homo sapiens
attttatttatttaatt

SEQ ID NO: 1651603 - DNA, 22 bp, Homo sapiens
attttatttgtaattttaaaag

SEQ ID NO: 1651604 - DNA, 16 bp, Homo sapiens
attttattttgctgag

SEQ ID NO: 1651605 - DNA, 15 bp, Homo sapiens
attttcaaagaaaat

SEQ ID NO: 1651606 - DNA, 15 bp, Homo sapiens
attttcaaagactta

SEQ ID NO: 1651607 - DNA, 18 bp, Homo sapiens
attttcaacgcagccctg

SEQ ID NO: 1651608 - DNA, 13 bp, Homo sapiens
attttcaagaaac

SEQ ID NO: 1651609 - DNA, 14 bp, Homo sapiens
attttcaagaaact

SEQ ID NO: 1651610 - DNA, 17 bp, Homo sapiens
attttcaagaaactgag

SEQ ID NO: 1651611 - DNA, 15 bp, Homo sapiens
attttcaagattcta

SEQ ID NO: 1651612 - DNA, 18 bp, Homo sapiens
attttcaagattctaaag

SEQ ID NO: 1651613 - DNA, 23 bp, Homo sapiens
attttcaagattctaaagctcaa

SEQ ID NO: 1651614 - DNA, 15 bp, Homo sapiens
attttcaaggccttc

SEQ ID NO: 1651615 - DNA, 17 bp, Homo sapiens
attttcaaggccttcag

SEQ ID NO: 1651616 - DNA, 12 bp, Homo sapiens
attttcaagtaa

SEQ ID NO: 1651617 - DNA, 17 bp, Homo sapiens
attttcacactggtaaa

SEQ ID NO: 1651618 - DNA, 16 bp, Homo sapiens
attttcactggaagat

SEQ ID NO: 1651619 - DNA, 14 bp, Homo sapiens
attttcactttgtg

SEQ ID NO: 1651620 - DNA, 17 bp, Homo sapiens
attttcagcaaactctt

SEQ ID NO: 1651621 - DNA, 18 bp, Homo sapiens
attttcagcaaactcttt

SEQ ID NO: 1651622 - DNA, 17 bp, Homo sapiens
attttcagtatactgtg

SEQ ID NO: 1651623 - DNA, 17 bp, Homo sapiens
attttcataatcagtaa

SEQ ID NO: 1651624 - DNA, 22 bp, Homo sapiens
attttcatacagcattacaaat

SEQ ID NO: 1651625 - DNA, 21 bp, Homo sapiens
attttcatgaaaataccattt

SEQ ID NO: 1651626 - DNA, 15 bp, Homo sapiens
attttcattaaaagc

SEQ ID NO: 1651627 - DNA, 16 bp, Homo sapiens
attttcattaaacttg

SEQ ID NO: 1651628 - DNA, 17 bp, Homo sapiens
attttcatttgtacaag

SEQ ID NO: 1651629 - DNA, 20 bp, Homo sapiens
attttccacaagattcccag

SEQ ID NO: 1651630 - DNA, 21 bp, Homo sapiens
attttccacaagattcccaga

SEQ ID NO: 1651631 - DNA, 13 bp, Homo sapiens
attttccataaat

SEQ ID NO: 1651632 - DNA, 17 bp, Homo sapiens
attttccataaatttgg

SEQ ID NO: 1651633 - DNA, 20 bp, Homo sapiens
attttcccactcattctgaa

SEQ ID NO: 1651634 - DNA, 20 bp, Homo sapiens
attttcccatcatcctttgt

SEQ ID NO: 1651635 - DNA, 20 bp, Homo sapiens
attttcccccactactgcag

SEQ ID NO: 1651636 - DNA, 20 bp, Homo sapiens
attttccgggaactttgcag

SEQ ID NO: 1651637 - DNA, 16 bp, Homo sapiens
attttcctagcatcag

SEQ ID NO: 1651638 - DNA, 12 bp, Homo sapiens
attttcctctga

SEQ ID NO: 1651639 - DNA, 11 bp, Homo sapiens
attttcctctt

SEQ ID NO: 1651640 - DNA, 18 bp, Homo sapiens
attttcctggtgccaatt

SEQ ID NO: 1651641 - DNA, 17 bp, Homo sapiens
attttcctgttcagtga

SEQ ID NO: 1651642 - DNA, 17 bp, Homo sapiens
attttcctttgtcattt

SEQ ID NO: 1651643 - DNA, 17 bp, Homo sapiens
attttcgggctgagaag

SEQ ID NO: 1651644 - DNA, 15 bp, Homo sapiens
attttctaaaagctt

SEQ ID NO: 1651645 - DNA, 14 bp, Homo sapiens
attttctaaactgt

SEQ ID NO: 1651646 - DNA, 12 bp, Homo sapiens
attttctaaata

SEQ ID NO: 1651647 - DNA, 16 bp, Homo sapiens
attttctattttaaga

SEQ ID NO: 1651648 - DNA, 23 bp, Homo sapiens
attttctattttaagactgattt

SEQ ID NO: 1651649 - DNA, 14 bp, Homo sapiens
attttctctgtact

SEQ ID NO: 1651650 - DNA, 16 bp, Homo sapiens
attttctctgtacttt

SEQ ID NO: 1651651 - DNA, 17 bp, Homo sapiens
attttctctgtactttt

SEQ ID NO: 1651652 - DNA, 16 bp, Homo sapiens
attttctgaattcata

SEQ ID NO: 1651653 - DNA, 13 bp, Homo sapiens
attttctgcagct

SEQ ID NO: 1651654 - DNA, 15 bp, Homo sapiens
attttctgcagctgt

SEQ ID NO: 1651655 - DNA, 14 bp, Homo sapiens
attttctggttcta

SEQ ID NO: 1651656 - DNA, 17 bp, Homo sapiens
attttctggttctaaca

SEQ ID NO: 1651657 - DNA, 18 bp, Homo sapiens
attttctgtggatcattt

SEQ ID NO: 1651658 - DNA, 21 bp, Homo sapiens
attttcttcatgcaatgacat

SEQ ID NO: 1651659 - DNA, 21 bp, Homo sapiens
attttcttccaagcaaaggtg

SEQ ID NO: 1651660 - DNA, 18 bp, Homo sapiens
attttcttctctgtgaga

SEQ ID NO: 1651661 - DNA, 16 bp, Homo sapiens
attttcttgaggaaaa

SEQ ID NO: 1651662 - DNA, 15 bp, Homo sapiens
attttctttctatgt

SEQ ID NO: 1651663 - DNA, 16 bp, Homo sapiens
attttcttttatatct

SEQ ID NO: 1651664 - DNA, 17 bp, Homo sapiens
attttcttttatatctg

SEQ ID NO: 1651665 - DNA, 13 bp, Homo sapiens
attttcttttctt

SEQ ID NO: 1651666 - DNA, 17 bp, Homo sapiens
attttcttttgtaaatg

SEQ ID NO: 1651667 - DNA, 19 bp, Homo sapiens
attttcttttgtaaatgtt

SEQ ID NO: 1651668 - DNA, 23 bp, Homo sapiens
attttctttttttaactggtgaa

SEQ ID NO: 1651669 - DNA, 15 bp, Homo sapiens
attttgaaggaaaat

SEQ ID NO: 1651670 - DNA, 20 bp, Homo sapiens
attttgaataaataaatgta

SEQ ID NO: 1651671 - DNA, 15 bp, Homo sapiens
attttgaataccatt

SEQ ID NO: 1651672 - DNA, 18 bp, Homo sapiens
attttgacggacactgtg

SEQ ID NO: 1651673 - DNA, 18 bp, Homo sapiens
attttgactgtgatttat

SEQ ID NO: 1651674 - DNA, 20 bp, Homo sapiens
attttgaggttttgtaaaac

SEQ ID NO: 1651675 - DNA, 22 bp, Homo sapiens
attttgaggttttgtaaaactg

SEQ ID NO: 1651676 - DNA, 15 bp, Homo sapiens
attttgagtattcca

SEQ ID NO: 1651677 - DNA, 19 bp, Homo sapiens
attttgagtattccatgag

SEQ ID NO: 1651678 - DNA, 18 bp, Homo sapiens
attttgagtatttttaaa

SEQ ID NO: 1651679 - DNA, 19 bp, Homo sapiens
attttgagtcctaggactt

SEQ ID NO: 1651680 - DNA, 20 bp, Homo sapiens
attttgagtcctaggactta

SEQ ID NO: 1651681 - DNA, 19 bp, Homo sapiens
attttgatatacattgtgt

SEQ ID NO: 1651682 - DNA, 23 bp, Homo sapiens
attttgatttttaatggaaagtt

SEQ ID NO: 1651683 - DNA, 20 bp, Homo sapiens
attttgcaaaaatcctattc

SEQ ID NO: 1651684 - DNA, 19 bp, Homo sapiens
attttgcaaaatttccagt

SEQ ID NO: 1651685 - DNA, 21 bp, Homo sapiens
attttgcaaagatttaatctg

SEQ ID NO: 1651686 - DNA, 18 bp, Homo sapiens
attttgcactctgtaatt

SEQ ID NO: 1651687 - DNA, 15 bp, Homo sapiens
caaacacctcccagg

SEQ ID NO: 1651688 - DNA, 12 bp, Homo sapiens
caaacaccttcc

SEQ ID NO: 1651689 - DNA, 14 bp, Homo sapiens
caaacaccttccag

SEQ ID NO: 1651690 - DNA, 21 bp, Homo sapiens
caaacaccttccagctcctgt

SEQ ID NO: 1651691 - DNA, 17 bp, Homo sapiens
caaacactgcagtttcc

SEQ ID NO: 1651692 - DNA, 16 bp, Homo sapiens
caaacacttctgcttt

SEQ ID NO: 1651693 - DNA, 21 bp, Homo sapiens
caaacacttctgctttcactt

SEQ ID NO: 1651694 - DNA, 18 bp, Homo sapiens
caaacagagctactgaga

SEQ ID NO: 1651695 - DNA, 22 bp, Homo sapiens
caaacagagtatgtccgatggt

SEQ ID NO: 1651696 - DNA, 21 bp, Homo sapiens
caaacagcaagagtaagcagt

SEQ ID NO: 1651697 - DNA, 14 bp, Homo sapiens
caaacaggctgtaa

SEQ ID NO: 1651698 - DNA, 15 bp, Homo sapiens
caaacagtctcagga

SEQ ID NO: 1651699 - DNA, 18 bp, Homo sapiens
caaacatcagacctgtct

SEQ ID NO: 1651700 - DNA, 16 bp, Homo sapiens
caaacatcagctgaat

SEQ ID NO: 1651701 - DNA, 19 bp, Homo sapiens
caaacatcagctgaattca

SEQ ID NO: 1651702 - DNA, 15 bp, Homo sapiens
caaacatggagaaat

SEQ ID NO: 1651703 - DNA, 19 bp, Homo sapiens
caaacattcgtgagctggg

SEQ ID NO: 1651704 - DNA, 14 bp, Homo sapiens
caaacattcttatt

SEQ ID NO: 1651705 - DNA, 16 bp, Homo sapiens
caaacattcttatttt

SEQ ID NO: 1651706 - DNA, 19 bp, Homo sapiens
caaacattcttattttaga

SEQ ID NO: 1651707 - DNA, 14 bp, Homo sapiens
caaacatttcaaag

SEQ ID NO: 1651708 - DNA, 15 bp, Homo sapiens
caaacatttcaaagt

SEQ ID NO: 1651709 - DNA, 14 bp, Homo sapiens
caaaccacaactga

SEQ ID NO: 1651710 - DNA, 19 bp, Homo sapiens
caaaccacgcctcttgacc

SEQ ID NO: 1651711 - DNA, 18 bp, Homo sapiens
caaaccagccttcggagc

SEQ ID NO: 1651712 - DNA, 12 bp, Homo sapiens
caaaccatgcct

SEQ ID NO: 1651713 - DNA, 16 bp, Homo sapiens
caaaccattacctgta

SEQ ID NO: 1651714 - DNA, 22 bp, Homo sapiens
caaacccaaaaaagaacaagct

SEQ ID NO: 1651715 - DNA, 21 bp, Homo sapiens
caaacccagaggtggatgtta

SEQ ID NO: 1651716 - DNA, 16 bp, Homo sapiens
caaacccagtctcctc

SEQ ID NO: 1651717 - DNA, 18 bp, Homo sapiens
caaaccccacttcccctc

SEQ ID NO: 1651718 - DNA, 22 bp, Homo sapiens
caaacccccaaaatccaaaact

SEQ ID NO: 1651719 - DNA, 18 bp, Homo sapiens
caaaccctagccttgctt

SEQ ID NO: 1651720 - DNA, 20 bp, Homo sapiens
caaaccctagccttgcttgt

SEQ ID NO: 1651721 - DNA, 15 bp, Homo sapiens
caaaccctcccagaa

SEQ ID NO: 1651722 - DNA, 16 bp, Homo sapiens
caaaccctcctgggaa

SEQ ID NO: 1651723 - DNA, 11 bp, Homo sapiens
caaaccctgct

SEQ ID NO: 1651724 - DNA, 14 bp, Homo sapiens
caaaccctgcttct

SEQ ID NO: 1651725 - DNA, 13 bp, Homo sapiens
caaaccggcaggt

SEQ ID NO: 1651726 - DNA, 15 bp, Homo sapiens
caaacctaccaaaat

SEQ ID NO: 1651727 - DNA, 14 bp, Homo sapiens
caaacctactgccc

SEQ ID NO: 1651728 - DNA, 22 bp, Homo sapiens
caaacctactgcccacatttgg

SEQ ID NO: 1651729 - DNA, 15 bp, Homo sapiens
caaacctcaaatata

SEQ ID NO: 1651730 - DNA, 17 bp, Homo sapiens
caaacctcactgagagg

SEQ ID NO: 1651731 - DNA, 20 bp, Homo sapiens
caaacctgacccctgctcag

SEQ ID NO: 1651732 - DNA, 19 bp, Homo sapiens
caaacctgtcttggggcca

SEQ ID NO: 1651733 - DNA, 14 bp, Homo sapiens
caaacctttgagta

SEQ ID NO: 1651734 - DNA, 20 bp, Homo sapiens
caaacgccctttcctcctca

SEQ ID NO: 1651735 - DNA, 22 bp, Homo sapiens
caaacgccctttcctcctcagg

SEQ ID NO: 1651736 - DNA, 17 bp, Homo sapiens
caaacgcctcccctgcc

SEQ ID NO: 1651737 - DNA, 13 bp, Homo sapiens
caaacgctaaaga

SEQ ID NO: 1651738 - DNA, 23 bp, Homo sapiens
caaacgctaaagagcccttgcct

SEQ ID NO: 1651739 - DNA, 19 bp, Homo sapiens
caaacggaggaagcccaca

SEQ ID NO: 1651740 - DNA, 12 bp, Homo sapiens
caaacgtcccca

SEQ ID NO: 1651741 - DNA, 23 bp, Homo sapiens
caaacgtctattttgtatatttg

SEQ ID NO: 1651742 - DNA, 21 bp, Homo sapiens
caaacgtgaaattctattgaa

SEQ ID NO: 1651743 - DNA, 21 bp, Homo sapiens
caaacgtttctcaaatctgct

SEQ ID NO: 1651744 - DNA, 17 bp, Homo sapiens
caaactacagaataatg

SEQ ID NO: 1651745 - DNA, 23 bp, Homo sapiens
caaactactgaatgaagcagtat

SEQ ID NO: 1651746 - DNA, 19 bp, Homo sapiens
caaactcactgctcaagaa

SEQ ID NO: 1651747 - DNA, 23 bp, Homo sapiens
caaactcagttccaaagtcacag

SEQ ID NO: 1651748 - DNA, 16 bp, Homo sapiens
caaactctgccagcca

SEQ ID NO: 1651749 - DNA, 17 bp, Homo sapiens
caaactgaaattcagag

SEQ ID NO: 1651750 - DNA, 22 bp, Homo sapiens
caaactgaggaatttcacctgt

SEQ ID NO: 1651751 - DNA, 17 bp, Homo sapiens
caaactgcctaagccct

SEQ ID NO: 1651752 - DNA, 16 bp, Homo sapiens
caaactgcctcaatcc

SEQ ID NO: 1651753 - DNA, 19 bp, Homo sapiens
caaactggggcctccagaa

SEQ ID NO: 1651754 - DNA, 20 bp, Homo sapiens
caaactgtgaaaatagtgta

SEQ ID NO: 1651755 - DNA, 20 bp, Homo sapiens
caaactgttcaagaaataat

SEQ ID NO: 1651756 - DNA, 16 bp, Homo sapiens
caaacttaaacaaaaa

SEQ ID NO: 1651757 - DNA, 13 bp, Homo sapiens
caaacttactatt

SEQ ID NO: 1651758 - DNA, 14 bp, Homo sapiens
caaacttactattt

SEQ ID NO: 1651759 - DNA, 21 bp, Homo sapiens
caaagaaaaaaaaaaaagcca

SEQ ID NO: 1651760 - DNA, 17 bp, Homo sapiens
caaagaaacaaagatgt

SEQ ID NO: 1651761 - DNA, 20 bp, Homo sapiens
caaagaaacaagctgtgcag

SEQ ID NO: 1651762 - DNA, 21 bp, Homo sapiens
caaagaaacactaagctctct

SEQ ID NO: 1651763 - DNA, 22 bp, Homo sapiens
caaagaaacactaagctctctg

SEQ ID NO: 1651764 - DNA, 13 bp, Homo sapiens
caaagaaagtgta

SEQ ID NO: 1651765 - DNA, 14 bp, Homo sapiens
caaagaaatgtaag

SEQ ID NO: 1651766 - DNA, 15 bp, Homo sapiens
caaagaacttgctgc

SEQ ID NO: 1651767 - DNA, 11 bp, Homo sapiens
caaagaagagt

SEQ ID NO: 1651768 - DNA, 21 bp, Homo sapiens
caaagaagcttccacaaaatt

SEQ ID NO: 1651769 - DNA, 22 bp, Homo sapiens
caaagaaggcatttgcagggtc

SEQ ID NO: 1651770 - DNA, 14 bp, Homo sapiens
caaagaattacagt

SEQ ID NO: 1651771 - DNA, 15 bp, Homo sapiens
caaagaattacagta

SEQ ID NO: 1651772 - DNA, 14 bp, Homo sapiens
caaagacaggcaaa

SEQ ID NO: 1651773 - DNA, 13 bp, Homo sapiens
caaagacatcagt

SEQ ID NO: 1651774 - DNA, 20 bp, Homo sapiens
caaagacatgctttccattt

SEQ ID NO: 1651775 - DNA, 20 bp, Homo sapiens
caaagacctgcctgtgtgct

SEQ ID NO: 1651776 - DNA, 12 bp, Homo sapiens
caaagactattt

SEQ ID NO: 1651777 - DNA, 13 bp, Homo sapiens
caaagactccttg

SEQ ID NO: 1651778 - DNA, 17 bp, Homo sapiens
caaagactccttgtgga

SEQ ID NO: 1651779 - DNA, 15 bp, Homo sapiens
caaagactctggagg

SEQ ID NO: 1651780 - DNA, 22 bp, Homo sapiens
caaagacttaagcccagtgcac

SEQ ID NO: 1651781 - DNA, 21 bp, Homo sapiens
caaagagagttaaaagcagca

SEQ ID NO: 1651782 - DNA, 15 bp, Homo sapiens
caaagaggctgcccc

SEQ ID NO: 1651783 - DNA, 13 bp, Homo sapiens
caaagaggtattt

SEQ ID NO: 1651784 - DNA, 20 bp, Homo sapiens
caaagaggttggagcaacaa

SEQ ID NO: 1651785 - DNA, 14 bp, Homo sapiens
caaagatagacagg

SEQ ID NO: 1651786 - DNA, 15 bp, Homo sapiens
caaagatcaaaataa

SEQ ID NO: 1651787 - DNA, 17 bp, Homo sapiens
caaagatcaaaataaaa

SEQ ID NO: 1651788 - DNA, 18 bp, Homo sapiens
caaagatcaaaataaaaa

SEQ ID NO: 1651789 - DNA, 20 bp, Homo sapiens
caaagatcaaaataaaaagt

SEQ ID NO: 1651790 - DNA, 15 bp, Homo sapiens
caaagatcacttgtt

SEQ ID NO: 1651791 - DNA, 18 bp, Homo sapiens
caaagatctctagagttt

SEQ ID NO: 1651792 - DNA, 15 bp, Homo sapiens
caaagattaaatgtg

SEQ ID NO: 1651793 - DNA, 17 bp, Homo sapiens
caaagattcaaaattga

SEQ ID NO: 1651794 - DNA, 16 bp, Homo sapiens
caaagattcatgattt

SEQ ID NO: 1651795 - DNA, 15 bp, Homo sapiens
caaagattgagaagc

SEQ ID NO: 1651796 - DNA, 14 bp, Homo sapiens
caaagcaagggctc

SEQ ID NO: 1651797 - DNA, 18 bp, Homo sapiens
caaagcaagggctccagc

SEQ ID NO: 1651798 - DNA, 20 bp, Homo sapiens
caaagcaatgtgagtcccag

SEQ ID NO: 1651799 - DNA, 15 bp, Homo sapiens
caaagcacagctggg

SEQ ID NO: 1651800 - DNA, 16 bp, Homo sapiens
caaagcacagctgggc

SEQ ID NO: 1651801 - DNA, 17 bp, Homo sapiens
caaagcacagtttgaac

SEQ ID NO: 1651802 - DNA, 22 bp, Homo sapiens
caaattgagataatgatactta

SEQ ID NO: 1651803 - DNA, 23 bp, Homo sapiens
caaattgagtttaacaataataa

SEQ ID NO: 1651804 - DNA, 15 bp, Homo sapiens
caaattgccttcagc

SEQ ID NO: 1651805 - DNA, 20 bp, Homo sapiens
caaattgcttttttccaaaa

SEQ ID NO: 1651806 - DNA, 17 bp, Homo sapiens
caaattgtactagttgt

SEQ ID NO: 1651807 - DNA, 16 bp, Homo sapiens
caaatttatgcatttc

SEQ ID NO: 1651808 - DNA, 17 bp, Homo sapiens
caaatttatgcatttca

SEQ ID NO: 1651809 - DNA, 20 bp, Homo sapiens
caaatttggccttaagaact

SEQ ID NO: 1651810 - DNA, 20 bp, Homo sapiens
caaatttgtacctctaagta

SEQ ID NO: 1651811 - DNA, 17 bp, Homo sapiens
caaatttgtcttgcctt

SEQ ID NO: 1651812 - DNA, 16 bp, Homo sapiens
caaattttaaaacatt

SEQ ID NO: 1651813 - DNA, 16 bp, Homo sapiens
caaattttcagaaggt

SEQ ID NO: 1651814 - DNA, 15 bp, Homo sapiens
caaattttggccaaa

SEQ ID NO: 1651815 - DNA, 14 bp, Homo sapiens
caacaaaatacatt

SEQ ID NO: 1651816 - DNA, 14 bp, Homo sapiens
caacaaagaacact

SEQ ID NO: 1651817 - DNA, 15 bp, Homo sapiens
caacaaagacatgct

SEQ ID NO: 1651818 - DNA, 20 bp, Homo sapiens
caacaaagagcgagtcccct

SEQ ID NO: 1651819 - DNA, 22 bp, Homo sapiens
caacaaatattcactggcccct

SEQ ID NO: 1651820 - DNA, 9 bp, Homo sapiens
caacaaatt

SEQ ID NO: 1651821 - DNA, 13 bp, Homo sapiens
caacaacatgaaa

SEQ ID NO: 1651822 - DNA, 18 bp, Homo sapiens
caacaacgtgagagaaag

SEQ ID NO: 1651823 - DNA, 12 bp, Homo sapiens
caacaagaatgc

SEQ ID NO: 1651824 - DNA, 14 bp, Homo sapiens
caacaagagcgaaa

SEQ ID NO: 1651825 - DNA, 21 bp, Homo sapiens
caacaagatttccttgtgcaa

SEQ ID NO: 1651826 - DNA, 15 bp, Homo sapiens
caacaataaaatttt

SEQ ID NO: 1651827 - DNA, 16 bp, Homo sapiens
caacaataaaattttt

SEQ ID NO: 1651828 - DNA, 23 bp, Homo sapiens
caacaataaacaggaattttatt

SEQ ID NO: 1651829 - DNA, 20 bp, Homo sapiens
caacaataatgattttcttg

SEQ ID NO: 1651830 - DNA, 14 bp, Homo sapiens
caacaatttatgaa

SEQ ID NO: 1651831 - DNA, 18 bp, Homo sapiens
caacaatttatgaattga

SEQ ID NO: 1651832 - DNA, 12 bp, Homo sapiens
caacacaaagag

SEQ ID NO: 1651833 - DNA, 15 bp, Homo sapiens
caacacaaagagaaa

SEQ ID NO: 1651834 - DNA, 14 bp, Homo sapiens
caacacacacactc

SEQ ID NO: 1651835 - DNA, 16 bp, Homo sapiens
caacacacagcagata

SEQ ID NO: 1651836 - DNA, 21 bp, Homo sapiens
caacacagataattttttctt

SEQ ID NO: 1651837 - DNA, 15 bp, Homo sapiens
caacacagcctgggc

SEQ ID NO: 1651838 - DNA, 16 bp, Homo sapiens
caacaccacagacaca

SEQ ID NO: 1651839 - DNA, 22 bp, Homo sapiens
caacaccactaggaatcccaga

SEQ ID NO: 1651840 - DNA, 18 bp, Homo sapiens
caacaccccgcctgcctc

SEQ ID NO: 1651841 - DNA, 15 bp, Homo sapiens
caacacgagcaggct

SEQ ID NO: 1651842 - DNA, 23 bp, Homo sapiens
caacacgagcaggctactgtcag

SEQ ID NO: 1651843 - DNA, 19 bp, Homo sapiens
caacactattgtaatcatt

SEQ ID NO: 1651844 - DNA, 13 bp, Homo sapiens
caacactgctgtc

SEQ ID NO: 1651845 - DNA, 17 bp, Homo sapiens
caacactgtccttccct

SEQ ID NO: 1651846 - DNA, 22 bp, Homo sapiens
caacactgtccttccctgccac

SEQ ID NO: 1651847 - DNA, 13 bp, Homo sapiens
caacactgtgccc

SEQ ID NO: 1651848 - DNA, 15 bp, Homo sapiens
caacactgtgccctg

SEQ ID NO: 1651849 - DNA, 22 bp, Homo sapiens
caacactgtgccctggtggaga

SEQ ID NO: 1651850 - DNA, 23 bp, Homo sapiens
caacactgtgccctggtggagaa

SEQ ID NO: 1651851 - DNA, 16 bp, Homo sapiens
caacacttattttctg

SEQ ID NO: 1651852 - DNA, 14 bp, Homo sapiens
caacagaaaccttt

SEQ ID NO: 1651853 - DNA, 18 bp, Homo sapiens
caacagaaaccttttatt

SEQ ID NO: 1651854 - DNA, 19 bp, Homo sapiens
caacagaaaccttttattt

SEQ ID NO: 1651855 - DNA, 13 bp, Homo sapiens
caacagaacatat

SEQ ID NO: 1651856 - DNA, 22 bp, Homo sapiens
caacagaacatatgttgcaaga

SEQ ID NO: 1651857 - DNA, 20 bp, Homo sapiens
caacagaagtcatgaagccc

SEQ ID NO: 1651858 - DNA, 12 bp, Homo sapiens
caacagaagtgg

SEQ ID NO: 1651859 - DNA, 23 bp, Homo sapiens
caacagaatttttccctccactc

SEQ ID NO: 1651860 - DNA, 11 bp, Homo sapiens
caacagaggcc

SEQ ID NO: 1651861 - DNA, 13 bp, Homo sapiens
caacagagtggac

SEQ ID NO: 1651862 - DNA, 21 bp, Homo sapiens
caacagagtggactcttccct

SEQ ID NO: 1651863 - DNA, 13 bp, Homo sapiens
caacagatctgga

SEQ ID NO: 1651864 - DNA, 15 bp, Homo sapiens
caacagcaaacaggt

SEQ ID NO: 1651865 - DNA, 17 bp, Homo sapiens
caacagcaaaggaacta

SEQ ID NO: 1651866 - DNA, 15 bp, Homo sapiens
caacagcaagtgttt

SEQ ID NO: 1651867 - DNA, 20 bp, Homo sapiens
caacagcacctccccgctgg

SEQ ID NO: 1651868 - DNA, 18 bp, Homo sapiens
caacagcagatggcacca

SEQ ID NO: 1651869 - DNA, 12 bp, Homo sapiens
caacagccatgc

SEQ ID NO: 1651870 - DNA, 17 bp, Homo sapiens
caacagcgtggcttaga

SEQ ID NO: 1651871 - DNA, 15 bp, Homo sapiens
caacagcttcagaaa

SEQ ID NO: 1651872 - DNA, 17 bp, Homo sapiens
caacaggaatctcagag

SEQ ID NO: 1651873 - DNA, 22 bp, Homo sapiens
caacaggaatctcagagacagg

SEQ ID NO: 1651874 - DNA, 19 bp, Homo sapiens
caacaggctgttctgcact

SEQ ID NO: 1651875 - DNA, 21 bp, Homo sapiens
caacaggctgttctgcactga

SEQ ID NO: 1651876 - DNA, 24 bp, Homo sapiens
caacaggctgttctgcactgaaaa

SEQ ID NO: 1651877 - DNA, 21 bp, Homo sapiens
caacagggagcacctgtctgg

SEQ ID NO: 1651878 - DNA, 15 bp, Homo sapiens
caacaggggaggaaa

SEQ ID NO: 1651879 - DNA, 16 bp, Homo sapiens
caacaggggaggaaaa

SEQ ID NO: 1651880 - DNA, 17 bp, Homo sapiens
caacaggggaggaaaaa

SEQ ID NO: 1651881 - DNA, 20 bp, Homo sapiens
caacaggggaggaaaaaaga

SEQ ID NO: 1651882 - DNA, 13 bp, Homo sapiens
caacaggttttat

SEQ ID NO: 1651883 - DNA, 15 bp, Homo sapiens
caacagtaaaccact

SEQ ID NO: 1651884 - DNA, 16 bp, Homo sapiens
caacagttcaaagaag

SEQ ID NO: 1651885 - DNA, 15 bp, Homo sapiens
caacagtttttaaaa

SEQ ID NO: 1651886 - DNA, 13 bp, Homo sapiens
caacataaaacaa

SEQ ID NO: 1651887 - DNA, 21 bp, Homo sapiens
caacataaaacaaaaccaagc

SEQ ID NO: 1651888 - DNA, 23 bp, Homo sapiens
caacatagtaagaccccatctct

SEQ ID NO: 1651889 - DNA, 23 bp, Homo sapiens
caacatagtgagacccctgtctc

SEQ ID NO: 1651890 - DNA, 20 bp, Homo sapiens
caacatcacagcccagcccg

SEQ ID NO: 1651891 - DNA, 20 bp, Homo sapiens
caacatcatcaggaagcctg

SEQ ID NO: 1651892 - DNA, 16 bp, Homo sapiens
caacatcccacagtgg

SEQ ID NO: 1651893 - DNA, 17 bp, Homo sapiens
caacatcccacagtggc

SEQ ID NO: 1651894 - DNA, 17 bp, Homo sapiens
caacatcccattgccct

SEQ ID NO: 1651895 - DNA, 20 bp, Homo sapiens
caacatcccattgccctggt

SEQ ID NO: 1651896 - DNA, 19 bp, Homo sapiens
caacatctcgagccccctg

SEQ ID NO: 1651897 - DNA, 13 bp, Homo sapiens
caacatctctgaa

SEQ ID NO: 1651898 - DNA, 22 bp, Homo sapiens
caacatcttggtcagatttgaa

SEQ ID NO: 1651899 - DNA, 21 bp, Homo sapiens
caacatctttgcgaaaagata

SEQ ID NO: 1651900 - DNA, 13 bp, Homo sapiens
caacatcttttct

SEQ ID NO: 1651901 - DNA, 16 bp, Homo sapiens
caacatgaggacagaa

SEQ ID NO: 1651902 - DNA, 18 bp, Homo sapiens
caacatggtgaaaccccg

SEQ ID NO: 1651903 - DNA, 22 bp, Homo sapiens
caacatgttgggaaacttggct

SEQ ID NO: 1651904 - DNA, 11 bp, Homo sapiens
caacattccac

SEQ ID NO: 1651905 - DNA, 14 bp, Homo sapiens
caacatttccaaaa

SEQ ID NO: 1651906 - DNA, 22 bp, Homo sapiens
caacatttccaaaagtggctag

SEQ ID NO: 1651907 - DNA, 16 bp, Homo sapiens
caacatttttttttct

SEQ ID NO: 1651908 - DNA, 22 bp, Homo sapiens
caaccacatacaacacaaagag

SEQ ID NO: 1651909 - DNA, 23 bp, Homo sapiens
caaccactggtctgtagggattt

SEQ ID NO: 1651910 - DNA, 15 bp, Homo sapiens
caaccactgtgccac

SEQ ID NO: 1651911 - DNA, 16 bp, Homo sapiens
caaccactgtgccact

SEQ ID NO: 1651912 - DNA, 13 bp, Homo sapiens
caaccacttgcta

SEQ ID NO: 1651913 - DNA, 23 bp, Homo sapiens
caaccagaaacacccctctgtct

SEQ ID NO: 1651914 - DNA, 14 bp, Homo sapiens
caaccagccagcgt

SEQ ID NO: 1651915 - DNA, 20 bp, Homo sapiens
caaccagcccgacagtgcca

SEQ ID NO: 1651916 - DNA, 22 bp, Homo sapiens
caaccagcccgacagtgccatc

SEQ ID NO: 1651917 - DNA, 18 bp, Homo sapiens
caactgccaggctgcctc

SEQ ID NO: 1651918 - DNA, 20 bp, Homo sapiens
caactgccaggctgcctcct

SEQ ID NO: 1651919 - DNA, 21 bp, Homo sapiens
caactgccaggctgcctcctg

SEQ ID NO: 1651920 - DNA, 19 bp, Homo sapiens
caactgcccttccaggtgg

SEQ ID NO: 1651921 - DNA, 18 bp, Homo sapiens
caactgcctactccaaaa

SEQ ID NO: 1651922 - DNA, 18 bp, Homo sapiens
caactgcgacaaaacatt

SEQ ID NO: 1651923 - DNA, 14 bp, Homo sapiens
caactgctgtttta

SEQ ID NO: 1651924 - DNA, 11 bp, Homo sapiens
caactgctttg

SEQ ID NO: 1651925 - DNA, 19 bp, Homo sapiens
caactggacattgtctgcg

SEQ ID NO: 1651926 - DNA, 23 bp, Homo sapiens
caactggagttccttatccctct

SEQ ID NO: 1651927 - DNA, 13 bp, Homo sapiens
caactggctgaaa

SEQ ID NO: 1651928 - DNA, 19 bp, Homo sapiens
caactggcttctgtgcact

SEQ ID NO: 1651929 - DNA, 12 bp, Homo sapiens
caactgtatata

SEQ ID NO: 1651930 - DNA, 13 bp, Homo sapiens
caactgtatttat

SEQ ID NO: 1651931 - DNA, 17 bp, Homo sapiens
caactgtccctttgttt

SEQ ID NO: 1651932 - DNA, 15 bp, Homo sapiens
caactgtcttcctca

SEQ ID NO: 1651933 - DNA, 12 bp, Homo sapiens
caactgtgactg

SEQ ID NO: 1651934 - DNA, 22 bp, Homo sapiens
caactgtggtagctccagcgat

SEQ ID NO: 1651935 - DNA, 19 bp, Homo sapiens
caactgttgattgcaggaa

SEQ ID NO: 1651936 - DNA, 18 bp, Homo sapiens
caactgtttccctgctga

SEQ ID NO: 1651937 - DNA, 15 bp, Homo sapiens
caacttaatgttctg

SEQ ID NO: 1651938 - DNA, 17 bp, Homo sapiens
caacttagagattgcat

SEQ ID NO: 1651939 - DNA, 16 bp, Homo sapiens
caacttagctcaggtg

SEQ ID NO: 1651940 - DNA, 15 bp, Homo sapiens
caacttatttaaaaa

SEQ ID NO: 1651941 - DNA, 16 bp, Homo sapiens
caacttatttaaaaat

SEQ ID NO: 1651942 - DNA, 21 bp, Homo sapiens
caacttatttaaaaatatttc

SEQ ID NO: 1651943 - DNA, 15 bp, Homo sapiens
caacttattttgctt

SEQ ID NO: 1651944 - DNA, 17 bp, Homo sapiens
caacttcaagtgcatgc

SEQ ID NO: 1651945 - DNA, 15 bp, Homo sapiens
caacttccaaagggt

SEQ ID NO: 1651946 - DNA, 22 bp, Homo sapiens
caacttctgcctcccatgctta

SEQ ID NO: 1651947 - DNA, 16 bp, Homo sapiens
caacttgagatgtatg

SEQ ID NO: 1651948 - DNA, 21 bp, Homo sapiens
caacttgagatgtatgaaggc

SEQ ID NO: 1651949 - DNA, 22 bp, Homo sapiens
caacttgagatgtatgaaggct

SEQ ID NO: 1651950 - DNA, 20 bp, Homo sapiens
caacttgatgttccacctgc

SEQ ID NO: 1651951 - DNA, 12 bp, Homo sapiens
caacttgccaca

SEQ ID NO: 1651952 - DNA, 16 bp, Homo sapiens
caacttgggttcttct

SEQ ID NO: 1651953 - DNA, 17 bp, Homo sapiens
caacttggttctgcttc

SEQ ID NO: 1651954 - DNA, 19 bp, Homo sapiens
caacttgtctttttctgga

SEQ ID NO: 1651955 - DNA, 22 bp, Homo sapiens
caacttgtctttttctggactg

SEQ ID NO: 1651956 - DNA, 12 bp, Homo sapiens
caacttgtgtac

SEQ ID NO: 1651957 - DNA, 12 bp, Homo sapiens
caactttactgt

SEQ ID NO: 1651958 - DNA, 22 bp, Homo sapiens
caactttcacagtgaagtgcct

SEQ ID NO: 1651959 - DNA, 17 bp, Homo sapiens
caactttcacttcttcc

SEQ ID NO: 1651960 - DNA, 23 bp, Homo sapiens
caacttttatgcagcaaatatat

SEQ ID NO: 1651961 - DNA, 20 bp, Homo sapiens
caacttttgtgtaatgaaaa

SEQ ID NO: 1651962 - DNA, 15 bp, Homo sapiens
caagaaaaggacaaa

SEQ ID NO: 1651963 - DNA, 16 bp, Homo sapiens
caagaaacagccagca

SEQ ID NO: 1651964 - DNA, 15 bp, Homo sapiens
caagaaactgaatga

SEQ ID NO: 1651965 - DNA, 19 bp, Homo sapiens
caagaaactgaggaatttt

SEQ ID NO: 1651966 - DNA, 15 bp, Homo sapiens
caagaaagaaatggc

SEQ ID NO: 1651967 - DNA, 23 bp, Homo sapiens
caagaaagaaatggcttttctta

SEQ ID NO: 1651968 - DNA, 12 bp, Homo sapiens
caagaaagtcca

SEQ ID NO: 1651969 - DNA, 12 bp, Homo sapiens
caagaaatggcg

SEQ ID NO: 1651970 - DNA, 13 bp, Homo sapiens
caagaacaaacag

SEQ ID NO: 1651971 - DNA, 15 bp, Homo sapiens
caagaacaagcaatg

SEQ ID NO: 1651972 - DNA, 12 bp, Homo sapiens
caagaactctaa

SEQ ID NO: 1651973 - DNA, 23 bp, Homo sapiens
caagaactgcatggacctaacat

SEQ ID NO: 1651974 - DNA, 18 bp, Homo sapiens
caagaagacatggagact

SEQ ID NO: 1651975 - DNA, 14 bp, Homo sapiens
caagaagaccccgc

SEQ ID NO: 1651976 - DNA, 15 bp, Homo sapiens
caagaagattctaaa

SEQ ID NO: 1651977 - DNA, 18 bp, Homo sapiens
caagaagattctaaaaca

SEQ ID NO: 1651978 - DNA, 13 bp, Homo sapiens
caagaagcagtgg

SEQ ID NO: 1651979 - DNA, 20 bp, Homo sapiens
caagaaggaaagatttgtga

SEQ ID NO: 1651980 - DNA, 20 bp, Homo sapiens
caagaagggctgcatgatgt

SEQ ID NO: 1651981 - DNA, 16 bp, Homo sapiens
caagaagttaaaaaac

SEQ ID NO: 1651982 - DNA, 20 bp, Homo sapiens
caagaagttaaaaaacagct

SEQ ID NO: 1651983 - DNA, 20 bp, Homo sapiens
caagaataatcacgctttcc

SEQ ID NO: 1651984 - DNA, 22 bp, Homo sapiens
caagaataatcacgctttcctg

SEQ ID NO: 1651985 - DNA, 23 bp, Homo sapiens
caagaataatcacgctttcctga

SEQ ID NO: 1651986 - DNA, 23 bp, Homo sapiens
caagaataattcaattttaaaga

SEQ ID NO: 1651987 - DNA, 17 bp, Homo sapiens
caagaataattttggaa

SEQ ID NO: 1651988 - DNA, 14 bp, Homo sapiens
caagaatacttgaa

SEQ ID NO: 1651989 - DNA, 13 bp, Homo sapiens
caagaatatagtt

SEQ ID NO: 1651990 - DNA, 18 bp, Homo sapiens
caagaatatcctttaaaa

SEQ ID NO: 1651991 - DNA, 15 bp, Homo sapiens
caagaatattgtatg

SEQ ID NO: 1651992 - DNA, 19 bp, Homo sapiens
caagaatccacatttctaa

SEQ ID NO: 1651993 - DNA, 14 bp, Homo sapiens
caagaatctagaag

SEQ ID NO: 1651994 - DNA, 17 bp, Homo sapiens
caagaatctagaagatg

SEQ ID NO: 1651995 - DNA, 14 bp, Homo sapiens
caagaatgaaaaat

SEQ ID NO: 1651996 - DNA, 13 bp, Homo sapiens
caagaatgaaggt

SEQ ID NO: 1651997 - DNA, 22 bp, Homo sapiens
caagaatgaaggtttttgtaaa

SEQ ID NO: 1651998 - DNA, 23 bp, Homo sapiens
caagaatgcattccctgaatctg

SEQ ID NO: 1651999 - DNA, 17 bp, Homo sapiens
caagaatggaagcctga

SEQ ID NO: 1652000 - DNA, 13 bp, Homo sapiens
caagaatggatca

SEQ ID NO: 1652001 - DNA, 11 bp, Homo sapiens
caagaatgtac

SEQ ID NO: 1652002 - DNA, 22 bp, Homo sapiens
caagaatttgatcgttccagtt

SEQ ID NO: 1652003 - DNA, 17 bp, Homo sapiens
caagacacgtggcctcg

SEQ ID NO: 1652004 - DNA, 15 bp, Homo sapiens
caagacagaaaagtg

SEQ ID NO: 1652005 - DNA, 12 bp, Homo sapiens
caagacagagac

SEQ ID NO: 1652006 - DNA, 22 bp, Homo sapiens
caagacagatgccccagagctg

SEQ ID NO: 1652007 - DNA, 12 bp, Homo sapiens
caagacagcctt

SEQ ID NO: 1652008 - DNA, 15 bp, Homo sapiens
caagacagccttcac

SEQ ID NO: 1652009 - DNA, 14 bp, Homo sapiens
caagacatgtctgt

SEQ ID NO: 1652010 - DNA, 15 bp, Homo sapiens
caagacatgtctgtt

SEQ ID NO: 1652011 - DNA, 17 bp, Homo sapiens
caagacatgtctgttct

SEQ ID NO: 1652012 - DNA, 16 bp, Homo sapiens
caagacatgtggaggg

SEQ ID NO: 1652013 - DNA, 15 bp, Homo sapiens
caagacattaaatct

SEQ ID NO: 1652014 - DNA, 20 bp, Homo sapiens
caagacatttgctgaactca

SEQ ID NO: 1652015 - DNA, 17 bp, Homo sapiens
caagaccagcctgtcca

SEQ ID NO: 1652016 - DNA, 16 bp, Homo sapiens
caagaccctcccatgg

SEQ ID NO: 1652017 - DNA, 21 bp, Homo sapiens
caagacctagtcccctttcct

SEQ ID NO: 1652018 - DNA, 22 bp, Homo sapiens
caagacctagtcccctttcctc

SEQ ID NO: 1652019 - DNA, 23 bp, Homo sapiens
caagacctcatctgtggagctgc

SEQ ID NO: 1652020 - DNA, 18 bp, Homo sapiens
caagacctcttccctctg

SEQ ID NO: 1652021 - DNA, 22 bp, Homo sapiens
caagacctcttccctctgggcc

SEQ ID NO: 1652022 - DNA, 24 bp, Homo sapiens
caagacctcttccctctgggcctg

SEQ ID NO: 1652023 - DNA, 17 bp, Homo sapiens
caagactagcctggcca

SEQ ID NO: 1652024 - DNA, 14 bp, Homo sapiens
caagactctagagt

SEQ ID NO: 1652025 - DNA, 14 bp, Homo sapiens
caagactgttgctc

SEQ ID NO: 1652026 - DNA, 18 bp, Homo sapiens
caagactgttgctcaaat

SEQ ID NO: 1652027 - DNA, 20 bp, Homo sapiens
caagactttagcttttcctt

SEQ ID NO: 1652028 - DNA, 20 bp, Homo sapiens
caagagaaaagaaaaatcaa

SEQ ID NO: 1652029 - DNA, 18 bp, Homo sapiens
caagagaaaattcctaga

SEQ ID NO: 1652030 - DNA, 20 bp, Homo sapiens
caagagaaaattcctagaaa

SEQ ID NO: 1652031 - DNA, 13 bp, Homo sapiens
caagagaaacttc

SEQ ID NO: 1652032 - DNA, 23 bp, Homo sapiens
caagtctttcttcttttttaagt

SEQ ID NO: 1652033 - DNA, 21 bp, Homo sapiens
caagtctttgctattgtgaat

SEQ ID NO: 1652034 - DNA, 20 bp, Homo sapiens
caagtgaaattattttggag

SEQ ID NO: 1652035 - DNA, 19 bp, Homo sapiens
caagtgaacactagccaga

SEQ ID NO: 1652036 - DNA, 15 bp, Homo sapiens
caagtgaagaatcta

SEQ ID NO: 1652037 - DNA, 19 bp, Homo sapiens
caagtgaatttttctctaa

SEQ ID NO: 1652038 - DNA, 18 bp, Homo sapiens
caagtgactgtatctgtg

SEQ ID NO: 1652039 - DNA, 21 bp, Homo sapiens
caagtgactgtatctgtgtag

SEQ ID NO: 1652040 - DNA, 12 bp, Homo sapiens
caagtgagcaga

SEQ ID NO: 1652041 - DNA, 19 bp, Homo sapiens
caagtgagttgaatagttg

SEQ ID NO: 1652042 - DNA, 21 bp, Homo sapiens
caagtgatatcacctctcttc

SEQ ID NO: 1652043 - DNA, 21 bp, Homo sapiens
caagtgatccttccacctcag

SEQ ID NO: 1652044 - DNA, 15 bp, Homo sapiens
caagtgattgaaaat

SEQ ID NO: 1652045 - DNA, 23 bp, Homo sapiens
caagtgcaatagattactgatgt

SEQ ID NO: 1652046 - DNA, 17 bp, Homo sapiens
caagtgcatttttctta

SEQ ID NO: 1652047 - DNA, 13 bp, Homo sapiens
caagtgccagagg

SEQ ID NO: 1652048 - DNA, 15 bp, Homo sapiens
caagtgccagaggtg

SEQ ID NO: 1652049 - DNA, 19 bp, Homo sapiens
caagtgccagaggtgggca

SEQ ID NO: 1652050 - DNA, 21 bp, Homo sapiens
caagtgccagaggtgggcagg

SEQ ID NO: 1652051 - DNA, 14 bp, Homo sapiens
caagtgcccagtgg

SEQ ID NO: 1652052 - DNA, 15 bp, Homo sapiens
caagtgcctcttgtt

SEQ ID NO: 1652053 - DNA, 18 bp, Homo sapiens
caagtgcctcttgttgca

SEQ ID NO: 1652054 - DNA, 16 bp, Homo sapiens
caagtgctgaacagtg

SEQ ID NO: 1652055 - DNA, 18 bp, Homo sapiens
caagtgctgaacagtgga

SEQ ID NO: 1652056 - DNA, 20 bp, Homo sapiens
caagtgctgaacagtggagg

SEQ ID NO: 1652057 - DNA, 21 bp, Homo sapiens
caagtgctgcacaaaagcaga

SEQ ID NO: 1652058 - DNA, 22 bp, Homo sapiens
caagtgctgcacaaaagcagat

SEQ ID NO: 1652059 - DNA, 23 bp, Homo sapiens
caagtggaccttaggccttcctc

SEQ ID NO: 1652060 - DNA, 21 bp, Homo sapiens
caagtggatgggaatttgtca

SEQ ID NO: 1652061 - DNA, 19 bp, Homo sapiens
caagtggcatgtgctgtga

SEQ ID NO: 1652062 - DNA, 16 bp, Homo sapiens
caagtggggctcgcca

SEQ ID NO: 1652063 - DNA, 17 bp, Homo sapiens
caagtggggctcgccat

SEQ ID NO: 1652064 - DNA, 13 bp, Homo sapiens
caagtgggggcag

SEQ ID NO: 1652065 - DNA, 19 bp, Homo sapiens
caagtggggtgctgggagg

SEQ ID NO: 1652066 - DNA, 19 bp, Homo sapiens
caagtggtaatttttgtac

SEQ ID NO: 1652067 - DNA, 18 bp, Homo sapiens
caagtggtgtttattgca

SEQ ID NO: 1652068 - DNA, 20 bp, Homo sapiens
caagtggtgtttattgcaat

SEQ ID NO: 1652069 - DNA, 16 bp, Homo sapiens
caagtgtgctaaaaat

SEQ ID NO: 1652070 - DNA, 22 bp, Homo sapiens
caagtgtggtagggacttaaaa

SEQ ID NO: 1652071 - DNA, 23 bp, Homo sapiens
caagtgttcttaggtttactgtg

SEQ ID NO: 1652072 - DNA, 16 bp, Homo sapiens
caagttataaatcaat

SEQ ID NO: 1652073 - DNA, 12 bp, Homo sapiens
caagttcaatct

SEQ ID NO: 1652074 - DNA, 19 bp, Homo sapiens
caagttcatctcatttgta

SEQ ID NO: 1652075 - DNA, 17 bp, Homo sapiens
caagttcatgcagctgt

SEQ ID NO: 1652076 - DNA, 21 bp, Homo sapiens
caagttccaacatgcaatact

SEQ ID NO: 1652077 - DNA, 22 bp, Homo sapiens
caagttccccatccctgtcatt

SEQ ID NO: 1652078 - DNA, 13 bp, Homo sapiens
caagttctaagat

SEQ ID NO: 1652079 - DNA, 15 bp, Homo sapiens
caagttctaagattc

SEQ ID NO: 1652080 - DNA, 20 bp, Homo sapiens
caagttgctgtcactgtttt

SEQ ID NO: 1652081 - DNA, 14 bp, Homo sapiens
caagttggactggg

SEQ ID NO: 1652082 - DNA, 23 bp, Homo sapiens
caagttgggttcacttgccatgc

SEQ ID NO: 1652083 - DNA, 13 bp, Homo sapiens
caagttgtgcttg

SEQ ID NO: 1652084 - DNA, 18 bp, Homo sapiens
caagttgtgcttgagcca

SEQ ID NO: 1652085 - DNA, 13 bp, Homo sapiens
caagttgttaaaa

SEQ ID NO: 1652086 - DNA, 23 bp, Homo sapiens
caagttgttaaaacatttaatat

SEQ ID NO: 1652087 - DNA, 16 bp, Homo sapiens
caagttgttgactgtg

SEQ ID NO: 1652088 - DNA, 22 bp, Homo sapiens
caagttgttgactgtgattaga

SEQ ID NO: 1652089 - DNA, 16 bp, Homo sapiens
caagttgtttcattga

SEQ ID NO: 1652090 - DNA, 20 bp, Homo sapiens
caagtttatcagtaaataac

SEQ ID NO: 1652091 - DNA, 14 bp, Homo sapiens
caagtttcagacag

SEQ ID NO: 1652092 - DNA, 22 bp, Homo sapiens
caagtttctgtttcaaagcaca

SEQ ID NO: 1652093 - DNA, 13 bp, Homo sapiens
caagttttaaagt

SEQ ID NO: 1652094 - DNA, 18 bp, Homo sapiens
caagttttccctgaagtt

SEQ ID NO: 1652095 - DNA, 20 bp, Homo sapiens
caataaaaaaaagaaatgaa

SEQ ID NO: 1652096 - DNA, 21 bp, Homo sapiens
caataaaaaaaagaaatgaaa

SEQ ID NO: 1652097 - DNA, 13 bp, Homo sapiens
caataaaaatgtt

SEQ ID NO: 1652098 - DNA, 19 bp, Homo sapiens
caataaaagtgactctcag

SEQ ID NO: 1652099 - DNA, 16 bp, Homo sapiens
caataaaatgtgattt

SEQ ID NO: 1652100 - DNA, 11 bp, Homo sapiens
caataaaattt

SEQ ID NO: 1652101 - DNA, 14 bp, Homo sapiens
caataaacagctcc

SEQ ID NO: 1652102 - DNA, 12 bp, Homo sapiens
caataaacagga

SEQ ID NO: 1652103 - DNA, 15 bp, Homo sapiens
caataaacaggaatt

SEQ ID NO: 1652104 - DNA, 22 bp, Homo sapiens
caataaacaggaattttatttt

SEQ ID NO: 1652105 - DNA, 14 bp, Homo sapiens
caataaacttagag

SEQ ID NO: 1652106 - DNA, 16 bp, Homo sapiens
caataaagcactgagc

SEQ ID NO: 1652107 - DNA, 17 bp, Homo sapiens
caataaagcactgagca

SEQ ID NO: 1652108 - DNA, 16 bp, Homo sapiens
caataaagcttttgga

SEQ ID NO: 1652109 - DNA, 17 bp, Homo sapiens
caataaagcttttggaa

SEQ ID NO: 1652110 - DNA, 18 bp, Homo sapiens
caataaagcttttggaag

SEQ ID NO: 1652111 - DNA, 15 bp, Homo sapiens
caataaaggcagctg

SEQ ID NO: 1652112 - DNA, 17 bp, Homo sapiens
caataaaggcagctgcc

SEQ ID NO: 1652113 - DNA, 18 bp, Homo sapiens
caataaaggcagctgcct

SEQ ID NO: 1652114 - DNA, 20 bp, Homo sapiens
caataaaggcagctgcctct

SEQ ID NO: 1652115 - DNA, 19 bp, Homo sapiens
caataaagggagaatggtg

SEQ ID NO: 1652116 - DNA, 21 bp, Homo sapiens
caataaagggagaatggtgct

SEQ ID NO: 1652117 - DNA, 16 bp, Homo sapiens
caataaagtataatgt

SEQ ID NO: 1652118 - DNA, 15 bp, Homo sapiens
caataaagtttacaa

SEQ ID NO: 1652119 - DNA, 17 bp, Homo sapiens
caataaagtttacaagc

SEQ ID NO: 1652120 - DNA, 18 bp, Homo sapiens
caataaatggtatagcaa

SEQ ID NO: 1652121 - DNA, 23 bp, Homo sapiens
caataaatggtatagcaaatgtt

SEQ ID NO: 1652122 - DNA, 12 bp, Homo sapiens
caataaatgtca

SEQ ID NO: 1652123 - DNA, 17 bp, Homo sapiens
caataaatgtgcttatg

SEQ ID NO: 1652124 - DNA, 17 bp, Homo sapiens
caataaatttgtaactt

SEQ ID NO: 1652125 - DNA, 21 bp, Homo sapiens
caataactcggtgtgtggccg

SEQ ID NO: 1652126 - DNA, 17 bp, Homo sapiens
caataacttctatattt

SEQ ID NO: 1652127 - DNA, 20 bp, Homo sapiens
caataagattggtgttcgtt

SEQ ID NO: 1652128 - DNA, 15 bp, Homo sapiens
caataataaagatgt

SEQ ID NO: 1652129 - DNA, 20 bp, Homo sapiens
caataataaagatgtgaaaa

SEQ ID NO: 1652130 - DNA, 21 bp, Homo sapiens
caataataagtgatgtgctga

SEQ ID NO: 1652131 - DNA, 19 bp, Homo sapiens
caataatctctatttgaga

SEQ ID NO: 1652132 - DNA, 18 bp, Homo sapiens
caataatggggcagacac

SEQ ID NO: 1652133 - DNA, 23 bp, Homo sapiens
caataatggtcccatccaggcag

SEQ ID NO: 1652134 - DNA, 15 bp, Homo sapiens
caataatgtactcac

SEQ ID NO: 1652135 - DNA, 22 bp, Homo sapiens
caataatttcaggttttgtaaa

SEQ ID NO: 1652136 - DNA, 17 bp, Homo sapiens
caataatttgtacaatg

SEQ ID NO: 1652137 - DNA, 15 bp, Homo sapiens
caatacaatgtacaa

SEQ ID NO: 1652138 - DNA, 16 bp, Homo sapiens
caatacatttgtattt

SEQ ID NO: 1652139 - DNA, 13 bp, Homo sapiens
caataccactggt

SEQ ID NO: 1652140 - DNA, 22 bp, Homo sapiens
caatacccttttaagtttaaaa

SEQ ID NO: 1652141 - DNA, 16 bp, Homo sapiens
caataccgctcagtat

SEQ ID NO: 1652142 - DNA, 18 bp, Homo sapiens
caataccgctcagtattt

SEQ ID NO: 1652143 - DNA, 19 bp, Homo sapiens
caatacgtttgtgcagaat

SEQ ID NO: 1652144 - DNA, 19 bp, Homo sapiens
caatagaataatctattat

SEQ ID NO: 1652145 - DNA, 17 bp, Homo sapiens
caatagcctgaatttga

SEQ ID NO: 1652146 - DNA, 14 bp, Homo sapiens
caatttgtatatca

SEQ ID NO: 1652147 - DNA, 22 bp, Homo sapiens
caatttgtttgtgttcaatatc

SEQ ID NO: 1652148 - DNA, 14 bp, Homo sapiens
caattttaaaaaat

SEQ ID NO: 1652149 - DNA, 13 bp, Homo sapiens
caattttaaagac

SEQ ID NO: 1652150 - DNA, 19 bp, Homo sapiens
caattttaaagttcttatt

SEQ ID NO: 1652151 - DNA, 21 bp, Homo sapiens
caattttaaagttcttatttt

SEQ ID NO: 1652152 - DNA, 22 bp, Homo sapiens
caattttaccctgaggtcactg

SEQ ID NO: 1652153 - DNA, 22 bp, Homo sapiens
caattttagtgtattaatcata

SEQ ID NO: 1652154 - DNA, 18 bp, Homo sapiens
caattttattaaatgcat

SEQ ID NO: 1652155 - DNA, 17 bp, Homo sapiens
caattttctttgtttct

SEQ ID NO: 1652156 - DNA, 12 bp, Homo sapiens
caattttgtaac

SEQ ID NO: 1652157 - DNA, 11 bp, Homo sapiens
caattttgtcc

SEQ ID NO: 1652158 - DNA, 12 bp, Homo sapiens
caatttttaata

SEQ ID NO: 1652159 - DNA, 17 bp, Homo sapiens
caatttttaccacttct

SEQ ID NO: 1652160 - DNA, 14 bp, Homo sapiens
caatttttgccttc

SEQ ID NO: 1652161 - DNA, 16 bp, Homo sapiens
caatttttgccttcat

SEQ ID NO: 1652162 - DNA, 12 bp, Homo sapiens
cacaaaaaagaa

SEQ ID NO: 1652163 - DNA, 17 bp, Homo sapiens
cacaaaaaggcaaatat

SEQ ID NO: 1652164 - DNA, 22 bp, Homo sapiens
cacaaaaaggcaaatattgaag

SEQ ID NO: 1652165 - DNA, 21 bp, Homo sapiens
cacaaaacctgtattactgaa

SEQ ID NO: 1652166 - DNA, 18 bp, Homo sapiens
cacaaaatccatgggcag

SEQ ID NO: 1652167 - DNA, 15 bp, Homo sapiens
cacaaaatctgtcca

SEQ ID NO: 1652168 - DNA, 21 bp, Homo sapiens
cacaaaattagaaaggacaac

SEQ ID NO: 1652169 - DNA, 16 bp, Homo sapiens
cacaaaattgggaaag

SEQ ID NO: 1652170 - DNA, 13 bp, Homo sapiens
cacaaaccctgct

SEQ ID NO: 1652171 - DNA, 18 bp, Homo sapiens
cacaaacctactgcccac

SEQ ID NO: 1652172 - DNA, 17 bp, Homo sapiens
cacaaaccttctgcctt

SEQ ID NO: 1652173 - DNA, 16 bp, Homo sapiens
cacaaacggagcccct

SEQ ID NO: 1652174 - DNA, 18 bp, Homo sapiens
cacaaacggagcccctga

SEQ ID NO: 1652175 - DNA, 23 bp, Homo sapiens
cacaaacgtttacttatcttatg

SEQ ID NO: 1652176 - DNA, 17 bp, Homo sapiens
cacaaactgtgaaaata

SEQ ID NO: 1652177 - DNA, 22 bp, Homo sapiens
cacaaagaacttgctgctgcct

SEQ ID NO: 1652178 - DNA, 18 bp, Homo sapiens
cacaaagagaaaaagaaa

SEQ ID NO: 1652179 - DNA, 23 bp, Homo sapiens
cacaaagccaagcctaggccgcc

SEQ ID NO: 1652180 - DNA, 19 bp, Homo sapiens
cacaaagcggggggagggt

SEQ ID NO: 1652181 - DNA, 21 bp, Homo sapiens
cacaaaggtggaataaacatt

SEQ ID NO: 1652182 - DNA, 18 bp, Homo sapiens
cacaaatgtcattgtcta

SEQ ID NO: 1652183 - DNA, 19 bp, Homo sapiens
cacaacaaacctattgtag

SEQ ID NO: 1652184 - DNA, 16 bp, Homo sapiens
cacaacacacacactc

SEQ ID NO: 1652185 - DNA, 14 bp, Homo sapiens
cacaacaccaggac

SEQ ID NO: 1652186 - DNA, 11 bp, Homo sapiens
cacaacagatt

SEQ ID NO: 1652187 - DNA, 16 bp, Homo sapiens
cacaaccttcggctcc

SEQ ID NO: 1652188 - DNA, 19 bp, Homo sapiens
cacaaccttctgtggctca

SEQ ID NO: 1652189 - DNA, 13 bp, Homo sapiens
cacaactgacaca

SEQ ID NO: 1652190 - DNA, 15 bp, Homo sapiens
cacaactgacacagg

SEQ ID NO: 1652191 - DNA, 16 bp, Homo sapiens
cacaactgacacagga

SEQ ID NO: 1652192 - DNA, 17 bp, Homo sapiens
cacaactgacacaggaa

SEQ ID NO: 1652193 - DNA, 12 bp, Homo sapiens
cacaagaatcta

SEQ ID NO: 1652194 - DNA, 14 bp, Homo sapiens
cacaagcacaaagc

SEQ ID NO: 1652195 - DNA, 21 bp, Homo sapiens
cacaagcactttaatggcctg

SEQ ID NO: 1652196 - DNA, 15 bp, Homo sapiens
cacaagcctgagaac

SEQ ID NO: 1652197 - DNA, 14 bp, Homo sapiens
cacaagctgcactg

SEQ ID NO: 1652198 - DNA, 15 bp, Homo sapiens
cacaagctgcactgt

SEQ ID NO: 1652199 - DNA, 17 bp, Homo sapiens
cacaagctgcactgtga

SEQ ID NO: 1652200 - DNA, 19 bp, Homo sapiens
cacaagctgcactgtgaac

SEQ ID NO: 1652201 - DNA, 20 bp, Homo sapiens
cacaagctgcactgtgaacc

SEQ ID NO: 1652202 - DNA, 15 bp, Homo sapiens
cacaagctgtccctg

SEQ ID NO: 1652203 - DNA, 17 bp, Homo sapiens
cacaaggaaaaggagga

SEQ ID NO: 1652204 - DNA, 15 bp, Homo sapiens
cacaaggaataaatg

SEQ ID NO: 1652205 - DNA, 18 bp, Homo sapiens
cacaaggaataaatgaga

SEQ ID NO: 1652206 - DNA, 22 bp, Homo sapiens
cacaaggacttcctgtccagct

SEQ ID NO: 1652207 - DNA, 17 bp, Homo sapiens
cacaaggatagatgctg

SEQ ID NO: 1652208 - DNA, 18 bp, Homo sapiens
cacaaggatagatgctgg

SEQ ID NO: 1652209 - DNA, 22 bp, Homo sapiens
cacaagggatataaaatgaaag

SEQ ID NO: 1652210 - DNA, 16 bp, Homo sapiens
cacaagggcacattgc

SEQ ID NO: 1652211 - DNA, 13 bp, Homo sapiens
cacaagtcttcca

SEQ ID NO: 1652212 - DNA, 14 bp, Homo sapiens
cacaagtcttccag

SEQ ID NO: 1652213 - DNA, 12 bp, Homo sapiens
cacaagtgaaaa

SEQ ID NO: 1652214 - DNA, 14 bp, Homo sapiens
cacaagttgtgttt

SEQ ID NO: 1652215 - DNA, 20 bp, Homo sapiens
cacaataaatgtattcaaat

SEQ ID NO: 1652216 - DNA, 22 bp, Homo sapiens
cacaataactagtaataccaaa

SEQ ID NO: 1652217 - DNA, 15 bp, Homo sapiens
cacaatattgaactt

SEQ ID NO: 1652218 - DNA, 20 bp, Homo sapiens
cacaatctggcttagtgcca

SEQ ID NO: 1652219 - DNA, 19 bp, Homo sapiens
cacaatctgtaaattttta

SEQ ID NO: 1652220 - DNA, 23 bp, Homo sapiens
cacaatcttggggctgatgaaga

SEQ ID NO: 1652221 - DNA, 18 bp, Homo sapiens
cacaatgcagttctgagc

SEQ ID NO: 1652222 - DNA, 24 bp, Homo sapiens
cacaatgtatacttcagtgctcac

SEQ ID NO: 1652223 - DNA, 13 bp, Homo sapiens
cacaatgtgaaac

SEQ ID NO: 1652224 - DNA, 21 bp, Homo sapiens
cacaatgttccttttttgtat

SEQ ID NO: 1652225 - DNA, 23 bp, Homo sapiens
cacaatgtttcttcatttctctg

SEQ ID NO: 1652226 - DNA, 19 bp, Homo sapiens
cacaattaaaccgcatgtg

SEQ ID NO: 1652227 - DNA, 21 bp, Homo sapiens
cacaattgatacttcaggtgc

SEQ ID NO: 1652228 - DNA, 23 bp, Homo sapiens
cacaattgatacttcaggtgctt

SEQ ID NO: 1652229 - DNA, 13 bp, Homo sapiens
cacaatttcattt

SEQ ID NO: 1652230 - DNA, 17 bp, Homo sapiens
cacaatttcatttccag

SEQ ID NO: 1652231 - DNA, 16 bp, Homo sapiens
cacacaaaaaccttgg

SEQ ID NO: 1652232 - DNA, 18 bp, Homo sapiens
cacacaaacctactgccc

SEQ ID NO: 1652233 - DNA, 19 bp, Homo sapiens
cacacaaacctactgccca

SEQ ID NO: 1652234 - DNA, 13 bp, Homo sapiens
cacacaaaggtat

SEQ ID NO: 1652235 - DNA, 18 bp, Homo sapiens
cacacaaaggtataattt

SEQ ID NO: 1652236 - DNA, 15 bp, Homo sapiens
cacacaacaccagga

SEQ ID NO: 1652237 - DNA, 16 bp, Homo sapiens
cacacaacaccaggac

SEQ ID NO: 1652238 - DNA, 17 bp, Homo sapiens
cacacaacaccaggact

SEQ ID NO: 1652239 - DNA, 13 bp, Homo sapiens
cacacacacacaa

SEQ ID NO: 1652240 - DNA, 13 bp, Homo sapiens
cacacacacacac

SEQ ID NO: 1652241 - DNA, 16 bp, Homo sapiens
cacacacacacacacg

SEQ ID NO: 1652242 - DNA, 14 bp, Homo sapiens
cacacacacacacg

SEQ ID NO: 1652243 - DNA, 15 bp, Homo sapiens
cacacacacacgatg

SEQ ID NO: 1652244 - DNA, 11 bp, Homo sapiens
cacacacacag

SEQ ID NO: 1652245 - DNA, 11 bp, Homo sapiens
cacacacacga

SEQ ID NO: 1652246 - DNA, 13 bp, Homo sapiens
cacacacacgcac

SEQ ID NO: 1652247 - DNA, 13 bp, Homo sapiens
cacacacactcta

SEQ ID NO: 1652248 - DNA, 13 bp, Homo sapiens
cacacacagctcc

SEQ ID NO: 1652249 - DNA, 13 bp, Homo sapiens
cacacacagtccc

SEQ ID NO: 1652250 - DNA, 13 bp, Homo sapiens
cacacacatagat

SEQ ID NO: 1652251 - DNA, 20 bp, Homo sapiens
cacacacctgtagtcccagc

SEQ ID NO: 1652252 - DNA, 17 bp, Homo sapiens
cacacacgcacgcacac

SEQ ID NO: 1652253 - DNA, 19 bp, Homo sapiens
cacacacgcacgcacacac

SEQ ID NO: 1652254 - DNA, 18 bp, Homo sapiens
cacacacgctccctggaa

SEQ ID NO: 1652255 - DNA, 20 bp, Homo sapiens
cacacactcgcccgcccact

SEQ ID NO: 1652256 - DNA, 21 bp, Homo sapiens
cacacactcgcccgcccactg

SEQ ID NO: 1652257 - DNA, 12 bp, Homo sapiens
cacacactttcc

SEQ ID NO: 1652258 - DNA, 15 bp, Homo sapiens
cacacagaatgcaac

SEQ ID NO: 1652259 - DNA, 15 bp, Homo sapiens
cacacagacatatat

SEQ ID NO: 1652260 - DNA, 15 bp, Homo sapiens
cacacagactatttt

SEQ ID NO: 1652261 - DNA, 12 bp, Homo sapiens
cacacagaggaa

SEQ ID NO: 1652262 - DNA, 13 bp, Homo sapiens
cacatagatttct

SEQ ID NO: 1652263 - DNA, 15 bp, Homo sapiens
cacatagcatgcttc

SEQ ID NO: 1652264 - DNA, 23 bp, Homo sapiens
cacatagcatgcttcctttctct

SEQ ID NO: 1652265 - DNA, 13 bp, Homo sapiens
cacatagctgtct

SEQ ID NO: 1652266 - DNA, 21 bp, Homo sapiens
cacataggaagggatctgaga

SEQ ID NO: 1652267 - DNA, 21 bp, Homo sapiens
cacataggctggtggccttgg

SEQ ID NO: 1652268 - DNA, 23 bp, Homo sapiens
cacataggctggtggccttgggc

SEQ ID NO: 1652269 - DNA, 12 bp, Homo sapiens
cacatataacat

SEQ ID NO: 1652270 - DNA, 15 bp, Homo sapiens
cacatatccaggcac

SEQ ID NO: 1652271 - DNA, 18 bp, Homo sapiens
cacatatccaggcaccag

SEQ ID NO: 1652272 - DNA, 23 bp, Homo sapiens
cacatatctagtatgaaattata

SEQ ID NO: 1652273 - DNA, 19 bp, Homo sapiens
cacatatgcaccttgtgtc

SEQ ID NO: 1652274 - DNA, 20 bp, Homo sapiens
cacatatgcaccttgtgtct

SEQ ID NO: 1652275 - DNA, 15 bp, Homo sapiens
cacatattcaaattc

SEQ ID NO: 1652276 - DNA, 18 bp, Homo sapiens
cacatattctattataga

SEQ ID NO: 1652277 - DNA, 23 bp, Homo sapiens
cacatatttgaagggtctttctc

SEQ ID NO: 1652278 - DNA, 15 bp, Homo sapiens
cacatatttgatagt

SEQ ID NO: 1652279 - DNA, 20 bp, Homo sapiens
cacatcacaagactatgcca

SEQ ID NO: 1652280 - DNA, 22 bp, Homo sapiens
cacatcacctctttgcccccga

SEQ ID NO: 1652281 - DNA, 20 bp, Homo sapiens
cacatcagcaatttcagaac

SEQ ID NO: 1652282 - DNA, 18 bp, Homo sapiens
cacatcagtgaggaggga

SEQ ID NO: 1652283 - DNA, 22 bp, Homo sapiens
cacatcatagataaagctgatt

SEQ ID NO: 1652284 - DNA, 16 bp, Homo sapiens
cacatccaactccagc

SEQ ID NO: 1652285 - DNA, 22 bp, Homo sapiens
cacatcccaggcttcaccctga

SEQ ID NO: 1652286 - DNA, 23 bp, Homo sapiens
cacatcccattgggactccatgc

SEQ ID NO: 1652287 - DNA, 14 bp, Homo sapiens
cacatccccagaat

SEQ ID NO: 1652288 - DNA, 21 bp, Homo sapiens
cacatccccagaatccataaa

SEQ ID NO: 1652289 - DNA, 14 bp, Homo sapiens
cacatccccagagc

SEQ ID NO: 1652290 - DNA, 21 bp, Homo sapiens
cacatccccagagcccagctc

SEQ ID NO: 1652291 - DNA, 23 bp, Homo sapiens
cacatccccagagcccagctctt

SEQ ID NO: 1652292 - DNA, 16 bp, Homo sapiens
cacatcccggcctctt

SEQ ID NO: 1652293 - DNA, 17 bp, Homo sapiens
cacatcccggcctcttc

SEQ ID NO: 1652294 - DNA, 15 bp, Homo sapiens
cacatcgttttgggg

SEQ ID NO: 1652295 - DNA, 21 bp, Homo sapiens
cacatctgcattttcacccca

SEQ ID NO: 1652296 - DNA, 15 bp, Homo sapiens
cacatctgctctagg

SEQ ID NO: 1652297 - DNA, 19 bp, Homo sapiens
cacatctgctggtgggtgg

SEQ ID NO: 1652298 - DNA, 17 bp, Homo sapiens
cacatctgggtgccctg

SEQ ID NO: 1652299 - DNA, 18 bp, Homo sapiens
cacatctgggtgccctga

SEQ ID NO: 1652300 - DNA, 20 bp, Homo sapiens
cacatcttaaattcatttct

SEQ ID NO: 1652301 - DNA, 22 bp, Homo sapiens
cacatctttatctgttcttgct

SEQ ID NO: 1652302 - DNA, 19 bp, Homo sapiens
cacatctttcacacttcca

SEQ ID NO: 1652303 - DNA, 15 bp, Homo sapiens
cacatgaacagcttg

SEQ ID NO: 1652304 - DNA, 18 bp, Homo sapiens
cacatgaacagcttgcca

SEQ ID NO: 1652305 - DNA, 21 bp, Homo sapiens
cacatgaataaagcctttgta

SEQ ID NO: 1652306 - DNA, 13 bp, Homo sapiens
cacatgacctcca

SEQ ID NO: 1652307 - DNA, 18 bp, Homo sapiens
cacatgacctccatttcc

SEQ ID NO: 1652308 - DNA, 20 bp, Homo sapiens
cacatgactcgggggtgggg

SEQ ID NO: 1652309 - DNA, 20 bp, Homo sapiens
cacatgacttattatgcata

SEQ ID NO: 1652310 - DNA, 22 bp, Homo sapiens
cacatgaggccatctcaggaga

SEQ ID NO: 1652311 - DNA, 14 bp, Homo sapiens
cacatgccacctgg

SEQ ID NO: 1652312 - DNA, 16 bp, Homo sapiens
cacatgccccaggctc

SEQ ID NO: 1652313 - DNA, 14 bp, Homo sapiens
cacatgccctcctg

SEQ ID NO: 1652314 - DNA, 15 bp, Homo sapiens
cacatgccctcctgg

SEQ ID NO: 1652315 - DNA, 21 bp, Homo sapiens
cacatgcgggctcgcccatac

SEQ ID NO: 1652316 - DNA, 16 bp, Homo sapiens
cacatgcgtatatgtg

SEQ ID NO: 1652317 - DNA, 21 bp, Homo sapiens
cacatgcgtatatgtgcgtct

SEQ ID NO: 1652318 - DNA, 13 bp, Homo sapiens
cacatgctatgtt

SEQ ID NO: 1652319 - DNA, 19 bp, Homo sapiens
cacatgctatgttctgtct

SEQ ID NO: 1652320 - DNA, 21 bp, Homo sapiens
cacatggacccaagataaaag

SEQ ID NO: 1652321 - DNA, 21 bp, Homo sapiens
cacatggagtgcttctggaac

SEQ ID NO: 1652322 - DNA, 18 bp, Homo sapiens
cacatggccatagaggcc

SEQ ID NO: 1652323 - DNA, 22 bp, Homo sapiens
cacatggccatagaggcccagg

SEQ ID NO: 1652324 - DNA, 23 bp, Homo sapiens
cacatggcccctccccctgccag

SEQ ID NO: 1652325 - DNA, 15 bp, Homo sapiens
cacatggcctatgca

SEQ ID NO: 1652326 - DNA, 12 bp, Homo sapiens
cacatgggcttg

SEQ ID NO: 1652327 - DNA, 22 bp, Homo sapiens
cacatggtttaaatatgaatga

SEQ ID NO: 1652328 - DNA, 22 bp, Homo sapiens
cacatgtgagcatgtcacttcc

SEQ ID NO: 1652329 - DNA, 13 bp, Homo sapiens
cacatgtgccaca

SEQ ID NO: 1652330 - DNA, 17 bp, Homo sapiens
cacatgtgccacacagt

SEQ ID NO: 1652331 - DNA, 17 bp, Homo sapiens
cacatgtggccatggcc

SEQ ID NO: 1652332 - DNA, 12 bp, Homo sapiens
cacatgtttcct

SEQ ID NO: 1652333 - DNA, 13 bp, Homo sapiens
cacatgtttttat

SEQ ID NO: 1652334 - DNA, 22 bp, Homo sapiens
cacattaactccctccaccagc

SEQ ID NO: 1652335 - DNA, 17 bp, Homo sapiens
cacattagataaattac

SEQ ID NO: 1652336 - DNA, 16 bp, Homo sapiens
cacattatcgggagca

SEQ ID NO: 1652337 - DNA, 20 bp, Homo sapiens
cacattatcgggagcagtgt

SEQ ID NO: 1652338 - DNA, 23 bp, Homo sapiens
cacattcagggctattttttccc

SEQ ID NO: 1652339 - DNA, 13 bp, Homo sapiens
cacattcctggcc

SEQ ID NO: 1652340 - DNA, 17 bp, Homo sapiens
cacattgagctgtgcaa

SEQ ID NO: 1652341 - DNA, 18 bp, Homo sapiens
cacattgatgtaaggact

SEQ ID NO: 1652342 - DNA, 17 bp, Homo sapiens
cacattgcccatggctg

SEQ ID NO: 1652343 - DNA, 16 bp, Homo sapiens
cacattgcctgttctg

SEQ ID NO: 1652344 - DNA, 21 bp, Homo sapiens
cacattgcctgttctgcttcg

SEQ ID NO: 1652345 - DNA, 12 bp, Homo sapiens
cacattgccttc

SEQ ID NO: 1652346 - DNA, 14 bp, Homo sapiens
cacattgctggctg

SEQ ID NO: 1652347 - DNA, 19 bp, Homo sapiens
cacattgtttgctgctatt

SEQ ID NO: 1652348 - DNA, 18 bp, Homo sapiens
cacattgttttaaaaaga

SEQ ID NO: 1652349 - DNA, 23 bp, Homo sapiens
cacattgttttaaaaagaaacaa

SEQ ID NO: 1652350 - DNA, 14 bp, Homo sapiens
cacatttctggatt

SEQ ID NO: 1652351 - DNA, 15 bp, Homo sapiens
cacatttctggattg

SEQ ID NO: 1652352 - DNA, 23 bp, Homo sapiens
cacatttctttgcattccagctg

SEQ ID NO: 1652353 - DNA, 13 bp, Homo sapiens
cacatttgatgta

SEQ ID NO: 1652354 - DNA, 16 bp, Homo sapiens
cacatttgatgtacat

SEQ ID NO: 1652355 - DNA, 17 bp, Homo sapiens
cacatttgatgtacatg

SEQ ID NO: 1652356 - DNA, 20 bp, Homo sapiens
cacatttgatgtacatgtgt

SEQ ID NO: 1652357 - DNA, 21 bp, Homo sapiens
cacatttgctactgttgtaag

SEQ ID NO: 1652358 - DNA, 17 bp, Homo sapiens
cacatttgggctcaggg

SEQ ID NO: 1652359 - DNA, 18 bp, Homo sapiens
cacatttggtaatgtttt

SEQ ID NO: 1652360 - DNA, 18 bp, Homo sapiens
cacatttgtgaactcaaa

SEQ ID NO: 1652361 - DNA, 18 bp, Homo sapiens
cacattttccttttcaaa

SEQ ID NO: 1652362 - DNA, 12 bp, Homo sapiens
cacattttgtac

SEQ ID NO: 1652363 - DNA, 18 bp, Homo sapiens
cacattttgtacattgtg

SEQ ID NO: 1652364 - DNA, 15 bp, Homo sapiens
cacattttgtatgga

SEQ ID NO: 1652365 - DNA, 19 bp, Homo sapiens
cacattttgtatggagtta

SEQ ID NO: 1652366 - DNA, 21 bp, Homo sapiens
cacatttttatacctgtttaa

SEQ ID NO: 1652367 - DNA, 14 bp, Homo sapiens
caccaaaaaatatc

SEQ ID NO: 1652368 - DNA, 13 bp, Homo sapiens
caccaaaacatgc

SEQ ID NO: 1652369 - DNA, 14 bp, Homo sapiens
caccaaactgccaa

SEQ ID NO: 1652370 - DNA, 14 bp, Homo sapiens
caccaaagacatca

SEQ ID NO: 1652371 - DNA, 15 bp, Homo sapiens
caccaaagtattttt

SEQ ID NO: 1652372 - DNA, 16 bp, Homo sapiens
caccaaagttctaata

SEQ ID NO: 1652373 - DNA, 17 bp, Homo sapiens
caccaacataaaacaaa

SEQ ID NO: 1652374 - DNA, 22 bp, Homo sapiens
caccaaccacagcatcgggagc

SEQ ID NO: 1652375 - DNA, 19 bp, Homo sapiens
caccaaccaggccttcatc

SEQ ID NO: 1652376 - DNA, 15 bp, Homo sapiens
caccccgcctgcctc

SEQ ID NO: 1652377 - DNA, 14 bp, Homo sapiens
caccccgctctggc

SEQ ID NO: 1652378 - DNA, 23 bp, Homo sapiens
caccccggccccctgcccgttct

SEQ ID NO: 1652379 - DNA, 12 bp, Homo sapiens
caccccggcctc

SEQ ID NO: 1652380 - DNA, 18 bp, Homo sapiens
caccccggcctccactcc

SEQ ID NO: 1652381 - DNA, 19 bp, Homo sapiens
caccccggcctccactccc

SEQ ID NO: 1652382 - DNA, 20 bp, Homo sapiens
caccccggggaccctgtgac

SEQ ID NO: 1652383 - DNA, 14 bp, Homo sapiens
cacccctaaagaga

SEQ ID NO: 1652384 - DNA, 15 bp, Homo sapiens
cacccctaaagagat

SEQ ID NO: 1652385 - DNA, 17 bp, Homo sapiens
cacccctacagcctgca

SEQ ID NO: 1652386 - DNA, 20 bp, Homo sapiens
cacccctacagcctgcacac

SEQ ID NO: 1652387 - DNA, 13 bp, Homo sapiens
cacccctcactcc

SEQ ID NO: 1652388 - DNA, 19 bp, Homo sapiens
cacccctcactccccaggg

SEQ ID NO: 1652389 - DNA, 12 bp, Homo sapiens
cacccctccacg

SEQ ID NO: 1652390 - DNA, 13 bp, Homo sapiens
cacccctccagga

SEQ ID NO: 1652391 - DNA, 18 bp, Homo sapiens
cacccctccctttctccc

SEQ ID NO: 1652392 - DNA, 14 bp, Homo sapiens
cacccctccttcct

SEQ ID NO: 1652393 - DNA, 12 bp, Homo sapiens
cacccctgcact

SEQ ID NO: 1652394 - DNA, 13 bp, Homo sapiens
cacccctgcactt

SEQ ID NO: 1652395 - DNA, 13 bp, Homo sapiens
cacccctgcccag

SEQ ID NO: 1652396 - DNA, 14 bp, Homo sapiens
cacccctgcccagg

SEQ ID NO: 1652397 - DNA, 13 bp, Homo sapiens
cacccctgccccg

SEQ ID NO: 1652398 - DNA, 22 bp, Homo sapiens
cacccctgccccgttgcttccc

SEQ ID NO: 1652399 - DNA, 18 bp, Homo sapiens
cacccctggggctgagtc

SEQ ID NO: 1652400 - DNA, 13 bp, Homo sapiens
cacccctgtgctc

SEQ ID NO: 1652401 - DNA, 21 bp, Homo sapiens
caccccttcataccgcctcgt

SEQ ID NO: 1652402 - DNA, 23 bp, Homo sapiens
caccccttcataccgcctcgtgc

SEQ ID NO: 1652403 - DNA, 14 bp, Homo sapiens
caccccttccatgt

SEQ ID NO: 1652404 - DNA, 15 bp, Homo sapiens
caccccttccatgtg

SEQ ID NO: 1652405 - DNA, 19 bp, Homo sapiens
caccccttccccaggccca

SEQ ID NO: 1652406 - DNA, 11 bp, Homo sapiens
caccccttcct

SEQ ID NO: 1652407 - DNA, 12 bp, Homo sapiens
caccccttcctc

SEQ ID NO: 1652408 - DNA, 13 bp, Homo sapiens
caccccttcctcc

SEQ ID NO: 1652409 - DNA, 22 bp, Homo sapiens
caccccttggaggagagagacc

SEQ ID NO: 1652410 - DNA, 23 bp, Homo sapiens
caccccttgtttctgttgttccc

SEQ ID NO: 1652411 - DNA, 14 bp, Homo sapiens
cacccgactcctca

SEQ ID NO: 1652412 - DNA, 16 bp, Homo sapiens
cacccgactttggaat

SEQ ID NO: 1652413 - DNA, 19 bp, Homo sapiens
cacccgagttcctctgggt

SEQ ID NO: 1652414 - DNA, 13 bp, Homo sapiens
cacccgatgctgc

SEQ ID NO: 1652415 - DNA, 20 bp, Homo sapiens
cacccgccgccactaggtgt

SEQ ID NO: 1652416 - DNA, 19 bp, Homo sapiens
cacccgcctcccgcctccc

SEQ ID NO: 1652417 - DNA, 19 bp, Homo sapiens
cacccgggggagcccagtg

SEQ ID NO: 1652418 - DNA, 23 bp, Homo sapiens
cacccgggggagcccagtgaagc

SEQ ID NO: 1652419 - DNA, 21 bp, Homo sapiens
cacccggttaccttggccgtg

SEQ ID NO: 1652420 - DNA, 18 bp, Homo sapiens
cacccgtaggcagcctct

SEQ ID NO: 1652421 - DNA, 21 bp, Homo sapiens
cacccgtaggcagcctctctg

SEQ ID NO: 1652422 - DNA, 18 bp, Homo sapiens
cacccgtggggtgctgcc

SEQ ID NO: 1652423 - DNA, 20 bp, Homo sapiens
cacccgtggggtgctgccct

SEQ ID NO: 1652424 - DNA, 18 bp, Homo sapiens
cacccgttctgctggcct

SEQ ID NO: 1652425 - DNA, 20 bp, Homo sapiens
cacccgttctgctggcctgg

SEQ ID NO: 1652426 - DNA, 16 bp, Homo sapiens
caccctacctgtgcct

SEQ ID NO: 1652427 - DNA, 13 bp, Homo sapiens
caccctaccttcc

SEQ ID NO: 1652428 - DNA, 17 bp, Homo sapiens
caccctaccttccccag

SEQ ID NO: 1652429 - DNA, 19 bp, Homo sapiens
caccctaccttccccagac

SEQ ID NO: 1652430 - DNA, 18 bp, Homo sapiens
caccctcaacctcttctg

SEQ ID NO: 1652431 - DNA, 17 bp, Homo sapiens
caccctcagcacccctt

SEQ ID NO: 1652432 - DNA, 22 bp, Homo sapiens
caccctcagcaccccttccatg

SEQ ID NO: 1652433 - DNA, 14 bp, Homo sapiens
caccctcatgaaaa

SEQ ID NO: 1652434 - DNA, 19 bp, Homo sapiens
caccctcatttctgccagc

SEQ ID NO: 1652435 - DNA, 12 bp, Homo sapiens
caccctccaccc

SEQ ID NO: 1652436 - DNA, 13 bp, Homo sapiens
caccctccaccct

SEQ ID NO: 1652437 - DNA, 14 bp, Homo sapiens
caccctccaccctg

SEQ ID NO: 1652438 - DNA, 16 bp, Homo sapiens
caccctccaccctgtc

SEQ ID NO: 1652439 - DNA, 17 bp, Homo sapiens
caccctccaccctgtcc

SEQ ID NO: 1652440 - DNA, 13 bp, Homo sapiens
caccctccacctt

SEQ ID NO: 1652441 - DNA, 15 bp, Homo sapiens
caccctccacttccc

SEQ ID NO: 1652442 - DNA, 18 bp, Homo sapiens
caccctccatgctcctca

SEQ ID NO: 1652443 - DNA, 18 bp, Homo sapiens
caccctcccctatgctgg

SEQ ID NO: 1652444 - DNA, 16 bp, Homo sapiens
caccctcccctctctt

SEQ ID NO: 1652445 - DNA, 14 bp, Homo sapiens
caccctccctagag

SEQ ID NO: 1652446 - DNA, 21 bp, Homo sapiens
caccctccggcgggtgacagc

SEQ ID NO: 1652447 - DNA, 13 bp, Homo sapiens
caccctccttccc

SEQ ID NO: 1652448 - DNA, 14 bp, Homo sapiens
caccctccttcccg

SEQ ID NO: 1652449 - DNA, 15 bp, Homo sapiens
caccctccttcccgc

SEQ ID NO: 1652450 - DNA, 14 bp, Homo sapiens
caccctctatccca

SEQ ID NO: 1652451 - DNA, 16 bp, Homo sapiens
caccctctatcccaat

SEQ ID NO: 1652452 - DNA, 16 bp, Homo sapiens
caccctctcccaggac

SEQ ID NO: 1652453 - DNA, 13 bp, Homo sapiens
caccctgcacctg

SEQ ID NO: 1652454 - DNA, 19 bp, Homo sapiens
caccctgcagagcacacag

SEQ ID NO: 1652455 - DNA, 12 bp, Homo sapiens
caccctgccccc

SEQ ID NO: 1652456 - DNA, 17 bp, Homo sapiens
caccctgcccgctccca

SEQ ID NO: 1652457 - DNA, 13 bp, Homo sapiens
caccctgccttat

SEQ ID NO: 1652458 - DNA, 18 bp, Homo sapiens
caccctgccttatcttgc

SEQ ID NO: 1652459 - DNA, 11 bp, Homo sapiens
caccctggaat

SEQ ID NO: 1652460 - DNA, 19 bp, Homo sapiens
caccctggatgctgttgag

SEQ ID NO: 1652461 - DNA, 16 bp, Homo sapiens
caccctggcccgcccc

SEQ ID NO: 1652462 - DNA, 19 bp, Homo sapiens
caccctggcccgcccctcg

SEQ ID NO: 1652463 - DNA, 12 bp, Homo sapiens
caccctgggccc

SEQ ID NO: 1652464 - DNA, 20 bp, Homo sapiens
caccctgggctccacacagc

SEQ ID NO: 1652465 - DNA, 18 bp, Homo sapiens
caccctgggtgccattcc

SEQ ID NO: 1652466 - DNA, 15 bp, Homo sapiens
caccctggtgggcca

SEQ ID NO: 1652467 - DNA, 16 bp, Homo sapiens
caccctggtgggccaa

SEQ ID NO: 1652468 - DNA, 17 bp, Homo sapiens
caccctgtactgttctg

SEQ ID NO: 1652469 - DNA, 17 bp, Homo sapiens
caccctgtcaagttaac

SEQ ID NO: 1652470 - DNA, 22 bp, Homo sapiens
caccctgtcaagttaacaagga

SEQ ID NO: 1652471 - DNA, 20 bp, Homo sapiens
caccctgtccaaactgccta

SEQ ID NO: 1652472 - DNA, 16 bp, Homo sapiens
caccctgtcccccagc

SEQ ID NO: 1652473 - DNA, 23 bp, Homo sapiens
caccctgtcccccagctctggtg

SEQ ID NO: 1652474 - DNA, 17 bp, Homo sapiens
caccctgtggctcacag

SEQ ID NO: 1652475 - DNA, 14 bp, Homo sapiens
cacccttcccctcc

SEQ ID NO: 1652476 - DNA, 13 bp, Homo sapiens
cacccttccctgc

SEQ ID NO: 1652477 - DNA, 13 bp, Homo sapiens
cacccttctcgga

SEQ ID NO: 1652478 - DNA, 17 bp, Homo sapiens
cacccttggaggctgtc

SEQ ID NO: 1652479 - DNA, 22 bp, Homo sapiens
cacccttggaggctgtcttctc

SEQ ID NO: 1652480 - DNA, 13 bp, Homo sapiens
cacccttggcctg

SEQ ID NO: 1652481 - DNA, 22 bp, Homo sapiens
caccctttgctgtgaggctgtc

SEQ ID NO: 1652482 - DNA, 23 bp, Homo sapiens
caccgaccaactgccctaagccc

SEQ ID NO: 1652483 - DNA, 17 bp, Homo sapiens
caccgagccagcttggt

SEQ ID NO: 1652484 - DNA, 20 bp, Homo sapiens
caccgcaggggactgtctca

SEQ ID NO: 1652485 - DNA, 19 bp, Homo sapiens
caccgccacgtcccagcat

SEQ ID NO: 1652486 - DNA, 14 bp, Homo sapiens
caccgcccatcagg

SEQ ID NO: 1652487 - DNA, 15 bp, Homo sapiens
caccgcccccacccc

SEQ ID NO: 1652488 - DNA, 22 bp, Homo sapiens
caccgcccccaccccttcccca

SEQ ID NO: 1652489 - DNA, 22 bp, Homo sapiens
caccgcctccccacctccaggc

SEQ ID NO: 1652490 - DNA, 17 bp, Homo sapiens
caccgcctctggccgcc

SEQ ID NO: 1652491 - DNA, 12 bp, Homo sapiens
caccgcctgccc

SEQ ID NO: 1652492 - DNA, 16 bp, Homo sapiens
cactaaacaagaaatc

SEQ ID NO: 1652493 - DNA, 13 bp, Homo sapiens
cactaaagcagtg

SEQ ID NO: 1652494 - DNA, 16 bp, Homo sapiens
cactaaatcagagaca

SEQ ID NO: 1652495 - DNA, 15 bp, Homo sapiens
cactaaatgagctcc

SEQ ID NO: 1652496 - DNA, 16 bp, Homo sapiens
cactaaatgagctcct

SEQ ID NO: 1652497 - DNA, 22 bp, Homo sapiens
cactaaccaagctgagtttcct

SEQ ID NO: 1652498 - DNA, 14 bp, Homo sapiens
cactaaccatcccc

SEQ ID NO: 1652499 - DNA, 20 bp, Homo sapiens
cactaaccatccccaactcc

SEQ ID NO: 1652500 - DNA, 15 bp, Homo sapiens
cactaactcaccagc

SEQ ID NO: 1652501 - DNA, 18 bp, Homo sapiens
cactaactcaccagcccc

SEQ ID NO: 1652502 - DNA, 14 bp, Homo sapiens
cactaagctctctg

SEQ ID NO: 1652503 - DNA, 15 bp, Homo sapiens
cactaagctctctgg

SEQ ID NO: 1652504 - DNA, 16 bp, Homo sapiens
cactaagctctctggg

SEQ ID NO: 1652505 - DNA, 14 bp, Homo sapiens
cactaagttatagt

SEQ ID NO: 1652506 - DNA, 17 bp, Homo sapiens
cactaagttatagtata

SEQ ID NO: 1652507 - DNA, 16 bp, Homo sapiens
cactaatatatttaaa

SEQ ID NO: 1652508 - DNA, 21 bp, Homo sapiens
cactaatatatttaaaaataa

SEQ ID NO: 1652509 - DNA, 15 bp, Homo sapiens
cactaatttttgtat

SEQ ID NO: 1652510 - DNA, 20 bp, Homo sapiens
cactaatttttgtattattt

SEQ ID NO: 1652511 - DNA, 21 bp, Homo sapiens
cactacaagtcagctccagct

SEQ ID NO: 1652512 - DNA, 15 bp, Homo sapiens
cactacacagcacac

SEQ ID NO: 1652513 - DNA, 16 bp, Homo sapiens
cactacacatttgaaa

SEQ ID NO: 1652514 - DNA, 14 bp, Homo sapiens
cactacatctggct

SEQ ID NO: 1652515 - DNA, 21 bp, Homo sapiens
cactacatgcagcccatgccc

SEQ ID NO: 1652516 - DNA, 23 bp, Homo sapiens
cactacatgcagcccatgcccac

SEQ ID NO: 1652517 - DNA, 21 bp, Homo sapiens
cactaccacgccaagctaatt

SEQ ID NO: 1652518 - DNA, 17 bp, Homo sapiens
cactaccagccagcctc

SEQ ID NO: 1652519 - DNA, 16 bp, Homo sapiens
cactaccccttgattt

SEQ ID NO: 1652520 - DNA, 17 bp, Homo sapiens
cactaccctgagatctg

SEQ ID NO: 1652521 - DNA, 14 bp, Homo sapiens
cactaccctgattc

SEQ ID NO: 1652522 - DNA, 20 bp, Homo sapiens
cactaccctgattcttgatt

SEQ ID NO: 1652523 - DNA, 14 bp, Homo sapiens
cactacccttctcc

SEQ ID NO: 1652524 - DNA, 17 bp, Homo sapiens
cactacccttctccttt

SEQ ID NO: 1652525 - DNA, 23 bp, Homo sapiens
cactacccttctcctttccttcc

SEQ ID NO: 1652526 - DNA, 20 bp, Homo sapiens
cactaccgtggaccacctag

SEQ ID NO: 1652527 - DNA, 15 bp, Homo sapiens
cactactcgagccca

SEQ ID NO: 1652528 - DNA, 21 bp, Homo sapiens
cactactcgagcccacccagc

SEQ ID NO: 1652529 - DNA, 23 bp, Homo sapiens
cactactcgagcccacccagcat

SEQ ID NO: 1652530 - DNA, 17 bp, Homo sapiens
cactagaactctccatc

SEQ ID NO: 1652531 - DNA, 15 bp, Homo sapiens
cactagaagaaaagc

SEQ ID NO: 1652532 - DNA, 18 bp, Homo sapiens
cactagaagaaaagccca

SEQ ID NO: 1652533 - DNA, 19 bp, Homo sapiens
cactagaagaaaagcccat

SEQ ID NO: 1652534 - DNA, 16 bp, Homo sapiens
cactagaagtcctgct

SEQ ID NO: 1652535 - DNA, 17 bp, Homo sapiens
cactagagggcccatca

SEQ ID NO: 1652536 - DNA, 23 bp, Homo sapiens
cactagagggcccatcaggcagt

SEQ ID NO: 1652537 - DNA, 12 bp, Homo sapiens
cactagcagctg

SEQ ID NO: 1652538 - DNA, 19 bp, Homo sapiens
cactagcccaatgaaatga

SEQ ID NO: 1652539 - DNA, 17 bp, Homo sapiens
cactagcctctccagga

SEQ ID NO: 1652540 - DNA, 21 bp, Homo sapiens
cactagcctctccaggaatgc

SEQ ID NO: 1652541 - DNA, 16 bp, Homo sapiens
cactagcctgtgatta

SEQ ID NO: 1652542 - DNA, 16 bp, Homo sapiens
cactaggactcagaaa

SEQ ID NO: 1652543 - DNA, 18 bp, Homo sapiens
cactaggactctgaggct

SEQ ID NO: 1652544 - DNA, 20 bp, Homo sapiens
cactaggcccccacttgcct

SEQ ID NO: 1652545 - DNA, 23 bp, Homo sapiens
cactaggcccccacttgcctctt

SEQ ID NO: 1652546 - DNA, 18 bp, Homo sapiens
cactagggccttggaaat

SEQ ID NO: 1652547 - DNA, 14 bp, Homo sapiens
cactaggtgtcccc

SEQ ID NO: 1652548 - DNA, 21 bp, Homo sapiens
cactaggtgtccccaacgtcc

SEQ ID NO: 1652549 - DNA, 22 bp, Homo sapiens
cactaggtgtccccaacgtccc

SEQ ID NO: 1652550 - DNA, 17 bp, Homo sapiens
cactagttttgtgccag

SEQ ID NO: 1652551 - DNA, 14 bp, Homo sapiens
cactataatgtaag

SEQ ID NO: 1652552 - DNA, 15 bp, Homo sapiens
cactatacaaacaaa

SEQ ID NO: 1652553 - DNA, 14 bp, Homo sapiens
cactatatctgtat

SEQ ID NO: 1652554 - DNA, 20 bp, Homo sapiens
cactatcccaatcaaagaat

SEQ ID NO: 1652555 - DNA, 22 bp, Homo sapiens
cactatcccaatcaaagaatta

SEQ ID NO: 1652556 - DNA, 14 bp, Homo sapiens
cactatgaatctat

SEQ ID NO: 1652557 - DNA, 16 bp, Homo sapiens
cactatgatttctgaa

SEQ ID NO: 1652558 - DNA, 18 bp, Homo sapiens
cactatgcactgctgtaa

SEQ ID NO: 1652559 - DNA, 14 bp, Homo sapiens
cactattatttcct

SEQ ID NO: 1652560 - DNA, 15 bp, Homo sapiens
cactattatttccta

SEQ ID NO: 1652561 - DNA, 17 bp, Homo sapiens
cactattgtaatcattt

SEQ ID NO: 1652562 - DNA, 13 bp, Homo sapiens
cactatttccaaa

SEQ ID NO: 1652563 - DNA, 14 bp, Homo sapiens
cactatttccaaaa

SEQ ID NO: 1652564 - DNA, 14 bp, Homo sapiens
cactatttccttta

SEQ ID NO: 1652565 - DNA, 17 bp, Homo sapiens
cactatttcctttataa

SEQ ID NO: 1652566 - DNA, 15 bp, Homo sapiens
cactattttatattt

SEQ ID NO: 1652567 - DNA, 18 bp, Homo sapiens
cactattttatatttaaa

SEQ ID NO: 1652568 - DNA, 21 bp, Homo sapiens
cactattttattaaaaataaa

SEQ ID NO: 1652569 - DNA, 16 bp, Homo sapiens
cactattttcaaagaa

SEQ ID NO: 1652570 - DNA, 23 bp, Homo sapiens
cactatttttatttatatttttg

SEQ ID NO: 1652571 - DNA, 17 bp, Homo sapiens
cactcaagcaacaagcc

SEQ ID NO: 1652572 - DNA, 20 bp, Homo sapiens
cactcacaatttaaaatatt

SEQ ID NO: 1652573 - DNA, 23 bp, Homo sapiens
cactcacagacctggagcccctg

SEQ ID NO: 1652574 - DNA, 18 bp, Homo sapiens
cactcacagagtcaaggc

SEQ ID NO: 1652575 - DNA, 20 bp, Homo sapiens
cactcacagagtcaaggcct

SEQ ID NO: 1652576 - DNA, 23 bp, Homo sapiens
cactcacagagtcaaggcctgct

SEQ ID NO: 1652577 - DNA, 23 bp, Homo sapiens
cactcacatagccaactctccca

SEQ ID NO: 1652578 - DNA, 12 bp, Homo sapiens
cactcaccagcc

SEQ ID NO: 1652579 - DNA, 22 bp, Homo sapiens
cactcaccagccctagctgtcc

SEQ ID NO: 1652580 - DNA, 12 bp, Homo sapiens
cactcaccaggg

SEQ ID NO: 1652581 - DNA, 15 bp, Homo sapiens
cactcaccagggtcc

SEQ ID NO: 1652582 - DNA, 19 bp, Homo sapiens
cactcacccctagccctgg

SEQ ID NO: 1652583 - DNA, 17 bp, Homo sapiens
cactcactaggccccca

SEQ ID NO: 1652584 - DNA, 16 bp, Homo sapiens
cactcagaactctcca

SEQ ID NO: 1652585 - DNA, 14 bp, Homo sapiens
cactcagatttaag

SEQ ID NO: 1652586 - DNA, 16 bp, Homo sapiens
cactcagccaccctga

SEQ ID NO: 1652587 - DNA, 23 bp, Homo sapiens
cactcagccatttccccctcctc

SEQ ID NO: 1652588 - DNA, 16 bp, Homo sapiens
cactcaggcctctgca

SEQ ID NO: 1652589 - DNA, 16 bp, Homo sapiens
cactcagtaaaacata

SEQ ID NO: 1652590 - DNA, 18 bp, Homo sapiens
cactcagtccactgttga

SEQ ID NO: 1652591 - DNA, 18 bp, Homo sapiens
cactcagtctctcttctc

SEQ ID NO: 1652592 - DNA, 19 bp, Homo sapiens
cactcagtgcagcaatata

SEQ ID NO: 1652593 - DNA, 14 bp, Homo sapiens
cactcatacacatg

SEQ ID NO: 1652594 - DNA, 20 bp, Homo sapiens
cactcattccttcactcatc

SEQ ID NO: 1652595 - DNA, 19 bp, Homo sapiens
cactcattgctgagcctct

SEQ ID NO: 1652596 - DNA, 13 bp, Homo sapiens
cactccacacatc

SEQ ID NO: 1652597 - DNA, 10 bp, Homo sapiens
cactccacca

SEQ ID NO: 1652598 - DNA, 17 bp, Homo sapiens
cactccaccctccacct

SEQ ID NO: 1652599 - DNA, 16 bp, Homo sapiens
cactccactctgattc

SEQ ID NO: 1652600 - DNA, 23 bp, Homo sapiens
cactccactgacaaacgtcccca

SEQ ID NO: 1652601 - DNA, 16 bp, Homo sapiens
cactccagacccctgg

SEQ ID NO: 1652602 - DNA, 11 bp, Homo sapiens
cactccagccc

SEQ ID NO: 1652603 - DNA, 13 bp, Homo sapiens
cactccagcctga

SEQ ID NO: 1652604 - DNA, 14 bp, Homo sapiens
cactccagcctgag

SEQ ID NO: 1652605 - DNA, 15 bp, Homo sapiens
cactccagcctgagc

SEQ ID NO: 1652606 - DNA, 15 bp, Homo sapiens
cactccagcctgggc

SEQ ID NO: 1652607 - DNA, 12 bp, Homo sapiens
cacttcactgtg

SEQ ID NO: 1652608 - DNA, 13 bp, Homo sapiens
cacttcagatctg

SEQ ID NO: 1652609 - DNA, 19 bp, Homo sapiens
cacttcagatctgaggttg

SEQ ID NO: 1652610 - DNA, 14 bp, Homo sapiens
cacttcaggctctt

SEQ ID NO: 1652611 - DNA, 19 bp, Homo sapiens
cacttcagggctttactcc

SEQ ID NO: 1652612 - DNA, 14 bp, Homo sapiens
cacttcataatcca

SEQ ID NO: 1652613 - DNA, 15 bp, Homo sapiens
cacttcataatccag

SEQ ID NO: 1652614 - DNA, 18 bp, Homo sapiens
cacttcatggaccaagaa

SEQ ID NO: 1652615 - DNA, 16 bp, Homo sapiens
cacttcattgttttaa

SEQ ID NO: 1652616 - DNA, 20 bp, Homo sapiens
cacttccaggggaacctgcc

SEQ ID NO: 1652617 - DNA, 14 bp, Homo sapiens
cacttcccagtgga

SEQ ID NO: 1652618 - DNA, 19 bp, Homo sapiens
cacttcccctccaagaccc

SEQ ID NO: 1652619 - DNA, 16 bp, Homo sapiens
cacttcccgtctcaga

SEQ ID NO: 1652620 - DNA, 14 bp, Homo sapiens
cacttccctctgtt

SEQ ID NO: 1652621 - DNA, 11 bp, Homo sapiens
cacttcctgcc

SEQ ID NO: 1652622 - DNA, 12 bp, Homo sapiens
cacttcctgcct

SEQ ID NO: 1652623 - DNA, 14 bp, Homo sapiens
cacttcctgcctaa

SEQ ID NO: 1652624 - DNA, 17 bp, Homo sapiens
cacttcctgttttataa

SEQ ID NO: 1652625 - DNA, 17 bp, Homo sapiens
cacttctaaatagcaat

SEQ ID NO: 1652626 - DNA, 20 bp, Homo sapiens
cacttctagatctcagccat

SEQ ID NO: 1652627 - DNA, 15 bp, Homo sapiens
cacttctccatgctg

SEQ ID NO: 1652628 - DNA, 14 bp, Homo sapiens
cacttctccccgca

SEQ ID NO: 1652629 - DNA, 13 bp, Homo sapiens
cacttctgctttc

SEQ ID NO: 1652630 - DNA, 12 bp, Homo sapiens
cacttctggctt

SEQ ID NO: 1652631 - DNA, 23 bp, Homo sapiens
cacttctggcttcagcccccacc

SEQ ID NO: 1652632 - DNA, 18 bp, Homo sapiens
cacttctgggcttcatct

SEQ ID NO: 1652633 - DNA, 18 bp, Homo sapiens
cacttctgggtggggcag

SEQ ID NO: 1652634 - DNA, 13 bp, Homo sapiens
cacttctggtata

SEQ ID NO: 1652635 - DNA, 13 bp, Homo sapiens
cacttctgtctcc

SEQ ID NO: 1652636 - DNA, 20 bp, Homo sapiens
cacttctgtgagacccccac

SEQ ID NO: 1652637 - DNA, 12 bp, Homo sapiens
cacttcttcacc

SEQ ID NO: 1652638 - DNA, 19 bp, Homo sapiens
cacttcttcacctcttcca

SEQ ID NO: 1652639 - DNA, 20 bp, Homo sapiens
cacttcttcacctcttccac

SEQ ID NO: 1652640 - DNA, 23 bp, Homo sapiens
cacttcttcttggtcttatttat

SEQ ID NO: 1652641 - DNA, 21 bp, Homo sapiens
cacttgaaccatagttactgt

SEQ ID NO: 1652642 - DNA, 20 bp, Homo sapiens
cacttgaagcctaaatttgt

SEQ ID NO: 1652643 - DNA, 17 bp, Homo sapiens
cacttgaatccattgaa

SEQ ID NO: 1652644 - DNA, 13 bp, Homo sapiens
cacttgaatttat

SEQ ID NO: 1652645 - DNA, 13 bp, Homo sapiens
cacttgagcctat

SEQ ID NO: 1652646 - DNA, 20 bp, Homo sapiens
cacttgaggcctgatctgcc

SEQ ID NO: 1652647 - DNA, 20 bp, Homo sapiens
cacttgatgtttcctggaag

SEQ ID NO: 1652648 - DNA, 22 bp, Homo sapiens
cacttgatgtttcctggaagca

SEQ ID NO: 1652649 - DNA, 23 bp, Homo sapiens
cacttgatgtttcctggaagcag

SEQ ID NO: 1652650 - DNA, 18 bp, Homo sapiens
cacttgccatgcaggaag

SEQ ID NO: 1652651 - DNA, 21 bp, Homo sapiens
cacttgcctgttggctgctgc

SEQ ID NO: 1652652 - DNA, 16 bp, Homo sapiens
cacttgcgtcctgcag

SEQ ID NO: 1652653 - DNA, 18 bp, Homo sapiens
cacttgcgtcctgcagag

SEQ ID NO: 1652654 - DNA, 17 bp, Homo sapiens
cacttgctcccaaccca

SEQ ID NO: 1652655 - DNA, 14 bp, Homo sapiens
cacttggagcccgt

SEQ ID NO: 1652656 - DNA, 15 bp, Homo sapiens
cacttggcatacaaa

SEQ ID NO: 1652657 - DNA, 17 bp, Homo sapiens
cacttggcctcatgctg

SEQ ID NO: 1652658 - DNA, 20 bp, Homo sapiens
cacttgggggttcaggcccg

SEQ ID NO: 1652659 - DNA, 16 bp, Homo sapiens
cacttggttgggtcct

SEQ ID NO: 1652660 - DNA, 19 bp, Homo sapiens
cacttggttgggtcctcac

SEQ ID NO: 1652661 - DNA, 20 bp, Homo sapiens
cacttggttgggtcctcaca

SEQ ID NO: 1652662 - DNA, 12 bp, Homo sapiens
cacttgtacaaa

SEQ ID NO: 1652663 - DNA, 17 bp, Homo sapiens
cacttgtacaaaataaa

SEQ ID NO: 1652664 - DNA, 13 bp, Homo sapiens
cacttgtatatac

SEQ ID NO: 1652665 - DNA, 21 bp, Homo sapiens
cacttgtatatacgcatctat

SEQ ID NO: 1652666 - DNA, 15 bp, Homo sapiens
cacttgtattgactt

SEQ ID NO: 1652667 - DNA, 14 bp, Homo sapiens
cacttgtatttaat

SEQ ID NO: 1652668 - DNA, 14 bp, Homo sapiens
cacttgtcaaagaa

SEQ ID NO: 1652669 - DNA, 17 bp, Homo sapiens
cacttgtgattatttat

SEQ ID NO: 1652670 - DNA, 14 bp, Homo sapiens
cacttgtgggcttc

SEQ ID NO: 1652671 - DNA, 21 bp, Homo sapiens
cacttgtgggcttcaggtgtt

SEQ ID NO: 1652672 - DNA, 22 bp, Homo sapiens
cacttgtgtgtgggctgtgagt

SEQ ID NO: 1652673 - DNA, 23 bp, Homo sapiens
cacttgtgtgtgggctgtgagtg

SEQ ID NO: 1652674 - DNA, 14 bp, Homo sapiens
cacttgttgtttta

SEQ ID NO: 1652675 - DNA, 14 bp, Homo sapiens
cacttgtttgcact

SEQ ID NO: 1652676 - DNA, 17 bp, Homo sapiens
cacttgtttgcactgtg

SEQ ID NO: 1652677 - DNA, 20 bp, Homo sapiens
cactttaatggcctggaggg

SEQ ID NO: 1652678 - DNA, 19 bp, Homo sapiens
cactttacccacctagaac

SEQ ID NO: 1652679 - DNA, 16 bp, Homo sapiens
cactttacctgcaggc

SEQ ID NO: 1652680 - DNA, 14 bp, Homo sapiens
cactttagatgctg

SEQ ID NO: 1652681 - DNA, 21 bp, Homo sapiens
cactttagatgctgatgattt

SEQ ID NO: 1652682 - DNA, 22 bp, Homo sapiens
cactttatgccggatgtgcttt

SEQ ID NO: 1652683 - DNA, 17 bp, Homo sapiens
cactttcacatagatgt

SEQ ID NO: 1652684 - DNA, 17 bp, Homo sapiens
cactttccatctctgcc

SEQ ID NO: 1652685 - DNA, 19 bp, Homo sapiens
cactttccatctctgcctg

SEQ ID NO: 1652686 - DNA, 15 bp, Homo sapiens
cactttcctgagctg

SEQ ID NO: 1652687 - DNA, 16 bp, Homo sapiens
cactttctaatgtttc

SEQ ID NO: 1652688 - DNA, 13 bp, Homo sapiens
cactttctggcaa

SEQ ID NO: 1652689 - DNA, 12 bp, Homo sapiens
cactttgaaaag

SEQ ID NO: 1652690 - DNA, 20 bp, Homo sapiens
cactttgaaaagttggaagg

SEQ ID NO: 1652691 - DNA, 21 bp, Homo sapiens
cactttgaaaagttggaagga

SEQ ID NO: 1652692 - DNA, 20 bp, Homo sapiens
cactttgaaatgtgtttctg

SEQ ID NO: 1652693 - DNA, 12 bp, Homo sapiens
cactttgggagg

SEQ ID NO: 1652694 - DNA, 19 bp, Homo sapiens
cactttgggaggccaagga

SEQ ID NO: 1652695 - DNA, 19 bp, Homo sapiens
cactttggtacatggccag

SEQ ID NO: 1652696 - DNA, 17 bp, Homo sapiens
cactttgtaatttttgc

SEQ ID NO: 1652697 - DNA, 14 bp, Homo sapiens
cactttgtattact

SEQ ID NO: 1652698 - DNA, 19 bp, Homo sapiens
cacttttaaaaaaattttt

SEQ ID NO: 1652699 - DNA, 17 bp, Homo sapiens
cacttttaataaacttt

SEQ ID NO: 1652700 - DNA, 17 bp, Homo sapiens
cacttttagaaatgcat

SEQ ID NO: 1652701 - DNA, 19 bp, Homo sapiens
cactttttaagtttgaaga

SEQ ID NO: 1652702 - DNA, 15 bp, Homo sapiens
cacttttttaaatat

SEQ ID NO: 1652703 - DNA, 17 bp, Homo sapiens
cactttttttctttttc

SEQ ID NO: 1652704 - DNA, 20 bp, Homo sapiens
cactttttttttttctgcct

SEQ ID NO: 1652705 - DNA, 19 bp, Homo sapiens
cactttttttttttttccc

SEQ ID NO: 1652706 - DNA, 20 bp, Homo sapiens
cactttttttttttttcccc

SEQ ID NO: 1652707 - DNA, 14 bp, Homo sapiens
cagaaaaaaaagtg

SEQ ID NO: 1652708 - DNA, 19 bp, Homo sapiens
cagaaaaaatgtctgtaaa

SEQ ID NO: 1652709 - DNA, 13 bp, Homo sapiens
cagaaaaacaatc

SEQ ID NO: 1652710 - DNA, 20 bp, Homo sapiens
cagaaaaacaatcttattcc

SEQ ID NO: 1652711 - DNA, 20 bp, Homo sapiens
cagaaaacaaaagagagaat

SEQ ID NO: 1652712 - DNA, 13 bp, Homo sapiens
cagaaaacaactt

SEQ ID NO: 1652713 - DNA, 20 bp, Homo sapiens
cagaaaacaacttggcattt

SEQ ID NO: 1652714 - DNA, 23 bp, Homo sapiens
cagaaaacaacttggcatttcta

SEQ ID NO: 1652715 - DNA, 15 bp, Homo sapiens
cagaaaacagggtct

SEQ ID NO: 1652716 - DNA, 23 bp, Homo sapiens
cagaaaacatgtttaaatagcct

SEQ ID NO: 1652717 - DNA, 21 bp, Homo sapiens
cagaaaacctctcctgacccc

SEQ ID NO: 1652718 - DNA, 16 bp, Homo sapiens
cagaaaagagccactt

SEQ ID NO: 1652719 - DNA, 21 bp, Homo sapiens
cagaaaagaggagaccctgga

SEQ ID NO: 1652720 - DNA, 14 bp, Homo sapiens
cagaaaagcacctg

SEQ ID NO: 1652721 - DNA, 16 bp, Homo sapiens
cagaaaagcacctgcc

SEQ ID NO: 1652722 - DNA, 17 bp, Homo sapiens
cagacacacacacgcac

SEQ ID NO: 1652723 - DNA, 21 bp, Homo sapiens
cagacacaccgcggccaggca

SEQ ID NO: 1652724 - DNA, 23 bp, Homo sapiens
cagacacagattatgttcctgct

SEQ ID NO: 1652725 - DNA, 17 bp, Homo sapiens
cagacacatgctatgtt

SEQ ID NO: 1652726 - DNA, 13 bp, Homo sapiens
cagacacatgggc

SEQ ID NO: 1652727 - DNA, 16 bp, Homo sapiens
cagacacatgggcttg

SEQ ID NO: 1652728 - DNA, 19 bp, Homo sapiens
cagacacctgttcacagaa

SEQ ID NO: 1652729 - DNA, 19 bp, Homo sapiens
cagacacgccttcccctca

SEQ ID NO: 1652730 - DNA, 11 bp, Homo sapiens
cagacactaag

SEQ ID NO: 1652731 - DNA, 12 bp, Homo sapiens
cagacactctgc

SEQ ID NO: 1652732 - DNA, 19 bp, Homo sapiens
cagacactctgctctgccc

SEQ ID NO: 1652733 - DNA, 20 bp, Homo sapiens
cagacactctgctctgccct

SEQ ID NO: 1652734 - DNA, 19 bp, Homo sapiens
cagacagacatctctgcac

SEQ ID NO: 1652735 - DNA, 21 bp, Homo sapiens
cagacagatgttgggaggata

SEQ ID NO: 1652736 - DNA, 17 bp, Homo sapiens
cagacagcagctcaggc

SEQ ID NO: 1652737 - DNA, 16 bp, Homo sapiens
cagacagccatgcgtg

SEQ ID NO: 1652738 - DNA, 17 bp, Homo sapiens
cagacagctccctctgc

SEQ ID NO: 1652739 - DNA, 19 bp, Homo sapiens
cagacagctccctctgcct

SEQ ID NO: 1652740 - DNA, 20 bp, Homo sapiens
cagacagcttgactgctttt

SEQ ID NO: 1652741 - DNA, 18 bp, Homo sapiens
cagacaggctcttagcag

SEQ ID NO: 1652742 - DNA, 16 bp, Homo sapiens
cagacaggtccctccc

SEQ ID NO: 1652743 - DNA, 14 bp, Homo sapiens
cagacagtctgtta

SEQ ID NO: 1652744 - DNA, 19 bp, Homo sapiens
cagacagtctgttatgcac

SEQ ID NO: 1652745 - DNA, 22 bp, Homo sapiens
cagacagtggatatgacccaca

SEQ ID NO: 1652746 - DNA, 17 bp, Homo sapiens
cagacatctctgcaccc

SEQ ID NO: 1652747 - DNA, 20 bp, Homo sapiens
cagacatctgaggttttatt

SEQ ID NO: 1652748 - DNA, 12 bp, Homo sapiens
cagacatgtttt

SEQ ID NO: 1652749 - DNA, 22 bp, Homo sapiens
cagacatgttttccgtgaaaac

SEQ ID NO: 1652750 - DNA, 22 bp, Homo sapiens
cagacattgctctcagtgcttt

SEQ ID NO: 1652751 - DNA, 15 bp, Homo sapiens
cagacattttgtgtg

SEQ ID NO: 1652752 - DNA, 16 bp, Homo sapiens
cagacattttgtgtga

SEQ ID NO: 1652753 - DNA, 17 bp, Homo sapiens
cagacattttgtgtgag

SEQ ID NO: 1652754 - DNA, 22 bp, Homo sapiens
cagaccagagctgtctgaactc

SEQ ID NO: 1652755 - DNA, 22 bp, Homo sapiens
cagaccatgaagtaaattatgt

SEQ ID NO: 1652756 - DNA, 15 bp, Homo sapiens
cagaccatgggccaa

SEQ ID NO: 1652757 - DNA, 18 bp, Homo sapiens
cagaccccacgctgacca

SEQ ID NO: 1652758 - DNA, 13 bp, Homo sapiens
cagacccccactc

SEQ ID NO: 1652759 - DNA, 22 bp, Homo sapiens
cagacccccccatttcccgcac

SEQ ID NO: 1652760 - DNA, 15 bp, Homo sapiens
cagaccccgcccctg

SEQ ID NO: 1652761 - DNA, 18 bp, Homo sapiens
cagacccctctggccagg

SEQ ID NO: 1652762 - DNA, 22 bp, Homo sapiens
cagacccctctggccaggatgg

SEQ ID NO: 1652763 - DNA, 13 bp, Homo sapiens
cagacccctggct

SEQ ID NO: 1652764 - DNA, 18 bp, Homo sapiens
cagacccctggcttttca

SEQ ID NO: 1652765 - DNA, 16 bp, Homo sapiens
cagaccccttggccag

SEQ ID NO: 1652766 - DNA, 17 bp, Homo sapiens
cagaccctaccccacca

SEQ ID NO: 1652767 - DNA, 13 bp, Homo sapiens
cagaccctggacc

SEQ ID NO: 1652768 - DNA, 22 bp, Homo sapiens
cagaccctgggcaaacagagct

SEQ ID NO: 1652769 - DNA, 13 bp, Homo sapiens
cagacctcatgcc

SEQ ID NO: 1652770 - DNA, 23 bp, Homo sapiens
cagacctgatcctggaggcccag

SEQ ID NO: 1652771 - DNA, 16 bp, Homo sapiens
cagacctggaagaaca

SEQ ID NO: 1652772 - DNA, 19 bp, Homo sapiens
cagacctggacactagggt

SEQ ID NO: 1652773 - DNA, 13 bp, Homo sapiens
cagacctggctct

SEQ ID NO: 1652774 - DNA, 13 bp, Homo sapiens
cagacctgtcacc

SEQ ID NO: 1652775 - DNA, 15 bp, Homo sapiens
cagacctgtcaccct

SEQ ID NO: 1652776 - DNA, 16 bp, Homo sapiens
cagacctgtcgtctct

SEQ ID NO: 1652777 - DNA, 18 bp, Homo sapiens
cagacctgtcgtctctcc

SEQ ID NO: 1652778 - DNA, 22 bp, Homo sapiens
cagacctgtcgtctctcccacc

SEQ ID NO: 1652779 - DNA, 16 bp, Homo sapiens
cagacctgtcttccaa

SEQ ID NO: 1652780 - DNA, 19 bp, Homo sapiens
cagacctgtcttccaagga

SEQ ID NO: 1652781 - DNA, 18 bp, Homo sapiens
cagaccttgggggaagac

SEQ ID NO: 1652782 - DNA, 15 bp, Homo sapiens
cagacgcagcagctg

SEQ ID NO: 1652783 - DNA, 18 bp, Homo sapiens
cagacgctgctgtcacaa

SEQ ID NO: 1652784 - DNA, 14 bp, Homo sapiens
cagacggcggccag

SEQ ID NO: 1652785 - DNA, 20 bp, Homo sapiens
cagacggcggccaggcacag

SEQ ID NO: 1652786 - DNA, 23 bp, Homo sapiens
cagacggcggccaggcacagggc

SEQ ID NO: 1652787 - DNA, 13 bp, Homo sapiens
cagacgggcacag

SEQ ID NO: 1652788 - DNA, 19 bp, Homo sapiens
cagacgggtctgagactga

SEQ ID NO: 1652789 - DNA, 17 bp, Homo sapiens
cagacggttcaccagcc

SEQ ID NO: 1652790 - DNA, 15 bp, Homo sapiens
cagactaaaaagaat

SEQ ID NO: 1652791 - DNA, 23 bp, Homo sapiens
cagactatcgtaacctggtgcct

SEQ ID NO: 1652792 - DNA, 15 bp, Homo sapiens
cagactatttttaga

SEQ ID NO: 1652793 - DNA, 20 bp, Homo sapiens
cagactatttttagattttc

SEQ ID NO: 1652794 - DNA, 17 bp, Homo sapiens
cagactcaagagaaact

SEQ ID NO: 1652795 - DNA, 14 bp, Homo sapiens
cagactcagacatt

SEQ ID NO: 1652796 - DNA, 23 bp, Homo sapiens
cagactcagagaccgtgagcgcc

SEQ ID NO: 1652797 - DNA, 15 bp, Homo sapiens
cagactcagagctct

SEQ ID NO: 1652798 - DNA, 18 bp, Homo sapiens
cagactcagagctctctc

SEQ ID NO: 1652799 - DNA, 23 bp, Homo sapiens
cagactcagctgctatacttatc

SEQ ID NO: 1652800 - DNA, 17 bp, Homo sapiens
cagactcaggttccaga

SEQ ID NO: 1652801 - DNA, 13 bp, Homo sapiens
cagactccaatgg

SEQ ID NO: 1652802 - DNA, 18 bp, Homo sapiens
cagactccaatggggcca

SEQ ID NO: 1652803 - DNA, 23 bp, Homo sapiens
cagactccaatggggccagcact

SEQ ID NO: 1652804 - DNA, 13 bp, Homo sapiens
cagactccatctc

SEQ ID NO: 1652805 - DNA, 14 bp, Homo sapiens
cagactccatctct

SEQ ID NO: 1652806 - DNA, 15 bp, Homo sapiens
cagactccatctctt

SEQ ID NO: 1652807 - DNA, 16 bp, Homo sapiens
cagactccatctcttc

SEQ ID NO: 1652808 - DNA, 22 bp, Homo sapiens
cagactccatctcttctgcaag

SEQ ID NO: 1652809 - DNA, 14 bp, Homo sapiens
cagactcccattcc

SEQ ID NO: 1652810 - DNA, 18 bp, Homo sapiens
cagactcctcagatctga

SEQ ID NO: 1652811 - DNA, 21 bp, Homo sapiens
cagactcctgtgcaactttcc

SEQ ID NO: 1652812 - DNA, 13 bp, Homo sapiens
cagactcttgcct

SEQ ID NO: 1652813 - DNA, 18 bp, Homo sapiens
cagactcttgcctgtttc

SEQ ID NO: 1652814 - DNA, 23 bp, Homo sapiens
cagactctttttttgagtgacag

SEQ ID NO: 1652815 - DNA, 17 bp, Homo sapiens
cagactgaactcgcagg

SEQ ID NO: 1652816 - DNA, 14 bp, Homo sapiens
cagactgagctctc

SEQ ID NO: 1652817 - DNA, 23 bp, Homo sapiens
cagactgagctctccaggccagg

SEQ ID NO: 1652818 - DNA, 18 bp, Homo sapiens
cagactgcgatttgtccc

SEQ ID NO: 1652819 - DNA, 15 bp, Homo sapiens
cagactgctgggact

SEQ ID NO: 1652820 - DNA, 20 bp, Homo sapiens
cagactgcttccaattttct

SEQ ID NO: 1652821 - DNA, 12 bp, Homo sapiens
cagactggaaga

SEQ ID NO: 1652822 - DNA, 23 bp, Homo sapiens
cagactggagaaaacccctccca

SEQ ID NO: 1652823 - DNA, 18 bp, Homo sapiens
cagactggggcatcctgt

SEQ ID NO: 1652824 - DNA, 11 bp, Homo sapiens
cagactgtctc

SEQ ID NO: 1652825 - DNA, 23 bp, Homo sapiens
cagactgttagaaaatggacact

SEQ ID NO: 1652826 - DNA, 15 bp, Homo sapiens
cagactgttgagtta

SEQ ID NO: 1652827 - DNA, 12 bp, Homo sapiens
cagactgtttta

SEQ ID NO: 1652828 - DNA, 17 bp, Homo sapiens
cagacttcacagcgtct

SEQ ID NO: 1652829 - DNA, 21 bp, Homo sapiens
cagacttccaaatcctggaag

SEQ ID NO: 1652830 - DNA, 15 bp, Homo sapiens
cagacttctccagac

SEQ ID NO: 1652831 - DNA, 23 bp, Homo sapiens
cagacttctggaaggctggctga

SEQ ID NO: 1652832 - DNA, 13 bp, Homo sapiens
cagacttgagaac

SEQ ID NO: 1652833 - DNA, 13 bp, Homo sapiens
cagacttgcactg

SEQ ID NO: 1652834 - DNA, 14 bp, Homo sapiens
cagacttgcactga

SEQ ID NO: 1652835 - DNA, 15 bp, Homo sapiens
cagactttaaagaat

SEQ ID NO: 1652836 - DNA, 21 bp, Homo sapiens
cagagaaaatgaattttttcc

SEQ ID NO: 1652837 - DNA, 18 bp, Homo sapiens
cagaggtggatgttatga

SEQ ID NO: 1652838 - DNA, 22 bp, Homo sapiens
cagaggtggatgttatgaacag

SEQ ID NO: 1652839 - DNA, 19 bp, Homo sapiens
cagaggtgggatcctccct

SEQ ID NO: 1652840 - DNA, 13 bp, Homo sapiens
cagaggtgggcag

SEQ ID NO: 1652841 - DNA, 17 bp, Homo sapiens
cagaggttatctgcctg

SEQ ID NO: 1652842 - DNA, 18 bp, Homo sapiens
cagaggttatctgcctgg

SEQ ID NO: 1652843 - DNA, 22 bp, Homo sapiens
cagaggttatctgcctggcctg

SEQ ID NO: 1652844 - DNA, 18 bp, Homo sapiens
cagaggttgcagtgagct

SEQ ID NO: 1652845 - DNA, 18 bp, Homo sapiens
cagaggttgtagtgagcc

SEQ ID NO: 1652846 - DNA, 22 bp, Homo sapiens
cagaggttgtagtgagccaaga

SEQ ID NO: 1652847 - DNA, 18 bp, Homo sapiens
cagaggtttgcttcctca

SEQ ID NO: 1652848 - DNA, 13 bp, Homo sapiens
cagagtaaaagta

SEQ ID NO: 1652849 - DNA, 13 bp, Homo sapiens
cagagtatgaaca

SEQ ID NO: 1652850 - DNA, 15 bp, Homo sapiens
cagagtcactcacac

SEQ ID NO: 1652851 - DNA, 18 bp, Homo sapiens
cagagtcagccaggacca

SEQ ID NO: 1652852 - DNA, 23 bp, Homo sapiens
cagagtccatttcccacatcttt

SEQ ID NO: 1652853 - DNA, 17 bp, Homo sapiens
cagagtcctcattataa

SEQ ID NO: 1652854 - DNA, 19 bp, Homo sapiens
cagagtccttagtggaggg

SEQ ID NO: 1652855 - DNA, 15 bp, Homo sapiens
cagagtctcccgctg

SEQ ID NO: 1652856 - DNA, 14 bp, Homo sapiens
cagagtctgagccc

SEQ ID NO: 1652857 - DNA, 23 bp, Homo sapiens
cagagtgaaagggctatggcaag

SEQ ID NO: 1652858 - DNA, 16 bp, Homo sapiens
cagagtgaagaatctt

SEQ ID NO: 1652859 - DNA, 15 bp, Homo sapiens
cagagtgagaccctg

SEQ ID NO: 1652860 - DNA, 21 bp, Homo sapiens
cagagtgagcaagggggccca

SEQ ID NO: 1652861 - DNA, 22 bp, Homo sapiens
cagagtgagcaagggggcccaa

SEQ ID NO: 1652862 - DNA, 11 bp, Homo sapiens
cagagtgagcc

SEQ ID NO: 1652863 - DNA, 23 bp, Homo sapiens
cagagtgaggatgtgttttgcac

SEQ ID NO: 1652864 - DNA, 13 bp, Homo sapiens
cagagtgattcta

SEQ ID NO: 1652865 - DNA, 15 bp, Homo sapiens
cagagtgcagtggcg

SEQ ID NO: 1652866 - DNA, 14 bp, Homo sapiens
cagagtgcccagaa

SEQ ID NO: 1652867 - DNA, 15 bp, Homo sapiens
cagagtgcttttctg

SEQ ID NO: 1652868 - DNA, 12 bp, Homo sapiens
cagagtggactc

SEQ ID NO: 1652869 - DNA, 21 bp, Homo sapiens
cagagtggactcttccctctc

SEQ ID NO: 1652870 - DNA, 17 bp, Homo sapiens
cagagtggagtctgagt

SEQ ID NO: 1652871 - DNA, 19 bp, Homo sapiens
cagagtggagtctgagtct

SEQ ID NO: 1652872 - DNA, 16 bp, Homo sapiens
cagagtggcctccctg

SEQ ID NO: 1652873 - DNA, 16 bp, Homo sapiens
cagagtggcctggcca

SEQ ID NO: 1652874 - DNA, 17 bp, Homo sapiens
cagagtggcctggccag

SEQ ID NO: 1652875 - DNA, 22 bp, Homo sapiens
cagagtggcctggccaggagct

SEQ ID NO: 1652876 - DNA, 23 bp, Homo sapiens
cagagtgggccccgggctggaga

SEQ ID NO: 1652877 - DNA, 21 bp, Homo sapiens
cagagtgggtcttggaccagg

SEQ ID NO: 1652878 - DNA, 21 bp, Homo sapiens
cagagtggtctttctggagag

SEQ ID NO: 1652879 - DNA, 22 bp, Homo sapiens
cagagtggtctttctggagagg

SEQ ID NO: 1652880 - DNA, 22 bp, Homo sapiens
cagagtgtttaattgtactcaa

SEQ ID NO: 1652881 - DNA, 12 bp, Homo sapiens
cagagttaaaat

SEQ ID NO: 1652882 - DNA, 14 bp, Homo sapiens
cagagttacagttc

SEQ ID NO: 1652883 - DNA, 16 bp, Homo sapiens
cagagttacagttctg

SEQ ID NO: 1652884 - DNA, 20 bp, Homo sapiens
cagagttctgtgaagaggaa

SEQ ID NO: 1652885 - DNA, 20 bp, Homo sapiens
cagagttgctgggagctgaa

SEQ ID NO: 1652886 - DNA, 17 bp, Homo sapiens
cagagtttgtgtgttgt

SEQ ID NO: 1652887 - DNA, 23 bp, Homo sapiens
cagagtttttaaagccttctgga

SEQ ID NO: 1652888 - DNA, 21 bp, Homo sapiens
cagataaatgattcaaaaagt

SEQ ID NO: 1652889 - DNA, 23 bp, Homo sapiens
cagataaatgattcaaaaagtca

SEQ ID NO: 1652890 - DNA, 15 bp, Homo sapiens
cagataactctcttt

SEQ ID NO: 1652891 - DNA, 13 bp, Homo sapiens
cagatacaatgta

SEQ ID NO: 1652892 - DNA, 17 bp, Homo sapiens
cagatacatggttgtga

SEQ ID NO: 1652893 - DNA, 19 bp, Homo sapiens
cagataccttatcttacaa

SEQ ID NO: 1652894 - DNA, 17 bp, Homo sapiens
cagataccttgaaagga

SEQ ID NO: 1652895 - DNA, 18 bp, Homo sapiens
cagatactggaagttttg

SEQ ID NO: 1652896 - DNA, 21 bp, Homo sapiens
cagatactggaagttttgcat

SEQ ID NO: 1652897 - DNA, 15 bp, Homo sapiens
cagatactgtgagct

SEQ ID NO: 1652898 - DNA, 14 bp, Homo sapiens
cagatagtctcttt

SEQ ID NO: 1652899 - DNA, 16 bp, Homo sapiens
cagatatatttttcac

SEQ ID NO: 1652900 - DNA, 18 bp, Homo sapiens
cagatatatttttcacag

SEQ ID NO: 1652901 - DNA, 14 bp, Homo sapiens
cagatatcaaaatt

SEQ ID NO: 1652902 - DNA, 16 bp, Homo sapiens
cagatatcaaaattct

SEQ ID NO: 1652903 - DNA, 24 bp, Homo sapiens
cagatatcaaaattctagctgtat

SEQ ID NO: 1652904 - DNA, 15 bp, Homo sapiens
cagatatgatatgta

SEQ ID NO: 1652905 - DNA, 14 bp, Homo sapiens
cagatatttcaaac

SEQ ID NO: 1652906 - DNA, 15 bp, Homo sapiens
cagatattttttcag

SEQ ID NO: 1652907 - DNA, 22 bp, Homo sapiens
cagatcaaagtatgtatgtttt

SEQ ID NO: 1652908 - DNA, 18 bp, Homo sapiens
cagatcacagcttcagcc

SEQ ID NO: 1652909 - DNA, 22 bp, Homo sapiens
cagatcaccagcccggcctgct

SEQ ID NO: 1652910 - DNA, 14 bp, Homo sapiens
cagatcacgaggtc

SEQ ID NO: 1652911 - DNA, 18 bp, Homo sapiens
cagatcactgaatttata

SEQ ID NO: 1652912 - DNA, 15 bp, Homo sapiens
cagatccagcctggg

SEQ ID NO: 1652913 - DNA, 17 bp, Homo sapiens
cagatccagcctggggt

SEQ ID NO: 1652914 - DNA, 12 bp, Homo sapiens
cagatccaggac

SEQ ID NO: 1652915 - DNA, 18 bp, Homo sapiens
cagatccaggcaggagca

SEQ ID NO: 1652916 - DNA, 13 bp, Homo sapiens
cagatcccctgga

SEQ ID NO: 1652917 - DNA, 13 bp, Homo sapiens
cagatccttgttt

SEQ ID NO: 1652918 - DNA, 19 bp, Homo sapiens
cagatccttgtttcaaaca

SEQ ID NO: 1652919 - DNA, 15 bp, Homo sapiens
cagatcgatcctgga

SEQ ID NO: 1652920 - DNA, 20 bp, Homo sapiens
cagatctctctctctctcct

SEQ ID NO: 1652921 - DNA, 14 bp, Homo sapiens
cagatctgaacaca

SEQ ID NO: 1652922 - DNA, 13 bp, Homo sapiens
cagatctgcctgg

SEQ ID NO: 1652923 - DNA, 15 bp, Homo sapiens
cagatctgcctgggc

SEQ ID NO: 1652924 - DNA, 17 bp, Homo sapiens
cagatctgcctgggcct

SEQ ID NO: 1652925 - DNA, 18 bp, Homo sapiens
cagatctgcctgggcctg

SEQ ID NO: 1652926 - DNA, 15 bp, Homo sapiens
cagatctggaacctc

SEQ ID NO: 1652927 - DNA, 19 bp, Homo sapiens
cagatctggaacctcagcc

SEQ ID NO: 1652928 - DNA, 22 bp, Homo sapiens
cagatctggaacctcagcctgg

SEQ ID NO: 1652929 - DNA, 12 bp, Homo sapiens
cagatctgtgcc

SEQ ID NO: 1652930 - DNA, 21 bp, Homo sapiens
cagatcttccgtggtcagagt

SEQ ID NO: 1652931 - DNA, 15 bp, Homo sapiens
cagatctttcagaaa

SEQ ID NO: 1652932 - DNA, 17 bp, Homo sapiens
cagatctttcagaaata

SEQ ID NO: 1652933 - DNA, 22 bp, Homo sapiens
cagatgaactctttctggcctg

SEQ ID NO: 1652934 - DNA, 16 bp, Homo sapiens
cagatgaactgactga

SEQ ID NO: 1652935 - DNA, 19 bp, Homo sapiens
cagatgaactgactgaagg

SEQ ID NO: 1652936 - DNA, 20 bp, Homo sapiens
cagatgaactgactgaagga

SEQ ID NO: 1652937 - DNA, 22 bp, Homo sapiens
cagatgaattgataaaagagtt

SEQ ID NO: 1652938 - DNA, 16 bp, Homo sapiens
cagatgacacataaat

SEQ ID NO: 1652939 - DNA, 22 bp, Homo sapiens
cagatgacacgcgctctccacc

SEQ ID NO: 1652940 - DNA, 16 bp, Homo sapiens
cagatgactctctcca

SEQ ID NO: 1652941 - DNA, 14 bp, Homo sapiens
cagatgagtcacac

SEQ ID NO: 1652942 - DNA, 19 bp, Homo sapiens
cagatgcaattgctcccat

SEQ ID NO: 1652943 - DNA, 16 bp, Homo sapiens
cagatgcaggacagga

SEQ ID NO: 1652944 - DNA, 19 bp, Homo sapiens
cagatgcaggacaggaggc

SEQ ID NO: 1652945 - DNA, 16 bp, Homo sapiens
cagatgccaccctagc

SEQ ID NO: 1652946 - DNA, 20 bp, Homo sapiens
cagatgccaccctagccaat

SEQ ID NO: 1652947 - DNA, 18 bp, Homo sapiens
cagatgccacttctaaga

SEQ ID NO: 1652948 - DNA, 20 bp, Homo sapiens
cagatgccatggcctgtgct

SEQ ID NO: 1652949 - DNA, 15 bp, Homo sapiens
cagatgccccagagc

SEQ ID NO: 1652950 - DNA, 18 bp, Homo sapiens
cagatgccccagagctgt

SEQ ID NO: 1652951 - DNA, 12 bp, Homo sapiens
cagcagctctga

SEQ ID NO: 1652952 - DNA, 23 bp, Homo sapiens
cagcagctgcgggtctgaaggaa

SEQ ID NO: 1652953 - DNA, 15 bp, Homo sapiens
cagcagctgggaccc

SEQ ID NO: 1652954 - DNA, 17 bp, Homo sapiens
cagcagctggtgcccca

SEQ ID NO: 1652955 - DNA, 23 bp, Homo sapiens
cagcaggagagactgagcagccg

SEQ ID NO: 1652956 - DNA, 14 bp, Homo sapiens
cagcaggcaggtgg

SEQ ID NO: 1652957 - DNA, 19 bp, Homo sapiens
cagcaggccagggactcag

SEQ ID NO: 1652958 - DNA, 13 bp, Homo sapiens
cagcaggcccagc

SEQ ID NO: 1652959 - DNA, 18 bp, Homo sapiens
cagcaggcccagcatgca

SEQ ID NO: 1652960 - DNA, 20 bp, Homo sapiens
cagcaggcccagcatgcagg

SEQ ID NO: 1652961 - DNA, 16 bp, Homo sapiens
cagcaggctcaggcac

SEQ ID NO: 1652962 - DNA, 13 bp, Homo sapiens
cagcaggctcctg

SEQ ID NO: 1652963 - DNA, 15 bp, Homo sapiens
cagcaggctcctggc

SEQ ID NO: 1652964 - DNA, 22 bp, Homo sapiens
cagcaggctcctggctgtgccc

SEQ ID NO: 1652965 - DNA, 17 bp, Homo sapiens
cagcagggccactcccg

SEQ ID NO: 1652966 - DNA, 20 bp, Homo sapiens
cagcaggggccctcactctt

SEQ ID NO: 1652967 - DNA, 15 bp, Homo sapiens
cagcaggggggctgt

SEQ ID NO: 1652968 - DNA, 18 bp, Homo sapiens
cagcaggggggctgtgcc

SEQ ID NO: 1652969 - DNA, 19 bp, Homo sapiens
cagcaggggggctgtgcca

SEQ ID NO: 1652970 - DNA, 15 bp, Homo sapiens
cagcaggtcacactg

SEQ ID NO: 1652971 - DNA, 21 bp, Homo sapiens
cagcaggtgctgggctggact

SEQ ID NO: 1652972 - DNA, 24 bp, Homo sapiens
cagcaggtgctgggctggactggc

SEQ ID NO: 1652973 - DNA, 17 bp, Homo sapiens
cagcaggtgtggtggct

SEQ ID NO: 1652974 - DNA, 21 bp, Homo sapiens
cagcaggtgtggtggctcatg

SEQ ID NO: 1652975 - DNA, 21 bp, Homo sapiens
cagcagtacgtggcttcagag

SEQ ID NO: 1652976 - DNA, 14 bp, Homo sapiens
cagcagtgaccaca

SEQ ID NO: 1652977 - DNA, 15 bp, Homo sapiens
cagcagtgatctcag

SEQ ID NO: 1652978 - DNA, 20 bp, Homo sapiens
cagcagtgatctcagggcag

SEQ ID NO: 1652979 - DNA, 12 bp, Homo sapiens
cagcagtgtccc

SEQ ID NO: 1652980 - DNA, 18 bp, Homo sapiens
cagcagtgtcccctgccc

SEQ ID NO: 1652981 - DNA, 20 bp, Homo sapiens
cagcagtgtcccctgcccca

SEQ ID NO: 1652982 - DNA, 20 bp, Homo sapiens
cagcagttgaaaagactcca

SEQ ID NO: 1652983 - DNA, 13 bp, Homo sapiens
cagcagttgacat

SEQ ID NO: 1652984 - DNA, 19 bp, Homo sapiens
cagcagtttccgaggctga

SEQ ID NO: 1652985 - DNA, 14 bp, Homo sapiens
cagcatacttcaaa

SEQ ID NO: 1652986 - DNA, 18 bp, Homo sapiens
cagcatagaacaggacct

SEQ ID NO: 1652987 - DNA, 16 bp, Homo sapiens
cagcatagcctgcctg

SEQ ID NO: 1652988 - DNA, 21 bp, Homo sapiens
cagcatagcctgcctgatccc

SEQ ID NO: 1652989 - DNA, 20 bp, Homo sapiens
cagcatatgggggcctggat

SEQ ID NO: 1652990 - DNA, 15 bp, Homo sapiens
cagcatcacctgcct

SEQ ID NO: 1652991 - DNA, 17 bp, Homo sapiens
cagcatcacctgcctgt

SEQ ID NO: 1652992 - DNA, 14 bp, Homo sapiens
cagcatccctggag

SEQ ID NO: 1652993 - DNA, 20 bp, Homo sapiens
cagcatccctggagcaggag

SEQ ID NO: 1652994 - DNA, 23 bp, Homo sapiens
cagcatccgcaggtgctggtccc

SEQ ID NO: 1652995 - DNA, 21 bp, Homo sapiens
cagcatcggacaagaccccca

SEQ ID NO: 1652996 - DNA, 18 bp, Homo sapiens
cagcatcgggagcaccca

SEQ ID NO: 1652997 - DNA, 23 bp, Homo sapiens
cagcatctccctcactgaaacca

SEQ ID NO: 1652998 - DNA, 17 bp, Homo sapiens
cagcatctgaccatctg

SEQ ID NO: 1652999 - DNA, 13 bp, Homo sapiens
cagcatctggctg

SEQ ID NO: 1653000 - DNA, 14 bp, Homo sapiens
cagcatctggctgt

SEQ ID NO: 1653001 - DNA, 20 bp, Homo sapiens
cagcatctggctgtctagaa

SEQ ID NO: 1653002 - DNA, 21 bp, Homo sapiens
cagcatctggctgtctagaat

SEQ ID NO: 1653003 - DNA, 22 bp, Homo sapiens
cagcatctggctgtctagaatg

SEQ ID NO: 1653004 - DNA, 14 bp, Homo sapiens
cagcatctttcacc

SEQ ID NO: 1653005 - DNA, 13 bp, Homo sapiens
cagcatgaataaa

SEQ ID NO: 1653006 - DNA, 15 bp, Homo sapiens
cagcatgaataaaac

SEQ ID NO: 1653007 - DNA, 18 bp, Homo sapiens
cagcatgaataaaacact

SEQ ID NO: 1653008 - DNA, 24 bp, Homo sapiens
cagcatgaataaaacactcatccc

SEQ ID NO: 1653009 - DNA, 23 bp, Homo sapiens
cagcatgacctgtgaccagcact

SEQ ID NO: 1653010 - DNA, 16 bp, Homo sapiens
cagcatgagactttct

SEQ ID NO: 1653011 - DNA, 15 bp, Homo sapiens
cagcatgaggacaga

SEQ ID NO: 1653012 - DNA, 13 bp, Homo sapiens
cagcatgattctt

SEQ ID NO: 1653013 - DNA, 14 bp, Homo sapiens
cagcatggaaaaat

SEQ ID NO: 1653014 - DNA, 18 bp, Homo sapiens
cagcatggaaaaatggtt

SEQ ID NO: 1653015 - DNA, 15 bp, Homo sapiens
cagcatggcatagcc

SEQ ID NO: 1653016 - DNA, 15 bp, Homo sapiens
cagcatggcatccaa

SEQ ID NO: 1653017 - DNA, 21 bp, Homo sapiens
cagcatgggtccttgatgcca

SEQ ID NO: 1653018 - DNA, 18 bp, Homo sapiens
cagcatgtctattcagct

SEQ ID NO: 1653019 - DNA, 13 bp, Homo sapiens
cagcatgtgccaa

SEQ ID NO: 1653020 - DNA, 14 bp, Homo sapiens
cagcattcaaaata

SEQ ID NO: 1653021 - DNA, 17 bp, Homo sapiens
cagcattcagcacacac

SEQ ID NO: 1653022 - DNA, 19 bp, Homo sapiens
cagcattcttgtcacaata

SEQ ID NO: 1653023 - DNA, 14 bp, Homo sapiens
cagcattgctggtt

SEQ ID NO: 1653024 - DNA, 15 bp, Homo sapiens
cagcattgctggttc

SEQ ID NO: 1653025 - DNA, 17 bp, Homo sapiens
cagcattgctggttcta

SEQ ID NO: 1653026 - DNA, 12 bp, Homo sapiens
cagcattgtctt

SEQ ID NO: 1653027 - DNA, 15 bp, Homo sapiens
cagcattgtctttgc

SEQ ID NO: 1653028 - DNA, 19 bp, Homo sapiens
cagcattgtctttgctgta

SEQ ID NO: 1653029 - DNA, 22 bp, Homo sapiens
cagcatttactatgcacaacag

SEQ ID NO: 1653030 - DNA, 18 bp, Homo sapiens
cagcatttagctggccac

SEQ ID NO: 1653031 - DNA, 20 bp, Homo sapiens
cagcatttgattaacatttg

SEQ ID NO: 1653032 - DNA, 17 bp, Homo sapiens
cagcatttgctttcctc

SEQ ID NO: 1653033 - DNA, 21 bp, Homo sapiens
cagcatttggttttacacagg

SEQ ID NO: 1653034 - DNA, 22 bp, Homo sapiens
cagcatttggttttacacagga

SEQ ID NO: 1653035 - DNA, 17 bp, Homo sapiens
cagccaaaccctgtctg

SEQ ID NO: 1653036 - DNA, 22 bp, Homo sapiens
cagccaaactgtagatgaagag

SEQ ID NO: 1653037 - DNA, 17 bp, Homo sapiens
cagccaaatgcagggag

SEQ ID NO: 1653038 - DNA, 15 bp, Homo sapiens
cagccaaatttcctg

SEQ ID NO: 1653039 - DNA, 22 bp, Homo sapiens
cagccaacgagacacattgcct

SEQ ID NO: 1653040 - DNA, 14 bp, Homo sapiens
cagccaactagccc

SEQ ID NO: 1653041 - DNA, 22 bp, Homo sapiens
cagccaactagcccctggggtg

SEQ ID NO: 1653042 - DNA, 17 bp, Homo sapiens
cagccaagaagcctgca

SEQ ID NO: 1653043 - DNA, 13 bp, Homo sapiens
cagccaaggccga

SEQ ID NO: 1653044 - DNA, 17 bp, Homo sapiens
cagccaaggccgagacc

SEQ ID NO: 1653045 - DNA, 17 bp, Homo sapiens
cagccaagggtcctcac

SEQ ID NO: 1653046 - DNA, 19 bp, Homo sapiens
cagccacacccaggcactt

SEQ ID NO: 1653047 - DNA, 17 bp, Homo sapiens
cagccacactgggcctg

SEQ ID NO: 1653048 - DNA, 21 bp, Homo sapiens
cagccacactgggcctggagc

SEQ ID NO: 1653049 - DNA, 16 bp, Homo sapiens
cagccacatgccccag

SEQ ID NO: 1653050 - DNA, 14 bp, Homo sapiens
cagccacccaagcc

SEQ ID NO: 1653051 - DNA, 20 bp, Homo sapiens
cagccaccccgggctctctg

SEQ ID NO: 1653052 - DNA, 21 bp, Homo sapiens
cagccaccccgggctctctgc

SEQ ID NO: 1653053 - DNA, 22 bp, Homo sapiens
cagccaccccgggctctctgct

SEQ ID NO: 1653054 - DNA, 21 bp, Homo sapiens
cagccacccgtggggtgctgc

SEQ ID NO: 1653055 - DNA, 16 bp, Homo sapiens
cagccacgcagggcca

SEQ ID NO: 1653056 - DNA, 21 bp, Homo sapiens
cagccacggggactcagccct

SEQ ID NO: 1653057 - DNA, 22 bp, Homo sapiens
cagccacttggtttttggctct

SEQ ID NO: 1653058 - DNA, 17 bp, Homo sapiens
cagccagaagcctctgc

SEQ ID NO: 1653059 - DNA, 18 bp, Homo sapiens
cagccagactggcacagt

SEQ ID NO: 1653060 - DNA, 15 bp, Homo sapiens
cagccagagctgtgc

SEQ ID NO: 1653061 - DNA, 19 bp, Homo sapiens
cagccagagttcctgcgga

SEQ ID NO: 1653062 - DNA, 22 bp, Homo sapiens
cagccagcaatgatgtccagaa

SEQ ID NO: 1653063 - DNA, 12 bp, Homo sapiens
cagccagcagag

SEQ ID NO: 1653064 - DNA, 13 bp, Homo sapiens
cagccagcagcag

SEQ ID NO: 1653065 - DNA, 17 bp, Homo sapiens
cagcctgggactcccag

SEQ ID NO: 1653066 - DNA, 18 bp, Homo sapiens
cagcctgggactcccagt

SEQ ID NO: 1653067 - DNA, 21 bp, Homo sapiens
cagcctgggactcccagtgaa

SEQ ID NO: 1653068 - DNA, 13 bp, Homo sapiens
cagcctgggagcc

SEQ ID NO: 1653069 - DNA, 12 bp, Homo sapiens
cagcctgggcaa

SEQ ID NO: 1653070 - DNA, 20 bp, Homo sapiens
cagcctgggcaacaagagca

SEQ ID NO: 1653071 - DNA, 19 bp, Homo sapiens
cagcctgggcaacagagca

SEQ ID NO: 1653072 - DNA, 20 bp, Homo sapiens
cagcctgggcaacagagcaa

SEQ ID NO: 1653073 - DNA, 18 bp, Homo sapiens
cagcctgggcagccaggc

SEQ ID NO: 1653074 - DNA, 19 bp, Homo sapiens
cagcctgggcagccaggct

SEQ ID NO: 1653075 - DNA, 16 bp, Homo sapiens
cagcctgggccccagc

SEQ ID NO: 1653076 - DNA, 18 bp, Homo sapiens
cagcctgggcgacaaaaa

SEQ ID NO: 1653077 - DNA, 20 bp, Homo sapiens
cagcctgggcgacaaaaacg

SEQ ID NO: 1653078 - DNA, 15 bp, Homo sapiens
cagcctggggacccc

SEQ ID NO: 1653079 - DNA, 22 bp, Homo sapiens
cagcctggggctccctctctgg

SEQ ID NO: 1653080 - DNA, 15 bp, Homo sapiens
cagcctggggtctgg

SEQ ID NO: 1653081 - DNA, 19 bp, Homo sapiens
cagcctggggtctggagtt

SEQ ID NO: 1653082 - DNA, 15 bp, Homo sapiens
cagcctgggtcacag

SEQ ID NO: 1653083 - DNA, 20 bp, Homo sapiens
cagcctgggtcacagagtga

SEQ ID NO: 1653084 - DNA, 19 bp, Homo sapiens
cagcctggtttagcctgga

SEQ ID NO: 1653085 - DNA, 16 bp, Homo sapiens
cagcctgtaccttgct

SEQ ID NO: 1653086 - DNA, 23 bp, Homo sapiens
cagcctgtatgtggtgtggggcg

SEQ ID NO: 1653087 - DNA, 14 bp, Homo sapiens
cagcctgtgcctgc

SEQ ID NO: 1653088 - DNA, 12 bp, Homo sapiens
cagcctgtggca

SEQ ID NO: 1653089 - DNA, 19 bp, Homo sapiens
cagcctgtggcggtgcctg

SEQ ID NO: 1653090 - DNA, 12 bp, Homo sapiens
cagcctgtggtt

SEQ ID NO: 1653091 - DNA, 19 bp, Homo sapiens
cagcctgtggttacagtgc

SEQ ID NO: 1653092 - DNA, 19 bp, Homo sapiens
cagccttagctctcccaac

SEQ ID NO: 1653093 - DNA, 20 bp, Homo sapiens
cagccttccccctcccaggg

SEQ ID NO: 1653094 - DNA, 15 bp, Homo sapiens
cagccttcctctgca

SEQ ID NO: 1653095 - DNA, 22 bp, Homo sapiens
cagccttcctctgcagctgacc

SEQ ID NO: 1653096 - DNA, 23 bp, Homo sapiens
cagccttcctctgcagctgacct

SEQ ID NO: 1653097 - DNA, 23 bp, Homo sapiens
cagccttcggagcgttctctgtc

SEQ ID NO: 1653098 - DNA, 16 bp, Homo sapiens
cagccttctactgctc

SEQ ID NO: 1653099 - DNA, 16 bp, Homo sapiens
cagccttgagccctgg

SEQ ID NO: 1653100 - DNA, 19 bp, Homo sapiens
cagccttgagccctggctg

SEQ ID NO: 1653101 - DNA, 14 bp, Homo sapiens
cagccttgccagag

SEQ ID NO: 1653102 - DNA, 16 bp, Homo sapiens
cagccttgctgctctg

SEQ ID NO: 1653103 - DNA, 23 bp, Homo sapiens
cagccttggaggatcgtggccaa

SEQ ID NO: 1653104 - DNA, 13 bp, Homo sapiens
cagcctttccaag

SEQ ID NO: 1653105 - DNA, 18 bp, Homo sapiens
cagcctttctcccaggcc

SEQ ID NO: 1653106 - DNA, 20 bp, Homo sapiens
cagcctttctcccaggccag

SEQ ID NO: 1653107 - DNA, 20 bp, Homo sapiens
cagcctttctgaggacacca

SEQ ID NO: 1653108 - DNA, 15 bp, Homo sapiens
cagcctttgggtcct

SEQ ID NO: 1653109 - DNA, 22 bp, Homo sapiens
cagcctttgggtcctgggcagg

SEQ ID NO: 1653110 - DNA, 19 bp, Homo sapiens
cagcgagagagtttcaaaa

SEQ ID NO: 1653111 - DNA, 14 bp, Homo sapiens
cagcgagggcagct

SEQ ID NO: 1653112 - DNA, 17 bp, Homo sapiens
cagcgagggcagctgct

SEQ ID NO: 1653113 - DNA, 18 bp, Homo sapiens
cagcgagggcagctgcta

SEQ ID NO: 1653114 - DNA, 14 bp, Homo sapiens
cagcgagtggtcaa

SEQ ID NO: 1653115 - DNA, 22 bp, Homo sapiens
cagcgagttgtggaaagcctct

SEQ ID NO: 1653116 - DNA, 20 bp, Homo sapiens
cagcgatggtgctgcccagg

SEQ ID NO: 1653117 - DNA, 22 bp, Homo sapiens
cagcgatggtgctgcccaggcc

SEQ ID NO: 1653118 - DNA, 19 bp, Homo sapiens
cagcgccaaatgttcatcc

SEQ ID NO: 1653119 - DNA, 22 bp, Homo sapiens
cagcgccaaatgttcatcctca

SEQ ID NO: 1653120 - DNA, 14 bp, Homo sapiens
cagcgcccgctggg

SEQ ID NO: 1653121 - DNA, 16 bp, Homo sapiens
cagcgcccgctgggct

SEQ ID NO: 1653122 - DNA, 17 bp, Homo sapiens
cagcgcccgctgggctg

SEQ ID NO: 1653123 - DNA, 15 bp, Homo sapiens
cagcgcggaggagga

SEQ ID NO: 1653124 - DNA, 13 bp, Homo sapiens
cagcgcggccagc

SEQ ID NO: 1653125 - DNA, 20 bp, Homo sapiens
cagcgcggccagcgtcccag

SEQ ID NO: 1653126 - DNA, 18 bp, Homo sapiens
cagcgctctggtgctgca

SEQ ID NO: 1653127 - DNA, 19 bp, Homo sapiens
cagcggaggagaccagctc

SEQ ID NO: 1653128 - DNA, 21 bp, Homo sapiens
cagcggaggagaccagctcag

SEQ ID NO: 1653129 - DNA, 20 bp, Homo sapiens
cagcggattgctctggagca

SEQ ID NO: 1653130 - DNA, 17 bp, Homo sapiens
cagcggcccctcccaca

SEQ ID NO: 1653131 - DNA, 18 bp, Homo sapiens
cagcggcccctcccacac

SEQ ID NO: 1653132 - DNA, 19 bp, Homo sapiens
cagcggcccctcccacaca

SEQ ID NO: 1653133 - DNA, 22 bp, Homo sapiens
cagcggccttgaagacagagca

SEQ ID NO: 1653134 - DNA, 17 bp, Homo sapiens
cagcggctccaactcct

SEQ ID NO: 1653135 - DNA, 14 bp, Homo sapiens
cagcggctggtgca

SEQ ID NO: 1653136 - DNA, 12 bp, Homo sapiens
cagcgggcacag

SEQ ID NO: 1653137 - DNA, 15 bp, Homo sapiens
cagcgggcacagggc

SEQ ID NO: 1653138 - DNA, 20 bp, Homo sapiens
cagcgggcacagggcaccag

SEQ ID NO: 1653139 - DNA, 14 bp, Homo sapiens
cagcgggcagatgg

SEQ ID NO: 1653140 - DNA, 13 bp, Homo sapiens
cagcgggccaggc

SEQ ID NO: 1653141 - DNA, 14 bp, Homo sapiens
cagcgggcggaggg

SEQ ID NO: 1653142 - DNA, 23 bp, Homo sapiens
cagcgggcggaggggatccagcc

SEQ ID NO: 1653143 - DNA, 14 bp, Homo sapiens
cagcgggggccttg

SEQ ID NO: 1653144 - DNA, 22 bp, Homo sapiens
cagcgggtctcctcccagcggc

SEQ ID NO: 1653145 - DNA, 15 bp, Homo sapiens
cagcggtttccactt

SEQ ID NO: 1653146 - DNA, 19 bp, Homo sapiens
cagcggtttccacttgtgg

SEQ ID NO: 1653147 - DNA, 21 bp, Homo sapiens
cagcggtttccacttgtgggc

SEQ ID NO: 1653148 - DNA, 18 bp, Homo sapiens
cagcgtcactccagtgct

SEQ ID NO: 1653149 - DNA, 19 bp, Homo sapiens
cagcgtcactccagtgctc

SEQ ID NO: 1653150 - DNA, 20 bp, Homo sapiens
cagcgtcactccagtgctca

SEQ ID NO: 1653151 - DNA, 21 bp, Homo sapiens
cagcgtcagctgctccctggc

SEQ ID NO: 1653152 - DNA, 14 bp, Homo sapiens
cagcgtcccccgcc

SEQ ID NO: 1653153 - DNA, 14 bp, Homo sapiens
cagcgtcccctgct

SEQ ID NO: 1653154 - DNA, 14 bp, Homo sapiens
cagcgtccctggcg

SEQ ID NO: 1653155 - DNA, 16 bp, Homo sapiens
cagcgtcccttggtga

SEQ ID NO: 1653156 - DNA, 22 bp, Homo sapiens
cagcgtctgctcataggacctg

SEQ ID NO: 1653157 - DNA, 23 bp, Homo sapiens
cagcgtctgctcataggacctgc

SEQ ID NO: 1653158 - DNA, 18 bp, Homo sapiens
cagcgtcttccttcttta

SEQ ID NO: 1653159 - DNA, 16 bp, Homo sapiens
cagcgtggctctaaaa

SEQ ID NO: 1653160 - DNA, 16 bp, Homo sapiens
cagcgttagggctgct

SEQ ID NO: 1653161 - DNA, 18 bp, Homo sapiens
cagctaaagtaacagagc

SEQ ID NO: 1653162 - DNA, 19 bp, Homo sapiens
cagctaaatgtaacttatt

SEQ ID NO: 1653163 - DNA, 21 bp, Homo sapiens
cagctaactccgagagcagtg

SEQ ID NO: 1653164 - DNA, 13 bp, Homo sapiens
cagctaagctcac

SEQ ID NO: 1653165 - DNA, 20 bp, Homo sapiens
cagctaagctcacgtcctga

SEQ ID NO: 1653166 - DNA, 13 bp, Homo sapiens
cagctaataaacc

SEQ ID NO: 1653167 - DNA, 19 bp, Homo sapiens
cagctaatcagcattctca

SEQ ID NO: 1653168 - DNA, 17 bp, Homo sapiens
cagctaatttttgtatt

SEQ ID NO: 1653169 - DNA, 13 bp, Homo sapiens
cagctacaaccct

SEQ ID NO: 1653170 - DNA, 20 bp, Homo sapiens
cagctacaaccctaccctgg

SEQ ID NO: 1653171 - DNA, 13 bp, Homo sapiens
cagctacattcct

SEQ ID NO: 1653172 - DNA, 16 bp, Homo sapiens
cagctacattcctcag

SEQ ID NO: 1653173 - DNA, 17 bp, Homo sapiens
cagctacattcctcagc

SEQ ID NO: 1653174 - DNA, 18 bp, Homo sapiens
cagctacattcctcagct

SEQ ID NO: 1653175 - DNA, 16 bp, Homo sapiens
cagctaccaagtcaga

SEQ ID NO: 1653176 - DNA, 18 bp, Homo sapiens
cagctaccaggtgttcta

SEQ ID NO: 1653177 - DNA, 17 bp, Homo sapiens
cagctactaatgatgtt

SEQ ID NO: 1653178 - DNA, 19 bp, Homo sapiens
cagctactaatgatgtttt

SEQ ID NO: 1653179 - DNA, 23 bp, Homo sapiens
cagcttattgtgtgcgctgcctg

SEQ ID NO: 1653180 - DNA, 17 bp, Homo sapiens
cagcttcaaatgcaaat

SEQ ID NO: 1653181 - DNA, 13 bp, Homo sapiens
cagcttcaccaga

SEQ ID NO: 1653182 - DNA, 16 bp, Homo sapiens
cagcttcaccctgtca

SEQ ID NO: 1653183 - DNA, 16 bp, Homo sapiens
cagcttcagaaagagc

SEQ ID NO: 1653184 - DNA, 21 bp, Homo sapiens
cagcttcagtccatgggtaat

SEQ ID NO: 1653185 - DNA, 14 bp, Homo sapiens
cagcttccaaagcc

SEQ ID NO: 1653186 - DNA, 21 bp, Homo sapiens
cagcttcctcacacccctgtc

SEQ ID NO: 1653187 - DNA, 15 bp, Homo sapiens
cagcttcctggtgta

SEQ ID NO: 1653188 - DNA, 23 bp, Homo sapiens
cagcttcggagggcccctgcgtg

SEQ ID NO: 1653189 - DNA, 20 bp, Homo sapiens
cagcttcgtttattttcaag

SEQ ID NO: 1653190 - DNA, 12 bp, Homo sapiens
cagcttctaaga

SEQ ID NO: 1653191 - DNA, 12 bp, Homo sapiens
cagcttctccaa

SEQ ID NO: 1653192 - DNA, 15 bp, Homo sapiens
cagcttctccaagca

SEQ ID NO: 1653193 - DNA, 18 bp, Homo sapiens
cagcttctctctccaggg

SEQ ID NO: 1653194 - DNA, 14 bp, Homo sapiens
cagcttctggagca

SEQ ID NO: 1653195 - DNA, 21 bp, Homo sapiens
cagcttctggagcagaacttt

SEQ ID NO: 1653196 - DNA, 16 bp, Homo sapiens
cagcttgactgctttt

SEQ ID NO: 1653197 - DNA, 14 bp, Homo sapiens
cagcttgagccggg

SEQ ID NO: 1653198 - DNA, 16 bp, Homo sapiens
cagcttgcacatttgg

SEQ ID NO: 1653199 - DNA, 16 bp, Homo sapiens
cagcttgccccggccc

SEQ ID NO: 1653200 - DNA, 17 bp, Homo sapiens
cagcttggccctttcct

SEQ ID NO: 1653201 - DNA, 14 bp, Homo sapiens
cagcttgggcccag

SEQ ID NO: 1653202 - DNA, 19 bp, Homo sapiens
cagcttgggcccagctggg

SEQ ID NO: 1653203 - DNA, 21 bp, Homo sapiens
cagcttggggccaccaaagct

SEQ ID NO: 1653204 - DNA, 17 bp, Homo sapiens
cagcttgttatttataa

SEQ ID NO: 1653205 - DNA, 14 bp, Homo sapiens
cagcttgtttaacg

SEQ ID NO: 1653206 - DNA, 13 bp, Homo sapiens
cagctttaaacaa

SEQ ID NO: 1653207 - DNA, 16 bp, Homo sapiens
cagctttcaaagcatt

SEQ ID NO: 1653208 - DNA, 13 bp, Homo sapiens
cagctttcagagc

SEQ ID NO: 1653209 - DNA, 20 bp, Homo sapiens
cagctttcatgattagcaag

SEQ ID NO: 1653210 - DNA, 17 bp, Homo sapiens
cagctttccctgcctct

SEQ ID NO: 1653211 - DNA, 20 bp, Homo sapiens
cagctttgataattgtgtac

SEQ ID NO: 1653212 - DNA, 17 bp, Homo sapiens
cagctttgatccctgac

SEQ ID NO: 1653213 - DNA, 19 bp, Homo sapiens
cagctttgctccgctccca

SEQ ID NO: 1653214 - DNA, 21 bp, Homo sapiens
cagctttgctccgctcccacc

SEQ ID NO: 1653215 - DNA, 14 bp, Homo sapiens
cagcttttactgtt

SEQ ID NO: 1653216 - DNA, 17 bp, Homo sapiens
cagcttttctttttctg

SEQ ID NO: 1653217 - DNA, 15 bp, Homo sapiens
cagcttttggtctcc

SEQ ID NO: 1653218 - DNA, 16 bp, Homo sapiens
cagcttttggtctcct

SEQ ID NO: 1653219 - DNA, 17 bp, Homo sapiens
cagcttttggttaatat

SEQ ID NO: 1653220 - DNA, 21 bp, Homo sapiens
cagcttttgttctagacttcc

SEQ ID NO: 1653221 - DNA, 19 bp, Homo sapiens
caggaaaaaaaattctgtt

SEQ ID NO: 1653222 - DNA, 20 bp, Homo sapiens
caggaaaaaaaattctgttg

SEQ ID NO: 1653223 - DNA, 22 bp, Homo sapiens
caggaaaaaaaattctgttgtt

SEQ ID NO: 1653224 - DNA, 19 bp, Homo sapiens
caggaaaagccattttggt

SEQ ID NO: 1653225 - DNA, 16 bp, Homo sapiens
caggaaaatcctctgg

SEQ ID NO: 1653226 - DNA, 17 bp, Homo sapiens
caggaaaatcctctggc

SEQ ID NO: 1653227 - DNA, 13 bp, Homo sapiens
caggaaaatgtat

SEQ ID NO: 1653228 - DNA, 21 bp, Homo sapiens
caggaaacagactaaaaagaa

SEQ ID NO: 1653229 - DNA, 18 bp, Homo sapiens
caggaaaccaacacccaa

SEQ ID NO: 1653230 - DNA, 16 bp, Homo sapiens
caggaaagtggccaag

SEQ ID NO: 1653231 - DNA, 17 bp, Homo sapiens
caggaaatatatatgtg

SEQ ID NO: 1653232 - DNA, 22 bp, Homo sapiens
caggaaatcaaatatgcaaagc

SEQ ID NO: 1653233 - DNA, 15 bp, Homo sapiens
caggaaatgagagat

SEQ ID NO: 1653234 - DNA, 22 bp, Homo sapiens
caggaacaaacagggctgcctt

SEQ ID NO: 1653235 - DNA, 22 bp, Homo sapiens
caggaacacccgactcctcaaa

SEQ ID NO: 1653236 - DNA, 13 bp, Homo sapiens
caggaacagaagg

SEQ ID NO: 1653237 - DNA, 14 bp, Homo sapiens
caggaacagaagga

SEQ ID NO: 1653238 - DNA, 15 bp, Homo sapiens
caggaacagaaggat

SEQ ID NO: 1653239 - DNA, 23 bp, Homo sapiens
caggaacagctatgggagcccca

SEQ ID NO: 1653240 - DNA, 12 bp, Homo sapiens
caggaacccttg

SEQ ID NO: 1653241 - DNA, 19 bp, Homo sapiens
caggaacccttgcatccat

SEQ ID NO: 1653242 - DNA, 21 bp, Homo sapiens
caggaacctgtcctaaggaac

SEQ ID NO: 1653243 - DNA, 15 bp, Homo sapiens
caggaacgagcactg

SEQ ID NO: 1653244 - DNA, 19 bp, Homo sapiens
caggaacgagcactggcca

SEQ ID NO: 1653245 - DNA, 21 bp, Homo sapiens
caggaacgagcactggccaga

SEQ ID NO: 1653246 - DNA, 15 bp, Homo sapiens
caggaactataaaaa

SEQ ID NO: 1653247 - DNA, 17 bp, Homo sapiens
caggaactataaaaaca

SEQ ID NO: 1653248 - DNA, 15 bp, Homo sapiens
caggaactgggctgg

SEQ ID NO: 1653249 - DNA, 19 bp, Homo sapiens
caggaactgggctgggcct

SEQ ID NO: 1653250 - DNA, 16 bp, Homo sapiens
caggaagaaagcagaa

SEQ ID NO: 1653251 - DNA, 15 bp, Homo sapiens
caggaagaggcccac

SEQ ID NO: 1653252 - DNA, 18 bp, Homo sapiens
caggaagccgtcctggcg

SEQ ID NO: 1653253 - DNA, 21 bp, Homo sapiens
caggaagcctgcagtcctgga

SEQ ID NO: 1653254 - DNA, 13 bp, Homo sapiens
caggaagctcagc

SEQ ID NO: 1653255 - DNA, 14 bp, Homo sapiens
caggaagctcagcc

SEQ ID NO: 1653256 - DNA, 18 bp, Homo sapiens
caggaaggagagcctgct

SEQ ID NO: 1653257 - DNA, 13 bp, Homo sapiens
caggaaggcagct

SEQ ID NO: 1653258 - DNA, 16 bp, Homo sapiens
caggaaggcagctgct

SEQ ID NO: 1653259 - DNA, 17 bp, Homo sapiens
caggaaggtagcccagc

SEQ ID NO: 1653260 - DNA, 22 bp, Homo sapiens
caggaaggtagcccagcactgt

SEQ ID NO: 1653261 - DNA, 21 bp, Homo sapiens
caggaagtcccttgccatcct

SEQ ID NO: 1653262 - DNA, 17 bp, Homo sapiens
caggaatattttccaaa

SEQ ID NO: 1653263 - DNA, 18 bp, Homo sapiens
caggaatccttactgata

SEQ ID NO: 1653264 - DNA, 13 bp, Homo sapiens
caggaatctcaga

SEQ ID NO: 1653265 - DNA, 24 bp, Homo sapiens
caggaatctcagagacaggtggcc

SEQ ID NO: 1653266 - DNA, 17 bp, Homo sapiens
caggaatggaaagcgga

SEQ ID NO: 1653267 - DNA, 21 bp, Homo sapiens
caggaatgtgtggcctgcaca

SEQ ID NO: 1653268 - DNA, 16 bp, Homo sapiens
caggaattcagtgcct

SEQ ID NO: 1653269 - DNA, 18 bp, Homo sapiens
caggaattctaaataaat

SEQ ID NO: 1653270 - DNA, 16 bp, Homo sapiens
caggaattctcaagac

SEQ ID NO: 1653271 - DNA, 15 bp, Homo sapiens
caggaattttatttt

SEQ ID NO: 1653272 - DNA, 15 bp, Homo sapiens
caggacacctggccg

SEQ ID NO: 1653273 - DNA, 18 bp, Homo sapiens
caggacacctggccgcct

SEQ ID NO: 1653274 - DNA, 19 bp, Homo sapiens
caggacacctggccgcctc

SEQ ID NO: 1653275 - DNA, 22 bp, Homo sapiens
caggacacctggccgcctccag

SEQ ID NO: 1653276 - DNA, 15 bp, Homo sapiens
caggacacggggcag

SEQ ID NO: 1653277 - DNA, 14 bp, Homo sapiens
caggacagatgcca

SEQ ID NO: 1653278 - DNA, 13 bp, Homo sapiens
caggacagctctt

SEQ ID NO: 1653279 - DNA, 12 bp, Homo sapiens
caggacaggacc

SEQ ID NO: 1653280 - DNA, 12 bp, Homo sapiens
caggacaggccc

SEQ ID NO: 1653281 - DNA, 21 bp, Homo sapiens
caggacagtgcttcagcctga

SEQ ID NO: 1653282 - DNA, 22 bp, Homo sapiens
caggacagtgcttcagcctgag

SEQ ID NO: 1653283 - DNA, 12 bp, Homo sapiens
caggaccacaaa

SEQ ID NO: 1653284 - DNA, 13 bp, Homo sapiens
caggaccagatgt

SEQ ID NO: 1653285 - DNA, 20 bp, Homo sapiens
caggaccagccagcagcagc

SEQ ID NO: 1653286 - DNA, 20 bp, Homo sapiens
caggaccagctcaggacaga

SEQ ID NO: 1653287 - DNA, 12 bp, Homo sapiens
caggaccagctg

SEQ ID NO: 1653288 - DNA, 23 bp, Homo sapiens
caggaccagctggggcgtgggga

SEQ ID NO: 1653289 - DNA, 19 bp, Homo sapiens
caggaccatcctggagggc

SEQ ID NO: 1653290 - DNA, 13 bp, Homo sapiens
caggacccaggcc

SEQ ID NO: 1653291 - DNA, 14 bp, Homo sapiens
caggaccctgaagg

SEQ ID NO: 1653292 - DNA, 16 bp, Homo sapiens
caggaccctgaagggg

SEQ ID NO: 1653293 - DNA, 19 bp, Homo sapiens
caggacctctgtaggcagc

SEQ ID NO: 1653294 - DNA, 18 bp, Homo sapiens
caggccaggctccttcct

SEQ ID NO: 1653295 - DNA, 11 bp, Homo sapiens
caggccaggtc

SEQ ID NO: 1653296 - DNA, 13 bp, Homo sapiens
caggccaggtccc

SEQ ID NO: 1653297 - DNA, 15 bp, Homo sapiens
caggccaggtgcagt

SEQ ID NO: 1653298 - DNA, 13 bp, Homo sapiens
caggccaggtggg

SEQ ID NO: 1653299 - DNA, 22 bp, Homo sapiens
caggccaggtgggaacggctga

SEQ ID NO: 1653300 - DNA, 18 bp, Homo sapiens
caggcccaagagatgaag

SEQ ID NO: 1653301 - DNA, 19 bp, Homo sapiens
caggcccaagagatgaaga

SEQ ID NO: 1653302 - DNA, 15 bp, Homo sapiens
caggcccagcatgca

SEQ ID NO: 1653303 - DNA, 19 bp, Homo sapiens
caggcccagcattgctggt

SEQ ID NO: 1653304 - DNA, 17 bp, Homo sapiens
caggcccagcgcggcca

SEQ ID NO: 1653305 - DNA, 20 bp, Homo sapiens
caggcccagcgcggccagcg

SEQ ID NO: 1653306 - DNA, 22 bp, Homo sapiens
caggcccagcgcggccagcgtc

SEQ ID NO: 1653307 - DNA, 16 bp, Homo sapiens
caggcccatctcaggt

SEQ ID NO: 1653308 - DNA, 23 bp, Homo sapiens
caggcccatgctatgagttttct

SEQ ID NO: 1653309 - DNA, 15 bp, Homo sapiens
caggcccccaccact

SEQ ID NO: 1653310 - DNA, 14 bp, Homo sapiens
caggcccccaggtg

SEQ ID NO: 1653311 - DNA, 19 bp, Homo sapiens
caggcccccaggtgccagt

SEQ ID NO: 1653312 - DNA, 15 bp, Homo sapiens
caggccccctgcatc

SEQ ID NO: 1653313 - DNA, 23 bp, Homo sapiens
caggccccgcttgtccagcgcct

SEQ ID NO: 1653314 - DNA, 15 bp, Homo sapiens
caggccccgggcttc

SEQ ID NO: 1653315 - DNA, 16 bp, Homo sapiens
caggcccctgaggact

SEQ ID NO: 1653316 - DNA, 17 bp, Homo sapiens
caggcccctgaggactg

SEQ ID NO: 1653317 - DNA, 20 bp, Homo sapiens
caggcccgagatgtgaccca

SEQ ID NO: 1653318 - DNA, 23 bp, Homo sapiens
caggcccgcaccccggcctcagg

SEQ ID NO: 1653319 - DNA, 20 bp, Homo sapiens
caggcccggactcaccaact

SEQ ID NO: 1653320 - DNA, 16 bp, Homo sapiens
caggcccgtcggagct

SEQ ID NO: 1653321 - DNA, 18 bp, Homo sapiens
caggcccgtcggagctgc

SEQ ID NO: 1653322 - DNA, 14 bp, Homo sapiens
caggccctccatgg

SEQ ID NO: 1653323 - DNA, 16 bp, Homo sapiens
caggccctccatgggc

SEQ ID NO: 1653324 - DNA, 19 bp, Homo sapiens
caggccctccatgggctag

SEQ ID NO: 1653325 - DNA, 23 bp, Homo sapiens
caggccctccctgttccccagag

SEQ ID NO: 1653326 - DNA, 13 bp, Homo sapiens
caggccctctgcc

SEQ ID NO: 1653327 - DNA, 17 bp, Homo sapiens
caggccctctgcctgca

SEQ ID NO: 1653328 - DNA, 18 bp, Homo sapiens
caggccctctgcctgcac

SEQ ID NO: 1653329 - DNA, 21 bp, Homo sapiens
caggccctctgcctgcactcc

SEQ ID NO: 1653330 - DNA, 22 bp, Homo sapiens
caggccctggcctcccctgcca

SEQ ID NO: 1653331 - DNA, 21 bp, Homo sapiens
caggcccttattttcaagaaa

SEQ ID NO: 1653332 - DNA, 23 bp, Homo sapiens
caggcccttcctctccactgcct

SEQ ID NO: 1653333 - DNA, 20 bp, Homo sapiens
caggcccttggctgcaggca

SEQ ID NO: 1653334 - DNA, 14 bp, Homo sapiens
caggccgcgcccag

SEQ ID NO: 1653335 - DNA, 19 bp, Homo sapiens
caggccgcgcccagcagag

SEQ ID NO: 1653336 - DNA, 21 bp, Homo sapiens
caggccgcgcccagcagaggc

SEQ ID NO: 1653337 - DNA, 13 bp, Homo sapiens
caggccggagccc

SEQ ID NO: 1653338 - DNA, 15 bp, Homo sapiens
caggccggagcccag

SEQ ID NO: 1653339 - DNA, 17 bp, Homo sapiens
caggccggagcccagat

SEQ ID NO: 1653340 - DNA, 21 bp, Homo sapiens
caggccgggcttgggccctgc

SEQ ID NO: 1653341 - DNA, 20 bp, Homo sapiens
caggccggggtggagcatgg

SEQ ID NO: 1653342 - DNA, 15 bp, Homo sapiens
caggcctaagacatg

SEQ ID NO: 1653343 - DNA, 11 bp, Homo sapiens
caggcctccag

SEQ ID NO: 1653344 - DNA, 17 bp, Homo sapiens
caggcctccagcctctc

SEQ ID NO: 1653345 - DNA, 17 bp, Homo sapiens
caggcctccctctctct

SEQ ID NO: 1653346 - DNA, 19 bp, Homo sapiens
caggcctccctctctcttc

SEQ ID NO: 1653347 - DNA, 15 bp, Homo sapiens
caggcctccctgcag

SEQ ID NO: 1653348 - DNA, 19 bp, Homo sapiens
caggcctctcggtgctcca

SEQ ID NO: 1653349 - DNA, 23 bp, Homo sapiens
caggcctctcggtgctccatctc

SEQ ID NO: 1653350 - DNA, 13 bp, Homo sapiens
caggcctctgcag

SEQ ID NO: 1653351 - DNA, 21 bp, Homo sapiens
caggcctctgcagaagccaag

SEQ ID NO: 1653352 - DNA, 13 bp, Homo sapiens
caggcctgagaat

SEQ ID NO: 1653353 - DNA, 15 bp, Homo sapiens
caggcctgcctccca

SEQ ID NO: 1653354 - DNA, 21 bp, Homo sapiens
caggcctgggacccagctact

SEQ ID NO: 1653355 - DNA, 24 bp, Homo sapiens
caggcctgggacccagctactctg

SEQ ID NO: 1653356 - DNA, 13 bp, Homo sapiens
caggcctgttgct

SEQ ID NO: 1653357 - DNA, 20 bp, Homo sapiens
caggcgacaaaatctcctgg

SEQ ID NO: 1653358 - DNA, 19 bp, Homo sapiens
caggcgatccacctgtctc

SEQ ID NO: 1653359 - DNA, 20 bp, Homo sapiens
caggcgatccacctgtctca

SEQ ID NO: 1653360 - DNA, 21 bp, Homo sapiens
caggcgcctataatcccagct

SEQ ID NO: 1653361 - DNA, 16 bp, Homo sapiens
caggcgctgcagggcc

SEQ ID NO: 1653362 - DNA, 23 bp, Homo sapiens
caggcggagctgctgagtgacag

SEQ ID NO: 1653363 - DNA, 16 bp, Homo sapiens
caggcgggctcaagga

SEQ ID NO: 1653364 - DNA, 21 bp, Homo sapiens
caggcggggcccagcgctctc

SEQ ID NO: 1653365 - DNA, 20 bp, Homo sapiens
caggcgtgggacgtggtcag

SEQ ID NO: 1653366 - DNA, 19 bp, Homo sapiens
caggcgttggtgccacttc

SEQ ID NO: 1653367 - DNA, 20 bp, Homo sapiens
caggcgttggtgccacttct

SEQ ID NO: 1653368 - DNA, 20 bp, Homo sapiens
caggcgtttctgaagtgctc

SEQ ID NO: 1653369 - DNA, 22 bp, Homo sapiens
caggctaaatgcaccaagaaag

SEQ ID NO: 1653370 - DNA, 19 bp, Homo sapiens
caggctaagaccctgtgtc

SEQ ID NO: 1653371 - DNA, 15 bp, Homo sapiens
caggctactctcctc

SEQ ID NO: 1653372 - DNA, 18 bp, Homo sapiens
caggctactctcctcggc

SEQ ID NO: 1653373 - DNA, 14 bp, Homo sapiens
caggctactgtcag

SEQ ID NO: 1653374 - DNA, 21 bp, Homo sapiens
caggctatgtataaaatacat

SEQ ID NO: 1653375 - DNA, 22 bp, Homo sapiens
caggctattatttattgtatta

SEQ ID NO: 1653376 - DNA, 13 bp, Homo sapiens
caggctcactgcc

SEQ ID NO: 1653377 - DNA, 15 bp, Homo sapiens
caggctcactgccag

SEQ ID NO: 1653378 - DNA, 16 bp, Homo sapiens
caggctccctttctct

SEQ ID NO: 1653379 - DNA, 23 bp, Homo sapiens
caggctcctacctgtctgctgcc

SEQ ID NO: 1653380 - DNA, 16 bp, Homo sapiens
caggctcctggctgtg

SEQ ID NO: 1653381 - DNA, 23 bp, Homo sapiens
caggctcctggctgtgcccagca

SEQ ID NO: 1653382 - DNA, 12 bp, Homo sapiens
caggctccttcc

SEQ ID NO: 1653383 - DNA, 17 bp, Homo sapiens
caggctctgcacagaca

SEQ ID NO: 1653384 - DNA, 21 bp, Homo sapiens
caggctctgcacagacaagca

SEQ ID NO: 1653385 - DNA, 21 bp, Homo sapiens
caggctctgccctgccctagc

SEQ ID NO: 1653386 - DNA, 22 bp, Homo sapiens
caggctctgccctgccctagct

SEQ ID NO: 1653387 - DNA, 12 bp, Homo sapiens
caggctctgggc

SEQ ID NO: 1653388 - DNA, 14 bp, Homo sapiens
caggctctgggctc

SEQ ID NO: 1653389 - DNA, 16 bp, Homo sapiens
caggctctgggctcag

SEQ ID NO: 1653390 - DNA, 22 bp, Homo sapiens
caggctctgggctcagggctgg

SEQ ID NO: 1653391 - DNA, 23 bp, Homo sapiens
caggctctgggctcagggctgga

SEQ ID NO: 1653392 - DNA, 12 bp, Homo sapiens
caggctcttagc

SEQ ID NO: 1653393 - DNA, 18 bp, Homo sapiens
caggctcttagcagcttc

SEQ ID NO: 1653394 - DNA, 21 bp, Homo sapiens
caggctcttagcagcttccag

SEQ ID NO: 1653395 - DNA, 12 bp, Homo sapiens
caggctgaagag

SEQ ID NO: 1653396 - DNA, 17 bp, Homo sapiens
caggctgaagagaggga

SEQ ID NO: 1653397 - DNA, 20 bp, Homo sapiens
caggctgaagagagggacag

SEQ ID NO: 1653398 - DNA, 14 bp, Homo sapiens
caggctgacatctg

SEQ ID NO: 1653399 - DNA, 16 bp, Homo sapiens
caggctgacatctgtg

SEQ ID NO: 1653400 - DNA, 14 bp, Homo sapiens
caggctgagccatg

SEQ ID NO: 1653401 - DNA, 17 bp, Homo sapiens
caggctgagccatgagg

SEQ ID NO: 1653402 - DNA, 20 bp, Homo sapiens
caggctgagccatgaggagc

SEQ ID NO: 1653403 - DNA, 20 bp, Homo sapiens
caggctgagtgagccacaga

SEQ ID NO: 1653404 - DNA, 13 bp, Homo sapiens
caggctgcacctc

SEQ ID NO: 1653405 - DNA, 20 bp, Homo sapiens
caggctgcacctctggctag

SEQ ID NO: 1653406 - DNA, 23 bp, Homo sapiens
caggctgcacctctggctagagc

SEQ ID NO: 1653407 - DNA, 15 bp, Homo sapiens
caggctgcactgcag

SEQ ID NO: 1653408 - DNA, 13 bp, Homo sapiens
caggggtcagtgc

SEQ ID NO: 1653409 - DNA, 15 bp, Homo sapiens
caggggtcagtgcag

SEQ ID NO: 1653410 - DNA, 14 bp, Homo sapiens
caggggtcccccct

SEQ ID NO: 1653411 - DNA, 17 bp, Homo sapiens
caggggtctccctggct

SEQ ID NO: 1653412 - DNA, 18 bp, Homo sapiens
caggggtctccctggctc

SEQ ID NO: 1653413 - DNA, 13 bp, Homo sapiens
caggggtgccccc

SEQ ID NO: 1653414 - DNA, 15 bp, Homo sapiens
caggggtgccccctc

SEQ ID NO: 1653415 - DNA, 22 bp, Homo sapiens
caggggtgggggtggaggcttc

SEQ ID NO: 1653416 - DNA, 18 bp, Homo sapiens
caggggttagcctggact

SEQ ID NO: 1653417 - DNA, 19 bp, Homo sapiens
caggggttcttgagccagc

SEQ ID NO: 1653418 - DNA, 17 bp, Homo sapiens
caggggttggtcaaggc

SEQ ID NO: 1653419 - DNA, 18 bp, Homo sapiens
caggggttggtcaaggcc

SEQ ID NO: 1653420 - DNA, 21 bp, Homo sapiens
caggggttggtcaaggccacc

SEQ ID NO: 1653421 - DNA, 23 bp, Homo sapiens
cagggtacccgcctgagctcctg

SEQ ID NO: 1653422 - DNA, 14 bp, Homo sapiens
cagggtacctcaag

SEQ ID NO: 1653423 - DNA, 19 bp, Homo sapiens
cagggtacctcaagcccca

SEQ ID NO: 1653424 - DNA, 22 bp, Homo sapiens
cagggtagaattgtttggcaat

SEQ ID NO: 1653425 - DNA, 23 bp, Homo sapiens
cagggtagaattgtttggcaatg

SEQ ID NO: 1653426 - DNA, 24 bp, Homo sapiens
cagggtagacttggagctgtcctc

SEQ ID NO: 1653427 - DNA, 23 bp, Homo sapiens
cagggtagataacctgtacttca

SEQ ID NO: 1653428 - DNA, 13 bp, Homo sapiens
cagggtagcaggt

SEQ ID NO: 1653429 - DNA, 15 bp, Homo sapiens
cagggtataaattat

SEQ ID NO: 1653430 - DNA, 13 bp, Homo sapiens
cagggtcaagcct

SEQ ID NO: 1653431 - DNA, 15 bp, Homo sapiens
cagggtcaggcggag

SEQ ID NO: 1653432 - DNA, 14 bp, Homo sapiens
cagggtccacagct

SEQ ID NO: 1653433 - DNA, 15 bp, Homo sapiens
cagggtccacagctg

SEQ ID NO: 1653434 - DNA, 16 bp, Homo sapiens
cagggtccacagctgg

SEQ ID NO: 1653435 - DNA, 19 bp, Homo sapiens
cagggtccccgagtgccta

SEQ ID NO: 1653436 - DNA, 20 bp, Homo sapiens
cagggtccccgagtgcctag

SEQ ID NO: 1653437 - DNA, 21 bp, Homo sapiens
cagggtccccgagtgcctagg

SEQ ID NO: 1653438 - DNA, 16 bp, Homo sapiens
cagggtccctctgtgt

SEQ ID NO: 1653439 - DNA, 15 bp, Homo sapiens
cagggtccgcaccag

SEQ ID NO: 1653440 - DNA, 16 bp, Homo sapiens
cagggtccgcaccagc

SEQ ID NO: 1653441 - DNA, 22 bp, Homo sapiens
cagggtccgcaccagctgctct

SEQ ID NO: 1653442 - DNA, 19 bp, Homo sapiens
cagggtccttttgacactg

SEQ ID NO: 1653443 - DNA, 13 bp, Homo sapiens
cagggtctgctct

SEQ ID NO: 1653444 - DNA, 14 bp, Homo sapiens
cagggtctgctctt

SEQ ID NO: 1653445 - DNA, 23 bp, Homo sapiens
cagggtctgctctttctctgcca

SEQ ID NO: 1653446 - DNA, 22 bp, Homo sapiens
cagggtcttccctacctcaggc

SEQ ID NO: 1653447 - DNA, 17 bp, Homo sapiens
cagggtcttgggctact

SEQ ID NO: 1653448 - DNA, 23 bp, Homo sapiens
cagggtcttgggctactggcagc

SEQ ID NO: 1653449 - DNA, 22 bp, Homo sapiens
cagggtgagcagggtcaagcct

SEQ ID NO: 1653450 - DNA, 17 bp, Homo sapiens
cagggtgcaggagcgcc

SEQ ID NO: 1653451 - DNA, 21 bp, Homo sapiens
cagggtgctaaagccaaccag

SEQ ID NO: 1653452 - DNA, 17 bp, Homo sapiens
cagggtggacttcagtg

SEQ ID NO: 1653453 - DNA, 17 bp, Homo sapiens
cagggtgggaagaaaga

SEQ ID NO: 1653454 - DNA, 17 bp, Homo sapiens
cagggtgggaagagaag

SEQ ID NO: 1653455 - DNA, 23 bp, Homo sapiens
cagggtgggcctcggcccctccc

SEQ ID NO: 1653456 - DNA, 13 bp, Homo sapiens
cagggtggggggt

SEQ ID NO: 1653457 - DNA, 16 bp, Homo sapiens
cagggtggggggtgac

SEQ ID NO: 1653458 - DNA, 20 bp, Homo sapiens
cagggtggggggtgacagtg

SEQ ID NO: 1653459 - DNA, 18 bp, Homo sapiens
cagggtggtgctgggact

SEQ ID NO: 1653460 - DNA, 15 bp, Homo sapiens
cagggtgtggtatga

SEQ ID NO: 1653461 - DNA, 12 bp, Homo sapiens
cagggtgtgtct

SEQ ID NO: 1653462 - DNA, 14 bp, Homo sapiens
cagggtttaataga

SEQ ID NO: 1653463 - DNA, 12 bp, Homo sapiens
caggtaactttc

SEQ ID NO: 1653464 - DNA, 18 bp, Homo sapiens
caggtaatatacctggtt

SEQ ID NO: 1653465 - DNA, 23 bp, Homo sapiens
caggtacagcaacaggaatctca

SEQ ID NO: 1653466 - DNA, 13 bp, Homo sapiens
caggtaccgtgct

SEQ ID NO: 1653467 - DNA, 19 bp, Homo sapiens
caggtacttcctcctgatg

SEQ ID NO: 1653468 - DNA, 20 bp, Homo sapiens
caggtacttcctcctgatgg

SEQ ID NO: 1653469 - DNA, 23 bp, Homo sapiens
caggtacttcctcctgatggcca

SEQ ID NO: 1653470 - DNA, 19 bp, Homo sapiens
caggtagatcgcttgagcc

SEQ ID NO: 1653471 - DNA, 23 bp, Homo sapiens
caggtagatcgcttgagcccagg

SEQ ID NO: 1653472 - DNA, 14 bp, Homo sapiens
caggtaggcccttg

SEQ ID NO: 1653473 - DNA, 19 bp, Homo sapiens
caggtaggcccttgtcctg

SEQ ID NO: 1653474 - DNA, 20 bp, Homo sapiens
caggtaggcccttgtcctgc

SEQ ID NO: 1653475 - DNA, 22 bp, Homo sapiens
caggtagtattacaccaccggc

SEQ ID NO: 1653476 - DNA, 18 bp, Homo sapiens
caggtagttgcaattgaa

SEQ ID NO: 1653477 - DNA, 15 bp, Homo sapiens
caggtatatactttg

SEQ ID NO: 1653478 - DNA, 13 bp, Homo sapiens
caggtatcaaatc

SEQ ID NO: 1653479 - DNA, 23 bp, Homo sapiens
caggtatggaagggtttgtggct

SEQ ID NO: 1653480 - DNA, 16 bp, Homo sapiens
caggtatgttgccttt

SEQ ID NO: 1653481 - DNA, 20 bp, Homo sapiens
caggtatttttttaaatcaa

SEQ ID NO: 1653482 - DNA, 22 bp, Homo sapiens
caggtcaataaacttagaggaa

SEQ ID NO: 1653483 - DNA, 17 bp, Homo sapiens
caggtcacccatcagga

SEQ ID NO: 1653484 - DNA, 18 bp, Homo sapiens
caggtcacccatcaggac

SEQ ID NO: 1653485 - DNA, 13 bp, Homo sapiens
caggtcactgtca

SEQ ID NO: 1653486 - DNA, 18 bp, Homo sapiens
caggtcactgtcactgcc

SEQ ID NO: 1653487 - DNA, 14 bp, Homo sapiens
caggtcagcctgga

SEQ ID NO: 1653488 - DNA, 17 bp, Homo sapiens
caggtcagcctggaagg

SEQ ID NO: 1653489 - DNA, 20 bp, Homo sapiens
caggtcatattaatatattt

SEQ ID NO: 1653490 - DNA, 21 bp, Homo sapiens
caggtcatattaatatatttc

SEQ ID NO: 1653491 - DNA, 20 bp, Homo sapiens
caggtcatgcagttcctggc

SEQ ID NO: 1653492 - DNA, 15 bp, Homo sapiens
caggtccagatgtgc

SEQ ID NO: 1653493 - DNA, 15 bp, Homo sapiens
caggtcccccgactg

SEQ ID NO: 1653494 - DNA, 19 bp, Homo sapiens
caggtcccccgactgcctg

SEQ ID NO: 1653495 - DNA, 22 bp, Homo sapiens
caggtccctggaccagcctcct

SEQ ID NO: 1653496 - DNA, 21 bp, Homo sapiens
caggtcctgctccgctgcctg

SEQ ID NO: 1653497 - DNA, 18 bp, Homo sapiens
caggtcctggtgggtcag

SEQ ID NO: 1653498 - DNA, 22 bp, Homo sapiens
caggtccttcctttaggtctgg

SEQ ID NO: 1653499 - DNA, 16 bp, Homo sapiens
caggtcgggcagtgga

SEQ ID NO: 1653500 - DNA, 16 bp, Homo sapiens
caggtctcactgcttt

SEQ ID NO: 1653501 - DNA, 14 bp, Homo sapiens
caggtctcctctta

SEQ ID NO: 1653502 - DNA, 22 bp, Homo sapiens
caggtctcctcttaaaaaataa

SEQ ID NO: 1653503 - DNA, 20 bp, Homo sapiens
caggtctctccactgctctc

SEQ ID NO: 1653504 - DNA, 22 bp, Homo sapiens
caggtctctccactgctctcag

SEQ ID NO: 1653505 - DNA, 17 bp, Homo sapiens
caggtctcttctgggcg

SEQ ID NO: 1653506 - DNA, 13 bp, Homo sapiens
caggtctgcaagg

SEQ ID NO: 1653507 - DNA, 14 bp, Homo sapiens
caggtctgcaaggg

SEQ ID NO: 1653508 - DNA, 23 bp, Homo sapiens
caggtctgcaagggcccagagtg

SEQ ID NO: 1653509 - DNA, 23 bp, Homo sapiens
caggtcttgactcatggcagctg

SEQ ID NO: 1653510 - DNA, 18 bp, Homo sapiens
caggtgactgtgctgtgc

SEQ ID NO: 1653511 - DNA, 19 bp, Homo sapiens
caggtgagaagtgagggag

SEQ ID NO: 1653512 - DNA, 19 bp, Homo sapiens
caggtgagcaggcagggct

SEQ ID NO: 1653513 - DNA, 17 bp, Homo sapiens
caggtgatcaaaataaa

SEQ ID NO: 1653514 - DNA, 22 bp, Homo sapiens
caggtgatctgtttgaggagag

SEQ ID NO: 1653515 - DNA, 21 bp, Homo sapiens
caggtgcagaccttgggggaa

SEQ ID NO: 1653516 - DNA, 23 bp, Homo sapiens
caggtgcagaggtaccctgggtg

SEQ ID NO: 1653517 - DNA, 17 bp, Homo sapiens
caggtgcagatgggctg

SEQ ID NO: 1653518 - DNA, 19 bp, Homo sapiens
caggtgccactccctgagc

SEQ ID NO: 1653519 - DNA, 19 bp, Homo sapiens
caggtgccagttatggcta

SEQ ID NO: 1653520 - DNA, 17 bp, Homo sapiens
caggtgccgccagctgc

SEQ ID NO: 1653521 - DNA, 23 bp, Homo sapiens
cagtctcagagaccagcactcag

SEQ ID NO: 1653522 - DNA, 18 bp, Homo sapiens
cagtctcagctgctgaaa

SEQ ID NO: 1653523 - DNA, 19 bp, Homo sapiens
cagtctcagctgctgaaat

SEQ ID NO: 1653524 - DNA, 22 bp, Homo sapiens
cagtctcattacagatttagtt

SEQ ID NO: 1653525 - DNA, 14 bp, Homo sapiens
cagtctcctctcca

SEQ ID NO: 1653526 - DNA, 18 bp, Homo sapiens
cagtctcctctccatttt

SEQ ID NO: 1653527 - DNA, 19 bp, Homo sapiens
cagtctctataccaataaa

SEQ ID NO: 1653528 - DNA, 23 bp, Homo sapiens
cagtctctataccaataaagtga

SEQ ID NO: 1653529 - DNA, 22 bp, Homo sapiens
cagtctgaacccttgtgcttgg

SEQ ID NO: 1653530 - DNA, 16 bp, Homo sapiens
cagtctgaatgctgcc

SEQ ID NO: 1653531 - DNA, 20 bp, Homo sapiens
cagtctgaatgctgccacaa

SEQ ID NO: 1653532 - DNA, 12 bp, Homo sapiens
cagtctgctcca

SEQ ID NO: 1653533 - DNA, 13 bp, Homo sapiens
cagtctgctccac

SEQ ID NO: 1653534 - DNA, 16 bp, Homo sapiens
cagtctgctccaccaa

SEQ ID NO: 1653535 - DNA, 24 bp, Homo sapiens
cagtctgtcatgaacatgttcctg

SEQ ID NO: 1653536 - DNA, 16 bp, Homo sapiens
cagtctgtctactgtg

SEQ ID NO: 1653537 - DNA, 20 bp, Homo sapiens
cagtctgtgatccttggtgc

SEQ ID NO: 1653538 - DNA, 15 bp, Homo sapiens
cagtctgtggatcag

SEQ ID NO: 1653539 - DNA, 14 bp, Homo sapiens
cagtctgttatgca

SEQ ID NO: 1653540 - DNA, 23 bp, Homo sapiens
cagtcttcctcttagcctctgga

SEQ ID NO: 1653541 - DNA, 22 bp, Homo sapiens
cagtcttctctctggctcaggt

SEQ ID NO: 1653542 - DNA, 13 bp, Homo sapiens
cagtcttctggat

SEQ ID NO: 1653543 - DNA, 15 bp, Homo sapiens
cagtcttgaatttct

SEQ ID NO: 1653544 - DNA, 17 bp, Homo sapiens
cagtcttgcctaggcca

SEQ ID NO: 1653545 - DNA, 11 bp, Homo sapiens
cagtcttgctc

SEQ ID NO: 1653546 - DNA, 11 bp, Homo sapiens
cagtcttggtg

SEQ ID NO: 1653547 - DNA, 22 bp, Homo sapiens
cagtctttaatctgagaggcca

SEQ ID NO: 1653548 - DNA, 20 bp, Homo sapiens
cagtctttgctcagtggatc

SEQ ID NO: 1653549 - DNA, 22 bp, Homo sapiens
cagtgaaaagagagaagggaga

SEQ ID NO: 1653550 - DNA, 22 bp, Homo sapiens
cagtgaaattttggtgaatgtg

SEQ ID NO: 1653551 - DNA, 18 bp, Homo sapiens
cagtgaagagtaagtttt

SEQ ID NO: 1653552 - DNA, 20 bp, Homo sapiens
cagtgaagatattttatttc

SEQ ID NO: 1653553 - DNA, 16 bp, Homo sapiens
cagtgaagatgctgta

SEQ ID NO: 1653554 - DNA, 20 bp, Homo sapiens
cagtgaagatgctgtaaata

SEQ ID NO: 1653555 - DNA, 19 bp, Homo sapiens
cagtgaagtagcctcttgt

SEQ ID NO: 1653556 - DNA, 22 bp, Homo sapiens
cagtgaagtagcctcttgtgta

SEQ ID NO: 1653557 - DNA, 15 bp, Homo sapiens
cagtgaatccctggg

SEQ ID NO: 1653558 - DNA, 12 bp, Homo sapiens
cagtgaattctt

SEQ ID NO: 1653559 - DNA, 14 bp, Homo sapiens
cagtgaattgtctt

SEQ ID NO: 1653560 - DNA, 15 bp, Homo sapiens
cagtgaattgtcttt

SEQ ID NO: 1653561 - DNA, 16 bp, Homo sapiens
cagtgaattgtctttt

SEQ ID NO: 1653562 - DNA, 16 bp, Homo sapiens
cagtgacactggacca

SEQ ID NO: 1653563 - DNA, 15 bp, Homo sapiens
cagtgacagacaggc

SEQ ID NO: 1653564 - DNA, 16 bp, Homo sapiens
cagtgacagacaggct

SEQ ID NO: 1653565 - DNA, 18 bp, Homo sapiens
cagtgacagagttcacta

SEQ ID NO: 1653566 - DNA, 22 bp, Homo sapiens
cagtgacatcaaagcctggcct

SEQ ID NO: 1653567 - DNA, 18 bp, Homo sapiens
cagtgacgtgcacctgta

SEQ ID NO: 1653568 - DNA, 22 bp, Homo sapiens
cagtgacgtgcacctgtactca

SEQ ID NO: 1653569 - DNA, 19 bp, Homo sapiens
cagtgactcctgctggtac

SEQ ID NO: 1653570 - DNA, 22 bp, Homo sapiens
cagtgactcctgctggtacctg

SEQ ID NO: 1653571 - DNA, 14 bp, Homo sapiens
cagtgactgaaacc

SEQ ID NO: 1653572 - DNA, 13 bp, Homo sapiens
cagtgacttctga

SEQ ID NO: 1653573 - DNA, 18 bp, Homo sapiens
cagtgactttacaggagg

SEQ ID NO: 1653574 - DNA, 21 bp, Homo sapiens
cagtgagatagaatacatgta

SEQ ID NO: 1653575 - DNA, 13 bp, Homo sapiens
cagtgagccaaga

SEQ ID NO: 1653576 - DNA, 13 bp, Homo sapiens
cagtgagctgtgt

SEQ ID NO: 1653577 - DNA, 12 bp, Homo sapiens
cagtgaggaggg

SEQ ID NO: 1653578 - DNA, 21 bp, Homo sapiens
cagtgaggctgtaaagtggcc

SEQ ID NO: 1653579 - DNA, 18 bp, Homo sapiens
cagtgatacgtacagcca

SEQ ID NO: 1653580 - DNA, 18 bp, Homo sapiens
cagtgatctcagggcaga

SEQ ID NO: 1653581 - DNA, 15 bp, Homo sapiens
cagtgatctccatat

SEQ ID NO: 1653582 - DNA, 16 bp, Homo sapiens
cagtgatctccatatg

SEQ ID NO: 1653583 - DNA, 21 bp, Homo sapiens
cagtgatctccatatgttaca

SEQ ID NO: 1653584 - DNA, 22 bp, Homo sapiens
cagtgatgacttgctgtccagg

SEQ ID NO: 1653585 - DNA, 24 bp, Homo sapiens
cagtgatgcctgcccgcaccctgg

SEQ ID NO: 1653586 - DNA, 22 bp, Homo sapiens
cagtgatggcgcgggaggcacc

SEQ ID NO: 1653587 - DNA, 17 bp, Homo sapiens
cagtgattttcaaacct

SEQ ID NO: 1653588 - DNA, 15 bp, Homo sapiens
cagtgcaaaccactt

SEQ ID NO: 1653589 - DNA, 13 bp, Homo sapiens
cagtgcaaatgca

SEQ ID NO: 1653590 - DNA, 22 bp, Homo sapiens
cagtgcactccggcctgggtga

SEQ ID NO: 1653591 - DNA, 20 bp, Homo sapiens
cagtgcagagccttctcaga

SEQ ID NO: 1653592 - DNA, 14 bp, Homo sapiens
cagtgcagatggag

SEQ ID NO: 1653593 - DNA, 16 bp, Homo sapiens
cagtgcagcagaggac

SEQ ID NO: 1653594 - DNA, 12 bp, Homo sapiens
cagtgcagccac

SEQ ID NO: 1653595 - DNA, 22 bp, Homo sapiens
cagtgcagtttcttttcacatt

SEQ ID NO: 1653596 - DNA, 22 bp, Homo sapiens
cagtgcatagttgtagacaaag

SEQ ID NO: 1653597 - DNA, 17 bp, Homo sapiens
cagtgcatggtggccag

SEQ ID NO: 1653598 - DNA, 20 bp, Homo sapiens
cagtgcatggtggccagagg

SEQ ID NO: 1653599 - DNA, 19 bp, Homo sapiens
cagtgcatgtgaagcatgc

SEQ ID NO: 1653600 - DNA, 17 bp, Homo sapiens
cagtgcatttcaaggaa

SEQ ID NO: 1653601 - DNA, 17 bp, Homo sapiens
cagtgcattttgtttct

SEQ ID NO: 1653602 - DNA, 19 bp, Homo sapiens
cagtgccaagcacagtgcc

SEQ ID NO: 1653603 - DNA, 23 bp, Homo sapiens
cagtgccaagcacagtgcctgca

SEQ ID NO: 1653604 - DNA, 14 bp, Homo sapiens
cagtgccacccatg

SEQ ID NO: 1653605 - DNA, 16 bp, Homo sapiens
cagtgccagctccctc

SEQ ID NO: 1653606 - DNA, 15 bp, Homo sapiens
cagtgccaggaaaga

SEQ ID NO: 1653607 - DNA, 14 bp, Homo sapiens
cagtgcccatgcaa

SEQ ID NO: 1653608 - DNA, 17 bp, Homo sapiens
cagtgcccatgtgtaca

SEQ ID NO: 1653609 - DNA, 23 bp, Homo sapiens
cagtgcccatgtgtacattctgc

SEQ ID NO: 1653610 - DNA, 15 bp, Homo sapiens
cagtgcccccactga

SEQ ID NO: 1653611 - DNA, 17 bp, Homo sapiens
cagtgcccccactgacc

SEQ ID NO: 1653612 - DNA, 15 bp, Homo sapiens
cagtgcctaaaataa

SEQ ID NO: 1653613 - DNA, 15 bp, Homo sapiens
cagtgcctcgaggca

SEQ ID NO: 1653614 - DNA, 17 bp, Homo sapiens
cagtgcctcgaggcacc

SEQ ID NO: 1653615 - DNA, 18 bp, Homo sapiens
cagtgcctcgaggcaccg

SEQ ID NO: 1653616 - DNA, 19 bp, Homo sapiens
cagtgcctcgaggcaccgg

SEQ ID NO: 1653617 - DNA, 21 bp, Homo sapiens
cagtgcctcttccagtgaaca

SEQ ID NO: 1653618 - DNA, 11 bp, Homo sapiens
cagtgcctgcc

SEQ ID NO: 1653619 - DNA, 12 bp, Homo sapiens
cagtgcctgctg

SEQ ID NO: 1653620 - DNA, 20 bp, Homo sapiens
cagtgcctgggaatgtatta

SEQ ID NO: 1653621 - DNA, 19 bp, Homo sapiens
cagtgccttacctcctgcc

SEQ ID NO: 1653622 - DNA, 20 bp, Homo sapiens
cagtgccttacctcctgccc

SEQ ID NO: 1653623 - DNA, 21 bp, Homo sapiens
cagtgccttacctcctgccca

SEQ ID NO: 1653624 - DNA, 13 bp, Homo sapiens
cagtgccttcaac

SEQ ID NO: 1653625 - DNA, 16 bp, Homo sapiens
cagtgccttcaataaa

SEQ ID NO: 1653626 - DNA, 15 bp, Homo sapiens
cagtgccttccataa

SEQ ID NO: 1653627 - DNA, 16 bp, Homo sapiens
cagtgccttccataat

SEQ ID NO: 1653628 - DNA, 21 bp, Homo sapiens
cagtgccttggggaatttcct

SEQ ID NO: 1653629 - DNA, 17 bp, Homo sapiens
cagtgcggttcctcatc

SEQ ID NO: 1653630 - DNA, 18 bp, Homo sapiens
cagtgcggttcctcatct

SEQ ID NO: 1653631 - DNA, 13 bp, Homo sapiens
cagtgctactgaa

SEQ ID NO: 1653632 - DNA, 16 bp, Homo sapiens
cagtgctataaatgcc

SEQ ID NO: 1653633 - DNA, 21 bp, Homo sapiens
cagtgctataaatgccagagc

SEQ ID NO: 1653634 - DNA, 18 bp, Homo sapiens
cagtgctcagctgtggct

SEQ ID NO: 1653635 - DNA, 15 bp, Homo sapiens
cataaaaacaacttt

SEQ ID NO: 1653636 - DNA, 17 bp, Homo sapiens
cataaaaacaactttat

SEQ ID NO: 1653637 - DNA, 21 bp, Homo sapiens
cataaaaacaactttataccc

SEQ ID NO: 1653638 - DNA, 19 bp, Homo sapiens
cataaaaacattttaaaaa

SEQ ID NO: 1653639 - DNA, 14 bp, Homo sapiens
cataaaaagcagaa

SEQ ID NO: 1653640 - DNA, 17 bp, Homo sapiens
cataaaaagcagaattt

SEQ ID NO: 1653641 - DNA, 18 bp, Homo sapiens
cataaaaagcagaatttt

SEQ ID NO: 1653642 - DNA, 23 bp, Homo sapiens
cataaaaagcctgcaatttcata

SEQ ID NO: 1653643 - DNA, 13 bp, Homo sapiens
cataaaaataacc

SEQ ID NO: 1653644 - DNA, 21 bp, Homo sapiens
cataaaaataaccaaaaaatg

SEQ ID NO: 1653645 - DNA, 15 bp, Homo sapiens
cataaaactttggca

SEQ ID NO: 1653646 - DNA, 21 bp, Homo sapiens
cataaaagatcaccttgtatt

SEQ ID NO: 1653647 - DNA, 14 bp, Homo sapiens
cataaaagccccag

SEQ ID NO: 1653648 - DNA, 17 bp, Homo sapiens
cataaaagccccagctt

SEQ ID NO: 1653649 - DNA, 19 bp, Homo sapiens
cataaaataaggagcatat

SEQ ID NO: 1653650 - DNA, 21 bp, Homo sapiens
cataaaatagaataattcttt

SEQ ID NO: 1653651 - DNA, 12 bp, Homo sapiens
cataaaatctgt

SEQ ID NO: 1653652 - DNA, 13 bp, Homo sapiens
cataaaatttaca

SEQ ID NO: 1653653 - DNA, 16 bp, Homo sapiens
cataaacagcacacct

SEQ ID NO: 1653654 - DNA, 20 bp, Homo sapiens
cataaacagcacacctgtgt

SEQ ID NO: 1653655 - DNA, 20 bp, Homo sapiens
cataaagaattaatgactta

SEQ ID NO: 1653656 - DNA, 17 bp, Homo sapiens
cataaagacaatcactg

SEQ ID NO: 1653657 - DNA, 18 bp, Homo sapiens
cataaagacaatcactgc

SEQ ID NO: 1653658 - DNA, 20 bp, Homo sapiens
cataaagctcaaatgaaatg

SEQ ID NO: 1653659 - DNA, 16 bp, Homo sapiens
cataaagtacaaatga

SEQ ID NO: 1653660 - DNA, 20 bp, Homo sapiens
cataaataaaggtgtagaaa

SEQ ID NO: 1653661 - DNA, 15 bp, Homo sapiens
cataaatacaaaaat

SEQ ID NO: 1653662 - DNA, 16 bp, Homo sapiens
cataaatacaaaaatg

SEQ ID NO: 1653663 - DNA, 11 bp, Homo sapiens
cataaatcaac

SEQ ID NO: 1653664 - DNA, 21 bp, Homo sapiens
cataaattactgttttgccaa

SEQ ID NO: 1653665 - DNA, 18 bp, Homo sapiens
cataaattcaactttgta

SEQ ID NO: 1653666 - DNA, 13 bp, Homo sapiens
cataacaaagggc

SEQ ID NO: 1653667 - DNA, 15 bp, Homo sapiens
cataacagcgtttat

SEQ ID NO: 1653668 - DNA, 15 bp, Homo sapiens
cataacatccagagc

SEQ ID NO: 1653669 - DNA, 21 bp, Homo sapiens
cataacggttaagaaagcact

SEQ ID NO: 1653670 - DNA, 23 bp, Homo sapiens
cataacggttaagaaagcactta

SEQ ID NO: 1653671 - DNA, 16 bp, Homo sapiens
cataactaaaattaag

SEQ ID NO: 1653672 - DNA, 21 bp, Homo sapiens
cataactatctttttgaaagc

SEQ ID NO: 1653673 - DNA, 20 bp, Homo sapiens
cataactgcttcttggagct

SEQ ID NO: 1653674 - DNA, 22 bp, Homo sapiens
cataactggcttctgcttgtca

SEQ ID NO: 1653675 - DNA, 13 bp, Homo sapiens
cataacttcctgt

SEQ ID NO: 1653676 - DNA, 14 bp, Homo sapiens
cataacttcctgta

SEQ ID NO: 1653677 - DNA, 23 bp, Homo sapiens
cataacttcctgtacttgaagtc

SEQ ID NO: 1653678 - DNA, 14 bp, Homo sapiens
cataagaaggcaat

SEQ ID NO: 1653679 - DNA, 21 bp, Homo sapiens
cataagaatgaataataatta

SEQ ID NO: 1653680 - DNA, 13 bp, Homo sapiens
cataagacaaaca

SEQ ID NO: 1653681 - DNA, 17 bp, Homo sapiens
cataagacaaacactgc

SEQ ID NO: 1653682 - DNA, 17 bp, Homo sapiens
cataagaccgtgtccca

SEQ ID NO: 1653683 - DNA, 22 bp, Homo sapiens
cataagaggagtaggccctggt

SEQ ID NO: 1653684 - DNA, 15 bp, Homo sapiens
cataagattaaagga

SEQ ID NO: 1653685 - DNA, 16 bp, Homo sapiens
cataagattaaaggaa

SEQ ID NO: 1653686 - DNA, 21 bp, Homo sapiens
cataagattaaaggaaggaaa

SEQ ID NO: 1653687 - DNA, 16 bp, Homo sapiens
cataagcattacttta

SEQ ID NO: 1653688 - DNA, 22 bp, Homo sapiens
cataaggaatgtagctggtttc

SEQ ID NO: 1653689 - DNA, 18 bp, Homo sapiens
cataaggatgactttttt

SEQ ID NO: 1653690 - DNA, 22 bp, Homo sapiens
cataagtaattcaagaaaacaa

SEQ ID NO: 1653691 - DNA, 17 bp, Homo sapiens
cataagtatttggaatt

SEQ ID NO: 1653692 - DNA, 21 bp, Homo sapiens
cataagtgacaccaataaatg

SEQ ID NO: 1653693 - DNA, 23 bp, Homo sapiens
cataagttggaccagaggaagcc

SEQ ID NO: 1653694 - DNA, 17 bp, Homo sapiens
cataagtttgtttaaac

SEQ ID NO: 1653695 - DNA, 21 bp, Homo sapiens
cataataaaaaattatgacaa

SEQ ID NO: 1653696 - DNA, 20 bp, Homo sapiens
cataatatatgacttcctag

SEQ ID NO: 1653697 - DNA, 23 bp, Homo sapiens
cataatatttttcaattttgaaa

SEQ ID NO: 1653698 - DNA, 18 bp, Homo sapiens
cataatcacaacccttca

SEQ ID NO: 1653699 - DNA, 16 bp, Homo sapiens
cataatcactctaatt

SEQ ID NO: 1653700 - DNA, 14 bp, Homo sapiens
cataatcagtaaat

SEQ ID NO: 1653701 - DNA, 15 bp, Homo sapiens
cataatcttctgcct

SEQ ID NO: 1653702 - DNA, 22 bp, Homo sapiens
cataatcttctgccttctcatg

SEQ ID NO: 1653703 - DNA, 18 bp, Homo sapiens
cataatgcagaagtattc

SEQ ID NO: 1653704 - DNA, 22 bp, Homo sapiens
cataatgctaatttaaagagac

SEQ ID NO: 1653705 - DNA, 19 bp, Homo sapiens
cataatgctcccatctcct

SEQ ID NO: 1653706 - DNA, 20 bp, Homo sapiens
cataatgtactgatttcagt

SEQ ID NO: 1653707 - DNA, 15 bp, Homo sapiens
cataatgtataaaga

SEQ ID NO: 1653708 - DNA, 14 bp, Homo sapiens
cataatgtattgtt

SEQ ID NO: 1653709 - DNA, 22 bp, Homo sapiens
cataatgtccctctcttggcta

SEQ ID NO: 1653710 - DNA, 18 bp, Homo sapiens
cataatgttacattatta

SEQ ID NO: 1653711 - DNA, 21 bp, Homo sapiens
cataatgtttctggatttcat

SEQ ID NO: 1653712 - DNA, 22 bp, Homo sapiens
cataatgtttctggatttcata

SEQ ID NO: 1653713 - DNA, 18 bp, Homo sapiens
cataattaaattttaatg

SEQ ID NO: 1653714 - DNA, 19 bp, Homo sapiens
cataattacattcctaact

SEQ ID NO: 1653715 - DNA, 20 bp, Homo sapiens
cataattacattcctaacta

SEQ ID NO: 1653716 - DNA, 15 bp, Homo sapiens
cataattatgacagt

SEQ ID NO: 1653717 - DNA, 22 bp, Homo sapiens
cataattctaagttatttactt

SEQ ID NO: 1653718 - DNA, 17 bp, Homo sapiens
cataattcttgtatatt

SEQ ID NO: 1653719 - DNA, 18 bp, Homo sapiens
cataattcttgtatatta

SEQ ID NO: 1653720 - DNA, 14 bp, Homo sapiens
cataattgtgacca

SEQ ID NO: 1653721 - DNA, 17 bp, Homo sapiens
cataattgtggattata

SEQ ID NO: 1653722 - DNA, 15 bp, Homo sapiens
cataatttgtacata

SEQ ID NO: 1653723 - DNA, 20 bp, Homo sapiens
cataattttcttcatgcaat

SEQ ID NO: 1653724 - DNA, 16 bp, Homo sapiens
catacaacacaaagag

SEQ ID NO: 1653725 - DNA, 22 bp, Homo sapiens
catacaagaaaatgtatccaag

SEQ ID NO: 1653726 - DNA, 21 bp, Homo sapiens
catacaatcgtcttaagtttt

SEQ ID NO: 1653727 - DNA, 13 bp, Homo sapiens
catacaatgtatg

SEQ ID NO: 1653728 - DNA, 14 bp, Homo sapiens
catacaatgtatgt

SEQ ID NO: 1653729 - DNA, 20 bp, Homo sapiens
catacaatgtatgtacaata

SEQ ID NO: 1653730 - DNA, 19 bp, Homo sapiens
catacacctcgtcaagagc

SEQ ID NO: 1653731 - DNA, 18 bp, Homo sapiens
catacacgcaaatacact

SEQ ID NO: 1653732 - DNA, 23 bp, Homo sapiens
catacacttattggaactctgct

SEQ ID NO: 1653733 - DNA, 20 bp, Homo sapiens
catacactttgttgcaagat

SEQ ID NO: 1653734 - DNA, 18 bp, Homo sapiens
catacagaggatgccttt

SEQ ID NO: 1653735 - DNA, 19 bp, Homo sapiens
catacagaggatgcctttt

SEQ ID NO: 1653736 - DNA, 18 bp, Homo sapiens
catacagcattacaaatt

SEQ ID NO: 1653737 - DNA, 13 bp, Homo sapiens
catacagcctcta

SEQ ID NO: 1653738 - DNA, 14 bp, Homo sapiens
catacagctgccta

SEQ ID NO: 1653739 - DNA, 23 bp, Homo sapiens
catacaggaaggtagaaatatct

SEQ ID NO: 1653740 - DNA, 13 bp, Homo sapiens
catacagttttct

SEQ ID NO: 1653741 - DNA, 23 bp, Homo sapiens
catacatttataatgtttgctat

SEQ ID NO: 1653742 - DNA, 24 bp, Homo sapiens
catacatttataatgtttgctatt

SEQ ID NO: 1653743 - DNA, 17 bp, Homo sapiens
cataccaacacgagcag

SEQ ID NO: 1653744 - DNA, 13 bp, Homo sapiens
cataccagttgtt

SEQ ID NO: 1653745 - DNA, 15 bp, Homo sapiens
catacccgtgacagt

SEQ ID NO: 1653746 - DNA, 20 bp, Homo sapiens
cataccgcctcgtgccagca

SEQ ID NO: 1653747 - DNA, 14 bp, Homo sapiens
catacctaccagta

SEQ ID NO: 1653748 - DNA, 13 bp, Homo sapiens
cataccttccttc

SEQ ID NO: 1653749 - DNA, 13 bp, Homo sapiens
catccccctgccc

SEQ ID NO: 1653750 - DNA, 19 bp, Homo sapiens
catccccctgccctcgtgg

SEQ ID NO: 1653751 - DNA, 18 bp, Homo sapiens
catccccgtccatgctca

SEQ ID NO: 1653752 - DNA, 19 bp, Homo sapiens
catcccctcgtcctgtccc

SEQ ID NO: 1653753 - DNA, 21 bp, Homo sapiens
catcccgaagccatcacttct

SEQ ID NO: 1653754 - DNA, 19 bp, Homo sapiens
catcccgcgcgcccttcct

SEQ ID NO: 1653755 - DNA, 22 bp, Homo sapiens
catccctcaactgagggccagg

SEQ ID NO: 1653756 - DNA, 13 bp, Homo sapiens
catccctcaccca

SEQ ID NO: 1653757 - DNA, 14 bp, Homo sapiens
catccctcacccat

SEQ ID NO: 1653758 - DNA, 14 bp, Homo sapiens
catccctccattca

SEQ ID NO: 1653759 - DNA, 16 bp, Homo sapiens
catccctcccccagca

SEQ ID NO: 1653760 - DNA, 23 bp, Homo sapiens
catccctgagacagggagggaag

SEQ ID NO: 1653761 - DNA, 18 bp, Homo sapiens
catccctgaggagccagg

SEQ ID NO: 1653762 - DNA, 19 bp, Homo sapiens
catccctggagcaggagcc

SEQ ID NO: 1653763 - DNA, 19 bp, Homo sapiens
catccctgtgtccactgag

SEQ ID NO: 1653764 - DNA, 20 bp, Homo sapiens
catccctgtgtccactgaga

SEQ ID NO: 1653765 - DNA, 21 bp, Homo sapiens
catccctgtgtccactgagac

SEQ ID NO: 1653766 - DNA, 19 bp, Homo sapiens
catcccttcctggaaacag

SEQ ID NO: 1653767 - DNA, 20 bp, Homo sapiens
catcccttcctggaaacagc

SEQ ID NO: 1653768 - DNA, 16 bp, Homo sapiens
catccgaggcagggtc

SEQ ID NO: 1653769 - DNA, 23 bp, Homo sapiens
catccgaggcagggtcaggagag

SEQ ID NO: 1653770 - DNA, 13 bp, Homo sapiens
catccgcaggtgc

SEQ ID NO: 1653771 - DNA, 20 bp, Homo sapiens
catccgcaggtgctggtccc

SEQ ID NO: 1653772 - DNA, 16 bp, Homo sapiens
catccgcgtgtgcctg

SEQ ID NO: 1653773 - DNA, 21 bp, Homo sapiens
catccgtagttccctgaaaac

SEQ ID NO: 1653774 - DNA, 19 bp, Homo sapiens
catccgtcattgctgctgc

SEQ ID NO: 1653775 - DNA, 21 bp, Homo sapiens
catcctacaactcacattaga

SEQ ID NO: 1653776 - DNA, 21 bp, Homo sapiens
catcctaccctcgggcccacc

SEQ ID NO: 1653777 - DNA, 18 bp, Homo sapiens
catcctagggtgttttaa

SEQ ID NO: 1653778 - DNA, 15 bp, Homo sapiens
catcctagtgggcac

SEQ ID NO: 1653779 - DNA, 22 bp, Homo sapiens
catcctcaaagaaagtgtattg

SEQ ID NO: 1653780 - DNA, 13 bp, Homo sapiens
catcctcatccct

SEQ ID NO: 1653781 - DNA, 15 bp, Homo sapiens
catcctcatccctga

SEQ ID NO: 1653782 - DNA, 16 bp, Homo sapiens
catcctcatccctgac

SEQ ID NO: 1653783 - DNA, 18 bp, Homo sapiens
catcctcattgcctcctg

SEQ ID NO: 1653784 - DNA, 23 bp, Homo sapiens
catcctcattgcctcctgttctg

SEQ ID NO: 1653785 - DNA, 19 bp, Homo sapiens
catcctccagtaccttgct

SEQ ID NO: 1653786 - DNA, 13 bp, Homo sapiens
catcctcccaagg

SEQ ID NO: 1653787 - DNA, 19 bp, Homo sapiens
catcctccgtccagccgcc

SEQ ID NO: 1653788 - DNA, 13 bp, Homo sapiens
catcctcctccca

SEQ ID NO: 1653789 - DNA, 16 bp, Homo sapiens
catcctcctcccaccc

SEQ ID NO: 1653790 - DNA, 20 bp, Homo sapiens
catcctcctcccacccggct

SEQ ID NO: 1653791 - DNA, 15 bp, Homo sapiens
catcctcctccccag

SEQ ID NO: 1653792 - DNA, 23 bp, Homo sapiens
catcctcctcctggactcccctc

SEQ ID NO: 1653793 - DNA, 17 bp, Homo sapiens
catcctctaaagcagag

SEQ ID NO: 1653794 - DNA, 20 bp, Homo sapiens
catcctctaaagcagaggca

SEQ ID NO: 1653795 - DNA, 14 bp, Homo sapiens
catcctcttttaat

SEQ ID NO: 1653796 - DNA, 19 bp, Homo sapiens
catcctgatttttactatc

SEQ ID NO: 1653797 - DNA, 20 bp, Homo sapiens
catcctgctcttttgtgatg

SEQ ID NO: 1653798 - DNA, 12 bp, Homo sapiens
catcctggcccc

SEQ ID NO: 1653799 - DNA, 23 bp, Homo sapiens
catcctggcccctccagaccctg

SEQ ID NO: 1653800 - DNA, 13 bp, Homo sapiens
catcctggctgcg

SEQ ID NO: 1653801 - DNA, 18 bp, Homo sapiens
catcctgggatgtaaacc

SEQ ID NO: 1653802 - DNA, 18 bp, Homo sapiens
catcctggggcagcactc

SEQ ID NO: 1653803 - DNA, 21 bp, Homo sapiens
catcctgtgtttctagggaaa

SEQ ID NO: 1653804 - DNA, 19 bp, Homo sapiens
catcctgtttgtatgaaat

SEQ ID NO: 1653805 - DNA, 14 bp, Homo sapiens
catccttcaccaga

SEQ ID NO: 1653806 - DNA, 15 bp, Homo sapiens
catccttccatccat

SEQ ID NO: 1653807 - DNA, 21 bp, Homo sapiens
catccttccccaacttcccta

SEQ ID NO: 1653808 - DNA, 14 bp, Homo sapiens
catccttgtaatac

SEQ ID NO: 1653809 - DNA, 15 bp, Homo sapiens
catccttgtaatacc

SEQ ID NO: 1653810 - DNA, 14 bp, Homo sapiens
catccttgtctttt

SEQ ID NO: 1653811 - DNA, 18 bp, Homo sapiens
catcctttgttctgagca

SEQ ID NO: 1653812 - DNA, 19 bp, Homo sapiens
catcctttgttctgagcat

SEQ ID NO: 1653813 - DNA, 19 bp, Homo sapiens
catccttttctgcagaggg

SEQ ID NO: 1653814 - DNA, 15 bp, Homo sapiens
catcgaatgtgtaca

SEQ ID NO: 1653815 - DNA, 19 bp, Homo sapiens
catcgacttagcctgagtc

SEQ ID NO: 1653816 - DNA, 18 bp, Homo sapiens
catcgccatcttcttccc

SEQ ID NO: 1653817 - DNA, 15 bp, Homo sapiens
catcggaaaaataat

SEQ ID NO: 1653818 - DNA, 19 bp, Homo sapiens
catcgggagcacccagagc

SEQ ID NO: 1653819 - DNA, 13 bp, Homo sapiens
catcgggctgagg

SEQ ID NO: 1653820 - DNA, 15 bp, Homo sapiens
catcgtaggcagcca

SEQ ID NO: 1653821 - DNA, 16 bp, Homo sapiens
catcgtaggcagccac

SEQ ID NO: 1653822 - DNA, 19 bp, Homo sapiens
catcgtaggcagccacggc

SEQ ID NO: 1653823 - DNA, 15 bp, Homo sapiens
catcgtccttcctct

SEQ ID NO: 1653824 - DNA, 16 bp, Homo sapiens
catcgtccttcctctc

SEQ ID NO: 1653825 - DNA, 16 bp, Homo sapiens
catcgtgaagaagcct

SEQ ID NO: 1653826 - DNA, 18 bp, Homo sapiens
catcgtgaagaagcctgt

SEQ ID NO: 1653827 - DNA, 19 bp, Homo sapiens
catcgtgacccttcagggc

SEQ ID NO: 1653828 - DNA, 23 bp, Homo sapiens
catctaaaaatatacatgtttat

SEQ ID NO: 1653829 - DNA, 19 bp, Homo sapiens
catctaatgcttgtttatg

SEQ ID NO: 1653830 - DNA, 19 bp, Homo sapiens
catctactcccaagtatgg

SEQ ID NO: 1653831 - DNA, 14 bp, Homo sapiens
catctagcaaatgt

SEQ ID NO: 1653832 - DNA, 18 bp, Homo sapiens
catctagcaaatgttatg

SEQ ID NO: 1653833 - DNA, 13 bp, Homo sapiens
catctagccagcc

SEQ ID NO: 1653834 - DNA, 17 bp, Homo sapiens
catctagccagcccctc

SEQ ID NO: 1653835 - DNA, 20 bp, Homo sapiens
catctatctcatctatctca

SEQ ID NO: 1653836 - DNA, 13 bp, Homo sapiens
catctatgtattc

SEQ ID NO: 1653837 - DNA, 20 bp, Homo sapiens
catctattctctccaaaaat

SEQ ID NO: 1653838 - DNA, 22 bp, Homo sapiens
catctattctttgtaccatctg

SEQ ID NO: 1653839 - DNA, 14 bp, Homo sapiens
catctatttctgag

SEQ ID NO: 1653840 - DNA, 15 bp, Homo sapiens
catctatttctgaga

SEQ ID NO: 1653841 - DNA, 14 bp, Homo sapiens
catctatttggaac

SEQ ID NO: 1653842 - DNA, 14 bp, Homo sapiens
catctcaaaacaaa

SEQ ID NO: 1653843 - DNA, 15 bp, Homo sapiens
catctcaaaacaaaa

SEQ ID NO: 1653844 - DNA, 20 bp, Homo sapiens
catctcagctcactgcaacc

SEQ ID NO: 1653845 - DNA, 13 bp, Homo sapiens
catctcaggagat

SEQ ID NO: 1653846 - DNA, 13 bp, Homo sapiens
catctcaggaggg

SEQ ID NO: 1653847 - DNA, 13 bp, Homo sapiens
catctcagggtcc

SEQ ID NO: 1653848 - DNA, 11 bp, Homo sapiens
catctcatcct

SEQ ID NO: 1653849 - DNA, 17 bp, Homo sapiens
catctcatcctggcacg

SEQ ID NO: 1653850 - DNA, 23 bp, Homo sapiens
catctcatgaggggagaggagac

SEQ ID NO: 1653851 - DNA, 22 bp, Homo sapiens
catctcattcaaaccccaccct

SEQ ID NO: 1653852 - DNA, 14 bp, Homo sapiens
catctcatttgtat

SEQ ID NO: 1653853 - DNA, 16 bp, Homo sapiens
catctccagggagcaa

SEQ ID NO: 1653854 - DNA, 20 bp, Homo sapiens
catctccagggagcaagaca

SEQ ID NO: 1653855 - DNA, 20 bp, Homo sapiens
catctccagggagtcccctc

SEQ ID NO: 1653856 - DNA, 21 bp, Homo sapiens
catctccagggagtcccctcc

SEQ ID NO: 1653857 - DNA, 22 bp, Homo sapiens
catctccagggagtcccctccc

SEQ ID NO: 1653858 - DNA, 16 bp, Homo sapiens
catctccatcagctgt

SEQ ID NO: 1653859 - DNA, 20 bp, Homo sapiens
catctcccaaagtgctggga

SEQ ID NO: 1653860 - DNA, 13 bp, Homo sapiens
catctccctgcct

SEQ ID NO: 1653861 - DNA, 16 bp, Homo sapiens
catctccctgcctggc

SEQ ID NO: 1653862 - DNA, 19 bp, Homo sapiens
catctcctcccgcccttcc

SEQ ID NO: 1653863 - DNA, 12 bp, Homo sapiens
catctcctgtcc

SEQ ID NO: 1653864 - DNA, 18 bp, Homo sapiens
catgcttgacatacctac

SEQ ID NO: 1653865 - DNA, 15 bp, Homo sapiens
catgcttgggctgac

SEQ ID NO: 1653866 - DNA, 13 bp, Homo sapiens
catgctttccatt

SEQ ID NO: 1653867 - DNA, 14 bp, Homo sapiens
catgctttgctgct

SEQ ID NO: 1653868 - DNA, 20 bp, Homo sapiens
catgcttttctgccactcca

SEQ ID NO: 1653869 - DNA, 14 bp, Homo sapiens
catggaaaaatggt

SEQ ID NO: 1653870 - DNA, 16 bp, Homo sapiens
catggaaaaatggttg

SEQ ID NO: 1653871 - DNA, 14 bp, Homo sapiens
catggaaagactgg

SEQ ID NO: 1653872 - DNA, 16 bp, Homo sapiens
catggaataacatgta

SEQ ID NO: 1653873 - DNA, 18 bp, Homo sapiens
catggaatttaatgctga

SEQ ID NO: 1653874 - DNA, 19 bp, Homo sapiens
catggaatttaatgctgaa

SEQ ID NO: 1653875 - DNA, 14 bp, Homo sapiens
catggacaccttgt

SEQ ID NO: 1653876 - DNA, 14 bp, Homo sapiens
catggaccaagaat

SEQ ID NO: 1653877 - DNA, 21 bp, Homo sapiens
catggaccagtggctggtctc

SEQ ID NO: 1653878 - DNA, 21 bp, Homo sapiens
catggacccaagataaaagaa

SEQ ID NO: 1653879 - DNA, 22 bp, Homo sapiens
catggacccactacccttctcc

SEQ ID NO: 1653880 - DNA, 15 bp, Homo sapiens
catggacctaacatt

SEQ ID NO: 1653881 - DNA, 16 bp, Homo sapiens
catggacctaacattc

SEQ ID NO: 1653882 - DNA, 14 bp, Homo sapiens
catggacttcacat

SEQ ID NO: 1653883 - DNA, 15 bp, Homo sapiens
catggacttccactg

SEQ ID NO: 1653884 - DNA, 16 bp, Homo sapiens
catggacttgtatatt

SEQ ID NO: 1653885 - DNA, 11 bp, Homo sapiens
catggagaaac

SEQ ID NO: 1653886 - DNA, 20 bp, Homo sapiens
catggagaaaccctgtctct

SEQ ID NO: 1653887 - DNA, 20 bp, Homo sapiens
catggagaagggttctgccc

SEQ ID NO: 1653888 - DNA, 23 bp, Homo sapiens
catggagaagggttctgccctgc

SEQ ID NO: 1653889 - DNA, 21 bp, Homo sapiens
catggagactcctgccctgtt

SEQ ID NO: 1653890 - DNA, 16 bp, Homo sapiens
catggagagcctctta

SEQ ID NO: 1653891 - DNA, 17 bp, Homo sapiens
catggaggactctcctc

SEQ ID NO: 1653892 - DNA, 18 bp, Homo sapiens
catggaggttctaaggcc

SEQ ID NO: 1653893 - DNA, 19 bp, Homo sapiens
catggatgggggaactcag

SEQ ID NO: 1653894 - DNA, 16 bp, Homo sapiens
catggatttccactgc

SEQ ID NO: 1653895 - DNA, 17 bp, Homo sapiens
catggatttccactgct

SEQ ID NO: 1653896 - DNA, 18 bp, Homo sapiens
catggcaccagccccctg

SEQ ID NO: 1653897 - DNA, 21 bp, Homo sapiens
catggcacctgtcgcccagtg

SEQ ID NO: 1653898 - DNA, 21 bp, Homo sapiens
catggcagaaagggggcatct

SEQ ID NO: 1653899 - DNA, 22 bp, Homo sapiens
catggcagaataatctttgggt

SEQ ID NO: 1653900 - DNA, 18 bp, Homo sapiens
catggcagagtttgtgtg

SEQ ID NO: 1653901 - DNA, 13 bp, Homo sapiens
catggcagcagcc

SEQ ID NO: 1653902 - DNA, 16 bp, Homo sapiens
catggcagcagccagg

SEQ ID NO: 1653903 - DNA, 22 bp, Homo sapiens
catggcagcagccagggacccc

SEQ ID NO: 1653904 - DNA, 20 bp, Homo sapiens
catggcagcctactctcctt

SEQ ID NO: 1653905 - DNA, 14 bp, Homo sapiens
catggcaggctggg

SEQ ID NO: 1653906 - DNA, 17 bp, Homo sapiens
catggcaggctgggtga

SEQ ID NO: 1653907 - DNA, 17 bp, Homo sapiens
catggcatagccccggc

SEQ ID NO: 1653908 - DNA, 19 bp, Homo sapiens
catggccaccccgtgccac

SEQ ID NO: 1653909 - DNA, 22 bp, Homo sapiens
catggccatagaggcccaggca

SEQ ID NO: 1653910 - DNA, 23 bp, Homo sapiens
catggccatagaggcccaggcac

SEQ ID NO: 1653911 - DNA, 12 bp, Homo sapiens
catggcccccaa

SEQ ID NO: 1653912 - DNA, 21 bp, Homo sapiens
catggcccccaataaaggcag

SEQ ID NO: 1653913 - DNA, 23 bp, Homo sapiens
catggcccccaataaaggcagct

SEQ ID NO: 1653914 - DNA, 14 bp, Homo sapiens
catggcccccaggg

SEQ ID NO: 1653915 - DNA, 16 bp, Homo sapiens
catggcccctctgacc

SEQ ID NO: 1653916 - DNA, 17 bp, Homo sapiens
catggcccctctgacct

SEQ ID NO: 1653917 - DNA, 12 bp, Homo sapiens
catggccctggg

SEQ ID NO: 1653918 - DNA, 14 bp, Homo sapiens
catggccctgggcg

SEQ ID NO: 1653919 - DNA, 21 bp, Homo sapiens
catggccgggccctctgtagc

SEQ ID NO: 1653920 - DNA, 23 bp, Homo sapiens
catggcctctaagagtgcccgtg

SEQ ID NO: 1653921 - DNA, 24 bp, Homo sapiens
catggcctggactgactgcagccc

SEQ ID NO: 1653922 - DNA, 19 bp, Homo sapiens
catggcgtaatgggcctgc

SEQ ID NO: 1653923 - DNA, 16 bp, Homo sapiens
catggctcaggcaagc

SEQ ID NO: 1653924 - DNA, 20 bp, Homo sapiens
catggctcaggcaagcccct

SEQ ID NO: 1653925 - DNA, 13 bp, Homo sapiens
catggctcctgtc

SEQ ID NO: 1653926 - DNA, 18 bp, Homo sapiens
catggctgaagctggagc

SEQ ID NO: 1653927 - DNA, 19 bp, Homo sapiens
catggctgaagctggagca

SEQ ID NO: 1653928 - DNA, 20 bp, Homo sapiens
catggctgaagctggagcag

SEQ ID NO: 1653929 - DNA, 15 bp, Homo sapiens
catggctggcctggt

SEQ ID NO: 1653930 - DNA, 15 bp, Homo sapiens
catggcttaatgttt

SEQ ID NO: 1653931 - DNA, 23 bp, Homo sapiens
catgggactttccttccctctcc

SEQ ID NO: 1653932 - DNA, 13 bp, Homo sapiens
catgggagccagc

SEQ ID NO: 1653933 - DNA, 20 bp, Homo sapiens
catgggagccagctgctttt

SEQ ID NO: 1653934 - DNA, 22 bp, Homo sapiens
catgggagccagctgctttttg

SEQ ID NO: 1653935 - DNA, 21 bp, Homo sapiens
catgggagctggttagaaatg

SEQ ID NO: 1653936 - DNA, 13 bp, Homo sapiens
catgggccagagc

SEQ ID NO: 1653937 - DNA, 16 bp, Homo sapiens
catgggccagagcctc

SEQ ID NO: 1653938 - DNA, 10 bp, Homo sapiens
catgggcctg

SEQ ID NO: 1653939 - DNA, 11 bp, Homo sapiens
catgggcctgg

SEQ ID NO: 1653940 - DNA, 14 bp, Homo sapiens
catgggcctgggcc

SEQ ID NO: 1653941 - DNA, 15 bp, Homo sapiens
catgggcctgggcct

SEQ ID NO: 1653942 - DNA, 13 bp, Homo sapiens
catgggcttggac

SEQ ID NO: 1653943 - DNA, 21 bp, Homo sapiens
catggggaaaccctggagcca

SEQ ID NO: 1653944 - DNA, 22 bp, Homo sapiens
catggggaaaccctggagccat

SEQ ID NO: 1653945 - DNA, 16 bp, Homo sapiens
catggggaggcagcag

SEQ ID NO: 1653946 - DNA, 21 bp, Homo sapiens
catggggatcaattttcatta

SEQ ID NO: 1653947 - DNA, 21 bp, Homo sapiens
catggggcccctggcccagag

SEQ ID NO: 1653948 - DNA, 19 bp, Homo sapiens
catgggggcacttgagttt

SEQ ID NO: 1653949 - DNA, 14 bp, Homo sapiens
catgggggtgagac

SEQ ID NO: 1653950 - DNA, 13 bp, Homo sapiens
catggggtccttg

SEQ ID NO: 1653951 - DNA, 15 bp, Homo sapiens
catggggtccttgga

SEQ ID NO: 1653952 - DNA, 14 bp, Homo sapiens
catggggttcctgg

SEQ ID NO: 1653953 - DNA, 15 bp, Homo sapiens
catgggtccagggcc

SEQ ID NO: 1653954 - DNA, 19 bp, Homo sapiens
catgggtcccttgaaggaa

SEQ ID NO: 1653955 - DNA, 19 bp, Homo sapiens
catgggtccttgatgccag

SEQ ID NO: 1653956 - DNA, 23 bp, Homo sapiens
catgggtccttgatgccagaggg

SEQ ID NO: 1653957 - DNA, 11 bp, Homo sapiens
catgggtgggg

SEQ ID NO: 1653958 - DNA, 18 bp, Homo sapiens
catggtaaccagccacag

SEQ ID NO: 1653959 - DNA, 17 bp, Homo sapiens
catggtcccttaaggca

SEQ ID NO: 1653960 - DNA, 20 bp, Homo sapiens
catggtcccttaaggcacag

SEQ ID NO: 1653961 - DNA, 14 bp, Homo sapiens
catggtcctttctg

SEQ ID NO: 1653962 - DNA, 18 bp, Homo sapiens
catggtgaaacccccatc

SEQ ID NO: 1653963 - DNA, 15 bp, Homo sapiens
catggtgagcctagc

SEQ ID NO: 1653964 - DNA, 18 bp, Homo sapiens
catggtgattccagcaag

SEQ ID NO: 1653965 - DNA, 15 bp, Homo sapiens
catggtgccccagga

SEQ ID NO: 1653966 - DNA, 19 bp, Homo sapiens
catggtgccccaggaccag

SEQ ID NO: 1653967 - DNA, 22 bp, Homo sapiens
catggtgcctatatctgagaga

SEQ ID NO: 1653968 - DNA, 16 bp, Homo sapiens
catggtgcctgagagg

SEQ ID NO: 1653969 - DNA, 17 bp, Homo sapiens
catggtgcctgagaggc

SEQ ID NO: 1653970 - DNA, 21 bp, Homo sapiens
catggtgctagtgggccctct

SEQ ID NO: 1653971 - DNA, 16 bp, Homo sapiens
catggtggacccagcg

SEQ ID NO: 1653972 - DNA, 14 bp, Homo sapiens
catggtggcaggcg

SEQ ID NO: 1653973 - DNA, 13 bp, Homo sapiens
catggtggccaga

SEQ ID NO: 1653974 - DNA, 12 bp, Homo sapiens
catggtggcgca

SEQ ID NO: 1653975 - DNA, 20 bp, Homo sapiens
catggtggcgcaagcctgta

SEQ ID NO: 1653976 - DNA, 19 bp, Homo sapiens
catggtgggttcaggggac

SEQ ID NO: 1653977 - DNA, 17 bp, Homo sapiens
catggtgtctcacacgt

SEQ ID NO: 1653978 - DNA, 13 bp, Homo sapiens
catggtgtggggg

SEQ ID NO: 1653979 - DNA, 17 bp, Homo sapiens
catgttactgaccagca

SEQ ID NO: 1653980 - DNA, 19 bp, Homo sapiens
catgttaggaaaatttcac

SEQ ID NO: 1653981 - DNA, 20 bp, Homo sapiens
catgttcacaccgctgcact

SEQ ID NO: 1653982 - DNA, 17 bp, Homo sapiens
catgttcatatgtactt

SEQ ID NO: 1653983 - DNA, 18 bp, Homo sapiens
catgttcatatgtacttg

SEQ ID NO: 1653984 - DNA, 18 bp, Homo sapiens
catgttcattataatctc

SEQ ID NO: 1653985 - DNA, 22 bp, Homo sapiens
catgttcattataatctcaaag

SEQ ID NO: 1653986 - DNA, 23 bp, Homo sapiens
catgttctaccgtggatttgtac

SEQ ID NO: 1653987 - DNA, 22 bp, Homo sapiens
catgttctccattttcaagctg

SEQ ID NO: 1653988 - DNA, 20 bp, Homo sapiens
catgttgatcatgtactttt

SEQ ID NO: 1653989 - DNA, 22 bp, Homo sapiens
catgttgcccctttctcttttc

SEQ ID NO: 1653990 - DNA, 18 bp, Homo sapiens
catgttgcgttcaaagag

SEQ ID NO: 1653991 - DNA, 14 bp, Homo sapiens
catgttgctgagga

SEQ ID NO: 1653992 - DNA, 15 bp, Homo sapiens
catgttgctgaggag

SEQ ID NO: 1653993 - DNA, 13 bp, Homo sapiens
catgttgctgcca

SEQ ID NO: 1653994 - DNA, 20 bp, Homo sapiens
catgttggccaggctggtct

SEQ ID NO: 1653995 - DNA, 20 bp, Homo sapiens
catgttgggaaacttggctc

SEQ ID NO: 1653996 - DNA, 15 bp, Homo sapiens
catgttgtaatgctg

SEQ ID NO: 1653997 - DNA, 19 bp, Homo sapiens
catgttgtaatgctgcact

SEQ ID NO: 1653998 - DNA, 20 bp, Homo sapiens
catgttgtaatgctgcactt

SEQ ID NO: 1653999 - DNA, 20 bp, Homo sapiens
catgtttaatgggtatgctc

SEQ ID NO: 1654000 - DNA, 19 bp, Homo sapiens
catgtttacaggtttgaat

SEQ ID NO: 1654001 - DNA, 21 bp, Homo sapiens
catgtttagtgaatgactttt

SEQ ID NO: 1654002 - DNA, 22 bp, Homo sapiens
catgtttatttatttccagtgg

SEQ ID NO: 1654003 - DNA, 22 bp, Homo sapiens
catgtttctcacattgctgtat

SEQ ID NO: 1654004 - DNA, 10 bp, Homo sapiens
catgtttctt

SEQ ID NO: 1654005 - DNA, 13 bp, Homo sapiens
catgtttcttcat

SEQ ID NO: 1654006 - DNA, 23 bp, Homo sapiens
catgtttgagctcagacccccac

SEQ ID NO: 1654007 - DNA, 23 bp, Homo sapiens
catgtttgatgtatctgagcagg

SEQ ID NO: 1654008 - DNA, 14 bp, Homo sapiens
catgtttgcttcat

SEQ ID NO: 1654009 - DNA, 23 bp, Homo sapiens
catgtttggtgtttgtctgtgtt

SEQ ID NO: 1654010 - DNA, 15 bp, Homo sapiens
catgttttgcatgta

SEQ ID NO: 1654011 - DNA, 12 bp, Homo sapiens
catgttttgtat

SEQ ID NO: 1654012 - DNA, 18 bp, Homo sapiens
catgttttttcttcaaat

SEQ ID NO: 1654013 - DNA, 23 bp, Homo sapiens
catgttttttcttcaaatgttta

SEQ ID NO: 1654014 - DNA, 23 bp, Homo sapiens
cattaaaaaaatgtgcctagttt

SEQ ID NO: 1654015 - DNA, 22 bp, Homo sapiens
cattaaaaagttgttctttgtt

SEQ ID NO: 1654016 - DNA, 23 bp, Homo sapiens
cattaaaaagttgttctttgttt

SEQ ID NO: 1654017 - DNA, 13 bp, Homo sapiens
cattaaaaattac

SEQ ID NO: 1654018 - DNA, 21 bp, Homo sapiens
cattaaaacaatattgtttct

SEQ ID NO: 1654019 - DNA, 15 bp, Homo sapiens
cattaaaactgcttt

SEQ ID NO: 1654020 - DNA, 13 bp, Homo sapiens
cattaaaagaata

SEQ ID NO: 1654021 - DNA, 19 bp, Homo sapiens
cattaaaatatagagacag

SEQ ID NO: 1654022 - DNA, 18 bp, Homo sapiens
cattaaacactgtaatct

SEQ ID NO: 1654023 - DNA, 21 bp, Homo sapiens
cattaaacactgtaatcttaa

SEQ ID NO: 1654024 - DNA, 15 bp, Homo sapiens
cattaaagtcagaag

SEQ ID NO: 1654025 - DNA, 18 bp, Homo sapiens
cattaaagtcagaagttt

SEQ ID NO: 1654026 - DNA, 13 bp, Homo sapiens
cattaaataaatt

SEQ ID NO: 1654027 - DNA, 17 bp, Homo sapiens
cattaaatcacttgaat

SEQ ID NO: 1654028 - DNA, 13 bp, Homo sapiens
cattaaatccgca

SEQ ID NO: 1654029 - DNA, 16 bp, Homo sapiens
cattaaccagtggccg

SEQ ID NO: 1654030 - DNA, 17 bp, Homo sapiens
cattaacggtgctaaaa

SEQ ID NO: 1654031 - DNA, 17 bp, Homo sapiens
cattaactccctccacc

SEQ ID NO: 1654032 - DNA, 20 bp, Homo sapiens
cattaactccctccaccagc

SEQ ID NO: 1654033 - DNA, 21 bp, Homo sapiens
cattaactccctccaccagcc

SEQ ID NO: 1654034 - DNA, 17 bp, Homo sapiens
cattaacttagcatgtg

SEQ ID NO: 1654035 - DNA, 21 bp, Homo sapiens
cattaaggggaagaatgaaag

SEQ ID NO: 1654036 - DNA, 15 bp, Homo sapiens
cattaagtaaatgct

SEQ ID NO: 1654037 - DNA, 18 bp, Homo sapiens
cattaataaagttgcttt

SEQ ID NO: 1654038 - DNA, 21 bp, Homo sapiens
cattaataagtgaagaataca

SEQ ID NO: 1654039 - DNA, 20 bp, Homo sapiens
cattaatagcagcctttctc

SEQ ID NO: 1654040 - DNA, 19 bp, Homo sapiens
cattaatgcctgctttttg

SEQ ID NO: 1654041 - DNA, 23 bp, Homo sapiens
cattaatgcctgctttttggaaa

SEQ ID NO: 1654042 - DNA, 21 bp, Homo sapiens
cattaatgttaattcagcact

SEQ ID NO: 1654043 - DNA, 23 bp, Homo sapiens
cattaatgttaattcagcactga

SEQ ID NO: 1654044 - DNA, 12 bp, Homo sapiens
cattaattacat

SEQ ID NO: 1654045 - DNA, 13 bp, Homo sapiens
cattaattacata

SEQ ID NO: 1654046 - DNA, 19 bp, Homo sapiens
cattaattattattgctgt

SEQ ID NO: 1654047 - DNA, 20 bp, Homo sapiens
cattaattattattgctgtt

SEQ ID NO: 1654048 - DNA, 17 bp, Homo sapiens
cattaattttgtgcatt

SEQ ID NO: 1654049 - DNA, 16 bp, Homo sapiens
cattacaaattgctta

SEQ ID NO: 1654050 - DNA, 18 bp, Homo sapiens
cattacaattttctgtaa

SEQ ID NO: 1654051 - DNA, 22 bp, Homo sapiens
cattacagtatccaatgtcttt

SEQ ID NO: 1654052 - DNA, 15 bp, Homo sapiens
cattacattattaaa

SEQ ID NO: 1654053 - DNA, 20 bp, Homo sapiens
cattaccaaaataataaaaa

SEQ ID NO: 1654054 - DNA, 17 bp, Homo sapiens
cattacctccatccatc

SEQ ID NO: 1654055 - DNA, 13 bp, Homo sapiens
cattactggtaaa

SEQ ID NO: 1654056 - DNA, 17 bp, Homo sapiens
cattactgtgatttctg

SEQ ID NO: 1654057 - DNA, 12 bp, Homo sapiens
cattactttata

SEQ ID NO: 1654058 - DNA, 12 bp, Homo sapiens
cattacttttta

SEQ ID NO: 1654059 - DNA, 14 bp, Homo sapiens
cattagaaaaagag

SEQ ID NO: 1654060 - DNA, 17 bp, Homo sapiens
cattagaaaattttgta

SEQ ID NO: 1654061 - DNA, 23 bp, Homo sapiens
cattagaaaattttgtaaaacaa

SEQ ID NO: 1654062 - DNA, 18 bp, Homo sapiens
cattagaaattagctgtg

SEQ ID NO: 1654063 - DNA, 22 bp, Homo sapiens
cattagactgaatttaactact

SEQ ID NO: 1654064 - DNA, 15 bp, Homo sapiens
cattagataaacaca

SEQ ID NO: 1654065 - DNA, 19 bp, Homo sapiens
cattagataaacacaggca

SEQ ID NO: 1654066 - DNA, 20 bp, Homo sapiens
cattagataaacacaggcag

SEQ ID NO: 1654067 - DNA, 15 bp, Homo sapiens
cattagataaattac

SEQ ID NO: 1654068 - DNA, 19 bp, Homo sapiens
cattagattttattttact

SEQ ID NO: 1654069 - DNA, 21 bp, Homo sapiens
cattaggaattaagttatctt

SEQ ID NO: 1654070 - DNA, 20 bp, Homo sapiens
cattaggccagcaacgcttg

SEQ ID NO: 1654071 - DNA, 13 bp, Homo sapiens
cattagttttaga

SEQ ID NO: 1654072 - DNA, 14 bp, Homo sapiens
cattataatctcaa

SEQ ID NO: 1654073 - DNA, 20 bp, Homo sapiens
cattataatctcaaaggaga

SEQ ID NO: 1654074 - DNA, 20 bp, Homo sapiens
cattatattttgaaagaagc

SEQ ID NO: 1654075 - DNA, 20 bp, Homo sapiens
cattatcgggagcagtgtct

SEQ ID NO: 1654076 - DNA, 19 bp, Homo sapiens
cattatctcacttagtcct

SEQ ID NO: 1654077 - DNA, 16 bp, Homo sapiens
cattatgagaggcaat

SEQ ID NO: 1654078 - DNA, 13 bp, Homo sapiens
cattatgatctaa

SEQ ID NO: 1654079 - DNA, 21 bp, Homo sapiens
cattatgatctaataaacttt

SEQ ID NO: 1654080 - DNA, 16 bp, Homo sapiens
cattatgccacttcct

SEQ ID NO: 1654081 - DNA, 20 bp, Homo sapiens
cattatggtagaatcatttt

SEQ ID NO: 1654082 - DNA, 19 bp, Homo sapiens
cattatgtccactgtgtat

SEQ ID NO: 1654083 - DNA, 17 bp, Homo sapiens
cattatgtggttttaga

SEQ ID NO: 1654084 - DNA, 21 bp, Homo sapiens
cattatgtggttttagatttt

SEQ ID NO: 1654085 - DNA, 15 bp, Homo sapiens
cattattatttctgt

SEQ ID NO: 1654086 - DNA, 17 bp, Homo sapiens
cattattatttctgttc

SEQ ID NO: 1654087 - DNA, 18 bp, Homo sapiens
cattattcaagaatgaaa

SEQ ID NO: 1654088 - DNA, 19 bp, Homo sapiens
cattattgacgaactggct

SEQ ID NO: 1654089 - DNA, 23 bp, Homo sapiens
cattatttatatggggaatatat

SEQ ID NO: 1654090 - DNA, 20 bp, Homo sapiens
cattatttctagtccaaaat

SEQ ID NO: 1654091 - DNA, 19 bp, Homo sapiens
cattatttcttcccagaat

SEQ ID NO: 1654092 - DNA, 19 bp, Homo sapiens
catttagaatggtgatttt

SEQ ID NO: 1654093 - DNA, 20 bp, Homo sapiens
catttagattgaaaactttt

SEQ ID NO: 1654094 - DNA, 21 bp, Homo sapiens
catttagctggccacatggcg

SEQ ID NO: 1654095 - DNA, 23 bp, Homo sapiens
catttaggagaatagcagagagc

SEQ ID NO: 1654096 - DNA, 15 bp, Homo sapiens
catttagtaagaata

SEQ ID NO: 1654097 - DNA, 20 bp, Homo sapiens
catttagtgaagttgtgcaa

SEQ ID NO: 1654098 - DNA, 23 bp, Homo sapiens
catttagttacaacctgaaggaa

SEQ ID NO: 1654099 - DNA, 11 bp, Homo sapiens
catttatactc

SEQ ID NO: 1654100 - DNA, 17 bp, Homo sapiens
catttatataaaactta

SEQ ID NO: 1654101 - DNA, 18 bp, Homo sapiens
catttatatatatatgta

SEQ ID NO: 1654102 - DNA, 20 bp, Homo sapiens
catttatatatatatgtata

SEQ ID NO: 1654103 - DNA, 21 bp, Homo sapiens
catttatatatatatgtatat

SEQ ID NO: 1654104 - DNA, 22 bp, Homo sapiens
catttatattgcagattgaata

SEQ ID NO: 1654105 - DNA, 23 bp, Homo sapiens
catttatcttgaaggaaaaattc

SEQ ID NO: 1654106 - DNA, 16 bp, Homo sapiens
catttatgaagcaagc

SEQ ID NO: 1654107 - DNA, 18 bp, Homo sapiens
catttatgacctaagtca

SEQ ID NO: 1654108 - DNA, 22 bp, Homo sapiens
catttatgacctaagtcaggta

SEQ ID NO: 1654109 - DNA, 22 bp, Homo sapiens
catttatgtgaggtaattattg

SEQ ID NO: 1654110 - DNA, 18 bp, Homo sapiens
catttattgtttatgtaa

SEQ ID NO: 1654111 - DNA, 17 bp, Homo sapiens
catttatttatccagaa

SEQ ID NO: 1654112 - DNA, 23 bp, Homo sapiens
catttatttatccagaaaactgt

SEQ ID NO: 1654113 - DNA, 22 bp, Homo sapiens
catttattttgactgtgattta

SEQ ID NO: 1654114 - DNA, 18 bp, Homo sapiens
catttcaaagccctgcct

SEQ ID NO: 1654115 - DNA, 14 bp, Homo sapiens
catttcaaggaaca

SEQ ID NO: 1654116 - DNA, 15 bp, Homo sapiens
catttcaccatggcc

SEQ ID NO: 1654117 - DNA, 13 bp, Homo sapiens
catttcacccctc

SEQ ID NO: 1654118 - DNA, 17 bp, Homo sapiens
catttcacccctccctt

SEQ ID NO: 1654119 - DNA, 19 bp, Homo sapiens
catttcacccctccctttc

SEQ ID NO: 1654120 - DNA, 18 bp, Homo sapiens
catttcacctgtgacaaa

SEQ ID NO: 1654121 - DNA, 13 bp, Homo sapiens
catttcagaagtt

SEQ ID NO: 1654122 - DNA, 15 bp, Homo sapiens
catttcagtggcttc

SEQ ID NO: 1654123 - DNA, 16 bp, Homo sapiens
catttcagtggcttcc

SEQ ID NO: 1654124 - DNA, 17 bp, Homo sapiens
catttcatcattgtttc

SEQ ID NO: 1654125 - DNA, 21 bp, Homo sapiens
catttcatcattgtttctgca

SEQ ID NO: 1654126 - DNA, 14 bp, Homo sapiens
catttcatctattt

SEQ ID NO: 1654127 - DNA, 15 bp, Homo sapiens
catttcatctatttc

SEQ ID NO: 1654128 - DNA, 16 bp, Homo sapiens
catttcatctatttct

SEQ ID NO: 1654129 - DNA, 17 bp, Homo sapiens
catttcatctatttctg

SEQ ID NO: 1654130 - DNA, 18 bp, Homo sapiens
catttcatctatttctga

SEQ ID NO: 1654131 - DNA, 21 bp, Homo sapiens
catttcatgaaaaagctgctt

SEQ ID NO: 1654132 - DNA, 16 bp, Homo sapiens
catttcattcaaatca

SEQ ID NO: 1654133 - DNA, 20 bp, Homo sapiens
catttccaacaccacagaca

SEQ ID NO: 1654134 - DNA, 21 bp, Homo sapiens
catttccaacaccacagacac

SEQ ID NO: 1654135 - DNA, 22 bp, Homo sapiens
catttccaccaagggtatctgc

SEQ ID NO: 1654136 - DNA, 14 bp, Homo sapiens
catttccattgctt

SEQ ID NO: 1654137 - DNA, 20 bp, Homo sapiens
catttcccaaagtcctctgc

SEQ ID NO: 1654138 - DNA, 17 bp, Homo sapiens
catttcccacatctttc

SEQ ID NO: 1654139 - DNA, 14 bp, Homo sapiens
catttcccatctgc

SEQ ID NO: 1654140 - DNA, 17 bp, Homo sapiens
catttcccatctgcacc

SEQ ID NO: 1654141 - DNA, 20 bp, Homo sapiens
catttcccatctgcacccct

SEQ ID NO: 1654142 - DNA, 14 bp, Homo sapiens
catttccccctcct

SEQ ID NO: 1654143 - DNA, 22 bp, Homo sapiens
catttcccctcccaatcctctc

SEQ ID NO: 1654144 - DNA, 23 bp, Homo sapiens
catttcccctctgcacccagaac

SEQ ID NO: 1654145 - DNA, 18 bp, Homo sapiens
catttccctatcttctcc

SEQ ID NO: 1654146 - DNA, 23 bp, Homo sapiens
catttccgttgtacatgttcctg

SEQ ID NO: 1654147 - DNA, 17 bp, Homo sapiens
catttcctatgtaactg

SEQ ID NO: 1654148 - DNA, 20 bp, Homo sapiens
catttcctcagcttatctct

SEQ ID NO: 1654149 - DNA, 20 bp, Homo sapiens
catttcctgacagaaggact

SEQ ID NO: 1654150 - DNA, 19 bp, Homo sapiens
catttcctgagaccacaga

SEQ ID NO: 1654151 - DNA, 19 bp, Homo sapiens
catttcctgcccttcctca

SEQ ID NO: 1654152 - DNA, 20 bp, Homo sapiens
catttcctgcccttcctcag

SEQ ID NO: 1654153 - DNA, 23 bp, Homo sapiens
catttcctgcccttcctcagttt

SEQ ID NO: 1654154 - DNA, 11 bp, Homo sapiens
catttcctgct

SEQ ID NO: 1654155 - DNA, 11 bp, Homo sapiens
catttccttgg

SEQ ID NO: 1654156 - DNA, 12 bp, Homo sapiens
catttccttgga

SEQ ID NO: 1654157 - DNA, 14 bp, Homo sapiens
catttccttggagg

SEQ ID NO: 1654158 - DNA, 12 bp, Homo sapiens
catttctaaaat

SEQ ID NO: 1654159 - DNA, 16 bp, Homo sapiens
catttctaattcctgt

SEQ ID NO: 1654160 - DNA, 13 bp, Homo sapiens
catttctatactt

SEQ ID NO: 1654161 - DNA, 21 bp, Homo sapiens
catttctatactttacaggaa

SEQ ID NO: 1654162 - DNA, 23 bp, Homo sapiens
catttctatttatttactgagct

SEQ ID NO: 1654163 - DNA, 17 bp, Homo sapiens
catttctcaatcagtgc

SEQ ID NO: 1654164 - DNA, 18 bp, Homo sapiens
catttctctccaggaagt

SEQ ID NO: 1654165 - DNA, 13 bp, Homo sapiens
catttctctgctt

SEQ ID NO: 1654166 - DNA, 14 bp, Homo sapiens
catttctctgctta

SEQ ID NO: 1654167 - DNA, 15 bp, Homo sapiens
catttctcttcctaa

SEQ ID NO: 1654168 - DNA, 18 bp, Homo sapiens
catttctgaactgttaca

SEQ ID NO: 1654169 - DNA, 12 bp, Homo sapiens
catttcttccca

SEQ ID NO: 1654170 - DNA, 15 bp, Homo sapiens
catttcttccccagt

SEQ ID NO: 1654171 - DNA, 17 bp, Homo sapiens
catttcttccccagtgt

SEQ ID NO: 1654172 - DNA, 13 bp, Homo sapiens
catttcttcctca

SEQ ID NO: 1654173 - DNA, 14 bp, Homo sapiens
catttcttcctcac

SEQ ID NO: 1654174 - DNA, 15 bp, Homo sapiens
catttctttcttgct

SEQ ID NO: 1654175 - DNA, 17 bp, Homo sapiens
catttctttcttgctgg

SEQ ID NO: 1654176 - DNA, 18 bp, Homo sapiens
catttctttcttgctggc

SEQ ID NO: 1654177 - DNA, 13 bp, Homo sapiens
catttctttgcat

SEQ ID NO: 1654178 - DNA, 13 bp, Homo sapiens
catttcttttctg

SEQ ID NO: 1654179 - DNA, 15 bp, Homo sapiens
catttctttttggga

SEQ ID NO: 1654180 - DNA, 23 bp, Homo sapiens
catttgaacctggatccagcact

SEQ ID NO: 1654181 - DNA, 16 bp, Homo sapiens
catttgacaaaactaa

SEQ ID NO: 1654182 - DNA, 17 bp, Homo sapiens
catttgacacaaagctt

SEQ ID NO: 1654183 - DNA, 18 bp, Homo sapiens
catttgagaaatgcatat

SEQ ID NO: 1654184 - DNA, 23 bp, Homo sapiens
catttgagaaatgcatattgtat

SEQ ID NO: 1654185 - DNA, 20 bp, Homo sapiens
catttgagggcccagccagg

SEQ ID NO: 1654186 - DNA, 22 bp, Homo sapiens
catttgatgcatgtcttttaaa

SEQ ID NO: 1654187 - DNA, 15 bp, Homo sapiens
catttgatgctaaat

SEQ ID NO: 1654188 - DNA, 16 bp, Homo sapiens
catttgatgtacatgt

SEQ ID NO: 1654189 - DNA, 16 bp, Homo sapiens
catttgatttttctaa

SEQ ID NO: 1654190 - DNA, 15 bp, Homo sapiens
catttgcaccctccg

SEQ ID NO: 1654191 - DNA, 19 bp, Homo sapiens
catttgcagatgttcaaat

SEQ ID NO: 1654192 - DNA, 19 bp, Homo sapiens
catttgcagggtcctcttc

SEQ ID NO: 1654193 - DNA, 20 bp, Homo sapiens
catttgcagggtcctcttct

SEQ ID NO: 1654194 - DNA, 13 bp, Homo sapiens
catttgccaagtg

SEQ ID NO: 1654195 - DNA, 14 bp, Homo sapiens
catttgccaagtga

SEQ ID NO: 1654196 - DNA, 19 bp, Homo sapiens
catttgctagttctgctgc

SEQ ID NO: 1654197 - DNA, 20 bp, Homo sapiens
catttgctcttcagatgcca

SEQ ID NO: 1654198 - DNA, 17 bp, Homo sapiens
catttgctgttttaaac

SEQ ID NO: 1654199 - DNA, 16 bp, Homo sapiens
catttggaacaacaaa

SEQ ID NO: 1654200 - DNA, 21 bp, Homo sapiens
catttggagacacaactattt

SEQ ID NO: 1654201 - DNA, 22 bp, Homo sapiens
catttggagctcttgggtcaga

SEQ ID NO: 1654202 - DNA, 15 bp, Homo sapiens
catttggattggatg

SEQ ID NO: 1654203 - DNA, 16 bp, Homo sapiens
catttgggatggagaa

SEQ ID NO: 1654204 - DNA, 21 bp, Homo sapiens
catttggtctcaggcagcacc

SEQ ID NO: 1654205 - DNA, 21 bp, Homo sapiens
catttggtgagagtcaaagct

SEQ ID NO: 1654206 - DNA, 18 bp, Homo sapiens
ccaagaggactgagactg

SEQ ID NO: 1654207 - DNA, 19 bp, Homo sapiens
ccaagagggtcctttagta

SEQ ID NO: 1654208 - DNA, 14 bp, Homo sapiens
ccaagaggtctgag

SEQ ID NO: 1654209 - DNA, 17 bp, Homo sapiens
ccaagaggtctgagccc

SEQ ID NO: 1654210 - DNA, 22 bp, Homo sapiens
ccaagatatttttatcccaaga

SEQ ID NO: 1654211 - DNA, 17 bp, Homo sapiens
ccaagatcgcaccactg

SEQ ID NO: 1654212 - DNA, 15 bp, Homo sapiens
ccaagatggctgctg

SEQ ID NO: 1654213 - DNA, 22 bp, Homo sapiens
ccaagatggctgctgcctgctc

SEQ ID NO: 1654214 - DNA, 13 bp, Homo sapiens
ccaagattccgga

SEQ ID NO: 1654215 - DNA, 14 bp, Homo sapiens
ccaagattctactc

SEQ ID NO: 1654216 - DNA, 14 bp, Homo sapiens
ccaagattctagat

SEQ ID NO: 1654217 - DNA, 16 bp, Homo sapiens
ccaagattctagatga

SEQ ID NO: 1654218 - DNA, 22 bp, Homo sapiens
ccaagcacctccaaccaaataa

SEQ ID NO: 1654219 - DNA, 15 bp, Homo sapiens
ccaagcactgctcac

SEQ ID NO: 1654220 - DNA, 19 bp, Homo sapiens
ccaagcactttcagtccaa

SEQ ID NO: 1654221 - DNA, 13 bp, Homo sapiens
ccaagcagccagc

SEQ ID NO: 1654222 - DNA, 18 bp, Homo sapiens
ccaagcagccagccagtc

SEQ ID NO: 1654223 - DNA, 17 bp, Homo sapiens
ccaagcagtgcctgcct

SEQ ID NO: 1654224 - DNA, 13 bp, Homo sapiens
ccaagcatcttgg

SEQ ID NO: 1654225 - DNA, 22 bp, Homo sapiens
ccaagcatcttgggggggtggc

SEQ ID NO: 1654226 - DNA, 22 bp, Homo sapiens
ccaagcatttcatgaaaaagct

SEQ ID NO: 1654227 - DNA, 20 bp, Homo sapiens
ccaagccaagggaacctgtg

SEQ ID NO: 1654228 - DNA, 19 bp, Homo sapiens
ccaagccagaggctgggtt

SEQ ID NO: 1654229 - DNA, 12 bp, Homo sapiens
ccaagccagagt

SEQ ID NO: 1654230 - DNA, 14 bp, Homo sapiens
ccaagccagattct

SEQ ID NO: 1654231 - DNA, 20 bp, Homo sapiens
ccaagccagattctcttgaa

SEQ ID NO: 1654232 - DNA, 15 bp, Homo sapiens
ccaagccccatctca

SEQ ID NO: 1654233 - DNA, 24 bp, Homo sapiens
ccaagccccatctcatcctggcac

SEQ ID NO: 1654234 - DNA, 17 bp, Homo sapiens
ccaagccgaccttccct

SEQ ID NO: 1654235 - DNA, 13 bp, Homo sapiens
ccaagccgtggct

SEQ ID NO: 1654236 - DNA, 15 bp, Homo sapiens
ccaagccgtggcttc

SEQ ID NO: 1654237 - DNA, 21 bp, Homo sapiens
ccaagccgtggcttcccgctc

SEQ ID NO: 1654238 - DNA, 20 bp, Homo sapiens
ccaagcctccacagcgaggg

SEQ ID NO: 1654239 - DNA, 13 bp, Homo sapiens
ccaagcctgctgg

SEQ ID NO: 1654240 - DNA, 14 bp, Homo sapiens
ccaagcctgctggc

SEQ ID NO: 1654241 - DNA, 16 bp, Homo sapiens
ccaagcctgctggctg

SEQ ID NO: 1654242 - DNA, 17 bp, Homo sapiens
ccaagcctgctggctgc

SEQ ID NO: 1654243 - DNA, 12 bp, Homo sapiens
ccaagccttggc

SEQ ID NO: 1654244 - DNA, 19 bp, Homo sapiens
ccaagccttggctctaccc

SEQ ID NO: 1654245 - DNA, 13 bp, Homo sapiens
ccaagcgttcctg

SEQ ID NO: 1654246 - DNA, 13 bp, Homo sapiens
ccaagctcacagt

SEQ ID NO: 1654247 - DNA, 17 bp, Homo sapiens
ccaagctccaagcccca

SEQ ID NO: 1654248 - DNA, 17 bp, Homo sapiens
ccaagctgagtttccta

SEQ ID NO: 1654249 - DNA, 19 bp, Homo sapiens
ccaagctgcctctgggcca

SEQ ID NO: 1654250 - DNA, 16 bp, Homo sapiens
ccaagctggagtgaag

SEQ ID NO: 1654251 - DNA, 11 bp, Homo sapiens
ccaagctgggc

SEQ ID NO: 1654252 - DNA, 16 bp, Homo sapiens
ccaagctgggccgagg

SEQ ID NO: 1654253 - DNA, 17 bp, Homo sapiens
ccaagctgtggcagccg

SEQ ID NO: 1654254 - DNA, 18 bp, Homo sapiens
ccaagctgtggcagccgt

SEQ ID NO: 1654255 - DNA, 21 bp, Homo sapiens
ccaagctgtggcagccgtccc

SEQ ID NO: 1654256 - DNA, 22 bp, Homo sapiens
ccaagctgtggcagccgtccca

SEQ ID NO: 1654257 - DNA, 17 bp, Homo sapiens
ccaagctgttttcttct

SEQ ID NO: 1654258 - DNA, 18 bp, Homo sapiens
ccaagctgttttcttcta

SEQ ID NO: 1654259 - DNA, 23 bp, Homo sapiens
ccaagcttcaaccctcagccttg

SEQ ID NO: 1654260 - DNA, 23 bp, Homo sapiens
ccaagcttcagagcctagccacc

SEQ ID NO: 1654261 - DNA, 17 bp, Homo sapiens
ccaagcttccacctgtc

SEQ ID NO: 1654262 - DNA, 15 bp, Homo sapiens
ccaagcttggcagcc

SEQ ID NO: 1654263 - DNA, 18 bp, Homo sapiens
ccaagctttaaattatgt

SEQ ID NO: 1654264 - DNA, 17 bp, Homo sapiens
ccaaggaaacgctacct

SEQ ID NO: 1654265 - DNA, 13 bp, Homo sapiens
ccaaggaagcagc

SEQ ID NO: 1654266 - DNA, 18 bp, Homo sapiens
ccaaggaatttaaaactg

SEQ ID NO: 1654267 - DNA, 13 bp, Homo sapiens
ccaaggacagggc

SEQ ID NO: 1654268 - DNA, 22 bp, Homo sapiens
ccaaggaccttggaagagcaag

SEQ ID NO: 1654269 - DNA, 19 bp, Homo sapiens
ccaaggagaaacagagaca

SEQ ID NO: 1654270 - DNA, 13 bp, Homo sapiens
ccaaggagccatt

SEQ ID NO: 1654271 - DNA, 22 bp, Homo sapiens
ccaaggagctgatttccaggcc

SEQ ID NO: 1654272 - DNA, 11 bp, Homo sapiens
ccaaggatccc

SEQ ID NO: 1654273 - DNA, 16 bp, Homo sapiens
ccaaggcagaggcctg

SEQ ID NO: 1654274 - DNA, 15 bp, Homo sapiens
ccaaggcagcctcca

SEQ ID NO: 1654275 - DNA, 19 bp, Homo sapiens
ccaaggcagcgaccccagg

SEQ ID NO: 1654276 - DNA, 15 bp, Homo sapiens
ccaaggccagagtgg

SEQ ID NO: 1654277 - DNA, 18 bp, Homo sapiens
ccaaggccagagtggcct

SEQ ID NO: 1654278 - DNA, 16 bp, Homo sapiens
ccaaggccgaagctct

SEQ ID NO: 1654279 - DNA, 17 bp, Homo sapiens
ccaaggccgaagctctg

SEQ ID NO: 1654280 - DNA, 13 bp, Homo sapiens
ccaaggcctctct

SEQ ID NO: 1654281 - DNA, 14 bp, Homo sapiens
ccaaggcctctctc

SEQ ID NO: 1654282 - DNA, 16 bp, Homo sapiens
ccaaggcctctctctg

SEQ ID NO: 1654283 - DNA, 23 bp, Homo sapiens
ccaaggcgtccgcgcgccagcac

SEQ ID NO: 1654284 - DNA, 22 bp, Homo sapiens
ccaaggcttctccaattctgcc

SEQ ID NO: 1654285 - DNA, 21 bp, Homo sapiens
ccaagggaaaggggtgctttt

SEQ ID NO: 1654286 - DNA, 16 bp, Homo sapiens
ccaagggaacctgtgt

SEQ ID NO: 1654287 - DNA, 17 bp, Homo sapiens
ccaagggaacctgtgtc

SEQ ID NO: 1654288 - DNA, 18 bp, Homo sapiens
ccaagggaacctgtgtcc

SEQ ID NO: 1654289 - DNA, 23 bp, Homo sapiens
ccaagggacagcaagtgagcaga

SEQ ID NO: 1654290 - DNA, 18 bp, Homo sapiens
ccaagggacagcccacgg

SEQ ID NO: 1654291 - DNA, 14 bp, Homo sapiens
ccaagggccccagg

SEQ ID NO: 1654292 - DNA, 17 bp, Homo sapiens
ccaagggggtgactgga

SEQ ID NO: 1654293 - DNA, 20 bp, Homo sapiens
ccaagggtatctgctgcctc

SEQ ID NO: 1654294 - DNA, 20 bp, Homo sapiens
ccaaggtaccgatttctgct

SEQ ID NO: 1654295 - DNA, 15 bp, Homo sapiens
ccaaggtgatgttgt

SEQ ID NO: 1654296 - DNA, 15 bp, Homo sapiens
ccaaggtgctggact

SEQ ID NO: 1654297 - DNA, 18 bp, Homo sapiens
ccaaggtggagggaagga

SEQ ID NO: 1654298 - DNA, 18 bp, Homo sapiens
ccaaggtgggctgagccc

SEQ ID NO: 1654299 - DNA, 23 bp, Homo sapiens
ccaaggtgggctgagccctggca

SEQ ID NO: 1654300 - DNA, 16 bp, Homo sapiens
ccaaggttctccaaca

SEQ ID NO: 1654301 - DNA, 22 bp, Homo sapiens
ccaaggttggagcccagggcat

SEQ ID NO: 1654302 - DNA, 19 bp, Homo sapiens
ccaaggtttaaagagtcta

SEQ ID NO: 1654303 - DNA, 23 bp, Homo sapiens
ccaaggtttaaagagtctagatt

SEQ ID NO: 1654304 - DNA, 19 bp, Homo sapiens
ccaaggttttataaggctg

SEQ ID NO: 1654305 - DNA, 20 bp, Homo sapiens
ccaaggttttataaggctga

SEQ ID NO: 1654306 - DNA, 18 bp, Homo sapiens
ccaagtaaagtgatgttt

SEQ ID NO: 1654307 - DNA, 18 bp, Homo sapiens
ccaagtaccaatgctgtt

SEQ ID NO: 1654308 - DNA, 21 bp, Homo sapiens
ccaagtatagcctatggcaga

SEQ ID NO: 1654309 - DNA, 21 bp, Homo sapiens
ccaagtatgccttaagcagaa

SEQ ID NO: 1654310 - DNA, 15 bp, Homo sapiens
ccaagtcactagaag

SEQ ID NO: 1654311 - DNA, 21 bp, Homo sapiens
ccaagtcattaaaatggaagt

SEQ ID NO: 1654312 - DNA, 15 bp, Homo sapiens
ccaagtccctgtttt

SEQ ID NO: 1654313 - DNA, 22 bp, Homo sapiens
ccaagtccctgttttctgagcc

SEQ ID NO: 1654314 - DNA, 23 bp, Homo sapiens
ccaagtccctgttttctgagccc

SEQ ID NO: 1654315 - DNA, 21 bp, Homo sapiens
ccaagtccgcagaagccctga

SEQ ID NO: 1654316 - DNA, 16 bp, Homo sapiens
ccaagtcctgaagagg

SEQ ID NO: 1654317 - DNA, 22 bp, Homo sapiens
ccaagtcctggctacatcccag

SEQ ID NO: 1654318 - DNA, 17 bp, Homo sapiens
ccaagtcggcacccttt

SEQ ID NO: 1654319 - DNA, 22 bp, Homo sapiens
ccaagtgatccttccacctcag

SEQ ID NO: 1654320 - DNA, 20 bp, Homo sapiens
ccacctaggccactcctcca

SEQ ID NO: 1654321 - DNA, 22 bp, Homo sapiens
ccacctaggccactcctccaaa

SEQ ID NO: 1654322 - DNA, 16 bp, Homo sapiens
ccacctagtgccccag

SEQ ID NO: 1654323 - DNA, 18 bp, Homo sapiens
ccacctagtgccccagac

SEQ ID NO: 1654324 - DNA, 19 bp, Homo sapiens
ccacctagtgccccagact

SEQ ID NO: 1654325 - DNA, 15 bp, Homo sapiens
ccacctcactcctgt

SEQ ID NO: 1654326 - DNA, 19 bp, Homo sapiens
ccacctcagaaaggatttt

SEQ ID NO: 1654327 - DNA, 12 bp, Homo sapiens
ccacctcagcct

SEQ ID NO: 1654328 - DNA, 14 bp, Homo sapiens
ccacctcagccttg

SEQ ID NO: 1654329 - DNA, 16 bp, Homo sapiens
ccacctcatcactgga

SEQ ID NO: 1654330 - DNA, 14 bp, Homo sapiens
ccacctccaccccc

SEQ ID NO: 1654331 - DNA, 14 bp, Homo sapiens
ccacctcccacccc

SEQ ID NO: 1654332 - DNA, 16 bp, Homo sapiens
ccacctcccaccccac

SEQ ID NO: 1654333 - DNA, 21 bp, Homo sapiens
ccacctcccactcctgctgca

SEQ ID NO: 1654334 - DNA, 15 bp, Homo sapiens
ccacctcccccaaac

SEQ ID NO: 1654335 - DNA, 21 bp, Homo sapiens
ccacctcccccaaaccctgct

SEQ ID NO: 1654336 - DNA, 17 bp, Homo sapiens
ccacctcccccttcccc

SEQ ID NO: 1654337 - DNA, 22 bp, Homo sapiens
ccacctcccctatccacccagc

SEQ ID NO: 1654338 - DNA, 11 bp, Homo sapiens
ccacctcctcc

SEQ ID NO: 1654339 - DNA, 17 bp, Homo sapiens
ccacctcctccccctgt

SEQ ID NO: 1654340 - DNA, 22 bp, Homo sapiens
ccacctcctccccctgttctgt

SEQ ID NO: 1654341 - DNA, 17 bp, Homo sapiens
ccacctctccaagggct

SEQ ID NO: 1654342 - DNA, 14 bp, Homo sapiens
ccacctctctcctt

SEQ ID NO: 1654343 - DNA, 19 bp, Homo sapiens
ccacctctctcctttgctg

SEQ ID NO: 1654344 - DNA, 11 bp, Homo sapiens
ccacctctggt

SEQ ID NO: 1654345 - DNA, 20 bp, Homo sapiens
ccacctgacaatggcagcta

SEQ ID NO: 1654346 - DNA, 20 bp, Homo sapiens
ccacctgacacaccaggcgc

SEQ ID NO: 1654347 - DNA, 16 bp, Homo sapiens
ccacctgaggtgggcc

SEQ ID NO: 1654348 - DNA, 21 bp, Homo sapiens
ccacctgaggtgggctggggc

SEQ ID NO: 1654349 - DNA, 17 bp, Homo sapiens
ccacctgcaagatggac

SEQ ID NO: 1654350 - DNA, 12 bp, Homo sapiens
ccacctgccaca

SEQ ID NO: 1654351 - DNA, 23 bp, Homo sapiens
ccacctgcccatcacagggttgg

SEQ ID NO: 1654352 - DNA, 22 bp, Homo sapiens
ccacctgctgagagacccaagg

SEQ ID NO: 1654353 - DNA, 22 bp, Homo sapiens
ccacctggacgaagagcaggcc

SEQ ID NO: 1654354 - DNA, 21 bp, Homo sapiens
ccacctggatctatccctgcg

SEQ ID NO: 1654355 - DNA, 15 bp, Homo sapiens
ccacctggccacctg

SEQ ID NO: 1654356 - DNA, 21 bp, Homo sapiens
ccacctggtactccctctcag

SEQ ID NO: 1654357 - DNA, 11 bp, Homo sapiens
ccacctgtctc

SEQ ID NO: 1654358 - DNA, 18 bp, Homo sapiens
ccacctgtcttggcctcc

SEQ ID NO: 1654359 - DNA, 15 bp, Homo sapiens
ccacctgtgccctca

SEQ ID NO: 1654360 - DNA, 18 bp, Homo sapiens
ccacctgtgccctcacca

SEQ ID NO: 1654361 - DNA, 21 bp, Homo sapiens
ccacctgtgccctcaccacca

SEQ ID NO: 1654362 - DNA, 17 bp, Homo sapiens
ccacctgttttctgaaa

SEQ ID NO: 1654363 - DNA, 17 bp, Homo sapiens
ccaccttcaattcctgg

SEQ ID NO: 1654364 - DNA, 19 bp, Homo sapiens
ccaccttcaattcctgggc

SEQ ID NO: 1654365 - DNA, 20 bp, Homo sapiens
ccaccttcaattcctgggcc

SEQ ID NO: 1654366 - DNA, 11 bp, Homo sapiens
ccaccttccca

SEQ ID NO: 1654367 - DNA, 19 bp, Homo sapiens
ccaccttcccagctctccc

SEQ ID NO: 1654368 - DNA, 21 bp, Homo sapiens
ccaccttcccagctctccctc

SEQ ID NO: 1654369 - DNA, 12 bp, Homo sapiens
ccaccttccctt

SEQ ID NO: 1654370 - DNA, 15 bp, Homo sapiens
ccaccttggcctccc

SEQ ID NO: 1654371 - DNA, 17 bp, Homo sapiens
ccaccttgttggagcct

SEQ ID NO: 1654372 - DNA, 19 bp, Homo sapiens
ccaccttgttggagcctgc

SEQ ID NO: 1654373 - DNA, 14 bp, Homo sapiens
ccacctttactgtg

SEQ ID NO: 1654374 - DNA, 20 bp, Homo sapiens
ccacctttattaaaatctta

SEQ ID NO: 1654375 - DNA, 16 bp, Homo sapiens
ccacgaacgctcttag

SEQ ID NO: 1654376 - DNA, 13 bp, Homo sapiens
ccacgactgccat

SEQ ID NO: 1654377 - DNA, 12 bp, Homo sapiens
ccacgagggctg

SEQ ID NO: 1654378 - DNA, 20 bp, Homo sapiens
ccacgagggctggctggcct

SEQ ID NO: 1654379 - DNA, 14 bp, Homo sapiens
ccacgatcccctcc

SEQ ID NO: 1654380 - DNA, 15 bp, Homo sapiens
ccacgatcccctccc

SEQ ID NO: 1654381 - DNA, 20 bp, Homo sapiens
ccacgatgtggccctggcct

SEQ ID NO: 1654382 - DNA, 20 bp, Homo sapiens
ccacgcactgggccacggag

SEQ ID NO: 1654383 - DNA, 17 bp, Homo sapiens
ccacgcagccaggacac

SEQ ID NO: 1654384 - DNA, 16 bp, Homo sapiens
ccacgcagggccatcc

SEQ ID NO: 1654385 - DNA, 15 bp, Homo sapiens
ccacgcatacacaca

SEQ ID NO: 1654386 - DNA, 19 bp, Homo sapiens
ccacgcatacacacatgcc

SEQ ID NO: 1654387 - DNA, 15 bp, Homo sapiens
ccacgccccgtgtct

SEQ ID NO: 1654388 - DNA, 15 bp, Homo sapiens
ccacgcccgtcctgc

SEQ ID NO: 1654389 - DNA, 19 bp, Homo sapiens
ccacgcctcttgaccaggc

SEQ ID NO: 1654390 - DNA, 18 bp, Homo sapiens
ccacgcgggggccttgag

SEQ ID NO: 1654391 - DNA, 13 bp, Homo sapiens
ccacgctccagct

SEQ ID NO: 1654392 - DNA, 22 bp, Homo sapiens
ccacggagcagttcagagtgga

SEQ ID NO: 1654393 - DNA, 22 bp, Homo sapiens
ccacggaggagggatgctgctc

SEQ ID NO: 1654394 - DNA, 12 bp, Homo sapiens
ccacggccaccc

SEQ ID NO: 1654395 - DNA, 13 bp, Homo sapiens
ccacggccaccct

SEQ ID NO: 1654396 - DNA, 17 bp, Homo sapiens
ccacggccaccctcctt

SEQ ID NO: 1654397 - DNA, 18 bp, Homo sapiens
ccacggccccgggtccag

SEQ ID NO: 1654398 - DNA, 23 bp, Homo sapiens
ccacggccctgtcagagccgcca

SEQ ID NO: 1654399 - DNA, 20 bp, Homo sapiens
ccacggcgttgtacctgtag

SEQ ID NO: 1654400 - DNA, 22 bp, Homo sapiens
ccacgggacatcacagggtggg

SEQ ID NO: 1654401 - DNA, 17 bp, Homo sapiens
ccacgggggcagtgtga

SEQ ID NO: 1654402 - DNA, 16 bp, Homo sapiens
ccacggtctggaggcc

SEQ ID NO: 1654403 - DNA, 18 bp, Homo sapiens
ccacggtctggaggccga

SEQ ID NO: 1654404 - DNA, 19 bp, Homo sapiens
ccacggtgcgtggctgtgg

SEQ ID NO: 1654405 - DNA, 21 bp, Homo sapiens
ccacggtgcgtggctgtggca

SEQ ID NO: 1654406 - DNA, 14 bp, Homo sapiens
ccacgtcccagcat

SEQ ID NO: 1654407 - DNA, 15 bp, Homo sapiens
ccacgtcccagcatc

SEQ ID NO: 1654408 - DNA, 22 bp, Homo sapiens
ccacgtcccagcatccctggag

SEQ ID NO: 1654409 - DNA, 17 bp, Homo sapiens
ccacgtctgccaggccc

SEQ ID NO: 1654410 - DNA, 22 bp, Homo sapiens
ccacgtctggctccctgcccct

SEQ ID NO: 1654411 - DNA, 14 bp, Homo sapiens
ccacgtcttcctcc

SEQ ID NO: 1654412 - DNA, 17 bp, Homo sapiens
ccacgtgagagaatctg

SEQ ID NO: 1654413 - DNA, 21 bp, Homo sapiens
ccacgtgagagaatctgcctg

SEQ ID NO: 1654414 - DNA, 22 bp, Homo sapiens
ccacgtgagagaatctgcctgt

SEQ ID NO: 1654415 - DNA, 16 bp, Homo sapiens
ccacgtgccaggcccg

SEQ ID NO: 1654416 - DNA, 14 bp, Homo sapiens
ccacgtggatgggc

SEQ ID NO: 1654417 - DNA, 18 bp, Homo sapiens
ccacgtgtatagtatctg

SEQ ID NO: 1654418 - DNA, 20 bp, Homo sapiens
ccacgtgtatagtatctgta

SEQ ID NO: 1654419 - DNA, 20 bp, Homo sapiens
ccacgtgtccgtccaccctt

SEQ ID NO: 1654420 - DNA, 15 bp, Homo sapiens
ccacgttccttactg

SEQ ID NO: 1654421 - DNA, 16 bp, Homo sapiens
ccacgttctcacaccc

SEQ ID NO: 1654422 - DNA, 20 bp, Homo sapiens
ccacgttggagaagcccgtg

SEQ ID NO: 1654423 - DNA, 20 bp, Homo sapiens
ccactaaagcttcagactca

SEQ ID NO: 1654424 - DNA, 21 bp, Homo sapiens
ccactacactcaactaatttt

SEQ ID NO: 1654425 - DNA, 18 bp, Homo sapiens
ccactacactccagcctg

SEQ ID NO: 1654426 - DNA, 19 bp, Homo sapiens
ccactacactccagcctga

SEQ ID NO: 1654427 - DNA, 21 bp, Homo sapiens
ccactacactccagcctgagc

SEQ ID NO: 1654428 - DNA, 22 bp, Homo sapiens
ccactacatgcagcccatgccc

SEQ ID NO: 1654429 - DNA, 16 bp, Homo sapiens
ccactacccttctcct

SEQ ID NO: 1654430 - DNA, 23 bp, Homo sapiens
ccactacccttctcctttccttc

SEQ ID NO: 1654431 - DNA, 21 bp, Homo sapiens
ccactagaactctccatctta

SEQ ID NO: 1654432 - DNA, 14 bp, Homo sapiens
ccactagagggccc

SEQ ID NO: 1654433 - DNA, 15 bp, Homo sapiens
ccactagagggccca

SEQ ID NO: 1654434 - DNA, 16 bp, Homo sapiens
ccagatccagcctggg

SEQ ID NO: 1654435 - DNA, 13 bp, Homo sapiens
ccagatcctgggt

SEQ ID NO: 1654436 - DNA, 14 bp, Homo sapiens
ccagatctgcctgg

SEQ ID NO: 1654437 - DNA, 16 bp, Homo sapiens
ccagatctgcctgggc

SEQ ID NO: 1654438 - DNA, 13 bp, Homo sapiens
ccagatctggtcc

SEQ ID NO: 1654439 - DNA, 16 bp, Homo sapiens
ccagatctttcagaaa

SEQ ID NO: 1654440 - DNA, 18 bp, Homo sapiens
ccagatctttctcttccc

SEQ ID NO: 1654441 - DNA, 23 bp, Homo sapiens
ccagatgaggatccgaaacggca

SEQ ID NO: 1654442 - DNA, 13 bp, Homo sapiens
ccagatgcctccc

SEQ ID NO: 1654443 - DNA, 16 bp, Homo sapiens
ccagatgcctccccaa

SEQ ID NO: 1654444 - DNA, 19 bp, Homo sapiens
ccagatgctaggctgtctg

SEQ ID NO: 1654445 - DNA, 21 bp, Homo sapiens
ccagatgctctactttttcct

SEQ ID NO: 1654446 - DNA, 13 bp, Homo sapiens
ccagatgctgtca

SEQ ID NO: 1654447 - DNA, 12 bp, Homo sapiens
ccagatggcccc

SEQ ID NO: 1654448 - DNA, 17 bp, Homo sapiens
ccagatggtcatccaga

SEQ ID NO: 1654449 - DNA, 12 bp, Homo sapiens
ccagatggtttc

SEQ ID NO: 1654450 - DNA, 15 bp, Homo sapiens
ccagatggtttccta

SEQ ID NO: 1654451 - DNA, 19 bp, Homo sapiens
ccagatgttgttcctggct

SEQ ID NO: 1654452 - DNA, 17 bp, Homo sapiens
ccagatgtttccagact

SEQ ID NO: 1654453 - DNA, 12 bp, Homo sapiens
ccagatgttttg

SEQ ID NO: 1654454 - DNA, 17 bp, Homo sapiens
ccagattcccctgtgtc

SEQ ID NO: 1654455 - DNA, 18 bp, Homo sapiens
ccagattcccctgtgtca

SEQ ID NO: 1654456 - DNA, 15 bp, Homo sapiens
ccagattctgatgca

SEQ ID NO: 1654457 - DNA, 13 bp, Homo sapiens
ccagattcttcag

SEQ ID NO: 1654458 - DNA, 21 bp, Homo sapiens
ccagattgacgacaagtgctg

SEQ ID NO: 1654459 - DNA, 19 bp, Homo sapiens
ccagattggctcacactga

SEQ ID NO: 1654460 - DNA, 22 bp, Homo sapiens
ccagattggctcacactgagaa

SEQ ID NO: 1654461 - DNA, 14 bp, Homo sapiens
ccagcaacacagcc

SEQ ID NO: 1654462 - DNA, 20 bp, Homo sapiens
ccagcaacacagcctgggcc

SEQ ID NO: 1654463 - DNA, 13 bp, Homo sapiens
ccagcaacatctc

SEQ ID NO: 1654464 - DNA, 20 bp, Homo sapiens
ccagcaacatctcgagcccc

SEQ ID NO: 1654465 - DNA, 22 bp, Homo sapiens
ccagcaacatctcgagccccct

SEQ ID NO: 1654466 - DNA, 18 bp, Homo sapiens
ccagcaactgcccttcca

SEQ ID NO: 1654467 - DNA, 21 bp, Homo sapiens
ccagcaagaataaaaaagaaa

SEQ ID NO: 1654468 - DNA, 17 bp, Homo sapiens
ccagcaatgatgtccag

SEQ ID NO: 1654469 - DNA, 18 bp, Homo sapiens
ccagcaatgatgtccaga

SEQ ID NO: 1654470 - DNA, 23 bp, Homo sapiens
ccagcaattacaacggagtcaaa

SEQ ID NO: 1654471 - DNA, 12 bp, Homo sapiens
ccagcacagaag

SEQ ID NO: 1654472 - DNA, 15 bp, Homo sapiens
ccagcacaggggccc

SEQ ID NO: 1654473 - DNA, 24 bp, Homo sapiens
ccagcacaggggccccagatctgc

SEQ ID NO: 1654474 - DNA, 21 bp, Homo sapiens
ccagcacatccatcagcaccc

SEQ ID NO: 1654475 - DNA, 20 bp, Homo sapiens
ccagcacattatcttcatat

SEQ ID NO: 1654476 - DNA, 20 bp, Homo sapiens
ccagcaccacctacacagga

SEQ ID NO: 1654477 - DNA, 18 bp, Homo sapiens
ccagcactaaagcagtgg

SEQ ID NO: 1654478 - DNA, 13 bp, Homo sapiens
ccagcactcagcc

SEQ ID NO: 1654479 - DNA, 17 bp, Homo sapiens
ccagcactgaggaagaa

SEQ ID NO: 1654480 - DNA, 19 bp, Homo sapiens
ccagcactggaggggccca

SEQ ID NO: 1654481 - DNA, 21 bp, Homo sapiens
ccagcactggaggggcccacc

SEQ ID NO: 1654482 - DNA, 22 bp, Homo sapiens
ccagcactggaggggcccaccc

SEQ ID NO: 1654483 - DNA, 15 bp, Homo sapiens
ccagcactgtctcag

SEQ ID NO: 1654484 - DNA, 23 bp, Homo sapiens
ccagcactttgggaggccaagga

SEQ ID NO: 1654485 - DNA, 20 bp, Homo sapiens
ccagcactttgggaggccga

SEQ ID NO: 1654486 - DNA, 22 bp, Homo sapiens
ccagcagaagacaaaaagacaa

SEQ ID NO: 1654487 - DNA, 17 bp, Homo sapiens
ccagcagaatggaggca

SEQ ID NO: 1654488 - DNA, 12 bp, Homo sapiens
ccagcagacaga

SEQ ID NO: 1654489 - DNA, 22 bp, Homo sapiens
ccagcagaggcgtactacccag

SEQ ID NO: 1654490 - DNA, 14 bp, Homo sapiens
ccagcagcactgga

SEQ ID NO: 1654491 - DNA, 14 bp, Homo sapiens
ccagcagcagcagg

SEQ ID NO: 1654492 - DNA, 15 bp, Homo sapiens
ccagcagcagcccaa

SEQ ID NO: 1654493 - DNA, 23 bp, Homo sapiens
ccagcagcagcccaagcttccct

SEQ ID NO: 1654494 - DNA, 12 bp, Homo sapiens
ccagcagcatgg

SEQ ID NO: 1654495 - DNA, 20 bp, Homo sapiens
ccagcagccagctctcagcc

SEQ ID NO: 1654496 - DNA, 21 bp, Homo sapiens
ccagcagccagctctcagcca

SEQ ID NO: 1654497 - DNA, 19 bp, Homo sapiens
ccagcagcctcgcacaggc

SEQ ID NO: 1654498 - DNA, 18 bp, Homo sapiens
ccagcagcgcgcaggcct

SEQ ID NO: 1654499 - DNA, 12 bp, Homo sapiens
ccagcagctgcg

SEQ ID NO: 1654500 - DNA, 24 bp, Homo sapiens
ccagcagctgcgggtctgaaggaa

SEQ ID NO: 1654501 - DNA, 15 bp, Homo sapiens
ccagcagctgtcaga

SEQ ID NO: 1654502 - DNA, 22 bp, Homo sapiens
ccagcaggaggttctgggcctc

SEQ ID NO: 1654503 - DNA, 22 bp, Homo sapiens
ccagcaggccagggactcagcg

SEQ ID NO: 1654504 - DNA, 11 bp, Homo sapiens
ccagcaggccc

SEQ ID NO: 1654505 - DNA, 18 bp, Homo sapiens
ccagcaggcccagcatgc

SEQ ID NO: 1654506 - DNA, 21 bp, Homo sapiens
ccagcaggcccagcatgcagg

SEQ ID NO: 1654507 - DNA, 23 bp, Homo sapiens
ccagcaggcgtcaccatccacct

SEQ ID NO: 1654508 - DNA, 16 bp, Homo sapiens
ccagcaggggggctgt

SEQ ID NO: 1654509 - DNA, 23 bp, Homo sapiens
ccagcaggggggctgtgccaacc

SEQ ID NO: 1654510 - DNA, 13 bp, Homo sapiens
ccagcaggtgtgg

SEQ ID NO: 1654511 - DNA, 15 bp, Homo sapiens
ccagcagttgttcca

SEQ ID NO: 1654512 - DNA, 15 bp, Homo sapiens
ccagcagtttgggag

SEQ ID NO: 1654513 - DNA, 16 bp, Homo sapiens
ccagcatcacctgcct

SEQ ID NO: 1654514 - DNA, 17 bp, Homo sapiens
ccagcatcacctgcctg

SEQ ID NO: 1654515 - DNA, 23 bp, Homo sapiens
ccagcatccctggagcaggagcc

SEQ ID NO: 1654516 - DNA, 14 bp, Homo sapiens
ccagcatcccttct

SEQ ID NO: 1654517 - DNA, 15 bp, Homo sapiens
ccagcattcagcaca

SEQ ID NO: 1654518 - DNA, 14 bp, Homo sapiens
ccagcattccagcc

SEQ ID NO: 1654519 - DNA, 15 bp, Homo sapiens
ccagcattccagccc

SEQ ID NO: 1654520 - DNA, 21 bp, Homo sapiens
ccagcattccagcccctctgg

SEQ ID NO: 1654521 - DNA, 22 bp, Homo sapiens
ccagcattccagcccctctggt

SEQ ID NO: 1654522 - DNA, 17 bp, Homo sapiens
ccagcattccagctctg

SEQ ID NO: 1654523 - DNA, 19 bp, Homo sapiens
ccagcattccagctctgcc

SEQ ID NO: 1654524 - DNA, 23 bp, Homo sapiens
ccagcattccagctctgcccccg

SEQ ID NO: 1654525 - DNA, 17 bp, Homo sapiens
ccagcattgctggttct

SEQ ID NO: 1654526 - DNA, 20 bp, Homo sapiens
ccagcatttaagtgaccttc

SEQ ID NO: 1654527 - DNA, 17 bp, Homo sapiens
ccagcatttagctggcc

SEQ ID NO: 1654528 - DNA, 23 bp, Homo sapiens
ccagcatttggttttacacagga

SEQ ID NO: 1654529 - DNA, 15 bp, Homo sapiens
ccagccacagacccc

SEQ ID NO: 1654530 - DNA, 17 bp, Homo sapiens
ccagccacagacccctg

SEQ ID NO: 1654531 - DNA, 18 bp, Homo sapiens
ccagccacagacccctgg

SEQ ID NO: 1654532 - DNA, 19 bp, Homo sapiens
ccagccacagacccctggg

SEQ ID NO: 1654533 - DNA, 20 bp, Homo sapiens
ccagccacagacccctggga

SEQ ID NO: 1654534 - DNA, 22 bp, Homo sapiens
ccagccacagacccctgggagc

SEQ ID NO: 1654535 - DNA, 23 bp, Homo sapiens
ccagccacagacccctgggagct

SEQ ID NO: 1654536 - DNA, 12 bp, Homo sapiens
ccagccacaggc

SEQ ID NO: 1654537 - DNA, 14 bp, Homo sapiens
ccagccacaggcca

SEQ ID NO: 1654538 - DNA, 20 bp, Homo sapiens
ccagccacagtacatatgta

SEQ ID NO: 1654539 - DNA, 21 bp, Homo sapiens
ccagccaccccgggctctctg

SEQ ID NO: 1654540 - DNA, 22 bp, Homo sapiens
ccagccaccccgggctctctgc

SEQ ID NO: 1654541 - DNA, 17 bp, Homo sapiens
ccagccacgactgccat

SEQ ID NO: 1654542 - DNA, 13 bp, Homo sapiens
ccagccagaagcc

SEQ ID NO: 1654543 - DNA, 21 bp, Homo sapiens
ccagccagaagcctctgcctc

SEQ ID NO: 1654544 - DNA, 14 bp, Homo sapiens
ccagccagacccca

SEQ ID NO: 1654545 - DNA, 22 bp, Homo sapiens
ccagccagcaatgatgtccaga

SEQ ID NO: 1654546 - DNA, 15 bp, Homo sapiens
ccagccagcagccag

SEQ ID NO: 1654547 - DNA, 19 bp, Homo sapiens
ccagccagcagccagctct

SEQ ID NO: 1654548 - DNA, 22 bp, Homo sapiens
ccagctgggctctgccacccta

SEQ ID NO: 1654549 - DNA, 16 bp, Homo sapiens
ccagctggggcgtggg

SEQ ID NO: 1654550 - DNA, 20 bp, Homo sapiens
ccagctggggcgtggggagg

SEQ ID NO: 1654551 - DNA, 16 bp, Homo sapiens
ccagctgtagccatgg

SEQ ID NO: 1654552 - DNA, 17 bp, Homo sapiens
ccagctgtagccatggc

SEQ ID NO: 1654553 - DNA, 22 bp, Homo sapiens
ccagctgtagccatggctcagg

SEQ ID NO: 1654554 - DNA, 16 bp, Homo sapiens
ccagcttaatagctgt

SEQ ID NO: 1654555 - DNA, 13 bp, Homo sapiens
ccagcttccaaag

SEQ ID NO: 1654556 - DNA, 14 bp, Homo sapiens
ccagcttccaaagc

SEQ ID NO: 1654557 - DNA, 14 bp, Homo sapiens
ccagcttcctggtg

SEQ ID NO: 1654558 - DNA, 14 bp, Homo sapiens
ccagcttctctctc

SEQ ID NO: 1654559 - DNA, 16 bp, Homo sapiens
ccagcttggggccacc

SEQ ID NO: 1654560 - DNA, 19 bp, Homo sapiens
ccagcttggggccaccaaa

SEQ ID NO: 1654561 - DNA, 14 bp, Homo sapiens
ccagctttccctgc

SEQ ID NO: 1654562 - DNA, 20 bp, Homo sapiens
ccagctttgctaccaaagca

SEQ ID NO: 1654563 - DNA, 17 bp, Homo sapiens
ccagcttttactgtttt

SEQ ID NO: 1654564 - DNA, 12 bp, Homo sapiens
ccaggaaaaaat

SEQ ID NO: 1654565 - DNA, 22 bp, Homo sapiens
ccaggaaaggcttggctggtgt

SEQ ID NO: 1654566 - DNA, 11 bp, Homo sapiens
ccaggaagccg

SEQ ID NO: 1654567 - DNA, 22 bp, Homo sapiens
ccaggaagccgtcctggcgcct

SEQ ID NO: 1654568 - DNA, 12 bp, Homo sapiens
ccaggaaggcag

SEQ ID NO: 1654569 - DNA, 19 bp, Homo sapiens
ccaggaaggcagctgctct

SEQ ID NO: 1654570 - DNA, 20 bp, Homo sapiens
ccaggaaggcagctgctctt

SEQ ID NO: 1654571 - DNA, 20 bp, Homo sapiens
ccaggaatattgtcatcctt

SEQ ID NO: 1654572 - DNA, 18 bp, Homo sapiens
ccaggacactaccctgag

SEQ ID NO: 1654573 - DNA, 13 bp, Homo sapiens
ccaggacaggacc

SEQ ID NO: 1654574 - DNA, 13 bp, Homo sapiens
ccaggacaggccc

SEQ ID NO: 1654575 - DNA, 20 bp, Homo sapiens
ccaggacatgcaataaaatt

SEQ ID NO: 1654576 - DNA, 23 bp, Homo sapiens
ccaggacatgcaataaaatttaa

SEQ ID NO: 1654577 - DNA, 18 bp, Homo sapiens
ccaggaccagcctgtacc

SEQ ID NO: 1654578 - DNA, 17 bp, Homo sapiens
ccaggacccgccagccc

SEQ ID NO: 1654579 - DNA, 14 bp, Homo sapiens
ccaggaccctgaag

SEQ ID NO: 1654580 - DNA, 18 bp, Homo sapiens
ccaggaccctgaaggggc

SEQ ID NO: 1654581 - DNA, 19 bp, Homo sapiens
ccaggaccctgaaggggcc

SEQ ID NO: 1654582 - DNA, 16 bp, Homo sapiens
ccaggacgaattgaga

SEQ ID NO: 1654583 - DNA, 20 bp, Homo sapiens
ccaggactatatttgggcct

SEQ ID NO: 1654584 - DNA, 21 bp, Homo sapiens
ccaggactatatttgggcctg

SEQ ID NO: 1654585 - DNA, 16 bp, Homo sapiens
ccaggactcaccctca

SEQ ID NO: 1654586 - DNA, 12 bp, Homo sapiens
ccaggactgggc

SEQ ID NO: 1654587 - DNA, 14 bp, Homo sapiens
ccaggactgggcca

SEQ ID NO: 1654588 - DNA, 14 bp, Homo sapiens
ccaggactgggtct

SEQ ID NO: 1654589 - DNA, 22 bp, Homo sapiens
ccaggactgggtctgacctggt

SEQ ID NO: 1654590 - DNA, 19 bp, Homo sapiens
ccaggagaaccactacatg

SEQ ID NO: 1654591 - DNA, 23 bp, Homo sapiens
ccaggagaaccactacatgcagc

SEQ ID NO: 1654592 - DNA, 11 bp, Homo sapiens
ccaggagaagc

SEQ ID NO: 1654593 - DNA, 17 bp, Homo sapiens
ccaggagaagctcagct

SEQ ID NO: 1654594 - DNA, 18 bp, Homo sapiens
ccaggagaagctcagctg

SEQ ID NO: 1654595 - DNA, 20 bp, Homo sapiens
ccaggagaagggctggggcc

SEQ ID NO: 1654596 - DNA, 21 bp, Homo sapiens
ccaggagaagggggctctgcc

SEQ ID NO: 1654597 - DNA, 20 bp, Homo sapiens
ccaggagaagtgctccctgg

SEQ ID NO: 1654598 - DNA, 21 bp, Homo sapiens
ccaggagaagtgctccctgga

SEQ ID NO: 1654599 - DNA, 23 bp, Homo sapiens
ccaggagaagtgctccctggagg

SEQ ID NO: 1654600 - DNA, 16 bp, Homo sapiens
ccaggagacctccagc

SEQ ID NO: 1654601 - DNA, 19 bp, Homo sapiens
ccaggagacctgctctccg

SEQ ID NO: 1654602 - DNA, 17 bp, Homo sapiens
ccaggagagagccagga

SEQ ID NO: 1654603 - DNA, 13 bp, Homo sapiens
ccaggagagccag

SEQ ID NO: 1654604 - DNA, 16 bp, Homo sapiens
ccaggagagccagccc

SEQ ID NO: 1654605 - DNA, 20 bp, Homo sapiens
ccaggagagccagccctccc

SEQ ID NO: 1654606 - DNA, 13 bp, Homo sapiens
ccaggagcagaag

SEQ ID NO: 1654607 - DNA, 17 bp, Homo sapiens
ccaggagcagcagccag

SEQ ID NO: 1654608 - DNA, 18 bp, Homo sapiens
ccaggagcagcagccagc

SEQ ID NO: 1654609 - DNA, 19 bp, Homo sapiens
ccaggagcagcagccagca

SEQ ID NO: 1654610 - DNA, 13 bp, Homo sapiens
ccaggagcagctt

SEQ ID NO: 1654611 - DNA, 23 bp, Homo sapiens
ccaggagcagcttttggtctcct

SEQ ID NO: 1654612 - DNA, 21 bp, Homo sapiens
ccaggagccgggcctcccacc

SEQ ID NO: 1654613 - DNA, 20 bp, Homo sapiens
ccaggagcctaccccctgaa

SEQ ID NO: 1654614 - DNA, 19 bp, Homo sapiens
ccaggagctagcccagtcc

SEQ ID NO: 1654615 - DNA, 15 bp, Homo sapiens
ccaggagctctgcgc

SEQ ID NO: 1654616 - DNA, 21 bp, Homo sapiens
ccaggagctcttcaggcctcc

SEQ ID NO: 1654617 - DNA, 22 bp, Homo sapiens
ccaggagctgagtcacctcctc

SEQ ID NO: 1654618 - DNA, 18 bp, Homo sapiens
ccaggagctgatggcagc

SEQ ID NO: 1654619 - DNA, 15 bp, Homo sapiens
ccaggaggcagtgga

SEQ ID NO: 1654620 - DNA, 17 bp, Homo sapiens
ccaggaggcagtggaca

SEQ ID NO: 1654621 - DNA, 19 bp, Homo sapiens
ccaggaggcagtggacatc

SEQ ID NO: 1654622 - DNA, 23 bp, Homo sapiens
ccaggaggccgagtggctgccgg

SEQ ID NO: 1654623 - DNA, 22 bp, Homo sapiens
ccaggaggtggctatggccacc

SEQ ID NO: 1654624 - DNA, 20 bp, Homo sapiens
ccaggaggttggtgactgaa

SEQ ID NO: 1654625 - DNA, 15 bp, Homo sapiens
ccaggagtaagacaa

SEQ ID NO: 1654626 - DNA, 14 bp, Homo sapiens
ccaggagtctgtgc

SEQ ID NO: 1654627 - DNA, 23 bp, Homo sapiens
ccaggagtttaagaccagcctgg

SEQ ID NO: 1654628 - DNA, 19 bp, Homo sapiens
ccaggagtttgaggctgca

SEQ ID NO: 1654629 - DNA, 22 bp, Homo sapiens
ccaggagtttgaggctgcagcg

SEQ ID NO: 1654630 - DNA, 17 bp, Homo sapiens
ccaggatactggcacag

SEQ ID NO: 1654631 - DNA, 17 bp, Homo sapiens
ccaggatatctgaaaat

SEQ ID NO: 1654632 - DNA, 19 bp, Homo sapiens
ccaggatatctgaaaatat

SEQ ID NO: 1654633 - DNA, 14 bp, Homo sapiens
ccaggatcactctc

SEQ ID NO: 1654634 - DNA, 20 bp, Homo sapiens
ccaggatcactctctgctgg

SEQ ID NO: 1654635 - DNA, 19 bp, Homo sapiens
ccaggatcccaagcctcct

SEQ ID NO: 1654636 - DNA, 14 bp, Homo sapiens
ccaggatcctgcag

SEQ ID NO: 1654637 - DNA, 16 bp, Homo sapiens
ccaggatcctgcagga

SEQ ID NO: 1654638 - DNA, 17 bp, Homo sapiens
ccaggatctgctccaac

SEQ ID NO: 1654639 - DNA, 19 bp, Homo sapiens
ccaggatctttgactgaaa

SEQ ID NO: 1654640 - DNA, 22 bp, Homo sapiens
ccaggatgccacgcctggaagg

SEQ ID NO: 1654641 - DNA, 23 bp, Homo sapiens
ccaggatgccacgcctggaaggg

SEQ ID NO: 1654642 - DNA, 14 bp, Homo sapiens
ccaggatgcccaga

SEQ ID NO: 1654643 - DNA, 20 bp, Homo sapiens
ccaggatgctaaagatgatg

SEQ ID NO: 1654644 - DNA, 21 bp, Homo sapiens
ccaggatgctaaagatgatga

SEQ ID NO: 1654645 - DNA, 14 bp, Homo sapiens
ccaggatggagggg

SEQ ID NO: 1654646 - DNA, 20 bp, Homo sapiens
ccaggatggtctcgatctcc

SEQ ID NO: 1654647 - DNA, 22 bp, Homo sapiens
ccaggatggtctcgatctcctg

SEQ ID NO: 1654648 - DNA, 20 bp, Homo sapiens
ccaggattaatctctaaaat

SEQ ID NO: 1654649 - DNA, 20 bp, Homo sapiens
ccaggattttaacaaaagca

SEQ ID NO: 1654650 - DNA, 14 bp, Homo sapiens
ccaggcaacctccc

SEQ ID NO: 1654651 - DNA, 17 bp, Homo sapiens
ccaggcaacctcccatc

SEQ ID NO: 1654652 - DNA, 20 bp, Homo sapiens
ccaggcaacctcccatccca

SEQ ID NO: 1654653 - DNA, 13 bp, Homo sapiens
ccaggcacagggc

SEQ ID NO: 1654654 - DNA, 18 bp, Homo sapiens
ccaggcacagggcccgca

SEQ ID NO: 1654655 - DNA, 19 bp, Homo sapiens
ccaggcacagggcccgcag

SEQ ID NO: 1654656 - DNA, 17 bp, Homo sapiens
ccaggcaccaccaggag

SEQ ID NO: 1654657 - DNA, 19 bp, Homo sapiens
ccaggcaccaccaggagca

SEQ ID NO: 1654658 - DNA, 13 bp, Homo sapiens
ccaggcacctggc

SEQ ID NO: 1654659 - DNA, 16 bp, Homo sapiens
ccaggcacctggcctg

SEQ ID NO: 1654660 - DNA, 21 bp, Homo sapiens
ccaggcacgaacccacctgct

SEQ ID NO: 1654661 - DNA, 16 bp, Homo sapiens
ccaggcacggtttgga

SEQ ID NO: 1654662 - DNA, 14 bp, Homo sapiens
ccagttaaagccac

SEQ ID NO: 1654663 - DNA, 23 bp, Homo sapiens
ccagttaaagtagatcacctcct

SEQ ID NO: 1654664 - DNA, 13 bp, Homo sapiens
ccagttaaggacc

SEQ ID NO: 1654665 - DNA, 21 bp, Homo sapiens
ccagttaaggaccgtggccct

SEQ ID NO: 1654666 - DNA, 22 bp, Homo sapiens
ccagttaaggaccgtggccctg

SEQ ID NO: 1654667 - DNA, 22 bp, Homo sapiens
ccagttaatactccagagacag

SEQ ID NO: 1654668 - DNA, 14 bp, Homo sapiens
ccagttatggctat

SEQ ID NO: 1654669 - DNA, 15 bp, Homo sapiens
ccagttcaaagtgta

SEQ ID NO: 1654670 - DNA, 14 bp, Homo sapiens
ccagttcaggagtc

SEQ ID NO: 1654671 - DNA, 14 bp, Homo sapiens
ccagttgcctttta

SEQ ID NO: 1654672 - DNA, 12 bp, Homo sapiens
ccagttgggact

SEQ ID NO: 1654673 - DNA, 18 bp, Homo sapiens
ccagttgggactcaggat

SEQ ID NO: 1654674 - DNA, 17 bp, Homo sapiens
ccagttgtgttgacaca

SEQ ID NO: 1654675 - DNA, 19 bp, Homo sapiens
ccagtttatggatatgctg

SEQ ID NO: 1654676 - DNA, 20 bp, Homo sapiens
ccagtttatggatatgctgc

SEQ ID NO: 1654677 - DNA, 14 bp, Homo sapiens
ccagtttctttccc

SEQ ID NO: 1654678 - DNA, 17 bp, Homo sapiens
ccagtttgcacctgtcc

SEQ ID NO: 1654679 - DNA, 23 bp, Homo sapiens
ccagtttgcagaaaagcacctgc

SEQ ID NO: 1654680 - DNA, 22 bp, Homo sapiens
ccagtttgggtaaaatactttt

SEQ ID NO: 1654681 - DNA, 15 bp, Homo sapiens
ccagttttccctgga

SEQ ID NO: 1654682 - DNA, 23 bp, Homo sapiens
ccagtttttgtttttgcatgaaa

SEQ ID NO: 1654683 - DNA, 15 bp, Homo sapiens
ccataaaagaagttt

SEQ ID NO: 1654684 - DNA, 22 bp, Homo sapiens
ccataaacagcacacctgtgtc

SEQ ID NO: 1654685 - DNA, 16 bp, Homo sapiens
ccataaactaagagaa

SEQ ID NO: 1654686 - DNA, 19 bp, Homo sapiens
ccataaactaagagaaact

SEQ ID NO: 1654687 - DNA, 20 bp, Homo sapiens
ccataaactaagagaaactg

SEQ ID NO: 1654688 - DNA, 21 bp, Homo sapiens
ccataaagacaatcactgcca

SEQ ID NO: 1654689 - DNA, 18 bp, Homo sapiens
ccataaatttggactgtc

SEQ ID NO: 1654690 - DNA, 17 bp, Homo sapiens
ccataagacaaacactg

SEQ ID NO: 1654691 - DNA, 15 bp, Homo sapiens
ccataaggaatgtag

SEQ ID NO: 1654692 - DNA, 20 bp, Homo sapiens
ccataattgctttgccaaaa

SEQ ID NO: 1654693 - DNA, 21 bp, Homo sapiens
ccataattttcttcatgcaat

SEQ ID NO: 1654694 - DNA, 23 bp, Homo sapiens
ccataattttcttcatgcaatga

SEQ ID NO: 1654695 - DNA, 13 bp, Homo sapiens
ccatacaatgtat

SEQ ID NO: 1654696 - DNA, 21 bp, Homo sapiens
ccatacaatgtatgtacaata

SEQ ID NO: 1654697 - DNA, 19 bp, Homo sapiens
ccatactcaagctgtctct

SEQ ID NO: 1654698 - DNA, 14 bp, Homo sapiens
ccatacttctctca

SEQ ID NO: 1654699 - DNA, 16 bp, Homo sapiens
ccatacttttggctcc

SEQ ID NO: 1654700 - DNA, 22 bp, Homo sapiens
ccatacttttggctcctctagt

SEQ ID NO: 1654701 - DNA, 13 bp, Homo sapiens
ccatagaaacatg

SEQ ID NO: 1654702 - DNA, 18 bp, Homo sapiens
ccatagaaacatgacact

SEQ ID NO: 1654703 - DNA, 20 bp, Homo sapiens
ccatagaaacatgacactga

SEQ ID NO: 1654704 - DNA, 21 bp, Homo sapiens
ccatagaaacatgacactgac

SEQ ID NO: 1654705 - DNA, 16 bp, Homo sapiens
ccatagacatgaaagg

SEQ ID NO: 1654706 - DNA, 15 bp, Homo sapiens
ccatagaggcccagg

SEQ ID NO: 1654707 - DNA, 17 bp, Homo sapiens
ccatagaggcccaggca

SEQ ID NO: 1654708 - DNA, 19 bp, Homo sapiens
ccatagaggcccaggcacc

SEQ ID NO: 1654709 - DNA, 17 bp, Homo sapiens
ccatagatcttctgaaa

SEQ ID NO: 1654710 - DNA, 21 bp, Homo sapiens
ccatagatcttctgaaatgaa

SEQ ID NO: 1654711 - DNA, 14 bp, Homo sapiens
ccatagcaacagga

SEQ ID NO: 1654712 - DNA, 15 bp, Homo sapiens
ccatagtcacatggc

SEQ ID NO: 1654713 - DNA, 21 bp, Homo sapiens
ccatagtggatcactcaccat

SEQ ID NO: 1654714 - DNA, 13 bp, Homo sapiens
ccatagtggggcc

SEQ ID NO: 1654715 - DNA, 18 bp, Homo sapiens
ccatagtggggcctggga

SEQ ID NO: 1654716 - DNA, 20 bp, Homo sapiens
ccatagtggggcctgggagg

SEQ ID NO: 1654717 - DNA, 16 bp, Homo sapiens
ccatagtgtcacagag

SEQ ID NO: 1654718 - DNA, 18 bp, Homo sapiens
ccatagttactgtaaaat

SEQ ID NO: 1654719 - DNA, 15 bp, Homo sapiens
ccatataagtttgaa

SEQ ID NO: 1654720 - DNA, 23 bp, Homo sapiens
ccatataagtttgaaggaaacag

SEQ ID NO: 1654721 - DNA, 19 bp, Homo sapiens
ccatatcagaactgtgcca

SEQ ID NO: 1654722 - DNA, 18 bp, Homo sapiens
ccatatcagctctctgca

SEQ ID NO: 1654723 - DNA, 14 bp, Homo sapiens
ccatatctccttcc

SEQ ID NO: 1654724 - DNA, 12 bp, Homo sapiens
ccatatgaattg

SEQ ID NO: 1654725 - DNA, 14 bp, Homo sapiens
ccatatgaattgta

SEQ ID NO: 1654726 - DNA, 15 bp, Homo sapiens
ccatatgctccagga

SEQ ID NO: 1654727 - DNA, 22 bp, Homo sapiens
ccatatgctccaggatctttga

SEQ ID NO: 1654728 - DNA, 14 bp, Homo sapiens
ccatattggccagt

SEQ ID NO: 1654729 - DNA, 14 bp, Homo sapiens
ccatattgtaaaac

SEQ ID NO: 1654730 - DNA, 21 bp, Homo sapiens
ccatatttaataatgctttaa

SEQ ID NO: 1654731 - DNA, 22 bp, Homo sapiens
ccatcaagaacctacagactcc

SEQ ID NO: 1654732 - DNA, 18 bp, Homo sapiens
ccatcaagcacttcccag

SEQ ID NO: 1654733 - DNA, 20 bp, Homo sapiens
ccatcaccaccgcctctggc

SEQ ID NO: 1654734 - DNA, 15 bp, Homo sapiens
ccatcacccaagcca

SEQ ID NO: 1654735 - DNA, 18 bp, Homo sapiens
ccatcaccctcttcctgt

SEQ ID NO: 1654736 - DNA, 16 bp, Homo sapiens
ccatcacgcctgtgca

SEQ ID NO: 1654737 - DNA, 14 bp, Homo sapiens
ccatcactggagca

SEQ ID NO: 1654738 - DNA, 19 bp, Homo sapiens
ccatcactggtccaggtct

SEQ ID NO: 1654739 - DNA, 24 bp, Homo sapiens
ccatcagctgtaagaagagactgg

SEQ ID NO: 1654740 - DNA, 20 bp, Homo sapiens
ccatcaggaccactcagtta

SEQ ID NO: 1654741 - DNA, 16 bp, Homo sapiens
ccatcagttcccccag

SEQ ID NO: 1654742 - DNA, 14 bp, Homo sapiens
ccatcatcactgta

SEQ ID NO: 1654743 - DNA, 15 bp, Homo sapiens
ccatcatcactgtaa

SEQ ID NO: 1654744 - DNA, 20 bp, Homo sapiens
ccatcatcactgtaaagaca

SEQ ID NO: 1654745 - DNA, 14 bp, Homo sapiens
ccatcatgtctgta

SEQ ID NO: 1654746 - DNA, 22 bp, Homo sapiens
ccatcatgtttacagaggacag

SEQ ID NO: 1654747 - DNA, 14 bp, Homo sapiens
ccatcatgtttcag

SEQ ID NO: 1654748 - DNA, 17 bp, Homo sapiens
ccatcattataaacgtg

SEQ ID NO: 1654749 - DNA, 12 bp, Homo sapiens
ccatcatttctg

SEQ ID NO: 1654750 - DNA, 15 bp, Homo sapiens
ccatccaaggccagg

SEQ ID NO: 1654751 - DNA, 11 bp, Homo sapiens
ccatccagcct

SEQ ID NO: 1654752 - DNA, 14 bp, Homo sapiens
ccatccagcctcca

SEQ ID NO: 1654753 - DNA, 16 bp, Homo sapiens
ccatccagcctccagg

SEQ ID NO: 1654754 - DNA, 13 bp, Homo sapiens
ccatccagtgggc

SEQ ID NO: 1654755 - DNA, 15 bp, Homo sapiens
ccatccagtgggccc

SEQ ID NO: 1654756 - DNA, 14 bp, Homo sapiens
ccatcccacaccct

SEQ ID NO: 1654757 - DNA, 19 bp, Homo sapiens
ccatccccctgccctcgtg

SEQ ID NO: 1654758 - DNA, 17 bp, Homo sapiens
ccatcccctatggacca

SEQ ID NO: 1654759 - DNA, 16 bp, Homo sapiens
ccatcccgaaaatctc

SEQ ID NO: 1654760 - DNA, 20 bp, Homo sapiens
ccatcccgaagccatcactt

SEQ ID NO: 1654761 - DNA, 18 bp, Homo sapiens
ccatccctcggacccacc

SEQ ID NO: 1654762 - DNA, 20 bp, Homo sapiens
ccatcccttcggagccaaca

SEQ ID NO: 1654763 - DNA, 12 bp, Homo sapiens
ccatcctgacca

SEQ ID NO: 1654764 - DNA, 12 bp, Homo sapiens
ccatcctgactg

SEQ ID NO: 1654765 - DNA, 18 bp, Homo sapiens
ccatcctgcagcctcctc

SEQ ID NO: 1654766 - DNA, 14 bp, Homo sapiens
ccatcctggagggc

SEQ ID NO: 1654767 - DNA, 12 bp, Homo sapiens
ccatcctggccc

SEQ ID NO: 1654768 - DNA, 15 bp, Homo sapiens
ccatcctggggcagc

SEQ ID NO: 1654769 - DNA, 16 bp, Homo sapiens
ccatcgctgtgtgtta

SEQ ID NO: 1654770 - DNA, 18 bp, Homo sapiens
ccatcgtgaagaagcctg

SEQ ID NO: 1654771 - DNA, 17 bp, Homo sapiens
ccatctagtacttgaaa

SEQ ID NO: 1654772 - DNA, 20 bp, Homo sapiens
ccatctatgtcccttgctgt

SEQ ID NO: 1654773 - DNA, 22 bp, Homo sapiens
ccatctatgtcccttgctgtga

SEQ ID NO: 1654774 - DNA, 16 bp, Homo sapiens
ccatctcaaaacaaaa

SEQ ID NO: 1654775 - DNA, 21 bp, Homo sapiens
ccatctcaggacacttccgta

SEQ ID NO: 1654776 - DNA, 13 bp, Homo sapiens
ccatctcaggaga

SEQ ID NO: 1654777 - DNA, 14 bp, Homo sapiens
cccaagccccatct

SEQ ID NO: 1654778 - DNA, 15 bp, Homo sapiens
cccaagccccatctc

SEQ ID NO: 1654779 - DNA, 20 bp, Homo sapiens
cccaagccccatctcatcct

SEQ ID NO: 1654780 - DNA, 19 bp, Homo sapiens
cccaagcctgatccagcct

SEQ ID NO: 1654781 - DNA, 15 bp, Homo sapiens
cccaagcctgctggc

SEQ ID NO: 1654782 - DNA, 22 bp, Homo sapiens
cccaagccttcgggcgtctgtg

SEQ ID NO: 1654783 - DNA, 20 bp, Homo sapiens
cccaagcgttcctggccttc

SEQ ID NO: 1654784 - DNA, 16 bp, Homo sapiens
cccaagctgcctctgg

SEQ ID NO: 1654785 - DNA, 14 bp, Homo sapiens
cccaagctgtggca

SEQ ID NO: 1654786 - DNA, 18 bp, Homo sapiens
cccaagctgtggcagccg

SEQ ID NO: 1654787 - DNA, 19 bp, Homo sapiens
cccaaggaaagccccagca

SEQ ID NO: 1654788 - DNA, 22 bp, Homo sapiens
cccaaggaaagccccagcacta

SEQ ID NO: 1654789 - DNA, 18 bp, Homo sapiens
cccaaggactgagggcag

SEQ ID NO: 1654790 - DNA, 12 bp, Homo sapiens
cccaaggagctg

SEQ ID NO: 1654791 - DNA, 22 bp, Homo sapiens
cccaaggagctgatttccaggc

SEQ ID NO: 1654792 - DNA, 11 bp, Homo sapiens
cccaaggccag

SEQ ID NO: 1654793 - DNA, 18 bp, Homo sapiens
cccaaggcctctctctgc

SEQ ID NO: 1654794 - DNA, 20 bp, Homo sapiens
cccaaggcctctctctgcct

SEQ ID NO: 1654795 - DNA, 21 bp, Homo sapiens
cccaagggacagcaagtgagc

SEQ ID NO: 1654796 - DNA, 16 bp, Homo sapiens
cccaagggccctggca

SEQ ID NO: 1654797 - DNA, 19 bp, Homo sapiens
cccaagggtgccctttggg

SEQ ID NO: 1654798 - DNA, 17 bp, Homo sapiens
cccaaggtcctctcagt

SEQ ID NO: 1654799 - DNA, 17 bp, Homo sapiens
cccaagtatgccttaag

SEQ ID NO: 1654800 - DNA, 22 bp, Homo sapiens
cccaagtatgccttaagcagaa

SEQ ID NO: 1654801 - DNA, 23 bp, Homo sapiens
cccaagtccctgttttctgagcc

SEQ ID NO: 1654802 - DNA, 15 bp, Homo sapiens
cccaagtgccagtct

SEQ ID NO: 1654803 - DNA, 21 bp, Homo sapiens
cccaagtttccatagcaacag

SEQ ID NO: 1654804 - DNA, 15 bp, Homo sapiens
cccaataaaggcagc

SEQ ID NO: 1654805 - DNA, 20 bp, Homo sapiens
cccaataaaggcagctgcct

SEQ ID NO: 1654806 - DNA, 22 bp, Homo sapiens
cccaataaaggcagctgcctct

SEQ ID NO: 1654807 - DNA, 23 bp, Homo sapiens
cccaataaaggtcccttagcccc

SEQ ID NO: 1654808 - DNA, 16 bp, Homo sapiens
cccaatagctctactg

SEQ ID NO: 1654809 - DNA, 19 bp, Homo sapiens
cccaatagctctactgccc

SEQ ID NO: 1654810 - DNA, 20 bp, Homo sapiens
cccaatagctctactgccct

SEQ ID NO: 1654811 - DNA, 17 bp, Homo sapiens
cccaatattataatttt

SEQ ID NO: 1654812 - DNA, 18 bp, Homo sapiens
cccaatcaaagaattaca

SEQ ID NO: 1654813 - DNA, 20 bp, Homo sapiens
cccaatcaaagaattacagt

SEQ ID NO: 1654814 - DNA, 16 bp, Homo sapiens
cccaatcagcactgaa

SEQ ID NO: 1654815 - DNA, 15 bp, Homo sapiens
cccaatcagcttttg

SEQ ID NO: 1654816 - DNA, 23 bp, Homo sapiens
cccaatcagcttttgttctagac

SEQ ID NO: 1654817 - DNA, 17 bp, Homo sapiens
cccaatccctttattac

SEQ ID NO: 1654818 - DNA, 16 bp, Homo sapiens
cccaatcctctctccc

SEQ ID NO: 1654819 - DNA, 19 bp, Homo sapiens
cccaatcctctctcccctc

SEQ ID NO: 1654820 - DNA, 19 bp, Homo sapiens
cccaatcgggtccagagac

SEQ ID NO: 1654821 - DNA, 20 bp, Homo sapiens
cccaatgtatgtgtggctgt

SEQ ID NO: 1654822 - DNA, 15 bp, Homo sapiens
cccaattaggaagtg

SEQ ID NO: 1654823 - DNA, 19 bp, Homo sapiens
cccaattaggaagtgtaac

SEQ ID NO: 1654824 - DNA, 20 bp, Homo sapiens
cccaattttaaaaaataaca

SEQ ID NO: 1654825 - DNA, 18 bp, Homo sapiens
cccacaaccttcggctcc

SEQ ID NO: 1654826 - DNA, 14 bp, Homo sapiens
cccacaagctgtcc

SEQ ID NO: 1654827 - DNA, 19 bp, Homo sapiens
cccacaagctgtccctgca

SEQ ID NO: 1654828 - DNA, 20 bp, Homo sapiens
cccacaagctgtccctgcag

SEQ ID NO: 1654829 - DNA, 22 bp, Homo sapiens
cccacaagctgtccctgcaggg

SEQ ID NO: 1654830 - DNA, 13 bp, Homo sapiens
cccacacagctgc

SEQ ID NO: 1654831 - DNA, 14 bp, Homo sapiens
cccacacagctgcc

SEQ ID NO: 1654832 - DNA, 12 bp, Homo sapiens
cccacacagggc

SEQ ID NO: 1654833 - DNA, 13 bp, Homo sapiens
cccacacagggca

SEQ ID NO: 1654834 - DNA, 15 bp, Homo sapiens
cccacaccgctggtc

SEQ ID NO: 1654835 - DNA, 18 bp, Homo sapiens
cccacaccttccagggcc

SEQ ID NO: 1654836 - DNA, 19 bp, Homo sapiens
cccacaccttccagggccc

SEQ ID NO: 1654837 - DNA, 22 bp, Homo sapiens
cccacacggaggcatctgcacc

SEQ ID NO: 1654838 - DNA, 14 bp, Homo sapiens
cccacactaacctg

SEQ ID NO: 1654839 - DNA, 23 bp, Homo sapiens
cccacactcccaaggttggagcc

SEQ ID NO: 1654840 - DNA, 16 bp, Homo sapiens
cccacactgccagaag

SEQ ID NO: 1654841 - DNA, 12 bp, Homo sapiens
cccacagccata

SEQ ID NO: 1654842 - DNA, 13 bp, Homo sapiens
cccacagcctcct

SEQ ID NO: 1654843 - DNA, 17 bp, Homo sapiens
cccacagcgtccctggc

SEQ ID NO: 1654844 - DNA, 15 bp, Homo sapiens
cccacagctcagctg

SEQ ID NO: 1654845 - DNA, 21 bp, Homo sapiens
cccacaggccccccgcagcac

SEQ ID NO: 1654846 - DNA, 16 bp, Homo sapiens
cccacaggcccttcct

SEQ ID NO: 1654847 - DNA, 18 bp, Homo sapiens
cccacaggcccttcctct

SEQ ID NO: 1654848 - DNA, 14 bp, Homo sapiens
cccacagtgccacc

SEQ ID NO: 1654849 - DNA, 15 bp, Homo sapiens
cccacagtgccaccc

SEQ ID NO: 1654850 - DNA, 18 bp, Homo sapiens
cccacataaaagccccag

SEQ ID NO: 1654851 - DNA, 20 bp, Homo sapiens
cccacataaaagccccagct

SEQ ID NO: 1654852 - DNA, 20 bp, Homo sapiens
cccacatcccaggcttcacc

SEQ ID NO: 1654853 - DNA, 14 bp, Homo sapiens
cccacatgaggcca

SEQ ID NO: 1654854 - DNA, 22 bp, Homo sapiens
cccacatgaggccatctcagga

SEQ ID NO: 1654855 - DNA, 23 bp, Homo sapiens
cccacatgaggccatctcaggag

SEQ ID NO: 1654856 - DNA, 19 bp, Homo sapiens
cccacatgtgacacatatg

SEQ ID NO: 1654857 - DNA, 18 bp, Homo sapiens
cccacatgtgtccatccc

SEQ ID NO: 1654858 - DNA, 13 bp, Homo sapiens
cccacatttgatg

SEQ ID NO: 1654859 - DNA, 14 bp, Homo sapiens
cccacatttgggct

SEQ ID NO: 1654860 - DNA, 21 bp, Homo sapiens
cccaccaacatcccattgccc

SEQ ID NO: 1654861 - DNA, 14 bp, Homo sapiens
cccaccaactctgc

SEQ ID NO: 1654862 - DNA, 15 bp, Homo sapiens
cccaccaccctggca

SEQ ID NO: 1654863 - DNA, 16 bp, Homo sapiens
cccaccacctaggcca

SEQ ID NO: 1654864 - DNA, 21 bp, Homo sapiens
cccaccacctaggccactcct

SEQ ID NO: 1654865 - DNA, 19 bp, Homo sapiens
cccaccacgatgtggccct

SEQ ID NO: 1654866 - DNA, 15 bp, Homo sapiens
cccaccagagccggg

SEQ ID NO: 1654867 - DNA, 17 bp, Homo sapiens
cccaccaggctgctcag

SEQ ID NO: 1654868 - DNA, 23 bp, Homo sapiens
cccaccaggggaaggaaggaggg

SEQ ID NO: 1654869 - DNA, 13 bp, Homo sapiens
cccaccagggtcc

SEQ ID NO: 1654870 - DNA, 23 bp, Homo sapiens
cccaccagtcagggacagcagcc

SEQ ID NO: 1654871 - DNA, 12 bp, Homo sapiens
cccaccattcct

SEQ ID NO: 1654872 - DNA, 22 bp, Homo sapiens
cccacccaagcttggcagccga

SEQ ID NO: 1654873 - DNA, 15 bp, Homo sapiens
cccacccacatgtga

SEQ ID NO: 1654874 - DNA, 14 bp, Homo sapiens
cccacccacccgcc

SEQ ID NO: 1654875 - DNA, 20 bp, Homo sapiens
cccacccatcttcctgctgc

SEQ ID NO: 1654876 - DNA, 17 bp, Homo sapiens
cccaccccaactctccc

SEQ ID NO: 1654877 - DNA, 12 bp, Homo sapiens
cccaccccacac

SEQ ID NO: 1654878 - DNA, 17 bp, Homo sapiens
cccaccccactccagcc

SEQ ID NO: 1654879 - DNA, 13 bp, Homo sapiens
cccacccccagct

SEQ ID NO: 1654880 - DNA, 12 bp, Homo sapiens
cccacccccatc

SEQ ID NO: 1654881 - DNA, 22 bp, Homo sapiens
cccacccccctctctttctctg

SEQ ID NO: 1654882 - DNA, 19 bp, Homo sapiens
cccaccccctccccagggg

SEQ ID NO: 1654883 - DNA, 15 bp, Homo sapiens
cccaccccctgccct

SEQ ID NO: 1654884 - DNA, 17 bp, Homo sapiens
cccaccccctgccctgc

SEQ ID NO: 1654885 - DNA, 23 bp, Homo sapiens
cccacccccttcagtgcccacca

SEQ ID NO: 1654886 - DNA, 20 bp, Homo sapiens
cccaccccggggaccctgtg

SEQ ID NO: 1654887 - DNA, 21 bp, Homo sapiens
cccaccccggggaccctgtga

SEQ ID NO: 1654888 - DNA, 16 bp, Homo sapiens
cccacccctcactccc

SEQ ID NO: 1654889 - DNA, 13 bp, Homo sapiens
cccacccctgccc

SEQ ID NO: 1654890 - DNA, 15 bp, Homo sapiens
cccacccctggaaga

SEQ ID NO: 1654891 - DNA, 20 bp, Homo sapiens
cccaggctgcctgagcacct

SEQ ID NO: 1654892 - DNA, 18 bp, Homo sapiens
cccaggctggagtgcagt

SEQ ID NO: 1654893 - DNA, 19 bp, Homo sapiens
cccaggctggagtgcagtg

SEQ ID NO: 1654894 - DNA, 14 bp, Homo sapiens
cccagggaaggaaa

SEQ ID NO: 1654895 - DNA, 18 bp, Homo sapiens
cccagggaaggtggggcc

SEQ ID NO: 1654896 - DNA, 23 bp, Homo sapiens
cccagggacaaaacactgtgtcc

SEQ ID NO: 1654897 - DNA, 19 bp, Homo sapiens
cccagggcatcttgctggc

SEQ ID NO: 1654898 - DNA, 23 bp, Homo sapiens
cccagggccactctgcctctgcc

SEQ ID NO: 1654899 - DNA, 16 bp, Homo sapiens
cccagggccagcccac

SEQ ID NO: 1654900 - DNA, 18 bp, Homo sapiens
cccagggccagggccctg

SEQ ID NO: 1654901 - DNA, 17 bp, Homo sapiens
cccagggcccccacagg

SEQ ID NO: 1654902 - DNA, 20 bp, Homo sapiens
cccagggcccccacaggccc

SEQ ID NO: 1654903 - DNA, 22 bp, Homo sapiens
cccagggcccctccctctgccc

SEQ ID NO: 1654904 - DNA, 16 bp, Homo sapiens
cccagggccctcccag

SEQ ID NO: 1654905 - DNA, 17 bp, Homo sapiens
cccagggccctcccagc

SEQ ID NO: 1654906 - DNA, 24 bp, Homo sapiens
cccagggcctgggggcagtgactg

SEQ ID NO: 1654907 - DNA, 14 bp, Homo sapiens
cccagggctcagcc

SEQ ID NO: 1654908 - DNA, 14 bp, Homo sapiens
cccagggctcctgc

SEQ ID NO: 1654909 - DNA, 12 bp, Homo sapiens
cccagggctctg

SEQ ID NO: 1654910 - DNA, 17 bp, Homo sapiens
cccagggctctgcagca

SEQ ID NO: 1654911 - DNA, 19 bp, Homo sapiens
cccagggctctgcaggcca

SEQ ID NO: 1654912 - DNA, 20 bp, Homo sapiens
cccagggctctgcaggccac

SEQ ID NO: 1654913 - DNA, 15 bp, Homo sapiens
cccaggggagagggt

SEQ ID NO: 1654914 - DNA, 21 bp, Homo sapiens
cccaggggagagggtctggag

SEQ ID NO: 1654915 - DNA, 19 bp, Homo sapiens
cccaggggagccagctgct

SEQ ID NO: 1654916 - DNA, 22 bp, Homo sapiens
cccaggggagccagctgcttga

SEQ ID NO: 1654917 - DNA, 16 bp, Homo sapiens
cccaggggcagcaagg

SEQ ID NO: 1654918 - DNA, 15 bp, Homo sapiens
cccaggggcagccac

SEQ ID NO: 1654919 - DNA, 13 bp, Homo sapiens
cccaggggcagga

SEQ ID NO: 1654920 - DNA, 16 bp, Homo sapiens
cccaggggcaggactg

SEQ ID NO: 1654921 - DNA, 17 bp, Homo sapiens
cccaggggcaggactga

SEQ ID NO: 1654922 - DNA, 23 bp, Homo sapiens
cccaggggcatgtattggcctgg

SEQ ID NO: 1654923 - DNA, 14 bp, Homo sapiens
cccagggggcctgg

SEQ ID NO: 1654924 - DNA, 16 bp, Homo sapiens
cccaggggtcccagcc

SEQ ID NO: 1654925 - DNA, 19 bp, Homo sapiens
cccaggggtcccagccacc

SEQ ID NO: 1654926 - DNA, 20 bp, Homo sapiens
cccaggggtcccagccaccc

SEQ ID NO: 1654927 - DNA, 17 bp, Homo sapiens
cccaggggtctccctgg

SEQ ID NO: 1654928 - DNA, 18 bp, Homo sapiens
cccaggggtctccctggc

SEQ ID NO: 1654929 - DNA, 21 bp, Homo sapiens
cccaggggtctccctggctcc

SEQ ID NO: 1654930 - DNA, 23 bp, Homo sapiens
cccaggggtgccccctcctctcc

SEQ ID NO: 1654931 - DNA, 16 bp, Homo sapiens
cccagggtcctgtgcc

SEQ ID NO: 1654932 - DNA, 15 bp, Homo sapiens
cccagggtcttccct

SEQ ID NO: 1654933 - DNA, 16 bp, Homo sapiens
cccagggtgtttgcag

SEQ ID NO: 1654934 - DNA, 16 bp, Homo sapiens
cccaggtaccagctgc

SEQ ID NO: 1654935 - DNA, 18 bp, Homo sapiens
cccaggtccagctctgga

SEQ ID NO: 1654936 - DNA, 22 bp, Homo sapiens
cccaggtcccccgactgcctgt

SEQ ID NO: 1654937 - DNA, 15 bp, Homo sapiens
cccaggtctctccac

SEQ ID NO: 1654938 - DNA, 20 bp, Homo sapiens
cccaggtctctccactgctc

SEQ ID NO: 1654939 - DNA, 13 bp, Homo sapiens
cccaggtgccagt

SEQ ID NO: 1654940 - DNA, 16 bp, Homo sapiens
cccaggtggctgaccc

SEQ ID NO: 1654941 - DNA, 18 bp, Homo sapiens
cccaggtggctgacccag

SEQ ID NO: 1654942 - DNA, 17 bp, Homo sapiens
cccaggtgtgcctgtgc

SEQ ID NO: 1654943 - DNA, 18 bp, Homo sapiens
cccaggtgtgcctgtgct

SEQ ID NO: 1654944 - DNA, 19 bp, Homo sapiens
cccaggtgtgcctgtgctc

SEQ ID NO: 1654945 - DNA, 22 bp, Homo sapiens
cccaggtgttaacattccaaga

SEQ ID NO: 1654946 - DNA, 18 bp, Homo sapiens
cccaggttcccccagcaa

SEQ ID NO: 1654947 - DNA, 16 bp, Homo sapiens
cccagtacctccaagc

SEQ ID NO: 1654948 - DNA, 15 bp, Homo sapiens
cccagtatctcttca

SEQ ID NO: 1654949 - DNA, 16 bp, Homo sapiens
cccagtatctcttcag

SEQ ID NO: 1654950 - DNA, 13 bp, Homo sapiens
cccagtcatccag

SEQ ID NO: 1654951 - DNA, 18 bp, Homo sapiens
cccagtccatgctccagg

SEQ ID NO: 1654952 - DNA, 19 bp, Homo sapiens
cccagtccatgctccaggg

SEQ ID NO: 1654953 - DNA, 21 bp, Homo sapiens
cccagtcccagggaaggtggg

SEQ ID NO: 1654954 - DNA, 13 bp, Homo sapiens
cccagtccccacc

SEQ ID NO: 1654955 - DNA, 20 bp, Homo sapiens
cccagtccccacccctgccc

SEQ ID NO: 1654956 - DNA, 15 bp, Homo sapiens
cccagtccctggagc

SEQ ID NO: 1654957 - DNA, 16 bp, Homo sapiens
cccagtccctggggga

SEQ ID NO: 1654958 - DNA, 18 bp, Homo sapiens
cccagtcgaccccaaagg

SEQ ID NO: 1654959 - DNA, 18 bp, Homo sapiens
cccagtcggccccatctc

SEQ ID NO: 1654960 - DNA, 23 bp, Homo sapiens
cccagtcgtgatgtggaggaaga

SEQ ID NO: 1654961 - DNA, 15 bp, Homo sapiens
cccagtctcctctcc

SEQ ID NO: 1654962 - DNA, 20 bp, Homo sapiens
cccagtctctggcagttctg

SEQ ID NO: 1654963 - DNA, 11 bp, Homo sapiens
cccagtgcaga

SEQ ID NO: 1654964 - DNA, 14 bp, Homo sapiens
cccagtgcatggtg

SEQ ID NO: 1654965 - DNA, 21 bp, Homo sapiens
cccagtgcatggtggccagag

SEQ ID NO: 1654966 - DNA, 22 bp, Homo sapiens
cccagtgccaagcacagtgcct

SEQ ID NO: 1654967 - DNA, 14 bp, Homo sapiens
cccagtgcctgcca

SEQ ID NO: 1654968 - DNA, 19 bp, Homo sapiens
cccagtgcctgccactctc

SEQ ID NO: 1654969 - DNA, 15 bp, Homo sapiens
cccagtgccttctgg

SEQ ID NO: 1654970 - DNA, 21 bp, Homo sapiens
cccagtgcggttcctcatctg

SEQ ID NO: 1654971 - DNA, 17 bp, Homo sapiens
cccagtgctgccatgcc

SEQ ID NO: 1654972 - DNA, 16 bp, Homo sapiens
cccagtgggaggggca

SEQ ID NO: 1654973 - DNA, 22 bp, Homo sapiens
cccagtgggaggggcaggctga

SEQ ID NO: 1654974 - DNA, 16 bp, Homo sapiens
cccagtgggtctggga

SEQ ID NO: 1654975 - DNA, 22 bp, Homo sapiens
cccagtgtcaagttgtgcttgt

SEQ ID NO: 1654976 - DNA, 17 bp, Homo sapiens
cccagtgtgagacccca

SEQ ID NO: 1654977 - DNA, 18 bp, Homo sapiens
cccagtgtgagaccccaa

SEQ ID NO: 1654978 - DNA, 12 bp, Homo sapiens
cccagtgtggct

SEQ ID NO: 1654979 - DNA, 18 bp, Homo sapiens
cccagtgttgtttgtaaa

SEQ ID NO: 1654980 - DNA, 16 bp, Homo sapiens
cccagtgttttctttg

SEQ ID NO: 1654981 - DNA, 20 bp, Homo sapiens
cccagttaatactccagaga

SEQ ID NO: 1654982 - DNA, 22 bp, Homo sapiens
cccagttcaggagtcccaagga

SEQ ID NO: 1654983 - DNA, 21 bp, Homo sapiens
cccagttcatcaccatttcct

SEQ ID NO: 1654984 - DNA, 20 bp, Homo sapiens
cccagttcctatgacacagt

SEQ ID NO: 1654985 - DNA, 21 bp, Homo sapiens
cccagtttatggatatgctgc

SEQ ID NO: 1654986 - DNA, 15 bp, Homo sapiens
cccagtttgcagaaa

SEQ ID NO: 1654987 - DNA, 16 bp, Homo sapiens
cccagtttgcagaaaa

SEQ ID NO: 1654988 - DNA, 23 bp, Homo sapiens
cccagtttgcagaaaagcacctg

SEQ ID NO: 1654989 - DNA, 20 bp, Homo sapiens
cccataaacagcacacctgt

SEQ ID NO: 1654990 - DNA, 15 bp, Homo sapiens
cccataagacaaaca

SEQ ID NO: 1654991 - DNA, 19 bp, Homo sapiens
cccataagacaaacactgc

SEQ ID NO: 1654992 - DNA, 20 bp, Homo sapiens
cccataatagttagccctca

SEQ ID NO: 1654993 - DNA, 20 bp, Homo sapiens
cccatacaatgtatgtacaa

SEQ ID NO: 1654994 - DNA, 18 bp, Homo sapiens
cccatacttttggctcct

SEQ ID NO: 1654995 - DNA, 15 bp, Homo sapiens
cccatagaaacatga

SEQ ID NO: 1654996 - DNA, 21 bp, Homo sapiens
cccatagaaacatgacactga

SEQ ID NO: 1654997 - DNA, 22 bp, Homo sapiens
cccatagaaacatgacactgac

SEQ ID NO: 1654998 - DNA, 17 bp, Homo sapiens
cccatagatcttctgaa

SEQ ID NO: 1654999 - DNA, 18 bp, Homo sapiens
cccataggccacccccta

SEQ ID NO: 1655000 - DNA, 21 bp, Homo sapiens
cccatagtggggcctgggagg

SEQ ID NO: 1655001 - DNA, 18 bp, Homo sapiens
cccatattgtaaaacagg

SEQ ID NO: 1655002 - DNA, 18 bp, Homo sapiens
cccatcacccaagccaca

SEQ ID NO: 1655003 - DNA, 16 bp, Homo sapiens
cccatcacgcctgtgc

SEQ ID NO: 1655004 - DNA, 15 bp, Homo sapiens
cccatcaggcagtgt

SEQ ID NO: 1655005 - DNA, 15 bp, Homo sapiens
ccctggctcactggc

SEQ ID NO: 1655006 - DNA, 17 bp, Homo sapiens
ccctggctcactggcag

SEQ ID NO: 1655007 - DNA, 18 bp, Homo sapiens
ccctggctcactggcagg

SEQ ID NO: 1655008 - DNA, 20 bp, Homo sapiens
ccctggctcccacaggccct

SEQ ID NO: 1655009 - DNA, 23 bp, Homo sapiens
ccctggctcccatgaccatactg

SEQ ID NO: 1655010 - DNA, 20 bp, Homo sapiens
ccctggctccctcctccagg

SEQ ID NO: 1655011 - DNA, 19 bp, Homo sapiens
ccctggctctcagaaggta

SEQ ID NO: 1655012 - DNA, 16 bp, Homo sapiens
ccctggctctgggccg

SEQ ID NO: 1655013 - DNA, 13 bp, Homo sapiens
ccctggctgccct

SEQ ID NO: 1655014 - DNA, 17 bp, Homo sapiens
ccctggctgccctggcc

SEQ ID NO: 1655015 - DNA, 19 bp, Homo sapiens
ccctggctgccctggccct

SEQ ID NO: 1655016 - DNA, 14 bp, Homo sapiens
ccctggctgctgcc

SEQ ID NO: 1655017 - DNA, 20 bp, Homo sapiens
ccctggctgtgagcagcctc

SEQ ID NO: 1655018 - DNA, 20 bp, Homo sapiens
ccctggcttgtaactccacc

SEQ ID NO: 1655019 - DNA, 13 bp, Homo sapiens
ccctggcttttca

SEQ ID NO: 1655020 - DNA, 19 bp, Homo sapiens
ccctggcttttcactgctg

SEQ ID NO: 1655021 - DNA, 22 bp, Homo sapiens
ccctggcttttcactgctggct

SEQ ID NO: 1655022 - DNA, 22 bp, Homo sapiens
ccctgggagcgcctgaccctgg

SEQ ID NO: 1655023 - DNA, 17 bp, Homo sapiens
ccctgggagctctggga

SEQ ID NO: 1655024 - DNA, 15 bp, Homo sapiens
ccctgggagggaggt

SEQ ID NO: 1655025 - DNA, 20 bp, Homo sapiens
ccctgggcaaacagagctac

SEQ ID NO: 1655026 - DNA, 22 bp, Homo sapiens
ccctgggcaaacagagctactg

SEQ ID NO: 1655027 - DNA, 19 bp, Homo sapiens
ccctgggcacccacctcca

SEQ ID NO: 1655028 - DNA, 18 bp, Homo sapiens
ccctgggccccaccacct

SEQ ID NO: 1655029 - DNA, 13 bp, Homo sapiens
ccctgggcctgga

SEQ ID NO: 1655030 - DNA, 16 bp, Homo sapiens
ccctgggctaccatct

SEQ ID NO: 1655031 - DNA, 21 bp, Homo sapiens
ccctgggctaccatctgcatg

SEQ ID NO: 1655032 - DNA, 17 bp, Homo sapiens
ccctgggctattgctgc

SEQ ID NO: 1655033 - DNA, 21 bp, Homo sapiens
ccctgggctattgctgctgcc

SEQ ID NO: 1655034 - DNA, 20 bp, Homo sapiens
ccctgggctccacacagcag

SEQ ID NO: 1655035 - DNA, 12 bp, Homo sapiens
ccctgggctctc

SEQ ID NO: 1655036 - DNA, 18 bp, Homo sapiens
ccctgggctctcacccag

SEQ ID NO: 1655037 - DNA, 17 bp, Homo sapiens
ccctgggctgaaactga

SEQ ID NO: 1655038 - DNA, 14 bp, Homo sapiens
ccctgggctggaat

SEQ ID NO: 1655039 - DNA, 19 bp, Homo sapiens
ccctgggctggggaggagg

SEQ ID NO: 1655040 - DNA, 20 bp, Homo sapiens
ccctggggagcttttgccca

SEQ ID NO: 1655041 - DNA, 20 bp, Homo sapiens
ccctggggcctgactgctca

SEQ ID NO: 1655042 - DNA, 21 bp, Homo sapiens
ccctggggcctgactgctcag

SEQ ID NO: 1655043 - DNA, 18 bp, Homo sapiens
ccctggggcctggacctg

SEQ ID NO: 1655044 - DNA, 21 bp, Homo sapiens
ccctggggcctggacctgcct

SEQ ID NO: 1655045 - DNA, 23 bp, Homo sapiens
ccctggggcctggacctgcctcc

SEQ ID NO: 1655046 - DNA, 22 bp, Homo sapiens
ccctggggctgagtctccaggg

SEQ ID NO: 1655047 - DNA, 21 bp, Homo sapiens
ccctggggcttctcctgaccc

SEQ ID NO: 1655048 - DNA, 18 bp, Homo sapiens
ccctgggggaagccctgg

SEQ ID NO: 1655049 - DNA, 17 bp, Homo sapiens
ccctggggtggccacca

SEQ ID NO: 1655050 - DNA, 23 bp, Homo sapiens
ccctggggtgggatctgagctcc

SEQ ID NO: 1655051 - DNA, 14 bp, Homo sapiens
ccctgggtgccatt

SEQ ID NO: 1655052 - DNA, 20 bp, Homo sapiens
ccctgggtgccattcccagc

SEQ ID NO: 1655053 - DNA, 17 bp, Homo sapiens
ccctgggtgggctctgt

SEQ ID NO: 1655054 - DNA, 20 bp, Homo sapiens
ccctgggtgggctctgtgca

SEQ ID NO: 1655055 - DNA, 22 bp, Homo sapiens
ccctgggtgtccccgctgctgt

SEQ ID NO: 1655056 - DNA, 18 bp, Homo sapiens
ccctgggttaacaaatga

SEQ ID NO: 1655057 - DNA, 22 bp, Homo sapiens
ccctgggttcagaaatgctgcc

SEQ ID NO: 1655058 - DNA, 23 bp, Homo sapiens
ccctgggttcagaaatgctgcct

SEQ ID NO: 1655059 - DNA, 17 bp, Homo sapiens
ccctgggttcttccaca

SEQ ID NO: 1655060 - DNA, 22 bp, Homo sapiens
ccctggtcctgacttccctgga

SEQ ID NO: 1655061 - DNA, 12 bp, Homo sapiens
ccctggtgcctc

SEQ ID NO: 1655062 - DNA, 16 bp, Homo sapiens
ccctggtgcctctgtg

SEQ ID NO: 1655063 - DNA, 17 bp, Homo sapiens
ccctggtgcctctgtgc

SEQ ID NO: 1655064 - DNA, 13 bp, Homo sapiens
ccctggtgctgcc

SEQ ID NO: 1655065 - DNA, 14 bp, Homo sapiens
ccctggtgctgcca

SEQ ID NO: 1655066 - DNA, 15 bp, Homo sapiens
ccctggtgctgccac

SEQ ID NO: 1655067 - DNA, 21 bp, Homo sapiens
ccctggtgtcacatggggcct

SEQ ID NO: 1655068 - DNA, 18 bp, Homo sapiens
ccctggttagctgacagt

SEQ ID NO: 1655069 - DNA, 16 bp, Homo sapiens
ccctggttcctgctgt

SEQ ID NO: 1655070 - DNA, 18 bp, Homo sapiens
ccctggttcctgctgtcc

SEQ ID NO: 1655071 - DNA, 15 bp, Homo sapiens
ccctggttctcatct

SEQ ID NO: 1655072 - DNA, 17 bp, Homo sapiens
ccctggttctcatcttt

SEQ ID NO: 1655073 - DNA, 19 bp, Homo sapiens
ccctgtagactagtgccgt

SEQ ID NO: 1655074 - DNA, 16 bp, Homo sapiens
ccctgtagctcagtca

SEQ ID NO: 1655075 - DNA, 21 bp, Homo sapiens
ccctgtagctctgcctccctc

SEQ ID NO: 1655076 - DNA, 19 bp, Homo sapiens
ccctgtagggaaaccttgg

SEQ ID NO: 1655077 - DNA, 14 bp, Homo sapiens
ccctgtcaccaagc

SEQ ID NO: 1655078 - DNA, 13 bp, Homo sapiens
ccctgtcagaggc

SEQ ID NO: 1655079 - DNA, 14 bp, Homo sapiens
ccctgtcagaggct

SEQ ID NO: 1655080 - DNA, 20 bp, Homo sapiens
ccctgtcatttgaacctgga

SEQ ID NO: 1655081 - DNA, 21 bp, Homo sapiens
ccctgtccaaactgcctaagc

SEQ ID NO: 1655082 - DNA, 17 bp, Homo sapiens
ccctgtcccaccaactc

SEQ ID NO: 1655083 - DNA, 21 bp, Homo sapiens
ccctgtcccaccaactctgca

SEQ ID NO: 1655084 - DNA, 14 bp, Homo sapiens
ccctgtcccaccca

SEQ ID NO: 1655085 - DNA, 14 bp, Homo sapiens
ccctgtcccagggc

SEQ ID NO: 1655086 - DNA, 16 bp, Homo sapiens
ccctgtcccagggccc

SEQ ID NO: 1655087 - DNA, 21 bp, Homo sapiens
ccctgtcccagggccctccca

SEQ ID NO: 1655088 - DNA, 22 bp, Homo sapiens
ccctgtcccagggccctcccag

SEQ ID NO: 1655089 - DNA, 13 bp, Homo sapiens
ccctgtcccattc

SEQ ID NO: 1655090 - DNA, 16 bp, Homo sapiens
ccctgtcccccagctc

SEQ ID NO: 1655091 - DNA, 18 bp, Homo sapiens
ccctgtcccctgaaaaac

SEQ ID NO: 1655092 - DNA, 22 bp, Homo sapiens
ccctgtccggcccagtgccact

SEQ ID NO: 1655093 - DNA, 16 bp, Homo sapiens
ccctgtcgagacactt

SEQ ID NO: 1655094 - DNA, 12 bp, Homo sapiens
ccctgtctccag

SEQ ID NO: 1655095 - DNA, 13 bp, Homo sapiens
ccctgtctccagc

SEQ ID NO: 1655096 - DNA, 14 bp, Homo sapiens
ccctgtctccagct

SEQ ID NO: 1655097 - DNA, 16 bp, Homo sapiens
ccctgtctccagctgc

SEQ ID NO: 1655098 - DNA, 17 bp, Homo sapiens
ccctgtctccagctgcc

SEQ ID NO: 1655099 - DNA, 22 bp, Homo sapiens
ccctgtctctaaggagcagcgg

SEQ ID NO: 1655100 - DNA, 19 bp, Homo sapiens
ccctgtctgctaggcgctg

SEQ ID NO: 1655101 - DNA, 14 bp, Homo sapiens
ccctgtctgtgtcc

SEQ ID NO: 1655102 - DNA, 15 bp, Homo sapiens
ccctgtctgtgtccc

SEQ ID NO: 1655103 - DNA, 16 bp, Homo sapiens
ccctgtctgtgtccca

SEQ ID NO: 1655104 - DNA, 17 bp, Homo sapiens
ccctgtctgtgtcccag

SEQ ID NO: 1655105 - DNA, 19 bp, Homo sapiens
ccctgtcttctgggcacag

SEQ ID NO: 1655106 - DNA, 16 bp, Homo sapiens
ccctgtcttgctgtca

SEQ ID NO: 1655107 - DNA, 23 bp, Homo sapiens
ccctgtgaaacgtcccacacttt

SEQ ID NO: 1655108 - DNA, 18 bp, Homo sapiens
ccctgtgacatggtgcct

SEQ ID NO: 1655109 - DNA, 22 bp, Homo sapiens
ccctgtgacatggtgcctgaga

SEQ ID NO: 1655110 - DNA, 24 bp, Homo sapiens
ccctgtgacatggtgcctgagagg

SEQ ID NO: 1655111 - DNA, 23 bp, Homo sapiens
ccctgtgagattttgcttttcca

SEQ ID NO: 1655112 - DNA, 18 bp, Homo sapiens
ccctgtgagggcgagcgg

SEQ ID NO: 1655113 - DNA, 13 bp, Homo sapiens
ccctgtgatggcc

SEQ ID NO: 1655114 - DNA, 20 bp, Homo sapiens
ccctgtgctccgtgcctcca

SEQ ID NO: 1655115 - DNA, 14 bp, Homo sapiens
ccctgtgctgatcc

SEQ ID NO: 1655116 - DNA, 15 bp, Homo sapiens
ccctgtgctgatcct

SEQ ID NO: 1655117 - DNA, 16 bp, Homo sapiens
ccctgtgctgatcctg

SEQ ID NO: 1655118 - DNA, 16 bp, Homo sapiens
ccctgtgctggtgtcc

SEQ ID NO: 1655119 - DNA, 13 bp, Homo sapiens
ccgcaccctggcc

SEQ ID NO: 1655120 - DNA, 14 bp, Homo sapiens
ccgcacgtccgcgg

SEQ ID NO: 1655121 - DNA, 15 bp, Homo sapiens
ccgcagacaccttgg

SEQ ID NO: 1655122 - DNA, 13 bp, Homo sapiens
ccgcagacgggca

SEQ ID NO: 1655123 - DNA, 18 bp, Homo sapiens
ccgcagacgggcacagac

SEQ ID NO: 1655124 - DNA, 16 bp, Homo sapiens
ccgcagcagggaagct

SEQ ID NO: 1655125 - DNA, 21 bp, Homo sapiens
ccgcagccagccggtgcctgg

SEQ ID NO: 1655126 - DNA, 14 bp, Homo sapiens
ccgcagcctccctc

SEQ ID NO: 1655127 - DNA, 18 bp, Homo sapiens
ccgcagcgtcccccgccg

SEQ ID NO: 1655128 - DNA, 20 bp, Homo sapiens
ccgcagctcttgcccttccc

SEQ ID NO: 1655129 - DNA, 16 bp, Homo sapiens
ccgcaggatccctcct

SEQ ID NO: 1655130 - DNA, 14 bp, Homo sapiens
ccgcaggcccggac

SEQ ID NO: 1655131 - DNA, 20 bp, Homo sapiens
ccgcagggccatgcagacct

SEQ ID NO: 1655132 - DNA, 20 bp, Homo sapiens
ccgcaggggactgtctcaga

SEQ ID NO: 1655133 - DNA, 15 bp, Homo sapiens
ccgcagtgctgggac

SEQ ID NO: 1655134 - DNA, 17 bp, Homo sapiens
ccgcagtgctgggacca

SEQ ID NO: 1655135 - DNA, 18 bp, Homo sapiens
ccgcagtgctgggaccag

SEQ ID NO: 1655136 - DNA, 19 bp, Homo sapiens
ccgcagtgctgggaccaga

SEQ ID NO: 1655137 - DNA, 12 bp, Homo sapiens
ccgcatcttctc

SEQ ID NO: 1655138 - DNA, 16 bp, Homo sapiens
ccgcatcttctccatc

SEQ ID NO: 1655139 - DNA, 20 bp, Homo sapiens
ccgcatcttctccatctggc

SEQ ID NO: 1655140 - DNA, 22 bp, Homo sapiens
ccgcatcttctccatctggcag

SEQ ID NO: 1655141 - DNA, 16 bp, Homo sapiens
ccgcatgcggcccagg

SEQ ID NO: 1655142 - DNA, 23 bp, Homo sapiens
ccgccaaggtagccatcccatga

SEQ ID NO: 1655143 - DNA, 14 bp, Homo sapiens
ccgccacgtcccag

SEQ ID NO: 1655144 - DNA, 21 bp, Homo sapiens
ccgccacgtcccagcatccct

SEQ ID NO: 1655145 - DNA, 16 bp, Homo sapiens
ccgccagactgttaga

SEQ ID NO: 1655146 - DNA, 17 bp, Homo sapiens
ccgccagccccaagctg

SEQ ID NO: 1655147 - DNA, 12 bp, Homo sapiens
ccgccagcctca

SEQ ID NO: 1655148 - DNA, 14 bp, Homo sapiens
ccgccagcctcagt

SEQ ID NO: 1655149 - DNA, 18 bp, Homo sapiens
ccgccagcctcagtgcca

SEQ ID NO: 1655150 - DNA, 12 bp, Homo sapiens
ccgccagcctcc

SEQ ID NO: 1655151 - DNA, 15 bp, Homo sapiens
ccgccagcctcctct

SEQ ID NO: 1655152 - DNA, 18 bp, Homo sapiens
ccgccagcctcctctgga

SEQ ID NO: 1655153 - DNA, 15 bp, Homo sapiens
ccgccagctgccgca

SEQ ID NO: 1655154 - DNA, 17 bp, Homo sapiens
ccgccagctgccgcacc

SEQ ID NO: 1655155 - DNA, 14 bp, Homo sapiens
ccgccagctgggag

SEQ ID NO: 1655156 - DNA, 17 bp, Homo sapiens
ccgccaggcgctgcagg

SEQ ID NO: 1655157 - DNA, 23 bp, Homo sapiens
ccgccaggcgctgcagggccgcg

SEQ ID NO: 1655158 - DNA, 16 bp, Homo sapiens
ccgccagggctgggga

SEQ ID NO: 1655159 - DNA, 21 bp, Homo sapiens
ccgccattctcaagccctgca

SEQ ID NO: 1655160 - DNA, 14 bp, Homo sapiens
ccgccattgccacc

SEQ ID NO: 1655161 - DNA, 12 bp, Homo sapiens
ccgcccacccac

SEQ ID NO: 1655162 - DNA, 22 bp, Homo sapiens
ccgcccagagacccaagctgcc

SEQ ID NO: 1655163 - DNA, 13 bp, Homo sapiens
ccgcccatgcact

SEQ ID NO: 1655164 - DNA, 19 bp, Homo sapiens
ccgcccatgcactggggac

SEQ ID NO: 1655165 - DNA, 12 bp, Homo sapiens
ccgcccccaccc

SEQ ID NO: 1655166 - DNA, 14 bp, Homo sapiens
ccgcccccacccct

SEQ ID NO: 1655167 - DNA, 15 bp, Homo sapiens
ccgcccccaccccta

SEQ ID NO: 1655168 - DNA, 18 bp, Homo sapiens
ccgcccctcgctgctgct

SEQ ID NO: 1655169 - DNA, 21 bp, Homo sapiens
ccgcccctcgctgctgctact

SEQ ID NO: 1655170 - DNA, 14 bp, Homo sapiens
ccgcccctggggaa

SEQ ID NO: 1655171 - DNA, 12 bp, Homo sapiens
ccgcccgctcct

SEQ ID NO: 1655172 - DNA, 14 bp, Homo sapiens
ccgccctcctcggg

SEQ ID NO: 1655173 - DNA, 20 bp, Homo sapiens
ccgccctcctcgggccgagg

SEQ ID NO: 1655174 - DNA, 17 bp, Homo sapiens
ccgccctgagcatcctg

SEQ ID NO: 1655175 - DNA, 14 bp, Homo sapiens
ccgccctgccactc

SEQ ID NO: 1655176 - DNA, 15 bp, Homo sapiens
ccgccctgccactca

SEQ ID NO: 1655177 - DNA, 14 bp, Homo sapiens
ccgccctgctcctc

SEQ ID NO: 1655178 - DNA, 18 bp, Homo sapiens
ccgccctgctcctccctg

SEQ ID NO: 1655179 - DNA, 16 bp, Homo sapiens
ccgccctgtaccctct

SEQ ID NO: 1655180 - DNA, 16 bp, Homo sapiens
ccgccctttccttgcc

SEQ ID NO: 1655181 - DNA, 13 bp, Homo sapiens
ccgccgcccgacc

SEQ ID NO: 1655182 - DNA, 14 bp, Homo sapiens
ccgccgccgccgcc

SEQ ID NO: 1655183 - DNA, 16 bp, Homo sapiens
ccgccgccgccgctgc

SEQ ID NO: 1655184 - DNA, 17 bp, Homo sapiens
ccgccgcctcccacggc

SEQ ID NO: 1655185 - DNA, 13 bp, Homo sapiens
ccgccgctgccct

SEQ ID NO: 1655186 - DNA, 14 bp, Homo sapiens
ccgccgtgccggcg

SEQ ID NO: 1655187 - DNA, 22 bp, Homo sapiens
ccgcctactggacgctgccctg

SEQ ID NO: 1655188 - DNA, 18 bp, Homo sapiens
ccgcctagtttactgttt

SEQ ID NO: 1655189 - DNA, 12 bp, Homo sapiens
ccgcctcagcct

SEQ ID NO: 1655190 - DNA, 17 bp, Homo sapiens
ccgcctcagcctcctga

SEQ ID NO: 1655191 - DNA, 12 bp, Homo sapiens
ccgcctccactc

SEQ ID NO: 1655192 - DNA, 14 bp, Homo sapiens
ccgcctccaggagc

SEQ ID NO: 1655193 - DNA, 14 bp, Homo sapiens
ccgcctccctctca

SEQ ID NO: 1655194 - DNA, 17 bp, Homo sapiens
ccgcctcgtgccagcag

SEQ ID NO: 1655195 - DNA, 19 bp, Homo sapiens
ccgcctctggccgccaccc

SEQ ID NO: 1655196 - DNA, 19 bp, Homo sapiens
ccgcctgagtcagtgctct

SEQ ID NO: 1655197 - DNA, 12 bp, Homo sapiens
ccgcctgccacc

SEQ ID NO: 1655198 - DNA, 13 bp, Homo sapiens
ccgcctgccaccg

SEQ ID NO: 1655199 - DNA, 12 bp, Homo sapiens
ccgcctgccctc

SEQ ID NO: 1655200 - DNA, 14 bp, Homo sapiens
ccgcctgccctcat

SEQ ID NO: 1655201 - DNA, 17 bp, Homo sapiens
ccgcctgcctcctggct

SEQ ID NO: 1655202 - DNA, 16 bp, Homo sapiens
ccgcctgcctctgcct

SEQ ID NO: 1655203 - DNA, 20 bp, Homo sapiens
ccgcctgctgggaagagctc

SEQ ID NO: 1655204 - DNA, 14 bp, Homo sapiens
ccgcctggcaggtg

SEQ ID NO: 1655205 - DNA, 15 bp, Homo sapiens
ccgcctggccaggag

SEQ ID NO: 1655206 - DNA, 23 bp, Homo sapiens
ccgcctggccaggagcaggcacg

SEQ ID NO: 1655207 - DNA, 14 bp, Homo sapiens
ccgcctggccggct

SEQ ID NO: 1655208 - DNA, 16 bp, Homo sapiens
ccgcctgggatctgag

SEQ ID NO: 1655209 - DNA, 11 bp, Homo sapiens
ccgcctgtggg

SEQ ID NO: 1655210 - DNA, 16 bp, Homo sapiens
ccgccttctcccacat

SEQ ID NO: 1655211 - DNA, 16 bp, Homo sapiens
ccgcctttacaaggga

SEQ ID NO: 1655212 - DNA, 17 bp, Homo sapiens
ccgcctttacaagggag

SEQ ID NO: 1655213 - DNA, 15 bp, Homo sapiens
ccgcgccagtccccg

SEQ ID NO: 1655214 - DNA, 17 bp, Homo sapiens
ccgcgccagtccccgct

SEQ ID NO: 1655215 - DNA, 12 bp, Homo sapiens
ccgcgcccagca

SEQ ID NO: 1655216 - DNA, 15 bp, Homo sapiens
ccgcgcccagcagag

SEQ ID NO: 1655217 - DNA, 23 bp, Homo sapiens
ccgcgcctacccttcccgcctcc

SEQ ID NO: 1655218 - DNA, 21 bp, Homo sapiens
ccgcgcgcccctgcccgagag

SEQ ID NO: 1655219 - DNA, 18 bp, Homo sapiens
ccgcggccaggcacccat

SEQ ID NO: 1655220 - DNA, 14 bp, Homo sapiens
ccgcgggttctaga

SEQ ID NO: 1655221 - DNA, 16 bp, Homo sapiens
ccgcggtgctgactga

SEQ ID NO: 1655222 - DNA, 14 bp, Homo sapiens
ccgcgtccctgccc

SEQ ID NO: 1655223 - DNA, 21 bp, Homo sapiens
ccgcgtgacggacatccaggc

SEQ ID NO: 1655224 - DNA, 17 bp, Homo sapiens
ccgcgtgtgcctgtgtg

SEQ ID NO: 1655225 - DNA, 18 bp, Homo sapiens
ccgctaagttgctgatgg

SEQ ID NO: 1655226 - DNA, 17 bp, Homo sapiens
ccgctagaggcctgagg

SEQ ID NO: 1655227 - DNA, 21 bp, Homo sapiens
ccgctaggagagactgaaagc

SEQ ID NO: 1655228 - DNA, 22 bp, Homo sapiens
ccgctagtggtagtatctcgta

SEQ ID NO: 1655229 - DNA, 22 bp, Homo sapiens
ccgctcagccctccctgcccct

SEQ ID NO: 1655230 - DNA, 18 bp, Homo sapiens
ccgctcaggggcctggag

SEQ ID NO: 1655231 - DNA, 19 bp, Homo sapiens
ccgctcaggggcctggagg

SEQ ID NO: 1655232 - DNA, 20 bp, Homo sapiens
ccgctcccaccgcccccacc

SEQ ID NO: 1655233 - DNA, 21 bp, Homo sapiens
ccgctcccaccgcccccaccc

SEQ ID NO: 1655234 - DNA, 17 bp, Homo sapiens
ccgctcccacctagtgc

SEQ ID NO: 1655235 - DNA, 20 bp, Homo sapiens
ccgtgagtgacatagcctca

SEQ ID NO: 1655236 - DNA, 20 bp, Homo sapiens
ccgtgatccatccatctcca

SEQ ID NO: 1655237 - DNA, 17 bp, Homo sapiens
ccgtgatgctcaggctt

SEQ ID NO: 1655238 - DNA, 19 bp, Homo sapiens
ccgtgcatggctcctgtct

SEQ ID NO: 1655239 - DNA, 19 bp, Homo sapiens
ccgtgcccgcaggaactgg

SEQ ID NO: 1655240 - DNA, 21 bp, Homo sapiens
ccgtgccgcctgcactcctca

SEQ ID NO: 1655241 - DNA, 14 bp, Homo sapiens
ccgtgcctgtgtcc

SEQ ID NO: 1655242 - DNA, 14 bp, Homo sapiens
ccgtgccttcagct

SEQ ID NO: 1655243 - DNA, 13 bp, Homo sapiens
ccgtggacaggcc

SEQ ID NO: 1655244 - DNA, 15 bp, Homo sapiens
ccgtggaccacctag

SEQ ID NO: 1655245 - DNA, 11 bp, Homo sapiens
ccgtggatgcg

SEQ ID NO: 1655246 - DNA, 16 bp, Homo sapiens
ccgtggatttgtactt

SEQ ID NO: 1655247 - DNA, 15 bp, Homo sapiens
ccgtggcactgcata

SEQ ID NO: 1655248 - DNA, 11 bp, Homo sapiens
ccgtggcttcc

SEQ ID NO: 1655249 - DNA, 14 bp, Homo sapiens
ccgtggcttcccgc

SEQ ID NO: 1655250 - DNA, 14 bp, Homo sapiens
ccgtggcttgggga

SEQ ID NO: 1655251 - DNA, 15 bp, Homo sapiens
ccgtggggcagggag

SEQ ID NO: 1655252 - DNA, 22 bp, Homo sapiens
ccgtggggcagggagctgggcc

SEQ ID NO: 1655253 - DNA, 23 bp, Homo sapiens
ccgtggggcagggagctgggccc

SEQ ID NO: 1655254 - DNA, 17 bp, Homo sapiens
ccgtggggccgccgcct

SEQ ID NO: 1655255 - DNA, 15 bp, Homo sapiens
ccgtggggtgctgcc

SEQ ID NO: 1655256 - DNA, 18 bp, Homo sapiens
ccgtggtatgtctgccat

SEQ ID NO: 1655257 - DNA, 11 bp, Homo sapiens
ccgtggtccaa

SEQ ID NO: 1655258 - DNA, 13 bp, Homo sapiens
ccgtggtccagct

SEQ ID NO: 1655259 - DNA, 16 bp, Homo sapiens
ccgtggtccctgagga

SEQ ID NO: 1655260 - DNA, 22 bp, Homo sapiens
ccgtggtggcggtggctgcccc

SEQ ID NO: 1655261 - DNA, 23 bp, Homo sapiens
ccgtggtttgaacacgaaagaaa

SEQ ID NO: 1655262 - DNA, 17 bp, Homo sapiens
ccgtgtaaaaagcctcc

SEQ ID NO: 1655263 - DNA, 18 bp, Homo sapiens
ccgtgtcaagctgctctg

SEQ ID NO: 1655264 - DNA, 15 bp, Homo sapiens
ccgtgtccagcacag

SEQ ID NO: 1655265 - DNA, 16 bp, Homo sapiens
ccgtgtcccaaggagc

SEQ ID NO: 1655266 - DNA, 14 bp, Homo sapiens
ccgtgtcctctccc

SEQ ID NO: 1655267 - DNA, 17 bp, Homo sapiens
ccgtgtctcagcctctg

SEQ ID NO: 1655268 - DNA, 17 bp, Homo sapiens
ccgtgtctgtctggcac

SEQ ID NO: 1655269 - DNA, 16 bp, Homo sapiens
ccgtgtgccctcgggc

SEQ ID NO: 1655270 - DNA, 15 bp, Homo sapiens
ccgtgtgtgtactga

SEQ ID NO: 1655271 - DNA, 12 bp, Homo sapiens
ccgtgtgtgtgt

SEQ ID NO: 1655272 - DNA, 13 bp, Homo sapiens
ccgttactctcca

SEQ ID NO: 1655273 - DNA, 17 bp, Homo sapiens
ccgttagctcctgtggc

SEQ ID NO: 1655274 - DNA, 19 bp, Homo sapiens
ccgttaggaataacactgc

SEQ ID NO: 1655275 - DNA, 17 bp, Homo sapiens
ccgttccaccccaagag

SEQ ID NO: 1655276 - DNA, 22 bp, Homo sapiens
ccgttccaccccaagagaactc

SEQ ID NO: 1655277 - DNA, 18 bp, Homo sapiens
ccgttctgctggcctgga

SEQ ID NO: 1655278 - DNA, 13 bp, Homo sapiens
ccgttctgttcca

SEQ ID NO: 1655279 - DNA, 18 bp, Homo sapiens
ccgtttagaaaaaacaat

SEQ ID NO: 1655280 - DNA, 13 bp, Homo sapiens
ccgtttgcttttg

SEQ ID NO: 1655281 - DNA, 21 bp, Homo sapiens
cctaaaaacatttactgacca

SEQ ID NO: 1655282 - DNA, 12 bp, Homo sapiens
cctaaaacaaat

SEQ ID NO: 1655283 - DNA, 15 bp, Homo sapiens
cctaaaagtaaacat

SEQ ID NO: 1655284 - DNA, 15 bp, Homo sapiens
cctaaaataagaata

SEQ ID NO: 1655285 - DNA, 12 bp, Homo sapiens
cctaaacataat

SEQ ID NO: 1655286 - DNA, 20 bp, Homo sapiens
cctaaagaaaaatatcttgg

SEQ ID NO: 1655287 - DNA, 23 bp, Homo sapiens
cctaaagggagaaggaagggcag

SEQ ID NO: 1655288 - DNA, 16 bp, Homo sapiens
cctaaagggcagggcc

SEQ ID NO: 1655289 - DNA, 19 bp, Homo sapiens
cctaaatagcagaaagaag

SEQ ID NO: 1655290 - DNA, 13 bp, Homo sapiens
cctaaatccaaag

SEQ ID NO: 1655291 - DNA, 16 bp, Homo sapiens
cctaaatccaaagaaa

SEQ ID NO: 1655292 - DNA, 16 bp, Homo sapiens
cctaaatccattttct

SEQ ID NO: 1655293 - DNA, 13 bp, Homo sapiens
cctaaatcccaag

SEQ ID NO: 1655294 - DNA, 16 bp, Homo sapiens
cctaaatgatggtgct

SEQ ID NO: 1655295 - DNA, 14 bp, Homo sapiens
cctaaatggcctca

SEQ ID NO: 1655296 - DNA, 18 bp, Homo sapiens
cctaacacagcatgtgta

SEQ ID NO: 1655297 - DNA, 11 bp, Homo sapiens
cctaaccaagt

SEQ ID NO: 1655298 - DNA, 15 bp, Homo sapiens
cctaaccccttccag

SEQ ID NO: 1655299 - DNA, 12 bp, Homo sapiens
cctaaccccttt

SEQ ID NO: 1655300 - DNA, 19 bp, Homo sapiens
cctaactcttttctatttt

SEQ ID NO: 1655301 - DNA, 22 bp, Homo sapiens
cctaagaagctctggccccagg

SEQ ID NO: 1655302 - DNA, 14 bp, Homo sapiens
cctaagacatgtga

SEQ ID NO: 1655303 - DNA, 21 bp, Homo sapiens
cctaagagtgtcactgagctg

SEQ ID NO: 1655304 - DNA, 16 bp, Homo sapiens
cctaagagtgtttaat

SEQ ID NO: 1655305 - DNA, 16 bp, Homo sapiens
cctaagcatctaagtt

SEQ ID NO: 1655306 - DNA, 15 bp, Homo sapiens
cctaagcccccaggg

SEQ ID NO: 1655307 - DNA, 18 bp, Homo sapiens
cctaagcccccagggcct

SEQ ID NO: 1655308 - DNA, 19 bp, Homo sapiens
cctaagcccccagggcctc

SEQ ID NO: 1655309 - DNA, 22 bp, Homo sapiens
cctaagcccccagggcctccag

SEQ ID NO: 1655310 - DNA, 23 bp, Homo sapiens
cctaagcccccagggcctccagg

SEQ ID NO: 1655311 - DNA, 20 bp, Homo sapiens
cctaagcggctgtttactgc

SEQ ID NO: 1655312 - DNA, 19 bp, Homo sapiens
cctaagctggagtgcagtg

SEQ ID NO: 1655313 - DNA, 15 bp, Homo sapiens
cctaaggacacacta

SEQ ID NO: 1655314 - DNA, 17 bp, Homo sapiens
cctaaggacacactaat

SEQ ID NO: 1655315 - DNA, 24 bp, Homo sapiens
cctaaggatctctcaggagcacag

SEQ ID NO: 1655316 - DNA, 23 bp, Homo sapiens
cctaaggcacccacaaataaatg

SEQ ID NO: 1655317 - DNA, 11 bp, Homo sapiens
cctaaggcatg

SEQ ID NO: 1655318 - DNA, 18 bp, Homo sapiens
cctaagggatcctgcctg

SEQ ID NO: 1655319 - DNA, 23 bp, Homo sapiens
cctaagggtcgaaagctctagaa

SEQ ID NO: 1655320 - DNA, 13 bp, Homo sapiens
cctaagtctctgt

SEQ ID NO: 1655321 - DNA, 17 bp, Homo sapiens
cctaagtgcccaaagtg

SEQ ID NO: 1655322 - DNA, 18 bp, Homo sapiens
cctaagtgcccaaagtgg

SEQ ID NO: 1655323 - DNA, 16 bp, Homo sapiens
cctaagtggctgctga

SEQ ID NO: 1655324 - DNA, 20 bp, Homo sapiens
cctaagtttcagttgatttt

SEQ ID NO: 1655325 - DNA, 18 bp, Homo sapiens
cctaataaacatccttca

SEQ ID NO: 1655326 - DNA, 17 bp, Homo sapiens
cctaatagcttttcctg

SEQ ID NO: 1655327 - DNA, 13 bp, Homo sapiens
cctaatccaggca

SEQ ID NO: 1655328 - DNA, 15 bp, Homo sapiens
cctaatccaggcaga

SEQ ID NO: 1655329 - DNA, 21 bp, Homo sapiens
cctaatccaggcagatccagg

SEQ ID NO: 1655330 - DNA, 21 bp, Homo sapiens
cctaatctcatacctctgacc

SEQ ID NO: 1655331 - DNA, 19 bp, Homo sapiens
cctaatggctatttttgaa

SEQ ID NO: 1655332 - DNA, 18 bp, Homo sapiens
cctaatgtttatgagcca

SEQ ID NO: 1655333 - DNA, 22 bp, Homo sapiens
cctaattattgtaatgtaataa

SEQ ID NO: 1655334 - DNA, 14 bp, Homo sapiens
cctaattcaatcct

SEQ ID NO: 1655335 - DNA, 19 bp, Homo sapiens
cctaattctcttcgctgtg

SEQ ID NO: 1655336 - DNA, 15 bp, Homo sapiens
cctaattcttctgtc

SEQ ID NO: 1655337 - DNA, 13 bp, Homo sapiens
cctaattgtggat

SEQ ID NO: 1655338 - DNA, 21 bp, Homo sapiens
cctacaagagcagcctgtggc

SEQ ID NO: 1655339 - DNA, 18 bp, Homo sapiens
cctacaagatttagaaaa

SEQ ID NO: 1655340 - DNA, 20 bp, Homo sapiens
cctacaagatttagaaaaaa

SEQ ID NO: 1655341 - DNA, 22 bp, Homo sapiens
cctacaagatttagaaaaaagt

SEQ ID NO: 1655342 - DNA, 22 bp, Homo sapiens
cctacacactgtcatgcttcat

SEQ ID NO: 1655343 - DNA, 13 bp, Homo sapiens
cctacacaggagt

SEQ ID NO: 1655344 - DNA, 14 bp, Homo sapiens
cctacacaggagtc

SEQ ID NO: 1655345 - DNA, 17 bp, Homo sapiens
cctacagaaatactgct

SEQ ID NO: 1655346 - DNA, 20 bp, Homo sapiens
cctacagaaatactgctctg

SEQ ID NO: 1655347 - DNA, 20 bp, Homo sapiens
cctacagactccatctcttc

SEQ ID NO: 1655348 - DNA, 21 bp, Homo sapiens
cctacagactccatctcttct

SEQ ID NO: 1655349 - DNA, 12 bp, Homo sapiens
cctacagcattg

SEQ ID NO: 1655350 - DNA, 23 bp, Homo sapiens
cctcacctcatgcccaccccctg

SEQ ID NO: 1655351 - DNA, 12 bp, Homo sapiens
cctcacctctga

SEQ ID NO: 1655352 - DNA, 15 bp, Homo sapiens
cctcacctctgagga

SEQ ID NO: 1655353 - DNA, 19 bp, Homo sapiens
cctcacctctgaggacaga

SEQ ID NO: 1655354 - DNA, 13 bp, Homo sapiens
cctcacctctgga

SEQ ID NO: 1655355 - DNA, 19 bp, Homo sapiens
cctcacctggtacctggac

SEQ ID NO: 1655356 - DNA, 17 bp, Homo sapiens
cctcacctttcccatct

SEQ ID NO: 1655357 - DNA, 17 bp, Homo sapiens
cctcacggggttggctg

SEQ ID NO: 1655358 - DNA, 21 bp, Homo sapiens
cctcacggggttggctgttcc

SEQ ID NO: 1655359 - DNA, 13 bp, Homo sapiens
cctcacgtgcagg

SEQ ID NO: 1655360 - DNA, 16 bp, Homo sapiens
cctcacgtgcaggaca

SEQ ID NO: 1655361 - DNA, 17 bp, Homo sapiens
cctcacgtgcaggacag

SEQ ID NO: 1655362 - DNA, 14 bp, Homo sapiens
cctcactaattttt

SEQ ID NO: 1655363 - DNA, 19 bp, Homo sapiens
cctcactactcgagcccac

SEQ ID NO: 1655364 - DNA, 23 bp, Homo sapiens
cctcactatgacactgagcaaga

SEQ ID NO: 1655365 - DNA, 21 bp, Homo sapiens
cctcactcaagaccaggctgc

SEQ ID NO: 1655366 - DNA, 13 bp, Homo sapiens
cctcactccacag

SEQ ID NO: 1655367 - DNA, 13 bp, Homo sapiens
cctcactccccag

SEQ ID NO: 1655368 - DNA, 16 bp, Homo sapiens
cctcactccccaggga

SEQ ID NO: 1655369 - DNA, 19 bp, Homo sapiens
cctcactccccagggagct

SEQ ID NO: 1655370 - DNA, 20 bp, Homo sapiens
cctcactgagaggcctggag

SEQ ID NO: 1655371 - DNA, 15 bp, Homo sapiens
cctcactggaggagc

SEQ ID NO: 1655372 - DNA, 16 bp, Homo sapiens
cctcactgtcctgtga

SEQ ID NO: 1655373 - DNA, 21 bp, Homo sapiens
cctcacttcccgtagctgcca

SEQ ID NO: 1655374 - DNA, 18 bp, Homo sapiens
cctcacttctgtctcctg

SEQ ID NO: 1655375 - DNA, 21 bp, Homo sapiens
cctcacttggctgtctgacca

SEQ ID NO: 1655376 - DNA, 12 bp, Homo sapiens
cctcagaagaaa

SEQ ID NO: 1655377 - DNA, 19 bp, Homo sapiens
cctcagaagaaaacttttg

SEQ ID NO: 1655378 - DNA, 15 bp, Homo sapiens
cctcagaaggcccca

SEQ ID NO: 1655379 - DNA, 22 bp, Homo sapiens
cctcagagacaccaaactgcca

SEQ ID NO: 1655380 - DNA, 14 bp, Homo sapiens
cctcagagaccagg

SEQ ID NO: 1655381 - DNA, 13 bp, Homo sapiens
cctcagagtggag

SEQ ID NO: 1655382 - DNA, 15 bp, Homo sapiens
cctcagatctctctc

SEQ ID NO: 1655383 - DNA, 14 bp, Homo sapiens
cctcagcaagccct

SEQ ID NO: 1655384 - DNA, 13 bp, Homo sapiens
cctcagcacccct

SEQ ID NO: 1655385 - DNA, 14 bp, Homo sapiens
cctcagcacccctt

SEQ ID NO: 1655386 - DNA, 22 bp, Homo sapiens
cctcagcaccccttccatgtgg

SEQ ID NO: 1655387 - DNA, 11 bp, Homo sapiens
cctcagccagt

SEQ ID NO: 1655388 - DNA, 13 bp, Homo sapiens
cctcagccctggc

SEQ ID NO: 1655389 - DNA, 18 bp, Homo sapiens
cctcagccctggccctgc

SEQ ID NO: 1655390 - DNA, 21 bp, Homo sapiens
cctcagccctggccctgccca

SEQ ID NO: 1655391 - DNA, 17 bp, Homo sapiens
cctcagcccttgccccc

SEQ ID NO: 1655392 - DNA, 22 bp, Homo sapiens
cctcagcccttgcccccatccc

SEQ ID NO: 1655393 - DNA, 20 bp, Homo sapiens
cctcagcctagaccctcctc

SEQ ID NO: 1655394 - DNA, 21 bp, Homo sapiens
cctcagcctccaaagtggagc

SEQ ID NO: 1655395 - DNA, 20 bp, Homo sapiens
cctcagcctccaatgcattg

SEQ ID NO: 1655396 - DNA, 12 bp, Homo sapiens
cctcagcctcct

SEQ ID NO: 1655397 - DNA, 16 bp, Homo sapiens
cctcagcctcctgagt

SEQ ID NO: 1655398 - DNA, 23 bp, Homo sapiens
cctcagcctgatcaggcttcctg

SEQ ID NO: 1655399 - DNA, 22 bp, Homo sapiens
cctcagcctggccagacacagg

SEQ ID NO: 1655400 - DNA, 22 bp, Homo sapiens
cctcagccttccccttgcccag

SEQ ID NO: 1655401 - DNA, 17 bp, Homo sapiens
cctcagccttgccagag

SEQ ID NO: 1655402 - DNA, 20 bp, Homo sapiens
cctcagccttgccagagatc

SEQ ID NO: 1655403 - DNA, 19 bp, Homo sapiens
cctcagcgggggccttgaa

SEQ ID NO: 1655404 - DNA, 20 bp, Homo sapiens
cctcagcgggggccttgaag

SEQ ID NO: 1655405 - DNA, 21 bp, Homo sapiens
cctcagcgggggccttgaaga

SEQ ID NO: 1655406 - DNA, 16 bp, Homo sapiens
cctcagctctctggga

SEQ ID NO: 1655407 - DNA, 11 bp, Homo sapiens
cctcagctgca

SEQ ID NO: 1655408 - DNA, 13 bp, Homo sapiens
cctcagctgcaca

SEQ ID NO: 1655409 - DNA, 18 bp, Homo sapiens
cctcagctgcacattcct

SEQ ID NO: 1655410 - DNA, 19 bp, Homo sapiens
cctcagctgcacattcctg

SEQ ID NO: 1655411 - DNA, 14 bp, Homo sapiens
cctcagctgccaag

SEQ ID NO: 1655412 - DNA, 19 bp, Homo sapiens
cctcagctgccaagcactc

SEQ ID NO: 1655413 - DNA, 14 bp, Homo sapiens
cctcagctgcctca

SEQ ID NO: 1655414 - DNA, 15 bp, Homo sapiens
cctcagctgcctcac

SEQ ID NO: 1655415 - DNA, 10 bp, Homo sapiens
cctcaggaat

SEQ ID NO: 1655416 - DNA, 13 bp, Homo sapiens
cctcaggagagac

SEQ ID NO: 1655417 - DNA, 15 bp, Homo sapiens
cctcaggcacacagc

SEQ ID NO: 1655418 - DNA, 16 bp, Homo sapiens
cctcaggcacacagct

SEQ ID NO: 1655419 - DNA, 18 bp, Homo sapiens
cctcaggcataggcctgg

SEQ ID NO: 1655420 - DNA, 15 bp, Homo sapiens
cctcaggctctgcac

SEQ ID NO: 1655421 - DNA, 19 bp, Homo sapiens
cctcaggctctgcacagac

SEQ ID NO: 1655422 - DNA, 17 bp, Homo sapiens
cctcaggcttccttggc

SEQ ID NO: 1655423 - DNA, 21 bp, Homo sapiens
cctcagggacagagacacctg

SEQ ID NO: 1655424 - DNA, 14 bp, Homo sapiens
cctcagggctccca

SEQ ID NO: 1655425 - DNA, 17 bp, Homo sapiens
cctcagggctcccaggg

SEQ ID NO: 1655426 - DNA, 18 bp, Homo sapiens
cctcagggctcccagggg

SEQ ID NO: 1655427 - DNA, 13 bp, Homo sapiens
cctcagggtgggg

SEQ ID NO: 1655428 - DNA, 22 bp, Homo sapiens
cctcaggtacggagaagaatag

SEQ ID NO: 1655429 - DNA, 18 bp, Homo sapiens
cctcaggtgctgtccatg

SEQ ID NO: 1655430 - DNA, 23 bp, Homo sapiens
cctcaggtggccagcctggatct

SEQ ID NO: 1655431 - DNA, 14 bp, Homo sapiens
cctcaggttccttt

SEQ ID NO: 1655432 - DNA, 15 bp, Homo sapiens
cctcagtagtccctg

SEQ ID NO: 1655433 - DNA, 19 bp, Homo sapiens
cctcagtagtccctgcaca

SEQ ID NO: 1655434 - DNA, 15 bp, Homo sapiens
cctcagtcagttccc

SEQ ID NO: 1655435 - DNA, 23 bp, Homo sapiens
cctcagtcagttcccggagcaca

SEQ ID NO: 1655436 - DNA, 15 bp, Homo sapiens
cctcagtgccacttg

SEQ ID NO: 1655437 - DNA, 22 bp, Homo sapiens
cctcagtgccacttgacattcc

SEQ ID NO: 1655438 - DNA, 19 bp, Homo sapiens
cctcagtggctctgggtac

SEQ ID NO: 1655439 - DNA, 14 bp, Homo sapiens
cctcagtgggaaga

SEQ ID NO: 1655440 - DNA, 16 bp, Homo sapiens
cctcagttcccagctc

SEQ ID NO: 1655441 - DNA, 19 bp, Homo sapiens
cctcagttcccagctcccc

SEQ ID NO: 1655442 - DNA, 19 bp, Homo sapiens
cctcagtttctccatcagc

SEQ ID NO: 1655443 - DNA, 22 bp, Homo sapiens
cctcatacccatgcacagtaca

SEQ ID NO: 1655444 - DNA, 13 bp, Homo sapiens
cctcatcactgga

SEQ ID NO: 1655445 - DNA, 18 bp, Homo sapiens
cctcatccaccaatctct

SEQ ID NO: 1655446 - DNA, 23 bp, Homo sapiens
cctcatcccctcgtcctgtccca

SEQ ID NO: 1655447 - DNA, 14 bp, Homo sapiens
cctcatccgaggca

SEQ ID NO: 1655448 - DNA, 15 bp, Homo sapiens
cctcatccgaggcag

SEQ ID NO: 1655449 - DNA, 17 bp, Homo sapiens
cctcatccgaggcaggg

SEQ ID NO: 1655450 - DNA, 20 bp, Homo sapiens
cctcatccgaggcagggtca

SEQ ID NO: 1655451 - DNA, 19 bp, Homo sapiens
cctcatctctctgcccaac

SEQ ID NO: 1655452 - DNA, 20 bp, Homo sapiens
cctcatctctctgcccaacc

SEQ ID NO: 1655453 - DNA, 15 bp, Homo sapiens
cctcatctgtggagc

SEQ ID NO: 1655454 - DNA, 15 bp, Homo sapiens
cctcatctttctcct

SEQ ID NO: 1655455 - DNA, 16 bp, Homo sapiens
cctcatgaatgtaaat

SEQ ID NO: 1655456 - DNA, 17 bp, Homo sapiens
cctcatgaatgtaaatt

SEQ ID NO: 1655457 - DNA, 16 bp, Homo sapiens
cctcatgacagccaga

SEQ ID NO: 1655458 - DNA, 14 bp, Homo sapiens
cctcatgccaaccc

SEQ ID NO: 1655459 - DNA, 21 bp, Homo sapiens
cctcatgccaaccctgggcta

SEQ ID NO: 1655460 - DNA, 20 bp, Homo sapiens
cctcatgcccaccccctgcc

SEQ ID NO: 1655461 - DNA, 19 bp, Homo sapiens
cctcatgcccagctctctg

SEQ ID NO: 1655462 - DNA, 18 bp, Homo sapiens
cctcatgctggagggagg

SEQ ID NO: 1655463 - DNA, 17 bp, Homo sapiens
cctcatggcccccaggg

SEQ ID NO: 1655464 - DNA, 20 bp, Homo sapiens
cctcatggcccccaggggca

SEQ ID NO: 1655465 - DNA, 17 bp, Homo sapiens
cctcctcacccaccctg

SEQ ID NO: 1655466 - DNA, 14 bp, Homo sapiens
cctcctcaccccca

SEQ ID NO: 1655467 - DNA, 12 bp, Homo sapiens
cctcctcacctc

SEQ ID NO: 1655468 - DNA, 15 bp, Homo sapiens
cctcctcacctcatg

SEQ ID NO: 1655469 - DNA, 22 bp, Homo sapiens
cctcctcacctcatgcccaccc

SEQ ID NO: 1655470 - DNA, 22 bp, Homo sapiens
cctcctcacctctggactggct

SEQ ID NO: 1655471 - DNA, 13 bp, Homo sapiens
cctcctcatcccg

SEQ ID NO: 1655472 - DNA, 20 bp, Homo sapiens
cctcctcatcccgtgttctc

SEQ ID NO: 1655473 - DNA, 23 bp, Homo sapiens
cctcctcatcccgtgttctcctt

SEQ ID NO: 1655474 - DNA, 12 bp, Homo sapiens
cctcctcatgta

SEQ ID NO: 1655475 - DNA, 21 bp, Homo sapiens
cctcctcatgtacataccctg

SEQ ID NO: 1655476 - DNA, 12 bp, Homo sapiens
cctcctccaccc

SEQ ID NO: 1655477 - DNA, 12 bp, Homo sapiens
cctcctccactc

SEQ ID NO: 1655478 - DNA, 20 bp, Homo sapiens
cctcctccagcccctgtccc

SEQ ID NO: 1655479 - DNA, 20 bp, Homo sapiens
cctcctccagggtgatttta

SEQ ID NO: 1655480 - DNA, 15 bp, Homo sapiens
cctcctcccatctcc

SEQ ID NO: 1655481 - DNA, 21 bp, Homo sapiens
cctcctccccaactgtggggg

SEQ ID NO: 1655482 - DNA, 16 bp, Homo sapiens
cctcctccccctgttc

SEQ ID NO: 1655483 - DNA, 18 bp, Homo sapiens
cctcctcggagagcagca

SEQ ID NO: 1655484 - DNA, 17 bp, Homo sapiens
cctcctcgggccgaggc

SEQ ID NO: 1655485 - DNA, 14 bp, Homo sapiens
cctcctctcagtgt

SEQ ID NO: 1655486 - DNA, 12 bp, Homo sapiens
cctcctctgcca

SEQ ID NO: 1655487 - DNA, 18 bp, Homo sapiens
cctcctctgccacctccc

SEQ ID NO: 1655488 - DNA, 21 bp, Homo sapiens
cctcctctgccacctccccta

SEQ ID NO: 1655489 - DNA, 20 bp, Homo sapiens
cctcctctggacggcaggct

SEQ ID NO: 1655490 - DNA, 21 bp, Homo sapiens
cctcctcttcccttagcctct

SEQ ID NO: 1655491 - DNA, 17 bp, Homo sapiens
cctcctcttctgacgtg

SEQ ID NO: 1655492 - DNA, 15 bp, Homo sapiens
cctcctgacctgtca

SEQ ID NO: 1655493 - DNA, 16 bp, Homo sapiens
cctcctgcaggctggc

SEQ ID NO: 1655494 - DNA, 12 bp, Homo sapiens
cctcctgcccag

SEQ ID NO: 1655495 - DNA, 16 bp, Homo sapiens
cctcctgcccaggaga

SEQ ID NO: 1655496 - DNA, 12 bp, Homo sapiens
cctcctgctcct

SEQ ID NO: 1655497 - DNA, 19 bp, Homo sapiens
cctcctgctcctccctgcc

SEQ ID NO: 1655498 - DNA, 17 bp, Homo sapiens
cctcctgctctgggacg

SEQ ID NO: 1655499 - DNA, 13 bp, Homo sapiens
cctcctgctgtgc

SEQ ID NO: 1655500 - DNA, 15 bp, Homo sapiens
cctcctgctgtgctg

SEQ ID NO: 1655501 - DNA, 20 bp, Homo sapiens
cctcctgctgtgctggaatt

SEQ ID NO: 1655502 - DNA, 18 bp, Homo sapiens
cctcctggactcccctcc

SEQ ID NO: 1655503 - DNA, 15 bp, Homo sapiens
cctcctggctcaggc

SEQ ID NO: 1655504 - DNA, 16 bp, Homo sapiens
cctcctggctcaggcc

SEQ ID NO: 1655505 - DNA, 23 bp, Homo sapiens
cctcctgggaaggagggagctgc

SEQ ID NO: 1655506 - DNA, 23 bp, Homo sapiens
cctcctgggaaggccacctccca

SEQ ID NO: 1655507 - DNA, 14 bp, Homo sapiens
cctcctgttctgaa

SEQ ID NO: 1655508 - DNA, 16 bp, Homo sapiens
cctcctgttctgccca

SEQ ID NO: 1655509 - DNA, 17 bp, Homo sapiens
cctcctgttctgcccac

SEQ ID NO: 1655510 - DNA, 16 bp, Homo sapiens
cctcctgtttgcaggc

SEQ ID NO: 1655511 - DNA, 18 bp, Homo sapiens
cctccttagccctgtctg

SEQ ID NO: 1655512 - DNA, 22 bp, Homo sapiens
cctccttcagacaccctcaacc

SEQ ID NO: 1655513 - DNA, 14 bp, Homo sapiens
cctccttcccatgc

SEQ ID NO: 1655514 - DNA, 12 bp, Homo sapiens
cctccttcccgc

SEQ ID NO: 1655515 - DNA, 14 bp, Homo sapiens
cctccttccttgac

SEQ ID NO: 1655516 - DNA, 18 bp, Homo sapiens
cctccttccttgaccagc

SEQ ID NO: 1655517 - DNA, 14 bp, Homo sapiens
cctccttctcccct

SEQ ID NO: 1655518 - DNA, 21 bp, Homo sapiens
cctccttctcccctgccggtg

SEQ ID NO: 1655519 - DNA, 22 bp, Homo sapiens
cctccttggctttatgcaaata

SEQ ID NO: 1655520 - DNA, 12 bp, Homo sapiens
cctccttgggca

SEQ ID NO: 1655521 - DNA, 15 bp, Homo sapiens
cctccttggtgcctg

SEQ ID NO: 1655522 - DNA, 14 bp, Homo sapiens
cctccttgtccagg

SEQ ID NO: 1655523 - DNA, 16 bp, Homo sapiens
cctccttgtccaggtc

SEQ ID NO: 1655524 - DNA, 14 bp, Homo sapiens
cctccttgtgcaat

SEQ ID NO: 1655525 - DNA, 21 bp, Homo sapiens
cctccttgtgcaattgtcttt

SEQ ID NO: 1655526 - DNA, 21 bp, Homo sapiens
cctcctttcttattctgtgag

SEQ ID NO: 1655527 - DNA, 17 bp, Homo sapiens
cctcctttgtttaataa

SEQ ID NO: 1655528 - DNA, 15 bp, Homo sapiens
cctccttttcacttt

SEQ ID NO: 1655529 - DNA, 14 bp, Homo sapiens
cctcgaacccactc

SEQ ID NO: 1655530 - DNA, 15 bp, Homo sapiens
cctcgaacccactcc

SEQ ID NO: 1655531 - DNA, 13 bp, Homo sapiens
cctcgaagccatg

SEQ ID NO: 1655532 - DNA, 17 bp, Homo sapiens
cctcgacagggcctgga

SEQ ID NO: 1655533 - DNA, 19 bp, Homo sapiens
cctcgacagggcctggagc

SEQ ID NO: 1655534 - DNA, 22 bp, Homo sapiens
cctcgacagggcctggagcccc

SEQ ID NO: 1655535 - DNA, 15 bp, Homo sapiens
cctcgaccctgtgca

SEQ ID NO: 1655536 - DNA, 22 bp, Homo sapiens
cctcgacctccccacccgctcc

SEQ ID NO: 1655537 - DNA, 20 bp, Homo sapiens
cctcgaggcaccggcgctgc

SEQ ID NO: 1655538 - DNA, 15 bp, Homo sapiens
cctcgcacaggccct

SEQ ID NO: 1655539 - DNA, 14 bp, Homo sapiens
cctcgccctgtgag

SEQ ID NO: 1655540 - DNA, 19 bp, Homo sapiens
cctcgcccttcagcccacc

SEQ ID NO: 1655541 - DNA, 20 bp, Homo sapiens
cctcgccgtccctcccaggt

SEQ ID NO: 1655542 - DNA, 15 bp, Homo sapiens
cctcgctcccttcaa

SEQ ID NO: 1655543 - DNA, 15 bp, Homo sapiens
cctcgctgctgctac

SEQ ID NO: 1655544 - DNA, 13 bp, Homo sapiens
cctcggaagagcc

SEQ ID NO: 1655545 - DNA, 13 bp, Homo sapiens
cctcggactccat

SEQ ID NO: 1655546 - DNA, 12 bp, Homo sapiens
cctcggagaaga

SEQ ID NO: 1655547 - DNA, 14 bp, Homo sapiens
cctcggagaagagc

SEQ ID NO: 1655548 - DNA, 18 bp, Homo sapiens
cctcggagccaatgaaca

SEQ ID NO: 1655549 - DNA, 16 bp, Homo sapiens
cctcggagcctcatcc

SEQ ID NO: 1655550 - DNA, 19 bp, Homo sapiens
cctcggaggtccagctggg

SEQ ID NO: 1655551 - DNA, 12 bp, Homo sapiens
cctcggcctccc

SEQ ID NO: 1655552 - DNA, 18 bp, Homo sapiens
cctcgggaagcagccagc

SEQ ID NO: 1655553 - DNA, 19 bp, Homo sapiens
cctcgggaagcagccagct

SEQ ID NO: 1655554 - DNA, 16 bp, Homo sapiens
cctcgggcccacctgg

SEQ ID NO: 1655555 - DNA, 20 bp, Homo sapiens
cctcgggcccacctggccac

SEQ ID NO: 1655556 - DNA, 21 bp, Homo sapiens
cctcgggcccacctggccacc

SEQ ID NO: 1655557 - DNA, 18 bp, Homo sapiens
cctcgggccccatcctca

SEQ ID NO: 1655558 - DNA, 20 bp, Homo sapiens
cctcgggccgaggcccagcg

SEQ ID NO: 1655559 - DNA, 19 bp, Homo sapiens
cctcgggcgagtcactgcc

SEQ ID NO: 1655560 - DNA, 14 bp, Homo sapiens
cctcggggacacca

SEQ ID NO: 1655561 - DNA, 15 bp, Homo sapiens
cctcggggacaccag

SEQ ID NO: 1655562 - DNA, 15 bp, Homo sapiens
cctcgggggcctgtg

SEQ ID NO: 1655563 - DNA, 12 bp, Homo sapiens
cctcgggtgggg

SEQ ID NO: 1655564 - DNA, 15 bp, Homo sapiens
cctcggtatctggct

SEQ ID NO: 1655565 - DNA, 19 bp, Homo sapiens
cctcggtgggccagagctg

SEQ ID NO: 1655566 - DNA, 16 bp, Homo sapiens
cctcgtcctccccctg

SEQ ID NO: 1655567 - DNA, 16 bp, Homo sapiens
cctcgtcttcagctgc

SEQ ID NO: 1655568 - DNA, 23 bp, Homo sapiens
cctcgtgaggggcaagctaggcc

SEQ ID NO: 1655569 - DNA, 12 bp, Homo sapiens
cctcgtgccagc

SEQ ID NO: 1655570 - DNA, 17 bp, Homo sapiens
cctcgtgccagcagcct

SEQ ID NO: 1655571 - DNA, 21 bp, Homo sapiens
cctcgtgccagcagcctcgca

SEQ ID NO: 1655572 - DNA, 17 bp, Homo sapiens
cctcgtgcctgggggag

SEQ ID NO: 1655573 - DNA, 19 bp, Homo sapiens
cctcgtgcctgggggagag

SEQ ID NO: 1655574 - DNA, 14 bp, Homo sapiens
cctcgtggccagcc

SEQ ID NO: 1655575 - DNA, 17 bp, Homo sapiens
cctcgtggccagcccgg

SEQ ID NO: 1655576 - DNA, 20 bp, Homo sapiens
cctcgtggcggggcagcagg

SEQ ID NO: 1655577 - DNA, 20 bp, Homo sapiens
cctcgttggaagaggaacag

SEQ ID NO: 1655578 - DNA, 23 bp, Homo sapiens
cctctaaagcaataatggtccca

SEQ ID NO: 1655579 - DNA, 22 bp, Homo sapiens
cctctaaagcagaggcaacact

SEQ ID NO: 1655580 - DNA, 15 bp, Homo sapiens
cctgaaattccaaag

SEQ ID NO: 1655581 - DNA, 16 bp, Homo sapiens
cctgaaattccaaagt

SEQ ID NO: 1655582 - DNA, 18 bp, Homo sapiens
cctgaaattccaaagtct

SEQ ID NO: 1655583 - DNA, 16 bp, Homo sapiens
cctgaacaagaattgg

SEQ ID NO: 1655584 - DNA, 18 bp, Homo sapiens
cctgaacatccttccttc

SEQ ID NO: 1655585 - DNA, 19 bp, Homo sapiens
cctgaaccccagaggcaga

SEQ ID NO: 1655586 - DNA, 17 bp, Homo sapiens
cctgaaccccatgggct

SEQ ID NO: 1655587 - DNA, 18 bp, Homo sapiens
cctgaaccccatgggctt

SEQ ID NO: 1655588 - DNA, 20 bp, Homo sapiens
cctgaaccccatgggcttgg

SEQ ID NO: 1655589 - DNA, 15 bp, Homo sapiens
cctgaacccctggcc

SEQ ID NO: 1655590 - DNA, 19 bp, Homo sapiens
cctgaacccctggccagct

SEQ ID NO: 1655591 - DNA, 16 bp, Homo sapiens
cctgaaccgcacagct

SEQ ID NO: 1655592 - DNA, 22 bp, Homo sapiens
cctgaaccgcacagctcaggag

SEQ ID NO: 1655593 - DNA, 13 bp, Homo sapiens
cctgaactcccag

SEQ ID NO: 1655594 - DNA, 19 bp, Homo sapiens
cctgaactgaggccttgtg

SEQ ID NO: 1655595 - DNA, 17 bp, Homo sapiens
cctgaagaaccagtccc

SEQ ID NO: 1655596 - DNA, 14 bp, Homo sapiens
cctgaagatttcag

SEQ ID NO: 1655597 - DNA, 18 bp, Homo sapiens
cctgaagatttcagaggc

SEQ ID NO: 1655598 - DNA, 18 bp, Homo sapiens
cctgaagcagttcagaag

SEQ ID NO: 1655599 - DNA, 17 bp, Homo sapiens
cctgaagccattggaga

SEQ ID NO: 1655600 - DNA, 12 bp, Homo sapiens
cctgaagcctgg

SEQ ID NO: 1655601 - DNA, 16 bp, Homo sapiens
cctgaatcatgagcct

SEQ ID NO: 1655602 - DNA, 22 bp, Homo sapiens
cctgaatcatgagcctgctgga

SEQ ID NO: 1655603 - DNA, 20 bp, Homo sapiens
cctgaatccaaactaatcca

SEQ ID NO: 1655604 - DNA, 20 bp, Homo sapiens
cctgaatggttccatgcctg

SEQ ID NO: 1655605 - DNA, 23 bp, Homo sapiens
cctgaatggttccatgcctgagg

SEQ ID NO: 1655606 - DNA, 23 bp, Homo sapiens
cctgaatgtattgaacttggaaa

SEQ ID NO: 1655607 - DNA, 21 bp, Homo sapiens
cctgaattctatttgctgggc

SEQ ID NO: 1655608 - DNA, 14 bp, Homo sapiens
cctgacaatggcag

SEQ ID NO: 1655609 - DNA, 18 bp, Homo sapiens
cctgacacaccaggcgct

SEQ ID NO: 1655610 - DNA, 14 bp, Homo sapiens
cctgacacactaac

SEQ ID NO: 1655611 - DNA, 14 bp, Homo sapiens
cctgacaccccctc

SEQ ID NO: 1655612 - DNA, 21 bp, Homo sapiens
cctgacaccgtccctcagtga

SEQ ID NO: 1655613 - DNA, 16 bp, Homo sapiens
cctgacagaaggactc

SEQ ID NO: 1655614 - DNA, 15 bp, Homo sapiens
cctgacagaaggtgc

SEQ ID NO: 1655615 - DNA, 23 bp, Homo sapiens
cctgaccaaacagccaactagcc

SEQ ID NO: 1655616 - DNA, 13 bp, Homo sapiens
cctgaccaccctc

SEQ ID NO: 1655617 - DNA, 15 bp, Homo sapiens
cctgaccaccctccc

SEQ ID NO: 1655618 - DNA, 23 bp, Homo sapiens
cctgaccaccctcccctctcttg

SEQ ID NO: 1655619 - DNA, 22 bp, Homo sapiens
cctgaccataatcctagccccg

SEQ ID NO: 1655620 - DNA, 20 bp, Homo sapiens
cctgacctaccccagccagg

SEQ ID NO: 1655621 - DNA, 14 bp, Homo sapiens
cctgacctgtctca

SEQ ID NO: 1655622 - DNA, 13 bp, Homo sapiens
cctgacgccctgc

SEQ ID NO: 1655623 - DNA, 18 bp, Homo sapiens
cctgacgccctgcgttgg

SEQ ID NO: 1655624 - DNA, 20 bp, Homo sapiens
cctgacggcgcccccagtgt

SEQ ID NO: 1655625 - DNA, 20 bp, Homo sapiens
cctgacgtctgaagcttgac

SEQ ID NO: 1655626 - DNA, 20 bp, Homo sapiens
cctgactaatttttgtattt

SEQ ID NO: 1655627 - DNA, 21 bp, Homo sapiens
cctgactcaattatttgcata

SEQ ID NO: 1655628 - DNA, 14 bp, Homo sapiens
cctgactcctgact

SEQ ID NO: 1655629 - DNA, 13 bp, Homo sapiens
cctgactcctggg

SEQ ID NO: 1655630 - DNA, 16 bp, Homo sapiens
cctgactctctgtgac

SEQ ID NO: 1655631 - DNA, 13 bp, Homo sapiens
cctgactgctcag

SEQ ID NO: 1655632 - DNA, 12 bp, Homo sapiens
cctgacttgagt

SEQ ID NO: 1655633 - DNA, 19 bp, Homo sapiens
cctgacttggggagatgga

SEQ ID NO: 1655634 - DNA, 12 bp, Homo sapiens
cctgactttctc

SEQ ID NO: 1655635 - DNA, 14 bp, Homo sapiens
cctgagaaagctca

SEQ ID NO: 1655636 - DNA, 19 bp, Homo sapiens
cctgagacaaatggaggcc

SEQ ID NO: 1655637 - DNA, 18 bp, Homo sapiens
cctgagaccctactgaag

SEQ ID NO: 1655638 - DNA, 19 bp, Homo sapiens
cctgagacctccactccac

SEQ ID NO: 1655639 - DNA, 19 bp, Homo sapiens
cctgagacctctagagaaa

SEQ ID NO: 1655640 - DNA, 13 bp, Homo sapiens
cctgagactccag

SEQ ID NO: 1655641 - DNA, 14 bp, Homo sapiens
cctgagactccaga

SEQ ID NO: 1655642 - DNA, 22 bp, Homo sapiens
cctgagagagaatagagctgcc

SEQ ID NO: 1655643 - DNA, 23 bp, Homo sapiens
cctgagagagaatagagctgcca

SEQ ID NO: 1655644 - DNA, 18 bp, Homo sapiens
cctgagatacttcccaaa

SEQ ID NO: 1655645 - DNA, 21 bp, Homo sapiens
cctgagattctttaaggagat

SEQ ID NO: 1655646 - DNA, 18 bp, Homo sapiens
cctgagatttcatctgct

SEQ ID NO: 1655647 - DNA, 21 bp, Homo sapiens
cctgagcaacagagtgagacc

SEQ ID NO: 1655648 - DNA, 18 bp, Homo sapiens
cctgagcacctcccagcc

SEQ ID NO: 1655649 - DNA, 22 bp, Homo sapiens
cctgagcacctcccagcccctg

SEQ ID NO: 1655650 - DNA, 21 bp, Homo sapiens
cctgagcagaatactggtctc

SEQ ID NO: 1655651 - DNA, 13 bp, Homo sapiens
cctgagcagggtc

SEQ ID NO: 1655652 - DNA, 15 bp, Homo sapiens
cctgagcagggtcca

SEQ ID NO: 1655653 - DNA, 23 bp, Homo sapiens
cctgagcagggtccacagctgga

SEQ ID NO: 1655654 - DNA, 22 bp, Homo sapiens
cctgagccagggaacagcccca

SEQ ID NO: 1655655 - DNA, 15 bp, Homo sapiens
cctgagcccagagaa

SEQ ID NO: 1655656 - DNA, 14 bp, Homo sapiens
cctgagcccaggag

SEQ ID NO: 1655657 - DNA, 16 bp, Homo sapiens
cctgagccccctgcac

SEQ ID NO: 1655658 - DNA, 21 bp, Homo sapiens
cctgagccctactccctgcag

SEQ ID NO: 1655659 - DNA, 16 bp, Homo sapiens
cctgagccggccccag

SEQ ID NO: 1655660 - DNA, 14 bp, Homo sapiens
cctgagcgctgtgg

SEQ ID NO: 1655661 - DNA, 15 bp, Homo sapiens
cctgagcgctgtgga

SEQ ID NO: 1655662 - DNA, 16 bp, Homo sapiens
cctgagcgctgtggac

SEQ ID NO: 1655663 - DNA, 24 bp, Homo sapiens
cctgagcgctgtggactgtcctga

SEQ ID NO: 1655664 - DNA, 20 bp, Homo sapiens
cctgagctcggggggctctg

SEQ ID NO: 1655665 - DNA, 15 bp, Homo sapiens
cctgagctggggaag

SEQ ID NO: 1655666 - DNA, 16 bp, Homo sapiens
cctgagctggggaagc

SEQ ID NO: 1655667 - DNA, 16 bp, Homo sapiens
cctgagctggggccac

SEQ ID NO: 1655668 - DNA, 18 bp, Homo sapiens
cctgagctttggggacag

SEQ ID NO: 1655669 - DNA, 12 bp, Homo sapiens
cctgaggaatga

SEQ ID NO: 1655670 - DNA, 16 bp, Homo sapiens
cctgaggagccctgag

SEQ ID NO: 1655671 - DNA, 21 bp, Homo sapiens
cctgaggagccctgaggacct

SEQ ID NO: 1655672 - DNA, 17 bp, Homo sapiens
cctgaggatgagctgga

SEQ ID NO: 1655673 - DNA, 21 bp, Homo sapiens
cctgaggccaggacgtctggg

SEQ ID NO: 1655674 - DNA, 14 bp, Homo sapiens
cctgaggccttcca

SEQ ID NO: 1655675 - DNA, 14 bp, Homo sapiens
cctgaggctgagac

SEQ ID NO: 1655676 - DNA, 14 bp, Homo sapiens
cctgaggctgtggt

SEQ ID NO: 1655677 - DNA, 16 bp, Homo sapiens
cctgaggctgtggtca

SEQ ID NO: 1655678 - DNA, 18 bp, Homo sapiens
cctgaggggcatctgccc

SEQ ID NO: 1655679 - DNA, 13 bp, Homo sapiens
cctgagggtggag

SEQ ID NO: 1655680 - DNA, 16 bp, Homo sapiens
cctgagggtggagact

SEQ ID NO: 1655681 - DNA, 16 bp, Homo sapiens
cctgaggtgggcccag

SEQ ID NO: 1655682 - DNA, 23 bp, Homo sapiens
cctgaggtgggcccaggaccagc

SEQ ID NO: 1655683 - DNA, 19 bp, Homo sapiens
cctgaggtgtgggggctgc

SEQ ID NO: 1655684 - DNA, 22 bp, Homo sapiens
cctgaggtgtgggggctgcagc

SEQ ID NO: 1655685 - DNA, 20 bp, Homo sapiens
cctgagtaatcgcttaaaga

SEQ ID NO: 1655686 - DNA, 17 bp, Homo sapiens
cctgagtcaactggagc

SEQ ID NO: 1655687 - DNA, 18 bp, Homo sapiens
cctgagtcaactggagca

SEQ ID NO: 1655688 - DNA, 13 bp, Homo sapiens
cctgagtcaccag

SEQ ID NO: 1655689 - DNA, 14 bp, Homo sapiens
cctgagtcagtgct

SEQ ID NO: 1655690 - DNA, 21 bp, Homo sapiens
cctgagtcagtgctctcagct

SEQ ID NO: 1655691 - DNA, 21 bp, Homo sapiens
cctgagtcggccccacatggg

SEQ ID NO: 1655692 - DNA, 21 bp, Homo sapiens
cctgagtcgtacagaaagctg

SEQ ID NO: 1655693 - DNA, 18 bp, Homo sapiens
cctgagtctcctgtgccc

SEQ ID NO: 1655694 - DNA, 18 bp, Homo sapiens
cctgccggtgggaccctg

SEQ ID NO: 1655695 - DNA, 20 bp, Homo sapiens
cctgcctaagggagagtggt

SEQ ID NO: 1655696 - DNA, 21 bp, Homo sapiens
cctgcctaggaattcccagcc

SEQ ID NO: 1655697 - DNA, 19 bp, Homo sapiens
cctgcctattatctgtcag

SEQ ID NO: 1655698 - DNA, 14 bp, Homo sapiens
cctgcctcagcctc

SEQ ID NO: 1655699 - DNA, 14 bp, Homo sapiens
cctgcctccaccag

SEQ ID NO: 1655700 - DNA, 18 bp, Homo sapiens
cctgcctccaccagcaag

SEQ ID NO: 1655701 - DNA, 12 bp, Homo sapiens
cctgcctccagg

SEQ ID NO: 1655702 - DNA, 18 bp, Homo sapiens
cctgcctcctgccacccc

SEQ ID NO: 1655703 - DNA, 20 bp, Homo sapiens
cctgcctcctggctcaggcc

SEQ ID NO: 1655704 - DNA, 23 bp, Homo sapiens
cctgcctctcatcaactgaatga

SEQ ID NO: 1655705 - DNA, 22 bp, Homo sapiens
cctgcctctgtgtagccgccct

SEQ ID NO: 1655706 - DNA, 17 bp, Homo sapiens
cctgcctgagcccagga

SEQ ID NO: 1655707 - DNA, 13 bp, Homo sapiens
cctgcctgaggag

SEQ ID NO: 1655708 - DNA, 19 bp, Homo sapiens
cctgcctgagggcccctct

SEQ ID NO: 1655709 - DNA, 20 bp, Homo sapiens
cctgcctgagggcccctctg

SEQ ID NO: 1655710 - DNA, 20 bp, Homo sapiens
cctgcctgagtttccagcct

SEQ ID NO: 1655711 - DNA, 14 bp, Homo sapiens
cctgcctgatccct

SEQ ID NO: 1655712 - DNA, 20 bp, Homo sapiens
cctgcctgcatggcatcaga

SEQ ID NO: 1655713 - DNA, 12 bp, Homo sapiens
cctgcctggccc

SEQ ID NO: 1655714 - DNA, 16 bp, Homo sapiens
cctgcctggtcctccc

SEQ ID NO: 1655715 - DNA, 13 bp, Homo sapiens
cctgcctggtgca

SEQ ID NO: 1655716 - DNA, 23 bp, Homo sapiens
cctgcctggtgcattgctgtgtg

SEQ ID NO: 1655717 - DNA, 13 bp, Homo sapiens
cctgcctgtctgc

SEQ ID NO: 1655718 - DNA, 14 bp, Homo sapiens
cctgcctgtctgcc

SEQ ID NO: 1655719 - DNA, 16 bp, Homo sapiens
cctgcctgtctgcccc

SEQ ID NO: 1655720 - DNA, 14 bp, Homo sapiens
cctgcctgtgtgct

SEQ ID NO: 1655721 - DNA, 16 bp, Homo sapiens
cctgccttatcttgca

SEQ ID NO: 1655722 - DNA, 18 bp, Homo sapiens
cctgccttcttcggggaa

SEQ ID NO: 1655723 - DNA, 16 bp, Homo sapiens
cctgccttgaagccac

SEQ ID NO: 1655724 - DNA, 18 bp, Homo sapiens
cctgcctttaagccaaag

SEQ ID NO: 1655725 - DNA, 16 bp, Homo sapiens
cctgcgaccctggggg

SEQ ID NO: 1655726 - DNA, 17 bp, Homo sapiens
cctgcgaccctgggggc

SEQ ID NO: 1655727 - DNA, 16 bp, Homo sapiens
cctgcgcctccagagg

SEQ ID NO: 1655728 - DNA, 14 bp, Homo sapiens
cctgcgcctgtgat

SEQ ID NO: 1655729 - DNA, 15 bp, Homo sapiens
cctgcgcctgtgatg

SEQ ID NO: 1655730 - DNA, 20 bp, Homo sapiens
cctgcggagtgaagaggggc

SEQ ID NO: 1655731 - DNA, 22 bp, Homo sapiens
cctgcggagtgaagaggggcag

SEQ ID NO: 1655732 - DNA, 17 bp, Homo sapiens
cctgcgggcgcgggcag

SEQ ID NO: 1655733 - DNA, 22 bp, Homo sapiens
cctgcgggctgccccgctttgc

SEQ ID NO: 1655734 - DNA, 15 bp, Homo sapiens
cctgcggggccaccc

SEQ ID NO: 1655735 - DNA, 15 bp, Homo sapiens
cctgcgtcctcctca

SEQ ID NO: 1655736 - DNA, 17 bp, Homo sapiens
cctgcgtcctcctcacc

SEQ ID NO: 1655737 - DNA, 19 bp, Homo sapiens
cctgcgtcctcctcacctc

SEQ ID NO: 1655738 - DNA, 17 bp, Homo sapiens
cctgcgtctgtttttaa

SEQ ID NO: 1655739 - DNA, 19 bp, Homo sapiens
cctgcgtgcgctggttccg

SEQ ID NO: 1655740 - DNA, 12 bp, Homo sapiens
cctgcgtggggg

SEQ ID NO: 1655741 - DNA, 13 bp, Homo sapiens
cctgcgtgggggc

SEQ ID NO: 1655742 - DNA, 17 bp, Homo sapiens
cctgcgttggagccact

SEQ ID NO: 1655743 - DNA, 18 bp, Homo sapiens
cctgcgttggagccactc

SEQ ID NO: 1655744 - DNA, 23 bp, Homo sapiens
cctgcgttggagccactcctgtc

SEQ ID NO: 1655745 - DNA, 18 bp, Homo sapiens
cctgcgtttggaggcccc

SEQ ID NO: 1655746 - DNA, 20 bp, Homo sapiens
cctgcgtttggaggcccctg

SEQ ID NO: 1655747 - DNA, 18 bp, Homo sapiens
cctgctaaggctcctcct

SEQ ID NO: 1655748 - DNA, 19 bp, Homo sapiens
cctgctaaggctcctcctt

SEQ ID NO: 1655749 - DNA, 20 bp, Homo sapiens
cctgctactcctgtgctctg

SEQ ID NO: 1655750 - DNA, 16 bp, Homo sapiens
cctgctactctgttcc

SEQ ID NO: 1655751 - DNA, 13 bp, Homo sapiens
cctgctagagcaa

SEQ ID NO: 1655752 - DNA, 23 bp, Homo sapiens
cctgctagagcaacccctgtacc

SEQ ID NO: 1655753 - DNA, 19 bp, Homo sapiens
cctgctcacgtcaaatgca

SEQ ID NO: 1655754 - DNA, 15 bp, Homo sapiens
cctgctcagcagcca

SEQ ID NO: 1655755 - DNA, 16 bp, Homo sapiens
cctgctcagcagccag

SEQ ID NO: 1655756 - DNA, 17 bp, Homo sapiens
cctgctcattatgccac

SEQ ID NO: 1655757 - DNA, 16 bp, Homo sapiens
cctgctccagacctga

SEQ ID NO: 1655758 - DNA, 22 bp, Homo sapiens
cctgctccagacctgatcctgg

SEQ ID NO: 1655759 - DNA, 12 bp, Homo sapiens
cctgctccagca

SEQ ID NO: 1655760 - DNA, 19 bp, Homo sapiens
cctgctccagcagcacacc

SEQ ID NO: 1655761 - DNA, 23 bp, Homo sapiens
cctgctccagcagcacacctcag

SEQ ID NO: 1655762 - DNA, 12 bp, Homo sapiens
cctgctcccagc

SEQ ID NO: 1655763 - DNA, 14 bp, Homo sapiens
cctgctcccagcag

SEQ ID NO: 1655764 - DNA, 15 bp, Homo sapiens
cctgctcccagtggg

SEQ ID NO: 1655765 - DNA, 18 bp, Homo sapiens
cctgctcccccaccccct

SEQ ID NO: 1655766 - DNA, 13 bp, Homo sapiens
cctgctccctgtc

SEQ ID NO: 1655767 - DNA, 14 bp, Homo sapiens
cctgctccctgtct

SEQ ID NO: 1655768 - DNA, 15 bp, Homo sapiens
cctgctccgctgcct

SEQ ID NO: 1655769 - DNA, 21 bp, Homo sapiens
cctgctccgctgcctggaaca

SEQ ID NO: 1655770 - DNA, 19 bp, Homo sapiens
cctgctcctccctgccccc

SEQ ID NO: 1655771 - DNA, 19 bp, Homo sapiens
cctgctcctccctggctgc

SEQ ID NO: 1655772 - DNA, 20 bp, Homo sapiens
cctgctctaacacctgccta

SEQ ID NO: 1655773 - DNA, 18 bp, Homo sapiens
cctgctctagtgggacag

SEQ ID NO: 1655774 - DNA, 22 bp, Homo sapiens
cctgctctagtgggacagccca

SEQ ID NO: 1655775 - DNA, 13 bp, Homo sapiens
cctgctctctgag

SEQ ID NO: 1655776 - DNA, 14 bp, Homo sapiens
cctgctctctgagt

SEQ ID NO: 1655777 - DNA, 16 bp, Homo sapiens
cctgctctcttcagga

SEQ ID NO: 1655778 - DNA, 14 bp, Homo sapiens
cctgctctggagcc

SEQ ID NO: 1655779 - DNA, 15 bp, Homo sapiens
cctgctctgggacgt

SEQ ID NO: 1655780 - DNA, 17 bp, Homo sapiens
cctgctctgggacgtgg

SEQ ID NO: 1655781 - DNA, 18 bp, Homo sapiens
cctgctctgggacgtgga

SEQ ID NO: 1655782 - DNA, 20 bp, Homo sapiens
cctgctctgggacgtggaca

SEQ ID NO: 1655783 - DNA, 23 bp, Homo sapiens
cctgctctgggacgtggacatgc

SEQ ID NO: 1655784 - DNA, 13 bp, Homo sapiens
cctgctgaagctg

SEQ ID NO: 1655785 - DNA, 13 bp, Homo sapiens
cctgctgaatgcc

SEQ ID NO: 1655786 - DNA, 21 bp, Homo sapiens
cctgctgaatgcctcgctccc

SEQ ID NO: 1655787 - DNA, 14 bp, Homo sapiens
cctgctgacagaca

SEQ ID NO: 1655788 - DNA, 16 bp, Homo sapiens
cctgctgacagacact

SEQ ID NO: 1655789 - DNA, 20 bp, Homo sapiens
cctgctgacagacactaact

SEQ ID NO: 1655790 - DNA, 13 bp, Homo sapiens
cctgctgaggagg

SEQ ID NO: 1655791 - DNA, 17 bp, Homo sapiens
cctgctgagggaccagc

SEQ ID NO: 1655792 - DNA, 15 bp, Homo sapiens
cctgctgcaccctgc

SEQ ID NO: 1655793 - DNA, 22 bp, Homo sapiens
cctgctgcaccctgcgcctcca

SEQ ID NO: 1655794 - DNA, 13 bp, Homo sapiens
cctgctgccagtg

SEQ ID NO: 1655795 - DNA, 17 bp, Homo sapiens
cctgctgccagtgcagc

SEQ ID NO: 1655796 - DNA, 19 bp, Homo sapiens
cctgctgccctcccacagc

SEQ ID NO: 1655797 - DNA, 17 bp, Homo sapiens
cctgctgccttttctgg

SEQ ID NO: 1655798 - DNA, 22 bp, Homo sapiens
cctgctgcggaggagctgcctg

SEQ ID NO: 1655799 - DNA, 17 bp, Homo sapiens
cctgctgcgtccccact

SEQ ID NO: 1655800 - DNA, 14 bp, Homo sapiens
cctgctgctccatg

SEQ ID NO: 1655801 - DNA, 19 bp, Homo sapiens
cctgctgctggtgcacagc

SEQ ID NO: 1655802 - DNA, 20 bp, Homo sapiens
cctgctgctgtaactgctga

SEQ ID NO: 1655803 - DNA, 13 bp, Homo sapiens
cctgctggaggcc

SEQ ID NO: 1655804 - DNA, 21 bp, Homo sapiens
cctgctggaggcctcaggtgc

SEQ ID NO: 1655805 - DNA, 22 bp, Homo sapiens
cctgctggaggcctcaggtgct

SEQ ID NO: 1655806 - DNA, 11 bp, Homo sapiens
cctgctggctg

SEQ ID NO: 1655807 - DNA, 12 bp, Homo sapiens
cctgctggctgc

SEQ ID NO: 1655808 - DNA, 13 bp, Homo sapiens
cctgctggctgcg

SEQ ID NO: 1655809 - DNA, 22 bp, Homo sapiens
cctgggttcagaaatgctgcct

SEQ ID NO: 1655810 - DNA, 13 bp, Homo sapiens
cctgggttccctt

SEQ ID NO: 1655811 - DNA, 18 bp, Homo sapiens
cctggtaattcctctcca

SEQ ID NO: 1655812 - DNA, 21 bp, Homo sapiens
cctggtaattcctctccaggc

SEQ ID NO: 1655813 - DNA, 23 bp, Homo sapiens
cctggtaattcctctccaggcca

SEQ ID NO: 1655814 - DNA, 13 bp, Homo sapiens
cctggtacccagc

SEQ ID NO: 1655815 - DNA, 17 bp, Homo sapiens
cctggtacccagccatc

SEQ ID NO: 1655816 - DNA, 14 bp, Homo sapiens
cctggtaccctcct

SEQ ID NO: 1655817 - DNA, 13 bp, Homo sapiens
cctggtactccct

SEQ ID NO: 1655818 - DNA, 19 bp, Homo sapiens
cctggtactgacccaggac

SEQ ID NO: 1655819 - DNA, 17 bp, Homo sapiens
cctggtattatttttct

SEQ ID NO: 1655820 - DNA, 23 bp, Homo sapiens
cctggtccctcacccccatggcc

SEQ ID NO: 1655821 - DNA, 21 bp, Homo sapiens
cctggtccctggtccttcact

SEQ ID NO: 1655822 - DNA, 16 bp, Homo sapiens
cctggtcctccctccc

SEQ ID NO: 1655823 - DNA, 20 bp, Homo sapiens
cctggtcctccctcccaagg

SEQ ID NO: 1655824 - DNA, 21 bp, Homo sapiens
cctggtcctccgcctactgtc

SEQ ID NO: 1655825 - DNA, 17 bp, Homo sapiens
cctggtcctgatgcccg

SEQ ID NO: 1655826 - DNA, 14 bp, Homo sapiens
cctggtcctggctg

SEQ ID NO: 1655827 - DNA, 19 bp, Homo sapiens
cctggtcctggctgcactc

SEQ ID NO: 1655828 - DNA, 17 bp, Homo sapiens
cctggtccttcactggc

SEQ ID NO: 1655829 - DNA, 19 bp, Homo sapiens
cctggtccttccaggcccc

SEQ ID NO: 1655830 - DNA, 15 bp, Homo sapiens
cctggtctgtctgga

SEQ ID NO: 1655831 - DNA, 23 bp, Homo sapiens
cctggtgcacgcaggcacagcag

SEQ ID NO: 1655832 - DNA, 17 bp, Homo sapiens
cctggtgcattgctgtg

SEQ ID NO: 1655833 - DNA, 17 bp, Homo sapiens
cctggtgcctctgtgca

SEQ ID NO: 1655834 - DNA, 20 bp, Homo sapiens
cctggtgcctctgtgcacag

SEQ ID NO: 1655835 - DNA, 13 bp, Homo sapiens
cctggtgcgggcc

SEQ ID NO: 1655836 - DNA, 16 bp, Homo sapiens
cctggtgcgggcctgg

SEQ ID NO: 1655837 - DNA, 18 bp, Homo sapiens
cctggtgcgggcctggcc

SEQ ID NO: 1655838 - DNA, 20 bp, Homo sapiens
cctggtgcgggcctggccct

SEQ ID NO: 1655839 - DNA, 22 bp, Homo sapiens
cctggtgcgggcctggccctca

SEQ ID NO: 1655840 - DNA, 16 bp, Homo sapiens
cctggtgctctctgcc

SEQ ID NO: 1655841 - DNA, 14 bp, Homo sapiens
cctggtggacagtc

SEQ ID NO: 1655842 - DNA, 18 bp, Homo sapiens
cctggtggacagtcctgg

SEQ ID NO: 1655843 - DNA, 19 bp, Homo sapiens
cctggtggacagtcctggg

SEQ ID NO: 1655844 - DNA, 22 bp, Homo sapiens
cctggtggagaaagcactgacc

SEQ ID NO: 1655845 - DNA, 23 bp, Homo sapiens
cctggtggatacctggttgagtg

SEQ ID NO: 1655846 - DNA, 13 bp, Homo sapiens
cctggtggctggg

SEQ ID NO: 1655847 - DNA, 15 bp, Homo sapiens
cctggtggctgggcc

SEQ ID NO: 1655848 - DNA, 18 bp, Homo sapiens
cctggtggctgggcccag

SEQ ID NO: 1655849 - DNA, 14 bp, Homo sapiens
cctggtgggccaac

SEQ ID NO: 1655850 - DNA, 23 bp, Homo sapiens
cctggtgggccaacaaagaacac

SEQ ID NO: 1655851 - DNA, 14 bp, Homo sapiens
cctggtgggcctcc

SEQ ID NO: 1655852 - DNA, 19 bp, Homo sapiens
cctggtggggtgtgcatgc

SEQ ID NO: 1655853 - DNA, 19 bp, Homo sapiens
cctggtgggtcagcccagc

SEQ ID NO: 1655854 - DNA, 19 bp, Homo sapiens
cctggtgggtggtgtcctg

SEQ ID NO: 1655855 - DNA, 16 bp, Homo sapiens
cctggtgtcaggcagg

SEQ ID NO: 1655856 - DNA, 14 bp, Homo sapiens
cctggtgtctagtt

SEQ ID NO: 1655857 - DNA, 14 bp, Homo sapiens
cctggttcatattt

SEQ ID NO: 1655858 - DNA, 15 bp, Homo sapiens
cctggttcctgctgt

SEQ ID NO: 1655859 - DNA, 14 bp, Homo sapiens
cctggttctcatct

SEQ ID NO: 1655860 - DNA, 13 bp, Homo sapiens
cctggttctgtct

SEQ ID NO: 1655861 - DNA, 19 bp, Homo sapiens
cctgtaaatggtgtacata

SEQ ID NO: 1655862 - DNA, 20 bp, Homo sapiens
cctgtaacaatgtaataaaa

SEQ ID NO: 1655863 - DNA, 19 bp, Homo sapiens
cctgtaacaggtgtgggga

SEQ ID NO: 1655864 - DNA, 16 bp, Homo sapiens
cctgtaatcccagcta

SEQ ID NO: 1655865 - DNA, 23 bp, Homo sapiens
cctgtaattcctacctccctgca

SEQ ID NO: 1655866 - DNA, 14 bp, Homo sapiens
cctgtacagtagat

SEQ ID NO: 1655867 - DNA, 20 bp, Homo sapiens
cctgtacagtagattttcca

SEQ ID NO: 1655868 - DNA, 22 bp, Homo sapiens
cctgtacagtagattttccaaa

SEQ ID NO: 1655869 - DNA, 16 bp, Homo sapiens
cctgtacattgtggga

SEQ ID NO: 1655870 - DNA, 13 bp, Homo sapiens
cctgtacccagct

SEQ ID NO: 1655871 - DNA, 16 bp, Homo sapiens
cctgtacccagctcct

SEQ ID NO: 1655872 - DNA, 14 bp, Homo sapiens
cctgtagactagtg

SEQ ID NO: 1655873 - DNA, 12 bp, Homo sapiens
cctgtagctcag

SEQ ID NO: 1655874 - DNA, 13 bp, Homo sapiens
cctgtagctcagt

SEQ ID NO: 1655875 - DNA, 14 bp, Homo sapiens
cctgtagctcagtc

SEQ ID NO: 1655876 - DNA, 15 bp, Homo sapiens
cctgtagctcagtca

SEQ ID NO: 1655877 - DNA, 20 bp, Homo sapiens
cctgtagctctgcctccctc

SEQ ID NO: 1655878 - DNA, 16 bp, Homo sapiens
cctgtagctttcctgg

SEQ ID NO: 1655879 - DNA, 20 bp, Homo sapiens
cctgtagctttcctggtccc

SEQ ID NO: 1655880 - DNA, 20 bp, Homo sapiens
cctgtagggaaaccttggag

SEQ ID NO: 1655881 - DNA, 14 bp, Homo sapiens
cctgtagggctagc

SEQ ID NO: 1655882 - DNA, 22 bp, Homo sapiens
cctgtagggtccaaccagacct

SEQ ID NO: 1655883 - DNA, 14 bp, Homo sapiens
cctgtagtcccagc

SEQ ID NO: 1655884 - DNA, 20 bp, Homo sapiens
cctgtagttgcgtggactct

SEQ ID NO: 1655885 - DNA, 21 bp, Homo sapiens
cctgtagttgcgtggactctg

SEQ ID NO: 1655886 - DNA, 15 bp, Homo sapiens
cctgtatacagtgca

SEQ ID NO: 1655887 - DNA, 14 bp, Homo sapiens
cctgtatgttgtcc

SEQ ID NO: 1655888 - DNA, 19 bp, Homo sapiens
cctgtattcctgacctccg

SEQ ID NO: 1655889 - DNA, 16 bp, Homo sapiens
cctgtattcttgtttg

SEQ ID NO: 1655890 - DNA, 18 bp, Homo sapiens
cctgtatttgagagactg

SEQ ID NO: 1655891 - DNA, 17 bp, Homo sapiens
cctgtcaccctgcagga

SEQ ID NO: 1655892 - DNA, 14 bp, Homo sapiens
cctgtcactcagct

SEQ ID NO: 1655893 - DNA, 21 bp, Homo sapiens
cctgtcagaataataaatatt

SEQ ID NO: 1655894 - DNA, 12 bp, Homo sapiens
cctgtcagaggc

SEQ ID NO: 1655895 - DNA, 16 bp, Homo sapiens
cctgtcagaggctaag

SEQ ID NO: 1655896 - DNA, 15 bp, Homo sapiens
cctgtcagtagtgga

SEQ ID NO: 1655897 - DNA, 16 bp, Homo sapiens
cctgtcatgcccccct

SEQ ID NO: 1655898 - DNA, 20 bp, Homo sapiens
cctgtcatttgaacctggat

SEQ ID NO: 1655899 - DNA, 23 bp, Homo sapiens
cctgtccaacctaacccctttcc

SEQ ID NO: 1655900 - DNA, 13 bp, Homo sapiens
cctgtccaccctg

SEQ ID NO: 1655901 - DNA, 14 bp, Homo sapiens
cctgtccagcctgg

SEQ ID NO: 1655902 - DNA, 22 bp, Homo sapiens
cctgtccagcctgggcagccag

SEQ ID NO: 1655903 - DNA, 19 bp, Homo sapiens
cctgtccagctccaacctg

SEQ ID NO: 1655904 - DNA, 19 bp, Homo sapiens
cctgtcccaccaactctgc

SEQ ID NO: 1655905 - DNA, 20 bp, Homo sapiens
cctgtcccaccaactctgca

SEQ ID NO: 1655906 - DNA, 15 bp, Homo sapiens
cctgtcccagggccc

SEQ ID NO: 1655907 - DNA, 21 bp, Homo sapiens
cctgtcccagggccctcccag

SEQ ID NO: 1655908 - DNA, 23 bp, Homo sapiens
cctgtcccagggccctcccagcc

SEQ ID NO: 1655909 - DNA, 16 bp, Homo sapiens
cctgtcccattctaga

SEQ ID NO: 1655910 - DNA, 17 bp, Homo sapiens
cctgtccccaccctcca

SEQ ID NO: 1655911 - DNA, 15 bp, Homo sapiens
cctgtcccccagctc

SEQ ID NO: 1655912 - DNA, 13 bp, Homo sapiens
cctgtccctccag

SEQ ID NO: 1655913 - DNA, 13 bp, Homo sapiens
cctgtccctgtag

SEQ ID NO: 1655914 - DNA, 16 bp, Homo sapiens
cctgtcccttttccct

SEQ ID NO: 1655915 - DNA, 21 bp, Homo sapiens
cctgtccggcccagtgccact

SEQ ID NO: 1655916 - DNA, 18 bp, Homo sapiens
cctgtcctaaggaacctt

SEQ ID NO: 1655917 - DNA, 13 bp, Homo sapiens
cctgtcctggtcc

SEQ ID NO: 1655918 - DNA, 14 bp, Homo sapiens
cctgtcctggtcct

SEQ ID NO: 1655919 - DNA, 15 bp, Homo sapiens
cctgtcctttcttgc

SEQ ID NO: 1655920 - DNA, 15 bp, Homo sapiens
cctgtcgagacactt

SEQ ID NO: 1655921 - DNA, 20 bp, Homo sapiens
cctgtcgagacacttgcctt

SEQ ID NO: 1655922 - DNA, 18 bp, Homo sapiens
cctgtcgtctctcccacc

SEQ ID NO: 1655923 - DNA, 17 bp, Homo sapiens
cctgtcgtgccagtcct

SEQ ID NO: 1655924 - DNA, 15 bp, Homo sapiens
ccttcctctgcagct

SEQ ID NO: 1655925 - DNA, 16 bp, Homo sapiens
ccttcctctgcagctg

SEQ ID NO: 1655926 - DNA, 17 bp, Homo sapiens
ccttcctcttcctgccc

SEQ ID NO: 1655927 - DNA, 13 bp, Homo sapiens
ccttcctgccact

SEQ ID NO: 1655928 - DNA, 18 bp, Homo sapiens
ccttcctggaaacagcat

SEQ ID NO: 1655929 - DNA, 19 bp, Homo sapiens
ccttcctggaaacagcatg

SEQ ID NO: 1655930 - DNA, 21 bp, Homo sapiens
ccttcctggaaacagcatgaa

SEQ ID NO: 1655931 - DNA, 17 bp, Homo sapiens
ccttcctggcctcactg

SEQ ID NO: 1655932 - DNA, 13 bp, Homo sapiens
ccttcctgtttca

SEQ ID NO: 1655933 - DNA, 16 bp, Homo sapiens
ccttcctgtttcagac

SEQ ID NO: 1655934 - DNA, 21 bp, Homo sapiens
ccttcctgtttcagacccccc

SEQ ID NO: 1655935 - DNA, 17 bp, Homo sapiens
ccttcctgtttttcaca

SEQ ID NO: 1655936 - DNA, 22 bp, Homo sapiens
ccttcctgtttttcacattttc

SEQ ID NO: 1655937 - DNA, 13 bp, Homo sapiens
ccttccttcaggg

SEQ ID NO: 1655938 - DNA, 15 bp, Homo sapiens
ccttcctttctcctg

SEQ ID NO: 1655939 - DNA, 19 bp, Homo sapiens
ccttccttttccctgcttc

SEQ ID NO: 1655940 - DNA, 20 bp, Homo sapiens
ccttccttttccctgcttcc

SEQ ID NO: 1655941 - DNA, 17 bp, Homo sapiens
ccttccttttgaggagc

SEQ ID NO: 1655942 - DNA, 15 bp, Homo sapiens
ccttcgaaaggcctt

SEQ ID NO: 1655943 - DNA, 16 bp, Homo sapiens
ccttcgaaaggccttc

SEQ ID NO: 1655944 - DNA, 19 bp, Homo sapiens
ccttcgaaaggccttcaga

SEQ ID NO: 1655945 - DNA, 23 bp, Homo sapiens
ccttcgaaaggccttcagacaca

SEQ ID NO: 1655946 - DNA, 23 bp, Homo sapiens
ccttcgatacaccgggcctggag

SEQ ID NO: 1655947 - DNA, 17 bp, Homo sapiens
ccttcgcttcttgcctc

SEQ ID NO: 1655948 - DNA, 18 bp, Homo sapiens
ccttcgcttcttgcctct

SEQ ID NO: 1655949 - DNA, 14 bp, Homo sapiens
ccttcgggctgtgc

SEQ ID NO: 1655950 - DNA, 15 bp, Homo sapiens
ccttcgggctgtgcc

SEQ ID NO: 1655951 - DNA, 16 bp, Homo sapiens
ccttcgggctgtgccc

SEQ ID NO: 1655952 - DNA, 16 bp, Homo sapiens
ccttcgtctttcccat

SEQ ID NO: 1655953 - DNA, 23 bp, Homo sapiens
ccttctaaaagccattattatga

SEQ ID NO: 1655954 - DNA, 15 bp, Homo sapiens
ccttctacaaggact

SEQ ID NO: 1655955 - DNA, 18 bp, Homo sapiens
ccttctacaaggactcca

SEQ ID NO: 1655956 - DNA, 15 bp, Homo sapiens
ccttctagtttccca

SEQ ID NO: 1655957 - DNA, 18 bp, Homo sapiens
ccttctagtttcccacaa

SEQ ID NO: 1655958 - DNA, 16 bp, Homo sapiens
ccttctccccagccag

SEQ ID NO: 1655959 - DNA, 17 bp, Homo sapiens
ccttctcccctgcactg

SEQ ID NO: 1655960 - DNA, 22 bp, Homo sapiens
ccttctcccctgcactgtaaaa

SEQ ID NO: 1655961 - DNA, 17 bp, Homo sapiens
ccttctcccttgccctc

SEQ ID NO: 1655962 - DNA, 20 bp, Homo sapiens
ccttctcccttgccctccct

SEQ ID NO: 1655963 - DNA, 21 bp, Homo sapiens
ccttctcctccccacccgccc

SEQ ID NO: 1655964 - DNA, 20 bp, Homo sapiens
ccttctctacactcttgtaa

SEQ ID NO: 1655965 - DNA, 19 bp, Homo sapiens
ccttctctacccatctccc

SEQ ID NO: 1655966 - DNA, 22 bp, Homo sapiens
ccttctctattgggcacagcct

SEQ ID NO: 1655967 - DNA, 13 bp, Homo sapiens
ccttctctcagct

SEQ ID NO: 1655968 - DNA, 16 bp, Homo sapiens
ccttctctcatctctt

SEQ ID NO: 1655969 - DNA, 15 bp, Homo sapiens
ccttctctcctcccc

SEQ ID NO: 1655970 - DNA, 17 bp, Homo sapiens
ccttctctcctccccaa

SEQ ID NO: 1655971 - DNA, 20 bp, Homo sapiens
ccttctctcctccccaaatc

SEQ ID NO: 1655972 - DNA, 11 bp, Homo sapiens
ccttctctctc

SEQ ID NO: 1655973 - DNA, 17 bp, Homo sapiens
ccttctctgctccacca

SEQ ID NO: 1655974 - DNA, 16 bp, Homo sapiens
ccttctctggtctcct

SEQ ID NO: 1655975 - DNA, 13 bp, Homo sapiens
ccttctgactgtt

SEQ ID NO: 1655976 - DNA, 16 bp, Homo sapiens
ccttctgactgtttat

SEQ ID NO: 1655977 - DNA, 15 bp, Homo sapiens
ccttctgagctccac

SEQ ID NO: 1655978 - DNA, 19 bp, Homo sapiens
ccttctgagctccacctct

SEQ ID NO: 1655979 - DNA, 22 bp, Homo sapiens
ccttctgatcttggaaaaacag

SEQ ID NO: 1655980 - DNA, 22 bp, Homo sapiens
ccttctgcccccgttccagctg

SEQ ID NO: 1655981 - DNA, 21 bp, Homo sapiens
ccttctgctggataaaatgag

SEQ ID NO: 1655982 - DNA, 18 bp, Homo sapiens
ccttctggagctgggaga

SEQ ID NO: 1655983 - DNA, 22 bp, Homo sapiens
ccttctggagctgggagacaaa

SEQ ID NO: 1655984 - DNA, 17 bp, Homo sapiens
ccttctggatccatggg

SEQ ID NO: 1655985 - DNA, 21 bp, Homo sapiens
ccttctggccggtgctgggtt

SEQ ID NO: 1655986 - DNA, 13 bp, Homo sapiens
ccttctgggaaac

SEQ ID NO: 1655987 - DNA, 14 bp, Homo sapiens
ccttctggttgctt

SEQ ID NO: 1655988 - DNA, 19 bp, Homo sapiens
ccttcttattctcactcca

SEQ ID NO: 1655989 - DNA, 20 bp, Homo sapiens
ccttcttattctcactccac

SEQ ID NO: 1655990 - DNA, 21 bp, Homo sapiens
ccttcttcggggaactcctgg

SEQ ID NO: 1655991 - DNA, 23 bp, Homo sapiens
ccttctttcacaggcatcaggaa

SEQ ID NO: 1655992 - DNA, 23 bp, Homo sapiens
ccttctttcactctgtcatcttt

SEQ ID NO: 1655993 - DNA, 13 bp, Homo sapiens
ccttctttgtata

SEQ ID NO: 1655994 - DNA, 15 bp, Homo sapiens
ccttgaaaataaaaa

SEQ ID NO: 1655995 - DNA, 15 bp, Homo sapiens
ccttgaaaatatttt

SEQ ID NO: 1655996 - DNA, 19 bp, Homo sapiens
ccttgaaactttgggaaaa

SEQ ID NO: 1655997 - DNA, 20 bp, Homo sapiens
ccttgaaccccctccctgtc

SEQ ID NO: 1655998 - DNA, 18 bp, Homo sapiens
ccttgaagaactgcaggc

SEQ ID NO: 1655999 - DNA, 21 bp, Homo sapiens
ccttgaagaactgcaggccct

SEQ ID NO: 1656000 - DNA, 22 bp, Homo sapiens
ccttgaagaactgcaggccctg

SEQ ID NO: 1656001 - DNA, 23 bp, Homo sapiens
ccttgaagaactgcaggccctgg

SEQ ID NO: 1656002 - DNA, 16 bp, Homo sapiens
ccttgaagacagagca

SEQ ID NO: 1656003 - DNA, 22 bp, Homo sapiens
ccttgaagccactgaagctggg

SEQ ID NO: 1656004 - DNA, 14 bp, Homo sapiens
ccttgaaggaagag

SEQ ID NO: 1656005 - DNA, 17 bp, Homo sapiens
ccttgaagtcacccggc

SEQ ID NO: 1656006 - DNA, 17 bp, Homo sapiens
ccttgaatgctgccagt

SEQ ID NO: 1656007 - DNA, 13 bp, Homo sapiens
ccttgacagagca

SEQ ID NO: 1656008 - DNA, 15 bp, Homo sapiens
ccttgacagagcagc

SEQ ID NO: 1656009 - DNA, 22 bp, Homo sapiens
ccttgacagagcagctaactcc

SEQ ID NO: 1656010 - DNA, 21 bp, Homo sapiens
ccttgaccagcagatcccagc

SEQ ID NO: 1656011 - DNA, 16 bp, Homo sapiens
ccttgagaccacaggg

SEQ ID NO: 1656012 - DNA, 22 bp, Homo sapiens
ccttgagacccccaagcttcca

SEQ ID NO: 1656013 - DNA, 16 bp, Homo sapiens
ccttgagccctggctg

SEQ ID NO: 1656014 - DNA, 22 bp, Homo sapiens
ccttgagccctggctgttctgt

SEQ ID NO: 1656015 - DNA, 19 bp, Homo sapiens
ccttgaggatggagagcag

SEQ ID NO: 1656016 - DNA, 23 bp, Homo sapiens
ccttgaggattgtggaaaaccag

SEQ ID NO: 1656017 - DNA, 23 bp, Homo sapiens
ccttgagtggggttatctctgtg

SEQ ID NO: 1656018 - DNA, 22 bp, Homo sapiens
ccttgatataaaaaatctttag

SEQ ID NO: 1656019 - DNA, 14 bp, Homo sapiens
ccttgatctgtata

SEQ ID NO: 1656020 - DNA, 13 bp, Homo sapiens
ccttgatgccaga

SEQ ID NO: 1656021 - DNA, 15 bp, Homo sapiens
ccttgatgccagagg

SEQ ID NO: 1656022 - DNA, 17 bp, Homo sapiens
ccttgatgccagagggc

SEQ ID NO: 1656023 - DNA, 20 bp, Homo sapiens
ccttgatgccagagggccag

SEQ ID NO: 1656024 - DNA, 21 bp, Homo sapiens
ccttgatggggaatccgtgtg

SEQ ID NO: 1656025 - DNA, 22 bp, Homo sapiens
ccttgattggaagggcttttca

SEQ ID NO: 1656026 - DNA, 13 bp, Homo sapiens
ccttgatttcaaa

SEQ ID NO: 1656027 - DNA, 14 bp, Homo sapiens
ccttgcacctgcat

SEQ ID NO: 1656028 - DNA, 20 bp, Homo sapiens
ccttgcagatatctgcatgt

SEQ ID NO: 1656029 - DNA, 16 bp, Homo sapiens
ccttgcagctggccca

SEQ ID NO: 1656030 - DNA, 19 bp, Homo sapiens
ccttgcagttcagcaccac

SEQ ID NO: 1656031 - DNA, 22 bp, Homo sapiens
ccttgcagttcagcaccaccct

SEQ ID NO: 1656032 - DNA, 23 bp, Homo sapiens
ccttgcagttcagcaccacccta

SEQ ID NO: 1656033 - DNA, 21 bp, Homo sapiens
ccttgcatccattgttgtgtc

SEQ ID NO: 1656034 - DNA, 21 bp, Homo sapiens
ccttgccaatggtgtagctgt

SEQ ID NO: 1656035 - DNA, 13 bp, Homo sapiens
ccttgcccagaga

SEQ ID NO: 1656036 - DNA, 14 bp, Homo sapiens
ccttgcccagagat

SEQ ID NO: 1656037 - DNA, 15 bp, Homo sapiens
ccttgcccagggctc

SEQ ID NO: 1656038 - DNA, 18 bp, Homo sapiens
cctttatcttgaagtcag

SEQ ID NO: 1656039 - DNA, 23 bp, Homo sapiens
cctttatgtggaaaacagaacat

SEQ ID NO: 1656040 - DNA, 12 bp, Homo sapiens
cctttcaaagct

SEQ ID NO: 1656041 - DNA, 19 bp, Homo sapiens
cctttcaccctcatgaaaa

SEQ ID NO: 1656042 - DNA, 19 bp, Homo sapiens
cctttcagatgtcttctgc

SEQ ID NO: 1656043 - DNA, 22 bp, Homo sapiens
cctttcagccacatgccccagg

SEQ ID NO: 1656044 - DNA, 13 bp, Homo sapiens
cctttcaggccaa

SEQ ID NO: 1656045 - DNA, 20 bp, Homo sapiens
cctttcagggaatttcagga

SEQ ID NO: 1656046 - DNA, 22 bp, Homo sapiens
cctttcagtgcagtttcttttc

SEQ ID NO: 1656047 - DNA, 18 bp, Homo sapiens
cctttcatctctctacct

SEQ ID NO: 1656048 - DNA, 19 bp, Homo sapiens
cctttcatttgctatctct

SEQ ID NO: 1656049 - DNA, 12 bp, Homo sapiens
cctttccaaaga

SEQ ID NO: 1656050 - DNA, 11 bp, Homo sapiens
cctttccataa

SEQ ID NO: 1656051 - DNA, 13 bp, Homo sapiens
cctttccatctgt

SEQ ID NO: 1656052 - DNA, 16 bp, Homo sapiens
cctttccatctgtcca

SEQ ID NO: 1656053 - DNA, 19 bp, Homo sapiens
cctttcccaccattcctgc

SEQ ID NO: 1656054 - DNA, 22 bp, Homo sapiens
cctttcccaccattcctgcctt

SEQ ID NO: 1656055 - DNA, 15 bp, Homo sapiens
cctttccttcccagg

SEQ ID NO: 1656056 - DNA, 16 bp, Homo sapiens
cctttcgaggcctgaa

SEQ ID NO: 1656057 - DNA, 21 bp, Homo sapiens
cctttcgttctgctgaccaaa

SEQ ID NO: 1656058 - DNA, 16 bp, Homo sapiens
cctttctaagccctgt

SEQ ID NO: 1656059 - DNA, 20 bp, Homo sapiens
cctttctcttttcccctttc

SEQ ID NO: 1656060 - DNA, 19 bp, Homo sapiens
cctttctggaagtttctgg

SEQ ID NO: 1656061 - DNA, 14 bp, Homo sapiens
cctttctggctctc

SEQ ID NO: 1656062 - DNA, 21 bp, Homo sapiens
cctttcttcctatttatcata

SEQ ID NO: 1656063 - DNA, 10 bp, Homo sapiens
cctttcttct

SEQ ID NO: 1656064 - DNA, 13 bp, Homo sapiens
cctttcttggcca

SEQ ID NO: 1656065 - DNA, 15 bp, Homo sapiens
cctttcttggccagt

SEQ ID NO: 1656066 - DNA, 13 bp, Homo sapiens
cctttctttgcct

SEQ ID NO: 1656067 - DNA, 14 bp, Homo sapiens
cctttctttgcctc

SEQ ID NO: 1656068 - DNA, 16 bp, Homo sapiens
cctttctttgcctctg

SEQ ID NO: 1656069 - DNA, 22 bp, Homo sapiens
cctttgaacttgattgcctatg

SEQ ID NO: 1656070 - DNA, 21 bp, Homo sapiens
cctttgagtgccaatttctta

SEQ ID NO: 1656071 - DNA, 14 bp, Homo sapiens
cctttgataaatgt

SEQ ID NO: 1656072 - DNA, 14 bp, Homo sapiens
cctttgattatgca

SEQ ID NO: 1656073 - DNA, 17 bp, Homo sapiens
cctttgcaagatgcttg

SEQ ID NO: 1656074 - DNA, 18 bp, Homo sapiens
cctttgcaagatgcttgg

SEQ ID NO: 1656075 - DNA, 20 bp, Homo sapiens
cctttgcaagatgcttggtt

SEQ ID NO: 1656076 - DNA, 17 bp, Homo sapiens
cctttgcacctgagacc

SEQ ID NO: 1656077 - DNA, 17 bp, Homo sapiens
cctttgcactgagggcc

SEQ ID NO: 1656078 - DNA, 22 bp, Homo sapiens
cctttgcactgtaatgaggaaa

SEQ ID NO: 1656079 - DNA, 21 bp, Homo sapiens
cctttgccccacctttattaa

SEQ ID NO: 1656080 - DNA, 13 bp, Homo sapiens
cctttgctctgga

SEQ ID NO: 1656081 - DNA, 19 bp, Homo sapiens
cctttgctgaggcctccag

SEQ ID NO: 1656082 - DNA, 13 bp, Homo sapiens
cctttgctgtgag

SEQ ID NO: 1656083 - DNA, 22 bp, Homo sapiens
cctttgctgtgaggctgtcctg

SEQ ID NO: 1656084 - DNA, 19 bp, Homo sapiens
cctttgcttatgaatattt

SEQ ID NO: 1656085 - DNA, 23 bp, Homo sapiens
cctttggaacaagacagccttca

SEQ ID NO: 1656086 - DNA, 21 bp, Homo sapiens
cctttggcctggggtgcatct

SEQ ID NO: 1656087 - DNA, 22 bp, Homo sapiens
cctttggcttctgatttttctc

SEQ ID NO: 1656088 - DNA, 12 bp, Homo sapiens
cctttgggtgtg

SEQ ID NO: 1656089 - DNA, 17 bp, Homo sapiens
cctttggtcctgtcccc

SEQ ID NO: 1656090 - DNA, 15 bp, Homo sapiens
cctttggttctggcc

SEQ ID NO: 1656091 - DNA, 20 bp, Homo sapiens
cctttggttctggccagaat

SEQ ID NO: 1656092 - DNA, 16 bp, Homo sapiens
cctttggtttgacaat

SEQ ID NO: 1656093 - DNA, 22 bp, Homo sapiens
cctttgtaagacatttgtatat

SEQ ID NO: 1656094 - DNA, 15 bp, Homo sapiens
cctttgtaagttatt

SEQ ID NO: 1656095 - DNA, 18 bp, Homo sapiens
cctttgtatctttctttc

SEQ ID NO: 1656096 - DNA, 14 bp, Homo sapiens
cctttgtcccagaa

SEQ ID NO: 1656097 - DNA, 18 bp, Homo sapiens
cctttgtcctttttcagg

SEQ ID NO: 1656098 - DNA, 20 bp, Homo sapiens
cctttgtcttgtacttctgt

SEQ ID NO: 1656099 - DNA, 23 bp, Homo sapiens
cctttgtcttgtacttctgtgtt

SEQ ID NO: 1656100 - DNA, 16 bp, Homo sapiens
cctttgtgctctatag

SEQ ID NO: 1656101 - DNA, 23 bp, Homo sapiens
cctttgtgtcagaaaaaggaaac

SEQ ID NO: 1656102 - DNA, 13 bp, Homo sapiens
cctttgtgtggct

SEQ ID NO: 1656103 - DNA, 21 bp, Homo sapiens
cctttgtgtgtgtgtcagctg

SEQ ID NO: 1656104 - DNA, 13 bp, Homo sapiens
cctttgtgtttct

SEQ ID NO: 1656105 - DNA, 14 bp, Homo sapiens
ccttttacattgtg

SEQ ID NO: 1656106 - DNA, 16 bp, Homo sapiens
ccttttataaccttgt

SEQ ID NO: 1656107 - DNA, 16 bp, Homo sapiens
ccttttcatgatttta

SEQ ID NO: 1656108 - DNA, 13 bp, Homo sapiens
ccttttccctgct

SEQ ID NO: 1656109 - DNA, 15 bp, Homo sapiens
ccttttccctgcttc

SEQ ID NO: 1656110 - DNA, 19 bp, Homo sapiens
ccttttccctgcttccagg

SEQ ID NO: 1656111 - DNA, 18 bp, Homo sapiens
ccttttcccttgctgtac

SEQ ID NO: 1656112 - DNA, 19 bp, Homo sapiens
ccttttctcacaaaaaggc

SEQ ID NO: 1656113 - DNA, 12 bp, Homo sapiens
ccttttctcagg

SEQ ID NO: 1656114 - DNA, 22 bp, Homo sapiens
ccttttctggggaaagacactg

SEQ ID NO: 1656115 - DNA, 23 bp, Homo sapiens
ccttttctgtgccagacattgct

SEQ ID NO: 1656116 - DNA, 16 bp, Homo sapiens
ccttttgaacttgtca

SEQ ID NO: 1656117 - DNA, 17 bp, Homo sapiens
ccttttgaacttgtcac

SEQ ID NO: 1656118 - DNA, 13 bp, Homo sapiens
ccttttgaggagc

SEQ ID NO: 1656119 - DNA, 16 bp, Homo sapiens
ccttttgaggagcccc

SEQ ID NO: 1656120 - DNA, 19 bp, Homo sapiens
ccttttgtaccatggtgtg

SEQ ID NO: 1656121 - DNA, 22 bp, Homo sapiens
ccttttgtagttttatttgtat

SEQ ID NO: 1656122 - DNA, 20 bp, Homo sapiens
ccttttgtgggtttctctgt

SEQ ID NO: 1656123 - DNA, 13 bp, Homo sapiens
ccttttgttttct

SEQ ID NO: 1656124 - DNA, 23 bp, Homo sapiens
cctttttctccacactccactga

SEQ ID NO: 1656125 - DNA, 19 bp, Homo sapiens
cctttttcttcgctggact

SEQ ID NO: 1656126 - DNA, 13 bp, Homo sapiens
cctttttgacact

SEQ ID NO: 1656127 - DNA, 14 bp, Homo sapiens
cctttttgacactg

SEQ ID NO: 1656128 - DNA, 21 bp, Homo sapiens
cctttttggtacttattactg

SEQ ID NO: 1656129 - DNA, 16 bp, Homo sapiens
cctttttgttccccat

SEQ ID NO: 1656130 - DNA, 20 bp, Homo sapiens
ccttttttaaaagtaaatgt

SEQ ID NO: 1656131 - DNA, 11 bp, Homo sapiens
ccttttttcct

SEQ ID NO: 1656132 - DNA, 14 bp, Homo sapiens
ccttttttgtagtt

SEQ ID NO: 1656133 - DNA, 12 bp, Homo sapiens
ccttttttttga

SEQ ID NO: 1656134 - DNA, 21 bp, Homo sapiens
cgaaactccatctcaaaacaa

SEQ ID NO: 1656135 - DNA, 22 bp, Homo sapiens
cgaaactccatctcaaaacaaa

SEQ ID NO: 1656136 - DNA, 14 bp, Homo sapiens
cgaaatgttatttt

SEQ ID NO: 1656137 - DNA, 17 bp, Homo sapiens
cgaaccaaggcagcctc

SEQ ID NO: 1656138 - DNA, 14 bp, Homo sapiens
cgaacccacctgct

SEQ ID NO: 1656139 - DNA, 16 bp, Homo sapiens
cgaacccacctgctga

SEQ ID NO: 1656140 - DNA, 16 bp, Homo sapiens
cgaacgacaatagctt

SEQ ID NO: 1656141 - DNA, 12 bp, Homo sapiens
cgaactcctggc

SEQ ID NO: 1656142 - DNA, 13 bp, Homo sapiens
cgaactggcgcct

SEQ ID NO: 1656143 - DNA, 19 bp, Homo sapiens
cgaagaaaaaaaataacac

SEQ ID NO: 1656144 - DNA, 14 bp, Homo sapiens
cgaagaagatgctc

SEQ ID NO: 1656145 - DNA, 19 bp, Homo sapiens
cgaagaaggctaggagttc

SEQ ID NO: 1656146 - DNA, 13 bp, Homo sapiens
cgaagacacagac

SEQ ID NO: 1656147 - DNA, 18 bp, Homo sapiens
cgaagaccctcttgccca

SEQ ID NO: 1656148 - DNA, 20 bp, Homo sapiens
cgaagaccctcttgcccatc

SEQ ID NO: 1656149 - DNA, 23 bp, Homo sapiens
cgaagaccctcttgcccatcctg

SEQ ID NO: 1656150 - DNA, 23 bp, Homo sapiens
cgaagagtatttttgacagaata

SEQ ID NO: 1656151 - DNA, 13 bp, Homo sapiens
cgaagcagagagg

SEQ ID NO: 1656152 - DNA, 20 bp, Homo sapiens
cgaagccatcacttctcccc

SEQ ID NO: 1656153 - DNA, 19 bp, Homo sapiens
cgcagcccgcctgccgtgc

SEQ ID NO: 1656154 - DNA, 22 bp, Homo sapiens
cgcagcccgtgaagcagtgcct

SEQ ID NO: 1656155 - DNA, 13 bp, Homo sapiens
cgcagccctgctt

SEQ ID NO: 1656156 - DNA, 16 bp, Homo sapiens
cgcagcctccctctga

SEQ ID NO: 1656157 - DNA, 15 bp, Homo sapiens
cgcagcctgaagcct

SEQ ID NO: 1656158 - DNA, 18 bp, Homo sapiens
cgcagcctgaagcctgga

SEQ ID NO: 1656159 - DNA, 15 bp, Homo sapiens
cgcagcgtcccccgc

SEQ ID NO: 1656160 - DNA, 17 bp, Homo sapiens
cgcagctaccctcagcc

SEQ ID NO: 1656161 - DNA, 18 bp, Homo sapiens
cgcagctaccctcagcct

SEQ ID NO: 1656162 - DNA, 21 bp, Homo sapiens
cgcaggaactgggctgggcct

SEQ ID NO: 1656163 - DNA, 14 bp, Homo sapiens
cgcaggatccctcc

SEQ ID NO: 1656164 - DNA, 17 bp, Homo sapiens
cgcaggatccctcctga

SEQ ID NO: 1656165 - DNA, 17 bp, Homo sapiens
cgcaggatccgctgcca

SEQ ID NO: 1656166 - DNA, 19 bp, Homo sapiens
cgcaggatccgctgccacc

SEQ ID NO: 1656167 - DNA, 17 bp, Homo sapiens
cgcaggctgagtccaga

SEQ ID NO: 1656168 - DNA, 18 bp, Homo sapiens
cgcagggccatgcagacc

SEQ ID NO: 1656169 - DNA, 18 bp, Homo sapiens
cgcaggtctcttctgggc

SEQ ID NO: 1656170 - DNA, 19 bp, Homo sapiens
cgcaggtgccatgcctgct

SEQ ID NO: 1656171 - DNA, 20 bp, Homo sapiens
cgcaggttatgtcagcagct

SEQ ID NO: 1656172 - DNA, 17 bp, Homo sapiens
cgcagtccccagccctt

SEQ ID NO: 1656173 - DNA, 16 bp, Homo sapiens
cgcagtgtctccacct

SEQ ID NO: 1656174 - DNA, 21 bp, Homo sapiens
cgcatacacacatgccctcct

SEQ ID NO: 1656175 - DNA, 13 bp, Homo sapiens
cgcatagactgag

SEQ ID NO: 1656176 - DNA, 15 bp, Homo sapiens
cgcataggacctttc

SEQ ID NO: 1656177 - DNA, 13 bp, Homo sapiens
cgcatcagacaga

SEQ ID NO: 1656178 - DNA, 12 bp, Homo sapiens
cgcatccctgct

SEQ ID NO: 1656179 - DNA, 15 bp, Homo sapiens
cgcatcctcttccat

SEQ ID NO: 1656180 - DNA, 20 bp, Homo sapiens
cgcatctcaaaacagagggc

SEQ ID NO: 1656181 - DNA, 13 bp, Homo sapiens
cgcatcttctcca

SEQ ID NO: 1656182 - DNA, 14 bp, Homo sapiens
cgcatcttctccat

SEQ ID NO: 1656183 - DNA, 15 bp, Homo sapiens
cgcatcttctccatc

SEQ ID NO: 1656184 - DNA, 16 bp, Homo sapiens
cgcatcttctccatct

SEQ ID NO: 1656185 - DNA, 21 bp, Homo sapiens
cgcatcttctccatctggcag

SEQ ID NO: 1656186 - DNA, 16 bp, Homo sapiens
cgcatgcggcccagga

SEQ ID NO: 1656187 - DNA, 21 bp, Homo sapiens
cgcatggcagaaagggggcat

SEQ ID NO: 1656188 - DNA, 20 bp, Homo sapiens
cgcatgtaatcccagctact

SEQ ID NO: 1656189 - DNA, 12 bp, Homo sapiens
cgcattccctga

SEQ ID NO: 1656190 - DNA, 22 bp, Homo sapiens
cgccaaatgttcatcctcattg

SEQ ID NO: 1656191 - DNA, 13 bp, Homo sapiens
cgccaccatcctg

SEQ ID NO: 1656192 - DNA, 17 bp, Homo sapiens
cgccacccccatcttcc

SEQ ID NO: 1656193 - DNA, 18 bp, Homo sapiens
cgccaccgccacccgcag

SEQ ID NO: 1656194 - DNA, 15 bp, Homo sapiens
cgccacctcagggca

SEQ ID NO: 1656195 - DNA, 12 bp, Homo sapiens
cgccacggccac

SEQ ID NO: 1656196 - DNA, 13 bp, Homo sapiens
cgccacggccacc

SEQ ID NO: 1656197 - DNA, 21 bp, Homo sapiens
cgccactacactccagcctga

SEQ ID NO: 1656198 - DNA, 13 bp, Homo sapiens
cgccactcagcca

SEQ ID NO: 1656199 - DNA, 21 bp, Homo sapiens
cgccactgcactccagcctgg

SEQ ID NO: 1656200 - DNA, 23 bp, Homo sapiens
cgccactgcactccagcctgggc

SEQ ID NO: 1656201 - DNA, 17 bp, Homo sapiens
cgccagccccgctccca

SEQ ID NO: 1656202 - DNA, 20 bp, Homo sapiens
cgccagccccgctcccacct

SEQ ID NO: 1656203 - DNA, 21 bp, Homo sapiens
cgccagcctcctctggacggc

SEQ ID NO: 1656204 - DNA, 21 bp, Homo sapiens
cgccagcgtgtggagcagagc

SEQ ID NO: 1656205 - DNA, 22 bp, Homo sapiens
cgccagcgtgtggagcagagct

SEQ ID NO: 1656206 - DNA, 12 bp, Homo sapiens
cgccagggctgg

SEQ ID NO: 1656207 - DNA, 15 bp, Homo sapiens
cgccagtcactgctg

SEQ ID NO: 1656208 - DNA, 18 bp, Homo sapiens
cgccattgccaccaggag

SEQ ID NO: 1656209 - DNA, 19 bp, Homo sapiens
cgccattggttggaagcta

SEQ ID NO: 1656210 - DNA, 16 bp, Homo sapiens
cgccattgtactccag

SEQ ID NO: 1656211 - DNA, 13 bp, Homo sapiens
cgcccaccctggg

SEQ ID NO: 1656212 - DNA, 17 bp, Homo sapiens
cgcccaccctgggctcc

SEQ ID NO: 1656213 - DNA, 19 bp, Homo sapiens
cgcccaccgtgggcagtgc

SEQ ID NO: 1656214 - DNA, 23 bp, Homo sapiens
cgcccaccgtgggcagtgccacc

SEQ ID NO: 1656215 - DNA, 20 bp, Homo sapiens
cgcccactgtcctgggcgcc

SEQ ID NO: 1656216 - DNA, 19 bp, Homo sapiens
cgcccagctccgcctgctg

SEQ ID NO: 1656217 - DNA, 15 bp, Homo sapiens
cgcccaggctggagc

SEQ ID NO: 1656218 - DNA, 18 bp, Homo sapiens
cgcccattcggactgctg

SEQ ID NO: 1656219 - DNA, 23 bp, Homo sapiens
cgcccattcgtctgtcccagagc

SEQ ID NO: 1656220 - DNA, 20 bp, Homo sapiens
cgccccaacactgtccttcc

SEQ ID NO: 1656221 - DNA, 18 bp, Homo sapiens
cgcccccagtccccaccc

SEQ ID NO: 1656222 - DNA, 12 bp, Homo sapiens
cgcccccagtgt

SEQ ID NO: 1656223 - DNA, 17 bp, Homo sapiens
cgccccctccgccctgc

SEQ ID NO: 1656224 - DNA, 15 bp, Homo sapiens
cgccccctgcctgcc

SEQ ID NO: 1656225 - DNA, 14 bp, Homo sapiens
cgccccgcccccac

SEQ ID NO: 1656226 - DNA, 20 bp, Homo sapiens
cgcccctccaaacctccagc

SEQ ID NO: 1656227 - DNA, 18 bp, Homo sapiens
cgcccctcccacgcctca

SEQ ID NO: 1656228 - DNA, 20 bp, Homo sapiens
cgcccctcgctgctgctact

SEQ ID NO: 1656229 - DNA, 12 bp, Homo sapiens
cgcccctctgca

SEQ ID NO: 1656230 - DNA, 21 bp, Homo sapiens
cgcccctggggaaatagcctc

SEQ ID NO: 1656231 - DNA, 14 bp, Homo sapiens
cgcccctgtggcca

SEQ ID NO: 1656232 - DNA, 21 bp, Homo sapiens
cgcccctgtggccctggccac

SEQ ID NO: 1656233 - DNA, 18 bp, Homo sapiens
cgcccgcccactgtcctg

SEQ ID NO: 1656234 - DNA, 18 bp, Homo sapiens
cgcccgctcctgccgcag

SEQ ID NO: 1656235 - DNA, 13 bp, Homo sapiens
cgcccgctgggct

SEQ ID NO: 1656236 - DNA, 23 bp, Homo sapiens
cgcccgctgggctgagcccctac

SEQ ID NO: 1656237 - DNA, 14 bp, Homo sapiens
cgcccggcagcccc

SEQ ID NO: 1656238 - DNA, 13 bp, Homo sapiens
cgcccgggcccag

SEQ ID NO: 1656239 - DNA, 16 bp, Homo sapiens
cgcccgggcccagagg

SEQ ID NO: 1656240 - DNA, 18 bp, Homo sapiens
cgcccgggcccagaggag

SEQ ID NO: 1656241 - DNA, 14 bp, Homo sapiens
cgcccgtcctgcct

SEQ ID NO: 1656242 - DNA, 15 bp, Homo sapiens
cgcccgtcctgcctg

SEQ ID NO: 1656243 - DNA, 18 bp, Homo sapiens
cgccctactccactgccc

SEQ ID NO: 1656244 - DNA, 21 bp, Homo sapiens
cgccctactccactgccctgg

SEQ ID NO: 1656245 - DNA, 15 bp, Homo sapiens
cgccctaggcctggc

SEQ ID NO: 1656246 - DNA, 23 bp, Homo sapiens
cgccctaggcctggcatggcacc

SEQ ID NO: 1656247 - DNA, 23 bp, Homo sapiens
cgccctccctctcccaggcccga

SEQ ID NO: 1656248 - DNA, 13 bp, Homo sapiens
cgccctcctttcc

SEQ ID NO: 1656249 - DNA, 16 bp, Homo sapiens
cgccctcctttccctt

SEQ ID NO: 1656250 - DNA, 16 bp, Homo sapiens
cgccctctctgctcct

SEQ ID NO: 1656251 - DNA, 23 bp, Homo sapiens
cgccctgagagagaatagagctg

SEQ ID NO: 1656252 - DNA, 11 bp, Homo sapiens
cgccctgccac

SEQ ID NO: 1656253 - DNA, 18 bp, Homo sapiens
cgccctgcgttggagcca

SEQ ID NO: 1656254 - DNA, 19 bp, Homo sapiens
cgccctgcgttggagccac

SEQ ID NO: 1656255 - DNA, 17 bp, Homo sapiens
cgccctgctcctccctg

SEQ ID NO: 1656256 - DNA, 13 bp, Homo sapiens
cgccctggaagcc

SEQ ID NO: 1656257 - DNA, 14 bp, Homo sapiens
cgcccttccatgtg

SEQ ID NO: 1656258 - DNA, 18 bp, Homo sapiens
cgcccttccatgtgcctt

SEQ ID NO: 1656259 - DNA, 22 bp, Homo sapiens
cgcccttccatgtgcctttctt

SEQ ID NO: 1656260 - DNA, 11 bp, Homo sapiens
cgcccttggct

SEQ ID NO: 1656261 - DNA, 16 bp, Homo sapiens
cgccctttcctcctca

SEQ ID NO: 1656262 - DNA, 20 bp, Homo sapiens
cgccgatagagggacggcca

SEQ ID NO: 1656263 - DNA, 13 bp, Homo sapiens
cgccgccgccgct

SEQ ID NO: 1656264 - DNA, 14 bp, Homo sapiens
cgccgccgccgctg

SEQ ID NO: 1656265 - DNA, 16 bp, Homo sapiens
cgccgccgccgctgcc

SEQ ID NO: 1656266 - DNA, 15 bp, Homo sapiens
cgccgccgctgccct

SEQ ID NO: 1656267 - DNA, 12 bp, Homo sapiens
cgccgcctcttt

SEQ ID NO: 1656268 - DNA, 11 bp, Homo sapiens
cggaggggagt

SEQ ID NO: 1656269 - DNA, 17 bp, Homo sapiens
cggaggggatccagcca

SEQ ID NO: 1656270 - DNA, 18 bp, Homo sapiens
cggaggggatccagccac

SEQ ID NO: 1656271 - DNA, 17 bp, Homo sapiens
cggaggtccagctgggc

SEQ ID NO: 1656272 - DNA, 16 bp, Homo sapiens
cggaggtgtggagccg

SEQ ID NO: 1656273 - DNA, 22 bp, Homo sapiens
cggaggttgcagtgagctgaga

SEQ ID NO: 1656274 - DNA, 18 bp, Homo sapiens
cggagtgaagaggggcag

SEQ ID NO: 1656275 - DNA, 20 bp, Homo sapiens
cggagtgaagaggggcagcc

SEQ ID NO: 1656276 - DNA, 18 bp, Homo sapiens
cggagtgcctggagtcag

SEQ ID NO: 1656277 - DNA, 14 bp, Homo sapiens
cggatcctaagcat

SEQ ID NO: 1656278 - DNA, 14 bp, Homo sapiens
cggatcctgctggg

SEQ ID NO: 1656279 - DNA, 12 bp, Homo sapiens
cggatcctgtga

SEQ ID NO: 1656280 - DNA, 19 bp, Homo sapiens
cggatgacaccctggcctg

SEQ ID NO: 1656281 - DNA, 18 bp, Homo sapiens
cggatgaccatactcaga

SEQ ID NO: 1656282 - DNA, 12 bp, Homo sapiens
cggattccagcc

SEQ ID NO: 1656283 - DNA, 16 bp, Homo sapiens
cggattccagcccaca

SEQ ID NO: 1656284 - DNA, 15 bp, Homo sapiens
cggattgctctggag

SEQ ID NO: 1656285 - DNA, 18 bp, Homo sapiens
cggattgctctggagcag

SEQ ID NO: 1656286 - DNA, 14 bp, Homo sapiens
cggcacagggtctg

SEQ ID NO: 1656287 - DNA, 13 bp, Homo sapiens
cggcacccaggcc

SEQ ID NO: 1656288 - DNA, 19 bp, Homo sapiens
cggcacctacatccccagg

SEQ ID NO: 1656289 - DNA, 21 bp, Homo sapiens
cggcacctacatccccaggtc

SEQ ID NO: 1656290 - DNA, 13 bp, Homo sapiens
cggcagcagccat

SEQ ID NO: 1656291 - DNA, 18 bp, Homo sapiens
cggcagcatcccagccag

SEQ ID NO: 1656292 - DNA, 11 bp, Homo sapiens
cggcagcccct

SEQ ID NO: 1656293 - DNA, 16 bp, Homo sapiens
cggcagccccttctgg

SEQ ID NO: 1656294 - DNA, 17 bp, Homo sapiens
cggcagccccttctggc

SEQ ID NO: 1656295 - DNA, 21 bp, Homo sapiens
cggcaggagagtgtgtgggca

SEQ ID NO: 1656296 - DNA, 16 bp, Homo sapiens
cggcaggcctgagaat

SEQ ID NO: 1656297 - DNA, 14 bp, Homo sapiens
cggcaggctcactg

SEQ ID NO: 1656298 - DNA, 20 bp, Homo sapiens
cggcaggctcactgccaggc

SEQ ID NO: 1656299 - DNA, 22 bp, Homo sapiens
cggcagggcgggcagagggctg

SEQ ID NO: 1656300 - DNA, 23 bp, Homo sapiens
cggcagggcgggcagagggctgg

SEQ ID NO: 1656301 - DNA, 12 bp, Homo sapiens
cggcatctcccc

SEQ ID NO: 1656302 - DNA, 23 bp, Homo sapiens
cggcatgagactcagtgcagatg

SEQ ID NO: 1656303 - DNA, 13 bp, Homo sapiens
cggcatgccagga

SEQ ID NO: 1656304 - DNA, 17 bp, Homo sapiens
cggccaaggtgccacca

SEQ ID NO: 1656305 - DNA, 14 bp, Homo sapiens
cggccacacccagc

SEQ ID NO: 1656306 - DNA, 16 bp, Homo sapiens
cggccacacccagcgg

SEQ ID NO: 1656307 - DNA, 18 bp, Homo sapiens
cggccacacccagcggcc

SEQ ID NO: 1656308 - DNA, 19 bp, Homo sapiens
cggccacacccagcggccc

SEQ ID NO: 1656309 - DNA, 16 bp, Homo sapiens
cggccacagctgctgg

SEQ ID NO: 1656310 - DNA, 16 bp, Homo sapiens
cggccagcgggcacag

SEQ ID NO: 1656311 - DNA, 17 bp, Homo sapiens
cggccagcgggcacagg

SEQ ID NO: 1656312 - DNA, 18 bp, Homo sapiens
cggccagcgggcacaggg

SEQ ID NO: 1656313 - DNA, 17 bp, Homo sapiens
cggccagcgtcccaggg

SEQ ID NO: 1656314 - DNA, 14 bp, Homo sapiens
cggccagctctgga

SEQ ID NO: 1656315 - DNA, 16 bp, Homo sapiens
cggccagctctggagt

SEQ ID NO: 1656316 - DNA, 17 bp, Homo sapiens
cggccaggcacagggcc

SEQ ID NO: 1656317 - DNA, 13 bp, Homo sapiens
cggccaggcaccc

SEQ ID NO: 1656318 - DNA, 18 bp, Homo sapiens
cggccaggcacccatgtg

SEQ ID NO: 1656319 - DNA, 17 bp, Homo sapiens
cggccagggagaagctc

SEQ ID NO: 1656320 - DNA, 19 bp, Homo sapiens
cggccagtgcggctgccag

SEQ ID NO: 1656321 - DNA, 15 bp, Homo sapiens
cggcccaagcccgac

SEQ ID NO: 1656322 - DNA, 15 bp, Homo sapiens
cggcccacacccagg

SEQ ID NO: 1656323 - DNA, 19 bp, Homo sapiens
cggcccacagctcccaccc

SEQ ID NO: 1656324 - DNA, 20 bp, Homo sapiens
cggcccactttcctgagctg

SEQ ID NO: 1656325 - DNA, 18 bp, Homo sapiens
cggcccagaagtttccct

SEQ ID NO: 1656326 - DNA, 17 bp, Homo sapiens
cggcccaggatggcttt

SEQ ID NO: 1656327 - DNA, 15 bp, Homo sapiens
cggcccagtgccact

SEQ ID NO: 1656328 - DNA, 13 bp, Homo sapiens
cggccccatctct

SEQ ID NO: 1656329 - DNA, 17 bp, Homo sapiens
cggcccccatgcaaggt

SEQ ID NO: 1656330 - DNA, 22 bp, Homo sapiens
cggccccccgcacagccacccg

SEQ ID NO: 1656331 - DNA, 21 bp, Homo sapiens
cggccccccgcgctcgcccag

SEQ ID NO: 1656332 - DNA, 17 bp, Homo sapiens
cggccccctccatcggg

SEQ ID NO: 1656333 - DNA, 20 bp, Homo sapiens
cggccccctccccccagact

SEQ ID NO: 1656334 - DNA, 22 bp, Homo sapiens
cggccccctccccccagactct

SEQ ID NO: 1656335 - DNA, 14 bp, Homo sapiens
cggccccggcccca

SEQ ID NO: 1656336 - DNA, 14 bp, Homo sapiens
cggccctgtcagag

SEQ ID NO: 1656337 - DNA, 18 bp, Homo sapiens
cggcccttacctttcctg

SEQ ID NO: 1656338 - DNA, 21 bp, Homo sapiens
cggcccttacctttcctgatg

SEQ ID NO: 1656339 - DNA, 16 bp, Homo sapiens
cggcccttctgactgt

SEQ ID NO: 1656340 - DNA, 15 bp, Homo sapiens
cggccgaccaggctg

SEQ ID NO: 1656341 - DNA, 18 bp, Homo sapiens
cggccgcattccctgagt

SEQ ID NO: 1656342 - DNA, 15 bp, Homo sapiens
cggccgcccgcacgt

SEQ ID NO: 1656343 - DNA, 15 bp, Homo sapiens
cggccgccgccagga

SEQ ID NO: 1656344 - DNA, 14 bp, Homo sapiens
cggccggccctggc

SEQ ID NO: 1656345 - DNA, 14 bp, Homo sapiens
cggcctaggcacct

SEQ ID NO: 1656346 - DNA, 13 bp, Homo sapiens
cggcctctctggc

SEQ ID NO: 1656347 - DNA, 16 bp, Homo sapiens
cggcctctctggcctc

SEQ ID NO: 1656348 - DNA, 15 bp, Homo sapiens
cggcctgatgctccc

SEQ ID NO: 1656349 - DNA, 17 bp, Homo sapiens
cggcctgatgctccctc

SEQ ID NO: 1656350 - DNA, 23 bp, Homo sapiens
cggcctgatgctccctcccctgc

SEQ ID NO: 1656351 - DNA, 13 bp, Homo sapiens
cggcctgctccca

SEQ ID NO: 1656352 - DNA, 18 bp, Homo sapiens
cggcctgctcccagcagc

SEQ ID NO: 1656353 - DNA, 15 bp, Homo sapiens
cggcctgggtgacag

SEQ ID NO: 1656354 - DNA, 12 bp, Homo sapiens
cggcctgtgggt

SEQ ID NO: 1656355 - DNA, 18 bp, Homo sapiens
cggcctgtgggtctctga

SEQ ID NO: 1656356 - DNA, 14 bp, Homo sapiens
cggccttgaagaca

SEQ ID NO: 1656357 - DNA, 16 bp, Homo sapiens
cggccttgctgggggc

SEQ ID NO: 1656358 - DNA, 18 bp, Homo sapiens
cggccttggtgaacacac

SEQ ID NO: 1656359 - DNA, 14 bp, Homo sapiens
cggcgcagagccct

SEQ ID NO: 1656360 - DNA, 16 bp, Homo sapiens
cggcgcagagccctcc

SEQ ID NO: 1656361 - DNA, 18 bp, Homo sapiens
cggcgcccctgccacctc

SEQ ID NO: 1656362 - DNA, 12 bp, Homo sapiens
cggcggccaggc

SEQ ID NO: 1656363 - DNA, 17 bp, Homo sapiens
cggcgggatcctccaca

SEQ ID NO: 1656364 - DNA, 20 bp, Homo sapiens
cggcgggatcctccacagag

SEQ ID NO: 1656365 - DNA, 19 bp, Homo sapiens
cggcgtcttgcccagcagc

SEQ ID NO: 1656366 - DNA, 19 bp, Homo sapiens
cggctaatttttatatttt

SEQ ID NO: 1656367 - DNA, 14 bp, Homo sapiens
cggctactcagcag

SEQ ID NO: 1656368 - DNA, 21 bp, Homo sapiens
cggctactcagcagccctcct

SEQ ID NO: 1656369 - DNA, 22 bp, Homo sapiens
cggctccaactcctttcagcca

SEQ ID NO: 1656370 - DNA, 22 bp, Homo sapiens
cggctccagtttccccatgggg

SEQ ID NO: 1656371 - DNA, 17 bp, Homo sapiens
cggctccccatgtgtcc

SEQ ID NO: 1656372 - DNA, 22 bp, Homo sapiens
cggctcccggggcagggcagcc

SEQ ID NO: 1656373 - DNA, 20 bp, Homo sapiens
cggctcgagcagtcctgcct

SEQ ID NO: 1656374 - DNA, 19 bp, Homo sapiens
cggctcgtgtatttattac

SEQ ID NO: 1656375 - DNA, 18 bp, Homo sapiens
cggctctcacctggccct

SEQ ID NO: 1656376 - DNA, 13 bp, Homo sapiens
cggctctgggcct

SEQ ID NO: 1656377 - DNA, 11 bp, Homo sapiens
cggctgaccat

SEQ ID NO: 1656378 - DNA, 23 bp, Homo sapiens
cggctgaccatgctcatctgctg

SEQ ID NO: 1656379 - DNA, 14 bp, Homo sapiens
cggctgagagcccc

SEQ ID NO: 1656380 - DNA, 17 bp, Homo sapiens
cggctgcctgccgccca

SEQ ID NO: 1656381 - DNA, 22 bp, Homo sapiens
cggctgcctgccgcccaaagag

SEQ ID NO: 1656382 - DNA, 15 bp, Homo sapiens
cggctggagaaagat

SEQ ID NO: 1656383 - DNA, 19 bp, Homo sapiens
cggctggagaaagatgcag

SEQ ID NO: 1656384 - DNA, 20 bp, Homo sapiens
cgtgcctccaccaccactgg

SEQ ID NO: 1656385 - DNA, 17 bp, Homo sapiens
cgtgcctgggggagaga

SEQ ID NO: 1656386 - DNA, 16 bp, Homo sapiens
cgtgccttcagctcta

SEQ ID NO: 1656387 - DNA, 16 bp, Homo sapiens
cgtgccttttgcaccc

SEQ ID NO: 1656388 - DNA, 17 bp, Homo sapiens
cgtgccttttgcacccc

SEQ ID NO: 1656389 - DNA, 19 bp, Homo sapiens
cgtgccttttgcacccctc

SEQ ID NO: 1656390 - DNA, 17 bp, Homo sapiens
cgtgcgtgttagtgtgt

SEQ ID NO: 1656391 - DNA, 14 bp, Homo sapiens
cgtgctgtgctctg

SEQ ID NO: 1656392 - DNA, 15 bp, Homo sapiens
cgtgctgtgctctgg

SEQ ID NO: 1656393 - DNA, 16 bp, Homo sapiens
cgtgctgtgctctggc

SEQ ID NO: 1656394 - DNA, 19 bp, Homo sapiens
cgtgctgtgggcctcaggc

SEQ ID NO: 1656395 - DNA, 13 bp, Homo sapiens
cgtgcttctttgt

SEQ ID NO: 1656396 - DNA, 14 bp, Homo sapiens
cgtgctttgtgttc

SEQ ID NO: 1656397 - DNA, 22 bp, Homo sapiens
cgtggaatgcccttcactgtca

SEQ ID NO: 1656398 - DNA, 19 bp, Homo sapiens
cgtggactgagtgggaagc

SEQ ID NO: 1656399 - DNA, 13 bp, Homo sapiens
cgtggactgtgct

SEQ ID NO: 1656400 - DNA, 14 bp, Homo sapiens
cgtggactgtgctg

SEQ ID NO: 1656401 - DNA, 20 bp, Homo sapiens
cgtggagagctggtgcccgg

SEQ ID NO: 1656402 - DNA, 20 bp, Homo sapiens
cgtggaggaggagggaggcc

SEQ ID NO: 1656403 - DNA, 16 bp, Homo sapiens
cgtggagggaggcccc

SEQ ID NO: 1656404 - DNA, 22 bp, Homo sapiens
cgtggatcgagtgtagctgtga

SEQ ID NO: 1656405 - DNA, 15 bp, Homo sapiens
cgtggatctccttcc

SEQ ID NO: 1656406 - DNA, 18 bp, Homo sapiens
cgtggatctccttccctt

SEQ ID NO: 1656407 - DNA, 22 bp, Homo sapiens
cgtggatctccttcccttctct

SEQ ID NO: 1656408 - DNA, 19 bp, Homo sapiens
cgtggatgggcaaagcttg

SEQ ID NO: 1656409 - DNA, 14 bp, Homo sapiens
cgtggatttgtact

SEQ ID NO: 1656410 - DNA, 15 bp, Homo sapiens
cgtggatttgtactt

SEQ ID NO: 1656411 - DNA, 16 bp, Homo sapiens
cgtggcatgtggcctg

SEQ ID NO: 1656412 - DNA, 19 bp, Homo sapiens
cgtggcatgtggcctgtgg

SEQ ID NO: 1656413 - DNA, 20 bp, Homo sapiens
cgtggcatgttttgatttgt

SEQ ID NO: 1656414 - DNA, 22 bp, Homo sapiens
cgtggccaacgtggacctgcct

SEQ ID NO: 1656415 - DNA, 23 bp, Homo sapiens
cgtggccacgggggcagtgtgag

SEQ ID NO: 1656416 - DNA, 18 bp, Homo sapiens
cgtggccctgccctctcc

SEQ ID NO: 1656417 - DNA, 19 bp, Homo sapiens
cgtggcctcgtgaggggca

SEQ ID NO: 1656418 - DNA, 15 bp, Homo sapiens
cgtggcctcttgagc

SEQ ID NO: 1656419 - DNA, 15 bp, Homo sapiens
cgtggctgtggcaca

SEQ ID NO: 1656420 - DNA, 19 bp, Homo sapiens
cgtggcttcagaggcctgg

SEQ ID NO: 1656421 - DNA, 21 bp, Homo sapiens
cgtggcttcccgctcagccct

SEQ ID NO: 1656422 - DNA, 14 bp, Homo sapiens
cgtggcttggggat

SEQ ID NO: 1656423 - DNA, 14 bp, Homo sapiens
cgtgggagccagcc

SEQ ID NO: 1656424 - DNA, 17 bp, Homo sapiens
cgtgggcagtgccaccc

SEQ ID NO: 1656425 - DNA, 12 bp, Homo sapiens
cgtgggctcccg

SEQ ID NO: 1656426 - DNA, 22 bp, Homo sapiens
cgtggggcagggagctgggccc

SEQ ID NO: 1656427 - DNA, 23 bp, Homo sapiens
cgtggggcagggagctgggcccg

SEQ ID NO: 1656428 - DNA, 13 bp, Homo sapiens
cgtggggcccact

SEQ ID NO: 1656429 - DNA, 18 bp, Homo sapiens
cgtgggtgccctctccaa

SEQ ID NO: 1656430 - DNA, 13 bp, Homo sapiens
cgtgggtgtgtgc

SEQ ID NO: 1656431 - DNA, 16 bp, Homo sapiens
cgtggtatgtctgcca

SEQ ID NO: 1656432 - DNA, 19 bp, Homo sapiens
cgtggtcagggcagggctc

SEQ ID NO: 1656433 - DNA, 21 bp, Homo sapiens
cgtggtggcggtggctgcccc

SEQ ID NO: 1656434 - DNA, 21 bp, Homo sapiens
cgtggtgtgtccctggacaca

SEQ ID NO: 1656435 - DNA, 22 bp, Homo sapiens
cgtggtgtgtccctggacacag

SEQ ID NO: 1656436 - DNA, 23 bp, Homo sapiens
cgtggtgtgtccctggacacagc

SEQ ID NO: 1656437 - DNA, 18 bp, Homo sapiens
cgtggtgttatttaaaga

SEQ ID NO: 1656438 - DNA, 19 bp, Homo sapiens
cgtggtgttatttaaagaa

SEQ ID NO: 1656439 - DNA, 17 bp, Homo sapiens
cgtgtaaaaagcctcct

SEQ ID NO: 1656440 - DNA, 18 bp, Homo sapiens
cgtgtaaaaagcctcctt

SEQ ID NO: 1656441 - DNA, 22 bp, Homo sapiens
cgtgtaaccagttataaataca

SEQ ID NO: 1656442 - DNA, 21 bp, Homo sapiens
cgtgtagtggaagagcagcct

SEQ ID NO: 1656443 - DNA, 22 bp, Homo sapiens
cgtgtagtggaagagcagcctg

SEQ ID NO: 1656444 - DNA, 17 bp, Homo sapiens
cgtgtatagtatctgta

SEQ ID NO: 1656445 - DNA, 15 bp, Homo sapiens
cgtgtatagtgccta

SEQ ID NO: 1656446 - DNA, 16 bp, Homo sapiens
cgtgtatcctggggct

SEQ ID NO: 1656447 - DNA, 17 bp, Homo sapiens
cgtgtatttattaccgt

SEQ ID NO: 1656448 - DNA, 14 bp, Homo sapiens
cgtgtcaagctgct

SEQ ID NO: 1656449 - DNA, 23 bp, Homo sapiens
cgtgtccaagggccgtgcccttg

SEQ ID NO: 1656450 - DNA, 14 bp, Homo sapiens
cgtgtccagcacag

SEQ ID NO: 1656451 - DNA, 17 bp, Homo sapiens
cgtgtcccgcggtgctg

SEQ ID NO: 1656452 - DNA, 19 bp, Homo sapiens
cgtgtccgtccacccttcc

SEQ ID NO: 1656453 - DNA, 20 bp, Homo sapiens
cgtgtcctctccctgccaag

SEQ ID NO: 1656454 - DNA, 13 bp, Homo sapiens
cgtgtctctccca

SEQ ID NO: 1656455 - DNA, 15 bp, Homo sapiens
cgtgtctctgccatg

SEQ ID NO: 1656456 - DNA, 18 bp, Homo sapiens
cgtgtgcatagcgtcctg

SEQ ID NO: 1656457 - DNA, 21 bp, Homo sapiens
cgtgtgcatagcgtcctgccc

SEQ ID NO: 1656458 - DNA, 24 bp, Homo sapiens
cgtgtgcatagcgtcctgccctgc

SEQ ID NO: 1656459 - DNA, 23 bp, Homo sapiens
cgtgtgccatggatctgatctgt

SEQ ID NO: 1656460 - DNA, 16 bp, Homo sapiens
cgtgtggactgtgcct

SEQ ID NO: 1656461 - DNA, 17 bp, Homo sapiens
cgtgtgtggctgggacc

SEQ ID NO: 1656462 - DNA, 19 bp, Homo sapiens
cgtgtgtgtgtatgtgtgt

SEQ ID NO: 1656463 - DNA, 15 bp, Homo sapiens
cgtgttacccactgc

SEQ ID NO: 1656464 - DNA, 19 bp, Homo sapiens
cgtgttactgttgcactga

SEQ ID NO: 1656465 - DNA, 21 bp, Homo sapiens
cgtgttaggaggctgcatgct

SEQ ID NO: 1656466 - DNA, 22 bp, Homo sapiens
cgtgttagtgtgtgtgcatgtg

SEQ ID NO: 1656467 - DNA, 15 bp, Homo sapiens
cgtgttcaatatttt

SEQ ID NO: 1656468 - DNA, 17 bp, Homo sapiens
cgtgttcagcagaacct

SEQ ID NO: 1656469 - DNA, 20 bp, Homo sapiens
cgtgttcagcagaacctgca

SEQ ID NO: 1656470 - DNA, 14 bp, Homo sapiens
cgtgtttctgactc

SEQ ID NO: 1656471 - DNA, 20 bp, Homo sapiens
cgttaattttcctttgtcat

SEQ ID NO: 1656472 - DNA, 15 bp, Homo sapiens
cgttagctcctgtgg

SEQ ID NO: 1656473 - DNA, 19 bp, Homo sapiens
cgttaggaataacactgca

SEQ ID NO: 1656474 - DNA, 20 bp, Homo sapiens
cgttaggcatttcctgctga

SEQ ID NO: 1656475 - DNA, 14 bp, Homo sapiens
cgttatgtgcagta

SEQ ID NO: 1656476 - DNA, 15 bp, Homo sapiens
cgttcaataagcatt

SEQ ID NO: 1656477 - DNA, 22 bp, Homo sapiens
cgttcacctccaagcatttcat

SEQ ID NO: 1656478 - DNA, 15 bp, Homo sapiens
cgttcagcagactgg

SEQ ID NO: 1656479 - DNA, 12 bp, Homo sapiens
cgttcagcctgt

SEQ ID NO: 1656480 - DNA, 15 bp, Homo sapiens
cgttccagctgacat

SEQ ID NO: 1656481 - DNA, 12 bp, Homo sapiens
cgttcctggcct

SEQ ID NO: 1656482 - DNA, 21 bp, Homo sapiens
cgttcgtacgcccaggacagc

SEQ ID NO: 1656483 - DNA, 15 bp, Homo sapiens
cgttctcaagaatct

SEQ ID NO: 1656484 - DNA, 19 bp, Homo sapiens
cgttctctgggtggccggc

SEQ ID NO: 1656485 - DNA, 14 bp, Homo sapiens
cgttctctgtccta

SEQ ID NO: 1656486 - DNA, 16 bp, Homo sapiens
cgttctctgtcctact

SEQ ID NO: 1656487 - DNA, 18 bp, Homo sapiens
cgttctcttctctcttca

SEQ ID NO: 1656488 - DNA, 12 bp, Homo sapiens
cgttctgctgcc

SEQ ID NO: 1656489 - DNA, 15 bp, Homo sapiens
cgttctgctgcccct

SEQ ID NO: 1656490 - DNA, 19 bp, Homo sapiens
cgttctgctgcccctgcag

SEQ ID NO: 1656491 - DNA, 18 bp, Homo sapiens
cgttctgctggcctggat

SEQ ID NO: 1656492 - DNA, 16 bp, Homo sapiens
cgttctggactctgcc

SEQ ID NO: 1656493 - DNA, 17 bp, Homo sapiens
cgttctggactctgccc

SEQ ID NO: 1656494 - DNA, 18 bp, Homo sapiens
cgttctggactctgcccc

SEQ ID NO: 1656495 - DNA, 23 bp, Homo sapiens
cgttctgggtcagcttgaatgtc

SEQ ID NO: 1656496 - DNA, 12 bp, Homo sapiens
cgttctgttcca

SEQ ID NO: 1656497 - DNA, 12 bp, Homo sapiens
cgttgccagggg

SEQ ID NO: 1656498 - DNA, 22 bp, Homo sapiens
ctaaggcatctatctgtgctag

SEQ ID NO: 1656499 - DNA, 13 bp, Homo sapiens
ctaaggcctactt

SEQ ID NO: 1656500 - DNA, 19 bp, Homo sapiens
ctaaggcctaggattctaa

SEQ ID NO: 1656501 - DNA, 20 bp, Homo sapiens
ctaaggcctaggattctaaa

SEQ ID NO: 1656502 - DNA, 15 bp, Homo sapiens
ctaaggctcctcctt

SEQ ID NO: 1656503 - DNA, 18 bp, Homo sapiens
ctaaggctctatgagtct

SEQ ID NO: 1656504 - DNA, 20 bp, Homo sapiens
ctaaggctctatgagtctag

SEQ ID NO: 1656505 - DNA, 23 bp, Homo sapiens
ctaaggctctatgagtctagatg

SEQ ID NO: 1656506 - DNA, 20 bp, Homo sapiens
ctaaggctctgagagtctag

SEQ ID NO: 1656507 - DNA, 22 bp, Homo sapiens
ctaaggctctgagagtctagat

SEQ ID NO: 1656508 - DNA, 23 bp, Homo sapiens
ctaagggagagtggtatttgcag

SEQ ID NO: 1656509 - DNA, 23 bp, Homo sapiens
ctaagggtcgaaagctctagaat

SEQ ID NO: 1656510 - DNA, 15 bp, Homo sapiens
ctaagggtctctcat

SEQ ID NO: 1656511 - DNA, 18 bp, Homo sapiens
ctaagggtgtaagtaatt

SEQ ID NO: 1656512 - DNA, 15 bp, Homo sapiens
ctaaggtaatcctat

SEQ ID NO: 1656513 - DNA, 14 bp, Homo sapiens
ctaaggtctcatgc

SEQ ID NO: 1656514 - DNA, 19 bp, Homo sapiens
ctaaggtctcatgctgttg

SEQ ID NO: 1656515 - DNA, 17 bp, Homo sapiens
ctaaggtggattttcat

SEQ ID NO: 1656516 - DNA, 16 bp, Homo sapiens
ctaaggttctaaggcc

SEQ ID NO: 1656517 - DNA, 17 bp, Homo sapiens
ctaagtaaataggaatt

SEQ ID NO: 1656518 - DNA, 22 bp, Homo sapiens
ctaagtcagtttcacatatttg

SEQ ID NO: 1656519 - DNA, 12 bp, Homo sapiens
ctaagtctctgt

SEQ ID NO: 1656520 - DNA, 14 bp, Homo sapiens
ctaagtgcccaaag

SEQ ID NO: 1656521 - DNA, 17 bp, Homo sapiens
ctaagtggcgtgtgcat

SEQ ID NO: 1656522 - DNA, 19 bp, Homo sapiens
ctaagtggctgccttcttt

SEQ ID NO: 1656523 - DNA, 22 bp, Homo sapiens
ctaagtggctgccttctttcca

SEQ ID NO: 1656524 - DNA, 22 bp, Homo sapiens
ctaagtgggacattcaaaaaac

SEQ ID NO: 1656525 - DNA, 20 bp, Homo sapiens
ctaagtgggcattgccatgt

SEQ ID NO: 1656526 - DNA, 13 bp, Homo sapiens
ctaagtgtgctta

SEQ ID NO: 1656527 - DNA, 22 bp, Homo sapiens
ctaagtgtgcttagttttaata

SEQ ID NO: 1656528 - DNA, 23 bp, Homo sapiens
ctaagtgttcgtctttagttttg

SEQ ID NO: 1656529 - DNA, 22 bp, Homo sapiens
ctaagtgtttactatgtgccag

SEQ ID NO: 1656530 - DNA, 17 bp, Homo sapiens
ctaagttataagactct

SEQ ID NO: 1656531 - DNA, 16 bp, Homo sapiens
ctaagttatagtatat

SEQ ID NO: 1656532 - DNA, 14 bp, Homo sapiens
ctaagttcacatta

SEQ ID NO: 1656533 - DNA, 20 bp, Homo sapiens
ctaagttcatgtttgtaaat

SEQ ID NO: 1656534 - DNA, 15 bp, Homo sapiens
ctaagttctcccaac

SEQ ID NO: 1656535 - DNA, 21 bp, Homo sapiens
ctaagtttctaagattctaaa

SEQ ID NO: 1656536 - DNA, 20 bp, Homo sapiens
ctaagttttagggtacatgt

SEQ ID NO: 1656537 - DNA, 13 bp, Homo sapiens
ctaataaaagcat

SEQ ID NO: 1656538 - DNA, 14 bp, Homo sapiens
ctaataatttctaa

SEQ ID NO: 1656539 - DNA, 15 bp, Homo sapiens
ctaataatttctaat

SEQ ID NO: 1656540 - DNA, 16 bp, Homo sapiens
ctaataatttctaatg

SEQ ID NO: 1656541 - DNA, 19 bp, Homo sapiens
ctaatacagcaacaattta

SEQ ID NO: 1656542 - DNA, 23 bp, Homo sapiens
ctaatacagcaacaatttatgaa

SEQ ID NO: 1656543 - DNA, 17 bp, Homo sapiens
ctaatacctctgtgtgc

SEQ ID NO: 1656544 - DNA, 22 bp, Homo sapiens
ctaatacgtgccagatataact

SEQ ID NO: 1656545 - DNA, 13 bp, Homo sapiens
ctaatagaactca

SEQ ID NO: 1656546 - DNA, 20 bp, Homo sapiens
ctaatagactaaatgaaatc

SEQ ID NO: 1656547 - DNA, 12 bp, Homo sapiens
ctaatagctttt

SEQ ID NO: 1656548 - DNA, 15 bp, Homo sapiens
ctaatatatatgaat

SEQ ID NO: 1656549 - DNA, 17 bp, Homo sapiens
ctaatatatattttaag

SEQ ID NO: 1656550 - DNA, 18 bp, Homo sapiens
ctaatatatattttaagg

SEQ ID NO: 1656551 - DNA, 13 bp, Homo sapiens
ctaatatatttaa

SEQ ID NO: 1656552 - DNA, 22 bp, Homo sapiens
ctaatatcttaattctttgttc

SEQ ID NO: 1656553 - DNA, 14 bp, Homo sapiens
ctaatatttttcat

SEQ ID NO: 1656554 - DNA, 15 bp, Homo sapiens
ctaatcaaaactttc

SEQ ID NO: 1656555 - DNA, 18 bp, Homo sapiens
ctaatcaccatgtaagca

SEQ ID NO: 1656556 - DNA, 19 bp, Homo sapiens
ctaatcagcattctcactc

SEQ ID NO: 1656557 - DNA, 21 bp, Homo sapiens
ctaatcagggaggtcattttg

SEQ ID NO: 1656558 - DNA, 21 bp, Homo sapiens
ctaatcatgtgggtgagccag

SEQ ID NO: 1656559 - DNA, 20 bp, Homo sapiens
ctaatccctgggcattgctt

SEQ ID NO: 1656560 - DNA, 12 bp, Homo sapiens
ctaatccttttc

SEQ ID NO: 1656561 - DNA, 13 bp, Homo sapiens
ctaatccttttcc

SEQ ID NO: 1656562 - DNA, 18 bp, Homo sapiens
ctaatctcatacctctga

SEQ ID NO: 1656563 - DNA, 22 bp, Homo sapiens
ctaatctcatacctctgaccaa

SEQ ID NO: 1656564 - DNA, 20 bp, Homo sapiens
ctaatctccacttttttcat

SEQ ID NO: 1656565 - DNA, 14 bp, Homo sapiens
ctaatctgagattg

SEQ ID NO: 1656566 - DNA, 14 bp, Homo sapiens
ctaatctgtagggc

SEQ ID NO: 1656567 - DNA, 18 bp, Homo sapiens
ctaatctgtagggctgga

SEQ ID NO: 1656568 - DNA, 18 bp, Homo sapiens
ctaatgctaagaaatgct

SEQ ID NO: 1656569 - DNA, 19 bp, Homo sapiens
ctaatgctcacctttatca

SEQ ID NO: 1656570 - DNA, 16 bp, Homo sapiens
ctaatgcttgtttatg

SEQ ID NO: 1656571 - DNA, 19 bp, Homo sapiens
ctaatggggaaatgtagct

SEQ ID NO: 1656572 - DNA, 20 bp, Homo sapiens
ctaatggggaaatgtagcta

SEQ ID NO: 1656573 - DNA, 21 bp, Homo sapiens
ctaatgtaatcatttatctta

SEQ ID NO: 1656574 - DNA, 16 bp, Homo sapiens
ctaatgtactgcatat

SEQ ID NO: 1656575 - DNA, 16 bp, Homo sapiens
ctaatgtctgcagctc

SEQ ID NO: 1656576 - DNA, 16 bp, Homo sapiens
ctaatgtttgtgagaa

SEQ ID NO: 1656577 - DNA, 14 bp, Homo sapiens
ctaattaaagatgg

SEQ ID NO: 1656578 - DNA, 22 bp, Homo sapiens
ctaattaaagatggtttatgca

SEQ ID NO: 1656579 - DNA, 23 bp, Homo sapiens
ctaattaaagatggtttatgcat

SEQ ID NO: 1656580 - DNA, 18 bp, Homo sapiens
ctaattaaccttactaat

SEQ ID NO: 1656581 - DNA, 14 bp, Homo sapiens
ctaattaaggaagt

SEQ ID NO: 1656582 - DNA, 13 bp, Homo sapiens
ctaattaatatat

SEQ ID NO: 1656583 - DNA, 18 bp, Homo sapiens
ctaattaatatattaaaa

SEQ ID NO: 1656584 - DNA, 23 bp, Homo sapiens
ctaattaatatattaaaattcca

SEQ ID NO: 1656585 - DNA, 15 bp, Homo sapiens
ctaattatatatttt

SEQ ID NO: 1656586 - DNA, 22 bp, Homo sapiens
ctaattatatattttgttgttc

SEQ ID NO: 1656587 - DNA, 19 bp, Homo sapiens
ctaattattattttaaaat

SEQ ID NO: 1656588 - DNA, 19 bp, Homo sapiens
ctaattccacaggtcatca

SEQ ID NO: 1656589 - DNA, 18 bp, Homo sapiens
ctaattcccattttgcaa

SEQ ID NO: 1656590 - DNA, 19 bp, Homo sapiens
ctaattcccattttgcaaa

SEQ ID NO: 1656591 - DNA, 23 bp, Homo sapiens
ctaattcctgttgctctgtttct

SEQ ID NO: 1656592 - DNA, 15 bp, Homo sapiens
ctaattctcttcgct

SEQ ID NO: 1656593 - DNA, 22 bp, Homo sapiens
ctaattctttgacctgttggga

SEQ ID NO: 1656594 - DNA, 12 bp, Homo sapiens
ctaattctttgc

SEQ ID NO: 1656595 - DNA, 16 bp, Homo sapiens
ctaattctttgcaaaa

SEQ ID NO: 1656596 - DNA, 19 bp, Homo sapiens
ctaattgcatctcaaaatt

SEQ ID NO: 1656597 - DNA, 19 bp, Homo sapiens
ctaattggtacttttaaaa

SEQ ID NO: 1656598 - DNA, 20 bp, Homo sapiens
ctaattggtttttactgaaa

SEQ ID NO: 1656599 - DNA, 18 bp, Homo sapiens
ctaattgtactaatctga

SEQ ID NO: 1656600 - DNA, 12 bp, Homo sapiens
ctaattgtggat

SEQ ID NO: 1656601 - DNA, 13 bp, Homo sapiens
ctaattgtgtata

SEQ ID NO: 1656602 - DNA, 13 bp, Homo sapiens
ctaatttaacacc

SEQ ID NO: 1656603 - DNA, 17 bp, Homo sapiens
ctaatttaacccagctc

SEQ ID NO: 1656604 - DNA, 21 bp, Homo sapiens
ctaatttatcttgtctctggg

SEQ ID NO: 1656605 - DNA, 14 bp, Homo sapiens
ctaatttctcctcc

SEQ ID NO: 1656606 - DNA, 23 bp, Homo sapiens
ctaatttgaataaactctcccct

SEQ ID NO: 1656607 - DNA, 16 bp, Homo sapiens
ctaatttgaggctcag

SEQ ID NO: 1656608 - DNA, 16 bp, Homo sapiens
ctaatttgatgtttac

SEQ ID NO: 1656609 - DNA, 14 bp, Homo sapiens
ctaattttaaataa

SEQ ID NO: 1656610 - DNA, 17 bp, Homo sapiens
ctaattttagtattcat

SEQ ID NO: 1656611 - DNA, 18 bp, Homo sapiens
ctaatttttggagaaatg

SEQ ID NO: 1656612 - DNA, 20 bp, Homo sapiens
ctactttgactttttgcatt

SEQ ID NO: 1656613 - DNA, 21 bp, Homo sapiens
ctactttgactttttgcattt

SEQ ID NO: 1656614 - DNA, 15 bp, Homo sapiens
ctactttgattctga

SEQ ID NO: 1656615 - DNA, 16 bp, Homo sapiens
ctactttgattctgat

SEQ ID NO: 1656616 - DNA, 20 bp, Homo sapiens
ctactttggtttctgtctgt

SEQ ID NO: 1656617 - DNA, 18 bp, Homo sapiens
ctacttttgcatgaaaat

SEQ ID NO: 1656618 - DNA, 14 bp, Homo sapiens
ctactttttatact

SEQ ID NO: 1656619 - DNA, 15 bp, Homo sapiens
ctactttttatactc

SEQ ID NO: 1656620 - DNA, 16 bp, Homo sapiens
ctactttttatactcc

SEQ ID NO: 1656621 - DNA, 18 bp, Homo sapiens
ctagaaaaaaaaaacact

SEQ ID NO: 1656622 - DNA, 12 bp, Homo sapiens
ctagaaaaataa

SEQ ID NO: 1656623 - DNA, 18 bp, Homo sapiens
ctagaaaaataaaatgtt

SEQ ID NO: 1656624 - DNA, 20 bp, Homo sapiens
ctagaaaaataaaatgtttc

SEQ ID NO: 1656625 - DNA, 14 bp, Homo sapiens
ctagaaagaaaaga

SEQ ID NO: 1656626 - DNA, 20 bp, Homo sapiens
ctagaaagctttgaatgcag

SEQ ID NO: 1656627 - DNA, 17 bp, Homo sapiens
ctagaaatatgatttta

SEQ ID NO: 1656628 - DNA, 18 bp, Homo sapiens
ctagaaattgaacaaaaa

SEQ ID NO: 1656629 - DNA, 16 bp, Homo sapiens
ctagaaattgacacaa

SEQ ID NO: 1656630 - DNA, 13 bp, Homo sapiens
ctagaaattttca

SEQ ID NO: 1656631 - DNA, 21 bp, Homo sapiens
ctagaacacaggcaaaatcct

SEQ ID NO: 1656632 - DNA, 20 bp, Homo sapiens
ctagaacatgcacatttata

SEQ ID NO: 1656633 - DNA, 17 bp, Homo sapiens
ctagaaccaagcttcag

SEQ ID NO: 1656634 - DNA, 19 bp, Homo sapiens
ctagaacgtgcatccttgt

SEQ ID NO: 1656635 - DNA, 15 bp, Homo sapiens
ctagaagatgaatac

SEQ ID NO: 1656636 - DNA, 15 bp, Homo sapiens
ctagaagatgtgtaa

SEQ ID NO: 1656637 - DNA, 17 bp, Homo sapiens
ctagaagatgtgtaaac

SEQ ID NO: 1656638 - DNA, 21 bp, Homo sapiens
ctagaagccaagggaaagggg

SEQ ID NO: 1656639 - DNA, 20 bp, Homo sapiens
ctagaagggccagtcctgcc

SEQ ID NO: 1656640 - DNA, 16 bp, Homo sapiens
ctagaagtaagaagag

SEQ ID NO: 1656641 - DNA, 17 bp, Homo sapiens
ctagaagtaagaagagg

SEQ ID NO: 1656642 - DNA, 21 bp, Homo sapiens
ctagaagtaagaagaggagcc

SEQ ID NO: 1656643 - DNA, 18 bp, Homo sapiens
ctagaagtctccctgcac

SEQ ID NO: 1656644 - DNA, 22 bp, Homo sapiens
ctagaagtctccctgcacagcc

SEQ ID NO: 1656645 - DNA, 20 bp, Homo sapiens
ctagaagtgggccaggacag

SEQ ID NO: 1656646 - DNA, 15 bp, Homo sapiens
ctagaagttactgaa

SEQ ID NO: 1656647 - DNA, 17 bp, Homo sapiens
ctagaagttactgaatg

SEQ ID NO: 1656648 - DNA, 18 bp, Homo sapiens
ctagaagttactgaatgc

SEQ ID NO: 1656649 - DNA, 14 bp, Homo sapiens
ctagaatgtaaagt

SEQ ID NO: 1656650 - DNA, 14 bp, Homo sapiens
ctagaatgtcagat

SEQ ID NO: 1656651 - DNA, 17 bp, Homo sapiens
ctagaatgtcagatttc

SEQ ID NO: 1656652 - DNA, 20 bp, Homo sapiens
ctagaatgtcagatttctgg

SEQ ID NO: 1656653 - DNA, 22 bp, Homo sapiens
ctagaatgtcagatttctggtt

SEQ ID NO: 1656654 - DNA, 20 bp, Homo sapiens
ctagaatgtggatttgattc

SEQ ID NO: 1656655 - DNA, 19 bp, Homo sapiens
ctagaattagtatgtctgt

SEQ ID NO: 1656656 - DNA, 15 bp, Homo sapiens
ctagaattctagtgc

SEQ ID NO: 1656657 - DNA, 19 bp, Homo sapiens
ctagaattctagtgctgct

SEQ ID NO: 1656658 - DNA, 15 bp, Homo sapiens
ctagaatttattcaa

SEQ ID NO: 1656659 - DNA, 16 bp, Homo sapiens
ctagaattttaagcct

SEQ ID NO: 1656660 - DNA, 19 bp, Homo sapiens
ctagaattttaagtgcttt

SEQ ID NO: 1656661 - DNA, 16 bp, Homo sapiens
ctagacaacctttctg

SEQ ID NO: 1656662 - DNA, 15 bp, Homo sapiens
ctagacaccaaagtt

SEQ ID NO: 1656663 - DNA, 21 bp, Homo sapiens
ctagacagaaaccaagccatt

SEQ ID NO: 1656664 - DNA, 17 bp, Homo sapiens
ctagaccagcagacaga

SEQ ID NO: 1656665 - DNA, 21 bp, Homo sapiens
ctagactcaaaacctggagat

SEQ ID NO: 1656666 - DNA, 16 bp, Homo sapiens
ctagactggagtgagg

SEQ ID NO: 1656667 - DNA, 23 bp, Homo sapiens
ctagactggagtgaggcttccag

SEQ ID NO: 1656668 - DNA, 14 bp, Homo sapiens
ctagactggcctag

SEQ ID NO: 1656669 - DNA, 18 bp, Homo sapiens
ctagactgttactttggc

SEQ ID NO: 1656670 - DNA, 17 bp, Homo sapiens
ctagacttccccatccc

SEQ ID NO: 1656671 - DNA, 16 bp, Homo sapiens
ctagagaacaggtggt

SEQ ID NO: 1656672 - DNA, 18 bp, Homo sapiens
ctagagacagtgatgcct

SEQ ID NO: 1656673 - DNA, 15 bp, Homo sapiens
ctagagagaataaat

SEQ ID NO: 1656674 - DNA, 20 bp, Homo sapiens
ctagagagccttaacttctt

SEQ ID NO: 1656675 - DNA, 22 bp, Homo sapiens
ctagagcaacccctgtacccag

SEQ ID NO: 1656676 - DNA, 21 bp, Homo sapiens
ctagagcaacttttcttggaa

SEQ ID NO: 1656677 - DNA, 21 bp, Homo sapiens
ctagagccgaggggagagagg

SEQ ID NO: 1656678 - DNA, 22 bp, Homo sapiens
ctagaggccagccccacccagg

SEQ ID NO: 1656679 - DNA, 12 bp, Homo sapiens
ctagaggcctca

SEQ ID NO: 1656680 - DNA, 18 bp, Homo sapiens
ctagaggcctgaggatga

SEQ ID NO: 1656681 - DNA, 20 bp, Homo sapiens
ctagaggcctgaggatgagc

SEQ ID NO: 1656682 - DNA, 15 bp, Homo sapiens
ctagaggcgagccag

SEQ ID NO: 1656683 - DNA, 16 bp, Homo sapiens
ctagaggcgagccagg

SEQ ID NO: 1656684 - DNA, 22 bp, Homo sapiens
ctagagggagacttgttctaga

SEQ ID NO: 1656685 - DNA, 22 bp, Homo sapiens
ctagagggatacactgaagtta

SEQ ID NO: 1656686 - DNA, 15 bp, Homo sapiens
ctagagggcccatca

SEQ ID NO: 1656687 - DNA, 18 bp, Homo sapiens
ctagagggcccatcaggc

SEQ ID NO: 1656688 - DNA, 20 bp, Homo sapiens
ctagagggcccatcaggcag

SEQ ID NO: 1656689 - DNA, 15 bp, Homo sapiens
ctagaggtgggcagc

SEQ ID NO: 1656690 - DNA, 16 bp, Homo sapiens
ctagaggtgggcagct

SEQ ID NO: 1656691 - DNA, 17 bp, Homo sapiens
ctagaggtgggcagctg

SEQ ID NO: 1656692 - DNA, 19 bp, Homo sapiens
ctagaggtgggcagctggg

SEQ ID NO: 1656693 - DNA, 23 bp, Homo sapiens
ctagaggtgggcagctgggcccc

SEQ ID NO: 1656694 - DNA, 20 bp, Homo sapiens
ctagagtagaggtataattg

SEQ ID NO: 1656695 - DNA, 21 bp, Homo sapiens
ctagagtagaggtataattgt

SEQ ID NO: 1656696 - DNA, 23 bp, Homo sapiens
ctagagtccaaggtttaaagagt

SEQ ID NO: 1656697 - DNA, 13 bp, Homo sapiens
ctagagtgtagcc

SEQ ID NO: 1656698 - DNA, 15 bp, Homo sapiens
ctagagtgtagccta

SEQ ID NO: 1656699 - DNA, 23 bp, Homo sapiens
ctagagttcggtctgacagtcct

SEQ ID NO: 1656700 - DNA, 19 bp, Homo sapiens
ctagagtttatacagtgta

SEQ ID NO: 1656701 - DNA, 22 bp, Homo sapiens
ctagagtttatacagtgtacat

SEQ ID NO: 1656702 - DNA, 23 bp, Homo sapiens
ctagagtttatacagtgtacatg

SEQ ID NO: 1656703 - DNA, 13 bp, Homo sapiens
ctagataaaaaga

SEQ ID NO: 1656704 - DNA, 16 bp, Homo sapiens
ctagataaaaagatgg

SEQ ID NO: 1656705 - DNA, 12 bp, Homo sapiens
ctagataaaagc

SEQ ID NO: 1656706 - DNA, 16 bp, Homo sapiens
ctagatacagaataat

SEQ ID NO: 1656707 - DNA, 19 bp, Homo sapiens
ctagatacagaataatgga

SEQ ID NO: 1656708 - DNA, 13 bp, Homo sapiens
ctagatactggaa

SEQ ID NO: 1656709 - DNA, 18 bp, Homo sapiens
ctagatcaaggagcccag

SEQ ID NO: 1656710 - DNA, 20 bp, Homo sapiens
ctagatcaaggagcccagaa

SEQ ID NO: 1656711 - DNA, 18 bp, Homo sapiens
ctagatccacacacagag

SEQ ID NO: 1656712 - DNA, 17 bp, Homo sapiens
ctagatcctaagggtcg

SEQ ID NO: 1656713 - DNA, 18 bp, Homo sapiens
ctagatcctgcaccccag

SEQ ID NO: 1656714 - DNA, 16 bp, Homo sapiens
ctagatctgcaggctg

SEQ ID NO: 1656715 - DNA, 18 bp, Homo sapiens
ctagatctgcaggctgca

SEQ ID NO: 1656716 - DNA, 19 bp, Homo sapiens
ctagatctgcaggctgcac

SEQ ID NO: 1656717 - DNA, 21 bp, Homo sapiens
ctagatgattaaataagattc

SEQ ID NO: 1656718 - DNA, 14 bp, Homo sapiens
ctagatgatttttt

SEQ ID NO: 1656719 - DNA, 17 bp, Homo sapiens
ctagatggaccccagca

SEQ ID NO: 1656720 - DNA, 18 bp, Homo sapiens
ctagatggacctgcctgc

SEQ ID NO: 1656721 - DNA, 17 bp, Homo sapiens
ctagatgtttaacaaat

SEQ ID NO: 1656722 - DNA, 15 bp, Homo sapiens
ctagattcaaaggtt

SEQ ID NO: 1656723 - DNA, 18 bp, Homo sapiens
ctagattcaaaggttcta

SEQ ID NO: 1656724 - DNA, 15 bp, Homo sapiens
ctagattcataaata

SEQ ID NO: 1656725 - DNA, 23 bp, Homo sapiens
ctagattccattggtccaagatt

SEQ ID NO: 1656726 - DNA, 16 bp, Homo sapiens
ctatagagcctacctg

SEQ ID NO: 1656727 - DNA, 19 bp, Homo sapiens
ctatagccatcgactcctg

SEQ ID NO: 1656728 - DNA, 18 bp, Homo sapiens
ctatagctacatgttctt

SEQ ID NO: 1656729 - DNA, 15 bp, Homo sapiens
ctataggcagcttct

SEQ ID NO: 1656730 - DNA, 23 bp, Homo sapiens
ctatagggatgaactttttcctg

SEQ ID NO: 1656731 - DNA, 21 bp, Homo sapiens
ctataggtgctacaaaaacac

SEQ ID NO: 1656732 - DNA, 22 bp, Homo sapiens
ctataggtgctacaaaaacaca

SEQ ID NO: 1656733 - DNA, 15 bp, Homo sapiens
ctatagtcccagcta

SEQ ID NO: 1656734 - DNA, 16 bp, Homo sapiens
ctatatagttccttgc

SEQ ID NO: 1656735 - DNA, 16 bp, Homo sapiens
ctatatatataaatgt

SEQ ID NO: 1656736 - DNA, 18 bp, Homo sapiens
ctatatatataaatgtat

SEQ ID NO: 1656737 - DNA, 15 bp, Homo sapiens
ctatatatgtgtatg

SEQ ID NO: 1656738 - DNA, 17 bp, Homo sapiens
ctatatatgtgtatgta

SEQ ID NO: 1656739 - DNA, 14 bp, Homo sapiens
ctatatatttagga

SEQ ID NO: 1656740 - DNA, 12 bp, Homo sapiens
ctatatatttct

SEQ ID NO: 1656741 - DNA, 15 bp, Homo sapiens
ctatatcatatttct

SEQ ID NO: 1656742 - DNA, 18 bp, Homo sapiens
ctatatcatatttctgtg

SEQ ID NO: 1656743 - DNA, 16 bp, Homo sapiens
ctatatctgagagacc

SEQ ID NO: 1656744 - DNA, 15 bp, Homo sapiens
ctatatgaaaaacaa

SEQ ID NO: 1656745 - DNA, 16 bp, Homo sapiens
ctatatgcagtccttt

SEQ ID NO: 1656746 - DNA, 16 bp, Homo sapiens
ctatatggaattgctt

SEQ ID NO: 1656747 - DNA, 16 bp, Homo sapiens
ctatatggttctccaa

SEQ ID NO: 1656748 - DNA, 17 bp, Homo sapiens
ctatatgtagtgcattt

SEQ ID NO: 1656749 - DNA, 16 bp, Homo sapiens
ctatatgtccatttaa

SEQ ID NO: 1656750 - DNA, 15 bp, Homo sapiens
ctatattagctgaaa

SEQ ID NO: 1656751 - DNA, 17 bp, Homo sapiens
ctatattagctgaaaca

SEQ ID NO: 1656752 - DNA, 18 bp, Homo sapiens
ctatattgattgtccttt

SEQ ID NO: 1656753 - DNA, 22 bp, Homo sapiens
ctatatttagattgttaaaata

SEQ ID NO: 1656754 - DNA, 15 bp, Homo sapiens
ctatatttcatattg

SEQ ID NO: 1656755 - DNA, 23 bp, Homo sapiens
ctatatttgattatgtatggata

SEQ ID NO: 1656756 - DNA, 12 bp, Homo sapiens
ctatatttgcta

SEQ ID NO: 1656757 - DNA, 16 bp, Homo sapiens
ctatatttgtcttccg

SEQ ID NO: 1656758 - DNA, 16 bp, Homo sapiens
ctatattttaatagaa

SEQ ID NO: 1656759 - DNA, 13 bp, Homo sapiens
ctatcaaactgaa

SEQ ID NO: 1656760 - DNA, 19 bp, Homo sapiens
ctatcacctagcagcctca

SEQ ID NO: 1656761 - DNA, 11 bp, Homo sapiens
ctatcacctgt

SEQ ID NO: 1656762 - DNA, 15 bp, Homo sapiens
ctatcacgagccttt

SEQ ID NO: 1656763 - DNA, 13 bp, Homo sapiens
ctatcactgtctt

SEQ ID NO: 1656764 - DNA, 18 bp, Homo sapiens
ctatcagaaatacaaaaa

SEQ ID NO: 1656765 - DNA, 20 bp, Homo sapiens
ctatcagaaatacaaaaaat

SEQ ID NO: 1656766 - DNA, 12 bp, Homo sapiens
ctatcattccaa

SEQ ID NO: 1656767 - DNA, 20 bp, Homo sapiens
ctatcattccaattctaaat

SEQ ID NO: 1656768 - DNA, 15 bp, Homo sapiens
ctatccacccagccc

SEQ ID NO: 1656769 - DNA, 16 bp, Homo sapiens
ctatccagttgcaggt

SEQ ID NO: 1656770 - DNA, 15 bp, Homo sapiens
ctatccatctcctgg

SEQ ID NO: 1656771 - DNA, 15 bp, Homo sapiens
ctatccccaagctgg

SEQ ID NO: 1656772 - DNA, 18 bp, Homo sapiens
ctatccccaggccaggtc

SEQ ID NO: 1656773 - DNA, 18 bp, Homo sapiens
ctatccccatctccctgc

SEQ ID NO: 1656774 - DNA, 23 bp, Homo sapiens
ctatccccatctccctgcctggc

SEQ ID NO: 1656775 - DNA, 15 bp, Homo sapiens
ctatccgctgccagc

SEQ ID NO: 1656776 - DNA, 16 bp, Homo sapiens
ctatcctctcttcctc

SEQ ID NO: 1656777 - DNA, 19 bp, Homo sapiens
ctatcctgaaaattctgta

SEQ ID NO: 1656778 - DNA, 18 bp, Homo sapiens
ctatcctgattccaaata

SEQ ID NO: 1656779 - DNA, 18 bp, Homo sapiens
ctatccttataggcctgt

SEQ ID NO: 1656780 - DNA, 20 bp, Homo sapiens
ctatcgagtttgcaatgtca

SEQ ID NO: 1656781 - DNA, 22 bp, Homo sapiens
ctatctaggtggagttgaaaga

SEQ ID NO: 1656782 - DNA, 21 bp, Homo sapiens
ctatctcatctatctcaatcc

SEQ ID NO: 1656783 - DNA, 15 bp, Homo sapiens
ctatctcctgacaga

SEQ ID NO: 1656784 - DNA, 19 bp, Homo sapiens
ctatctcctgacagaaggt

SEQ ID NO: 1656785 - DNA, 19 bp, Homo sapiens
ctatctctattattggaaa

SEQ ID NO: 1656786 - DNA, 18 bp, Homo sapiens
ctatctgattttgtgcaa

SEQ ID NO: 1656787 - DNA, 20 bp, Homo sapiens
ctatctggaggccttccagc

SEQ ID NO: 1656788 - DNA, 21 bp, Homo sapiens
ctatctgtctggtggccccgt

SEQ ID NO: 1656789 - DNA, 16 bp, Homo sapiens
ctatctgttcctatct

SEQ ID NO: 1656790 - DNA, 14 bp, Homo sapiens
ctatctgttgaaaa

SEQ ID NO: 1656791 - DNA, 15 bp, Homo sapiens
ctatctgttgaaaag

SEQ ID NO: 1656792 - DNA, 13 bp, Homo sapiens
ctatcttggagag

SEQ ID NO: 1656793 - DNA, 13 bp, Homo sapiens
ctatctttttgaa

SEQ ID NO: 1656794 - DNA, 18 bp, Homo sapiens
ctatctttttgaaagcaa

SEQ ID NO: 1656795 - DNA, 18 bp, Homo sapiens
ctatgaagttgctgttta

SEQ ID NO: 1656796 - DNA, 17 bp, Homo sapiens
ctatgaattctaagtga

SEQ ID NO: 1656797 - DNA, 14 bp, Homo sapiens
ctatgacaaattca

SEQ ID NO: 1656798 - DNA, 14 bp, Homo sapiens
ctatgacactgagc

SEQ ID NO: 1656799 - DNA, 16 bp, Homo sapiens
ctatgacactgagcaa

SEQ ID NO: 1656800 - DNA, 18 bp, Homo sapiens
ctatgacataaaaacaac

SEQ ID NO: 1656801 - DNA, 21 bp, Homo sapiens
ctatgagaacaagtcacagct

SEQ ID NO: 1656802 - DNA, 23 bp, Homo sapiens
ctatgagaacaagtcacagctgc

SEQ ID NO: 1656803 - DNA, 14 bp, Homo sapiens
ctatgagtctagat

SEQ ID NO: 1656804 - DNA, 20 bp, Homo sapiens
ctatgatatggtaaaagtta

SEQ ID NO: 1656805 - DNA, 14 bp, Homo sapiens
ctatgatcacagtg

SEQ ID NO: 1656806 - DNA, 17 bp, Homo sapiens
ctatgatcacagtgact

SEQ ID NO: 1656807 - DNA, 21 bp, Homo sapiens
ctatgatcccagcactttggg

SEQ ID NO: 1656808 - DNA, 22 bp, Homo sapiens
ctatgatcccagcactttggga

SEQ ID NO: 1656809 - DNA, 21 bp, Homo sapiens
ctatgatgtttcttttgcaat

SEQ ID NO: 1656810 - DNA, 14 bp, Homo sapiens
ctatgattattaac

SEQ ID NO: 1656811 - DNA, 20 bp, Homo sapiens
ctatgatttttttttccaaa

SEQ ID NO: 1656812 - DNA, 17 bp, Homo sapiens
ctatgcaaatgcctcca

SEQ ID NO: 1656813 - DNA, 18 bp, Homo sapiens
ctatgcacaacagagtaa

SEQ ID NO: 1656814 - DNA, 21 bp, Homo sapiens
ctatgcacaacagagtaacta

SEQ ID NO: 1656815 - DNA, 12 bp, Homo sapiens
ctatgcacatat

SEQ ID NO: 1656816 - DNA, 20 bp, Homo sapiens
ctatgcacatatggactctg

SEQ ID NO: 1656817 - DNA, 18 bp, Homo sapiens
ctatgcagaggcctgggg

SEQ ID NO: 1656818 - DNA, 20 bp, Homo sapiens
ctatgcatattcaatgtatt

SEQ ID NO: 1656819 - DNA, 22 bp, Homo sapiens
ctatgcatattcaatgtattga

SEQ ID NO: 1656820 - DNA, 21 bp, Homo sapiens
ctatgcatggtgccccaggac

SEQ ID NO: 1656821 - DNA, 17 bp, Homo sapiens
ctatgccaaagatcact

SEQ ID NO: 1656822 - DNA, 20 bp, Homo sapiens
ctatgccagctcagtcccat

SEQ ID NO: 1656823 - DNA, 19 bp, Homo sapiens
ctatgccagtgctcaaggt

SEQ ID NO: 1656824 - DNA, 14 bp, Homo sapiens
ctatgcctgtattt

SEQ ID NO: 1656825 - DNA, 15 bp, Homo sapiens
ctatgctaaactgtg

SEQ ID NO: 1656826 - DNA, 21 bp, Homo sapiens
ctatgctattaaaaaaaaaga

SEQ ID NO: 1656827 - DNA, 13 bp, Homo sapiens
ctatgctttagaa

SEQ ID NO: 1656828 - DNA, 18 bp, Homo sapiens
ctatggaacataaagttg

SEQ ID NO: 1656829 - DNA, 16 bp, Homo sapiens
ctatggaagtggttct

SEQ ID NO: 1656830 - DNA, 17 bp, Homo sapiens
ctatggacaacttattt

SEQ ID NO: 1656831 - DNA, 19 bp, Homo sapiens
ctatggagcctggcacagg

SEQ ID NO: 1656832 - DNA, 23 bp, Homo sapiens
ctatggagcctggcacaggactg

SEQ ID NO: 1656833 - DNA, 19 bp, Homo sapiens
ctatggagggtcctcctcc

SEQ ID NO: 1656834 - DNA, 15 bp, Homo sapiens
ctatggatggcttct

SEQ ID NO: 1656835 - DNA, 18 bp, Homo sapiens
ctatggcagtccagccag

SEQ ID NO: 1656836 - DNA, 19 bp, Homo sapiens
ctatggcagtccagccagc

SEQ ID NO: 1656837 - DNA, 21 bp, Homo sapiens
ctatggcagtccagccagctc

SEQ ID NO: 1656838 - DNA, 13 bp, Homo sapiens
ctatggccagtct

SEQ ID NO: 1656839 - DNA, 17 bp, Homo sapiens
ctatggccagtctgccc

SEQ ID NO: 1656840 - DNA, 14 bp, Homo sapiens
ctatggcccagaaa

SEQ ID NO: 1656841 - DNA, 13 bp, Homo sapiens
ctcacactgagaa

SEQ ID NO: 1656842 - DNA, 16 bp, Homo sapiens
ctcacagagaagctcc

SEQ ID NO: 1656843 - DNA, 23 bp, Homo sapiens
ctcacagagaagctcctgctact

SEQ ID NO: 1656844 - DNA, 13 bp, Homo sapiens
ctcacagagcttt

SEQ ID NO: 1656845 - DNA, 20 bp, Homo sapiens
ctcacagagtcaaggcctgc

SEQ ID NO: 1656846 - DNA, 22 bp, Homo sapiens
ctcacagagtcaaggcctgctc

SEQ ID NO: 1656847 - DNA, 20 bp, Homo sapiens
ctcacagatgtgactgtata

SEQ ID NO: 1656848 - DNA, 14 bp, Homo sapiens
ctcacagtgaccct

SEQ ID NO: 1656849 - DNA, 18 bp, Homo sapiens
ctcacagtgacccttccc

SEQ ID NO: 1656850 - DNA, 17 bp, Homo sapiens
ctcacagttcctcgccc

SEQ ID NO: 1656851 - DNA, 21 bp, Homo sapiens
ctcacataagcccagttcatc

SEQ ID NO: 1656852 - DNA, 22 bp, Homo sapiens
ctcacatataacatgcaaacag

SEQ ID NO: 1656853 - DNA, 17 bp, Homo sapiens
ctcaccaacttgccaca

SEQ ID NO: 1656854 - DNA, 18 bp, Homo sapiens
ctcaccaacttgccacat

SEQ ID NO: 1656855 - DNA, 15 bp, Homo sapiens
ctcaccaacttttaa

SEQ ID NO: 1656856 - DNA, 13 bp, Homo sapiens
ctcaccaaggtga

SEQ ID NO: 1656857 - DNA, 20 bp, Homo sapiens
ctcaccaccacactacacag

SEQ ID NO: 1656858 - DNA, 13 bp, Homo sapiens
ctcaccagcccca

SEQ ID NO: 1656859 - DNA, 20 bp, Homo sapiens
ctcaccagccctagctgtcc

SEQ ID NO: 1656860 - DNA, 12 bp, Homo sapiens
ctcaccaggcct

SEQ ID NO: 1656861 - DNA, 15 bp, Homo sapiens
ctcaccaggcctggc

SEQ ID NO: 1656862 - DNA, 16 bp, Homo sapiens
ctcaccaggcctggcc

SEQ ID NO: 1656863 - DNA, 22 bp, Homo sapiens
ctcaccaggcctggcctctggg

SEQ ID NO: 1656864 - DNA, 13 bp, Homo sapiens
ctcaccatccagt

SEQ ID NO: 1656865 - DNA, 17 bp, Homo sapiens
ctcaccatccagtgggc

SEQ ID NO: 1656866 - DNA, 14 bp, Homo sapiens
ctcaccatgtaaaa

SEQ ID NO: 1656867 - DNA, 14 bp, Homo sapiens
ctcacccatcctag

SEQ ID NO: 1656868 - DNA, 15 bp, Homo sapiens
ctcacccatcctaga

SEQ ID NO: 1656869 - DNA, 17 bp, Homo sapiens
ctcacccatcctagagg

SEQ ID NO: 1656870 - DNA, 14 bp, Homo sapiens
ctcaccccaggata

SEQ ID NO: 1656871 - DNA, 12 bp, Homo sapiens
ctcaccccatcc

SEQ ID NO: 1656872 - DNA, 21 bp, Homo sapiens
ctcaccccatcccacaccctg

SEQ ID NO: 1656873 - DNA, 22 bp, Homo sapiens
ctcaccccatcccacaccctgg

SEQ ID NO: 1656874 - DNA, 17 bp, Homo sapiens
ctcacccccagctttgc

SEQ ID NO: 1656875 - DNA, 18 bp, Homo sapiens
ctcacccccagctttgct

SEQ ID NO: 1656876 - DNA, 19 bp, Homo sapiens
ctcacccccagctttgcta

SEQ ID NO: 1656877 - DNA, 16 bp, Homo sapiens
ctcaccccgtctgggg

SEQ ID NO: 1656878 - DNA, 15 bp, Homo sapiens
ctcacccctgccctg

SEQ ID NO: 1656879 - DNA, 18 bp, Homo sapiens
ctcacccctgccctggga

SEQ ID NO: 1656880 - DNA, 20 bp, Homo sapiens
ctcacccctggttctcatct

SEQ ID NO: 1656881 - DNA, 14 bp, Homo sapiens
ctcaccctgcctta

SEQ ID NO: 1656882 - DNA, 23 bp, Homo sapiens
ctcaccctgggagccagtcctcc

SEQ ID NO: 1656883 - DNA, 14 bp, Homo sapiens
ctcaccgcccatca

SEQ ID NO: 1656884 - DNA, 16 bp, Homo sapiens
ctcaccgcccatcagg

SEQ ID NO: 1656885 - DNA, 17 bp, Homo sapiens
ctcaccgcccatcaggg

SEQ ID NO: 1656886 - DNA, 15 bp, Homo sapiens
ctcacctcagagcag

SEQ ID NO: 1656887 - DNA, 16 bp, Homo sapiens
ctcacctcagagcagg

SEQ ID NO: 1656888 - DNA, 15 bp, Homo sapiens
ctcacctcatgccca

SEQ ID NO: 1656889 - DNA, 17 bp, Homo sapiens
ctcacctcatgcccacc

SEQ ID NO: 1656890 - DNA, 13 bp, Homo sapiens
ctcacctgcagcc

SEQ ID NO: 1656891 - DNA, 17 bp, Homo sapiens
ctcacctggccctgctt

SEQ ID NO: 1656892 - DNA, 16 bp, Homo sapiens
ctcacctgtactattg

SEQ ID NO: 1656893 - DNA, 22 bp, Homo sapiens
ctcacctgtctaggtctcctca

SEQ ID NO: 1656894 - DNA, 17 bp, Homo sapiens
ctcacctgtgtgcccag

SEQ ID NO: 1656895 - DNA, 22 bp, Homo sapiens
ctcacctgtgtgcccagcacct

SEQ ID NO: 1656896 - DNA, 17 bp, Homo sapiens
ctcaccttggcaccaga

SEQ ID NO: 1656897 - DNA, 19 bp, Homo sapiens
ctcacgcctgtaatcccag

SEQ ID NO: 1656898 - DNA, 20 bp, Homo sapiens
ctcacgcctgtaatcccagc

SEQ ID NO: 1656899 - DNA, 22 bp, Homo sapiens
ctcacgcctgtaatcccagcag

SEQ ID NO: 1656900 - DNA, 23 bp, Homo sapiens
ctcacgcctgtaatcccagcagt

SEQ ID NO: 1656901 - DNA, 23 bp, Homo sapiens
ctcacgcttacctcaaccatcct

SEQ ID NO: 1656902 - DNA, 19 bp, Homo sapiens
ctcacgggcagtagctgtg

SEQ ID NO: 1656903 - DNA, 20 bp, Homo sapiens
ctcacggggttggctgttcc

SEQ ID NO: 1656904 - DNA, 16 bp, Homo sapiens
ctcacgtctctgccgc

SEQ ID NO: 1656905 - DNA, 20 bp, Homo sapiens
ctcacgtctctgccgcctgc

SEQ ID NO: 1656906 - DNA, 17 bp, Homo sapiens
ctcacgtgcaggacagc

SEQ ID NO: 1656907 - DNA, 15 bp, Homo sapiens
ctcactaggccccca

SEQ ID NO: 1656908 - DNA, 22 bp, Homo sapiens
ctcactaggcccccacttgcct

SEQ ID NO: 1656909 - DNA, 11 bp, Homo sapiens
ctcactatgac

SEQ ID NO: 1656910 - DNA, 15 bp, Homo sapiens
ctcactcaagaccag

SEQ ID NO: 1656911 - DNA, 19 bp, Homo sapiens
ctcactcaagaccaggctg

SEQ ID NO: 1656912 - DNA, 20 bp, Homo sapiens
ctcactcagtaaaacataat

SEQ ID NO: 1656913 - DNA, 21 bp, Homo sapiens
ctcactccacagagtgagcca

SEQ ID NO: 1656914 - DNA, 20 bp, Homo sapiens
ctcactccaccacccaaaag

SEQ ID NO: 1656915 - DNA, 13 bp, Homo sapiens
ctcactccagccc

SEQ ID NO: 1656916 - DNA, 18 bp, Homo sapiens
ctcactcccaagggacag

SEQ ID NO: 1656917 - DNA, 15 bp, Homo sapiens
ctcactccccaggga

SEQ ID NO: 1656918 - DNA, 16 bp, Homo sapiens
ctcactccccagggag

SEQ ID NO: 1656919 - DNA, 19 bp, Homo sapiens
ctcactccccagggagctc

SEQ ID NO: 1656920 - DNA, 23 bp, Homo sapiens
ctcactccccagggagctctggg

SEQ ID NO: 1656921 - DNA, 15 bp, Homo sapiens
ctcactccctctgca

SEQ ID NO: 1656922 - DNA, 16 bp, Homo sapiens
ctcactcctacctggt

SEQ ID NO: 1656923 - DNA, 20 bp, Homo sapiens
ctcactcctgttacttacct

SEQ ID NO: 1656924 - DNA, 11 bp, Homo sapiens
ctcactctggg

SEQ ID NO: 1656925 - DNA, 15 bp, Homo sapiens
ctcactctgggctgt

SEQ ID NO: 1656926 - DNA, 24 bp, Homo sapiens
ctcactcttgaagtccaggactgg

SEQ ID NO: 1656927 - DNA, 23 bp, Homo sapiens
ctcactgaaacatggctgtgttt

SEQ ID NO: 1656928 - DNA, 19 bp, Homo sapiens
ctcactgaaacctctgcct

SEQ ID NO: 1656929 - DNA, 15 bp, Homo sapiens
ctcactgaactccac

SEQ ID NO: 1656930 - DNA, 19 bp, Homo sapiens
ctcactgaactccttcccc

SEQ ID NO: 1656931 - DNA, 22 bp, Homo sapiens
ctcactgaactccttccccact

SEQ ID NO: 1656932 - DNA, 17 bp, Homo sapiens
ctcactgaatcttcacg

SEQ ID NO: 1656933 - DNA, 15 bp, Homo sapiens
ctcactgagtgatac

SEQ ID NO: 1656934 - DNA, 15 bp, Homo sapiens
ctcactgcagcctca

SEQ ID NO: 1656935 - DNA, 21 bp, Homo sapiens
ctcactgcagcctcagcgtcc

SEQ ID NO: 1656936 - DNA, 16 bp, Homo sapiens
ctcactgcagcctccg

SEQ ID NO: 1656937 - DNA, 17 bp, Homo sapiens
ctcactgcagcctccgc

SEQ ID NO: 1656938 - DNA, 11 bp, Homo sapiens
ctcactgccag

SEQ ID NO: 1656939 - DNA, 13 bp, Homo sapiens
ctcactgccaggc

SEQ ID NO: 1656940 - DNA, 18 bp, Homo sapiens
ctcactgccaggccagcc

SEQ ID NO: 1656941 - DNA, 20 bp, Homo sapiens
ctcactgccaggccagcctc

SEQ ID NO: 1656942 - DNA, 16 bp, Homo sapiens
ctcactgcttgaacta

SEQ ID NO: 1656943 - DNA, 18 bp, Homo sapiens
ctcactggaggagcagct

SEQ ID NO: 1656944 - DNA, 12 bp, Homo sapiens
ctcactggcagg

SEQ ID NO: 1656945 - DNA, 12 bp, Homo sapiens
ctcactggctgg

SEQ ID NO: 1656946 - DNA, 13 bp, Homo sapiens
ctcactggctggg

SEQ ID NO: 1656947 - DNA, 15 bp, Homo sapiens
ctcactggctggggc

SEQ ID NO: 1656948 - DNA, 20 bp, Homo sapiens
ctcactggctggggcagagg

SEQ ID NO: 1656949 - DNA, 22 bp, Homo sapiens
ctcactggctggggcagagggg

SEQ ID NO: 1656950 - DNA, 13 bp, Homo sapiens
ctcactggggcct

SEQ ID NO: 1656951 - DNA, 17 bp, Homo sapiens
ctcactggggtcctggg

SEQ ID NO: 1656952 - DNA, 22 bp, Homo sapiens
ctcactggggtcctggggcctc

SEQ ID NO: 1656953 - DNA, 21 bp, Homo sapiens
ctcactgtattagagcgccag

SEQ ID NO: 1656954 - DNA, 15 bp, Homo sapiens
ctcactgtcctgtga

SEQ ID NO: 1656955 - DNA, 23 bp, Homo sapiens
ctcactgtgttactgctttgcaa

SEQ ID NO: 1656956 - DNA, 16 bp, Homo sapiens
ctcagtcccccaccac

SEQ ID NO: 1656957 - DNA, 21 bp, Homo sapiens
ctcagtcccccaccacactga

SEQ ID NO: 1656958 - DNA, 13 bp, Homo sapiens
ctcagtctcagga

SEQ ID NO: 1656959 - DNA, 16 bp, Homo sapiens
ctcagtctcaggagca

SEQ ID NO: 1656960 - DNA, 17 bp, Homo sapiens
ctcagtctctcttctct

SEQ ID NO: 1656961 - DNA, 19 bp, Homo sapiens
ctcagtctctcttctctcc

SEQ ID NO: 1656962 - DNA, 22 bp, Homo sapiens
ctcagtgacatcaaagcctggc

SEQ ID NO: 1656963 - DNA, 14 bp, Homo sapiens
ctcagtgcatttgt

SEQ ID NO: 1656964 - DNA, 16 bp, Homo sapiens
ctcagtgcatttgtgc

SEQ ID NO: 1656965 - DNA, 17 bp, Homo sapiens
ctcagtgcatttgtgct

SEQ ID NO: 1656966 - DNA, 22 bp, Homo sapiens
ctcagtgcatttgtgctagaaa

SEQ ID NO: 1656967 - DNA, 21 bp, Homo sapiens
ctcagtgccacttgacattcc

SEQ ID NO: 1656968 - DNA, 13 bp, Homo sapiens
ctcagtgccttct

SEQ ID NO: 1656969 - DNA, 17 bp, Homo sapiens
ctcagtggggctggcat

SEQ ID NO: 1656970 - DNA, 14 bp, Homo sapiens
ctcagtgtcattta

SEQ ID NO: 1656971 - DNA, 22 bp, Homo sapiens
ctcagtgtccagcttccaaagc

SEQ ID NO: 1656972 - DNA, 20 bp, Homo sapiens
ctcagtgttagagaaatcct

SEQ ID NO: 1656973 - DNA, 13 bp, Homo sapiens
ctcagttaaaatg

SEQ ID NO: 1656974 - DNA, 16 bp, Homo sapiens
ctcagttcccttggcc

SEQ ID NO: 1656975 - DNA, 22 bp, Homo sapiens
ctcagttcccttggcctcagaa

SEQ ID NO: 1656976 - DNA, 16 bp, Homo sapiens
ctcagttctctccctt

SEQ ID NO: 1656977 - DNA, 18 bp, Homo sapiens
ctcagttgtttgcttctt

SEQ ID NO: 1656978 - DNA, 22 bp, Homo sapiens
ctcagttgtttgcttcttgcca

SEQ ID NO: 1656979 - DNA, 15 bp, Homo sapiens
ctcagtttaatcctt

SEQ ID NO: 1656980 - DNA, 18 bp, Homo sapiens
ctcagtttaatccttcta

SEQ ID NO: 1656981 - DNA, 21 bp, Homo sapiens
ctcagtttaatccttctagtt

SEQ ID NO: 1656982 - DNA, 17 bp, Homo sapiens
ctcagtttatttttcca

SEQ ID NO: 1656983 - DNA, 16 bp, Homo sapiens
ctcagtttctccatca

SEQ ID NO: 1656984 - DNA, 19 bp, Homo sapiens
ctcagtttctccatcagct

SEQ ID NO: 1656985 - DNA, 13 bp, Homo sapiens
ctcagtttgtcag

SEQ ID NO: 1656986 - DNA, 18 bp, Homo sapiens
ctcagttttatcattttc

SEQ ID NO: 1656987 - DNA, 12 bp, Homo sapiens
ctcagttttcct

SEQ ID NO: 1656988 - DNA, 16 bp, Homo sapiens
ctcagttttccttctg

SEQ ID NO: 1656989 - DNA, 21 bp, Homo sapiens
ctcataaaaagcctgcaattt

SEQ ID NO: 1656990 - DNA, 22 bp, Homo sapiens
ctcataaaactgtgactaggca

SEQ ID NO: 1656991 - DNA, 16 bp, Homo sapiens
ctcataaacctgtttt

SEQ ID NO: 1656992 - DNA, 21 bp, Homo sapiens
ctcataagttggaccagagga

SEQ ID NO: 1656993 - DNA, 14 bp, Homo sapiens
ctcataattggaat

SEQ ID NO: 1656994 - DNA, 15 bp, Homo sapiens
ctcataattttgcaa

SEQ ID NO: 1656995 - DNA, 15 bp, Homo sapiens
ctcataccatctgct

SEQ ID NO: 1656996 - DNA, 20 bp, Homo sapiens
ctcataccatctgctgcccc

SEQ ID NO: 1656997 - DNA, 22 bp, Homo sapiens
ctcataccatctgctgccccgc

SEQ ID NO: 1656998 - DNA, 15 bp, Homo sapiens
ctcatacccatgcac

SEQ ID NO: 1656999 - DNA, 21 bp, Homo sapiens
ctcatacccatgcacagtaca

SEQ ID NO: 1657000 - DNA, 15 bp, Homo sapiens
ctcatacctctgacc

SEQ ID NO: 1657001 - DNA, 23 bp, Homo sapiens
ctcatagaattttgagtattcca

SEQ ID NO: 1657002 - DNA, 12 bp, Homo sapiens
ctcatagaggtg

SEQ ID NO: 1657003 - DNA, 19 bp, Homo sapiens
ctcatagcatagccagcat

SEQ ID NO: 1657004 - DNA, 21 bp, Homo sapiens
ctcataggaaaagtacattta

SEQ ID NO: 1657005 - DNA, 16 bp, Homo sapiens
ctcataggacctgcat

SEQ ID NO: 1657006 - DNA, 18 bp, Homo sapiens
ctcataggacctgcatcc

SEQ ID NO: 1657007 - DNA, 15 bp, Homo sapiens
ctcataggagactgc

SEQ ID NO: 1657008 - DNA, 15 bp, Homo sapiens
ctcataggttaaaaa

SEQ ID NO: 1657009 - DNA, 14 bp, Homo sapiens
ctcatatatttaag

SEQ ID NO: 1657010 - DNA, 15 bp, Homo sapiens
ctcatatcagtttgc

SEQ ID NO: 1657011 - DNA, 18 bp, Homo sapiens
ctcatatggcccagtgtc

SEQ ID NO: 1657012 - DNA, 13 bp, Homo sapiens
ctcatcaactgaa

SEQ ID NO: 1657013 - DNA, 12 bp, Homo sapiens
ctcatcactgga

SEQ ID NO: 1657014 - DNA, 15 bp, Homo sapiens
ctcatcactggactg

SEQ ID NO: 1657015 - DNA, 14 bp, Homo sapiens
ctcatcataaaata

SEQ ID NO: 1657016 - DNA, 14 bp, Homo sapiens
ctcatcatattcca

SEQ ID NO: 1657017 - DNA, 18 bp, Homo sapiens
ctcatcatattccaaccc

SEQ ID NO: 1657018 - DNA, 13 bp, Homo sapiens
ctcatcatattgt

SEQ ID NO: 1657019 - DNA, 22 bp, Homo sapiens
ctcatcatattgtatgtaagta

SEQ ID NO: 1657020 - DNA, 13 bp, Homo sapiens
ctcatcattaata

SEQ ID NO: 1657021 - DNA, 14 bp, Homo sapiens
ctcatcattaataa

SEQ ID NO: 1657022 - DNA, 22 bp, Homo sapiens
ctcatcattaataagtgaagaa

SEQ ID NO: 1657023 - DNA, 15 bp, Homo sapiens
ctcatccaccccatc

SEQ ID NO: 1657024 - DNA, 16 bp, Homo sapiens
ctcatccaccccatcc

SEQ ID NO: 1657025 - DNA, 24 bp, Homo sapiens
ctcatccaccccatccctccccag

SEQ ID NO: 1657026 - DNA, 16 bp, Homo sapiens
ctcatcccgtgttctc

SEQ ID NO: 1657027 - DNA, 15 bp, Homo sapiens
ctcatccctcggaag

SEQ ID NO: 1657028 - DNA, 17 bp, Homo sapiens
ctcatccgaggcagggt

SEQ ID NO: 1657029 - DNA, 13 bp, Homo sapiens
ctcatcctgctct

SEQ ID NO: 1657030 - DNA, 15 bp, Homo sapiens
ctcatcctgctcttt

SEQ ID NO: 1657031 - DNA, 18 bp, Homo sapiens
ctcatcctggcacgccct

SEQ ID NO: 1657032 - DNA, 17 bp, Homo sapiens
ctcatcgccagacaact

SEQ ID NO: 1657033 - DNA, 20 bp, Homo sapiens
ctcatcggaggcccatgccc

SEQ ID NO: 1657034 - DNA, 24 bp, Homo sapiens
ctcatctctacaaaaagtaaaaat

SEQ ID NO: 1657035 - DNA, 16 bp, Homo sapiens
ctcatctctctgccca

SEQ ID NO: 1657036 - DNA, 17 bp, Homo sapiens
ctcatctcttcaggttc

SEQ ID NO: 1657037 - DNA, 15 bp, Homo sapiens
ctcatctgagaggct

SEQ ID NO: 1657038 - DNA, 24 bp, Homo sapiens
ctcatctgagaggctctccgtgca

SEQ ID NO: 1657039 - DNA, 14 bp, Homo sapiens
ctcatctgctggtc

SEQ ID NO: 1657040 - DNA, 17 bp, Homo sapiens
ctcatctgtggagctgc

SEQ ID NO: 1657041 - DNA, 21 bp, Homo sapiens
ctcatctgtggagctgccaca

SEQ ID NO: 1657042 - DNA, 13 bp, Homo sapiens
ctcatcttactgt

SEQ ID NO: 1657043 - DNA, 18 bp, Homo sapiens
ctcatcttagtgcctgag

SEQ ID NO: 1657044 - DNA, 14 bp, Homo sapiens
ctcatctttttact

SEQ ID NO: 1657045 - DNA, 12 bp, Homo sapiens
ctcatgaatgta

SEQ ID NO: 1657046 - DNA, 13 bp, Homo sapiens
ctcatgaatgtaa

SEQ ID NO: 1657047 - DNA, 15 bp, Homo sapiens
ctcatgaatgtaaat

SEQ ID NO: 1657048 - DNA, 15 bp, Homo sapiens
ctcatgacagccaga

SEQ ID NO: 1657049 - DNA, 19 bp, Homo sapiens
ctcatgacagccagagcct

SEQ ID NO: 1657050 - DNA, 15 bp, Homo sapiens
ctcatgcagccgtga

SEQ ID NO: 1657051 - DNA, 18 bp, Homo sapiens
ctcatgccacaccttctt

SEQ ID NO: 1657052 - DNA, 19 bp, Homo sapiens
ctcatgcccagctctctga

SEQ ID NO: 1657053 - DNA, 12 bp, Homo sapiens
ctcatgcctcag

SEQ ID NO: 1657054 - DNA, 17 bp, Homo sapiens
ctcatggaaactggcca

SEQ ID NO: 1657055 - DNA, 18 bp, Homo sapiens
ctcatggaaactggccag

SEQ ID NO: 1657056 - DNA, 22 bp, Homo sapiens
ctcatggcagctgtttctcatg

SEQ ID NO: 1657057 - DNA, 17 bp, Homo sapiens
ctcatggcccccagggg

SEQ ID NO: 1657058 - DNA, 14 bp, Homo sapiens
ctcatggcccctct

SEQ ID NO: 1657059 - DNA, 15 bp, Homo sapiens
ctcatggcccctctg

SEQ ID NO: 1657060 - DNA, 19 bp, Homo sapiens
ctcatggcgtaatgggcct

SEQ ID NO: 1657061 - DNA, 21 bp, Homo sapiens
ctcatggcgtaatgggcctgc

SEQ ID NO: 1657062 - DNA, 14 bp, Homo sapiens
ctcatgggtggcac

SEQ ID NO: 1657063 - DNA, 19 bp, Homo sapiens
ctcatgggtggcactcagt

SEQ ID NO: 1657064 - DNA, 16 bp, Homo sapiens
ctcatgtcctgtcctg

SEQ ID NO: 1657065 - DNA, 20 bp, Homo sapiens
ctcatgtcctgtcctggtcc

SEQ ID NO: 1657066 - DNA, 15 bp, Homo sapiens
ctcatgtggctggaa

SEQ ID NO: 1657067 - DNA, 17 bp, Homo sapiens
ctcatgttactcagtgt

SEQ ID NO: 1657068 - DNA, 17 bp, Homo sapiens
ctcattaatagctgcct

SEQ ID NO: 1657069 - DNA, 19 bp, Homo sapiens
ctcattacagttctttcct

SEQ ID NO: 1657070 - DNA, 20 bp, Homo sapiens
ctcattacagttctttcctc

SEQ ID NO: 1657071 - DNA, 15 bp, Homo sapiens
ctcccagaggagcca

SEQ ID NO: 1657072 - DNA, 22 bp, Homo sapiens
ctcccagaggagccaccagttc

SEQ ID NO: 1657073 - DNA, 23 bp, Homo sapiens
ctcccagaggagccaccagttct

SEQ ID NO: 1657074 - DNA, 21 bp, Homo sapiens
ctcccagatcagtcagagccc

SEQ ID NO: 1657075 - DNA, 16 bp, Homo sapiens
ctcccagatttttact

SEQ ID NO: 1657076 - DNA, 22 bp, Homo sapiens
ctcccagatttttactttttcc

SEQ ID NO: 1657077 - DNA, 17 bp, Homo sapiens
ctcccagcaagacctca

SEQ ID NO: 1657078 - DNA, 11 bp, Homo sapiens
ctcccagccca

SEQ ID NO: 1657079 - DNA, 17 bp, Homo sapiens
ctcccagcccattgctg

SEQ ID NO: 1657080 - DNA, 13 bp, Homo sapiens
ctcccagcggcct

SEQ ID NO: 1657081 - DNA, 18 bp, Homo sapiens
ctcccagcggcctccggc

SEQ ID NO: 1657082 - DNA, 16 bp, Homo sapiens
ctcccaggagacagtt

SEQ ID NO: 1657083 - DNA, 11 bp, Homo sapiens
ctcccaggcaa

SEQ ID NO: 1657084 - DNA, 12 bp, Homo sapiens
ctcccaggcccg

SEQ ID NO: 1657085 - DNA, 18 bp, Homo sapiens
ctcccaggcctgcctgca

SEQ ID NO: 1657086 - DNA, 20 bp, Homo sapiens
ctcccaggcctgcctgcatg

SEQ ID NO: 1657087 - DNA, 14 bp, Homo sapiens
ctcccaggcgcccc

SEQ ID NO: 1657088 - DNA, 22 bp, Homo sapiens
ctcccaggggagccagctgctt

SEQ ID NO: 1657089 - DNA, 21 bp, Homo sapiens
ctcccaggggtctccctggct

SEQ ID NO: 1657090 - DNA, 18 bp, Homo sapiens
ctcccaggtaccagctgc

SEQ ID NO: 1657091 - DNA, 21 bp, Homo sapiens
ctcccaggtaccagctgcgct

SEQ ID NO: 1657092 - DNA, 24 bp, Homo sapiens
ctcccaggtaccagctgcgcttgc

SEQ ID NO: 1657093 - DNA, 20 bp, Homo sapiens
ctcccaggtcgggcagtgga

SEQ ID NO: 1657094 - DNA, 22 bp, Homo sapiens
ctcccaggtcgggcagtggagg

SEQ ID NO: 1657095 - DNA, 22 bp, Homo sapiens
ctcccaggttcccccagcaagc

SEQ ID NO: 1657096 - DNA, 22 bp, Homo sapiens
ctcccataattgctttgccaaa

SEQ ID NO: 1657097 - DNA, 17 bp, Homo sapiens
ctcccatccccctgccc

SEQ ID NO: 1657098 - DNA, 21 bp, Homo sapiens
ctcccatcctccccagcgcca

SEQ ID NO: 1657099 - DNA, 15 bp, Homo sapiens
ctcccatcctggggc

SEQ ID NO: 1657100 - DNA, 18 bp, Homo sapiens
ctcccatctccttccccc

SEQ ID NO: 1657101 - DNA, 19 bp, Homo sapiens
ctcccatctccttccccca

SEQ ID NO: 1657102 - DNA, 22 bp, Homo sapiens
ctcccatctgggagtccccttt

SEQ ID NO: 1657103 - DNA, 19 bp, Homo sapiens
ctcccattcctgaagaacc

SEQ ID NO: 1657104 - DNA, 19 bp, Homo sapiens
ctccccaaagccactggaa

SEQ ID NO: 1657105 - DNA, 23 bp, Homo sapiens
ctccccaaagccactggaaggag

SEQ ID NO: 1657106 - DNA, 16 bp, Homo sapiens
ctccccaattctcccc

SEQ ID NO: 1657107 - DNA, 21 bp, Homo sapiens
ctccccacactccactctgat

SEQ ID NO: 1657108 - DNA, 11 bp, Homo sapiens
ctccccacagc

SEQ ID NO: 1657109 - DNA, 18 bp, Homo sapiens
ctccccacagcgtccctg

SEQ ID NO: 1657110 - DNA, 18 bp, Homo sapiens
ctccccacaggagccctg

SEQ ID NO: 1657111 - DNA, 14 bp, Homo sapiens
ctccccacagtgcc

SEQ ID NO: 1657112 - DNA, 18 bp, Homo sapiens
ctccccacagtgccaccc

SEQ ID NO: 1657113 - DNA, 14 bp, Homo sapiens
ctccccacccgccc

SEQ ID NO: 1657114 - DNA, 18 bp, Homo sapiens
ctccccacctacccagct

SEQ ID NO: 1657115 - DNA, 15 bp, Homo sapiens
ctccccacgagggct

SEQ ID NO: 1657116 - DNA, 23 bp, Homo sapiens
ctccccacgagtcacctgcaagc

SEQ ID NO: 1657117 - DNA, 13 bp, Homo sapiens
ctccccactctag

SEQ ID NO: 1657118 - DNA, 18 bp, Homo sapiens
ctccccagagctgtgcca

SEQ ID NO: 1657119 - DNA, 19 bp, Homo sapiens
ctccccagcattccagccc

SEQ ID NO: 1657120 - DNA, 22 bp, Homo sapiens
ctccccagcattccagcccctc

SEQ ID NO: 1657121 - DNA, 11 bp, Homo sapiens
ctccccagcca

SEQ ID NO: 1657122 - DNA, 12 bp, Homo sapiens
ctccccagccag

SEQ ID NO: 1657123 - DNA, 13 bp, Homo sapiens
ctccccagccaga

SEQ ID NO: 1657124 - DNA, 18 bp, Homo sapiens
ctccccagcccagagaca

SEQ ID NO: 1657125 - DNA, 14 bp, Homo sapiens
ctccccagccccag

SEQ ID NO: 1657126 - DNA, 15 bp, Homo sapiens
ctccccagccccagc

SEQ ID NO: 1657127 - DNA, 16 bp, Homo sapiens
ctccccagctcttctc

SEQ ID NO: 1657128 - DNA, 20 bp, Homo sapiens
ctccccagctcttctcttcc

SEQ ID NO: 1657129 - DNA, 13 bp, Homo sapiens
ctccccaggactc

SEQ ID NO: 1657130 - DNA, 22 bp, Homo sapiens
ctccccaggactcaccctcata

SEQ ID NO: 1657131 - DNA, 19 bp, Homo sapiens
ctccccaggcatttgccaa

SEQ ID NO: 1657132 - DNA, 14 bp, Homo sapiens
ctccccaggcctcc

SEQ ID NO: 1657133 - DNA, 11 bp, Homo sapiens
ctccccaggga

SEQ ID NO: 1657134 - DNA, 13 bp, Homo sapiens
ctccccagggagc

SEQ ID NO: 1657135 - DNA, 20 bp, Homo sapiens
ctccccagggagctctgggg

SEQ ID NO: 1657136 - DNA, 20 bp, Homo sapiens
ctccccaggtccagctctgg

SEQ ID NO: 1657137 - DNA, 21 bp, Homo sapiens
ctccccaggtccagctctgga

SEQ ID NO: 1657138 - DNA, 14 bp, Homo sapiens
ctccccagtgcctg

SEQ ID NO: 1657139 - DNA, 16 bp, Homo sapiens
ctccccagtgcctgcc

SEQ ID NO: 1657140 - DNA, 22 bp, Homo sapiens
ctccccagtgcctgccactctc

SEQ ID NO: 1657141 - DNA, 11 bp, Homo sapiens
ctccccagtgt

SEQ ID NO: 1657142 - DNA, 17 bp, Homo sapiens
ctccccatggagccagc

SEQ ID NO: 1657143 - DNA, 23 bp, Homo sapiens
ctccccatgtgcctgcaccagga

SEQ ID NO: 1657144 - DNA, 18 bp, Homo sapiens
ctccccatgtgtcctggt

SEQ ID NO: 1657145 - DNA, 22 bp, Homo sapiens
ctccccatttcccatctgcacc

SEQ ID NO: 1657146 - DNA, 16 bp, Homo sapiens
ctcccccacctgacaa

SEQ ID NO: 1657147 - DNA, 12 bp, Homo sapiens
ctcccccagcag

SEQ ID NO: 1657148 - DNA, 15 bp, Homo sapiens
ctcccccatgggctg

SEQ ID NO: 1657149 - DNA, 15 bp, Homo sapiens
ctccccccactgcag

SEQ ID NO: 1657150 - DNA, 13 bp, Homo sapiens
ctcccccccatgc

SEQ ID NO: 1657151 - DNA, 15 bp, Homo sapiens
ctcccccccatgcac

SEQ ID NO: 1657152 - DNA, 21 bp, Homo sapiens
ctcccccccatgcactgtgaa

SEQ ID NO: 1657153 - DNA, 16 bp, Homo sapiens
ctcccccgacactgct

SEQ ID NO: 1657154 - DNA, 17 bp, Homo sapiens
ctcccccgacactgctg

SEQ ID NO: 1657155 - DNA, 19 bp, Homo sapiens
ctcccccgacactgctgca

SEQ ID NO: 1657156 - DNA, 21 bp, Homo sapiens
ctcccccgacactgctgcacc

SEQ ID NO: 1657157 - DNA, 16 bp, Homo sapiens
ctccccctcctgctgt

SEQ ID NO: 1657158 - DNA, 18 bp, Homo sapiens
ctccccctcctgctgtgc

SEQ ID NO: 1657159 - DNA, 21 bp, Homo sapiens
ctccccctcctgctgtgctgg

SEQ ID NO: 1657160 - DNA, 14 bp, Homo sapiens
ctccccctctgctt

SEQ ID NO: 1657161 - DNA, 16 bp, Homo sapiens
ctccccctctgcttct

SEQ ID NO: 1657162 - DNA, 18 bp, Homo sapiens
ctccccctgccagtgcct

SEQ ID NO: 1657163 - DNA, 12 bp, Homo sapiens
ctccccctgggc

SEQ ID NO: 1657164 - DNA, 23 bp, Homo sapiens
ctccccctgggctctgccccagc

SEQ ID NO: 1657165 - DNA, 20 bp, Homo sapiens
ctccccctttcacactggat

SEQ ID NO: 1657166 - DNA, 16 bp, Homo sapiens
ctccccgaggctgccc

SEQ ID NO: 1657167 - DNA, 15 bp, Homo sapiens
ctccccgcccctgtg

SEQ ID NO: 1657168 - DNA, 13 bp, Homo sapiens
ctccccgcctcca

SEQ ID NO: 1657169 - DNA, 16 bp, Homo sapiens
ctccccgctcaggggc

SEQ ID NO: 1657170 - DNA, 21 bp, Homo sapiens
ctccccgctccgtctctgtcc

SEQ ID NO: 1657171 - DNA, 16 bp, Homo sapiens
ctccccgctctccctg

SEQ ID NO: 1657172 - DNA, 23 bp, Homo sapiens
ctccccggcatgagactcagtgc

SEQ ID NO: 1657173 - DNA, 13 bp, Homo sapiens
ctccccggccaca

SEQ ID NO: 1657174 - DNA, 14 bp, Homo sapiens
ctccccggctcgag

SEQ ID NO: 1657175 - DNA, 22 bp, Homo sapiens
ctccccgtgtaaaaagcctcct

SEQ ID NO: 1657176 - DNA, 16 bp, Homo sapiens
ctcccctaaccctact

SEQ ID NO: 1657177 - DNA, 18 bp, Homo sapiens
ctcccctaaccctacttt

SEQ ID NO: 1657178 - DNA, 20 bp, Homo sapiens
ctcccctaacctcttttctg

SEQ ID NO: 1657179 - DNA, 17 bp, Homo sapiens
ctcccctatccacccag

SEQ ID NO: 1657180 - DNA, 19 bp, Homo sapiens
ctcccctatccacccagcc

SEQ ID NO: 1657181 - DNA, 21 bp, Homo sapiens
ctcccctatccacccagccca

SEQ ID NO: 1657182 - DNA, 13 bp, Homo sapiens
ctcccctatgctg

SEQ ID NO: 1657183 - DNA, 13 bp, Homo sapiens
ctcccctcaagga

SEQ ID NO: 1657184 - DNA, 15 bp, Homo sapiens
ctcccctccacagct

SEQ ID NO: 1657185 - DNA, 23 bp, Homo sapiens
ctcccctcccaggggagccagct

SEQ ID NO: 1657186 - DNA, 22 bp, Homo sapiens
ctcctcccacccggctgcagag

SEQ ID NO: 1657187 - DNA, 17 bp, Homo sapiens
ctcctcccaggcgcccc

SEQ ID NO: 1657188 - DNA, 14 bp, Homo sapiens
ctcctcccagtgcc

SEQ ID NO: 1657189 - DNA, 18 bp, Homo sapiens
ctcctcccagtgccttct

SEQ ID NO: 1657190 - DNA, 22 bp, Homo sapiens
ctcctcccatctccttccccca

SEQ ID NO: 1657191 - DNA, 17 bp, Homo sapiens
ctcctccccaaatcaat

SEQ ID NO: 1657192 - DNA, 17 bp, Homo sapiens
ctcctccccagctcttc

SEQ ID NO: 1657193 - DNA, 12 bp, Homo sapiens
ctcctcccccag

SEQ ID NO: 1657194 - DNA, 20 bp, Homo sapiens
ctcctcccccggctgggcct

SEQ ID NO: 1657195 - DNA, 11 bp, Homo sapiens
ctcctccccct

SEQ ID NO: 1657196 - DNA, 13 bp, Homo sapiens
ctcctcccctcct

SEQ ID NO: 1657197 - DNA, 17 bp, Homo sapiens
ctcctccccttcctctt

SEQ ID NO: 1657198 - DNA, 21 bp, Homo sapiens
ctcctcccgccccgcccctcc

SEQ ID NO: 1657199 - DNA, 21 bp, Homo sapiens
ctcctcccgcccttccatgtg

SEQ ID NO: 1657200 - DNA, 17 bp, Homo sapiens
ctcctcccggtgcccaa

SEQ ID NO: 1657201 - DNA, 12 bp, Homo sapiens
ctcctccctgcc

SEQ ID NO: 1657202 - DNA, 12 bp, Homo sapiens
ctcctccctggc

SEQ ID NO: 1657203 - DNA, 14 bp, Homo sapiens
ctcctccctggctg

SEQ ID NO: 1657204 - DNA, 17 bp, Homo sapiens
ctcctccctggctgccc

SEQ ID NO: 1657205 - DNA, 19 bp, Homo sapiens
ctcctccctggctgccctg

SEQ ID NO: 1657206 - DNA, 22 bp, Homo sapiens
ctcctccctggctgccctggcc

SEQ ID NO: 1657207 - DNA, 21 bp, Homo sapiens
ctcctcctaggaaaccagctc

SEQ ID NO: 1657208 - DNA, 14 bp, Homo sapiens
ctcctcctgggcta

SEQ ID NO: 1657209 - DNA, 18 bp, Homo sapiens
ctcctccttgcccagact

SEQ ID NO: 1657210 - DNA, 19 bp, Homo sapiens
ctcctccttggtgcctggc

SEQ ID NO: 1657211 - DNA, 20 bp, Homo sapiens
ctcctcgaacccactccggt

SEQ ID NO: 1657212 - DNA, 17 bp, Homo sapiens
ctcctcggaagagcccg

SEQ ID NO: 1657213 - DNA, 21 bp, Homo sapiens
ctcctcggagagcagcagcac

SEQ ID NO: 1657214 - DNA, 19 bp, Homo sapiens
ctcctcgggccgaggccca

SEQ ID NO: 1657215 - DNA, 21 bp, Homo sapiens
ctcctcgggccgaggcccagc

SEQ ID NO: 1657216 - DNA, 15 bp, Homo sapiens
ctcctctcagagtga

SEQ ID NO: 1657217 - DNA, 21 bp, Homo sapiens
ctcctctccattttagcccag

SEQ ID NO: 1657218 - DNA, 21 bp, Homo sapiens
ctcctctccccagcccagaga

SEQ ID NO: 1657219 - DNA, 17 bp, Homo sapiens
ctcctctccttgggctc

SEQ ID NO: 1657220 - DNA, 22 bp, Homo sapiens
ctcctctccttgggctcctggc

SEQ ID NO: 1657221 - DNA, 23 bp, Homo sapiens
ctcctctctctttcctccaccca

SEQ ID NO: 1657222 - DNA, 14 bp, Homo sapiens
ctcctctcttggca

SEQ ID NO: 1657223 - DNA, 12 bp, Homo sapiens
ctcctctgagca

SEQ ID NO: 1657224 - DNA, 14 bp, Homo sapiens
ctcctctgagcagc

SEQ ID NO: 1657225 - DNA, 18 bp, Homo sapiens
ctcctctgcagtgccttg

SEQ ID NO: 1657226 - DNA, 18 bp, Homo sapiens
ctcctctgcccccgctga

SEQ ID NO: 1657227 - DNA, 21 bp, Homo sapiens
ctcctctggacggcaggctca

SEQ ID NO: 1657228 - DNA, 18 bp, Homo sapiens
ctcctcttccatgctgtg

SEQ ID NO: 1657229 - DNA, 23 bp, Homo sapiens
ctcctcttcgtggttgtgtttct

SEQ ID NO: 1657230 - DNA, 23 bp, Homo sapiens
ctcctcttcttttttttcattat

SEQ ID NO: 1657231 - DNA, 16 bp, Homo sapiens
ctcctcttgattcctg

SEQ ID NO: 1657232 - DNA, 20 bp, Homo sapiens
ctcctcttggagctgagatg

SEQ ID NO: 1657233 - DNA, 23 bp, Homo sapiens
ctcctcttggtgggtgtggccag

SEQ ID NO: 1657234 - DNA, 18 bp, Homo sapiens
ctcctgaaccgcacagct

SEQ ID NO: 1657235 - DNA, 14 bp, Homo sapiens
ctcctgaatatttt

SEQ ID NO: 1657236 - DNA, 16 bp, Homo sapiens
ctcctgacagaaggtg

SEQ ID NO: 1657237 - DNA, 18 bp, Homo sapiens
ctcctgacagaaggtgcc

SEQ ID NO: 1657238 - DNA, 16 bp, Homo sapiens
ctcctgacccctgcct

SEQ ID NO: 1657239 - DNA, 15 bp, Homo sapiens
ctcctgacctcaagt

SEQ ID NO: 1657240 - DNA, 19 bp, Homo sapiens
ctcctgacctcaggtgatt

SEQ ID NO: 1657241 - DNA, 16 bp, Homo sapiens
ctcctgactggtgctg

SEQ ID NO: 1657242 - DNA, 20 bp, Homo sapiens
ctcctgagaaggcgaggaga

SEQ ID NO: 1657243 - DNA, 22 bp, Homo sapiens
ctcctgagaaggcgaggagagt

SEQ ID NO: 1657244 - DNA, 21 bp, Homo sapiens
ctcctgagcacccgctgacat

SEQ ID NO: 1657245 - DNA, 15 bp, Homo sapiens
ctcctgagctcgggg

SEQ ID NO: 1657246 - DNA, 21 bp, Homo sapiens
ctcctgaggggcatctgcccc

SEQ ID NO: 1657247 - DNA, 21 bp, Homo sapiens
ctcctgagtagctggattaca

SEQ ID NO: 1657248 - DNA, 19 bp, Homo sapiens
ctcctgatagtcacctgct

SEQ ID NO: 1657249 - DNA, 23 bp, Homo sapiens
ctcctgatccgtccgaggctgct

SEQ ID NO: 1657250 - DNA, 17 bp, Homo sapiens
ctcctgatggccaagag

SEQ ID NO: 1657251 - DNA, 15 bp, Homo sapiens
ctcctgcacttactt

SEQ ID NO: 1657252 - DNA, 17 bp, Homo sapiens
ctcctgcacttacttgc

SEQ ID NO: 1657253 - DNA, 18 bp, Homo sapiens
ctcctgcacttacttgct

SEQ ID NO: 1657254 - DNA, 14 bp, Homo sapiens
ctcctgccacccct

SEQ ID NO: 1657255 - DNA, 16 bp, Homo sapiens
ctcctgccaccccttc

SEQ ID NO: 1657256 - DNA, 20 bp, Homo sapiens
ctcctgccaccccttcctcc

SEQ ID NO: 1657257 - DNA, 21 bp, Homo sapiens
ctcctgccaccccttcctccc

SEQ ID NO: 1657258 - DNA, 13 bp, Homo sapiens
ctcctgcccacgg

SEQ ID NO: 1657259 - DNA, 13 bp, Homo sapiens
ctcctgcccagga

SEQ ID NO: 1657260 - DNA, 15 bp, Homo sapiens
ctcctgcccaggaga

SEQ ID NO: 1657261 - DNA, 19 bp, Homo sapiens
ctcctgcccaggagcagct

SEQ ID NO: 1657262 - DNA, 14 bp, Homo sapiens
ctcctgccccaagg

SEQ ID NO: 1657263 - DNA, 21 bp, Homo sapiens
ctcctgccccaagggcccaga

SEQ ID NO: 1657264 - DNA, 17 bp, Homo sapiens
ctcctgccctctgctct

SEQ ID NO: 1657265 - DNA, 13 bp, Homo sapiens
ctcctgccctgtg

SEQ ID NO: 1657266 - DNA, 14 bp, Homo sapiens
ctcctgccctgtga

SEQ ID NO: 1657267 - DNA, 13 bp, Homo sapiens
ctcctgccctgtt

SEQ ID NO: 1657268 - DNA, 14 bp, Homo sapiens
ctcctgccgcagag

SEQ ID NO: 1657269 - DNA, 15 bp, Homo sapiens
ctcctgcctcagcct

SEQ ID NO: 1657270 - DNA, 16 bp, Homo sapiens
ctcctgcctcagcctc

SEQ ID NO: 1657271 - DNA, 12 bp, Homo sapiens
ctcctgcctgag

SEQ ID NO: 1657272 - DNA, 21 bp, Homo sapiens
ctcctgcctgagtttccagcc

SEQ ID NO: 1657273 - DNA, 18 bp, Homo sapiens
ctcctgctactctgttcc

SEQ ID NO: 1657274 - DNA, 18 bp, Homo sapiens
ctcctgctacttccccag

SEQ ID NO: 1657275 - DNA, 14 bp, Homo sapiens
ctcctgctcctccc

SEQ ID NO: 1657276 - DNA, 23 bp, Homo sapiens
ctcctgctcctccctgcccccca

SEQ ID NO: 1657277 - DNA, 14 bp, Homo sapiens
ctcctgctctggga

SEQ ID NO: 1657278 - DNA, 14 bp, Homo sapiens
ctcctgctgcacag

SEQ ID NO: 1657279 - DNA, 19 bp, Homo sapiens
ctcctgctgcacaggccct

SEQ ID NO: 1657280 - DNA, 17 bp, Homo sapiens
ctcctgctggtacctgc

SEQ ID NO: 1657281 - DNA, 12 bp, Homo sapiens
ctcctgctgtgc

SEQ ID NO: 1657282 - DNA, 14 bp, Homo sapiens
ctcctgcttcctct

SEQ ID NO: 1657283 - DNA, 23 bp, Homo sapiens
ctcctgcttcctcttttcctgct

SEQ ID NO: 1657284 - DNA, 14 bp, Homo sapiens
ctcctgcttttctg

SEQ ID NO: 1657285 - DNA, 22 bp, Homo sapiens
ctcctgcttttctgtcctgggc

SEQ ID NO: 1657286 - DNA, 23 bp, Homo sapiens
ctcctgcttttctgtcctgggca

SEQ ID NO: 1657287 - DNA, 22 bp, Homo sapiens
ctcctggaaaggctcagtctca

SEQ ID NO: 1657288 - DNA, 11 bp, Homo sapiens
ctcctggaaat

SEQ ID NO: 1657289 - DNA, 23 bp, Homo sapiens
ctcctggaagctgtgtccttgca

SEQ ID NO: 1657290 - DNA, 11 bp, Homo sapiens
ctcctggacct

SEQ ID NO: 1657291 - DNA, 17 bp, Homo sapiens
ctcctggaccttgacag

SEQ ID NO: 1657292 - DNA, 13 bp, Homo sapiens
ctcctggcctatc

SEQ ID NO: 1657293 - DNA, 16 bp, Homo sapiens
ctcctggctcaggccc

SEQ ID NO: 1657294 - DNA, 22 bp, Homo sapiens
ctcctggctcttgatacccccc

SEQ ID NO: 1657295 - DNA, 17 bp, Homo sapiens
ctcctggctgccaggcg

SEQ ID NO: 1657296 - DNA, 17 bp, Homo sapiens
ctcctggctgtgcccag

SEQ ID NO: 1657297 - DNA, 21 bp, Homo sapiens
ctcctggctgtgcccagcagg

SEQ ID NO: 1657298 - DNA, 16 bp, Homo sapiens
ctcctgggcagcttga

SEQ ID NO: 1657299 - DNA, 11 bp, Homo sapiens
ctcctgggccg

SEQ ID NO: 1657300 - DNA, 13 bp, Homo sapiens
ctcctgggctcag

SEQ ID NO: 1657301 - DNA, 13 bp, Homo sapiens
ctcgtttctacac

SEQ ID NO: 1657302 - DNA, 22 bp, Homo sapiens
ctctaaaaggtaatgtgtggat

SEQ ID NO: 1657303 - DNA, 20 bp, Homo sapiens
ctctaaaataggtaaatgta

SEQ ID NO: 1657304 - DNA, 15 bp, Homo sapiens
ctctaaaattataaa

SEQ ID NO: 1657305 - DNA, 14 bp, Homo sapiens
ctctaaaattctag

SEQ ID NO: 1657306 - DNA, 15 bp, Homo sapiens
ctctaaaattctagt

SEQ ID NO: 1657307 - DNA, 16 bp, Homo sapiens
ctctaaaattctagtc

SEQ ID NO: 1657308 - DNA, 18 bp, Homo sapiens
ctctaaagaaaaatgcct

SEQ ID NO: 1657309 - DNA, 21 bp, Homo sapiens
ctctaaagtagcaactgctgg

SEQ ID NO: 1657310 - DNA, 18 bp, Homo sapiens
ctctaaccattcaaatga

SEQ ID NO: 1657311 - DNA, 12 bp, Homo sapiens
ctctaacccagt

SEQ ID NO: 1657312 - DNA, 14 bp, Homo sapiens
ctctaacccagtgg

SEQ ID NO: 1657313 - DNA, 20 bp, Homo sapiens
ctctaactggacatgaagga

SEQ ID NO: 1657314 - DNA, 21 bp, Homo sapiens
ctctaactggacatgaaggaa

SEQ ID NO: 1657315 - DNA, 15 bp, Homo sapiens
ctctaacttctcaag

SEQ ID NO: 1657316 - DNA, 15 bp, Homo sapiens
ctctaagctggagct

SEQ ID NO: 1657317 - DNA, 17 bp, Homo sapiens
ctctaatgtctgcagct

SEQ ID NO: 1657318 - DNA, 17 bp, Homo sapiens
ctctaatgttgtatcat

SEQ ID NO: 1657319 - DNA, 16 bp, Homo sapiens
ctctaattcacagtgc

SEQ ID NO: 1657320 - DNA, 20 bp, Homo sapiens
ctctaattcacagtgctctt

SEQ ID NO: 1657321 - DNA, 21 bp, Homo sapiens
ctctacaaaaagtaaaaatta

SEQ ID NO: 1657322 - DNA, 17 bp, Homo sapiens
ctctacaaactcccact

SEQ ID NO: 1657323 - DNA, 14 bp, Homo sapiens
ctctacactaaggg

SEQ ID NO: 1657324 - DNA, 15 bp, Homo sapiens
ctctacactcttgta

SEQ ID NO: 1657325 - DNA, 14 bp, Homo sapiens
ctctacagccgtcc

SEQ ID NO: 1657326 - DNA, 15 bp, Homo sapiens
ctctacatcttctgc

SEQ ID NO: 1657327 - DNA, 17 bp, Homo sapiens
ctctacatcttctgcct

SEQ ID NO: 1657328 - DNA, 16 bp, Homo sapiens
ctctaccagtctattt

SEQ ID NO: 1657329 - DNA, 16 bp, Homo sapiens
ctctacccctgctccc

SEQ ID NO: 1657330 - DNA, 18 bp, Homo sapiens
ctctaccctcccaccccc

SEQ ID NO: 1657331 - DNA, 15 bp, Homo sapiens
ctctaccctgtctgt

SEQ ID NO: 1657332 - DNA, 11 bp, Homo sapiens
ctctacctcca

SEQ ID NO: 1657333 - DNA, 14 bp, Homo sapiens
ctctacctccaccc

SEQ ID NO: 1657334 - DNA, 22 bp, Homo sapiens
ctctactaaaaatacaaaaatt

SEQ ID NO: 1657335 - DNA, 19 bp, Homo sapiens
ctctactaccacaaggaaa

SEQ ID NO: 1657336 - DNA, 22 bp, Homo sapiens
ctctactcttacagagccttga

SEQ ID NO: 1657337 - DNA, 15 bp, Homo sapiens
ctctactgccctccc

SEQ ID NO: 1657338 - DNA, 16 bp, Homo sapiens
ctctactgccctcccc

SEQ ID NO: 1657339 - DNA, 15 bp, Homo sapiens
ctctacttaatgaga

SEQ ID NO: 1657340 - DNA, 16 bp, Homo sapiens
ctctacttagcatgtc

SEQ ID NO: 1657341 - DNA, 18 bp, Homo sapiens
ctctactttgattctgat

SEQ ID NO: 1657342 - DNA, 14 bp, Homo sapiens
ctctagaaaaaagg

SEQ ID NO: 1657343 - DNA, 18 bp, Homo sapiens
ctctagaacatgcacatt

SEQ ID NO: 1657344 - DNA, 22 bp, Homo sapiens
ctctagaagccaagggaaaggg

SEQ ID NO: 1657345 - DNA, 21 bp, Homo sapiens
ctctagacactgccacacagg

SEQ ID NO: 1657346 - DNA, 13 bp, Homo sapiens
ctctagagcaggg

SEQ ID NO: 1657347 - DNA, 13 bp, Homo sapiens
ctctagagtccaa

SEQ ID NO: 1657348 - DNA, 15 bp, Homo sapiens
ctctagagtccaagg

SEQ ID NO: 1657349 - DNA, 16 bp, Homo sapiens
ctctagagtccaaggt

SEQ ID NO: 1657350 - DNA, 17 bp, Homo sapiens
ctctagattcataaata

SEQ ID NO: 1657351 - DNA, 12 bp, Homo sapiens
ctctagattcca

SEQ ID NO: 1657352 - DNA, 16 bp, Homo sapiens
ctctagcaaggctcat

SEQ ID NO: 1657353 - DNA, 14 bp, Homo sapiens
ctctagcaggccta

SEQ ID NO: 1657354 - DNA, 15 bp, Homo sapiens
ctctagccaggagtc

SEQ ID NO: 1657355 - DNA, 23 bp, Homo sapiens
ctctagccaggagtctgtgctct

SEQ ID NO: 1657356 - DNA, 22 bp, Homo sapiens
ctctagcctggcaacagagcga

SEQ ID NO: 1657357 - DNA, 13 bp, Homo sapiens
ctctagcctgggc

SEQ ID NO: 1657358 - DNA, 14 bp, Homo sapiens
ctctagcctgggca

SEQ ID NO: 1657359 - DNA, 17 bp, Homo sapiens
ctctagctctctaggcc

SEQ ID NO: 1657360 - DNA, 13 bp, Homo sapiens
ctctagctggcag

SEQ ID NO: 1657361 - DNA, 17 bp, Homo sapiens
ctctagctgttctggac

SEQ ID NO: 1657362 - DNA, 18 bp, Homo sapiens
ctctagctgttctggact

SEQ ID NO: 1657363 - DNA, 21 bp, Homo sapiens
ctctaggagggagccttgtga

SEQ ID NO: 1657364 - DNA, 21 bp, Homo sapiens
ctctagggactgccaggctgt

SEQ ID NO: 1657365 - DNA, 17 bp, Homo sapiens
ctctaggggtcaggctc

SEQ ID NO: 1657366 - DNA, 19 bp, Homo sapiens
ctctagtaagatgcactga

SEQ ID NO: 1657367 - DNA, 18 bp, Homo sapiens
ctctagtccccaaggcct

SEQ ID NO: 1657368 - DNA, 18 bp, Homo sapiens
ctctagtgccctccacag

SEQ ID NO: 1657369 - DNA, 13 bp, Homo sapiens
ctctagtgggaca

SEQ ID NO: 1657370 - DNA, 18 bp, Homo sapiens
ctctagtgggacagccca

SEQ ID NO: 1657371 - DNA, 13 bp, Homo sapiens
ctctagttctaga

SEQ ID NO: 1657372 - DNA, 18 bp, Homo sapiens
ctctagttctttgttcat

SEQ ID NO: 1657373 - DNA, 20 bp, Homo sapiens
ctctagttttcagccttggg

SEQ ID NO: 1657374 - DNA, 16 bp, Homo sapiens
ctctataccaataaag

SEQ ID NO: 1657375 - DNA, 13 bp, Homo sapiens
ctctatactttgt

SEQ ID NO: 1657376 - DNA, 21 bp, Homo sapiens
ctctatactttgttctgttgt

SEQ ID NO: 1657377 - DNA, 15 bp, Homo sapiens
ctctatattatgtct

SEQ ID NO: 1657378 - DNA, 16 bp, Homo sapiens
ctctatattatgtctt

SEQ ID NO: 1657379 - DNA, 21 bp, Homo sapiens
ctctatcagaaatacaaaaaa

SEQ ID NO: 1657380 - DNA, 16 bp, Homo sapiens
ctctatgagtctagat

SEQ ID NO: 1657381 - DNA, 17 bp, Homo sapiens
ctctatgccagctcagt

SEQ ID NO: 1657382 - DNA, 17 bp, Homo sapiens
ctctatgtatattctat

SEQ ID NO: 1657383 - DNA, 16 bp, Homo sapiens
ctctatgtctgccttc

SEQ ID NO: 1657384 - DNA, 15 bp, Homo sapiens
ctctatgtttacaaa

SEQ ID NO: 1657385 - DNA, 20 bp, Homo sapiens
ctctatgtttacaaatggac

SEQ ID NO: 1657386 - DNA, 18 bp, Homo sapiens
ctctattaagatttccaa

SEQ ID NO: 1657387 - DNA, 24 bp, Homo sapiens
ctctattagactttagaaataaat

SEQ ID NO: 1657388 - DNA, 14 bp, Homo sapiens
ctctattctctaaa

SEQ ID NO: 1657389 - DNA, 17 bp, Homo sapiens
ctctattctctaaactg

SEQ ID NO: 1657390 - DNA, 23 bp, Homo sapiens
ctctattgatgtacagtctgtca

SEQ ID NO: 1657391 - DNA, 22 bp, Homo sapiens
ctctattgggcacagcctaggg

SEQ ID NO: 1657392 - DNA, 20 bp, Homo sapiens
ctctattgtagcatttcttg

SEQ ID NO: 1657393 - DNA, 21 bp, Homo sapiens
ctctattgtagcatttcttga

SEQ ID NO: 1657394 - DNA, 13 bp, Homo sapiens
ctctatttaagat

SEQ ID NO: 1657395 - DNA, 16 bp, Homo sapiens
ctctatttatgtttgc

SEQ ID NO: 1657396 - DNA, 14 bp, Homo sapiens
ctctattttaaagt

SEQ ID NO: 1657397 - DNA, 20 bp, Homo sapiens
ctctattttcataatcagta

SEQ ID NO: 1657398 - DNA, 15 bp, Homo sapiens
ctctatttttaatca

SEQ ID NO: 1657399 - DNA, 14 bp, Homo sapiens
ctctattttttact

SEQ ID NO: 1657400 - DNA, 13 bp, Homo sapiens
ctctcacccagtc

SEQ ID NO: 1657401 - DNA, 19 bp, Homo sapiens
ctctcacccgggactctcc

SEQ ID NO: 1657402 - DNA, 13 bp, Homo sapiens
ctctcactcccca

SEQ ID NO: 1657403 - DNA, 14 bp, Homo sapiens
ctctcagaactcct

SEQ ID NO: 1657404 - DNA, 16 bp, Homo sapiens
ctctcagaactcctgt

SEQ ID NO: 1657405 - DNA, 17 bp, Homo sapiens
ctctcagaactcctgtg

SEQ ID NO: 1657406 - DNA, 16 bp, Homo sapiens
ctctcagaaggtattc

SEQ ID NO: 1657407 - DNA, 13 bp, Homo sapiens
ctctcagcaagtg

SEQ ID NO: 1657408 - DNA, 20 bp, Homo sapiens
ctctcagcaagtgcccagtg

SEQ ID NO: 1657409 - DNA, 19 bp, Homo sapiens
ctctcagcatagcctgcct

SEQ ID NO: 1657410 - DNA, 23 bp, Homo sapiens
ctctcagcatagcctgcctgatc

SEQ ID NO: 1657411 - DNA, 19 bp, Homo sapiens
ctctcagccacctgttact

SEQ ID NO: 1657412 - DNA, 22 bp, Homo sapiens
ctctcagcctcccaaccccagg

SEQ ID NO: 1657413 - DNA, 13 bp, Homo sapiens
ctctcagctccag

SEQ ID NO: 1657414 - DNA, 20 bp, Homo sapiens
ctctcagctggcagtgcaat

SEQ ID NO: 1657415 - DNA, 15 bp, Homo sapiens
ctctcaggagcacag

SEQ ID NO: 1657416 - DNA, 15 bp, Homo sapiens
ctctgctccaccaca

SEQ ID NO: 1657417 - DNA, 15 bp, Homo sapiens
ctctgctctagccag

SEQ ID NO: 1657418 - DNA, 15 bp, Homo sapiens
ctctgctctgccctt

SEQ ID NO: 1657419 - DNA, 13 bp, Homo sapiens
ctctgctctgcct

SEQ ID NO: 1657420 - DNA, 16 bp, Homo sapiens
ctctgctctgcctgga

SEQ ID NO: 1657421 - DNA, 19 bp, Homo sapiens
ctctgctctgcctggagtg

SEQ ID NO: 1657422 - DNA, 14 bp, Homo sapiens
ctctgctgaaggtt

SEQ ID NO: 1657423 - DNA, 14 bp, Homo sapiens
ctctgctgaatgca

SEQ ID NO: 1657424 - DNA, 15 bp, Homo sapiens
ctctgctgaatgcag

SEQ ID NO: 1657425 - DNA, 11 bp, Homo sapiens
ctctgctgccg

SEQ ID NO: 1657426 - DNA, 19 bp, Homo sapiens
ctctgctgccggctctggg

SEQ ID NO: 1657427 - DNA, 15 bp, Homo sapiens
ctctgctgctgcccg

SEQ ID NO: 1657428 - DNA, 16 bp, Homo sapiens
ctctgctgctgtccct

SEQ ID NO: 1657429 - DNA, 22 bp, Homo sapiens
ctctgctgctgtccctccccct

SEQ ID NO: 1657430 - DNA, 23 bp, Homo sapiens
ctctgctggaaggggcagcagga

SEQ ID NO: 1657431 - DNA, 23 bp, Homo sapiens
ctctgctgtacatatttgagact

SEQ ID NO: 1657432 - DNA, 17 bp, Homo sapiens
ctctgctgtcctgcagt

SEQ ID NO: 1657433 - DNA, 13 bp, Homo sapiens
ctctgcttctctg

SEQ ID NO: 1657434 - DNA, 14 bp, Homo sapiens
ctctgcttctctga

SEQ ID NO: 1657435 - DNA, 15 bp, Homo sapiens
ctctgcttctctgac

SEQ ID NO: 1657436 - DNA, 17 bp, Homo sapiens
ctctgcttctctgactt

SEQ ID NO: 1657437 - DNA, 19 bp, Homo sapiens
ctctgcttgacaacatctg

SEQ ID NO: 1657438 - DNA, 14 bp, Homo sapiens
ctctgctttaaagt

SEQ ID NO: 1657439 - DNA, 12 bp, Homo sapiens
ctctggaaaaat

SEQ ID NO: 1657440 - DNA, 17 bp, Homo sapiens
ctctggaaaagctgggg

SEQ ID NO: 1657441 - DNA, 15 bp, Homo sapiens
ctctggaagcctgga

SEQ ID NO: 1657442 - DNA, 16 bp, Homo sapiens
ctctggaagcctggac

SEQ ID NO: 1657443 - DNA, 21 bp, Homo sapiens
ctctggaataaagttgcagat

SEQ ID NO: 1657444 - DNA, 19 bp, Homo sapiens
ctctggacactctatatgt

SEQ ID NO: 1657445 - DNA, 18 bp, Homo sapiens
ctctggacggcaggctca

SEQ ID NO: 1657446 - DNA, 15 bp, Homo sapiens
ctctggactggcctg

SEQ ID NO: 1657447 - DNA, 16 bp, Homo sapiens
ctctggactggcctgt

SEQ ID NO: 1657448 - DNA, 12 bp, Homo sapiens
ctctggactgtg

SEQ ID NO: 1657449 - DNA, 12 bp, Homo sapiens
ctctggagcagc

SEQ ID NO: 1657450 - DNA, 18 bp, Homo sapiens
ctctggagcagccaaggc

SEQ ID NO: 1657451 - DNA, 10 bp, Homo sapiens
ctctggagcc

SEQ ID NO: 1657452 - DNA, 17 bp, Homo sapiens
ctctggaggaagttctc

SEQ ID NO: 1657453 - DNA, 22 bp, Homo sapiens
ctctggaggaagttctccagct

SEQ ID NO: 1657454 - DNA, 14 bp, Homo sapiens
ctctggaggggagg

SEQ ID NO: 1657455 - DNA, 16 bp, Homo sapiens
ctctggaggggagggg

SEQ ID NO: 1657456 - DNA, 19 bp, Homo sapiens
ctctggaggggtgtggctc

SEQ ID NO: 1657457 - DNA, 17 bp, Homo sapiens
ctctggaggtcatctgg

SEQ ID NO: 1657458 - DNA, 21 bp, Homo sapiens
ctctggatctagaagggacca

SEQ ID NO: 1657459 - DNA, 17 bp, Homo sapiens
ctctggatgaaggcaaa

SEQ ID NO: 1657460 - DNA, 16 bp, Homo sapiens
ctctggcaccatcagc

SEQ ID NO: 1657461 - DNA, 19 bp, Homo sapiens
ctctggcaccatcagcctg

SEQ ID NO: 1657462 - DNA, 20 bp, Homo sapiens
ctctggcattagaattattt

SEQ ID NO: 1657463 - DNA, 23 bp, Homo sapiens
ctctggcattagaattatttaaa

SEQ ID NO: 1657464 - DNA, 15 bp, Homo sapiens
ctctggccaggatgg

SEQ ID NO: 1657465 - DNA, 12 bp, Homo sapiens
ctctggcccaga

SEQ ID NO: 1657466 - DNA, 23 bp, Homo sapiens
ctctggcccagaaagcctctctc

SEQ ID NO: 1657467 - DNA, 14 bp, Homo sapiens
ctctggccctggcc

SEQ ID NO: 1657468 - DNA, 20 bp, Homo sapiens
ctctggccctggcccttact

SEQ ID NO: 1657469 - DNA, 19 bp, Homo sapiens
ctctggccgccacccccat

SEQ ID NO: 1657470 - DNA, 15 bp, Homo sapiens
ctctggcctcccacc

SEQ ID NO: 1657471 - DNA, 22 bp, Homo sapiens
ctctggctagagccgaggggag

SEQ ID NO: 1657472 - DNA, 19 bp, Homo sapiens
ctctggctagaggccagcc

SEQ ID NO: 1657473 - DNA, 16 bp, Homo sapiens
ctctggctgaaccctg

SEQ ID NO: 1657474 - DNA, 17 bp, Homo sapiens
ctctggctgaaccctgt

SEQ ID NO: 1657475 - DNA, 23 bp, Homo sapiens
ctctggctggctaactggaagca

SEQ ID NO: 1657476 - DNA, 22 bp, Homo sapiens
ctctggctgtaaggctctagat

SEQ ID NO: 1657477 - DNA, 22 bp, Homo sapiens
ctctggctgtctgtctgcagtg

SEQ ID NO: 1657478 - DNA, 14 bp, Homo sapiens
ctctggcttcccat

SEQ ID NO: 1657479 - DNA, 21 bp, Homo sapiens
ctctggcttctctcttttcct

SEQ ID NO: 1657480 - DNA, 22 bp, Homo sapiens
ctctgggacgtggacatgcctc

SEQ ID NO: 1657481 - DNA, 12 bp, Homo sapiens
ctctgggagaaa

SEQ ID NO: 1657482 - DNA, 15 bp, Homo sapiens
ctctgggagcccaga

SEQ ID NO: 1657483 - DNA, 16 bp, Homo sapiens
ctctgggcacagtggg

SEQ ID NO: 1657484 - DNA, 11 bp, Homo sapiens
ctctgggcagg

SEQ ID NO: 1657485 - DNA, 18 bp, Homo sapiens
ctctgggcagtgtggcct

SEQ ID NO: 1657486 - DNA, 14 bp, Homo sapiens
ctctgggcccaggg

SEQ ID NO: 1657487 - DNA, 22 bp, Homo sapiens
ctctgggcccaggggctgtggc

SEQ ID NO: 1657488 - DNA, 21 bp, Homo sapiens
ctctgggccgggcctggggct

SEQ ID NO: 1657489 - DNA, 14 bp, Homo sapiens
ctctgggcctgttc

SEQ ID NO: 1657490 - DNA, 16 bp, Homo sapiens
ctctgggctcagggct

SEQ ID NO: 1657491 - DNA, 18 bp, Homo sapiens
ctctgggctcagggctgg

SEQ ID NO: 1657492 - DNA, 22 bp, Homo sapiens
ctctgggctcagggctggagtg

SEQ ID NO: 1657493 - DNA, 17 bp, Homo sapiens
ctctgggctgccatgtg

SEQ ID NO: 1657494 - DNA, 23 bp, Homo sapiens
ctctggggacagcttcctcacac

SEQ ID NO: 1657495 - DNA, 20 bp, Homo sapiens
ctctgggtcagaaccagagg

SEQ ID NO: 1657496 - DNA, 22 bp, Homo sapiens
ctctgggttgtgcacatttctt

SEQ ID NO: 1657497 - DNA, 19 bp, Homo sapiens
ctctggtgacaccagcctt

SEQ ID NO: 1657498 - DNA, 20 bp, Homo sapiens
ctctggtgacaccagccttt

SEQ ID NO: 1657499 - DNA, 21 bp, Homo sapiens
ctctggtgagtcttggcggca

SEQ ID NO: 1657500 - DNA, 16 bp, Homo sapiens
ctctggtgcctccaga

SEQ ID NO: 1657501 - DNA, 16 bp, Homo sapiens
ctctggtgctgcagta

SEQ ID NO: 1657502 - DNA, 15 bp, Homo sapiens
ctctggtggagacaa

SEQ ID NO: 1657503 - DNA, 17 bp, Homo sapiens
ctctggtggctcctcct

SEQ ID NO: 1657504 - DNA, 20 bp, Homo sapiens
ctctggtggctcctcctagg

SEQ ID NO: 1657505 - DNA, 18 bp, Homo sapiens
ctctggtggcttaagtga

SEQ ID NO: 1657506 - DNA, 23 bp, Homo sapiens
ctctggtggcttaagtgagcaga

SEQ ID NO: 1657507 - DNA, 18 bp, Homo sapiens
ctctggtggtcttccttc

SEQ ID NO: 1657508 - DNA, 15 bp, Homo sapiens
ctctggttcctttca

SEQ ID NO: 1657509 - DNA, 22 bp, Homo sapiens
ctctggttcctttcatctctct

SEQ ID NO: 1657510 - DNA, 16 bp, Homo sapiens
ctctgtaagtgtagct

SEQ ID NO: 1657511 - DNA, 21 bp, Homo sapiens
ctctgtaccgcccggcagccc

SEQ ID NO: 1657512 - DNA, 22 bp, Homo sapiens
ctctgtaccgcccggcagcccc

SEQ ID NO: 1657513 - DNA, 11 bp, Homo sapiens
ctctgtacttt

SEQ ID NO: 1657514 - DNA, 22 bp, Homo sapiens
ctctgtacttttcattctcttt

SEQ ID NO: 1657515 - DNA, 20 bp, Homo sapiens
ctctgtaggcagcagagaga

SEQ ID NO: 1657516 - DNA, 14 bp, Homo sapiens
ctctgtagtttatg

SEQ ID NO: 1657517 - DNA, 13 bp, Homo sapiens
ctctgtcagatgg

SEQ ID NO: 1657518 - DNA, 16 bp, Homo sapiens
ctctgtcatcactccc

SEQ ID NO: 1657519 - DNA, 19 bp, Homo sapiens
ctctgtccagctcccgctg

SEQ ID NO: 1657520 - DNA, 12 bp, Homo sapiens
ctctgtccaggc

SEQ ID NO: 1657521 - DNA, 14 bp, Homo sapiens
ctctgtccaggcca

SEQ ID NO: 1657522 - DNA, 22 bp, Homo sapiens
ctctgtccaggccactgtggcc

SEQ ID NO: 1657523 - DNA, 13 bp, Homo sapiens
ctctgtcccacgt

SEQ ID NO: 1657524 - DNA, 17 bp, Homo sapiens
ctctgtccccttctctc

SEQ ID NO: 1657525 - DNA, 23 bp, Homo sapiens
ctctgtccccttctctcatctct

SEQ ID NO: 1657526 - DNA, 15 bp, Homo sapiens
ctctgtcccttgctg

SEQ ID NO: 1657527 - DNA, 13 bp, Homo sapiens
ctctgtcctactt

SEQ ID NO: 1657528 - DNA, 16 bp, Homo sapiens
ctctgtctacctggtc

SEQ ID NO: 1657529 - DNA, 20 bp, Homo sapiens
ctctgtctaggactgcagtg

SEQ ID NO: 1657530 - DNA, 23 bp, Homo sapiens
ctctgtctaggactgcagtgtgg

SEQ ID NO: 1657531 - DNA, 14 bp, Homo sapiens
ctgaaaatgcaaag

SEQ ID NO: 1657532 - DNA, 18 bp, Homo sapiens
ctgaaaatgcaaagctga

SEQ ID NO: 1657533 - DNA, 16 bp, Homo sapiens
ctgaaaatgtatgtgt

SEQ ID NO: 1657534 - DNA, 12 bp, Homo sapiens
ctgaaaatgtgc

SEQ ID NO: 1657535 - DNA, 19 bp, Homo sapiens
ctgaaaattgcctttctgt

SEQ ID NO: 1657536 - DNA, 15 bp, Homo sapiens
ctgaaacaacttgga

SEQ ID NO: 1657537 - DNA, 14 bp, Homo sapiens
ctgaaacagagaac

SEQ ID NO: 1657538 - DNA, 21 bp, Homo sapiens
ctgaaacatgcacattttgta

SEQ ID NO: 1657539 - DNA, 23 bp, Homo sapiens
ctgaaacatgcacattttgtaca

SEQ ID NO: 1657540 - DNA, 20 bp, Homo sapiens
ctgaaacattcacacagggc

SEQ ID NO: 1657541 - DNA, 12 bp, Homo sapiens
ctgaaaccattt

SEQ ID NO: 1657542 - DNA, 22 bp, Homo sapiens
ctgaaaccattttcccatcatc

SEQ ID NO: 1657543 - DNA, 23 bp, Homo sapiens
ctgaaagaagaaaacagtacaga

SEQ ID NO: 1657544 - DNA, 14 bp, Homo sapiens
ctgaaagaggctga

SEQ ID NO: 1657545 - DNA, 17 bp, Homo sapiens
ctgaaagcagcagctag

SEQ ID NO: 1657546 - DNA, 13 bp, Homo sapiens
ctgaaaggagaca

SEQ ID NO: 1657547 - DNA, 14 bp, Homo sapiens
ctgaaaggagacat

SEQ ID NO: 1657548 - DNA, 22 bp, Homo sapiens
ctgaaaggagacattgctctat

SEQ ID NO: 1657549 - DNA, 24 bp, Homo sapiens
ctgaaaggagacattgctctatgt

SEQ ID NO: 1657550 - DNA, 15 bp, Homo sapiens
ctgaaagggagcccc

SEQ ID NO: 1657551 - DNA, 16 bp, Homo sapiens
ctgaaagggagcccct

SEQ ID NO: 1657552 - DNA, 23 bp, Homo sapiens
ctgaaagttcatatctggagcct

SEQ ID NO: 1657553 - DNA, 13 bp, Homo sapiens
ctgaaagttttgt

SEQ ID NO: 1657554 - DNA, 17 bp, Homo sapiens
ctgaaagttttgtaaaa

SEQ ID NO: 1657555 - DNA, 18 bp, Homo sapiens
ctgaaagttttgtaaaag

SEQ ID NO: 1657556 - DNA, 15 bp, Homo sapiens
ctgaaatccataaac

SEQ ID NO: 1657557 - DNA, 14 bp, Homo sapiens
ctgaaatctccttt

SEQ ID NO: 1657558 - DNA, 21 bp, Homo sapiens
ctgaaatcttcccatgcattc

SEQ ID NO: 1657559 - DNA, 20 bp, Homo sapiens
ctgaaatgctgcattttaat

SEQ ID NO: 1657560 - DNA, 18 bp, Homo sapiens
ctgaaatgttacacatta

SEQ ID NO: 1657561 - DNA, 15 bp, Homo sapiens
ctgaaattccaaagt

SEQ ID NO: 1657562 - DNA, 16 bp, Homo sapiens
ctgaaattccaaagtc

SEQ ID NO: 1657563 - DNA, 20 bp, Homo sapiens
ctgaaattctcctggaggtc

SEQ ID NO: 1657564 - DNA, 15 bp, Homo sapiens
ctgaaattgaaaagt

SEQ ID NO: 1657565 - DNA, 20 bp, Homo sapiens
ctgaaattgaaaagttattt

SEQ ID NO: 1657566 - DNA, 18 bp, Homo sapiens
ctgaaatttattcacata

SEQ ID NO: 1657567 - DNA, 14 bp, Homo sapiens
ctgaaatttcagat

SEQ ID NO: 1657568 - DNA, 19 bp, Homo sapiens
ctgaaattttatatgctta

SEQ ID NO: 1657569 - DNA, 22 bp, Homo sapiens
ctgaaattttatatgcttactg

SEQ ID NO: 1657570 - DNA, 16 bp, Homo sapiens
ctgaacaaaacctaca

SEQ ID NO: 1657571 - DNA, 21 bp, Homo sapiens
ctgaacaaagtgctagacttt

SEQ ID NO: 1657572 - DNA, 16 bp, Homo sapiens
ctgaacaagaattgga

SEQ ID NO: 1657573 - DNA, 13 bp, Homo sapiens
ctgaacacagtgt

SEQ ID NO: 1657574 - DNA, 16 bp, Homo sapiens
ctgaacacagtgtctg

SEQ ID NO: 1657575 - DNA, 17 bp, Homo sapiens
ctgaacacatgtgtatg

SEQ ID NO: 1657576 - DNA, 13 bp, Homo sapiens
ctgaacacatttc

SEQ ID NO: 1657577 - DNA, 20 bp, Homo sapiens
ctgaacacttttgttgtaaa

SEQ ID NO: 1657578 - DNA, 22 bp, Homo sapiens
ctgaacaggaatccttactgat

SEQ ID NO: 1657579 - DNA, 12 bp, Homo sapiens
ctgaacagtgga

SEQ ID NO: 1657580 - DNA, 12 bp, Homo sapiens
ctgaacatgttt

SEQ ID NO: 1657581 - DNA, 20 bp, Homo sapiens
ctgaacatgtttacaggttt

SEQ ID NO: 1657582 - DNA, 11 bp, Homo sapiens
ctgaaccactg

SEQ ID NO: 1657583 - DNA, 19 bp, Homo sapiens
ctgaaccactgcttctctt

SEQ ID NO: 1657584 - DNA, 16 bp, Homo sapiens
ctgaaccatccctgat

SEQ ID NO: 1657585 - DNA, 15 bp, Homo sapiens
ctgaaccccagaggc

SEQ ID NO: 1657586 - DNA, 16 bp, Homo sapiens
ctgaaccccagaggca

SEQ ID NO: 1657587 - DNA, 17 bp, Homo sapiens
ctgaaccccagaggcag

SEQ ID NO: 1657588 - DNA, 13 bp, Homo sapiens
ctgaaccctgtgc

SEQ ID NO: 1657589 - DNA, 17 bp, Homo sapiens
ctgaaccctgtgctggt

SEQ ID NO: 1657590 - DNA, 20 bp, Homo sapiens
ctgaaccctgtgctggtgtc

SEQ ID NO: 1657591 - DNA, 23 bp, Homo sapiens
ctgaaccctgtgctggtgtcctg

SEQ ID NO: 1657592 - DNA, 15 bp, Homo sapiens
ctgaaccgcacagct

SEQ ID NO: 1657593 - DNA, 18 bp, Homo sapiens
ctgaaccgcacagctcag

SEQ ID NO: 1657594 - DNA, 21 bp, Homo sapiens
ctgaaccgcacagctcaggag

SEQ ID NO: 1657595 - DNA, 16 bp, Homo sapiens
ctgaactatttattaa

SEQ ID NO: 1657596 - DNA, 21 bp, Homo sapiens
ctgaactattttaaataaaat

SEQ ID NO: 1657597 - DNA, 16 bp, Homo sapiens
ctgaactcaagctgcg

SEQ ID NO: 1657598 - DNA, 21 bp, Homo sapiens
ctgaactccaccgaccaactg

SEQ ID NO: 1657599 - DNA, 18 bp, Homo sapiens
ctgaactccttccccact

SEQ ID NO: 1657600 - DNA, 16 bp, Homo sapiens
ctgaactcgcagggaa

SEQ ID NO: 1657601 - DNA, 13 bp, Homo sapiens
ctgaactctgaca

SEQ ID NO: 1657602 - DNA, 21 bp, Homo sapiens
ctgaactctgacagattgaca

SEQ ID NO: 1657603 - DNA, 17 bp, Homo sapiens
ctgaactcttcagaaca

SEQ ID NO: 1657604 - DNA, 14 bp, Homo sapiens
ctgaactgacaatg

SEQ ID NO: 1657605 - DNA, 18 bp, Homo sapiens
ctgaactgacaatgaagg

SEQ ID NO: 1657606 - DNA, 16 bp, Homo sapiens
ctgaactgaggccttg

SEQ ID NO: 1657607 - DNA, 14 bp, Homo sapiens
ctgaagaaccagtc

SEQ ID NO: 1657608 - DNA, 20 bp, Homo sapiens
ctgaagaattaagatacaaa

SEQ ID NO: 1657609 - DNA, 15 bp, Homo sapiens
ctgaagaggcgggcc

SEQ ID NO: 1657610 - DNA, 18 bp, Homo sapiens
ctgaagaggcgggccagc

SEQ ID NO: 1657611 - DNA, 22 bp, Homo sapiens
ctgaagaggcgggccagccagg

SEQ ID NO: 1657612 - DNA, 20 bp, Homo sapiens
ctgaagattaggcacacaga

SEQ ID NO: 1657613 - DNA, 21 bp, Homo sapiens
ctgaagatttcagaggctgca

SEQ ID NO: 1657614 - DNA, 15 bp, Homo sapiens
ctgaagcacagcacc

SEQ ID NO: 1657615 - DNA, 20 bp, Homo sapiens
ctgaagcagcctctccccag

SEQ ID NO: 1657616 - DNA, 14 bp, Homo sapiens
ctgaagccagctgc

SEQ ID NO: 1657617 - DNA, 22 bp, Homo sapiens
ctgaagccattggagagctgtc

SEQ ID NO: 1657618 - DNA, 19 bp, Homo sapiens
ctgaagccggacagctgcc

SEQ ID NO: 1657619 - DNA, 21 bp, Homo sapiens
ctgaagccggacagctgccca

SEQ ID NO: 1657620 - DNA, 13 bp, Homo sapiens
ctgaagcctgcag

SEQ ID NO: 1657621 - DNA, 23 bp, Homo sapiens
ctgaagctgctgcagccctgcca

SEQ ID NO: 1657622 - DNA, 14 bp, Homo sapiens
ctgaagctggagca

SEQ ID NO: 1657623 - DNA, 15 bp, Homo sapiens
ctgaagctggagcag

SEQ ID NO: 1657624 - DNA, 16 bp, Homo sapiens
ctgaagctggagcagc

SEQ ID NO: 1657625 - DNA, 21 bp, Homo sapiens
ctgaagcttgactcccaagtt

SEQ ID NO: 1657626 - DNA, 18 bp, Homo sapiens
ctgaaggaaaaacacaag

SEQ ID NO: 1657627 - DNA, 22 bp, Homo sapiens
ctgaaggaaaaacacaagcaaa

SEQ ID NO: 1657628 - DNA, 22 bp, Homo sapiens
ctgaaggaaaagcaagaaacag

SEQ ID NO: 1657629 - DNA, 17 bp, Homo sapiens
ctgaaggacacttcctg

SEQ ID NO: 1657630 - DNA, 19 bp, Homo sapiens
ctgaaggacacttcctgcc

SEQ ID NO: 1657631 - DNA, 13 bp, Homo sapiens
ctgaaggactgga

SEQ ID NO: 1657632 - DNA, 12 bp, Homo sapiens
ctgaaggagagg

SEQ ID NO: 1657633 - DNA, 20 bp, Homo sapiens
ctgaagggaactagaggtgt

SEQ ID NO: 1657634 - DNA, 14 bp, Homo sapiens
ctgaaggggcacac

SEQ ID NO: 1657635 - DNA, 20 bp, Homo sapiens
ctgaaggggcacaccactgc

SEQ ID NO: 1657636 - DNA, 22 bp, Homo sapiens
ctgaaggggcacaccactgccc

SEQ ID NO: 1657637 - DNA, 23 bp, Homo sapiens
ctgaaggggccatgatggcaaca

SEQ ID NO: 1657638 - DNA, 21 bp, Homo sapiens
ctgaaggggtgcacccacctg

SEQ ID NO: 1657639 - DNA, 17 bp, Homo sapiens
ctgaaggggttctcaca

SEQ ID NO: 1657640 - DNA, 15 bp, Homo sapiens
ctgaaggtaaaattg

SEQ ID NO: 1657641 - DNA, 17 bp, Homo sapiens
ctgaaggtaaaattgaa

SEQ ID NO: 1657642 - DNA, 18 bp, Homo sapiens
ctgaaggtcccctggcag

SEQ ID NO: 1657643 - DNA, 20 bp, Homo sapiens
ctgaagtacttaaacttcca

SEQ ID NO: 1657644 - DNA, 15 bp, Homo sapiens
ctgaagtcaaaatat

SEQ ID NO: 1657645 - DNA, 14 bp, Homo sapiens
ctgagcctgcaggg

SEQ ID NO: 1657646 - DNA, 19 bp, Homo sapiens
ctgagcctgcagggaagcc

SEQ ID NO: 1657647 - DNA, 17 bp, Homo sapiens
ctgagcctggctggaga

SEQ ID NO: 1657648 - DNA, 12 bp, Homo sapiens
ctgagccttcag

SEQ ID NO: 1657649 - DNA, 21 bp, Homo sapiens
ctgagccttgtaattctaaat

SEQ ID NO: 1657650 - DNA, 13 bp, Homo sapiens
ctgagcgcctcca

SEQ ID NO: 1657651 - DNA, 14 bp, Homo sapiens
ctgagcgctcctgc

SEQ ID NO: 1657652 - DNA, 15 bp, Homo sapiens
ctgagcgctgtggac

SEQ ID NO: 1657653 - DNA, 16 bp, Homo sapiens
ctgagcgctgtggact

SEQ ID NO: 1657654 - DNA, 18 bp, Homo sapiens
ctgagcggcgcagagccc

SEQ ID NO: 1657655 - DNA, 19 bp, Homo sapiens
ctgagcggcgcagagccct

SEQ ID NO: 1657656 - DNA, 21 bp, Homo sapiens
ctgagctatttcatctatttt

SEQ ID NO: 1657657 - DNA, 15 bp, Homo sapiens
ctgagctccacctct

SEQ ID NO: 1657658 - DNA, 22 bp, Homo sapiens
ctgagctccacctctggtggct

SEQ ID NO: 1657659 - DNA, 19 bp, Homo sapiens
ctgagctcccacctccctt

SEQ ID NO: 1657660 - DNA, 21 bp, Homo sapiens
ctgagctcccacctcccttcc

SEQ ID NO: 1657661 - DNA, 20 bp, Homo sapiens
ctgagctcggggggctctgc

SEQ ID NO: 1657662 - DNA, 23 bp, Homo sapiens
ctgagctcggggggctctgcctt

SEQ ID NO: 1657663 - DNA, 17 bp, Homo sapiens
ctgagctcggtggaccc

SEQ ID NO: 1657664 - DNA, 13 bp, Homo sapiens
ctgagctctccag

SEQ ID NO: 1657665 - DNA, 15 bp, Homo sapiens
ctgagctctccaggc

SEQ ID NO: 1657666 - DNA, 18 bp, Homo sapiens
ctgagctctccaggccag

SEQ ID NO: 1657667 - DNA, 19 bp, Homo sapiens
ctgagctctccaggccagg

SEQ ID NO: 1657668 - DNA, 20 bp, Homo sapiens
ctgagctctccaggccaggt

SEQ ID NO: 1657669 - DNA, 11 bp, Homo sapiens
ctgagctgggg

SEQ ID NO: 1657670 - DNA, 15 bp, Homo sapiens
ctgagctggggccac

SEQ ID NO: 1657671 - DNA, 17 bp, Homo sapiens
ctgagctgggggaagaa

SEQ ID NO: 1657672 - DNA, 12 bp, Homo sapiens
ctgagctggggt

SEQ ID NO: 1657673 - DNA, 15 bp, Homo sapiens
ctgagctggggtggg

SEQ ID NO: 1657674 - DNA, 23 bp, Homo sapiens
ctgagctggggtgggagctcctc

SEQ ID NO: 1657675 - DNA, 17 bp, Homo sapiens
ctgagctgtcgctgcct

SEQ ID NO: 1657676 - DNA, 18 bp, Homo sapiens
ctgagctgtcgctgcctc

SEQ ID NO: 1657677 - DNA, 19 bp, Homo sapiens
ctgagctgtcgctgcctcc

SEQ ID NO: 1657678 - DNA, 21 bp, Homo sapiens
ctgagctgtgttttgtctgag

SEQ ID NO: 1657679 - DNA, 19 bp, Homo sapiens
ctgagcttagccttgtgcc

SEQ ID NO: 1657680 - DNA, 17 bp, Homo sapiens
ctgagcttgagctcccc

SEQ ID NO: 1657681 - DNA, 18 bp, Homo sapiens
ctgagcttgagctcccct

SEQ ID NO: 1657682 - DNA, 22 bp, Homo sapiens
ctgagctttggggacagttggc

SEQ ID NO: 1657683 - DNA, 15 bp, Homo sapiens
ctgaggaagaacggg

SEQ ID NO: 1657684 - DNA, 18 bp, Homo sapiens
ctgaggaagaacggggct

SEQ ID NO: 1657685 - DNA, 18 bp, Homo sapiens
ctgaggaagagggactgt

SEQ ID NO: 1657686 - DNA, 19 bp, Homo sapiens
ctgaggaatcaacagggca

SEQ ID NO: 1657687 - DNA, 14 bp, Homo sapiens
ctgaggacaggccc

SEQ ID NO: 1657688 - DNA, 17 bp, Homo sapiens
ctgaggacaggccccca

SEQ ID NO: 1657689 - DNA, 20 bp, Homo sapiens
ctgaggacgagacccccatc

SEQ ID NO: 1657690 - DNA, 23 bp, Homo sapiens
ctgaggacgagacccccatccag

SEQ ID NO: 1657691 - DNA, 14 bp, Homo sapiens
ctgaggactcctga

SEQ ID NO: 1657692 - DNA, 22 bp, Homo sapiens
ctgaggactgatttcagagtga

SEQ ID NO: 1657693 - DNA, 14 bp, Homo sapiens
ctgaggagacagaa

SEQ ID NO: 1657694 - DNA, 15 bp, Homo sapiens
ctgaggagccctgag

SEQ ID NO: 1657695 - DNA, 20 bp, Homo sapiens
ctgaggagccctgaggacct

SEQ ID NO: 1657696 - DNA, 20 bp, Homo sapiens
ctgaggagctgttactgaat

SEQ ID NO: 1657697 - DNA, 17 bp, Homo sapiens
ctgaggatacagctctt

SEQ ID NO: 1657698 - DNA, 19 bp, Homo sapiens
ctgaggatacagctcttct

SEQ ID NO: 1657699 - DNA, 17 bp, Homo sapiens
ctgaggatttcaagcct

SEQ ID NO: 1657700 - DNA, 20 bp, Homo sapiens
ctgaggcaccgtccaggccc

SEQ ID NO: 1657701 - DNA, 22 bp, Homo sapiens
ctgaggcaccgtccaggcccca

SEQ ID NO: 1657702 - DNA, 23 bp, Homo sapiens
ctgaggcaccgtccaggccccac

SEQ ID NO: 1657703 - DNA, 13 bp, Homo sapiens
ctgaggcagacag

SEQ ID NO: 1657704 - DNA, 16 bp, Homo sapiens
ctgaggcagacagcag

SEQ ID NO: 1657705 - DNA, 18 bp, Homo sapiens
ctgaggcagacagcagct

SEQ ID NO: 1657706 - DNA, 22 bp, Homo sapiens
ctgaggcagacagcagctcagg

SEQ ID NO: 1657707 - DNA, 14 bp, Homo sapiens
ctgaggcagcccag

SEQ ID NO: 1657708 - DNA, 11 bp, Homo sapiens
ctgaggcagga

SEQ ID NO: 1657709 - DNA, 15 bp, Homo sapiens
ctgaggcaggaggat

SEQ ID NO: 1657710 - DNA, 14 bp, Homo sapiens
ctgaggccacccac

SEQ ID NO: 1657711 - DNA, 13 bp, Homo sapiens
ctgaggcccagtg

SEQ ID NO: 1657712 - DNA, 22 bp, Homo sapiens
ctgaggcccctaggtgcccagg

SEQ ID NO: 1657713 - DNA, 23 bp, Homo sapiens
ctgaggccccttaactcatctgt

SEQ ID NO: 1657714 - DNA, 16 bp, Homo sapiens
ctgaggccctgcccaa

SEQ ID NO: 1657715 - DNA, 15 bp, Homo sapiens
ctgaggcctcatccc

SEQ ID NO: 1657716 - DNA, 15 bp, Homo sapiens
ctgaggcctccagct

SEQ ID NO: 1657717 - DNA, 15 bp, Homo sapiens
ctgaggcctgcttcc

SEQ ID NO: 1657718 - DNA, 16 bp, Homo sapiens
ctgaggcctgcttccc

SEQ ID NO: 1657719 - DNA, 17 bp, Homo sapiens
ctgaggcctgcttcccc

SEQ ID NO: 1657720 - DNA, 15 bp, Homo sapiens
ctgaggcctggactt

SEQ ID NO: 1657721 - DNA, 19 bp, Homo sapiens
ctgaggcctggactttcct

SEQ ID NO: 1657722 - DNA, 21 bp, Homo sapiens
ctgaggccttgtgtgtcaggc

SEQ ID NO: 1657723 - DNA, 22 bp, Homo sapiens
ctgaggccttgtgtgtcaggcc

SEQ ID NO: 1657724 - DNA, 23 bp, Homo sapiens
ctgaggccttgtgtgtcaggccc

SEQ ID NO: 1657725 - DNA, 18 bp, Homo sapiens
ctgaggcgggtggatcac

SEQ ID NO: 1657726 - DNA, 13 bp, Homo sapiens
ctgaggctgtggt

SEQ ID NO: 1657727 - DNA, 19 bp, Homo sapiens
ctgaggctgtggtcacagc

SEQ ID NO: 1657728 - DNA, 20 bp, Homo sapiens
ctgaggcttcacgccgggag

SEQ ID NO: 1657729 - DNA, 12 bp, Homo sapiens
ctgagggaccaa

SEQ ID NO: 1657730 - DNA, 19 bp, Homo sapiens
ctgagggaccaactgggcc

SEQ ID NO: 1657731 - DNA, 14 bp, Homo sapiens
ctgagggaccgagc

SEQ ID NO: 1657732 - DNA, 18 bp, Homo sapiens
ctgagggaccttggagag

SEQ ID NO: 1657733 - DNA, 20 bp, Homo sapiens
ctgagggaccttggagagct

SEQ ID NO: 1657734 - DNA, 13 bp, Homo sapiens
ctgagggaggagg

SEQ ID NO: 1657735 - DNA, 17 bp, Homo sapiens
ctgagggaggaggccac

SEQ ID NO: 1657736 - DNA, 18 bp, Homo sapiens
ctgagggaggaggccacc

SEQ ID NO: 1657737 - DNA, 22 bp, Homo sapiens
ctgagggaggaggccacctctc

SEQ ID NO: 1657738 - DNA, 23 bp, Homo sapiens
ctgagggaggaggccacctctcc

SEQ ID NO: 1657739 - DNA, 22 bp, Homo sapiens
ctgagggattgaggggccctgg

SEQ ID NO: 1657740 - DNA, 23 bp, Homo sapiens
ctgagggattgaggggccctggc

SEQ ID NO: 1657741 - DNA, 19 bp, Homo sapiens
ctgagggcagactggggca

SEQ ID NO: 1657742 - DNA, 14 bp, Homo sapiens
ctgagggcagtgcc

SEQ ID NO: 1657743 - DNA, 13 bp, Homo sapiens
ctgagggccacac

SEQ ID NO: 1657744 - DNA, 21 bp, Homo sapiens
ctgagggccagggacccaggt

SEQ ID NO: 1657745 - DNA, 14 bp, Homo sapiens
ctgagggctctgtt

SEQ ID NO: 1657746 - DNA, 22 bp, Homo sapiens
ctgagggctctgtttgtgggac

SEQ ID NO: 1657747 - DNA, 21 bp, Homo sapiens
ctgaggggaggatcactggag

SEQ ID NO: 1657748 - DNA, 23 bp, Homo sapiens
ctgaggggaggatcactggagcc

SEQ ID NO: 1657749 - DNA, 14 bp, Homo sapiens
ctgaggggaggcac

SEQ ID NO: 1657750 - DNA, 17 bp, Homo sapiens
ctgaggggaggcacctc

SEQ ID NO: 1657751 - DNA, 20 bp, Homo sapiens
ctgaggggaggcacctccag

SEQ ID NO: 1657752 - DNA, 18 bp, Homo sapiens
ctgaggggcatctgcccc

SEQ ID NO: 1657753 - DNA, 20 bp, Homo sapiens
ctgaggggcatctgcccctc

SEQ ID NO: 1657754 - DNA, 16 bp, Homo sapiens
ctgagggtccacctgg

SEQ ID NO: 1657755 - DNA, 18 bp, Homo sapiens
ctgagggtccacctggag

SEQ ID NO: 1657756 - DNA, 19 bp, Homo sapiens
ctgagggtccacctggaga

SEQ ID NO: 1657757 - DNA, 22 bp, Homo sapiens
ctgagggtccacctggagagta

SEQ ID NO: 1657758 - DNA, 16 bp, Homo sapiens
ctgagggtctgggcgg

SEQ ID NO: 1657759 - DNA, 19 bp, Homo sapiens
ctgcaatttgtttaaagaa

SEQ ID NO: 1657760 - DNA, 16 bp, Homo sapiens
ctgcacaaaagcagat

SEQ ID NO: 1657761 - DNA, 19 bp, Homo sapiens
ctgcacaagccagggtgtg

SEQ ID NO: 1657762 - DNA, 22 bp, Homo sapiens
ctgcacaagccagggtgtgtct

SEQ ID NO: 1657763 - DNA, 13 bp, Homo sapiens
ctgcacacacagc

SEQ ID NO: 1657764 - DNA, 15 bp, Homo sapiens
ctgcacacacagctc

SEQ ID NO: 1657765 - DNA, 16 bp, Homo sapiens
ctgcacacacagctcc

SEQ ID NO: 1657766 - DNA, 14 bp, Homo sapiens
ctgcacacacctgc

SEQ ID NO: 1657767 - DNA, 19 bp, Homo sapiens
ctgcacacagaatgctcag

SEQ ID NO: 1657768 - DNA, 21 bp, Homo sapiens
ctgcacacagaatgctcaggg

SEQ ID NO: 1657769 - DNA, 22 bp, Homo sapiens
ctgcacacagaatgctcagggt

SEQ ID NO: 1657770 - DNA, 12 bp, Homo sapiens
ctgcacacagga

SEQ ID NO: 1657771 - DNA, 15 bp, Homo sapiens
ctgcacacaggacag

SEQ ID NO: 1657772 - DNA, 18 bp, Homo sapiens
ctgcacacaggacagcgg

SEQ ID NO: 1657773 - DNA, 17 bp, Homo sapiens
ctgcacagacaagcagc

SEQ ID NO: 1657774 - DNA, 20 bp, Homo sapiens
ctgcacaggcacacagggcc

SEQ ID NO: 1657775 - DNA, 22 bp, Homo sapiens
ctgcacaggcacacagggcccg

SEQ ID NO: 1657776 - DNA, 16 bp, Homo sapiens
ctgcacagtgacttct

SEQ ID NO: 1657777 - DNA, 15 bp, Homo sapiens
ctgcacagttgaagg

SEQ ID NO: 1657778 - DNA, 23 bp, Homo sapiens
ctgcacatgaatcccacccacat

SEQ ID NO: 1657779 - DNA, 22 bp, Homo sapiens
ctgcacatgactcgggggtggg

SEQ ID NO: 1657780 - DNA, 21 bp, Homo sapiens
ctgcacatggacagacttcac

SEQ ID NO: 1657781 - DNA, 16 bp, Homo sapiens
ctgcacatgtcttgta

SEQ ID NO: 1657782 - DNA, 13 bp, Homo sapiens
ctgcacattcctg

SEQ ID NO: 1657783 - DNA, 15 bp, Homo sapiens
ctgcacattcctggc

SEQ ID NO: 1657784 - DNA, 22 bp, Homo sapiens
ctgcacattcctggccccgggc

SEQ ID NO: 1657785 - DNA, 14 bp, Homo sapiens
ctgcacattgcctg

SEQ ID NO: 1657786 - DNA, 16 bp, Homo sapiens
ctgcacattgcctgtt

SEQ ID NO: 1657787 - DNA, 17 bp, Homo sapiens
ctgcaccactctcttca

SEQ ID NO: 1657788 - DNA, 15 bp, Homo sapiens
ctgcaccagagtgaa

SEQ ID NO: 1657789 - DNA, 14 bp, Homo sapiens
ctgcaccaggagac

SEQ ID NO: 1657790 - DNA, 14 bp, Homo sapiens
ctgcacccacccct

SEQ ID NO: 1657791 - DNA, 17 bp, Homo sapiens
ctgcacccacccctgcc

SEQ ID NO: 1657792 - DNA, 19 bp, Homo sapiens
ctgcacccagcagtgtcac

SEQ ID NO: 1657793 - DNA, 13 bp, Homo sapiens
ctgcacccgcctc

SEQ ID NO: 1657794 - DNA, 13 bp, Homo sapiens
ctgcaccctccac

SEQ ID NO: 1657795 - DNA, 15 bp, Homo sapiens
ctgcaccctccaccc

SEQ ID NO: 1657796 - DNA, 20 bp, Homo sapiens
ctgcaccctccaccctgtcc

SEQ ID NO: 1657797 - DNA, 21 bp, Homo sapiens
ctgcaccctccaccctgtccc

SEQ ID NO: 1657798 - DNA, 14 bp, Homo sapiens
ctgcaccctgcgcc

SEQ ID NO: 1657799 - DNA, 15 bp, Homo sapiens
ctgcaccctgcgcct

SEQ ID NO: 1657800 - DNA, 17 bp, Homo sapiens
ctgcaccctgcgcctcc

SEQ ID NO: 1657801 - DNA, 15 bp, Homo sapiens
ctgcaccctggaaag

SEQ ID NO: 1657802 - DNA, 18 bp, Homo sapiens
ctgcaccctggaaagggg

SEQ ID NO: 1657803 - DNA, 21 bp, Homo sapiens
ctgcaccctggggcctggacc

SEQ ID NO: 1657804 - DNA, 13 bp, Homo sapiens
ctgcacccttccc

SEQ ID NO: 1657805 - DNA, 15 bp, Homo sapiens
ctgcacccttccctc

SEQ ID NO: 1657806 - DNA, 19 bp, Homo sapiens
ctgcacccttccctcttcc

SEQ ID NO: 1657807 - DNA, 14 bp, Homo sapiens
ctgcacctcccccc

SEQ ID NO: 1657808 - DNA, 19 bp, Homo sapiens
ctgcacctccccccactgc

SEQ ID NO: 1657809 - DNA, 20 bp, Homo sapiens
ctgcacctccccccactgca

SEQ ID NO: 1657810 - DNA, 21 bp, Homo sapiens
ctgcacctccccccactgcag

SEQ ID NO: 1657811 - DNA, 15 bp, Homo sapiens
ctgcacctctggcta

SEQ ID NO: 1657812 - DNA, 20 bp, Homo sapiens
ctgcacctctggctagagcc

SEQ ID NO: 1657813 - DNA, 14 bp, Homo sapiens
ctgcacctgctgcg

SEQ ID NO: 1657814 - DNA, 21 bp, Homo sapiens
ctgcacctgctgcgtccccac

SEQ ID NO: 1657815 - DNA, 12 bp, Homo sapiens
ctgcacctggcc

SEQ ID NO: 1657816 - DNA, 15 bp, Homo sapiens
ctgcacctggcctgg

SEQ ID NO: 1657817 - DNA, 16 bp, Homo sapiens
ctgcacctggcctggg

SEQ ID NO: 1657818 - DNA, 17 bp, Homo sapiens
ctgcacctggcctgggc

SEQ ID NO: 1657819 - DNA, 20 bp, Homo sapiens
ctgcacctggcctgggccac

SEQ ID NO: 1657820 - DNA, 14 bp, Homo sapiens
ctgcaccttgtaaa

SEQ ID NO: 1657821 - DNA, 17 bp, Homo sapiens
ctgcactaacagagtgg

SEQ ID NO: 1657822 - DNA, 16 bp, Homo sapiens
ctgcactactcctctg

SEQ ID NO: 1657823 - DNA, 19 bp, Homo sapiens
ctgcactactcctctgcag

SEQ ID NO: 1657824 - DNA, 15 bp, Homo sapiens
ctgcactcagattta

SEQ ID NO: 1657825 - DNA, 12 bp, Homo sapiens
ctgcactccagc

SEQ ID NO: 1657826 - DNA, 16 bp, Homo sapiens
ctgcactccagcctga

SEQ ID NO: 1657827 - DNA, 20 bp, Homo sapiens
ctgcactccagcctgagtga

SEQ ID NO: 1657828 - DNA, 11 bp, Homo sapiens
ctgcactccat

SEQ ID NO: 1657829 - DNA, 12 bp, Homo sapiens
ctgcactccatg

SEQ ID NO: 1657830 - DNA, 14 bp, Homo sapiens
ctgcactccatggc

SEQ ID NO: 1657831 - DNA, 15 bp, Homo sapiens
ctgcactccatggcc

SEQ ID NO: 1657832 - DNA, 17 bp, Homo sapiens
ctgcactccatggccac

SEQ ID NO: 1657833 - DNA, 18 bp, Homo sapiens
ctgcactcccacctgaca

SEQ ID NO: 1657834 - DNA, 19 bp, Homo sapiens
ctgcactcccacctgacac

SEQ ID NO: 1657835 - DNA, 13 bp, Homo sapiens
ctgcactccctgg

SEQ ID NO: 1657836 - DNA, 14 bp, Homo sapiens
ctgcactccctggc

SEQ ID NO: 1657837 - DNA, 18 bp, Homo sapiens
ctgcactccctggccttg

SEQ ID NO: 1657838 - DNA, 19 bp, Homo sapiens
ctgcactccctggccttgc

SEQ ID NO: 1657839 - DNA, 21 bp, Homo sapiens
ctgcactccctggccttgccc

SEQ ID NO: 1657840 - DNA, 12 bp, Homo sapiens
ctgcactcttga

SEQ ID NO: 1657841 - DNA, 14 bp, Homo sapiens
ctgcactgaaaagg

SEQ ID NO: 1657842 - DNA, 14 bp, Homo sapiens
ctgcactgacaccc

SEQ ID NO: 1657843 - DNA, 18 bp, Homo sapiens
ctgcactgatgctgcccc

SEQ ID NO: 1657844 - DNA, 12 bp, Homo sapiens
ctgcactgcagt

SEQ ID NO: 1657845 - DNA, 12 bp, Homo sapiens
ctgcactgctgt

SEQ ID NO: 1657846 - DNA, 21 bp, Homo sapiens
ctgcactggagtccagtctct

SEQ ID NO: 1657847 - DNA, 16 bp, Homo sapiens
ctgcactggggagccc

SEQ ID NO: 1657848 - DNA, 11 bp, Homo sapiens
ctgcactgtaa

SEQ ID NO: 1657849 - DNA, 16 bp, Homo sapiens
ctgcactgtaaaatgt

SEQ ID NO: 1657850 - DNA, 15 bp, Homo sapiens
ctgcacttacttgct

SEQ ID NO: 1657851 - DNA, 21 bp, Homo sapiens
ctgcagaacccccaggtggcc

SEQ ID NO: 1657852 - DNA, 21 bp, Homo sapiens
ctgcagaacgtattggtccag

SEQ ID NO: 1657853 - DNA, 15 bp, Homo sapiens
ctgcagaagcaaggg

SEQ ID NO: 1657854 - DNA, 13 bp, Homo sapiens
ctgcagaagccaa

SEQ ID NO: 1657855 - DNA, 14 bp, Homo sapiens
ctgcagaagccaag

SEQ ID NO: 1657856 - DNA, 17 bp, Homo sapiens
ctgcagaagccaaggga

SEQ ID NO: 1657857 - DNA, 14 bp, Homo sapiens
ctgcagaaggaaag

SEQ ID NO: 1657858 - DNA, 23 bp, Homo sapiens
ctgcagaaggaaagaagggggcc

SEQ ID NO: 1657859 - DNA, 13 bp, Homo sapiens
ctgcagacaggct

SEQ ID NO: 1657860 - DNA, 15 bp, Homo sapiens
ctgcagaccacgccc

SEQ ID NO: 1657861 - DNA, 23 bp, Homo sapiens
ctgcagactccaatggggccagc

SEQ ID NO: 1657862 - DNA, 14 bp, Homo sapiens
ctgcagacttccca

SEQ ID NO: 1657863 - DNA, 17 bp, Homo sapiens
ctgcagacttcccagct

SEQ ID NO: 1657864 - DNA, 14 bp, Homo sapiens
ctgcagagatttct

SEQ ID NO: 1657865 - DNA, 11 bp, Homo sapiens
ctgcagagggg

SEQ ID NO: 1657866 - DNA, 23 bp, Homo sapiens
ctgcagaggggctttctggagag

SEQ ID NO: 1657867 - DNA, 23 bp, Homo sapiens
ctgcagaggtctgtgctgaggcc

SEQ ID NO: 1657868 - DNA, 17 bp, Homo sapiens
ctgcagatcttccgtgg

SEQ ID NO: 1657869 - DNA, 14 bp, Homo sapiens
ctgcagatgccacc

SEQ ID NO: 1657870 - DNA, 16 bp, Homo sapiens
ctgcagcaccgagggg

SEQ ID NO: 1657871 - DNA, 22 bp, Homo sapiens
ctgcagcaccgaggggcctttg

SEQ ID NO: 1657872 - DNA, 17 bp, Homo sapiens
ctgcagcacctcacctg

SEQ ID NO: 1657873 - DNA, 14 bp, Homo sapiens
ctgcagcacctcca

SEQ ID NO: 1657874 - DNA, 19 bp, Homo sapiens
ctgcagcacctccaggcct

SEQ ID NO: 1657875 - DNA, 21 bp, Homo sapiens
ctgccgcccccgcctgggcac

SEQ ID NO: 1657876 - DNA, 22 bp, Homo sapiens
ctgccggaggagcatgcgcaga

SEQ ID NO: 1657877 - DNA, 13 bp, Homo sapiens
ctgccggctctgg

SEQ ID NO: 1657878 - DNA, 18 bp, Homo sapiens
ctgccggctctgggcctg

SEQ ID NO: 1657879 - DNA, 20 bp, Homo sapiens
ctgccggctctgggcctgag

SEQ ID NO: 1657880 - DNA, 22 bp, Homo sapiens
ctgccggctctgggcctgaggg

SEQ ID NO: 1657881 - DNA, 21 bp, Homo sapiens
ctgccgggctgagggcctgct

SEQ ID NO: 1657882 - DNA, 19 bp, Homo sapiens
ctgccgggttctagtctcc

SEQ ID NO: 1657883 - DNA, 20 bp, Homo sapiens
ctgccgggttctagtctcct

SEQ ID NO: 1657884 - DNA, 23 bp, Homo sapiens
ctgccgggttctagtctcctttg

SEQ ID NO: 1657885 - DNA, 23 bp, Homo sapiens
ctgccggtcccccatgccaccac

SEQ ID NO: 1657886 - DNA, 21 bp, Homo sapiens
ctgccggtcgggcagccagca

SEQ ID NO: 1657887 - DNA, 22 bp, Homo sapiens
ctgccggtcgggcagccagcag

SEQ ID NO: 1657888 - DNA, 17 bp, Homo sapiens
ctgccggtgcacaggcc

SEQ ID NO: 1657889 - DNA, 18 bp, Homo sapiens
ctgccggtgcacaggcct

SEQ ID NO: 1657890 - DNA, 15 bp, Homo sapiens
ctgccggtgggaccc

SEQ ID NO: 1657891 - DNA, 21 bp, Homo sapiens
ctgccggtgggaccctgtccg

SEQ ID NO: 1657892 - DNA, 15 bp, Homo sapiens
ctgccgtaatttaac

SEQ ID NO: 1657893 - DNA, 18 bp, Homo sapiens
ctgccgtgcatggctcct

SEQ ID NO: 1657894 - DNA, 19 bp, Homo sapiens
ctgccgtgcatggctcctg

SEQ ID NO: 1657895 - DNA, 15 bp, Homo sapiens
ctgccgtgccgcctg

SEQ ID NO: 1657896 - DNA, 22 bp, Homo sapiens
ctgccgtgggcctgtcgtgcca

SEQ ID NO: 1657897 - DNA, 21 bp, Homo sapiens
ctgccgtggggccgccgcctc

SEQ ID NO: 1657898 - DNA, 14 bp, Homo sapiens
ctgcctaagtggct

SEQ ID NO: 1657899 - DNA, 23 bp, Homo sapiens
ctgcctacggagggtgggctctg

SEQ ID NO: 1657900 - DNA, 13 bp, Homo sapiens
ctgcctactcacg

SEQ ID NO: 1657901 - DNA, 14 bp, Homo sapiens
ctgcctactcacga

SEQ ID NO: 1657902 - DNA, 18 bp, Homo sapiens
ctgcctagagtgtagcct

SEQ ID NO: 1657903 - DNA, 20 bp, Homo sapiens
ctgcctagagtgtagcctaa

SEQ ID NO: 1657904 - DNA, 22 bp, Homo sapiens
ctgcctagagtgtagcctaaag

SEQ ID NO: 1657905 - DNA, 19 bp, Homo sapiens
ctgcctaggaattcccagc

SEQ ID NO: 1657906 - DNA, 16 bp, Homo sapiens
ctgcctaggagctggc

SEQ ID NO: 1657907 - DNA, 16 bp, Homo sapiens
ctgcctaggtttttcc

SEQ ID NO: 1657908 - DNA, 23 bp, Homo sapiens
ctgcctattatctgtcagctgca

SEQ ID NO: 1657909 - DNA, 24 bp, Homo sapiens
ctgcctcaatgtgaatcagaccct

SEQ ID NO: 1657910 - DNA, 14 bp, Homo sapiens
ctgcctcacttcct

SEQ ID NO: 1657911 - DNA, 13 bp, Homo sapiens
ctgcctcagccag

SEQ ID NO: 1657912 - DNA, 17 bp, Homo sapiens
ctgcctcagccagtggc

SEQ ID NO: 1657913 - DNA, 17 bp, Homo sapiens
ctgcctcagcctcctga

SEQ ID NO: 1657914 - DNA, 18 bp, Homo sapiens
ctgcctcagcctcctgag

SEQ ID NO: 1657915 - DNA, 14 bp, Homo sapiens
ctgcctcagtggct

SEQ ID NO: 1657916 - DNA, 19 bp, Homo sapiens
ctgcctcagtggctctggg

SEQ ID NO: 1657917 - DNA, 21 bp, Homo sapiens
ctgcctcagtggctctgggta

SEQ ID NO: 1657918 - DNA, 14 bp, Homo sapiens
ctgcctccaccagc

SEQ ID NO: 1657919 - DNA, 18 bp, Homo sapiens
ctgcctccaccagcaagg

SEQ ID NO: 1657920 - DNA, 17 bp, Homo sapiens
ctgcctccaccgagcca

SEQ ID NO: 1657921 - DNA, 14 bp, Homo sapiens
ctgcctccagggct

SEQ ID NO: 1657922 - DNA, 23 bp, Homo sapiens
ctgcctccagggctggactgagg

SEQ ID NO: 1657923 - DNA, 12 bp, Homo sapiens
ctgcctcccact

SEQ ID NO: 1657924 - DNA, 13 bp, Homo sapiens
ctgcctcccatgc

SEQ ID NO: 1657925 - DNA, 21 bp, Homo sapiens
ctgcctcccgcccccttggct

SEQ ID NO: 1657926 - DNA, 12 bp, Homo sapiens
ctgcctccctag

SEQ ID NO: 1657927 - DNA, 13 bp, Homo sapiens
ctgcctccctggg

SEQ ID NO: 1657928 - DNA, 21 bp, Homo sapiens
ctgcctcccttgtggcagcaa

SEQ ID NO: 1657929 - DNA, 20 bp, Homo sapiens
ctgcctccgggcaggcaagg

SEQ ID NO: 1657930 - DNA, 12 bp, Homo sapiens
ctgcctcctgcc

SEQ ID NO: 1657931 - DNA, 13 bp, Homo sapiens
ctgcctcctgcca

SEQ ID NO: 1657932 - DNA, 16 bp, Homo sapiens
ctgcctcctgcctgcc

SEQ ID NO: 1657933 - DNA, 12 bp, Homo sapiens
ctgcctcctggc

SEQ ID NO: 1657934 - DNA, 14 bp, Homo sapiens
ctgcctcctggctc

SEQ ID NO: 1657935 - DNA, 18 bp, Homo sapiens
ctgcctcctggctcaggc

SEQ ID NO: 1657936 - DNA, 15 bp, Homo sapiens
ctgcctcggactcca

SEQ ID NO: 1657937 - DNA, 18 bp, Homo sapiens
ctgcctcggactccatgg

SEQ ID NO: 1657938 - DNA, 22 bp, Homo sapiens
ctgcctctagtccccaaggcct

SEQ ID NO: 1657939 - DNA, 19 bp, Homo sapiens
ctgcctctcattggcacca

SEQ ID NO: 1657940 - DNA, 23 bp, Homo sapiens
ctgcctctcccatcacttcccta

SEQ ID NO: 1657941 - DNA, 19 bp, Homo sapiens
ctgcctctccctggccctc

SEQ ID NO: 1657942 - DNA, 15 bp, Homo sapiens
ctgcctctcctccac

SEQ ID NO: 1657943 - DNA, 19 bp, Homo sapiens
ctgcctctgaaaatatttt

SEQ ID NO: 1657944 - DNA, 18 bp, Homo sapiens
ctgcctctgcctgcattc

SEQ ID NO: 1657945 - DNA, 20 bp, Homo sapiens
ctgcctctgcctgcattctg

SEQ ID NO: 1657946 - DNA, 21 bp, Homo sapiens
ctgcctctgtgtagccgccct

SEQ ID NO: 1657947 - DNA, 14 bp, Homo sapiens
ctgcctctttccct

SEQ ID NO: 1657948 - DNA, 17 bp, Homo sapiens
ctgcctgaaccttccat

SEQ ID NO: 1657949 - DNA, 16 bp, Homo sapiens
ctgcctgagattcttt

SEQ ID NO: 1657950 - DNA, 22 bp, Homo sapiens
ctgcctgagattctttaaggag

SEQ ID NO: 1657951 - DNA, 21 bp, Homo sapiens
ctgcctgagcacctcccagcc

SEQ ID NO: 1657952 - DNA, 11 bp, Homo sapiens
ctgcctgagga

SEQ ID NO: 1657953 - DNA, 12 bp, Homo sapiens
ctgcctgaggag

SEQ ID NO: 1657954 - DNA, 13 bp, Homo sapiens
ctgcctgatccct

SEQ ID NO: 1657955 - DNA, 17 bp, Homo sapiens
ctgcctgatccctgaac

SEQ ID NO: 1657956 - DNA, 19 bp, Homo sapiens
ctgcctgatccctgaaccc

SEQ ID NO: 1657957 - DNA, 17 bp, Homo sapiens
ctgcctgcaatatttga

SEQ ID NO: 1657958 - DNA, 19 bp, Homo sapiens
ctgcctgcaatatttgaat

SEQ ID NO: 1657959 - DNA, 20 bp, Homo sapiens
ctgcctgcaatatttgaatt

SEQ ID NO: 1657960 - DNA, 14 bp, Homo sapiens
ctgcctgcactccc

SEQ ID NO: 1657961 - DNA, 18 bp, Homo sapiens
ctgcctgcactccctggc

SEQ ID NO: 1657962 - DNA, 14 bp, Homo sapiens
ctgcctgcagagca

SEQ ID NO: 1657963 - DNA, 23 bp, Homo sapiens
ctgcctgcagaggtctgtgctga

SEQ ID NO: 1657964 - DNA, 12 bp, Homo sapiens
ctgcctgcagca

SEQ ID NO: 1657965 - DNA, 15 bp, Homo sapiens
ctgcctgcagcacat

SEQ ID NO: 1657966 - DNA, 17 bp, Homo sapiens
ctgcctgcagcacatgc

SEQ ID NO: 1657967 - DNA, 16 bp, Homo sapiens
ctgcctgcatctattc

SEQ ID NO: 1657968 - DNA, 15 bp, Homo sapiens
ctgcctgcatgagct

SEQ ID NO: 1657969 - DNA, 18 bp, Homo sapiens
ctgcctgcatgagctggc

SEQ ID NO: 1657970 - DNA, 21 bp, Homo sapiens
ctgcctgcatgagctggcaac

SEQ ID NO: 1657971 - DNA, 22 bp, Homo sapiens
ctgcctgcatgagctggcaacc

SEQ ID NO: 1657972 - DNA, 16 bp, Homo sapiens
ctgcctgccagctgca

SEQ ID NO: 1657973 - DNA, 13 bp, Homo sapiens
ctgcctgcccact

SEQ ID NO: 1657974 - DNA, 22 bp, Homo sapiens
ctgcctgccccgcccccagtcc

SEQ ID NO: 1657975 - DNA, 17 bp, Homo sapiens
ctgcctgccgcccaaag

SEQ ID NO: 1657976 - DNA, 14 bp, Homo sapiens
ctgcctgcggccca

SEQ ID NO: 1657977 - DNA, 15 bp, Homo sapiens
ctgcctgctcatggc

SEQ ID NO: 1657978 - DNA, 20 bp, Homo sapiens
ctgcctgctcatggccctcg

SEQ ID NO: 1657979 - DNA, 18 bp, Homo sapiens
ctgcctgcttggcccggc

SEQ ID NO: 1657980 - DNA, 13 bp, Homo sapiens
ctgcctgctttgg

SEQ ID NO: 1657981 - DNA, 22 bp, Homo sapiens
ctgcctggagtgtcggatcctg

SEQ ID NO: 1657982 - DNA, 18 bp, Homo sapiens
ctgcctggatgagaaaca

SEQ ID NO: 1657983 - DNA, 11 bp, Homo sapiens
ctgcctggcca

SEQ ID NO: 1657984 - DNA, 16 bp, Homo sapiens
ctgcctggccaggcag

SEQ ID NO: 1657985 - DNA, 15 bp, Homo sapiens
ctgcctggccaggcc

SEQ ID NO: 1657986 - DNA, 18 bp, Homo sapiens
ctgcctggccaggccctg

SEQ ID NO: 1657987 - DNA, 12 bp, Homo sapiens
ctgcctggcccc

SEQ ID NO: 1657988 - DNA, 15 bp, Homo sapiens
ctgcctggcccccaa

SEQ ID NO: 1657989 - DNA, 22 bp, Homo sapiens
ctgcctggcccccaacctcagg

SEQ ID NO: 1657990 - DNA, 16 bp, Homo sapiens
ctgctgaatgcaggga

SEQ ID NO: 1657991 - DNA, 23 bp, Homo sapiens
ctgctgaccaattgtgctgccat

SEQ ID NO: 1657992 - DNA, 20 bp, Homo sapiens
ctgctgacctcactgtcctg

SEQ ID NO: 1657993 - DNA, 11 bp, Homo sapiens
ctgctgagcca

SEQ ID NO: 1657994 - DNA, 12 bp, Homo sapiens
ctgctgagccac

SEQ ID NO: 1657995 - DNA, 13 bp, Homo sapiens
ctgctgagccact

SEQ ID NO: 1657996 - DNA, 17 bp, Homo sapiens
ctgctgagccactcgca

SEQ ID NO: 1657997 - DNA, 11 bp, Homo sapiens
ctgctgaggcc

SEQ ID NO: 1657998 - DNA, 18 bp, Homo sapiens
ctgctgagggaccagcca

SEQ ID NO: 1657999 - DNA, 15 bp, Homo sapiens
ctgctgagggtctgg

SEQ ID NO: 1658000 - DNA, 17 bp, Homo sapiens
ctgctgagttggcctgg

SEQ ID NO: 1658001 - DNA, 17 bp, Homo sapiens
ctgctgatatcaacagc

SEQ ID NO: 1658002 - DNA, 14 bp, Homo sapiens
ctgctgatgcagcc

SEQ ID NO: 1658003 - DNA, 18 bp, Homo sapiens
ctgctgattcttgtaaat

SEQ ID NO: 1658004 - DNA, 17 bp, Homo sapiens
ctgctgcacaggccctg

SEQ ID NO: 1658005 - DNA, 19 bp, Homo sapiens
ctgctgcacaggccctggg

SEQ ID NO: 1658006 - DNA, 13 bp, Homo sapiens
ctgctgcaccctg

SEQ ID NO: 1658007 - DNA, 14 bp, Homo sapiens
ctgctgcaccctgc

SEQ ID NO: 1658008 - DNA, 23 bp, Homo sapiens
ctgctgcaccctgcgcctccaga

SEQ ID NO: 1658009 - DNA, 20 bp, Homo sapiens
ctgctgcagattagttcttt

SEQ ID NO: 1658010 - DNA, 23 bp, Homo sapiens
ctgctgcagattagttctttttg

SEQ ID NO: 1658011 - DNA, 14 bp, Homo sapiens
ctgctgccagcaca

SEQ ID NO: 1658012 - DNA, 14 bp, Homo sapiens
ctgctgccagtgca

SEQ ID NO: 1658013 - DNA, 19 bp, Homo sapiens
ctgctgccagtgcagccac

SEQ ID NO: 1658014 - DNA, 15 bp, Homo sapiens
ctgctgccatccatg

SEQ ID NO: 1658015 - DNA, 16 bp, Homo sapiens
ctgctgccatccatgt

SEQ ID NO: 1658016 - DNA, 18 bp, Homo sapiens
ctgctgccatccatgtgc

SEQ ID NO: 1658017 - DNA, 22 bp, Homo sapiens
ctgctgcccccaccccggggac

SEQ ID NO: 1658018 - DNA, 15 bp, Homo sapiens
ctgctgcccctgcag

SEQ ID NO: 1658019 - DNA, 11 bp, Homo sapiens
ctgctgccctc

SEQ ID NO: 1658020 - DNA, 16 bp, Homo sapiens
ctgctgccctcccaca

SEQ ID NO: 1658021 - DNA, 21 bp, Homo sapiens
ctgctgccggctctgggcctg

SEQ ID NO: 1658022 - DNA, 23 bp, Homo sapiens
ctgctgccggctctgggcctgag

SEQ ID NO: 1658023 - DNA, 12 bp, Homo sapiens
ctgctgcctctt

SEQ ID NO: 1658024 - DNA, 17 bp, Homo sapiens
ctgctgcgcccttacct

SEQ ID NO: 1658025 - DNA, 20 bp, Homo sapiens
ctgctgcgcccttaccttcc

SEQ ID NO: 1658026 - DNA, 17 bp, Homo sapiens
ctgctgcggaggagctg

SEQ ID NO: 1658027 - DNA, 13 bp, Homo sapiens
ctgctgcggctgt

SEQ ID NO: 1658028 - DNA, 18 bp, Homo sapiens
ctgctgcgtccccactcc

SEQ ID NO: 1658029 - DNA, 19 bp, Homo sapiens
ctgctgcgtccccactccc

SEQ ID NO: 1658030 - DNA, 16 bp, Homo sapiens
ctgctgctacaatgtc

SEQ ID NO: 1658031 - DNA, 16 bp, Homo sapiens
ctgctgctgccgccgc

SEQ ID NO: 1658032 - DNA, 13 bp, Homo sapiens
ctgctgctggaga

SEQ ID NO: 1658033 - DNA, 20 bp, Homo sapiens
ctgctgctgtaactgctgag

SEQ ID NO: 1658034 - DNA, 13 bp, Homo sapiens
ctgctggaagccc

SEQ ID NO: 1658035 - DNA, 14 bp, Homo sapiens
ctgctggaagccca

SEQ ID NO: 1658036 - DNA, 18 bp, Homo sapiens
ctgctggaaggggcagca

SEQ ID NO: 1658037 - DNA, 20 bp, Homo sapiens
ctgctggaaggggcagcagg

SEQ ID NO: 1658038 - DNA, 13 bp, Homo sapiens
ctgctggatattt

SEQ ID NO: 1658039 - DNA, 16 bp, Homo sapiens
ctgctggatcttgcct

SEQ ID NO: 1658040 - DNA, 16 bp, Homo sapiens
ctgctggcacccaccg

SEQ ID NO: 1658041 - DNA, 22 bp, Homo sapiens
ctgctggcaggattcttcccgc

SEQ ID NO: 1658042 - DNA, 20 bp, Homo sapiens
ctgctggccaaatagcaaag

SEQ ID NO: 1658043 - DNA, 15 bp, Homo sapiens
ctgctggcccagcca

SEQ ID NO: 1658044 - DNA, 14 bp, Homo sapiens
ctgctggcctggat

SEQ ID NO: 1658045 - DNA, 14 bp, Homo sapiens
ctgctggctgcggc

SEQ ID NO: 1658046 - DNA, 19 bp, Homo sapiens
ctgctgggaaccccgcagc

SEQ ID NO: 1658047 - DNA, 20 bp, Homo sapiens
ctgctgggaaccccgcagcc

SEQ ID NO: 1658048 - DNA, 16 bp, Homo sapiens
ctgctgggaagagctc

SEQ ID NO: 1658049 - DNA, 22 bp, Homo sapiens
ctgctgggacccacctccccct

SEQ ID NO: 1658050 - DNA, 17 bp, Homo sapiens
ctgctgggctctccacc

SEQ ID NO: 1658051 - DNA, 18 bp, Homo sapiens
ctgctggggaagacagtg

SEQ ID NO: 1658052 - DNA, 20 bp, Homo sapiens
ctgctggggaagacagtggc

SEQ ID NO: 1658053 - DNA, 21 bp, Homo sapiens
ctgctggggaagggttttctt

SEQ ID NO: 1658054 - DNA, 14 bp, Homo sapiens
ctgctggggagtcc

SEQ ID NO: 1658055 - DNA, 13 bp, Homo sapiens
ctgctggggatcc

SEQ ID NO: 1658056 - DNA, 21 bp, Homo sapiens
ctgctggggatccccgcctgg

SEQ ID NO: 1658057 - DNA, 12 bp, Homo sapiens
ctgctggggcat

SEQ ID NO: 1658058 - DNA, 15 bp, Homo sapiens
ctgctggggcatgtg

SEQ ID NO: 1658059 - DNA, 19 bp, Homo sapiens
ctgctggggcatgtgtgcc

SEQ ID NO: 1658060 - DNA, 23 bp, Homo sapiens
ctgctggggcatgtgtgcctgtg

SEQ ID NO: 1658061 - DNA, 19 bp, Homo sapiens
ctgctggggccgccacggc

SEQ ID NO: 1658062 - DNA, 16 bp, Homo sapiens
ctgctggtacctgccc

SEQ ID NO: 1658063 - DNA, 18 bp, Homo sapiens
ctgctgtaactgctgagc

SEQ ID NO: 1658064 - DNA, 15 bp, Homo sapiens
ctgctgtatttcctg

SEQ ID NO: 1658065 - DNA, 22 bp, Homo sapiens
ctgctgtatttcctgcttccct

SEQ ID NO: 1658066 - DNA, 17 bp, Homo sapiens
ctgctgtccctccccct

SEQ ID NO: 1658067 - DNA, 20 bp, Homo sapiens
ctgctgtccctcccccttgt

SEQ ID NO: 1658068 - DNA, 17 bp, Homo sapiens
ctgctgtctctctgggc

SEQ ID NO: 1658069 - DNA, 11 bp, Homo sapiens
ctgctgtgcaa

SEQ ID NO: 1658070 - DNA, 21 bp, Homo sapiens
ctgctgtgccccaccacgtct

SEQ ID NO: 1658071 - DNA, 18 bp, Homo sapiens
ctgctgtgttaagaggac

SEQ ID NO: 1658072 - DNA, 23 bp, Homo sapiens
ctgctgttggtcctctctctgtg

SEQ ID NO: 1658073 - DNA, 12 bp, Homo sapiens
ctgctgttttat

SEQ ID NO: 1658074 - DNA, 14 bp, Homo sapiens
ctgctgttttatgt

SEQ ID NO: 1658075 - DNA, 16 bp, Homo sapiens
ctgcttaaactggaaa

SEQ ID NO: 1658076 - DNA, 17 bp, Homo sapiens
ctgcttaaactggaaag

SEQ ID NO: 1658077 - DNA, 15 bp, Homo sapiens
ctgcttaaagcttcc

SEQ ID NO: 1658078 - DNA, 21 bp, Homo sapiens
ctgcttaaagcttccctctca

SEQ ID NO: 1658079 - DNA, 22 bp, Homo sapiens
ctgcttaatcttcaaagccttc

SEQ ID NO: 1658080 - DNA, 14 bp, Homo sapiens
ctgcttacccttca

SEQ ID NO: 1658081 - DNA, 19 bp, Homo sapiens
ctgcttagcttgcaccttg

SEQ ID NO: 1658082 - DNA, 19 bp, Homo sapiens
ctgcttcaaggcttccact

SEQ ID NO: 1658083 - DNA, 21 bp, Homo sapiens
ctgcttcagtgtatggaaata

SEQ ID NO: 1658084 - DNA, 22 bp, Homo sapiens
ctgcttccaaaagtgatagtgt

SEQ ID NO: 1658085 - DNA, 24 bp, Homo sapiens
ctgcttccaattttctggaataca

SEQ ID NO: 1658086 - DNA, 15 bp, Homo sapiens
ctgcttccaggctgg

SEQ ID NO: 1658087 - DNA, 15 bp, Homo sapiens
ctgcttcccactggg

SEQ ID NO: 1658088 - DNA, 17 bp, Homo sapiens
ctgcttcccagaggagc

SEQ ID NO: 1658089 - DNA, 11 bp, Homo sapiens
ctgcttcccat

SEQ ID NO: 1658090 - DNA, 12 bp, Homo sapiens
ctgcttcccatc

SEQ ID NO: 1658091 - DNA, 14 bp, Homo sapiens
ctgcttcccatcct

SEQ ID NO: 1658092 - DNA, 15 bp, Homo sapiens
ctgcttcccatccta

SEQ ID NO: 1658093 - DNA, 18 bp, Homo sapiens
ctgcttcccatcctaccc

SEQ ID NO: 1658094 - DNA, 16 bp, Homo sapiens
ctgcttcctcctggaa

SEQ ID NO: 1658095 - DNA, 12 bp, Homo sapiens
ctgcttcctgct

SEQ ID NO: 1658096 - DNA, 15 bp, Homo sapiens
ctgcttcctgcttgc

SEQ ID NO: 1658097 - DNA, 16 bp, Homo sapiens
ctgcttctccaaggaa

SEQ ID NO: 1658098 - DNA, 22 bp, Homo sapiens
ctgcttctcggggtccagtgca

SEQ ID NO: 1658099 - DNA, 23 bp, Homo sapiens
ctgcttctcggggtccagtgcat

SEQ ID NO: 1658100 - DNA, 13 bp, Homo sapiens
ctgcttctctgac

SEQ ID NO: 1658101 - DNA, 17 bp, Homo sapiens
ctgcttctctgacttct

SEQ ID NO: 1658102 - DNA, 20 bp, Homo sapiens
ctgcttctgaactcaagctg

SEQ ID NO: 1658103 - DNA, 11 bp, Homo sapiens
ctgcttctgct

SEQ ID NO: 1658104 - DNA, 13 bp, Homo sapiens
ctgcttctgctgc

SEQ ID NO: 1658105 - DNA, 18 bp, Homo sapiens
ctggaattccacagggac

SEQ ID NO: 1658106 - DNA, 15 bp, Homo sapiens
ctggacaagccaact

SEQ ID NO: 1658107 - DNA, 21 bp, Homo sapiens
ctggacaagccaacttgtaaa

SEQ ID NO: 1658108 - DNA, 23 bp, Homo sapiens
ctggacaagccaacttgtaaata

SEQ ID NO: 1658109 - DNA, 10 bp, Homo sapiens
ctggacacag

SEQ ID NO: 1658110 - DNA, 16 bp, Homo sapiens
ctggacacagctcttc

SEQ ID NO: 1658111 - DNA, 17 bp, Homo sapiens
ctggacacagctcttca

SEQ ID NO: 1658112 - DNA, 15 bp, Homo sapiens
ctggacaccctctgc

SEQ ID NO: 1658113 - DNA, 17 bp, Homo sapiens
ctggacaccctctgccg

SEQ ID NO: 1658114 - DNA, 20 bp, Homo sapiens
ctggacactagggtcaggcg

SEQ ID NO: 1658115 - DNA, 12 bp, Homo sapiens
ctggacagacag

SEQ ID NO: 1658116 - DNA, 15 bp, Homo sapiens
ctggacagccccacc

SEQ ID NO: 1658117 - DNA, 18 bp, Homo sapiens
ctggacagccccaccctg

SEQ ID NO: 1658118 - DNA, 19 bp, Homo sapiens
ctggacagccccaccctgg

SEQ ID NO: 1658119 - DNA, 12 bp, Homo sapiens
ctggacagctta

SEQ ID NO: 1658120 - DNA, 21 bp, Homo sapiens
ctggacagctttgctccgctc

SEQ ID NO: 1658121 - DNA, 15 bp, Homo sapiens
ctggacaggcagcct

SEQ ID NO: 1658122 - DNA, 15 bp, Homo sapiens
ctggacaggctctgc

SEQ ID NO: 1658123 - DNA, 16 bp, Homo sapiens
ctggacatcaccagtc

SEQ ID NO: 1658124 - DNA, 18 bp, Homo sapiens
ctggacatcaccagtcct

SEQ ID NO: 1658125 - DNA, 20 bp, Homo sapiens
ctggacatgagatggagagg

SEQ ID NO: 1658126 - DNA, 15 bp, Homo sapiens
ctggacattctcttt

SEQ ID NO: 1658127 - DNA, 19 bp, Homo sapiens
ctggacattctctttgata

SEQ ID NO: 1658128 - DNA, 22 bp, Homo sapiens
ctggacattctctttgataaca

SEQ ID NO: 1658129 - DNA, 15 bp, Homo sapiens
ctggaccagcctcct

SEQ ID NO: 1658130 - DNA, 13 bp, Homo sapiens
ctggaccaggtcc

SEQ ID NO: 1658131 - DNA, 14 bp, Homo sapiens
ctggaccaggtcct

SEQ ID NO: 1658132 - DNA, 15 bp, Homo sapiens
ctggaccaggtcctg

SEQ ID NO: 1658133 - DNA, 16 bp, Homo sapiens
ctggacccttataaaa

SEQ ID NO: 1658134 - DNA, 21 bp, Homo sapiens
ctggaccgctgactgcaccag

SEQ ID NO: 1658135 - DNA, 12 bp, Homo sapiens
ctggacctgagt

SEQ ID NO: 1658136 - DNA, 15 bp, Homo sapiens
ctggacctgagtcgg

SEQ ID NO: 1658137 - DNA, 15 bp, Homo sapiens
ctggacctgcctcct

SEQ ID NO: 1658138 - DNA, 20 bp, Homo sapiens
ctggacctgcctcctgcctg

SEQ ID NO: 1658139 - DNA, 13 bp, Homo sapiens
ctggaccttgaca

SEQ ID NO: 1658140 - DNA, 16 bp, Homo sapiens
ctggaccttgacagag

SEQ ID NO: 1658141 - DNA, 17 bp, Homo sapiens
ctggaccttgacagagc

SEQ ID NO: 1658142 - DNA, 20 bp, Homo sapiens
ctggaccttgacagagcagc

SEQ ID NO: 1658143 - DNA, 19 bp, Homo sapiens
ctggaccttttcccttgct

SEQ ID NO: 1658144 - DNA, 23 bp, Homo sapiens
ctggaccttttcccttgctgtac

SEQ ID NO: 1658145 - DNA, 20 bp, Homo sapiens
ctggacgaagagcaggccag

SEQ ID NO: 1658146 - DNA, 13 bp, Homo sapiens
ctggacggcaggc

SEQ ID NO: 1658147 - DNA, 17 bp, Homo sapiens
ctggacggcattcctgc

SEQ ID NO: 1658148 - DNA, 20 bp, Homo sapiens
ctggacggcattcctgctta

SEQ ID NO: 1658149 - DNA, 18 bp, Homo sapiens
ctggactaaaggcatcct

SEQ ID NO: 1658150 - DNA, 22 bp, Homo sapiens
ctggactaaaggcatccttgtc

SEQ ID NO: 1658151 - DNA, 19 bp, Homo sapiens
ctggactacacccaagcct

SEQ ID NO: 1658152 - DNA, 16 bp, Homo sapiens
ctggactattgtgcca

SEQ ID NO: 1658153 - DNA, 20 bp, Homo sapiens
ctggactcaggatgcccagg

SEQ ID NO: 1658154 - DNA, 18 bp, Homo sapiens
ctggactcccctccctgc

SEQ ID NO: 1658155 - DNA, 15 bp, Homo sapiens
ctggactccctcaag

SEQ ID NO: 1658156 - DNA, 21 bp, Homo sapiens
ctggactctccgttaatctct

SEQ ID NO: 1658157 - DNA, 13 bp, Homo sapiens
ctggactctgccc

SEQ ID NO: 1658158 - DNA, 22 bp, Homo sapiens
ctggactgaagcctgcaggagt

SEQ ID NO: 1658159 - DNA, 14 bp, Homo sapiens
ctggactgaccaaa

SEQ ID NO: 1658160 - DNA, 19 bp, Homo sapiens
ctggactgaccaaagactg

SEQ ID NO: 1658161 - DNA, 21 bp, Homo sapiens
ctggactgaccaaagactgca

SEQ ID NO: 1658162 - DNA, 14 bp, Homo sapiens
ctggactgaccaca

SEQ ID NO: 1658163 - DNA, 12 bp, Homo sapiens
ctggactggcca

SEQ ID NO: 1658164 - DNA, 20 bp, Homo sapiens
ctggactggcctgtctggcc

SEQ ID NO: 1658165 - DNA, 21 bp, Homo sapiens
ctggactggctagagtcctca

SEQ ID NO: 1658166 - DNA, 21 bp, Homo sapiens
ctggactggtggcccctgcct

SEQ ID NO: 1658167 - DNA, 16 bp, Homo sapiens
ctggactgtggagggt

SEQ ID NO: 1658168 - DNA, 21 bp, Homo sapiens
ctggactgttactgacttgga

SEQ ID NO: 1658169 - DNA, 23 bp, Homo sapiens
ctggactgttactgacttggatc

SEQ ID NO: 1658170 - DNA, 18 bp, Homo sapiens
ctggacttaagcatctgg

SEQ ID NO: 1658171 - DNA, 18 bp, Homo sapiens
ctggacttcctataatac

SEQ ID NO: 1658172 - DNA, 12 bp, Homo sapiens
ctggacttcctg

SEQ ID NO: 1658173 - DNA, 13 bp, Homo sapiens
ctggacttcctgt

SEQ ID NO: 1658174 - DNA, 15 bp, Homo sapiens
ctggacttctacctg

SEQ ID NO: 1658175 - DNA, 18 bp, Homo sapiens
ctggacttctacctgccc

SEQ ID NO: 1658176 - DNA, 19 bp, Homo sapiens
ctggacttctacctgccct

SEQ ID NO: 1658177 - DNA, 15 bp, Homo sapiens
ctggacttgagcttg

SEQ ID NO: 1658178 - DNA, 13 bp, Homo sapiens
ctggactttcctg

SEQ ID NO: 1658179 - DNA, 15 bp, Homo sapiens
ctggactttcctgca

SEQ ID NO: 1658180 - DNA, 16 bp, Homo sapiens
ctggagaaagagctgc

SEQ ID NO: 1658181 - DNA, 20 bp, Homo sapiens
ctggagaaagagctgcctgg

SEQ ID NO: 1658182 - DNA, 22 bp, Homo sapiens
ctggagaaagagctgcctggat

SEQ ID NO: 1658183 - DNA, 19 bp, Homo sapiens
ctggagaagaccctccccg

SEQ ID NO: 1658184 - DNA, 14 bp, Homo sapiens
ctggagaagcagtg

SEQ ID NO: 1658185 - DNA, 21 bp, Homo sapiens
ctggagaagcagtgagccgca

SEQ ID NO: 1658186 - DNA, 18 bp, Homo sapiens
ctggagaattgactgaag

SEQ ID NO: 1658187 - DNA, 17 bp, Homo sapiens
ctggagacaaggtgcta

SEQ ID NO: 1658188 - DNA, 18 bp, Homo sapiens
ctggagacaaggtgctaa

SEQ ID NO: 1658189 - DNA, 13 bp, Homo sapiens
ctggagaccacac

SEQ ID NO: 1658190 - DNA, 17 bp, Homo sapiens
ctggagaccagggagcc

SEQ ID NO: 1658191 - DNA, 22 bp, Homo sapiens
ctggagaccgcttcacccctgc

SEQ ID NO: 1658192 - DNA, 13 bp, Homo sapiens
ctggagagctgct

SEQ ID NO: 1658193 - DNA, 21 bp, Homo sapiens
ctggagaggttataggtcact

SEQ ID NO: 1658194 - DNA, 18 bp, Homo sapiens
ctggagatcctcctgcag

SEQ ID NO: 1658195 - DNA, 23 bp, Homo sapiens
ctggagatcctcctgcagaccac

SEQ ID NO: 1658196 - DNA, 14 bp, Homo sapiens
ctggagatgcagct

SEQ ID NO: 1658197 - DNA, 21 bp, Homo sapiens
ctggagatgcagctactggaa

SEQ ID NO: 1658198 - DNA, 22 bp, Homo sapiens
ctggagatggaagcttgttgaa

SEQ ID NO: 1658199 - DNA, 23 bp, Homo sapiens
ctggagattgtgctctgcagcga

SEQ ID NO: 1658200 - DNA, 14 bp, Homo sapiens
ctggagcaagaagg

SEQ ID NO: 1658201 - DNA, 15 bp, Homo sapiens
ctggagcaccaggtg

SEQ ID NO: 1658202 - DNA, 22 bp, Homo sapiens
ctggagcagaccaccccgcctg

SEQ ID NO: 1658203 - DNA, 20 bp, Homo sapiens
ctggagcagccaaggccgcc

SEQ ID NO: 1658204 - DNA, 23 bp, Homo sapiens
ctggagcagccaaggccgccagc

SEQ ID NO: 1658205 - DNA, 14 bp, Homo sapiens
ctggagcaggagcc

SEQ ID NO: 1658206 - DNA, 17 bp, Homo sapiens
ctggagcaggagccccg

SEQ ID NO: 1658207 - DNA, 17 bp, Homo sapiens
ctggagcatggacagtg

SEQ ID NO: 1658208 - DNA, 14 bp, Homo sapiens
ctggagccagcagg

SEQ ID NO: 1658209 - DNA, 16 bp, Homo sapiens
ctggagccagcagggc

SEQ ID NO: 1658210 - DNA, 17 bp, Homo sapiens
ctggagccagcagggct

SEQ ID NO: 1658211 - DNA, 13 bp, Homo sapiens
ctggagccagggc

SEQ ID NO: 1658212 - DNA, 13 bp, Homo sapiens
ctggagccatccc

SEQ ID NO: 1658213 - DNA, 23 bp, Homo sapiens
ctggagccatcccttcggagcca

SEQ ID NO: 1658214 - DNA, 21 bp, Homo sapiens
ctggagcccagaggagggcag

SEQ ID NO: 1658215 - DNA, 23 bp, Homo sapiens
ctggagcccagaggagggcagca

SEQ ID NO: 1658216 - DNA, 12 bp, Homo sapiens
ctggagcccagg

SEQ ID NO: 1658217 - DNA, 15 bp, Homo sapiens
ctggagcccaggagt

SEQ ID NO: 1658218 - DNA, 13 bp, Homo sapiens
ctggagccccatc

SEQ ID NO: 1658219 - DNA, 16 bp, Homo sapiens
ctggagcccctcctcc

SEQ ID NO: 1658220 - DNA, 13 bp, Homo sapiens
ctggcacactccc

SEQ ID NO: 1658221 - DNA, 16 bp, Homo sapiens
ctggcacagaaacctc

SEQ ID NO: 1658222 - DNA, 12 bp, Homo sapiens
ctggcacagagg

SEQ ID NO: 1658223 - DNA, 22 bp, Homo sapiens
ctggcacaggactgattctggg

SEQ ID NO: 1658224 - DNA, 16 bp, Homo sapiens
ctggcacagggcagtg

SEQ ID NO: 1658225 - DNA, 17 bp, Homo sapiens
ctggcacagggcagtgg

SEQ ID NO: 1658226 - DNA, 20 bp, Homo sapiens
ctggcacagttttctgagaa

SEQ ID NO: 1658227 - DNA, 22 bp, Homo sapiens
ctggcacagttttctgagaaag

SEQ ID NO: 1658228 - DNA, 14 bp, Homo sapiens
ctggcacatcagaa

SEQ ID NO: 1658229 - DNA, 17 bp, Homo sapiens
ctggcacccccacaagc

SEQ ID NO: 1658230 - DNA, 12 bp, Homo sapiens
ctggcacgccct

SEQ ID NO: 1658231 - DNA, 15 bp, Homo sapiens
ctggcacgccctact

SEQ ID NO: 1658232 - DNA, 21 bp, Homo sapiens
ctggcacgccctactccactg

SEQ ID NO: 1658233 - DNA, 22 bp, Homo sapiens
ctggcactataatgtaagctct

SEQ ID NO: 1658234 - DNA, 19 bp, Homo sapiens
ctggcactcttgttcccac

SEQ ID NO: 1658235 - DNA, 12 bp, Homo sapiens
ctggcacttttt

SEQ ID NO: 1658236 - DNA, 23 bp, Homo sapiens
ctggcagaaagcaaatgtgacct

SEQ ID NO: 1658237 - DNA, 18 bp, Homo sapiens
ctggcagaagcattgcct

SEQ ID NO: 1658238 - DNA, 22 bp, Homo sapiens
ctggcagaagcattgcctggac

SEQ ID NO: 1658239 - DNA, 13 bp, Homo sapiens
ctggcagacacaa

SEQ ID NO: 1658240 - DNA, 12 bp, Homo sapiens
ctggcagcccag

SEQ ID NO: 1658241 - DNA, 16 bp, Homo sapiens
ctggcagcccagagac

SEQ ID NO: 1658242 - DNA, 18 bp, Homo sapiens
ctggcagccgtgccttca

SEQ ID NO: 1658243 - DNA, 19 bp, Homo sapiens
ctggcagcctgcacctggt

SEQ ID NO: 1658244 - DNA, 24 bp, Homo sapiens
ctggcagctcctctccttgggctc

SEQ ID NO: 1658245 - DNA, 19 bp, Homo sapiens
ctggcagctgagagccctg

SEQ ID NO: 1658246 - DNA, 20 bp, Homo sapiens
ctggcagctgagagccctgc

SEQ ID NO: 1658247 - DNA, 21 bp, Homo sapiens
ctggcagctgagagccctgct

SEQ ID NO: 1658248 - DNA, 20 bp, Homo sapiens
ctggcaggatgaccctgcga

SEQ ID NO: 1658249 - DNA, 20 bp, Homo sapiens
ctggcaggattcttcccgct

SEQ ID NO: 1658250 - DNA, 21 bp, Homo sapiens
ctggcaggattcttcccgctc

SEQ ID NO: 1658251 - DNA, 19 bp, Homo sapiens
ctggcaggcagttctagaa

SEQ ID NO: 1658252 - DNA, 16 bp, Homo sapiens
ctggcagggacctgag

SEQ ID NO: 1658253 - DNA, 23 bp, Homo sapiens
ctggcaggggagacaggagccta

SEQ ID NO: 1658254 - DNA, 12 bp, Homo sapiens
ctggcaggtgca

SEQ ID NO: 1658255 - DNA, 23 bp, Homo sapiens
ctggcaggtgcagatgggctgtt

SEQ ID NO: 1658256 - DNA, 20 bp, Homo sapiens
ctggcaggtgttgggacctg

SEQ ID NO: 1658257 - DNA, 16 bp, Homo sapiens
ctggcagtccgtggga

SEQ ID NO: 1658258 - DNA, 19 bp, Homo sapiens
ctggcagtccgtgggacgg

SEQ ID NO: 1658259 - DNA, 17 bp, Homo sapiens
ctggcatagccctcctg

SEQ ID NO: 1658260 - DNA, 21 bp, Homo sapiens
ctggcatagccctcctgagca

SEQ ID NO: 1658261 - DNA, 22 bp, Homo sapiens
ctggcatcaagggagacaccag

SEQ ID NO: 1658262 - DNA, 17 bp, Homo sapiens
ctggcatcgcaccattc

SEQ ID NO: 1658263 - DNA, 21 bp, Homo sapiens
ctggcatctaattctgattct

SEQ ID NO: 1658264 - DNA, 17 bp, Homo sapiens
ctggcatctgacacaaa

SEQ ID NO: 1658265 - DNA, 17 bp, Homo sapiens
ctggcatctgctctaga

SEQ ID NO: 1658266 - DNA, 15 bp, Homo sapiens
ctggcatcttctgga

SEQ ID NO: 1658267 - DNA, 17 bp, Homo sapiens
ctggcatcttctggaga

SEQ ID NO: 1658268 - DNA, 18 bp, Homo sapiens
ctggcatcttctggagaa

SEQ ID NO: 1658269 - DNA, 15 bp, Homo sapiens
ctggcatggcacctg

SEQ ID NO: 1658270 - DNA, 17 bp, Homo sapiens
ctggcatggcacctgtc

SEQ ID NO: 1658271 - DNA, 19 bp, Homo sapiens
ctggcatggcacctgtcgc

SEQ ID NO: 1658272 - DNA, 14 bp, Homo sapiens
ctggcatgttttct

SEQ ID NO: 1658273 - DNA, 18 bp, Homo sapiens
ctggcatgttttctttgt

SEQ ID NO: 1658274 - DNA, 19 bp, Homo sapiens
ctggcattagaattattta

SEQ ID NO: 1658275 - DNA, 20 bp, Homo sapiens
ctggcattagaattatttaa

SEQ ID NO: 1658276 - DNA, 19 bp, Homo sapiens
ctggcattatgtccactgt

SEQ ID NO: 1658277 - DNA, 19 bp, Homo sapiens
ctggccaaagagcctttcc

SEQ ID NO: 1658278 - DNA, 23 bp, Homo sapiens
ctggccaaggtgtccagggtcct

SEQ ID NO: 1658279 - DNA, 15 bp, Homo sapiens
ctggccaccaggctg

SEQ ID NO: 1658280 - DNA, 18 bp, Homo sapiens
ctggccaccaggctggcg

SEQ ID NO: 1658281 - DNA, 13 bp, Homo sapiens
ctggccaccctgg

SEQ ID NO: 1658282 - DNA, 18 bp, Homo sapiens
ctggccacctctctcctt

SEQ ID NO: 1658283 - DNA, 15 bp, Homo sapiens
ctggccacctgaggt

SEQ ID NO: 1658284 - DNA, 19 bp, Homo sapiens
ctggccaccttgtcctggc

SEQ ID NO: 1658285 - DNA, 15 bp, Homo sapiens
ctggccactaaagct

SEQ ID NO: 1658286 - DNA, 19 bp, Homo sapiens
ctggccactaaagcttcag

SEQ ID NO: 1658287 - DNA, 21 bp, Homo sapiens
ctggccactaaagcttcagac

SEQ ID NO: 1658288 - DNA, 22 bp, Homo sapiens
ctggccactaaagcttcagact

SEQ ID NO: 1658289 - DNA, 18 bp, Homo sapiens
ctggccagacacaggccc

SEQ ID NO: 1658290 - DNA, 14 bp, Homo sapiens
ctggccagagaggg

SEQ ID NO: 1658291 - DNA, 18 bp, Homo sapiens
ctggccagagagggccca

SEQ ID NO: 1658292 - DNA, 15 bp, Homo sapiens
ctggccagctctgag

SEQ ID NO: 1658293 - DNA, 12 bp, Homo sapiens
ctggccaggagc

SEQ ID NO: 1658294 - DNA, 15 bp, Homo sapiens
ctggccaggagctct

SEQ ID NO: 1658295 - DNA, 22 bp, Homo sapiens
ctggccaggagctcttcaggcc

SEQ ID NO: 1658296 - DNA, 21 bp, Homo sapiens
ctggccaggcagatctgtgcc

SEQ ID NO: 1658297 - DNA, 22 bp, Homo sapiens
ctggccaggcagatctgtgccc

SEQ ID NO: 1658298 - DNA, 13 bp, Homo sapiens
ctggccagggcca

SEQ ID NO: 1658299 - DNA, 15 bp, Homo sapiens
ctggccaggggtcct

SEQ ID NO: 1658300 - DNA, 17 bp, Homo sapiens
ctggccagtccaggctg

SEQ ID NO: 1658301 - DNA, 23 bp, Homo sapiens
ctggccagtccaggctgccgtgg

SEQ ID NO: 1658302 - DNA, 13 bp, Homo sapiens
ctggccagtcctg

SEQ ID NO: 1658303 - DNA, 21 bp, Homo sapiens
ctggccagtcctggtcctggc

SEQ ID NO: 1658304 - DNA, 22 bp, Homo sapiens
ctggccagtcctggtcctggct

SEQ ID NO: 1658305 - DNA, 23 bp, Homo sapiens
ctggccagtcctggtcctggctg

SEQ ID NO: 1658306 - DNA, 20 bp, Homo sapiens
ctggccagtgctgcccatga

SEQ ID NO: 1658307 - DNA, 23 bp, Homo sapiens
ctggccagtgctgcccatgagca

SEQ ID NO: 1658308 - DNA, 22 bp, Homo sapiens
ctggccattcttatgttccaga

SEQ ID NO: 1658309 - DNA, 23 bp, Homo sapiens
ctggccattcttatgttccagat

SEQ ID NO: 1658310 - DNA, 16 bp, Homo sapiens
ctggccatttttctgg

SEQ ID NO: 1658311 - DNA, 14 bp, Homo sapiens
ctggcccaccaggg

SEQ ID NO: 1658312 - DNA, 16 bp, Homo sapiens
ctggcccacgccctcc

SEQ ID NO: 1658313 - DNA, 17 bp, Homo sapiens
ctggcccacgccctccc

SEQ ID NO: 1658314 - DNA, 22 bp, Homo sapiens
ctggcccacgccctccctctcc

SEQ ID NO: 1658315 - DNA, 16 bp, Homo sapiens
ctggcccactgctggc

SEQ ID NO: 1658316 - DNA, 17 bp, Homo sapiens
ctggcccactgctggct

SEQ ID NO: 1658317 - DNA, 12 bp, Homo sapiens
ctggcccagaaa

SEQ ID NO: 1658318 - DNA, 18 bp, Homo sapiens
ctggcccagaaagcctct

SEQ ID NO: 1658319 - DNA, 22 bp, Homo sapiens
ctggcccagaaagcctctctct

SEQ ID NO: 1658320 - DNA, 11 bp, Homo sapiens
ctggcccagcc

SEQ ID NO: 1658321 - DNA, 13 bp, Homo sapiens
ctggcccagccaa

SEQ ID NO: 1658322 - DNA, 20 bp, Homo sapiens
ctggcccagccaaaccctgt

SEQ ID NO: 1658323 - DNA, 12 bp, Homo sapiens
ctggcccagccg

SEQ ID NO: 1658324 - DNA, 19 bp, Homo sapiens
ctggcccagccggcctctc

SEQ ID NO: 1658325 - DNA, 23 bp, Homo sapiens
ctggcccagccggcctctctggc

SEQ ID NO: 1658326 - DNA, 17 bp, Homo sapiens
ctggcccagcggcccct

SEQ ID NO: 1658327 - DNA, 17 bp, Homo sapiens
ctggcccagggcccaga

SEQ ID NO: 1658328 - DNA, 22 bp, Homo sapiens
ctggcccagggcccagagccca

SEQ ID NO: 1658329 - DNA, 19 bp, Homo sapiens
ctggcccagggggcctgga

SEQ ID NO: 1658330 - DNA, 17 bp, Homo sapiens
ctggcccatagaaacat

SEQ ID NO: 1658331 - DNA, 23 bp, Homo sapiens
ctggcccatagaaacatgacact

SEQ ID NO: 1658332 - DNA, 14 bp, Homo sapiens
ctggccccagccct

SEQ ID NO: 1658333 - DNA, 15 bp, Homo sapiens
ctggccccagccctg

SEQ ID NO: 1658334 - DNA, 20 bp, Homo sapiens
ctgggaggcaagaggggtgg

SEQ ID NO: 1658335 - DNA, 22 bp, Homo sapiens
ctgggaggcaagaggggtggag

SEQ ID NO: 1658336 - DNA, 15 bp, Homo sapiens
ctgggaggcagaggt

SEQ ID NO: 1658337 - DNA, 22 bp, Homo sapiens
ctgggaggcagaggttgcagtg

SEQ ID NO: 1658338 - DNA, 15 bp, Homo sapiens
ctgggagggaggtgg

SEQ ID NO: 1658339 - DNA, 19 bp, Homo sapiens
ctgggagggaggtggtcct

SEQ ID NO: 1658340 - DNA, 15 bp, Homo sapiens
ctgggaggtagaagg

SEQ ID NO: 1658341 - DNA, 21 bp, Homo sapiens
ctgggagtagttgtctttcct

SEQ ID NO: 1658342 - DNA, 14 bp, Homo sapiens
ctgggagtcacaca

SEQ ID NO: 1658343 - DNA, 16 bp, Homo sapiens
ctgggagtgtgggctg

SEQ ID NO: 1658344 - DNA, 18 bp, Homo sapiens
ctgggagtgtgggctgcc

SEQ ID NO: 1658345 - DNA, 20 bp, Homo sapiens
ctgggatctgttttctggaa

SEQ ID NO: 1658346 - DNA, 22 bp, Homo sapiens
ctgggatctgttttctggaagt

SEQ ID NO: 1658347 - DNA, 22 bp, Homo sapiens
ctgggatgacaggcgcctgcca

SEQ ID NO: 1658348 - DNA, 16 bp, Homo sapiens
ctgggatgtagaactt

SEQ ID NO: 1658349 - DNA, 15 bp, Homo sapiens
ctgggatgtagagag

SEQ ID NO: 1658350 - DNA, 15 bp, Homo sapiens
ctgggatgtcacagt

SEQ ID NO: 1658351 - DNA, 17 bp, Homo sapiens
ctgggatgtcacagtcc

SEQ ID NO: 1658352 - DNA, 14 bp, Homo sapiens
ctgggatgtccaca

SEQ ID NO: 1658353 - DNA, 14 bp, Homo sapiens
ctgggattaagaaa

SEQ ID NO: 1658354 - DNA, 15 bp, Homo sapiens
ctgggattaagggca

SEQ ID NO: 1658355 - DNA, 16 bp, Homo sapiens
ctgggattaaggggat

SEQ ID NO: 1658356 - DNA, 22 bp, Homo sapiens
ctgggattatataggcatgagc

SEQ ID NO: 1658357 - DNA, 20 bp, Homo sapiens
ctgggcaaacagagctactg

SEQ ID NO: 1658358 - DNA, 13 bp, Homo sapiens
ctgggcaagagat

SEQ ID NO: 1658359 - DNA, 21 bp, Homo sapiens
ctgggcaaggtgggtgattcc

SEQ ID NO: 1658360 - DNA, 22 bp, Homo sapiens
ctgggcacagtgggcctgtgtg

SEQ ID NO: 1658361 - DNA, 20 bp, Homo sapiens
ctgggcaccacctctgtggg

SEQ ID NO: 1658362 - DNA, 14 bp, Homo sapiens
ctgggcacccacct

SEQ ID NO: 1658363 - DNA, 20 bp, Homo sapiens
ctgggcacccacctccaccc

SEQ ID NO: 1658364 - DNA, 17 bp, Homo sapiens
ctgggcacctgcgcaca

SEQ ID NO: 1658365 - DNA, 17 bp, Homo sapiens
ctgggcagcaaggctgc

SEQ ID NO: 1658366 - DNA, 17 bp, Homo sapiens
ctgggcagcttgagagg

SEQ ID NO: 1658367 - DNA, 20 bp, Homo sapiens
ctgggcagggatgatggcag

SEQ ID NO: 1658368 - DNA, 12 bp, Homo sapiens
ctgggcagggtg

SEQ ID NO: 1658369 - DNA, 19 bp, Homo sapiens
ctgggcaggtgggagctga

SEQ ID NO: 1658370 - DNA, 16 bp, Homo sapiens
ctgggcagtgtggcct

SEQ ID NO: 1658371 - DNA, 18 bp, Homo sapiens
ctgggcagtgtggcctct

SEQ ID NO: 1658372 - DNA, 19 bp, Homo sapiens
ctgggcagtgtggcctctt

SEQ ID NO: 1658373 - DNA, 19 bp, Homo sapiens
ctgggcatcttctggcttg

SEQ ID NO: 1658374 - DNA, 19 bp, Homo sapiens
ctgggcatgggtccagggc

SEQ ID NO: 1658375 - DNA, 20 bp, Homo sapiens
ctgggcatgggtccagggcc

SEQ ID NO: 1658376 - DNA, 21 bp, Homo sapiens
ctgggcatgggtccagggcct

SEQ ID NO: 1658377 - DNA, 14 bp, Homo sapiens
ctgggcattgcttt

SEQ ID NO: 1658378 - DNA, 17 bp, Homo sapiens
ctgggcattgctttcca

SEQ ID NO: 1658379 - DNA, 15 bp, Homo sapiens
ctgggccaagttcct

SEQ ID NO: 1658380 - DNA, 21 bp, Homo sapiens
ctgggccaagttcctctagtg

SEQ ID NO: 1658381 - DNA, 22 bp, Homo sapiens
ctgggccacggaggagggatgc

SEQ ID NO: 1658382 - DNA, 12 bp, Homo sapiens
ctgggccactgg

SEQ ID NO: 1658383 - DNA, 12 bp, Homo sapiens
ctgggccaggga

SEQ ID NO: 1658384 - DNA, 13 bp, Homo sapiens
ctgggccaggtct

SEQ ID NO: 1658385 - DNA, 19 bp, Homo sapiens
ctgggccatgtccaaagag

SEQ ID NO: 1658386 - DNA, 15 bp, Homo sapiens
ctgggcccaggcagg

SEQ ID NO: 1658387 - DNA, 20 bp, Homo sapiens
ctgggccccatgctctgccc

SEQ ID NO: 1658388 - DNA, 14 bp, Homo sapiens
ctgggcccctgcac

SEQ ID NO: 1658389 - DNA, 16 bp, Homo sapiens
ctgggcccctgcacag

SEQ ID NO: 1658390 - DNA, 18 bp, Homo sapiens
ctgggcccggaagggctt

SEQ ID NO: 1658391 - DNA, 22 bp, Homo sapiens
ctgggcccggaagggctttggt

SEQ ID NO: 1658392 - DNA, 14 bp, Homo sapiens
ctgggccctctctt

SEQ ID NO: 1658393 - DNA, 13 bp, Homo sapiens
ctgggccctgagt

SEQ ID NO: 1658394 - DNA, 22 bp, Homo sapiens
ctgggccctgagtctgggcagc

SEQ ID NO: 1658395 - DNA, 14 bp, Homo sapiens
ctgggccctgggct

SEQ ID NO: 1658396 - DNA, 15 bp, Homo sapiens
ctgggccctgggctg

SEQ ID NO: 1658397 - DNA, 18 bp, Homo sapiens
ctgggccctgggctgatg

SEQ ID NO: 1658398 - DNA, 16 bp, Homo sapiens
ctgggccgggcctggg

SEQ ID NO: 1658399 - DNA, 19 bp, Homo sapiens
ctgggccgggctgtagatc

SEQ ID NO: 1658400 - DNA, 14 bp, Homo sapiens
ctgggcctcatggc

SEQ ID NO: 1658401 - DNA, 15 bp, Homo sapiens
ctgggcctcctggga

SEQ ID NO: 1658402 - DNA, 20 bp, Homo sapiens
ctgggcctcgtgcgcccgtg

SEQ ID NO: 1658403 - DNA, 12 bp, Homo sapiens
ctgggcctgagg

SEQ ID NO: 1658404 - DNA, 22 bp, Homo sapiens
ctgggcctgagggtccacctgg

SEQ ID NO: 1658405 - DNA, 16 bp, Homo sapiens
ctgggcctgcccctgt

SEQ ID NO: 1658406 - DNA, 12 bp, Homo sapiens
ctgggcctgctt

SEQ ID NO: 1658407 - DNA, 12 bp, Homo sapiens
ctgggcctgtgc

SEQ ID NO: 1658408 - DNA, 14 bp, Homo sapiens
ctgggcctgtgcag

SEQ ID NO: 1658409 - DNA, 15 bp, Homo sapiens
ctgggcctgtgcagc

SEQ ID NO: 1658410 - DNA, 17 bp, Homo sapiens
ctgggcctgtgcagcag

SEQ ID NO: 1658411 - DNA, 18 bp, Homo sapiens
ctgggcctgtgcagcagc

SEQ ID NO: 1658412 - DNA, 23 bp, Homo sapiens
ctgggcctttgcaagatgcttgg

SEQ ID NO: 1658413 - DNA, 18 bp, Homo sapiens
ctgggcggcatccctgca

SEQ ID NO: 1658414 - DNA, 22 bp, Homo sapiens
ctgggcggcgggcggctgggtc

SEQ ID NO: 1658415 - DNA, 17 bp, Homo sapiens
ctgggcgtgtgtgacac

SEQ ID NO: 1658416 - DNA, 14 bp, Homo sapiens
ctgggctatattcc

SEQ ID NO: 1658417 - DNA, 18 bp, Homo sapiens
ctgggctatattcctgac

SEQ ID NO: 1658418 - DNA, 23 bp, Homo sapiens
ctgggctattgctgctgcccctt

SEQ ID NO: 1658419 - DNA, 22 bp, Homo sapiens
ctgggctcaaatgatcctccca

SEQ ID NO: 1658420 - DNA, 14 bp, Homo sapiens
ctgggctcagggct

SEQ ID NO: 1658421 - DNA, 15 bp, Homo sapiens
ctgggctcagggctg

SEQ ID NO: 1658422 - DNA, 20 bp, Homo sapiens
ctgggctcagggctggagtg

SEQ ID NO: 1658423 - DNA, 12 bp, Homo sapiens
ctgggctccaca

SEQ ID NO: 1658424 - DNA, 21 bp, Homo sapiens
ctgggctccacacagcagtgt

SEQ ID NO: 1658425 - DNA, 17 bp, Homo sapiens
ctgggctcctggaacca

SEQ ID NO: 1658426 - DNA, 15 bp, Homo sapiens
ctgggctctcaccca

SEQ ID NO: 1658427 - DNA, 22 bp, Homo sapiens
ctgggctctgcaattcccctct

SEQ ID NO: 1658428 - DNA, 14 bp, Homo sapiens
ctgggctctgccac

SEQ ID NO: 1658429 - DNA, 17 bp, Homo sapiens
ctgggctctgccaccct

SEQ ID NO: 1658430 - DNA, 18 bp, Homo sapiens
ctgggctctgccccagct

SEQ ID NO: 1658431 - DNA, 13 bp, Homo sapiens
ctgggctgagccc

SEQ ID NO: 1658432 - DNA, 17 bp, Homo sapiens
ctgggctgagcccctac

SEQ ID NO: 1658433 - DNA, 16 bp, Homo sapiens
ctgggctgagtgacac

SEQ ID NO: 1658434 - DNA, 17 bp, Homo sapiens
ctgggctgccatgtgaa

SEQ ID NO: 1658435 - DNA, 12 bp, Homo sapiens
ctgggctgggga

SEQ ID NO: 1658436 - DNA, 20 bp, Homo sapiens
ctgggcttcattccggactg

SEQ ID NO: 1658437 - DNA, 22 bp, Homo sapiens
ctgggcttcattccggactggc

SEQ ID NO: 1658438 - DNA, 14 bp, Homo sapiens
ctgggcttggcctg

SEQ ID NO: 1658439 - DNA, 17 bp, Homo sapiens
ctgggcttggcctgctg

SEQ ID NO: 1658440 - DNA, 20 bp, Homo sapiens
ctgggcttggcctgctgtga

SEQ ID NO: 1658441 - DNA, 18 bp, Homo sapiens
ctggggaaagacactgcc

SEQ ID NO: 1658442 - DNA, 19 bp, Homo sapiens
ctggggaaagacactgcct

SEQ ID NO: 1658443 - DNA, 21 bp, Homo sapiens
ctggggaaagacactgcctgg

SEQ ID NO: 1658444 - DNA, 14 bp, Homo sapiens
ctggggaaagggga

SEQ ID NO: 1658445 - DNA, 23 bp, Homo sapiens
ctggggaaaggggacaaggaagg

SEQ ID NO: 1658446 - DNA, 14 bp, Homo sapiens
ctggggaagacagt

SEQ ID NO: 1658447 - DNA, 15 bp, Homo sapiens
ctggggaagacagtg

SEQ ID NO: 1658448 - DNA, 20 bp, Homo sapiens
ctggggaagaggatgagcag

SEQ ID NO: 1658449 - DNA, 20 bp, Homo sapiens
ctggtggtctgttggcaggc

SEQ ID NO: 1658450 - DNA, 23 bp, Homo sapiens
ctggtggtctgttggcaggctgg

SEQ ID NO: 1658451 - DNA, 21 bp, Homo sapiens
ctggtggttaaggccagggcc

SEQ ID NO: 1658452 - DNA, 15 bp, Homo sapiens
ctggtgtagtctttt

SEQ ID NO: 1658453 - DNA, 15 bp, Homo sapiens
ctggtgtcaggcagg

SEQ ID NO: 1658454 - DNA, 14 bp, Homo sapiens
ctggtgtccagctg

SEQ ID NO: 1658455 - DNA, 14 bp, Homo sapiens
ctggtgtcctgacc

SEQ ID NO: 1658456 - DNA, 15 bp, Homo sapiens
ctggtgtcctgacca

SEQ ID NO: 1658457 - DNA, 17 bp, Homo sapiens
ctggtgtcctgaccacc

SEQ ID NO: 1658458 - DNA, 18 bp, Homo sapiens
ctggtgtcctgaccaccc

SEQ ID NO: 1658459 - DNA, 19 bp, Homo sapiens
ctggtgtcctgaccaccct

SEQ ID NO: 1658460 - DNA, 17 bp, Homo sapiens
ctggtgtgaactcaccc

SEQ ID NO: 1658461 - DNA, 20 bp, Homo sapiens
ctggtgtgtggtgaggggct

SEQ ID NO: 1658462 - DNA, 22 bp, Homo sapiens
ctggtgtgtggtgaggggcttt

SEQ ID NO: 1658463 - DNA, 17 bp, Homo sapiens
ctggttatttttctctt

SEQ ID NO: 1658464 - DNA, 15 bp, Homo sapiens
ctggttccagggtcc

SEQ ID NO: 1658465 - DNA, 22 bp, Homo sapiens
ctggttccagggtccctctgtg

SEQ ID NO: 1658466 - DNA, 21 bp, Homo sapiens
ctggttccatttttcctctgt

SEQ ID NO: 1658467 - DNA, 14 bp, Homo sapiens
ctggttccgccagg

SEQ ID NO: 1658468 - DNA, 23 bp, Homo sapiens
ctggttccgccaggcgctgcagg

SEQ ID NO: 1658469 - DNA, 21 bp, Homo sapiens
ctggttcctgctgtcctggtg

SEQ ID NO: 1658470 - DNA, 23 bp, Homo sapiens
ctggttcctgctgtcctggtggc

SEQ ID NO: 1658471 - DNA, 16 bp, Homo sapiens
ctggttcctttcatct

SEQ ID NO: 1658472 - DNA, 17 bp, Homo sapiens
ctggttctatttaatgg

SEQ ID NO: 1658473 - DNA, 16 bp, Homo sapiens
ctggttctcatctttc

SEQ ID NO: 1658474 - DNA, 20 bp, Homo sapiens
ctggttctgtctagactggc

SEQ ID NO: 1658475 - DNA, 17 bp, Homo sapiens
ctggttgaagctttgct

SEQ ID NO: 1658476 - DNA, 14 bp, Homo sapiens
ctggttgagtgtgt

SEQ ID NO: 1658477 - DNA, 19 bp, Homo sapiens
ctggttggccgtggtccag

SEQ ID NO: 1658478 - DNA, 21 bp, Homo sapiens
ctggttggctcccgcggtgcc

SEQ ID NO: 1658479 - DNA, 16 bp, Homo sapiens
ctggttgtatttctat

SEQ ID NO: 1658480 - DNA, 15 bp, Homo sapiens
ctggttgtcattttt

SEQ ID NO: 1658481 - DNA, 16 bp, Homo sapiens
ctggttgttatgtgat

SEQ ID NO: 1658482 - DNA, 17 bp, Homo sapiens
ctggttgttcctgcatc

SEQ ID NO: 1658483 - DNA, 14 bp, Homo sapiens
ctggttgttgccag

SEQ ID NO: 1658484 - DNA, 13 bp, Homo sapiens
ctggtttcctggc

SEQ ID NO: 1658485 - DNA, 14 bp, Homo sapiens
ctggtttgactcag

SEQ ID NO: 1658486 - DNA, 18 bp, Homo sapiens
ctggttttcctaaatgca

SEQ ID NO: 1658487 - DNA, 19 bp, Homo sapiens
ctggttttgatggctgggt

SEQ ID NO: 1658488 - DNA, 23 bp, Homo sapiens
ctggttttgatggctgggtcctt

SEQ ID NO: 1658489 - DNA, 15 bp, Homo sapiens
ctggttttgtaagat

SEQ ID NO: 1658490 - DNA, 15 bp, Homo sapiens
ctgtaaaatgtggga

SEQ ID NO: 1658491 - DNA, 21 bp, Homo sapiens
ctgtaaaatgtgggattatgg

SEQ ID NO: 1658492 - DNA, 20 bp, Homo sapiens
ctgtaaacctctcgagggca

SEQ ID NO: 1658493 - DNA, 19 bp, Homo sapiens
ctgtaaactttatcactta

SEQ ID NO: 1658494 - DNA, 16 bp, Homo sapiens
ctgtaaagatttgttg

SEQ ID NO: 1658495 - DNA, 12 bp, Homo sapiens
ctgtaaagccag

SEQ ID NO: 1658496 - DNA, 14 bp, Homo sapiens
ctgtaaataaaatg

SEQ ID NO: 1658497 - DNA, 19 bp, Homo sapiens
ctgtaaataaaatgtgtac

SEQ ID NO: 1658498 - DNA, 22 bp, Homo sapiens
ctgtaaataaaatgtgtacagt

SEQ ID NO: 1658499 - DNA, 14 bp, Homo sapiens
ctgtaaatatgttt

SEQ ID NO: 1658500 - DNA, 15 bp, Homo sapiens
ctgtaaatgccttgc

SEQ ID NO: 1658501 - DNA, 21 bp, Homo sapiens
ctgtaaatgccttgcttgtat

SEQ ID NO: 1658502 - DNA, 23 bp, Homo sapiens
ctgtaaatggtgtacataatgta

SEQ ID NO: 1658503 - DNA, 17 bp, Homo sapiens
ctgtaaattgcagaatt

SEQ ID NO: 1658504 - DNA, 20 bp, Homo sapiens
ctgtaaatttaactgcatat

SEQ ID NO: 1658505 - DNA, 21 bp, Homo sapiens
ctgtaaatttaactgcatata

SEQ ID NO: 1658506 - DNA, 17 bp, Homo sapiens
ctgtaacactcctctgc

SEQ ID NO: 1658507 - DNA, 16 bp, Homo sapiens
ctgtaactactttata

SEQ ID NO: 1658508 - DNA, 21 bp, Homo sapiens
ctgtaactggtagtgttcagt

SEQ ID NO: 1658509 - DNA, 15 bp, Homo sapiens
ctgtaactgtcagtg

SEQ ID NO: 1658510 - DNA, 15 bp, Homo sapiens
ctgtaagagaaaata

SEQ ID NO: 1658511 - DNA, 17 bp, Homo sapiens
ctgtaagagaaaatatt

SEQ ID NO: 1658512 - DNA, 20 bp, Homo sapiens
ctgtaagagaaaatattact

SEQ ID NO: 1658513 - DNA, 13 bp, Homo sapiens
ctgtaagagcttg

SEQ ID NO: 1658514 - DNA, 22 bp, Homo sapiens
ctgtaagcggtggtttgtaatt

SEQ ID NO: 1658515 - DNA, 15 bp, Homo sapiens
ctgtaagctccatga

SEQ ID NO: 1658516 - DNA, 13 bp, Homo sapiens
ctgtaaggctcta

SEQ ID NO: 1658517 - DNA, 17 bp, Homo sapiens
ctgtaaggctctagatc

SEQ ID NO: 1658518 - DNA, 20 bp, Homo sapiens
ctgtaaggctctagatcata

SEQ ID NO: 1658519 - DNA, 15 bp, Homo sapiens
ctgtaatattgtaaa

SEQ ID NO: 1658520 - DNA, 17 bp, Homo sapiens
ctgtaatattgtaaata

SEQ ID NO: 1658521 - DNA, 22 bp, Homo sapiens
ctgtaatattgtaaatactgga

SEQ ID NO: 1658522 - DNA, 14 bp, Homo sapiens
ctgtaatcagcaat

SEQ ID NO: 1658523 - DNA, 18 bp, Homo sapiens
ctgtaatcatttgtttac

SEQ ID NO: 1658524 - DNA, 20 bp, Homo sapiens
ctgtaatcatttgtttacat

SEQ ID NO: 1658525 - DNA, 16 bp, Homo sapiens
ctgtaatcccagaact

SEQ ID NO: 1658526 - DNA, 22 bp, Homo sapiens
ctgtaatcccagcactttgaga

SEQ ID NO: 1658527 - DNA, 20 bp, Homo sapiens
ctgtaatcgccctactattc

SEQ ID NO: 1658528 - DNA, 14 bp, Homo sapiens
ctgtaatctatgaa

SEQ ID NO: 1658529 - DNA, 15 bp, Homo sapiens
ctgtaatgacaaaag

SEQ ID NO: 1658530 - DNA, 18 bp, Homo sapiens
ctgtaatggtactgactt

SEQ ID NO: 1658531 - DNA, 19 bp, Homo sapiens
ctgtaatgtttcacagagt

SEQ ID NO: 1658532 - DNA, 14 bp, Homo sapiens
ctgtaattatttga

SEQ ID NO: 1658533 - DNA, 16 bp, Homo sapiens
ctgtaattatttgaat

SEQ ID NO: 1658534 - DNA, 17 bp, Homo sapiens
ctgtaattatttgaatg

SEQ ID NO: 1658535 - DNA, 22 bp, Homo sapiens
ctgtaattcctacctccctgca

SEQ ID NO: 1658536 - DNA, 21 bp, Homo sapiens
ctgtaattgcactttttaagt

SEQ ID NO: 1658537 - DNA, 13 bp, Homo sapiens
ctgtacaaagtag

SEQ ID NO: 1658538 - DNA, 17 bp, Homo sapiens
ctgtacactgacttgag

SEQ ID NO: 1658539 - DNA, 19 bp, Homo sapiens
ctgtacagatcaagaaaaa

SEQ ID NO: 1658540 - DNA, 23 bp, Homo sapiens
ctgtacatattactgttgcattt

SEQ ID NO: 1658541 - DNA, 20 bp, Homo sapiens
ctgtacatatttgagactag

SEQ ID NO: 1658542 - DNA, 19 bp, Homo sapiens
ctgtacattgtgagctctg

SEQ ID NO: 1658543 - DNA, 20 bp, Homo sapiens
ctgtacattgtgagctctgg

SEQ ID NO: 1658544 - DNA, 15 bp, Homo sapiens
ctgtacattgtggga

SEQ ID NO: 1658545 - DNA, 18 bp, Homo sapiens
ctgtaccacatctgctct

SEQ ID NO: 1658546 - DNA, 12 bp, Homo sapiens
ctgtaccagtta

SEQ ID NO: 1658547 - DNA, 14 bp, Homo sapiens
ctgtacccagctcc

SEQ ID NO: 1658548 - DNA, 15 bp, Homo sapiens
ctgtacccagctcct

SEQ ID NO: 1658549 - DNA, 13 bp, Homo sapiens
ctgtacccttcca

SEQ ID NO: 1658550 - DNA, 20 bp, Homo sapiens
ctgtaccttttgaggagccc

SEQ ID NO: 1658551 - DNA, 22 bp, Homo sapiens
ctgtaccttttgaggagcccca

SEQ ID NO: 1658552 - DNA, 20 bp, Homo sapiens
ctgtactactcctaattatt

SEQ ID NO: 1658553 - DNA, 15 bp, Homo sapiens
ctgtactataagtag

SEQ ID NO: 1658554 - DNA, 21 bp, Homo sapiens
ctgtactataagtagttggtt

SEQ ID NO: 1658555 - DNA, 16 bp, Homo sapiens
ctgtactattgcagac

SEQ ID NO: 1658556 - DNA, 20 bp, Homo sapiens
ctgtactcagagcagagcaa

SEQ ID NO: 1658557 - DNA, 20 bp, Homo sapiens
ctgtactcaggaggctgagg

SEQ ID NO: 1658558 - DNA, 15 bp, Homo sapiens
ctgtactcctcccag

SEQ ID NO: 1658559 - DNA, 12 bp, Homo sapiens
ctgtactgcatg

SEQ ID NO: 1658560 - DNA, 14 bp, Homo sapiens
ctgtactgcatgtg

SEQ ID NO: 1658561 - DNA, 17 bp, Homo sapiens
ctgtactgtgtctcatg

SEQ ID NO: 1658562 - DNA, 13 bp, Homo sapiens
ctgtacttaataa

SEQ ID NO: 1658563 - DNA, 19 bp, Homo sapiens
ctgtctcagcctcctgagt

SEQ ID NO: 1658564 - DNA, 16 bp, Homo sapiens
ctgtctcagtttcact

SEQ ID NO: 1658565 - DNA, 14 bp, Homo sapiens
ctgtctcatcccca

SEQ ID NO: 1658566 - DNA, 21 bp, Homo sapiens
ctgtctcatccccaggggtcc

SEQ ID NO: 1658567 - DNA, 16 bp, Homo sapiens
ctgtctcatcttctga

SEQ ID NO: 1658568 - DNA, 16 bp, Homo sapiens
ctgtctccagctgcct

SEQ ID NO: 1658569 - DNA, 18 bp, Homo sapiens
ctgtctccagctgcctgg

SEQ ID NO: 1658570 - DNA, 13 bp, Homo sapiens
ctgtctcccttct

SEQ ID NO: 1658571 - DNA, 17 bp, Homo sapiens
ctgtctcccttctctct

SEQ ID NO: 1658572 - DNA, 18 bp, Homo sapiens
ctgtctcccttctctctc

SEQ ID NO: 1658573 - DNA, 14 bp, Homo sapiens
ctgtctcgatgcct

SEQ ID NO: 1658574 - DNA, 19 bp, Homo sapiens
ctgtctcgatgcctgattc

SEQ ID NO: 1658575 - DNA, 20 bp, Homo sapiens
ctgtctcgatgcctgattcg

SEQ ID NO: 1658576 - DNA, 20 bp, Homo sapiens
ctgtctctaaccattcaaat

SEQ ID NO: 1658577 - DNA, 22 bp, Homo sapiens
ctgtctctaaccattcaaatga

SEQ ID NO: 1658578 - DNA, 13 bp, Homo sapiens
ctgtctctccatc

SEQ ID NO: 1658579 - DNA, 13 bp, Homo sapiens
ctgtctctgcctg

SEQ ID NO: 1658580 - DNA, 14 bp, Homo sapiens
ctgtctctgcctgc

SEQ ID NO: 1658581 - DNA, 21 bp, Homo sapiens
ctgtctgaaccacgcgggggc

SEQ ID NO: 1658582 - DNA, 20 bp, Homo sapiens
ctgtctgaatattctagaac

SEQ ID NO: 1658583 - DNA, 15 bp, Homo sapiens
ctgtctgaccagaga

SEQ ID NO: 1658584 - DNA, 16 bp, Homo sapiens
ctgtctgaccagagaa

SEQ ID NO: 1658585 - DNA, 17 bp, Homo sapiens
ctgtctgaccagagaat

SEQ ID NO: 1658586 - DNA, 13 bp, Homo sapiens
ctgtctgattcta

SEQ ID NO: 1658587 - DNA, 20 bp, Homo sapiens
ctgtctgccaacctaaaact

SEQ ID NO: 1658588 - DNA, 14 bp, Homo sapiens
ctgtctgccagcca

SEQ ID NO: 1658589 - DNA, 15 bp, Homo sapiens
ctgtctgccccagcc

SEQ ID NO: 1658590 - DNA, 19 bp, Homo sapiens
ctgtctgccccagcccaga

SEQ ID NO: 1658591 - DNA, 12 bp, Homo sapiens
ctgtctgccctc

SEQ ID NO: 1658592 - DNA, 16 bp, Homo sapiens
ctgtctgccctctggg

SEQ ID NO: 1658593 - DNA, 15 bp, Homo sapiens
ctgtctgcttctctc

SEQ ID NO: 1658594 - DNA, 18 bp, Homo sapiens
ctgtctgcttctctctct

SEQ ID NO: 1658595 - DNA, 15 bp, Homo sapiens
ctgtctggccctggg

SEQ ID NO: 1658596 - DNA, 13 bp, Homo sapiens
ctgtctgggatta

SEQ ID NO: 1658597 - DNA, 13 bp, Homo sapiens
ctgtctgtccctt

SEQ ID NO: 1658598 - DNA, 12 bp, Homo sapiens
ctgtctgtgtcc

SEQ ID NO: 1658599 - DNA, 16 bp, Homo sapiens
ctgtctgtgtcccagc

SEQ ID NO: 1658600 - DNA, 18 bp, Homo sapiens
ctgtctgtgtcccagcca

SEQ ID NO: 1658601 - DNA, 19 bp, Homo sapiens
ctgtcttaaactaaatgtg

SEQ ID NO: 1658602 - DNA, 19 bp, Homo sapiens
ctgtcttcacatgtatgga

SEQ ID NO: 1658603 - DNA, 15 bp, Homo sapiens
ctgtcttcagagcaa

SEQ ID NO: 1658604 - DNA, 14 bp, Homo sapiens
ctgtcttcagtctc

SEQ ID NO: 1658605 - DNA, 22 bp, Homo sapiens
ctgtcttcatagcagattttaa

SEQ ID NO: 1658606 - DNA, 15 bp, Homo sapiens
ctgtcttccaaggag

SEQ ID NO: 1658607 - DNA, 18 bp, Homo sapiens
ctgtcttccacagccgcc

SEQ ID NO: 1658608 - DNA, 20 bp, Homo sapiens
ctgtcttcctcaaaataaag

SEQ ID NO: 1658609 - DNA, 12 bp, Homo sapiens
ctgtcttctgga

SEQ ID NO: 1658610 - DNA, 20 bp, Homo sapiens
ctgtcttctggacttggtct

SEQ ID NO: 1658611 - DNA, 16 bp, Homo sapiens
ctgtcttctgggcaca

SEQ ID NO: 1658612 - DNA, 16 bp, Homo sapiens
ctgtcttgaataagag

SEQ ID NO: 1658613 - DNA, 19 bp, Homo sapiens
ctgtcttgaattagtattt

SEQ ID NO: 1658614 - DNA, 22 bp, Homo sapiens
ctgtcttgaattagtatttcag

SEQ ID NO: 1658615 - DNA, 15 bp, Homo sapiens
ctgtcttgccagcca

SEQ ID NO: 1658616 - DNA, 12 bp, Homo sapiens
ctgtcttggctg

SEQ ID NO: 1658617 - DNA, 17 bp, Homo sapiens
ctgtcttgttcattttg

SEQ ID NO: 1658618 - DNA, 18 bp, Homo sapiens
ctgtcttgtttcagtgag

SEQ ID NO: 1658619 - DNA, 16 bp, Homo sapiens
ctgtctttaaaagaga

SEQ ID NO: 1658620 - DNA, 17 bp, Homo sapiens
ctgtctttaaaagagag

SEQ ID NO: 1658621 - DNA, 18 bp, Homo sapiens
ctgtctttaaaagagaga

SEQ ID NO: 1658622 - DNA, 17 bp, Homo sapiens
ctgtctttattcttatt

SEQ ID NO: 1658623 - DNA, 16 bp, Homo sapiens
ctgtctttcagataca

SEQ ID NO: 1658624 - DNA, 23 bp, Homo sapiens
ctgtctttctctaaatatgatta

SEQ ID NO: 1658625 - DNA, 23 bp, Homo sapiens
ctgtctttctgagcacactttag

SEQ ID NO: 1658626 - DNA, 23 bp, Homo sapiens
ctgtctttttcatttttttctct

SEQ ID NO: 1658627 - DNA, 12 bp, Homo sapiens
ctgtgaaaaatc

SEQ ID NO: 1658628 - DNA, 20 bp, Homo sapiens
ctgtgaaaaatcagatgaat

SEQ ID NO: 1658629 - DNA, 17 bp, Homo sapiens
ctgtgaaacgtcccaca

SEQ ID NO: 1658630 - DNA, 18 bp, Homo sapiens
ctgtgaaagtacatttgg

SEQ ID NO: 1658631 - DNA, 13 bp, Homo sapiens
ctgtgaaatacca

SEQ ID NO: 1658632 - DNA, 17 bp, Homo sapiens
ctgtgaaattctcagag

SEQ ID NO: 1658633 - DNA, 20 bp, Homo sapiens
ctgtgaaattctcagagtgt

SEQ ID NO: 1658634 - DNA, 23 bp, Homo sapiens
ctgtgaaattctcagagtgttta

SEQ ID NO: 1658635 - DNA, 17 bp, Homo sapiens
ctgtgaacagcttgctg

SEQ ID NO: 1658636 - DNA, 22 bp, Homo sapiens
ctgtgaagaaccctgcagggcc

SEQ ID NO: 1658637 - DNA, 15 bp, Homo sapiens
ctgtgaagacccagc

SEQ ID NO: 1658638 - DNA, 21 bp, Homo sapiens
ctgtgaagacccagcaggaag

SEQ ID NO: 1658639 - DNA, 22 bp, Homo sapiens
ctgtgaagacccagcaggaagc

SEQ ID NO: 1658640 - DNA, 22 bp, Homo sapiens
ctgtgaagagaatgtattctgt

SEQ ID NO: 1658641 - DNA, 18 bp, Homo sapiens
ctgtgaagcagtcagccc

SEQ ID NO: 1658642 - DNA, 21 bp, Homo sapiens
ctgtgaagctattggaatttt

SEQ ID NO: 1658643 - DNA, 14 bp, Homo sapiens
ctgtgaaggaccct

SEQ ID NO: 1658644 - DNA, 23 bp, Homo sapiens
ctgtgaagtaacccctcctggct

SEQ ID NO: 1658645 - DNA, 21 bp, Homo sapiens
ctgtgaagtgatctaaaattt

SEQ ID NO: 1658646 - DNA, 13 bp, Homo sapiens
ctgtgaagtgtta

SEQ ID NO: 1658647 - DNA, 15 bp, Homo sapiens
ctgtgaatcaatcct

SEQ ID NO: 1658648 - DNA, 23 bp, Homo sapiens
ctgtgaattgagctgcagaaacg

SEQ ID NO: 1658649 - DNA, 16 bp, Homo sapiens
ctgtgacaaaggatga

SEQ ID NO: 1658650 - DNA, 21 bp, Homo sapiens
ctgtgacaaaggatgaagaac

SEQ ID NO: 1658651 - DNA, 13 bp, Homo sapiens
ctgtgacaacact

SEQ ID NO: 1658652 - DNA, 13 bp, Homo sapiens
ctgtgacacctgg

SEQ ID NO: 1658653 - DNA, 17 bp, Homo sapiens
ctgtgacatggtgcctg

SEQ ID NO: 1658654 - DNA, 18 bp, Homo sapiens
ctgtgacatggtgcctga

SEQ ID NO: 1658655 - DNA, 19 bp, Homo sapiens
ctgtgacatggtgcctgag

SEQ ID NO: 1658656 - DNA, 21 bp, Homo sapiens
ctgtgacatggtgcctgagag

SEQ ID NO: 1658657 - DNA, 24 bp, Homo sapiens
ctgtgacatggtgcctgagaggca

SEQ ID NO: 1658658 - DNA, 13 bp, Homo sapiens
ctgtgacatgtaa

SEQ ID NO: 1658659 - DNA, 14 bp, Homo sapiens
ctgtgaccatttat

SEQ ID NO: 1658660 - DNA, 13 bp, Homo sapiens
ctgtgacccatct

SEQ ID NO: 1658661 - DNA, 14 bp, Homo sapiens
ctgtgacccatctg

SEQ ID NO: 1658662 - DNA, 18 bp, Homo sapiens
ctgtgacccatctgtagt

SEQ ID NO: 1658663 - DNA, 14 bp, Homo sapiens
ctgtgaccccacct

SEQ ID NO: 1658664 - DNA, 22 bp, Homo sapiens
ctgtgacctgccccgcccagct

SEQ ID NO: 1658665 - DNA, 18 bp, Homo sapiens
ctgtgaccttacagccat

SEQ ID NO: 1658666 - DNA, 16 bp, Homo sapiens
ctgtgacgcagacaga

SEQ ID NO: 1658667 - DNA, 18 bp, Homo sapiens
ctgtgacgcagacagagg

SEQ ID NO: 1658668 - DNA, 21 bp, Homo sapiens
ctgtgacgcagacagagggga

SEQ ID NO: 1658669 - DNA, 17 bp, Homo sapiens
ctgtgactaggaaaaaa

SEQ ID NO: 1658670 - DNA, 22 bp, Homo sapiens
ctgtgactaggcatacactgta

SEQ ID NO: 1658671 - DNA, 15 bp, Homo sapiens
ctgtgactataaagc

SEQ ID NO: 1658672 - DNA, 15 bp, Homo sapiens
ctgtgactcctgttg

SEQ ID NO: 1658673 - DNA, 14 bp, Homo sapiens
ctgtgactctgggc

SEQ ID NO: 1658674 - DNA, 15 bp, Homo sapiens
ctgtgactctgggca

SEQ ID NO: 1658675 - DNA, 17 bp, Homo sapiens
ctgtgactgaagaagat

SEQ ID NO: 1658676 - DNA, 12 bp, Homo sapiens
ctgtgactggat

SEQ ID NO: 1658677 - DNA, 17 bp, Homo sapiens
ctgtgagaaggtttatt

SEQ ID NO: 1658678 - DNA, 15 bp, Homo sapiens
ctgtgtgggatactt

SEQ ID NO: 1658679 - DNA, 15 bp, Homo sapiens
ctgtgtgtccaaaac

SEQ ID NO: 1658680 - DNA, 19 bp, Homo sapiens
ctgtgtgtccaaaactgcc

SEQ ID NO: 1658681 - DNA, 22 bp, Homo sapiens
ctgtgtgtccaaaactgcctca

SEQ ID NO: 1658682 - DNA, 18 bp, Homo sapiens
ctgtgtgtcccaggcagg

SEQ ID NO: 1658683 - DNA, 20 bp, Homo sapiens
ctgtgtgtcccaggcaggga

SEQ ID NO: 1658684 - DNA, 16 bp, Homo sapiens
ctgtgtgtctggtggg

SEQ ID NO: 1658685 - DNA, 13 bp, Homo sapiens
ctgtgtgtctgtc

SEQ ID NO: 1658686 - DNA, 18 bp, Homo sapiens
ctgtgtgtgtgtatgtgg

SEQ ID NO: 1658687 - DNA, 12 bp, Homo sapiens
ctgtgtgttagt

SEQ ID NO: 1658688 - DNA, 16 bp, Homo sapiens
ctgtgtgttgcctggg

SEQ ID NO: 1658689 - DNA, 15 bp, Homo sapiens
ctgtgtgttttccca

SEQ ID NO: 1658690 - DNA, 13 bp, Homo sapiens
ctgtgttaaacac

SEQ ID NO: 1658691 - DNA, 22 bp, Homo sapiens
ctgtgttaattgcgtagaggct

SEQ ID NO: 1658692 - DNA, 23 bp, Homo sapiens
ctgtgttactaaaaaaaagatga

SEQ ID NO: 1658693 - DNA, 14 bp, Homo sapiens
ctgtgttactgctt

SEQ ID NO: 1658694 - DNA, 16 bp, Homo sapiens
ctgtgttactgctttg

SEQ ID NO: 1658695 - DNA, 22 bp, Homo sapiens
ctgtgttactgctttgcaaaga

SEQ ID NO: 1658696 - DNA, 19 bp, Homo sapiens
ctgtgttcaagcgattctc

SEQ ID NO: 1658697 - DNA, 22 bp, Homo sapiens
ctgtgttcaatatttagaaaat

SEQ ID NO: 1658698 - DNA, 11 bp, Homo sapiens
ctgtgttcatt

SEQ ID NO: 1658699 - DNA, 23 bp, Homo sapiens
ctgtgttcatttggtgttcctgg

SEQ ID NO: 1658700 - DNA, 14 bp, Homo sapiens
ctgtgttccagccc

SEQ ID NO: 1658701 - DNA, 14 bp, Homo sapiens
ctgtgttgaacaca

SEQ ID NO: 1658702 - DNA, 13 bp, Homo sapiens
ctgtgttgccaag

SEQ ID NO: 1658703 - DNA, 20 bp, Homo sapiens
ctgtgttgcgtgtcgtgggt

SEQ ID NO: 1658704 - DNA, 14 bp, Homo sapiens
ctgtgttgtctcta

SEQ ID NO: 1658705 - DNA, 22 bp, Homo sapiens
ctgtgttgtctctagagcaggg

SEQ ID NO: 1658706 - DNA, 19 bp, Homo sapiens
ctgtgtttataaaatataa

SEQ ID NO: 1658707 - DNA, 16 bp, Homo sapiens
ctgtgtttctggagtg

SEQ ID NO: 1658708 - DNA, 14 bp, Homo sapiens
ctgtgtttgcattg

SEQ ID NO: 1658709 - DNA, 17 bp, Homo sapiens
ctgtgtttgcattgtct

SEQ ID NO: 1658710 - DNA, 18 bp, Homo sapiens
ctgtgttttgtctgagcc

SEQ ID NO: 1658711 - DNA, 19 bp, Homo sapiens
ctgtgttttgtctgagcct

SEQ ID NO: 1658712 - DNA, 16 bp, Homo sapiens
ctgttaaaagatgaaa

SEQ ID NO: 1658713 - DNA, 21 bp, Homo sapiens
ctgttaaaagatgaaaatatt

SEQ ID NO: 1658714 - DNA, 11 bp, Homo sapiens
ctgttaaaatg

SEQ ID NO: 1658715 - DNA, 13 bp, Homo sapiens
ctgttaaaatgca

SEQ ID NO: 1658716 - DNA, 23 bp, Homo sapiens
ctgttaaaatgcatgattgcaga

SEQ ID NO: 1658717 - DNA, 23 bp, Homo sapiens
ctgttaaatacaggaaacagttg

SEQ ID NO: 1658718 - DNA, 14 bp, Homo sapiens
ctgttaagagagga

SEQ ID NO: 1658719 - DNA, 14 bp, Homo sapiens
ctgttaatacacag

SEQ ID NO: 1658720 - DNA, 21 bp, Homo sapiens
ctgttaatacacagtacttta

SEQ ID NO: 1658721 - DNA, 15 bp, Homo sapiens
ctgttaatatttcta

SEQ ID NO: 1658722 - DNA, 17 bp, Homo sapiens
ctgttaatatttctaaa

SEQ ID NO: 1658723 - DNA, 18 bp, Homo sapiens
ctgttacccagagaatat

SEQ ID NO: 1658724 - DNA, 21 bp, Homo sapiens
ctgttacccagggctctgcag

SEQ ID NO: 1658725 - DNA, 13 bp, Homo sapiens
ctgttactccaca

SEQ ID NO: 1658726 - DNA, 14 bp, Homo sapiens
ctgttactctgtcc

SEQ ID NO: 1658727 - DNA, 15 bp, Homo sapiens
ctgttactctgtccc

SEQ ID NO: 1658728 - DNA, 14 bp, Homo sapiens
ctgttactgggccc

SEQ ID NO: 1658729 - DNA, 15 bp, Homo sapiens
ctgttagggccttgg

SEQ ID NO: 1658730 - DNA, 15 bp, Homo sapiens
ctgttagtcatttgc

SEQ ID NO: 1658731 - DNA, 14 bp, Homo sapiens
ctgttataactctg

SEQ ID NO: 1658732 - DNA, 21 bp, Homo sapiens
ctgttatgcactgtggtttca

SEQ ID NO: 1658733 - DNA, 13 bp, Homo sapiens
ctgttatgggctt

SEQ ID NO: 1658734 - DNA, 19 bp, Homo sapiens
ctgttattatatttgacat

SEQ ID NO: 1658735 - DNA, 18 bp, Homo sapiens
ctgttattcaaatttgat

SEQ ID NO: 1658736 - DNA, 13 bp, Homo sapiens
ctgttattcttgt

SEQ ID NO: 1658737 - DNA, 15 bp, Homo sapiens
ctgttattcttgtta

SEQ ID NO: 1658738 - DNA, 17 bp, Homo sapiens
ctgttattcttgttata

SEQ ID NO: 1658739 - DNA, 16 bp, Homo sapiens
ctgttattctttgcac

SEQ ID NO: 1658740 - DNA, 13 bp, Homo sapiens
ctgttatttaatt

SEQ ID NO: 1658741 - DNA, 16 bp, Homo sapiens
ctgttatttcttccct

SEQ ID NO: 1658742 - DNA, 23 bp, Homo sapiens
ctgttatttcttccctgctttgc

SEQ ID NO: 1658743 - DNA, 18 bp, Homo sapiens
ctgttatttttctgccct

SEQ ID NO: 1658744 - DNA, 18 bp, Homo sapiens
ctgttcaaagatgcattt

SEQ ID NO: 1658745 - DNA, 21 bp, Homo sapiens
ctgttcaaagatgcattttga

SEQ ID NO: 1658746 - DNA, 18 bp, Homo sapiens
ctgttcacagtctctgga

SEQ ID NO: 1658747 - DNA, 17 bp, Homo sapiens
ctgttcacttttcctcc

SEQ ID NO: 1658748 - DNA, 17 bp, Homo sapiens
ctgttcagcgttttgca

SEQ ID NO: 1658749 - DNA, 23 bp, Homo sapiens
ctgttcatttccaccaagggtat

SEQ ID NO: 1658750 - DNA, 16 bp, Homo sapiens
ctgttccaacctcctg

SEQ ID NO: 1658751 - DNA, 18 bp, Homo sapiens
ctgttccaacctcctgct

SEQ ID NO: 1658752 - DNA, 23 bp, Homo sapiens
ctgttccaacctcctgctctggg

SEQ ID NO: 1658753 - DNA, 11 bp, Homo sapiens
ctgttccagac

SEQ ID NO: 1658754 - DNA, 15 bp, Homo sapiens
ctgttccagactcag

SEQ ID NO: 1658755 - DNA, 15 bp, Homo sapiens
ctgttccccagagaa

SEQ ID NO: 1658756 - DNA, 16 bp, Homo sapiens
ctgttccccagagaaa

SEQ ID NO: 1658757 - DNA, 12 bp, Homo sapiens
ctgttccctaga

SEQ ID NO: 1658758 - DNA, 21 bp, Homo sapiens
ctgttccctagagagaataaa

SEQ ID NO: 1658759 - DNA, 11 bp, Homo sapiens
ctgttccctgg

SEQ ID NO: 1658760 - DNA, 19 bp, Homo sapiens
ctgttccctggagtcaggg

SEQ ID NO: 1658761 - DNA, 22 bp, Homo sapiens
ctgttcccttatctgttttcta

SEQ ID NO: 1658762 - DNA, 16 bp, Homo sapiens
ctgttcctgttcagta

SEQ ID NO: 1658763 - DNA, 16 bp, Homo sapiens
ctgttccttagacctt

SEQ ID NO: 1658764 - DNA, 21 bp, Homo sapiens
ctgttccttcacatcctgtgt

SEQ ID NO: 1658765 - DNA, 22 bp, Homo sapiens
ctgttcggaaggggttcctcaa

SEQ ID NO: 1658766 - DNA, 17 bp, Homo sapiens
ctgttctaaagctctga

SEQ ID NO: 1658767 - DNA, 19 bp, Homo sapiens
ctgttctacatagatgctt

SEQ ID NO: 1658768 - DNA, 16 bp, Homo sapiens
ctgttctatgccttta

SEQ ID NO: 1658769 - DNA, 16 bp, Homo sapiens
ctgttctcatttgatc

SEQ ID NO: 1658770 - DNA, 13 bp, Homo sapiens
ctgttctgcactg

SEQ ID NO: 1658771 - DNA, 13 bp, Homo sapiens
ctgttctgcgctg

SEQ ID NO: 1658772 - DNA, 13 bp, Homo sapiens
ctgttctgcttcg

SEQ ID NO: 1658773 - DNA, 22 bp, Homo sapiens
ctgttctggaggaaagggagga

SEQ ID NO: 1658774 - DNA, 19 bp, Homo sapiens
ctgttctgtggttcctctg

SEQ ID NO: 1658775 - DNA, 20 bp, Homo sapiens
ctgttctgtggttcctctgc

SEQ ID NO: 1658776 - DNA, 11 bp, Homo sapiens
ctgttctgtgt

SEQ ID NO: 1658777 - DNA, 21 bp, Homo sapiens
ctgttctgtttggcacttgta

SEQ ID NO: 1658778 - DNA, 16 bp, Homo sapiens
ctgttcttacaaatgt

SEQ ID NO: 1658779 - DNA, 23 bp, Homo sapiens
ctgttcttagagtgtagctgtaa

SEQ ID NO: 1658780 - DNA, 22 bp, Homo sapiens
ctgttcttcaactcctgggctc

SEQ ID NO: 1658781 - DNA, 22 bp, Homo sapiens
ctgttcttggtaactgattacc

SEQ ID NO: 1658782 - DNA, 15 bp, Homo sapiens
ctgttgacatcagcc

SEQ ID NO: 1658783 - DNA, 21 bp, Homo sapiens
ctgttgacatcagcctgcttc

SEQ ID NO: 1658784 - DNA, 14 bp, Homo sapiens
ctgttgacctgtgc

SEQ ID NO: 1658785 - DNA, 15 bp, Homo sapiens
ctgttgacctgtgca

SEQ ID NO: 1658786 - DNA, 19 bp, Homo sapiens
ctgttgagggccacttttt

SEQ ID NO: 1658787 - DNA, 16 bp, Homo sapiens
ctgttgaggtggctgt

SEQ ID NO: 1658788 - DNA, 22 bp, Homo sapiens
ctgttgatcccacttcactgtg

SEQ ID NO: 1658789 - DNA, 23 bp, Homo sapiens
ctgttgatcccacttcactgtga

SEQ ID NO: 1658790 - DNA, 13 bp, Homo sapiens
ctgttgatgggaa

SEQ ID NO: 1658791 - DNA, 14 bp, Homo sapiens
ctgttgattatctt

SEQ ID NO: 1658792 - DNA, 23 bp, Homo sapiens
ctgttgattatcttcagcccagg

SEQ ID NO: 1658793 - DNA, 16 bp, Homo sapiens
cttactctgagcccag

SEQ ID NO: 1658794 - DNA, 19 bp, Homo sapiens
cttactctgagcccaggcc

SEQ ID NO: 1658795 - DNA, 17 bp, Homo sapiens
cttactgactttgcatt

SEQ ID NO: 1658796 - DNA, 19 bp, Homo sapiens
cttactgataaacctaata

SEQ ID NO: 1658797 - DNA, 21 bp, Homo sapiens
cttactgataaacctaatatt

SEQ ID NO: 1658798 - DNA, 23 bp, Homo sapiens
cttactgataaacctaatattca

SEQ ID NO: 1658799 - DNA, 21 bp, Homo sapiens
cttactgatatattttacaat

SEQ ID NO: 1658800 - DNA, 15 bp, Homo sapiens
cttactgatatttat

SEQ ID NO: 1658801 - DNA, 13 bp, Homo sapiens
cttactgcagaat

SEQ ID NO: 1658802 - DNA, 15 bp, Homo sapiens
cttactgtacctgtt

SEQ ID NO: 1658803 - DNA, 16 bp, Homo sapiens
cttactgtctcactcg

SEQ ID NO: 1658804 - DNA, 17 bp, Homo sapiens
cttacttgtctgtacag

SEQ ID NO: 1658805 - DNA, 21 bp, Homo sapiens
cttactttaattactggaatt

SEQ ID NO: 1658806 - DNA, 13 bp, Homo sapiens
cttactttgctga

SEQ ID NO: 1658807 - DNA, 22 bp, Homo sapiens
cttacttttccagtctgtacag

SEQ ID NO: 1658808 - DNA, 21 bp, Homo sapiens
cttagaaaaggtgataaaatc

SEQ ID NO: 1658809 - DNA, 19 bp, Homo sapiens
cttagaaatcattgtagaa

SEQ ID NO: 1658810 - DNA, 15 bp, Homo sapiens
cttagaacctttctt

SEQ ID NO: 1658811 - DNA, 17 bp, Homo sapiens
cttagacccgccaggtc

SEQ ID NO: 1658812 - DNA, 13 bp, Homo sapiens
cttagacctcagc

SEQ ID NO: 1658813 - DNA, 14 bp, Homo sapiens
cttagacctcagcc

SEQ ID NO: 1658814 - DNA, 16 bp, Homo sapiens
cttagacctcagcctg

SEQ ID NO: 1658815 - DNA, 20 bp, Homo sapiens
cttagacctcagcctgtgct

SEQ ID NO: 1658816 - DNA, 18 bp, Homo sapiens
cttagactctagtattta

SEQ ID NO: 1658817 - DNA, 18 bp, Homo sapiens
cttagaggcaacaggatt

SEQ ID NO: 1658818 - DNA, 12 bp, Homo sapiens
cttagagtgtag

SEQ ID NO: 1658819 - DNA, 14 bp, Homo sapiens
cttagagtgtagct

SEQ ID NO: 1658820 - DNA, 15 bp, Homo sapiens
cttagagtgtagctg

SEQ ID NO: 1658821 - DNA, 14 bp, Homo sapiens
cttagagttcttct

SEQ ID NO: 1658822 - DNA, 19 bp, Homo sapiens
cttagatgtatatatttcc

SEQ ID NO: 1658823 - DNA, 11 bp, Homo sapiens
cttagattctc

SEQ ID NO: 1658824 - DNA, 24 bp, Homo sapiens
cttagattctctgtgtctaagatt

SEQ ID NO: 1658825 - DNA, 22 bp, Homo sapiens
cttagattgtgttcctgaagaa

SEQ ID NO: 1658826 - DNA, 18 bp, Homo sapiens
cttagcaaggggctcaga

SEQ ID NO: 1658827 - DNA, 19 bp, Homo sapiens
cttagcaataaatgctttt

SEQ ID NO: 1658828 - DNA, 22 bp, Homo sapiens
cttagcagctatctctcagtga

SEQ ID NO: 1658829 - DNA, 18 bp, Homo sapiens
cttagcagcttccagatt

SEQ ID NO: 1658830 - DNA, 19 bp, Homo sapiens
cttagccccttggattcct

SEQ ID NO: 1658831 - DNA, 20 bp, Homo sapiens
cttagccgcaccctgcacct

SEQ ID NO: 1658832 - DNA, 20 bp, Homo sapiens
cttagccgtccatggcacca

SEQ ID NO: 1658833 - DNA, 22 bp, Homo sapiens
cttagccgtccatggcaccagc

SEQ ID NO: 1658834 - DNA, 15 bp, Homo sapiens
cttagcctccctgaa

SEQ ID NO: 1658835 - DNA, 15 bp, Homo sapiens
cttagcctctcccac

SEQ ID NO: 1658836 - DNA, 16 bp, Homo sapiens
cttagcctctcccacc

SEQ ID NO: 1658837 - DNA, 14 bp, Homo sapiens
cttagccttgtgcc

SEQ ID NO: 1658838 - DNA, 17 bp, Homo sapiens
cttagccttgtgccctg

SEQ ID NO: 1658839 - DNA, 23 bp, Homo sapiens
cttagcgtcaagacatttgctga

SEQ ID NO: 1658840 - DNA, 23 bp, Homo sapiens
cttagcgttctggactctgcccc

SEQ ID NO: 1658841 - DNA, 24 bp, Homo sapiens
cttagcgttctggactctgcccca

SEQ ID NO: 1658842 - DNA, 22 bp, Homo sapiens
cttagctactgtatgcaaagtc

SEQ ID NO: 1658843 - DNA, 19 bp, Homo sapiens
cttagctagttttattctt

SEQ ID NO: 1658844 - DNA, 16 bp, Homo sapiens
cttagctcaggtgcct

SEQ ID NO: 1658845 - DNA, 15 bp, Homo sapiens
cttagctctggacgt

SEQ ID NO: 1658846 - DNA, 19 bp, Homo sapiens
cttagctctggacgtgaaa

SEQ ID NO: 1658847 - DNA, 15 bp, Homo sapiens
cttagcttagacctc

SEQ ID NO: 1658848 - DNA, 18 bp, Homo sapiens
cttagcttagacctcagc

SEQ ID NO: 1658849 - DNA, 13 bp, Homo sapiens
cttagcttttaat

SEQ ID NO: 1658850 - DNA, 22 bp, Homo sapiens
cttaggagatttaccacttttt

SEQ ID NO: 1658851 - DNA, 12 bp, Homo sapiens
cttaggccttcc

SEQ ID NO: 1658852 - DNA, 23 bp, Homo sapiens
cttaggccttcctctctccagat

SEQ ID NO: 1658853 - DNA, 19 bp, Homo sapiens
cttaggcttggctgccctg

SEQ ID NO: 1658854 - DNA, 13 bp, Homo sapiens
cttagggcactgg

SEQ ID NO: 1658855 - DNA, 18 bp, Homo sapiens
cttagggcactgggctgt

SEQ ID NO: 1658856 - DNA, 20 bp, Homo sapiens
cttagggtggctttaattgt

SEQ ID NO: 1658857 - DNA, 18 bp, Homo sapiens
cttaggttattttgcttt

SEQ ID NO: 1658858 - DNA, 18 bp, Homo sapiens
cttaggtttactgtgaag

SEQ ID NO: 1658859 - DNA, 14 bp, Homo sapiens
cttaggttttgtcc

SEQ ID NO: 1658860 - DNA, 16 bp, Homo sapiens
cttagtattgacaact

SEQ ID NO: 1658861 - DNA, 12 bp, Homo sapiens
cttagtatttct

SEQ ID NO: 1658862 - DNA, 16 bp, Homo sapiens
cttagtatttctcagg

SEQ ID NO: 1658863 - DNA, 14 bp, Homo sapiens
cttagtcactgcct

SEQ ID NO: 1658864 - DNA, 23 bp, Homo sapiens
cttagtccagttgtgttgacaca

SEQ ID NO: 1658865 - DNA, 23 bp, Homo sapiens
cttagtctcagtttgtgtgtctt

SEQ ID NO: 1658866 - DNA, 16 bp, Homo sapiens
cttagtgccacccacc

SEQ ID NO: 1658867 - DNA, 19 bp, Homo sapiens
cttagtgcggacaagtttt

SEQ ID NO: 1658868 - DNA, 22 bp, Homo sapiens
cttagtgcggacaagttttaat

SEQ ID NO: 1658869 - DNA, 22 bp, Homo sapiens
cttagtgcttcagagtttgtgt

SEQ ID NO: 1658870 - DNA, 23 bp, Homo sapiens
cttagtgcttcagagtttgtgtg

SEQ ID NO: 1658871 - DNA, 17 bp, Homo sapiens
cttagtggtatgtctct

SEQ ID NO: 1658872 - DNA, 15 bp, Homo sapiens
cttagtgtatgatta

SEQ ID NO: 1658873 - DNA, 19 bp, Homo sapiens
cttagttcatatatcaaga

SEQ ID NO: 1658874 - DNA, 22 bp, Homo sapiens
cttagttgacaacctagaatgt

SEQ ID NO: 1658875 - DNA, 14 bp, Homo sapiens
cttagttggctgga

SEQ ID NO: 1658876 - DNA, 19 bp, Homo sapiens
cttagttggctggaaactg

SEQ ID NO: 1658877 - DNA, 20 bp, Homo sapiens
cttagttggctttgcccacc

SEQ ID NO: 1658878 - DNA, 19 bp, Homo sapiens
cttagtttggattcttatg

SEQ ID NO: 1658879 - DNA, 19 bp, Homo sapiens
cttagttttttttaaaaaa

SEQ ID NO: 1658880 - DNA, 18 bp, Homo sapiens
cttataaaatcctgtgca

SEQ ID NO: 1658881 - DNA, 19 bp, Homo sapiens
cttataacctagttaaaga

SEQ ID NO: 1658882 - DNA, 22 bp, Homo sapiens
cttataacctagttaaagaaag

SEQ ID NO: 1658883 - DNA, 20 bp, Homo sapiens
cttataagagggcatataca

SEQ ID NO: 1658884 - DNA, 19 bp, Homo sapiens
cttataagtgaagtgatac

SEQ ID NO: 1658885 - DNA, 14 bp, Homo sapiens
cttataattgttct

SEQ ID NO: 1658886 - DNA, 17 bp, Homo sapiens
cttatagaataaaagct

SEQ ID NO: 1658887 - DNA, 14 bp, Homo sapiens
cttatagaatattt

SEQ ID NO: 1658888 - DNA, 20 bp, Homo sapiens
cttatagaatatttattacc

SEQ ID NO: 1658889 - DNA, 16 bp, Homo sapiens
cttataggcctgtccc

SEQ ID NO: 1658890 - DNA, 17 bp, Homo sapiens
cttataggcctgtccct

SEQ ID NO: 1658891 - DNA, 16 bp, Homo sapiens
cttatagttactgtgt

SEQ ID NO: 1658892 - DNA, 14 bp, Homo sapiens
cttatagttctagg

SEQ ID NO: 1658893 - DNA, 17 bp, Homo sapiens
cttatataaaatagact

SEQ ID NO: 1658894 - DNA, 14 bp, Homo sapiens
cttatatatgtgaa

SEQ ID NO: 1658895 - DNA, 21 bp, Homo sapiens
cttatatctggcctctgcttt

SEQ ID NO: 1658896 - DNA, 14 bp, Homo sapiens
cttatatgtacttt

SEQ ID NO: 1658897 - DNA, 23 bp, Homo sapiens
cttatattgaagacaatttgata

SEQ ID NO: 1658898 - DNA, 14 bp, Homo sapiens
cttatcacatttta

SEQ ID NO: 1658899 - DNA, 22 bp, Homo sapiens
cttatcaccacagtaagttcct

SEQ ID NO: 1658900 - DNA, 18 bp, Homo sapiens
cttatcactgacacaaaa

SEQ ID NO: 1658901 - DNA, 21 bp, Homo sapiens
cttatcatccacattgtttta

SEQ ID NO: 1658902 - DNA, 16 bp, Homo sapiens
cttatccctctcttcc

SEQ ID NO: 1658903 - DNA, 18 bp, Homo sapiens
cttatccctctcttcccc

SEQ ID NO: 1658904 - DNA, 17 bp, Homo sapiens
cttatcccttctttttc

SEQ ID NO: 1658905 - DNA, 18 bp, Homo sapiens
cttatcctctctctcttc

SEQ ID NO: 1658906 - DNA, 22 bp, Homo sapiens
cttatcctctctctcttctagg

SEQ ID NO: 1658907 - DNA, 20 bp, Homo sapiens
cttccctacctcaggcagga

SEQ ID NO: 1658908 - DNA, 22 bp, Homo sapiens
cttccctagctttagaccctgg

SEQ ID NO: 1658909 - DNA, 23 bp, Homo sapiens
cttccctagctttagaccctggg

SEQ ID NO: 1658910 - DNA, 14 bp, Homo sapiens
cttccctctcagct

SEQ ID NO: 1658911 - DNA, 14 bp, Homo sapiens
cttccctctccctc

SEQ ID NO: 1658912 - DNA, 17 bp, Homo sapiens
cttccctctccctctct

SEQ ID NO: 1658913 - DNA, 23 bp, Homo sapiens
cttccctctccctctctctggga

SEQ ID NO: 1658914 - DNA, 15 bp, Homo sapiens
cttccctctcgctcc

SEQ ID NO: 1658915 - DNA, 22 bp, Homo sapiens
cttccctctcgctcccctctgc

SEQ ID NO: 1658916 - DNA, 12 bp, Homo sapiens
cttccctctggg

SEQ ID NO: 1658917 - DNA, 13 bp, Homo sapiens
cttccctctgggc

SEQ ID NO: 1658918 - DNA, 14 bp, Homo sapiens
cttccctctgggcc

SEQ ID NO: 1658919 - DNA, 20 bp, Homo sapiens
cttccctctgggcctgttct

SEQ ID NO: 1658920 - DNA, 16 bp, Homo sapiens
cttccctctgtttctc

SEQ ID NO: 1658921 - DNA, 17 bp, Homo sapiens
cttccctctgtttctct

SEQ ID NO: 1658922 - DNA, 21 bp, Homo sapiens
cttccctctgtttctctttcc

SEQ ID NO: 1658923 - DNA, 12 bp, Homo sapiens
cttccctcttcc

SEQ ID NO: 1658924 - DNA, 17 bp, Homo sapiens
cttccctcttccctctc

SEQ ID NO: 1658925 - DNA, 18 bp, Homo sapiens
cttccctgacttgcttta

SEQ ID NO: 1658926 - DNA, 18 bp, Homo sapiens
cttccctgcgcctgtgat

SEQ ID NO: 1658927 - DNA, 21 bp, Homo sapiens
cttccctgctttgcatctttg

SEQ ID NO: 1658928 - DNA, 23 bp, Homo sapiens
cttccctggaaaccttccaccca

SEQ ID NO: 1658929 - DNA, 19 bp, Homo sapiens
cttccctggaggagaagta

SEQ ID NO: 1658930 - DNA, 23 bp, Homo sapiens
cttccctggctacttcccttcct

SEQ ID NO: 1658931 - DNA, 12 bp, Homo sapiens
cttccctggctt

SEQ ID NO: 1658932 - DNA, 15 bp, Homo sapiens
cttccctgggaaggc

SEQ ID NO: 1658933 - DNA, 12 bp, Homo sapiens
cttccctgggct

SEQ ID NO: 1658934 - DNA, 18 bp, Homo sapiens
cttccctgggctgtgcta

SEQ ID NO: 1658935 - DNA, 13 bp, Homo sapiens
cttccctgtccca

SEQ ID NO: 1658936 - DNA, 14 bp, Homo sapiens
cttccctgtccctc

SEQ ID NO: 1658937 - DNA, 22 bp, Homo sapiens
cttccctgtgtagtttgtgctg

SEQ ID NO: 1658938 - DNA, 20 bp, Homo sapiens
cttcccttagcctctcccac

SEQ ID NO: 1658939 - DNA, 17 bp, Homo sapiens
cttcccttcccagacca

SEQ ID NO: 1658940 - DNA, 23 bp, Homo sapiens
cttcccttctccccagccagagg

SEQ ID NO: 1658941 - DNA, 13 bp, Homo sapiens
cttcccttctctt

SEQ ID NO: 1658942 - DNA, 15 bp, Homo sapiens
cttcccttctcttgg

SEQ ID NO: 1658943 - DNA, 15 bp, Homo sapiens
cttcccttgagccct

SEQ ID NO: 1658944 - DNA, 13 bp, Homo sapiens
cttccctttctgc

SEQ ID NO: 1658945 - DNA, 14 bp, Homo sapiens
cttcccttttacat

SEQ ID NO: 1658946 - DNA, 19 bp, Homo sapiens
cttccgatcaacatttatg

SEQ ID NO: 1658947 - DNA, 17 bp, Homo sapiens
cttccgatgacagtgct

SEQ ID NO: 1658948 - DNA, 18 bp, Homo sapiens
cttccgatgtttgtgtca

SEQ ID NO: 1658949 - DNA, 20 bp, Homo sapiens
cttccgatgtttgtgtcaca

SEQ ID NO: 1658950 - DNA, 16 bp, Homo sapiens
cttccgctgaggggtc

SEQ ID NO: 1658951 - DNA, 19 bp, Homo sapiens
cttccgctttgaaagaagc

SEQ ID NO: 1658952 - DNA, 20 bp, Homo sapiens
cttccgtggtcagagtgcca

SEQ ID NO: 1658953 - DNA, 13 bp, Homo sapiens
cttcctaaatttc

SEQ ID NO: 1658954 - DNA, 15 bp, Homo sapiens
cttcctaaatttcat

SEQ ID NO: 1658955 - DNA, 18 bp, Homo sapiens
cttcctacaagagcagcc

SEQ ID NO: 1658956 - DNA, 15 bp, Homo sapiens
cttcctacctatccc

SEQ ID NO: 1658957 - DNA, 22 bp, Homo sapiens
cttcctagaagttactgaatgc

SEQ ID NO: 1658958 - DNA, 16 bp, Homo sapiens
cttcctagatctgcag

SEQ ID NO: 1658959 - DNA, 14 bp, Homo sapiens
cttcctagccttgc

SEQ ID NO: 1658960 - DNA, 20 bp, Homo sapiens
cttcctagggatctgaaatc

SEQ ID NO: 1658961 - DNA, 19 bp, Homo sapiens
cttcctcacacccctgtcc

SEQ ID NO: 1658962 - DNA, 20 bp, Homo sapiens
cttcctcacacccctgtccc

SEQ ID NO: 1658963 - DNA, 20 bp, Homo sapiens
cttcctcactatgacactga

SEQ ID NO: 1658964 - DNA, 22 bp, Homo sapiens
cttcctcactatgacactgagc

SEQ ID NO: 1658965 - DNA, 15 bp, Homo sapiens
cttcctcagcctcca

SEQ ID NO: 1658966 - DNA, 20 bp, Homo sapiens
cttcctcagcctccaaagtg

SEQ ID NO: 1658967 - DNA, 23 bp, Homo sapiens
cttcctcatccaccccatccctc

SEQ ID NO: 1658968 - DNA, 15 bp, Homo sapiens
cttcctccacatcct

SEQ ID NO: 1658969 - DNA, 21 bp, Homo sapiens
cttcctccacatcctttctaa

SEQ ID NO: 1658970 - DNA, 22 bp, Homo sapiens
cttcctccccacactccactct

SEQ ID NO: 1658971 - DNA, 21 bp, Homo sapiens
cttcctcccggggccttcctt

SEQ ID NO: 1658972 - DNA, 18 bp, Homo sapiens
cttcctccgtccacccag

SEQ ID NO: 1658973 - DNA, 23 bp, Homo sapiens
cttcctccgtccacccaggctgc

SEQ ID NO: 1658974 - DNA, 15 bp, Homo sapiens
cttcctcctccacag

SEQ ID NO: 1658975 - DNA, 19 bp, Homo sapiens
cttcctcctccacagtgct

SEQ ID NO: 1658976 - DNA, 23 bp, Homo sapiens
cttcctcctccacagtgctgctt

SEQ ID NO: 1658977 - DNA, 10 bp, Homo sapiens
cttcctcctg

SEQ ID NO: 1658978 - DNA, 21 bp, Homo sapiens
cttcctcctgatggagtgtgc

SEQ ID NO: 1658979 - DNA, 21 bp, Homo sapiens
cttcctcctgatggccaagag

SEQ ID NO: 1658980 - DNA, 22 bp, Homo sapiens
cttcctctcaagctagccagag

SEQ ID NO: 1658981 - DNA, 20 bp, Homo sapiens
cttcctctcgcggccctcag

SEQ ID NO: 1658982 - DNA, 21 bp, Homo sapiens
cttcctctcgcggccctcagt

SEQ ID NO: 1658983 - DNA, 15 bp, Homo sapiens
cttcctctctcctta

SEQ ID NO: 1658984 - DNA, 14 bp, Homo sapiens
cttcctctgcagct

SEQ ID NO: 1658985 - DNA, 19 bp, Homo sapiens
cttcctctggttcctttca

SEQ ID NO: 1658986 - DNA, 13 bp, Homo sapiens
cttcctcttagcc

SEQ ID NO: 1658987 - DNA, 19 bp, Homo sapiens
cttcctcttagcctctgga

SEQ ID NO: 1658988 - DNA, 17 bp, Homo sapiens
cttcctcttcctgccct

SEQ ID NO: 1658989 - DNA, 15 bp, Homo sapiens
cttcctcttcttgtt

SEQ ID NO: 1658990 - DNA, 18 bp, Homo sapiens
cttcctcttgtctgattt

SEQ ID NO: 1658991 - DNA, 17 bp, Homo sapiens
cttcctcttttcctgct

SEQ ID NO: 1658992 - DNA, 17 bp, Homo sapiens
cttcctgacactttaat

SEQ ID NO: 1658993 - DNA, 19 bp, Homo sapiens
cttcctgactctcacctgt

SEQ ID NO: 1658994 - DNA, 17 bp, Homo sapiens
cttcctgcattcaccca

SEQ ID NO: 1658995 - DNA, 11 bp, Homo sapiens
cttcctgccac

SEQ ID NO: 1658996 - DNA, 13 bp, Homo sapiens
cttcctgccactg

SEQ ID NO: 1658997 - DNA, 11 bp, Homo sapiens
cttcctgccct

SEQ ID NO: 1658998 - DNA, 16 bp, Homo sapiens
cttcctgcccttgaac

SEQ ID NO: 1658999 - DNA, 15 bp, Homo sapiens
cttcctgcgtcctcc

SEQ ID NO: 1659000 - DNA, 16 bp, Homo sapiens
cttcctgcgtcctcct

SEQ ID NO: 1659001 - DNA, 20 bp, Homo sapiens
cttcctgcgtcctcctcacc

SEQ ID NO: 1659002 - DNA, 21 bp, Homo sapiens
cttcctgcgtcctcctcacct

SEQ ID NO: 1659003 - DNA, 15 bp, Homo sapiens
cttcctgctgcaccc

SEQ ID NO: 1659004 - DNA, 20 bp, Homo sapiens
cttcctgctgcaccctgcgc

SEQ ID NO: 1659005 - DNA, 13 bp, Homo sapiens
cttcctgctgctg

SEQ ID NO: 1659006 - DNA, 14 bp, Homo sapiens
cttcctgctgctgt

SEQ ID NO: 1659007 - DNA, 20 bp, Homo sapiens
cttcctggaaacagcatgaa

SEQ ID NO: 1659008 - DNA, 18 bp, Homo sapiens
cttcctggacctgagtcg

SEQ ID NO: 1659009 - DNA, 22 bp, Homo sapiens
cttcctggagcccagaggaggg

SEQ ID NO: 1659010 - DNA, 18 bp, Homo sapiens
cttcctggcctcactggc

SEQ ID NO: 1659011 - DNA, 14 bp, Homo sapiens
cttcctggcctccc

SEQ ID NO: 1659012 - DNA, 15 bp, Homo sapiens
cttcctggcctccct

SEQ ID NO: 1659013 - DNA, 19 bp, Homo sapiens
cttcctggcctgagagtca

SEQ ID NO: 1659014 - DNA, 23 bp, Homo sapiens
cttcctggggcatctggcgaatc

SEQ ID NO: 1659015 - DNA, 22 bp, Homo sapiens
cttcctggggccccgctgggat

SEQ ID NO: 1659016 - DNA, 21 bp, Homo sapiens
cttcctgggtcctgttcccta

SEQ ID NO: 1659017 - DNA, 23 bp, Homo sapiens
cttcctgggtcctgttccctacc

SEQ ID NO: 1659018 - DNA, 15 bp, Homo sapiens
cttcctggtgagaac

SEQ ID NO: 1659019 - DNA, 21 bp, Homo sapiens
cttcctggtgagaactgagga

SEQ ID NO: 1659020 - DNA, 22 bp, Homo sapiens
cttcctggtgagaactgaggag

SEQ ID NO: 1659021 - DNA, 15 bp, Homo sapiens
cttcttcttccaaat

SEQ ID NO: 1659022 - DNA, 16 bp, Homo sapiens
cttcttgaatataaaa

SEQ ID NO: 1659023 - DNA, 16 bp, Homo sapiens
cttcttgcctctgtgc

SEQ ID NO: 1659024 - DNA, 14 bp, Homo sapiens
cttcttgctatatg

SEQ ID NO: 1659025 - DNA, 21 bp, Homo sapiens
cttcttgcttctttctagaaa

SEQ ID NO: 1659026 - DNA, 17 bp, Homo sapiens
cttcttggaccttggcg

SEQ ID NO: 1659027 - DNA, 17 bp, Homo sapiens
cttcttggagctttgga

SEQ ID NO: 1659028 - DNA, 22 bp, Homo sapiens
cttcttggggcccagtgcatgg

SEQ ID NO: 1659029 - DNA, 24 bp, Homo sapiens
cttcttggggcccagtgcatggtg

SEQ ID NO: 1659030 - DNA, 16 bp, Homo sapiens
cttcttggtcttattt

SEQ ID NO: 1659031 - DNA, 21 bp, Homo sapiens
cttcttggtttggggagaaat

SEQ ID NO: 1659032 - DNA, 17 bp, Homo sapiens
cttctttaattgatcta

SEQ ID NO: 1659033 - DNA, 17 bp, Homo sapiens
cttctttagatgccaaa

SEQ ID NO: 1659034 - DNA, 18 bp, Homo sapiens
cttctttagatgccaaac

SEQ ID NO: 1659035 - DNA, 13 bp, Homo sapiens
cttctttccatca

SEQ ID NO: 1659036 - DNA, 17 bp, Homo sapiens
cttctttccctggacag

SEQ ID NO: 1659037 - DNA, 16 bp, Homo sapiens
cttctttgtgcctttg

SEQ ID NO: 1659038 - DNA, 22 bp, Homo sapiens
cttcttttgtggtgtcttccat

SEQ ID NO: 1659039 - DNA, 15 bp, Homo sapiens
cttctttttattttc

SEQ ID NO: 1659040 - DNA, 20 bp, Homo sapiens
cttctttttattttcttttg

SEQ ID NO: 1659041 - DNA, 16 bp, Homo sapiens
cttgaaaaaaaacagt

SEQ ID NO: 1659042 - DNA, 12 bp, Homo sapiens
cttgaaaaacaa

SEQ ID NO: 1659043 - DNA, 17 bp, Homo sapiens
cttgaaaagttcaggga

SEQ ID NO: 1659044 - DNA, 20 bp, Homo sapiens
cttgaaaataaaaagagaaa

SEQ ID NO: 1659045 - DNA, 20 bp, Homo sapiens
cttgaaaattttattaaaaa

SEQ ID NO: 1659046 - DNA, 20 bp, Homo sapiens
cttgaaacagattcaggcca

SEQ ID NO: 1659047 - DNA, 21 bp, Homo sapiens
cttgaaacagattcaggccag

SEQ ID NO: 1659048 - DNA, 20 bp, Homo sapiens
cttgaaacctgttaaaacaa

SEQ ID NO: 1659049 - DNA, 19 bp, Homo sapiens
cttgaaagaagttttatgc

SEQ ID NO: 1659050 - DNA, 13 bp, Homo sapiens
cttgaaagctgtg

SEQ ID NO: 1659051 - DNA, 22 bp, Homo sapiens
cttgaaatatataatattcagc

SEQ ID NO: 1659052 - DNA, 18 bp, Homo sapiens
cttgaaatattcagaaat

SEQ ID NO: 1659053 - DNA, 19 bp, Homo sapiens
cttgaaatattcagaaatt

SEQ ID NO: 1659054 - DNA, 15 bp, Homo sapiens
cttgaacactggggg

SEQ ID NO: 1659055 - DNA, 16 bp, Homo sapiens
cttgaacatacttggt

SEQ ID NO: 1659056 - DNA, 18 bp, Homo sapiens
cttgaacatgttttgtat

SEQ ID NO: 1659057 - DNA, 18 bp, Homo sapiens
cttgaaccccctccctgt

SEQ ID NO: 1659058 - DNA, 21 bp, Homo sapiens
cttgaacgagcagcccagggc

SEQ ID NO: 1659059 - DNA, 23 bp, Homo sapiens
cttgaacgagcagcccagggcct

SEQ ID NO: 1659060 - DNA, 18 bp, Homo sapiens
cttgaactcctggactca

SEQ ID NO: 1659061 - DNA, 12 bp, Homo sapiens
cttgaagaactg

SEQ ID NO: 1659062 - DNA, 18 bp, Homo sapiens
cttgaagaactgcaggcc

SEQ ID NO: 1659063 - DNA, 20 bp, Homo sapiens
cttgaagaactgcaggccct

SEQ ID NO: 1659064 - DNA, 18 bp, Homo sapiens
cttgaagaatagtcataa

SEQ ID NO: 1659065 - DNA, 15 bp, Homo sapiens
cttgaagacagagca

SEQ ID NO: 1659066 - DNA, 16 bp, Homo sapiens
cttgaagacagagcaa

SEQ ID NO: 1659067 - DNA, 12 bp, Homo sapiens
cttgaagcagtc

SEQ ID NO: 1659068 - DNA, 20 bp, Homo sapiens
cttgaagcatttcaaagccc

SEQ ID NO: 1659069 - DNA, 23 bp, Homo sapiens
cttgaagcatttcaaagccctgc

SEQ ID NO: 1659070 - DNA, 24 bp, Homo sapiens
cttgaagcatttcaaagccctgcc

SEQ ID NO: 1659071 - DNA, 13 bp, Homo sapiens
cttgaagccaaag

SEQ ID NO: 1659072 - DNA, 19 bp, Homo sapiens
cttgaagccaaagaaaaat

SEQ ID NO: 1659073 - DNA, 21 bp, Homo sapiens
cttgaagccactgaagctggg

SEQ ID NO: 1659074 - DNA, 18 bp, Homo sapiens
cttgaagcctaaatttgt

SEQ ID NO: 1659075 - DNA, 14 bp, Homo sapiens
cttgaaggaaaaat

SEQ ID NO: 1659076 - DNA, 15 bp, Homo sapiens
cttgaaggaaaaatt

SEQ ID NO: 1659077 - DNA, 18 bp, Homo sapiens
cttgaaggaaaaattcaa

SEQ ID NO: 1659078 - DNA, 18 bp, Homo sapiens
cttgaaggactgcagaca

SEQ ID NO: 1659079 - DNA, 18 bp, Homo sapiens
cttgaaggccctgctgag

SEQ ID NO: 1659080 - DNA, 13 bp, Homo sapiens
cttgaagggccag

SEQ ID NO: 1659081 - DNA, 14 bp, Homo sapiens
cttgaagggccaga

SEQ ID NO: 1659082 - DNA, 15 bp, Homo sapiens
cttgaagggccagag

SEQ ID NO: 1659083 - DNA, 16 bp, Homo sapiens
cttgaagggccagagc

SEQ ID NO: 1659084 - DNA, 21 bp, Homo sapiens
cttgaagggccagagccaggg

SEQ ID NO: 1659085 - DNA, 19 bp, Homo sapiens
cttgaagtcagccacactg

SEQ ID NO: 1659086 - DNA, 16 bp, Homo sapiens
cttgaagttgggtgtt

SEQ ID NO: 1659087 - DNA, 14 bp, Homo sapiens
cttgaataggaaga

SEQ ID NO: 1659088 - DNA, 14 bp, Homo sapiens
cttgaatatgtagc

SEQ ID NO: 1659089 - DNA, 16 bp, Homo sapiens
cttgaatattcctgga

SEQ ID NO: 1659090 - DNA, 22 bp, Homo sapiens
cttgaatattcctggacttaca

SEQ ID NO: 1659091 - DNA, 15 bp, Homo sapiens
cttgaatcctctatt

SEQ ID NO: 1659092 - DNA, 16 bp, Homo sapiens
cttgaatcctctatta

SEQ ID NO: 1659093 - DNA, 21 bp, Homo sapiens
cttgaatccttccattccaca

SEQ ID NO: 1659094 - DNA, 13 bp, Homo sapiens
cttgaatcttctc

SEQ ID NO: 1659095 - DNA, 15 bp, Homo sapiens
cttgacaacatccca

SEQ ID NO: 1659096 - DNA, 13 bp, Homo sapiens
cttgacaccacta

SEQ ID NO: 1659097 - DNA, 16 bp, Homo sapiens
cttgacaccactaaga

SEQ ID NO: 1659098 - DNA, 15 bp, Homo sapiens
cttgacacctgtctt

SEQ ID NO: 1659099 - DNA, 19 bp, Homo sapiens
cttgacatacctaccagta

SEQ ID NO: 1659100 - DNA, 20 bp, Homo sapiens
cttgacatacctaccagtat

SEQ ID NO: 1659101 - DNA, 14 bp, Homo sapiens
cttgacattcaagg

SEQ ID NO: 1659102 - DNA, 12 bp, Homo sapiens
cttgacattcct

SEQ ID NO: 1659103 - DNA, 13 bp, Homo sapiens
cttgacattcctt

SEQ ID NO: 1659104 - DNA, 20 bp, Homo sapiens
cttgaccagcagatcccagc

SEQ ID NO: 1659105 - DNA, 13 bp, Homo sapiens
cttgaccaggctg

SEQ ID NO: 1659106 - DNA, 22 bp, Homo sapiens
cttgaccatcgtccttcctctc

SEQ ID NO: 1659107 - DNA, 14 bp, Homo sapiens
cttgacctgaggct

SEQ ID NO: 1659108 - DNA, 18 bp, Homo sapiens
cttgacctgtttctctgc

SEQ ID NO: 1659109 - DNA, 15 bp, Homo sapiens
cttgacgtttcttct

SEQ ID NO: 1659110 - DNA, 20 bp, Homo sapiens
cttgacgtttcttctttcta

SEQ ID NO: 1659111 - DNA, 15 bp, Homo sapiens
cttgactcaggattt

SEQ ID NO: 1659112 - DNA, 16 bp, Homo sapiens
cttgactcatggcagc

SEQ ID NO: 1659113 - DNA, 19 bp, Homo sapiens
cttgactcatggcagctgt

SEQ ID NO: 1659114 - DNA, 14 bp, Homo sapiens
cttgactctaaatg

SEQ ID NO: 1659115 - DNA, 19 bp, Homo sapiens
cttgactctactgatctga

SEQ ID NO: 1659116 - DNA, 12 bp, Homo sapiens
cttgagaaacct

SEQ ID NO: 1659117 - DNA, 13 bp, Homo sapiens
cttgagaaacctt

SEQ ID NO: 1659118 - DNA, 21 bp, Homo sapiens
cttgagacccccaagcttcca

SEQ ID NO: 1659119 - DNA, 21 bp, Homo sapiens
cttgagagaaaaagtgcccct

SEQ ID NO: 1659120 - DNA, 18 bp, Homo sapiens
cttgagagacccagctgc

SEQ ID NO: 1659121 - DNA, 16 bp, Homo sapiens
cttgagagctcaggca

SEQ ID NO: 1659122 - DNA, 13 bp, Homo sapiens
cttgagagctgct

SEQ ID NO: 1659123 - DNA, 16 bp, Homo sapiens
cttgagagctgctgag

SEQ ID NO: 1659124 - DNA, 22 bp, Homo sapiens
cttgagatggtgaggctgtcag

SEQ ID NO: 1659125 - DNA, 21 bp, Homo sapiens
cttgagatgtatgaaggcttt

SEQ ID NO: 1659126 - DNA, 15 bp, Homo sapiens
cttgagatgtcttct

SEQ ID NO: 1659127 - DNA, 13 bp, Homo sapiens
cttgagcagtggc

SEQ ID NO: 1659128 - DNA, 14 bp, Homo sapiens
cttgagcagtggct

SEQ ID NO: 1659129 - DNA, 21 bp, Homo sapiens
cttgagccacagtcactggat

SEQ ID NO: 1659130 - DNA, 17 bp, Homo sapiens
cttgagccatccaaaga

SEQ ID NO: 1659131 - DNA, 22 bp, Homo sapiens
cttgagccatccaaagaaacac

SEQ ID NO: 1659132 - DNA, 15 bp, Homo sapiens
cttgagcccaggagt

SEQ ID NO: 1659133 - DNA, 12 bp, Homo sapiens
cttgagccctgg

SEQ ID NO: 1659134 - DNA, 14 bp, Homo sapiens
cttgagccctggct

SEQ ID NO: 1659135 - DNA, 20 bp, Homo sapiens
cttgagccctggctgttctg

SEQ ID NO: 1659136 - DNA, 18 bp, Homo sapiens
cttggaggagagagaccc

SEQ ID NO: 1659137 - DNA, 14 bp, Homo sapiens
cttggagggaagcc

SEQ ID NO: 1659138 - DNA, 15 bp, Homo sapiens
cttggagtcccaggg

SEQ ID NO: 1659139 - DNA, 19 bp, Homo sapiens
cttggagtcccaggggcag

SEQ ID NO: 1659140 - DNA, 14 bp, Homo sapiens
cttggagtggccaa

SEQ ID NO: 1659141 - DNA, 22 bp, Homo sapiens
cttggagtttttcattgtcgct

SEQ ID NO: 1659142 - DNA, 23 bp, Homo sapiens
cttggataatgctgttgcctcat

SEQ ID NO: 1659143 - DNA, 20 bp, Homo sapiens
cttggatcccaaagcaagga

SEQ ID NO: 1659144 - DNA, 22 bp, Homo sapiens
cttggatcgctaagctggctct

SEQ ID NO: 1659145 - DNA, 21 bp, Homo sapiens
cttggattattttaaatcatt

SEQ ID NO: 1659146 - DNA, 13 bp, Homo sapiens
cttggattcctgc

SEQ ID NO: 1659147 - DNA, 22 bp, Homo sapiens
cttggattctctgagaaatgat

SEQ ID NO: 1659148 - DNA, 15 bp, Homo sapiens
cttggattttcctga

SEQ ID NO: 1659149 - DNA, 16 bp, Homo sapiens
cttggattttcctgaa

SEQ ID NO: 1659150 - DNA, 14 bp, Homo sapiens
cttggcaaatttta

SEQ ID NO: 1659151 - DNA, 13 bp, Homo sapiens
cttggcaacagaa

SEQ ID NO: 1659152 - DNA, 18 bp, Homo sapiens
cttggcagccgagctcgt

SEQ ID NO: 1659153 - DNA, 16 bp, Homo sapiens
cttggcatacaaaata

SEQ ID NO: 1659154 - DNA, 17 bp, Homo sapiens
cttggcatacaaaatat

SEQ ID NO: 1659155 - DNA, 22 bp, Homo sapiens
cttggcatcacagggcagagcc

SEQ ID NO: 1659156 - DNA, 16 bp, Homo sapiens
cttggcatgccttcca

SEQ ID NO: 1659157 - DNA, 15 bp, Homo sapiens
cttggcattggaatt

SEQ ID NO: 1659158 - DNA, 16 bp, Homo sapiens
cttggcattggaattc

SEQ ID NO: 1659159 - DNA, 12 bp, Homo sapiens
cttggcatttct

SEQ ID NO: 1659160 - DNA, 14 bp, Homo sapiens
cttggccacagact

SEQ ID NO: 1659161 - DNA, 19 bp, Homo sapiens
cttggccacagactgaact

SEQ ID NO: 1659162 - DNA, 14 bp, Homo sapiens
cttggcccaggagc

SEQ ID NO: 1659163 - DNA, 15 bp, Homo sapiens
cttggcccaggagct

SEQ ID NO: 1659164 - DNA, 16 bp, Homo sapiens
cttggcccctgtgtga

SEQ ID NO: 1659165 - DNA, 20 bp, Homo sapiens
cttggccctttccttccaga

SEQ ID NO: 1659166 - DNA, 22 bp, Homo sapiens
cttggccgcacctaaagcagcc

SEQ ID NO: 1659167 - DNA, 12 bp, Homo sapiens
cttggcctcaga

SEQ ID NO: 1659168 - DNA, 11 bp, Homo sapiens
cttggcctccc

SEQ ID NO: 1659169 - DNA, 14 bp, Homo sapiens
cttggcctcccaag

SEQ ID NO: 1659170 - DNA, 17 bp, Homo sapiens
cttggcctgtctcatcc

SEQ ID NO: 1659171 - DNA, 19 bp, Homo sapiens
cttggcggcagcagccatc

SEQ ID NO: 1659172 - DNA, 18 bp, Homo sapiens
cttggcgtggagccaggg

SEQ ID NO: 1659173 - DNA, 21 bp, Homo sapiens
cttggcgtggagccagggagc

SEQ ID NO: 1659174 - DNA, 15 bp, Homo sapiens
cttggctattgaaga

SEQ ID NO: 1659175 - DNA, 18 bp, Homo sapiens
cttggctatttctgtgtc

SEQ ID NO: 1659176 - DNA, 19 bp, Homo sapiens
cttggctatttctgtgtcc

SEQ ID NO: 1659177 - DNA, 20 bp, Homo sapiens
cttggctatttctgtgtcca

SEQ ID NO: 1659178 - DNA, 16 bp, Homo sapiens
cttggctcagacatgt

SEQ ID NO: 1659179 - DNA, 12 bp, Homo sapiens
cttggctgaccc

SEQ ID NO: 1659180 - DNA, 14 bp, Homo sapiens
cttggctgacccct

SEQ ID NO: 1659181 - DNA, 23 bp, Homo sapiens
cttggctgagatagcagaggggc

SEQ ID NO: 1659182 - DNA, 23 bp, Homo sapiens
cttggctgcaaataaggacagca

SEQ ID NO: 1659183 - DNA, 15 bp, Homo sapiens
cttggctgctcttcc

SEQ ID NO: 1659184 - DNA, 19 bp, Homo sapiens
cttggctgctcttccagcg

SEQ ID NO: 1659185 - DNA, 21 bp, Homo sapiens
cttggctggtgtatgcacagg

SEQ ID NO: 1659186 - DNA, 14 bp, Homo sapiens
cttggctgtctgac

SEQ ID NO: 1659187 - DNA, 20 bp, Homo sapiens
cttggcttcaggggagtccc

SEQ ID NO: 1659188 - DNA, 21 bp, Homo sapiens
cttggcttctgtgatgagctg

SEQ ID NO: 1659189 - DNA, 20 bp, Homo sapiens
cttgggaagtcgaggctgca

SEQ ID NO: 1659190 - DNA, 18 bp, Homo sapiens
cttgggaatggatcctgg

SEQ ID NO: 1659191 - DNA, 20 bp, Homo sapiens
cttgggacccccactaagac

SEQ ID NO: 1659192 - DNA, 15 bp, Homo sapiens
cttgggactgggttt

SEQ ID NO: 1659193 - DNA, 20 bp, Homo sapiens
cttgggaggctgaggcagga

SEQ ID NO: 1659194 - DNA, 23 bp, Homo sapiens
cttgggaggctgaggcaggagaa

SEQ ID NO: 1659195 - DNA, 19 bp, Homo sapiens
cttgggataattccttggt

SEQ ID NO: 1659196 - DNA, 20 bp, Homo sapiens
cttgggatagtgttctgctc

SEQ ID NO: 1659197 - DNA, 22 bp, Homo sapiens
cttgggcactttttaattcacc

SEQ ID NO: 1659198 - DNA, 14 bp, Homo sapiens
cttgggcagagctg

SEQ ID NO: 1659199 - DNA, 19 bp, Homo sapiens
cttgggcagagctggctct

SEQ ID NO: 1659200 - DNA, 20 bp, Homo sapiens
cttgggcagagctggctctg

SEQ ID NO: 1659201 - DNA, 23 bp, Homo sapiens
cttgggcagagctggctctgagc

SEQ ID NO: 1659202 - DNA, 19 bp, Homo sapiens
cttgggcatccacccagtg

SEQ ID NO: 1659203 - DNA, 24 bp, Homo sapiens
cttgggcatccacccagtgctgcc

SEQ ID NO: 1659204 - DNA, 14 bp, Homo sapiens
cttgggcccagctg

SEQ ID NO: 1659205 - DNA, 15 bp, Homo sapiens
cttgggcccagctgg

SEQ ID NO: 1659206 - DNA, 16 bp, Homo sapiens
cttgggcccagctggg

SEQ ID NO: 1659207 - DNA, 18 bp, Homo sapiens
cttgggcccagctgggct

SEQ ID NO: 1659208 - DNA, 22 bp, Homo sapiens
cttgggcccagctgggctctgc

SEQ ID NO: 1659209 - DNA, 14 bp, Homo sapiens
cttgggccctgcac

SEQ ID NO: 1659210 - DNA, 16 bp, Homo sapiens
cttgggccctgcacag

SEQ ID NO: 1659211 - DNA, 17 bp, Homo sapiens
cttgggccctgcacaga

SEQ ID NO: 1659212 - DNA, 18 bp, Homo sapiens
cttgggccctgcattggc

SEQ ID NO: 1659213 - DNA, 21 bp, Homo sapiens
cttgggccctttttcccttcc

SEQ ID NO: 1659214 - DNA, 12 bp, Homo sapiens
cttgggcctggc

SEQ ID NO: 1659215 - DNA, 19 bp, Homo sapiens
cttgggctactggcagctc

SEQ ID NO: 1659216 - DNA, 14 bp, Homo sapiens
cttgggctcctggc

SEQ ID NO: 1659217 - DNA, 18 bp, Homo sapiens
cttgggctcctggctgcc

SEQ ID NO: 1659218 - DNA, 21 bp, Homo sapiens
cttgggctcctggctgccagg

SEQ ID NO: 1659219 - DNA, 14 bp, Homo sapiens
cttgggctgaccca

SEQ ID NO: 1659220 - DNA, 19 bp, Homo sapiens
cttgggctgacccagcatc

SEQ ID NO: 1659221 - DNA, 14 bp, Homo sapiens
cttggggagaaggc

SEQ ID NO: 1659222 - DNA, 22 bp, Homo sapiens
cttggggagttaagacctggca

SEQ ID NO: 1659223 - DNA, 15 bp, Homo sapiens
cttggggattgtaca

SEQ ID NO: 1659224 - DNA, 17 bp, Homo sapiens
cttggggattgtacacg

SEQ ID NO: 1659225 - DNA, 14 bp, Homo sapiens
cttggggcagggcc

SEQ ID NO: 1659226 - DNA, 21 bp, Homo sapiens
cttggggccaccaaagctgcc

SEQ ID NO: 1659227 - DNA, 22 bp, Homo sapiens
cttggggccactttcagagccc

SEQ ID NO: 1659228 - DNA, 15 bp, Homo sapiens
cttggggcccagtgc

SEQ ID NO: 1659229 - DNA, 17 bp, Homo sapiens
cttggggcctggcttgc

SEQ ID NO: 1659230 - DNA, 15 bp, Homo sapiens
cttggggctatttgt

SEQ ID NO: 1659231 - DNA, 18 bp, Homo sapiens
cttggggctcacacacct

SEQ ID NO: 1659232 - DNA, 19 bp, Homo sapiens
cttggggctgatgaagaag

SEQ ID NO: 1659233 - DNA, 24 bp, Homo sapiens
cttgggggatgactagaggcaggg

SEQ ID NO: 1659234 - DNA, 23 bp, Homo sapiens
cttggggggtgggggctgtcctg

SEQ ID NO: 1659235 - DNA, 17 bp, Homo sapiens
cttgggtttttgttacc

SEQ ID NO: 1659236 - DNA, 17 bp, Homo sapiens
cttggtcccatggctga

SEQ ID NO: 1659237 - DNA, 19 bp, Homo sapiens
cttggtcccatggctgaag

SEQ ID NO: 1659238 - DNA, 13 bp, Homo sapiens
cttggtctctcct

SEQ ID NO: 1659239 - DNA, 17 bp, Homo sapiens
cttggtctctccttcct

SEQ ID NO: 1659240 - DNA, 19 bp, Homo sapiens
cttggtctctccttcctct

SEQ ID NO: 1659241 - DNA, 13 bp, Homo sapiens
cttggtcttccat

SEQ ID NO: 1659242 - DNA, 12 bp, Homo sapiens
cttggtcttgaa

SEQ ID NO: 1659243 - DNA, 20 bp, Homo sapiens
cttggtgaatttttttttcc

SEQ ID NO: 1659244 - DNA, 22 bp, Homo sapiens
cttggtgagtcttggttctaaa

SEQ ID NO: 1659245 - DNA, 13 bp, Homo sapiens
cttggtgctgtgt

SEQ ID NO: 1659246 - DNA, 14 bp, Homo sapiens
cttggtgctgtgtg

SEQ ID NO: 1659247 - DNA, 17 bp, Homo sapiens
cttggtggagcagccag

SEQ ID NO: 1659248 - DNA, 23 bp, Homo sapiens
cttggtgggtgtggccagcacac

SEQ ID NO: 1659249 - DNA, 13 bp, Homo sapiens
cttggtgtaattt

SEQ ID NO: 1659250 - DNA, 20 bp, Homo sapiens
ctttatgtagtttttatatg

SEQ ID NO: 1659251 - DNA, 13 bp, Homo sapiens
ctttatgtattat

SEQ ID NO: 1659252 - DNA, 16 bp, Homo sapiens
ctttatgtgaactttg

SEQ ID NO: 1659253 - DNA, 14 bp, Homo sapiens
ctttatgtgaattt

SEQ ID NO: 1659254 - DNA, 20 bp, Homo sapiens
ctttatgttcatttgtttgt

SEQ ID NO: 1659255 - DNA, 12 bp, Homo sapiens
ctttatgttgta

SEQ ID NO: 1659256 - DNA, 17 bp, Homo sapiens
ctttatgtttttggtta

SEQ ID NO: 1659257 - DNA, 14 bp, Homo sapiens
ctttattaagtaaa

SEQ ID NO: 1659258 - DNA, 14 bp, Homo sapiens
ctttattaccccct

SEQ ID NO: 1659259 - DNA, 14 bp, Homo sapiens
ctttattctgtgtt

SEQ ID NO: 1659260 - DNA, 19 bp, Homo sapiens
ctttattttgagatgtaaa

SEQ ID NO: 1659261 - DNA, 23 bp, Homo sapiens
ctttattttttaagtatttatat

SEQ ID NO: 1659262 - DNA, 21 bp, Homo sapiens
ctttcaaagaaggaattctag

SEQ ID NO: 1659263 - DNA, 15 bp, Homo sapiens
ctttcaaaggaacat

SEQ ID NO: 1659264 - DNA, 15 bp, Homo sapiens
ctttcaagctgcact

SEQ ID NO: 1659265 - DNA, 14 bp, Homo sapiens
ctttcaagtgcctt

SEQ ID NO: 1659266 - DNA, 23 bp, Homo sapiens
ctttcaagtgcctttctgcagtt

SEQ ID NO: 1659267 - DNA, 16 bp, Homo sapiens
ctttcacaaccttctg

SEQ ID NO: 1659268 - DNA, 14 bp, Homo sapiens
ctttcacacttcca

SEQ ID NO: 1659269 - DNA, 15 bp, Homo sapiens
ctttcacacttccac

SEQ ID NO: 1659270 - DNA, 16 bp, Homo sapiens
ctttcacacttccacc

SEQ ID NO: 1659271 - DNA, 21 bp, Homo sapiens
ctttcacacttccaccagcct

SEQ ID NO: 1659272 - DNA, 13 bp, Homo sapiens
ctttcacagctcc

SEQ ID NO: 1659273 - DNA, 15 bp, Homo sapiens
ctttcacagctcctc

SEQ ID NO: 1659274 - DNA, 22 bp, Homo sapiens
ctttcacattgtttgctgctat

SEQ ID NO: 1659275 - DNA, 15 bp, Homo sapiens
ctttcacatttaaat

SEQ ID NO: 1659276 - DNA, 20 bp, Homo sapiens
ctttcaccaagatgggtggc

SEQ ID NO: 1659277 - DNA, 17 bp, Homo sapiens
ctttcaccctcatgaaa

SEQ ID NO: 1659278 - DNA, 16 bp, Homo sapiens
ctttcactatttcctt

SEQ ID NO: 1659279 - DNA, 21 bp, Homo sapiens
ctttcactatttcctttataa

SEQ ID NO: 1659280 - DNA, 15 bp, Homo sapiens
ctttcacttcttcct

SEQ ID NO: 1659281 - DNA, 21 bp, Homo sapiens
ctttcagaaatataacacatt

SEQ ID NO: 1659282 - DNA, 22 bp, Homo sapiens
ctttcagaatattttcaaaata

SEQ ID NO: 1659283 - DNA, 22 bp, Homo sapiens
ctttcagactctctctgggagg

SEQ ID NO: 1659284 - DNA, 15 bp, Homo sapiens
ctttcagagccagcc

SEQ ID NO: 1659285 - DNA, 19 bp, Homo sapiens
ctttcagagccagcctggc

SEQ ID NO: 1659286 - DNA, 21 bp, Homo sapiens
ctttcagagccagcctggctc

SEQ ID NO: 1659287 - DNA, 18 bp, Homo sapiens
ctttcagagcccccagcc

SEQ ID NO: 1659288 - DNA, 19 bp, Homo sapiens
ctttcagatacatggttgt

SEQ ID NO: 1659289 - DNA, 15 bp, Homo sapiens
ctttcagatgtcttc

SEQ ID NO: 1659290 - DNA, 16 bp, Homo sapiens
ctttcagatgtcttct

SEQ ID NO: 1659291 - DNA, 20 bp, Homo sapiens
ctttcagatgtcttctgcct

SEQ ID NO: 1659292 - DNA, 21 bp, Homo sapiens
ctttcagatgtcttctgcctg

SEQ ID NO: 1659293 - DNA, 12 bp, Homo sapiens
ctttcagccaca

SEQ ID NO: 1659294 - DNA, 20 bp, Homo sapiens
ctttcagggaatttcaggaa

SEQ ID NO: 1659295 - DNA, 21 bp, Homo sapiens
ctttcagtacttttttaaata

SEQ ID NO: 1659296 - DNA, 22 bp, Homo sapiens
ctttcagtgcagtttcttttca

SEQ ID NO: 1659297 - DNA, 23 bp, Homo sapiens
ctttcataatttaaaaatctcca

SEQ ID NO: 1659298 - DNA, 18 bp, Homo sapiens
ctttcataccacttgaat

SEQ ID NO: 1659299 - DNA, 19 bp, Homo sapiens
ctttcatagtataacttta

SEQ ID NO: 1659300 - DNA, 19 bp, Homo sapiens
ctttcatcacactgggtgg

SEQ ID NO: 1659301 - DNA, 21 bp, Homo sapiens
ctttcatctctctacctccac

SEQ ID NO: 1659302 - DNA, 23 bp, Homo sapiens
ctttcatgctacagaaagctgct

SEQ ID NO: 1659303 - DNA, 15 bp, Homo sapiens
ctttcattttgcttt

SEQ ID NO: 1659304 - DNA, 22 bp, Homo sapiens
ctttcatttttttccaggctgg

SEQ ID NO: 1659305 - DNA, 11 bp, Homo sapiens
ctttccaaatt

SEQ ID NO: 1659306 - DNA, 13 bp, Homo sapiens
ctttccaaattaa

SEQ ID NO: 1659307 - DNA, 19 bp, Homo sapiens
ctttccaaattaaaacaaa

SEQ ID NO: 1659308 - DNA, 18 bp, Homo sapiens
ctttccaacctcacttcc

SEQ ID NO: 1659309 - DNA, 18 bp, Homo sapiens
ctttccacatttgtcaca

SEQ ID NO: 1659310 - DNA, 17 bp, Homo sapiens
ctttccaccacagccag

SEQ ID NO: 1659311 - DNA, 14 bp, Homo sapiens
ctttccatctgtcc

SEQ ID NO: 1659312 - DNA, 15 bp, Homo sapiens
ctttccatctgtcca

SEQ ID NO: 1659313 - DNA, 23 bp, Homo sapiens
ctttccatgggagccagctgctt

SEQ ID NO: 1659314 - DNA, 17 bp, Homo sapiens
ctttccatgttgctgcc

SEQ ID NO: 1659315 - DNA, 19 bp, Homo sapiens
ctttcccaaaatgtgcctc

SEQ ID NO: 1659316 - DNA, 15 bp, Homo sapiens
ctttcccaagccttc

SEQ ID NO: 1659317 - DNA, 16 bp, Homo sapiens
ctttcccaccattcct

SEQ ID NO: 1659318 - DNA, 16 bp, Homo sapiens
ctttcccatcttccaa

SEQ ID NO: 1659319 - DNA, 17 bp, Homo sapiens
ctttcccatggggaggg

SEQ ID NO: 1659320 - DNA, 14 bp, Homo sapiens
ctttccccacacct

SEQ ID NO: 1659321 - DNA, 15 bp, Homo sapiens
ctttccccagaggct

SEQ ID NO: 1659322 - DNA, 20 bp, Homo sapiens
ctttccccagaggctcccaa

SEQ ID NO: 1659323 - DNA, 21 bp, Homo sapiens
ctttccccagaggctcccaat

SEQ ID NO: 1659324 - DNA, 22 bp, Homo sapiens
ctttccccagaggctcccaatc

SEQ ID NO: 1659325 - DNA, 13 bp, Homo sapiens
ctttccctgagga

SEQ ID NO: 1659326 - DNA, 22 bp, Homo sapiens
ctttccggccaaggtgccacca

SEQ ID NO: 1659327 - DNA, 17 bp, Homo sapiens
ctttccgtggcactgca

SEQ ID NO: 1659328 - DNA, 22 bp, Homo sapiens
ctttcctacttgcactcttcta

SEQ ID NO: 1659329 - DNA, 15 bp, Homo sapiens
ctttcctcacatttg

SEQ ID NO: 1659330 - DNA, 14 bp, Homo sapiens
ctttcctccaccca

SEQ ID NO: 1659331 - DNA, 22 bp, Homo sapiens
ctttcctctaactcactgccta

SEQ ID NO: 1659332 - DNA, 15 bp, Homo sapiens
ctttcctctttctgc

SEQ ID NO: 1659333 - DNA, 22 bp, Homo sapiens
ctttcctgaatccaaactaatc

SEQ ID NO: 1659334 - DNA, 21 bp, Homo sapiens
ctttcctgagctgtcgctgcc

SEQ ID NO: 1659335 - DNA, 21 bp, Homo sapiens
ctttcctgcaactcaaggact

SEQ ID NO: 1659336 - DNA, 19 bp, Homo sapiens
ctttcctgcatctctgtga

SEQ ID NO: 1659337 - DNA, 10 bp, Homo sapiens
ctttcctgcc

SEQ ID NO: 1659338 - DNA, 21 bp, Homo sapiens
ctttcctgccatgtttagtga

SEQ ID NO: 1659339 - DNA, 13 bp, Homo sapiens
ctttcctgcccca

SEQ ID NO: 1659340 - DNA, 18 bp, Homo sapiens
ctttcctgccccaggcct

SEQ ID NO: 1659341 - DNA, 19 bp, Homo sapiens
ctttcctgccccaggcctg

SEQ ID NO: 1659342 - DNA, 10 bp, Homo sapiens
ctttcctgtc

SEQ ID NO: 1659343 - DNA, 21 bp, Homo sapiens
ctttcctgtgtgtactctgtc

SEQ ID NO: 1659344 - DNA, 15 bp, Homo sapiens
ctttccttcccaggc

SEQ ID NO: 1659345 - DNA, 16 bp, Homo sapiens
ctttccttccctctcc

SEQ ID NO: 1659346 - DNA, 17 bp, Homo sapiens
ctttccttccctctcct

SEQ ID NO: 1659347 - DNA, 20 bp, Homo sapiens
ctttccttccctctcctgct

SEQ ID NO: 1659348 - DNA, 17 bp, Homo sapiens
ctttccttggctttatg

SEQ ID NO: 1659349 - DNA, 14 bp, Homo sapiens
ctttcggagctcct

SEQ ID NO: 1659350 - DNA, 18 bp, Homo sapiens
ctttctacttttttcatt

SEQ ID NO: 1659351 - DNA, 22 bp, Homo sapiens
ctttctagaaagagaaacagtt

SEQ ID NO: 1659352 - DNA, 21 bp, Homo sapiens
ctttctagagcagttggccaa

SEQ ID NO: 1659353 - DNA, 23 bp, Homo sapiens
ctttctattgttaaacaaatgat

SEQ ID NO: 1659354 - DNA, 16 bp, Homo sapiens
ctttctcagttttcat

SEQ ID NO: 1659355 - DNA, 14 bp, Homo sapiens
ctttctccagccag

SEQ ID NO: 1659356 - DNA, 19 bp, Homo sapiens
ctttctccagccagcaatg

SEQ ID NO: 1659357 - DNA, 23 bp, Homo sapiens
ctttctcccctgcccccaggact

SEQ ID NO: 1659358 - DNA, 12 bp, Homo sapiens
ctttctcctgtg

SEQ ID NO: 1659359 - DNA, 13 bp, Homo sapiens
ctttctcctgtgc

SEQ ID NO: 1659360 - DNA, 14 bp, Homo sapiens
ctttctcctgtgcc

SEQ ID NO: 1659361 - DNA, 15 bp, Homo sapiens
ctttctcctgtgccc

SEQ ID NO: 1659362 - DNA, 23 bp, Homo sapiens
ctttctctccgacttcccctggg

SEQ ID NO: 1659363 - DNA, 13 bp, Homo sapiens
ctttctctcctgg

SEQ ID NO: 1659364 - DNA, 12 bp, Homo sapiens
cttttgcccaca

SEQ ID NO: 1659365 - DNA, 13 bp, Homo sapiens
cttttgcctgtaa

SEQ ID NO: 1659366 - DNA, 16 bp, Homo sapiens
cttttgcctgtaagaa

SEQ ID NO: 1659367 - DNA, 15 bp, Homo sapiens
cttttgctactaagt

SEQ ID NO: 1659368 - DNA, 14 bp, Homo sapiens
cttttgctctctgt

SEQ ID NO: 1659369 - DNA, 18 bp, Homo sapiens
cttttgctgtctttctct

SEQ ID NO: 1659370 - DNA, 19 bp, Homo sapiens
cttttgctgtctttctcta

SEQ ID NO: 1659371 - DNA, 14 bp, Homo sapiens
cttttggaacattt

SEQ ID NO: 1659372 - DNA, 16 bp, Homo sapiens
cttttggaacatttct

SEQ ID NO: 1659373 - DNA, 18 bp, Homo sapiens
cttttggaacatttcttt

SEQ ID NO: 1659374 - DNA, 20 bp, Homo sapiens
cttttggaacatttctttct

SEQ ID NO: 1659375 - DNA, 23 bp, Homo sapiens
cttttggagaaccagggctcttc

SEQ ID NO: 1659376 - DNA, 21 bp, Homo sapiens
cttttggttaatatgtctttt

SEQ ID NO: 1659377 - DNA, 21 bp, Homo sapiens
cttttggtttgggggcgccct

SEQ ID NO: 1659378 - DNA, 13 bp, Homo sapiens
cttttgtaaatgt

SEQ ID NO: 1659379 - DNA, 20 bp, Homo sapiens
cttttgtaagacaaaggttt

SEQ ID NO: 1659380 - DNA, 14 bp, Homo sapiens
cttttgtaattgtg

SEQ ID NO: 1659381 - DNA, 16 bp, Homo sapiens
cttttgtaattgtgta

SEQ ID NO: 1659382 - DNA, 12 bp, Homo sapiens
cttttgtactga

SEQ ID NO: 1659383 - DNA, 23 bp, Homo sapiens
cttttgtagttttatttgtatta

SEQ ID NO: 1659384 - DNA, 11 bp, Homo sapiens
cttttgtatta

SEQ ID NO: 1659385 - DNA, 14 bp, Homo sapiens
cttttgtattaaga

SEQ ID NO: 1659386 - DNA, 16 bp, Homo sapiens
cttttgtccccagggc

SEQ ID NO: 1659387 - DNA, 18 bp, Homo sapiens
cttttgtccccagggccc

SEQ ID NO: 1659388 - DNA, 14 bp, Homo sapiens
cttttgtgaacttt

SEQ ID NO: 1659389 - DNA, 21 bp, Homo sapiens
cttttgtgaagaactatttta

SEQ ID NO: 1659390 - DNA, 15 bp, Homo sapiens
cttttgtgatgaaca

SEQ ID NO: 1659391 - DNA, 21 bp, Homo sapiens
cttttgtgatgaacatattca

SEQ ID NO: 1659392 - DNA, 21 bp, Homo sapiens
cttttgtggaggggagggatg

SEQ ID NO: 1659393 - DNA, 17 bp, Homo sapiens
cttttgtgggtttctct

SEQ ID NO: 1659394 - DNA, 17 bp, Homo sapiens
cttttgtggtgtcttcc

SEQ ID NO: 1659395 - DNA, 16 bp, Homo sapiens
cttttgtgtaatgaaa

SEQ ID NO: 1659396 - DNA, 17 bp, Homo sapiens
cttttgtgtaatgaaaa

SEQ ID NO: 1659397 - DNA, 14 bp, Homo sapiens
cttttgtgtattct

SEQ ID NO: 1659398 - DNA, 15 bp, Homo sapiens
cttttgtgtattctg

SEQ ID NO: 1659399 - DNA, 16 bp, Homo sapiens
cttttgtgtattctgt

SEQ ID NO: 1659400 - DNA, 20 bp, Homo sapiens
cttttgttaggaaaaaattg

SEQ ID NO: 1659401 - DNA, 18 bp, Homo sapiens
cttttgttagggctgctt

SEQ ID NO: 1659402 - DNA, 14 bp, Homo sapiens
cttttgttctctga

SEQ ID NO: 1659403 - DNA, 14 bp, Homo sapiens
cttttgttgtttat

SEQ ID NO: 1659404 - DNA, 17 bp, Homo sapiens
cttttgtttagagccct

SEQ ID NO: 1659405 - DNA, 22 bp, Homo sapiens
cttttgtttagagccctcccta

SEQ ID NO: 1659406 - DNA, 22 bp, Homo sapiens
cttttgtttcccttgctttgtt

SEQ ID NO: 1659407 - DNA, 19 bp, Homo sapiens
cttttgttttcctgctggt

SEQ ID NO: 1659408 - DNA, 22 bp, Homo sapiens
ctttttaaaaggtattttgaat

SEQ ID NO: 1659409 - DNA, 21 bp, Homo sapiens
ctttttaaatgtaaagatatt

SEQ ID NO: 1659410 - DNA, 21 bp, Homo sapiens
ctttttaaatgtgaattttta

SEQ ID NO: 1659411 - DNA, 23 bp, Homo sapiens
ctttttaaattcagtcctaagaa

SEQ ID NO: 1659412 - DNA, 20 bp, Homo sapiens
ctttttaaggtctttcagta

SEQ ID NO: 1659413 - DNA, 16 bp, Homo sapiens
ctttttaatagcacta

SEQ ID NO: 1659414 - DNA, 22 bp, Homo sapiens
ctttttaattattttaaaatat

SEQ ID NO: 1659415 - DNA, 14 bp, Homo sapiens
ctttttacagcatt

SEQ ID NO: 1659416 - DNA, 17 bp, Homo sapiens
ctttttacagcattgtc

SEQ ID NO: 1659417 - DNA, 12 bp, Homo sapiens
ctttttactgtt

SEQ ID NO: 1659418 - DNA, 16 bp, Homo sapiens
ctttttagatgtattt

SEQ ID NO: 1659419 - DNA, 14 bp, Homo sapiens
ctttttagccagtg

SEQ ID NO: 1659420 - DNA, 13 bp, Homo sapiens
ctttttagttttt

SEQ ID NO: 1659421 - DNA, 16 bp, Homo sapiens
ctttttataggtttta

SEQ ID NO: 1659422 - DNA, 23 bp, Homo sapiens
ctttttcatttatctataattta

SEQ ID NO: 1659423 - DNA, 22 bp, Homo sapiens
ctttttccagacacttttttga

SEQ ID NO: 1659424 - DNA, 12 bp, Homo sapiens
ctttttccagtg

SEQ ID NO: 1659425 - DNA, 22 bp, Homo sapiens
ctttttcccatctggctttttc

SEQ ID NO: 1659426 - DNA, 12 bp, Homo sapiens
ctttttctcaga

SEQ ID NO: 1659427 - DNA, 21 bp, Homo sapiens
ctttttctccagctgggctct

SEQ ID NO: 1659428 - DNA, 17 bp, Homo sapiens
ctttttctgccactgag

SEQ ID NO: 1659429 - DNA, 12 bp, Homo sapiens
ctttttcttaat

SEQ ID NO: 1659430 - DNA, 14 bp, Homo sapiens
ctttttcttgatct

SEQ ID NO: 1659431 - DNA, 16 bp, Homo sapiens
ctttttctttataaac

SEQ ID NO: 1659432 - DNA, 19 bp, Homo sapiens
ctttttctttttctttctt

SEQ ID NO: 1659433 - DNA, 17 bp, Homo sapiens
ctttttgaaatcacctg

SEQ ID NO: 1659434 - DNA, 13 bp, Homo sapiens
ctttttgaatctt

SEQ ID NO: 1659435 - DNA, 21 bp, Homo sapiens
ctttttgccagttttccctgg

SEQ ID NO: 1659436 - DNA, 22 bp, Homo sapiens
ctttttgccagttttccctgga

SEQ ID NO: 1659437 - DNA, 14 bp, Homo sapiens
ctttttgctctaaa

SEQ ID NO: 1659438 - DNA, 11 bp, Homo sapiens
ctttttggaat

SEQ ID NO: 1659439 - DNA, 19 bp, Homo sapiens
ctttttgggagagacttgt

SEQ ID NO: 1659440 - DNA, 15 bp, Homo sapiens
ctttttgtaatactt

SEQ ID NO: 1659441 - DNA, 13 bp, Homo sapiens
ctttttgtacttt

SEQ ID NO: 1659442 - DNA, 11 bp, Homo sapiens
ctttttgtagg

SEQ ID NO: 1659443 - DNA, 17 bp, Homo sapiens
ctttttgttgtaaaaca

SEQ ID NO: 1659444 - DNA, 18 bp, Homo sapiens
cttttttaaaatcaactt

SEQ ID NO: 1659445 - DNA, 17 bp, Homo sapiens
cttttttaaatattttc

SEQ ID NO: 1659446 - DNA, 18 bp, Homo sapiens
cttttttaaatattttct

SEQ ID NO: 1659447 - DNA, 22 bp, Homo sapiens
cttttttaaatattttctattt

SEQ ID NO: 1659448 - DNA, 15 bp, Homo sapiens
cttttttatgaagaa

SEQ ID NO: 1659449 - DNA, 15 bp, Homo sapiens
cttttttctcttccc

SEQ ID NO: 1659450 - DNA, 20 bp, Homo sapiens
cttttttcttaaagcaaagt

SEQ ID NO: 1659451 - DNA, 11 bp, Homo sapiens
cttttttgtcc

SEQ ID NO: 1659452 - DNA, 22 bp, Homo sapiens
cttttttgtcccccaacttgag

SEQ ID NO: 1659453 - DNA, 17 bp, Homo sapiens
ctttttttctctagagt

SEQ ID NO: 1659454 - DNA, 14 bp, Homo sapiens
ctttttttctgtac

SEQ ID NO: 1659455 - DNA, 16 bp, Homo sapiens
ctttttttctgtacca

SEQ ID NO: 1659456 - DNA, 20 bp, Homo sapiens
ctttttttctgtaccagtta

SEQ ID NO: 1659457 - DNA, 20 bp, Homo sapiens
ctttttttgagtgacagctt

SEQ ID NO: 1659458 - DNA, 16 bp, Homo sapiens
cttttttttcctttga

SEQ ID NO: 1659459 - DNA, 22 bp, Homo sapiens
cttttttttgacagcttcctgt

SEQ ID NO: 1659460 - DNA, 13 bp, Homo sapiens
ctttttttttaag

SEQ ID NO: 1659461 - DNA, 12 bp, Homo sapiens
ctttttttttcc

SEQ ID NO: 1659462 - DNA, 13 bp, Homo sapiens
ctttttttttcct

SEQ ID NO: 1659463 - DNA, 19 bp, Homo sapiens
ctttttttttctttttcca

SEQ ID NO: 1659464 - DNA, 21 bp, Homo sapiens
ctttttttttttttataaaag

SEQ ID NO: 1659465 - DNA, 22 bp, Homo sapiens
ctttttttttttttataaaagc

SEQ ID NO: 1659466 - DNA, 22 bp, Homo sapiens
ctttttttttttttttttggtc

SEQ ID NO: 1659467 - DNA, 19 bp, Homo sapiens
gaaaaaaaaaaagaagaag

SEQ ID NO: 1659468 - DNA, 20 bp, Homo sapiens
gaaaaaaaaaaagaagaaga

SEQ ID NO: 1659469 - DNA, 15 bp, Homo sapiens
gaaaaaaaaaacttt

SEQ ID NO: 1659470 - DNA, 19 bp, Homo sapiens
gaaaaaaaaccttgtaaaa

SEQ ID NO: 1659471 - DNA, 17 bp, Homo sapiens
gaaaaaaaagtgtctca

SEQ ID NO: 1659472 - DNA, 15 bp, Homo sapiens
gaaaaaaaagttttt

SEQ ID NO: 1659473 - DNA, 16 bp, Homo sapiens
gaaaaaaaagttttta

SEQ ID NO: 1659474 - DNA, 19 bp, Homo sapiens
gaaaaaaaagtttttaatt

SEQ ID NO: 1659475 - DNA, 13 bp, Homo sapiens
gaaaaaaaatgta

SEQ ID NO: 1659476 - DNA, 18 bp, Homo sapiens
gaaaaaaaccacacaaag

SEQ ID NO: 1659477 - DNA, 20 bp, Homo sapiens
gaaaaaaagtttgccagaag

SEQ ID NO: 1659478 - DNA, 15 bp, Homo sapiens
gaaaaaaatactatt

SEQ ID NO: 1659479 - DNA, 22 bp, Homo sapiens
gaaagcagagttttcattaaat

SEQ ID NO: 1659480 - DNA, 20 bp, Homo sapiens
gaaagcaggatgaattttct

SEQ ID NO: 1659481 - DNA, 22 bp, Homo sapiens
gaaagcataaagctcaaatgaa

SEQ ID NO: 1659482 - DNA, 22 bp, Homo sapiens
gaaagcatgtggcatgttcatc

SEQ ID NO: 1659483 - DNA, 16 bp, Homo sapiens
gaaagcatttaggaga

SEQ ID NO: 1659484 - DNA, 21 bp, Homo sapiens
gaaagcatttaggagaatagc

SEQ ID NO: 1659485 - DNA, 20 bp, Homo sapiens
gaaagccaacaactctgcct

SEQ ID NO: 1659486 - DNA, 18 bp, Homo sapiens
gaaagccccagcactaac

SEQ ID NO: 1659487 - DNA, 15 bp, Homo sapiens
gaaagcctaaaattg

SEQ ID NO: 1659488 - DNA, 14 bp, Homo sapiens
gaaagcctctctct

SEQ ID NO: 1659489 - DNA, 17 bp, Homo sapiens
gaaagcctctctctccc

SEQ ID NO: 1659490 - DNA, 14 bp, Homo sapiens
gaaagcctctgtcc

SEQ ID NO: 1659491 - DNA, 17 bp, Homo sapiens
gaaagctcactgtagct

SEQ ID NO: 1659492 - DNA, 13 bp, Homo sapiens
gaaagctgagaag

SEQ ID NO: 1659493 - DNA, 17 bp, Homo sapiens
gaaagcttcaaactgca

SEQ ID NO: 1659494 - DNA, 15 bp, Homo sapiens
gaaagcttttaaaat

SEQ ID NO: 1659495 - DNA, 14 bp, Homo sapiens
gaaaggaacactgg

SEQ ID NO: 1659496 - DNA, 15 bp, Homo sapiens
gaaaggaacactggc

SEQ ID NO: 1659497 - DNA, 12 bp, Homo sapiens
gaaaggagacat

SEQ ID NO: 1659498 - DNA, 14 bp, Homo sapiens
gaaaggagacattg

SEQ ID NO: 1659499 - DNA, 18 bp, Homo sapiens
gaaaggaggcatgcctct

SEQ ID NO: 1659500 - DNA, 19 bp, Homo sapiens
gaaaggaggcatgcctctg

SEQ ID NO: 1659501 - DNA, 16 bp, Homo sapiens
gaaaggatatttaaga

SEQ ID NO: 1659502 - DNA, 21 bp, Homo sapiens
gaaaggatatttaagaaaata

SEQ ID NO: 1659503 - DNA, 22 bp, Homo sapiens
gaaaggatctgtgattggctgg

SEQ ID NO: 1659504 - DNA, 20 bp, Homo sapiens
gaaaggattttaccaaagca

SEQ ID NO: 1659505 - DNA, 21 bp, Homo sapiens
gaaaggattttaccaaagcat

SEQ ID NO: 1659506 - DNA, 17 bp, Homo sapiens
gaaaggcaaagtacatt

SEQ ID NO: 1659507 - DNA, 22 bp, Homo sapiens
gaaaggcagccctcacctctga

SEQ ID NO: 1659508 - DNA, 18 bp, Homo sapiens
gaaaggcctcaagaacaa

SEQ ID NO: 1659509 - DNA, 18 bp, Homo sapiens
gaaaggctattttcagat

SEQ ID NO: 1659510 - DNA, 14 bp, Homo sapiens
gaaaggctcagtct

SEQ ID NO: 1659511 - DNA, 22 bp, Homo sapiens
gaaaggctcagtctcaggagca

SEQ ID NO: 1659512 - DNA, 19 bp, Homo sapiens
gaaaggctcatttaaaaca

SEQ ID NO: 1659513 - DNA, 15 bp, Homo sapiens
gaaaggctctgaaag

SEQ ID NO: 1659514 - DNA, 22 bp, Homo sapiens
gaaaggctgttaaatacaggaa

SEQ ID NO: 1659515 - DNA, 14 bp, Homo sapiens
gaaagggaaactgg

SEQ ID NO: 1659516 - DNA, 22 bp, Homo sapiens
gaaagggcccttcccctccccc

SEQ ID NO: 1659517 - DNA, 14 bp, Homo sapiens
gaaagggcctggcc

SEQ ID NO: 1659518 - DNA, 17 bp, Homo sapiens
gaaaggggacaaggaag

SEQ ID NO: 1659519 - DNA, 15 bp, Homo sapiens
gaaaggggagagcct

SEQ ID NO: 1659520 - DNA, 16 bp, Homo sapiens
gaaagggggtcccagt

SEQ ID NO: 1659521 - DNA, 17 bp, Homo sapiens
gaaagggggtcccagtg

SEQ ID NO: 1659522 - DNA, 23 bp, Homo sapiens
gaaagggggtcccagtgggaggg

SEQ ID NO: 1659523 - DNA, 17 bp, Homo sapiens
gaaaggggtcggctgac

SEQ ID NO: 1659524 - DNA, 14 bp, Homo sapiens
gaaaggggtgcttt

SEQ ID NO: 1659525 - DNA, 15 bp, Homo sapiens
gaaaggggtgctttt

SEQ ID NO: 1659526 - DNA, 21 bp, Homo sapiens
gaaaggtactatatttgctag

SEQ ID NO: 1659527 - DNA, 23 bp, Homo sapiens
gaaaggtgagtttgagctgcctt

SEQ ID NO: 1659528 - DNA, 19 bp, Homo sapiens
gaaagtaaataaaaggact

SEQ ID NO: 1659529 - DNA, 20 bp, Homo sapiens
gaaagtacattttttgaaat

SEQ ID NO: 1659530 - DNA, 21 bp, Homo sapiens
gaaagtagggggctttctggg

SEQ ID NO: 1659531 - DNA, 18 bp, Homo sapiens
gaaagtcacccaaacact

SEQ ID NO: 1659532 - DNA, 23 bp, Homo sapiens
gaaagtcacccaaacacttctgc

SEQ ID NO: 1659533 - DNA, 14 bp, Homo sapiens
gaaagtgacagaga

SEQ ID NO: 1659534 - DNA, 15 bp, Homo sapiens
gaaagtgtatttgga

SEQ ID NO: 1659535 - DNA, 23 bp, Homo sapiens
gaaagtgtatttggaaataaagt

SEQ ID NO: 1659536 - DNA, 15 bp, Homo sapiens
gaaagtgtgagctct

SEQ ID NO: 1659537 - DNA, 18 bp, Homo sapiens
gaaagttactgtaaatgc

SEQ ID NO: 1659538 - DNA, 20 bp, Homo sapiens
gaaagttagagattttacaa

SEQ ID NO: 1659539 - DNA, 19 bp, Homo sapiens
gaaagttagggggttctta

SEQ ID NO: 1659540 - DNA, 20 bp, Homo sapiens
gaaagttagggggttcttat

SEQ ID NO: 1659541 - DNA, 22 bp, Homo sapiens
gaaagttcccccatcagttccc

SEQ ID NO: 1659542 - DNA, 19 bp, Homo sapiens
gaaagttggaaaggaaaaa

SEQ ID NO: 1659543 - DNA, 13 bp, Homo sapiens
gaaagttttgtaa

SEQ ID NO: 1659544 - DNA, 15 bp, Homo sapiens
gaaagttttgtaaaa

SEQ ID NO: 1659545 - DNA, 18 bp, Homo sapiens
gaaagttttgtaaaagaa

SEQ ID NO: 1659546 - DNA, 20 bp, Homo sapiens
gaaagttttgtaaaagaaat

SEQ ID NO: 1659547 - DNA, 21 bp, Homo sapiens
gaaagttttgtaaaagaaatc

SEQ ID NO: 1659548 - DNA, 12 bp, Homo sapiens
gaaataaaatta

SEQ ID NO: 1659549 - DNA, 21 bp, Homo sapiens
gaaataaaatttgataaacat

SEQ ID NO: 1659550 - DNA, 18 bp, Homo sapiens
gaaataaagttggtgaca

SEQ ID NO: 1659551 - DNA, 15 bp, Homo sapiens
gaaataaattcctaa

SEQ ID NO: 1659552 - DNA, 17 bp, Homo sapiens
gaaataaattcctaaac

SEQ ID NO: 1659553 - DNA, 18 bp, Homo sapiens
gaaataacagagagaatg

SEQ ID NO: 1659554 - DNA, 11 bp, Homo sapiens
gaaataataaa

SEQ ID NO: 1659555 - DNA, 19 bp, Homo sapiens
gaaataataaaaaatttca

SEQ ID NO: 1659556 - DNA, 13 bp, Homo sapiens
gaaataataaatc

SEQ ID NO: 1659557 - DNA, 17 bp, Homo sapiens
gaaataataaatctggt

SEQ ID NO: 1659558 - DNA, 15 bp, Homo sapiens
gaaataatatgcatt

SEQ ID NO: 1659559 - DNA, 17 bp, Homo sapiens
gaaataatttgaatgta

SEQ ID NO: 1659560 - DNA, 21 bp, Homo sapiens
gaaataatttgaatgtatttg

SEQ ID NO: 1659561 - DNA, 13 bp, Homo sapiens
gaaatacaaaaaa

SEQ ID NO: 1659562 - DNA, 18 bp, Homo sapiens
gaaatacacaagtaaaca

SEQ ID NO: 1659563 - DNA, 22 bp, Homo sapiens
gaaatacagataaatgattcaa

SEQ ID NO: 1659564 - DNA, 14 bp, Homo sapiens
gaaatacagttatt

SEQ ID NO: 1659565 - DNA, 18 bp, Homo sapiens
gaaatacagttatttcat

SEQ ID NO: 1659566 - DNA, 16 bp, Homo sapiens
gaaatactactcctgt

SEQ ID NO: 1659567 - DNA, 15 bp, Homo sapiens
gaaatactatttaaa

SEQ ID NO: 1659568 - DNA, 14 bp, Homo sapiens
gaaatactgctctg

SEQ ID NO: 1659569 - DNA, 19 bp, Homo sapiens
gaaatacttcgatgatgat

SEQ ID NO: 1659570 - DNA, 13 bp, Homo sapiens
gaaatagacaaaa

SEQ ID NO: 1659571 - DNA, 14 bp, Homo sapiens
gaaatagcagagcc

SEQ ID NO: 1659572 - DNA, 15 bp, Homo sapiens
gaaatagcagagcct

SEQ ID NO: 1659573 - DNA, 19 bp, Homo sapiens
gaaatagccaaaaaggcaa

SEQ ID NO: 1659574 - DNA, 19 bp, Homo sapiens
gaaatagtaccttcaatac

SEQ ID NO: 1659575 - DNA, 16 bp, Homo sapiens
gaaatagtatacattg

SEQ ID NO: 1659576 - DNA, 19 bp, Homo sapiens
gaaatagtctgattttaat

SEQ ID NO: 1659577 - DNA, 17 bp, Homo sapiens
gaaatataacacatttt

SEQ ID NO: 1659578 - DNA, 14 bp, Homo sapiens
gaaatatatatgtg

SEQ ID NO: 1659579 - DNA, 23 bp, Homo sapiens
gaaatatatatgtgtgtgtatgt

SEQ ID NO: 1659580 - DNA, 20 bp, Homo sapiens
gaaatatattacttaactgt

SEQ ID NO: 1659581 - DNA, 23 bp, Homo sapiens
gaaatatcagttactcagccctg

SEQ ID NO: 1659582 - DNA, 12 bp, Homo sapiens
gaaatatcattt

SEQ ID NO: 1659583 - DNA, 21 bp, Homo sapiens
gaaatatctgaaaatgtatgt

SEQ ID NO: 1659584 - DNA, 16 bp, Homo sapiens
gaaatatctttctctt

SEQ ID NO: 1659585 - DNA, 14 bp, Homo sapiens
gaaatatgatttta

SEQ ID NO: 1659586 - DNA, 22 bp, Homo sapiens
gaaatatgattttatttgacaa

SEQ ID NO: 1659587 - DNA, 17 bp, Homo sapiens
gaaatatgcacaatagc

SEQ ID NO: 1659588 - DNA, 22 bp, Homo sapiens
gaaatattaagcatgttttgtt

SEQ ID NO: 1659589 - DNA, 13 bp, Homo sapiens
gaaatatttaagt

SEQ ID NO: 1659590 - DNA, 19 bp, Homo sapiens
gaaatatttaagtatatag

SEQ ID NO: 1659591 - DNA, 22 bp, Homo sapiens
gaaatattttaatttttaaatg

SEQ ID NO: 1659592 - DNA, 19 bp, Homo sapiens
gaaatcaaatatgcaaagc

SEQ ID NO: 1659593 - DNA, 15 bp, Homo sapiens
gaactcagatccagg

SEQ ID NO: 1659594 - DNA, 19 bp, Homo sapiens
gaactcagatccagggaca

SEQ ID NO: 1659595 - DNA, 19 bp, Homo sapiens
gaactcagcacattcggga

SEQ ID NO: 1659596 - DNA, 13 bp, Homo sapiens
gaactcattcctg

SEQ ID NO: 1659597 - DNA, 18 bp, Homo sapiens
gaactccactctccttcg

SEQ ID NO: 1659598 - DNA, 14 bp, Homo sapiens
gaactccaggccct

SEQ ID NO: 1659599 - DNA, 19 bp, Homo sapiens
gaactccatacagcctcta

SEQ ID NO: 1659600 - DNA, 13 bp, Homo sapiens
gaactcctggcct

SEQ ID NO: 1659601 - DNA, 14 bp, Homo sapiens
gaactcctggcctc

SEQ ID NO: 1659602 - DNA, 16 bp, Homo sapiens
gaactccttccccact

SEQ ID NO: 1659603 - DNA, 17 bp, Homo sapiens
gaactcgcgctcagtaa

SEQ ID NO: 1659604 - DNA, 18 bp, Homo sapiens
gaactcgcgctcagtaaa

SEQ ID NO: 1659605 - DNA, 17 bp, Homo sapiens
gaactctactcaaccca

SEQ ID NO: 1659606 - DNA, 19 bp, Homo sapiens
gaactctagagagccttaa

SEQ ID NO: 1659607 - DNA, 16 bp, Homo sapiens
gaactctccaaatatt

SEQ ID NO: 1659608 - DNA, 13 bp, Homo sapiens
gaactctccaggg

SEQ ID NO: 1659609 - DNA, 13 bp, Homo sapiens
gaactctgacaag

SEQ ID NO: 1659610 - DNA, 18 bp, Homo sapiens
gaactctggtggcacagg

SEQ ID NO: 1659611 - DNA, 18 bp, Homo sapiens
gaactctgtgcaggtgct

SEQ ID NO: 1659612 - DNA, 13 bp, Homo sapiens
gaactctgttccc

SEQ ID NO: 1659613 - DNA, 21 bp, Homo sapiens
gaactcttcagaacacacaga

SEQ ID NO: 1659614 - DNA, 18 bp, Homo sapiens
gaactctttctggcctgc

SEQ ID NO: 1659615 - DNA, 22 bp, Homo sapiens
gaactctttctggcctgccttc

SEQ ID NO: 1659616 - DNA, 20 bp, Homo sapiens
gaactgaaccggctttacca

SEQ ID NO: 1659617 - DNA, 17 bp, Homo sapiens
gaactgagctgggcagg

SEQ ID NO: 1659618 - DNA, 11 bp, Homo sapiens
gaactgaggag

SEQ ID NO: 1659619 - DNA, 21 bp, Homo sapiens
gaactgaggagatgaccaggg

SEQ ID NO: 1659620 - DNA, 19 bp, Homo sapiens
gaactgagggctctgtttg

SEQ ID NO: 1659621 - DNA, 12 bp, Homo sapiens
gaactgcaggcc

SEQ ID NO: 1659622 - DNA, 21 bp, Homo sapiens
gaactgcaggccctggcctcc

SEQ ID NO: 1659623 - DNA, 15 bp, Homo sapiens
gaactgcatatgttt

SEQ ID NO: 1659624 - DNA, 22 bp, Homo sapiens
gaactgcatggacctaacattc

SEQ ID NO: 1659625 - DNA, 17 bp, Homo sapiens
gaactgctgggcttggc

SEQ ID NO: 1659626 - DNA, 17 bp, Homo sapiens
gaactgcttactagccc

SEQ ID NO: 1659627 - DNA, 20 bp, Homo sapiens
gaactgcttactagccctgc

SEQ ID NO: 1659628 - DNA, 13 bp, Homo sapiens
gaactgcttttcc

SEQ ID NO: 1659629 - DNA, 17 bp, Homo sapiens
gaactgcttttcctcaa

SEQ ID NO: 1659630 - DNA, 13 bp, Homo sapiens
gaactggaagaaa

SEQ ID NO: 1659631 - DNA, 18 bp, Homo sapiens
gaactggcaattgtctat

SEQ ID NO: 1659632 - DNA, 16 bp, Homo sapiens
gaactggcttgtacat

SEQ ID NO: 1659633 - DNA, 11 bp, Homo sapiens
gaactgggctg

SEQ ID NO: 1659634 - DNA, 23 bp, Homo sapiens
gaactggggttcaagcccaggct

SEQ ID NO: 1659635 - DNA, 19 bp, Homo sapiens
gaactgggtgactggaggc

SEQ ID NO: 1659636 - DNA, 20 bp, Homo sapiens
gaactggtcaccatgaaact

SEQ ID NO: 1659637 - DNA, 20 bp, Homo sapiens
gaactgtagctgccatggct

SEQ ID NO: 1659638 - DNA, 15 bp, Homo sapiens
gaactgtcccagcta

SEQ ID NO: 1659639 - DNA, 21 bp, Homo sapiens
gaactgtctgaatattctaga

SEQ ID NO: 1659640 - DNA, 13 bp, Homo sapiens
gaactgtcttggc

SEQ ID NO: 1659641 - DNA, 18 bp, Homo sapiens
gaactgtgcatcaaccag

SEQ ID NO: 1659642 - DNA, 15 bp, Homo sapiens
gaactgttggagccc

SEQ ID NO: 1659643 - DNA, 17 bp, Homo sapiens
gaacttaagtctcgaat

SEQ ID NO: 1659644 - DNA, 23 bp, Homo sapiens
gaacttacacttggagcccgtgc

SEQ ID NO: 1659645 - DNA, 22 bp, Homo sapiens
gaacttacatactaggtgcctt

SEQ ID NO: 1659646 - DNA, 20 bp, Homo sapiens
gaacttatcctaaaacaaat

SEQ ID NO: 1659647 - DNA, 22 bp, Homo sapiens
gaacttcaagaagtaagagcta

SEQ ID NO: 1659648 - DNA, 14 bp, Homo sapiens
gaacttcagaaaga

SEQ ID NO: 1659649 - DNA, 23 bp, Homo sapiens
gaacttcaggtgtgactctagca

SEQ ID NO: 1659650 - DNA, 12 bp, Homo sapiens
gaacttgacaat

SEQ ID NO: 1659651 - DNA, 15 bp, Homo sapiens
gaacttgaccctgag

SEQ ID NO: 1659652 - DNA, 14 bp, Homo sapiens
gaacttgctgctgc

SEQ ID NO: 1659653 - DNA, 15 bp, Homo sapiens
gaacttgctgctgcc

SEQ ID NO: 1659654 - DNA, 19 bp, Homo sapiens
gaacttgctgctgccttca

SEQ ID NO: 1659655 - DNA, 21 bp, Homo sapiens
gaacttgctgctgccttcaca

SEQ ID NO: 1659656 - DNA, 20 bp, Homo sapiens
gaacttgtgtccctaatgtg

SEQ ID NO: 1659657 - DNA, 16 bp, Homo sapiens
gaactttattaagtaa

SEQ ID NO: 1659658 - DNA, 14 bp, Homo sapiens
gaagaaaacaaagt

SEQ ID NO: 1659659 - DNA, 18 bp, Homo sapiens
gaagaaaacactgttatc

SEQ ID NO: 1659660 - DNA, 19 bp, Homo sapiens
gaagaaaacactgttatca

SEQ ID NO: 1659661 - DNA, 12 bp, Homo sapiens
gaagaaagatgt

SEQ ID NO: 1659662 - DNA, 17 bp, Homo sapiens
gaagaaagtctatgctt

SEQ ID NO: 1659663 - DNA, 15 bp, Homo sapiens
gaagaaatcacagaa

SEQ ID NO: 1659664 - DNA, 17 bp, Homo sapiens
gaagaaattcaggtaca

SEQ ID NO: 1659665 - DNA, 21 bp, Homo sapiens
gaagaaattcaggtacagaaa

SEQ ID NO: 1659666 - DNA, 16 bp, Homo sapiens
gaagaacaagaaatgg

SEQ ID NO: 1659667 - DNA, 19 bp, Homo sapiens
gaagaacacagcatgtgcc

SEQ ID NO: 1659668 - DNA, 17 bp, Homo sapiens
gaagaacatccaaggag

SEQ ID NO: 1659669 - DNA, 20 bp, Homo sapiens
gaagaaccctatttaaaact

SEQ ID NO: 1659670 - DNA, 22 bp, Homo sapiens
gaagaacggggctcttctcatt

SEQ ID NO: 1659671 - DNA, 22 bp, Homo sapiens
gaagaacgttttttcctcagtg

SEQ ID NO: 1659672 - DNA, 13 bp, Homo sapiens
gaagaactgcagg

SEQ ID NO: 1659673 - DNA, 19 bp, Homo sapiens
gaagaactgcaggccctgg

SEQ ID NO: 1659674 - DNA, 16 bp, Homo sapiens
gaagaacttgcatgga

SEQ ID NO: 1659675 - DNA, 23 bp, Homo sapiens
gaagaagaattggccatcttaaa

SEQ ID NO: 1659676 - DNA, 16 bp, Homo sapiens
gaagaagacacctcta

SEQ ID NO: 1659677 - DNA, 20 bp, Homo sapiens
gaagaagacctctaggagga

SEQ ID NO: 1659678 - DNA, 18 bp, Homo sapiens
gaagaagggagaagaaag

SEQ ID NO: 1659679 - DNA, 20 bp, Homo sapiens
gaagaaggggctgttcttcc

SEQ ID NO: 1659680 - DNA, 14 bp, Homo sapiens
gaagaatattcagg

SEQ ID NO: 1659681 - DNA, 19 bp, Homo sapiens
gaagaatattcaggactta

SEQ ID NO: 1659682 - DNA, 20 bp, Homo sapiens
gaagaatgcacaagaatgga

SEQ ID NO: 1659683 - DNA, 17 bp, Homo sapiens
gaagaattgaaaagttt

SEQ ID NO: 1659684 - DNA, 22 bp, Homo sapiens
gaagaattgaaaagtttttgtt

SEQ ID NO: 1659685 - DNA, 19 bp, Homo sapiens
gaagaattttatttttctg

SEQ ID NO: 1659686 - DNA, 20 bp, Homo sapiens
gaagaattttatttttctgt

SEQ ID NO: 1659687 - DNA, 22 bp, Homo sapiens
gaagaattttatttttctgtgg

SEQ ID NO: 1659688 - DNA, 21 bp, Homo sapiens
gaagaattttcagaccccagc

SEQ ID NO: 1659689 - DNA, 21 bp, Homo sapiens
gaagaattttttctcattctg

SEQ ID NO: 1659690 - DNA, 13 bp, Homo sapiens
gaagacaaagtct

SEQ ID NO: 1659691 - DNA, 13 bp, Homo sapiens
gaagacaagcatt

SEQ ID NO: 1659692 - DNA, 20 bp, Homo sapiens
gaagacattttgttacataa

SEQ ID NO: 1659693 - DNA, 21 bp, Homo sapiens
gaagacattttttgctataat

SEQ ID NO: 1659694 - DNA, 13 bp, Homo sapiens
gaagaccaaagtt

SEQ ID NO: 1659695 - DNA, 19 bp, Homo sapiens
gaagaccagaattcccttg

SEQ ID NO: 1659696 - DNA, 15 bp, Homo sapiens
gaagacccacgtgct

SEQ ID NO: 1659697 - DNA, 15 bp, Homo sapiens
gaagacccagcagga

SEQ ID NO: 1659698 - DNA, 15 bp, Homo sapiens
gaagaccccacccaa

SEQ ID NO: 1659699 - DNA, 18 bp, Homo sapiens
gaagaccccacccaagct

SEQ ID NO: 1659700 - DNA, 17 bp, Homo sapiens
gaagaccctcttgccca

SEQ ID NO: 1659701 - DNA, 23 bp, Homo sapiens
gaagaccctcttgcccatcctga

SEQ ID NO: 1659702 - DNA, 20 bp, Homo sapiens
gaagacctcacctagaaatt

SEQ ID NO: 1659703 - DNA, 22 bp, Homo sapiens
gaagacctgctgagggaccagc

SEQ ID NO: 1659704 - DNA, 21 bp, Homo sapiens
gaagacctttattcacccctg

SEQ ID NO: 1659705 - DNA, 22 bp, Homo sapiens
gaagacctttattcacccctgc

SEQ ID NO: 1659706 - DNA, 23 bp, Homo sapiens
gaagactagaggccagggcagca

SEQ ID NO: 1659707 - DNA, 22 bp, Homo sapiens
gaagtcctccctcctgcaggct

SEQ ID NO: 1659708 - DNA, 23 bp, Homo sapiens
gaagtcctccctcctgcaggctg

SEQ ID NO: 1659709 - DNA, 22 bp, Homo sapiens
gaagtcggaatgtcatagtctt

SEQ ID NO: 1659710 - DNA, 13 bp, Homo sapiens
gaagtcttgaagt

SEQ ID NO: 1659711 - DNA, 18 bp, Homo sapiens
gaagtctttgccttctct

SEQ ID NO: 1659712 - DNA, 16 bp, Homo sapiens
gaagtcttttctgtca

SEQ ID NO: 1659713 - DNA, 15 bp, Homo sapiens
gaagtgaaaaagttt

SEQ ID NO: 1659714 - DNA, 17 bp, Homo sapiens
gaagtgaatgctgggac

SEQ ID NO: 1659715 - DNA, 16 bp, Homo sapiens
gaagtgagcacagcct

SEQ ID NO: 1659716 - DNA, 18 bp, Homo sapiens
gaagtgagctttgctgct

SEQ ID NO: 1659717 - DNA, 16 bp, Homo sapiens
gaagtgagggaggaag

SEQ ID NO: 1659718 - DNA, 22 bp, Homo sapiens
gaagtgatactatccagttact

SEQ ID NO: 1659719 - DNA, 21 bp, Homo sapiens
gaagtgcccagcccctgcccc

SEQ ID NO: 1659720 - DNA, 19 bp, Homo sapiens
gaagtgcgtggtataatct

SEQ ID NO: 1659721 - DNA, 10 bp, Homo sapiens
gaagtggaag

SEQ ID NO: 1659722 - DNA, 18 bp, Homo sapiens
gaagtgggccaggacagg

SEQ ID NO: 1659723 - DNA, 15 bp, Homo sapiens
gaagtggggtgttct

SEQ ID NO: 1659724 - DNA, 23 bp, Homo sapiens
gaagtggtacaatctggctcact

SEQ ID NO: 1659725 - DNA, 15 bp, Homo sapiens
gaagtgtaacagctg

SEQ ID NO: 1659726 - DNA, 16 bp, Homo sapiens
gaagtgtaacagctga

SEQ ID NO: 1659727 - DNA, 15 bp, Homo sapiens
gaagtgtctgccagc

SEQ ID NO: 1659728 - DNA, 21 bp, Homo sapiens
gaagtgtctgccagctgggcc

SEQ ID NO: 1659729 - DNA, 17 bp, Homo sapiens
gaagtgtgggtctgtgt

SEQ ID NO: 1659730 - DNA, 24 bp, Homo sapiens
gaagtgtgggtctgtgtgtgtgta

SEQ ID NO: 1659731 - DNA, 17 bp, Homo sapiens
gaagtgttcaagaaata

SEQ ID NO: 1659732 - DNA, 18 bp, Homo sapiens
gaagttaacagtctcatt

SEQ ID NO: 1659733 - DNA, 22 bp, Homo sapiens
gaagttacacagaaatgctgct

SEQ ID NO: 1659734 - DNA, 14 bp, Homo sapiens
gaagttactgaatg

SEQ ID NO: 1659735 - DNA, 16 bp, Homo sapiens
gaagttactttatgtt

SEQ ID NO: 1659736 - DNA, 15 bp, Homo sapiens
gaagttagtttgtat

SEQ ID NO: 1659737 - DNA, 16 bp, Homo sapiens
gaagttagtttgtata

SEQ ID NO: 1659738 - DNA, 14 bp, Homo sapiens
gaagttcccattat

SEQ ID NO: 1659739 - DNA, 14 bp, Homo sapiens
gaagttctttgatt

SEQ ID NO: 1659740 - DNA, 17 bp, Homo sapiens
gaagttgaagtttagga

SEQ ID NO: 1659741 - DNA, 17 bp, Homo sapiens
gaagttgcaagactcga

SEQ ID NO: 1659742 - DNA, 20 bp, Homo sapiens
gaagttggtttagctttgga

SEQ ID NO: 1659743 - DNA, 23 bp, Homo sapiens
gaagttgtgcaacggccagggtt

SEQ ID NO: 1659744 - DNA, 21 bp, Homo sapiens
gaagttgtggatatcagggta

SEQ ID NO: 1659745 - DNA, 17 bp, Homo sapiens
gaagttgtttatcaact

SEQ ID NO: 1659746 - DNA, 14 bp, Homo sapiens
gaagttgtttgtca

SEQ ID NO: 1659747 - DNA, 14 bp, Homo sapiens
gaagtttaaatatt

SEQ ID NO: 1659748 - DNA, 15 bp, Homo sapiens
gaagtttcaagtttt

SEQ ID NO: 1659749 - DNA, 14 bp, Homo sapiens
gaagtttggctgct

SEQ ID NO: 1659750 - DNA, 14 bp, Homo sapiens
gaagtttgtagcca

SEQ ID NO: 1659751 - DNA, 13 bp, Homo sapiens
gaagttttcagga

SEQ ID NO: 1659752 - DNA, 12 bp, Homo sapiens
gaagttttccta

SEQ ID NO: 1659753 - DNA, 14 bp, Homo sapiens
gaataaaaaagaaa

SEQ ID NO: 1659754 - DNA, 15 bp, Homo sapiens
gaataaaaaccctgt

SEQ ID NO: 1659755 - DNA, 19 bp, Homo sapiens
gaataaaacaataaatgaa

SEQ ID NO: 1659756 - DNA, 18 bp, Homo sapiens
gaataaaacactcatccc

SEQ ID NO: 1659757 - DNA, 12 bp, Homo sapiens
gaataaaagtgc

SEQ ID NO: 1659758 - DNA, 20 bp, Homo sapiens
gaataaaatctgctgcacct

SEQ ID NO: 1659759 - DNA, 19 bp, Homo sapiens
gaataaaattcctatctca

SEQ ID NO: 1659760 - DNA, 18 bp, Homo sapiens
gaataaagcctttgtatc

SEQ ID NO: 1659761 - DNA, 19 bp, Homo sapiens
gaataaaggcagttttcta

SEQ ID NO: 1659762 - DNA, 14 bp, Homo sapiens
gaataaagttgaag

SEQ ID NO: 1659763 - DNA, 15 bp, Homo sapiens
gaataaagttgcaga

SEQ ID NO: 1659764 - DNA, 18 bp, Homo sapiens
gaataaataaagaagaaa

SEQ ID NO: 1659765 - DNA, 15 bp, Homo sapiens
gaataaatacccatt

SEQ ID NO: 1659766 - DNA, 16 bp, Homo sapiens
gaataaattgattttt

SEQ ID NO: 1659767 - DNA, 14 bp, Homo sapiens
gaataaatttggga

SEQ ID NO: 1659768 - DNA, 16 bp, Homo sapiens
gaataacactgcagcc

SEQ ID NO: 1659769 - DNA, 18 bp, Homo sapiens
gaataacatgtaattaag

SEQ ID NO: 1659770 - DNA, 22 bp, Homo sapiens
gaataaccacttaaaaaatgtc

SEQ ID NO: 1659771 - DNA, 15 bp, Homo sapiens
gaataactacctcct

SEQ ID NO: 1659772 - DNA, 21 bp, Homo sapiens
gaataactctgtggcattatt

SEQ ID NO: 1659773 - DNA, 23 bp, Homo sapiens
gaataaggaggaggagggagaag

SEQ ID NO: 1659774 - DNA, 20 bp, Homo sapiens
gaataagtgccaggatggaa

SEQ ID NO: 1659775 - DNA, 21 bp, Homo sapiens
gaataataaaagtatatatat

SEQ ID NO: 1659776 - DNA, 12 bp, Homo sapiens
gaataatagaag

SEQ ID NO: 1659777 - DNA, 20 bp, Homo sapiens
gaataatatcaaataaaata

SEQ ID NO: 1659778 - DNA, 19 bp, Homo sapiens
gaataatatgctgccaaat

SEQ ID NO: 1659779 - DNA, 20 bp, Homo sapiens
gaataatcacgctttcctga

SEQ ID NO: 1659780 - DNA, 15 bp, Homo sapiens
gaataatctttgggt

SEQ ID NO: 1659781 - DNA, 21 bp, Homo sapiens
gaataattgctttttcacagt

SEQ ID NO: 1659782 - DNA, 16 bp, Homo sapiens
gaataatttcacttaa

SEQ ID NO: 1659783 - DNA, 14 bp, Homo sapiens
gaataatttcccaa

SEQ ID NO: 1659784 - DNA, 13 bp, Homo sapiens
gaataatttctat

SEQ ID NO: 1659785 - DNA, 21 bp, Homo sapiens
gaatacagtaagctgctctat

SEQ ID NO: 1659786 - DNA, 20 bp, Homo sapiens
gaatacagtgttattttctt

SEQ ID NO: 1659787 - DNA, 20 bp, Homo sapiens
gaatacattaacggtgctaa

SEQ ID NO: 1659788 - DNA, 21 bp, Homo sapiens
gaatacattaacggtgctaaa

SEQ ID NO: 1659789 - DNA, 13 bp, Homo sapiens
gaatacatttgta

SEQ ID NO: 1659790 - DNA, 17 bp, Homo sapiens
gaatacatttgtattta

SEQ ID NO: 1659791 - DNA, 19 bp, Homo sapiens
gaataccacatcaaataag

SEQ ID NO: 1659792 - DNA, 22 bp, Homo sapiens
gaataccattaaaactgctttt

SEQ ID NO: 1659793 - DNA, 14 bp, Homo sapiens
gaatacggaagagc

SEQ ID NO: 1659794 - DNA, 15 bp, Homo sapiens
gaatactgggttctt

SEQ ID NO: 1659795 - DNA, 13 bp, Homo sapiens
gaatactggtctc

SEQ ID NO: 1659796 - DNA, 19 bp, Homo sapiens
gaatagaaacgtaaactat

SEQ ID NO: 1659797 - DNA, 16 bp, Homo sapiens
gaatagatatgaaagc

SEQ ID NO: 1659798 - DNA, 23 bp, Homo sapiens
gaatagcacagccagacttgctt

SEQ ID NO: 1659799 - DNA, 15 bp, Homo sapiens
gaatagcagagagcc

SEQ ID NO: 1659800 - DNA, 16 bp, Homo sapiens
gaatagcagagagcca

SEQ ID NO: 1659801 - DNA, 20 bp, Homo sapiens
gaatagcagagagccaaatc

SEQ ID NO: 1659802 - DNA, 23 bp, Homo sapiens
gaatagcagagagccaaatctga

SEQ ID NO: 1659803 - DNA, 15 bp, Homo sapiens
gaatagccagagagg

SEQ ID NO: 1659804 - DNA, 22 bp, Homo sapiens
gaataggcagggggccctgccc

SEQ ID NO: 1659805 - DNA, 20 bp, Homo sapiens
gaataggcattaacacaaag

SEQ ID NO: 1659806 - DNA, 18 bp, Homo sapiens
gaatagggagacagggta

SEQ ID NO: 1659807 - DNA, 13 bp, Homo sapiens
gaatataaaaaat

SEQ ID NO: 1659808 - DNA, 14 bp, Homo sapiens
gaatataaaacagt

SEQ ID NO: 1659809 - DNA, 15 bp, Homo sapiens
gaatataacatgtaa

SEQ ID NO: 1659810 - DNA, 17 bp, Homo sapiens
gaatataacatgtaaaa

SEQ ID NO: 1659811 - DNA, 17 bp, Homo sapiens
gaatataccttttttgt

SEQ ID NO: 1659812 - DNA, 11 bp, Homo sapiens
gaatatattat

SEQ ID NO: 1659813 - DNA, 16 bp, Homo sapiens
gaatatccatgtactt

SEQ ID NO: 1659814 - DNA, 15 bp, Homo sapiens
gaatatctgtaatgg

SEQ ID NO: 1659815 - DNA, 18 bp, Homo sapiens
gaatatgtagctcatcct

SEQ ID NO: 1659816 - DNA, 13 bp, Homo sapiens
gaatattaaaaaa

SEQ ID NO: 1659817 - DNA, 11 bp, Homo sapiens
gaatattcagg

SEQ ID NO: 1659818 - DNA, 15 bp, Homo sapiens
gaatattcaggactt

SEQ ID NO: 1659819 - DNA, 16 bp, Homo sapiens
gaatattcctggactt

SEQ ID NO: 1659820 - DNA, 20 bp, Homo sapiens
gaatattcctggacttacaa

SEQ ID NO: 1659821 - DNA, 22 bp, Homo sapiens
gaatattcctggacttacaaaa

SEQ ID NO: 1659822 - DNA, 20 bp, Homo sapiens
gaatttaaaattaagtagaa

SEQ ID NO: 1659823 - DNA, 12 bp, Homo sapiens
gaatttaaataa

SEQ ID NO: 1659824 - DNA, 13 bp, Homo sapiens
gaatttaaataaa

SEQ ID NO: 1659825 - DNA, 17 bp, Homo sapiens
gaatttaaatataattc

SEQ ID NO: 1659826 - DNA, 23 bp, Homo sapiens
gaatttaaatataattctgtaaa

SEQ ID NO: 1659827 - DNA, 16 bp, Homo sapiens
gaatttaatgctgaat

SEQ ID NO: 1659828 - DNA, 17 bp, Homo sapiens
gaatttagtattatcaa

SEQ ID NO: 1659829 - DNA, 21 bp, Homo sapiens
gaatttatccaattttgatct

SEQ ID NO: 1659830 - DNA, 23 bp, Homo sapiens
gaatttatccaattttgatcttt

SEQ ID NO: 1659831 - DNA, 14 bp, Homo sapiens
gaatttatctttac

SEQ ID NO: 1659832 - DNA, 20 bp, Homo sapiens
gaatttatgtgaaatgcttt

SEQ ID NO: 1659833 - DNA, 23 bp, Homo sapiens
gaatttatgtgaaatgctttctg

SEQ ID NO: 1659834 - DNA, 22 bp, Homo sapiens
gaatttattagtttaaaatgca

SEQ ID NO: 1659835 - DNA, 13 bp, Homo sapiens
gaatttattgata

SEQ ID NO: 1659836 - DNA, 21 bp, Homo sapiens
gaatttcaggcattttgttct

SEQ ID NO: 1659837 - DNA, 14 bp, Homo sapiens
gaatttcccaggac

SEQ ID NO: 1659838 - DNA, 13 bp, Homo sapiens
gaatttcctctat

SEQ ID NO: 1659839 - DNA, 12 bp, Homo sapiens
gaatttctaaaa

SEQ ID NO: 1659840 - DNA, 14 bp, Homo sapiens
gaatttcttaactt

SEQ ID NO: 1659841 - DNA, 17 bp, Homo sapiens
gaatttcttaacttctt

SEQ ID NO: 1659842 - DNA, 18 bp, Homo sapiens
gaatttcttaacttcttg

SEQ ID NO: 1659843 - DNA, 21 bp, Homo sapiens
gaatttcttaacttcttgctt

SEQ ID NO: 1659844 - DNA, 16 bp, Homo sapiens
gaatttcttgattttt

SEQ ID NO: 1659845 - DNA, 9 bp, Homo sapiens
gaatttgag

SEQ ID NO: 1659846 - DNA, 11 bp, Homo sapiens
gaatttgagaa

SEQ ID NO: 1659847 - DNA, 19 bp, Homo sapiens
gaatttggagactctgtgg

SEQ ID NO: 1659848 - DNA, 23 bp, Homo sapiens
gaatttgggagaagcaaatatag

SEQ ID NO: 1659849 - DNA, 18 bp, Homo sapiens
gaatttgtacgtttatac

SEQ ID NO: 1659850 - DNA, 15 bp, Homo sapiens
gaatttgttcttaaa

SEQ ID NO: 1659851 - DNA, 16 bp, Homo sapiens
gaatttgttcttaaaa

SEQ ID NO: 1659852 - DNA, 12 bp, Homo sapiens
gaattttaaagt

SEQ ID NO: 1659853 - DNA, 15 bp, Homo sapiens
gaattttaagtgctt

SEQ ID NO: 1659854 - DNA, 13 bp, Homo sapiens
gaattttaatgtg

SEQ ID NO: 1659855 - DNA, 16 bp, Homo sapiens
gaattttaatgtgaag

SEQ ID NO: 1659856 - DNA, 15 bp, Homo sapiens
gaattttatctgtgg

SEQ ID NO: 1659857 - DNA, 18 bp, Homo sapiens
gaattttattttgctgag

SEQ ID NO: 1659858 - DNA, 18 bp, Homo sapiens
gaattttatttttctgtg

SEQ ID NO: 1659859 - DNA, 16 bp, Homo sapiens
gaattttcaaggcctt

SEQ ID NO: 1659860 - DNA, 18 bp, Homo sapiens
gaattttcaaggccttca

SEQ ID NO: 1659861 - DNA, 14 bp, Homo sapiens
gaattttcagaccc

SEQ ID NO: 1659862 - DNA, 18 bp, Homo sapiens
gaattttccaagaacata

SEQ ID NO: 1659863 - DNA, 15 bp, Homo sapiens
gaattttctaaaagc

SEQ ID NO: 1659864 - DNA, 16 bp, Homo sapiens
gaattttctaaaagct

SEQ ID NO: 1659865 - DNA, 13 bp, Homo sapiens
gaattttctctcc

SEQ ID NO: 1659866 - DNA, 19 bp, Homo sapiens
gaattttctgcagctgttt

SEQ ID NO: 1659867 - DNA, 21 bp, Homo sapiens
gaattttctttgtgtagcttt

SEQ ID NO: 1659868 - DNA, 23 bp, Homo sapiens
gaattttctttgtgtagctttgc

SEQ ID NO: 1659869 - DNA, 20 bp, Homo sapiens
gaattttgagtattccatga

SEQ ID NO: 1659870 - DNA, 22 bp, Homo sapiens
gaattttgcaaagatttaatct

SEQ ID NO: 1659871 - DNA, 14 bp, Homo sapiens
gaattttgcaatgt

SEQ ID NO: 1659872 - DNA, 16 bp, Homo sapiens
gaattttgttctctgg

SEQ ID NO: 1659873 - DNA, 13 bp, Homo sapiens
gaatttttattgt

SEQ ID NO: 1659874 - DNA, 14 bp, Homo sapiens
gaatttttctctaa

SEQ ID NO: 1659875 - DNA, 20 bp, Homo sapiens
gaatttttttcatcttctct

SEQ ID NO: 1659876 - DNA, 22 bp, Homo sapiens
gaatttttttttcctagccctc

SEQ ID NO: 1659877 - DNA, 18 bp, Homo sapiens
gacaaaaaatgttttaaa

SEQ ID NO: 1659878 - DNA, 19 bp, Homo sapiens
gacaaaaataatagtttta

SEQ ID NO: 1659879 - DNA, 17 bp, Homo sapiens
gacaaaacctaacttgc

SEQ ID NO: 1659880 - DNA, 16 bp, Homo sapiens
gacaaacacctcccag

SEQ ID NO: 1659881 - DNA, 17 bp, Homo sapiens
gacaaacacctcccagg

SEQ ID NO: 1659882 - DNA, 23 bp, Homo sapiens
gacaaacactgccatattgtgta

SEQ ID NO: 1659883 - DNA, 14 bp, Homo sapiens
gacaaagacaaatt

SEQ ID NO: 1659884 - DNA, 20 bp, Homo sapiens
gacaaagccagaggagaaga

SEQ ID NO: 1659885 - DNA, 16 bp, Homo sapiens
gacaaaggaggaattt

SEQ ID NO: 1659886 - DNA, 12 bp, Homo sapiens
gacaaaggtggt

SEQ ID NO: 1659887 - DNA, 18 bp, Homo sapiens
gacaaaggtggtaaattc

SEQ ID NO: 1659888 - DNA, 21 bp, Homo sapiens
gacaaaggtggtaaattcaga

SEQ ID NO: 1659889 - DNA, 22 bp, Homo sapiens
gacaaaggtggtaaattcagac

SEQ ID NO: 1659890 - DNA, 23 bp, Homo sapiens
gacaaaggtggtaaattcagaca

SEQ ID NO: 1659891 - DNA, 16 bp, Homo sapiens
gacaaagtctccagcc

SEQ ID NO: 1659892 - DNA, 22 bp, Homo sapiens
gacaaataaatgattatattca

SEQ ID NO: 1659893 - DNA, 11 bp, Homo sapiens
gacaaatattc

SEQ ID NO: 1659894 - DNA, 20 bp, Homo sapiens
gacaaatcaagagcattgct

SEQ ID NO: 1659895 - DNA, 20 bp, Homo sapiens
gacaaatcacatattttaaa

SEQ ID NO: 1659896 - DNA, 13 bp, Homo sapiens
gacaaatgggact

SEQ ID NO: 1659897 - DNA, 21 bp, Homo sapiens
gacaaatgggactgatgtcat

SEQ ID NO: 1659898 - DNA, 23 bp, Homo sapiens
gacaaatgggactgatgtcatct

SEQ ID NO: 1659899 - DNA, 15 bp, Homo sapiens
gacaaattctgtttc

SEQ ID NO: 1659900 - DNA, 16 bp, Homo sapiens
gacaaattctgtttct

SEQ ID NO: 1659901 - DNA, 20 bp, Homo sapiens
gacaacaggtaaaacagggc

SEQ ID NO: 1659902 - DNA, 21 bp, Homo sapiens
gacaacaggttttcaccatag

SEQ ID NO: 1659903 - DNA, 22 bp, Homo sapiens
gacaacagttctgagctgtaat

SEQ ID NO: 1659904 - DNA, 16 bp, Homo sapiens
gacaacatcccacagt

SEQ ID NO: 1659905 - DNA, 18 bp, Homo sapiens
gacaacatcccacagtgg

SEQ ID NO: 1659906 - DNA, 23 bp, Homo sapiens
gacaacatcgcaatagtttttta

SEQ ID NO: 1659907 - DNA, 11 bp, Homo sapiens
gacaacatctg

SEQ ID NO: 1659908 - DNA, 14 bp, Homo sapiens
gacaacatgtttaa

SEQ ID NO: 1659909 - DNA, 13 bp, Homo sapiens
gacaacattatga

SEQ ID NO: 1659910 - DNA, 23 bp, Homo sapiens
gacaacattatgatctaataaac

SEQ ID NO: 1659911 - DNA, 13 bp, Homo sapiens
gacaacctttctg

SEQ ID NO: 1659912 - DNA, 12 bp, Homo sapiens
gacaactgtgac

SEQ ID NO: 1659913 - DNA, 21 bp, Homo sapiens
gacaacttagctcaggtgcct

SEQ ID NO: 1659914 - DNA, 21 bp, Homo sapiens
gacaacttatttaaaaatatt

SEQ ID NO: 1659915 - DNA, 22 bp, Homo sapiens
gacaacttatttaaaaatattt

SEQ ID NO: 1659916 - DNA, 20 bp, Homo sapiens
gacaacttttaaagaaaaat

SEQ ID NO: 1659917 - DNA, 15 bp, Homo sapiens
gacaagacccccagc

SEQ ID NO: 1659918 - DNA, 19 bp, Homo sapiens
gacaagagatctacacatg

SEQ ID NO: 1659919 - DNA, 14 bp, Homo sapiens
gacaagagctgctg

SEQ ID NO: 1659920 - DNA, 14 bp, Homo sapiens
gacaagagtgagac

SEQ ID NO: 1659921 - DNA, 18 bp, Homo sapiens
gacaagatattgtacata

SEQ ID NO: 1659922 - DNA, 22 bp, Homo sapiens
gacaagcactattttatattta

SEQ ID NO: 1659923 - DNA, 15 bp, Homo sapiens
gacaagcagcccttg

SEQ ID NO: 1659924 - DNA, 22 bp, Homo sapiens
gacaagccaacttgtaaataca

SEQ ID NO: 1659925 - DNA, 12 bp, Homo sapiens
gacaagccctgg

SEQ ID NO: 1659926 - DNA, 13 bp, Homo sapiens
gacaagccctggc

SEQ ID NO: 1659927 - DNA, 19 bp, Homo sapiens
gacaagctgacttggcact

SEQ ID NO: 1659928 - DNA, 18 bp, Homo sapiens
gacaaggaaaatctatat

SEQ ID NO: 1659929 - DNA, 19 bp, Homo sapiens
gacaagggattctgggaag

SEQ ID NO: 1659930 - DNA, 20 bp, Homo sapiens
gacaagggattctgggaagc

SEQ ID NO: 1659931 - DNA, 14 bp, Homo sapiens
gacaaggtgctaac

SEQ ID NO: 1659932 - DNA, 21 bp, Homo sapiens
gacaataaagatatttccaag

SEQ ID NO: 1659933 - DNA, 23 bp, Homo sapiens
gacaataattctacatgttgtct

SEQ ID NO: 1659934 - DNA, 13 bp, Homo sapiens
gacaataatttca

SEQ ID NO: 1659935 - DNA, 13 bp, Homo sapiens
gacaatacagtaa

SEQ ID NO: 1659936 - DNA, 14 bp, Homo sapiens
gacaatcagtcccc

SEQ ID NO: 1659937 - DNA, 12 bp, Homo sapiens
gaccctgtctct

SEQ ID NO: 1659938 - DNA, 21 bp, Homo sapiens
gaccctgtgacatggtgcctg

SEQ ID NO: 1659939 - DNA, 22 bp, Homo sapiens
gaccctgtgacatggtgcctga

SEQ ID NO: 1659940 - DNA, 20 bp, Homo sapiens
gaccctgtgtcctccaccat

SEQ ID NO: 1659941 - DNA, 22 bp, Homo sapiens
gaccctgtgtcctccaccatgc

SEQ ID NO: 1659942 - DNA, 20 bp, Homo sapiens
gacccttattgctgtcctgg

SEQ ID NO: 1659943 - DNA, 15 bp, Homo sapiens
gacccttccagacat

SEQ ID NO: 1659944 - DNA, 20 bp, Homo sapiens
gacccttccagacatacgaa

SEQ ID NO: 1659945 - DNA, 19 bp, Homo sapiens
gacccttcccttgagccct

SEQ ID NO: 1659946 - DNA, 18 bp, Homo sapiens
gacccttggcctccattt

SEQ ID NO: 1659947 - DNA, 22 bp, Homo sapiens
gaccctttccttccttccctgg

SEQ ID NO: 1659948 - DNA, 12 bp, Homo sapiens
gacccttttcat

SEQ ID NO: 1659949 - DNA, 16 bp, Homo sapiens
gacccttttctcagga

SEQ ID NO: 1659950 - DNA, 16 bp, Homo sapiens
gaccgaaatctgtatt

SEQ ID NO: 1659951 - DNA, 15 bp, Homo sapiens
gaccgactttcccca

SEQ ID NO: 1659952 - DNA, 19 bp, Homo sapiens
gaccgagccctggagagcc

SEQ ID NO: 1659953 - DNA, 15 bp, Homo sapiens
gaccgccccagggct

SEQ ID NO: 1659954 - DNA, 16 bp, Homo sapiens
gaccgccccctcctct

SEQ ID NO: 1659955 - DNA, 16 bp, Homo sapiens
gaccgctgataagcat

SEQ ID NO: 1659956 - DNA, 16 bp, Homo sapiens
gaccgggtgggcctgg

SEQ ID NO: 1659957 - DNA, 22 bp, Homo sapiens
gaccgtccaggggagatgggga

SEQ ID NO: 1659958 - DNA, 19 bp, Homo sapiens
gaccgtggacaggcccagc

SEQ ID NO: 1659959 - DNA, 21 bp, Homo sapiens
gacctaaaagttgaaaagcca

SEQ ID NO: 1659960 - DNA, 18 bp, Homo sapiens
gacctaaatccattttct

SEQ ID NO: 1659961 - DNA, 20 bp, Homo sapiens
gacctaaatggcctcatgtg

SEQ ID NO: 1659962 - DNA, 16 bp, Homo sapiens
gacctaagtcaggtaa

SEQ ID NO: 1659963 - DNA, 11 bp, Homo sapiens
gacctacagac

SEQ ID NO: 1659964 - DNA, 14 bp, Homo sapiens
gacctacagacctg

SEQ ID NO: 1659965 - DNA, 19 bp, Homo sapiens
gacctacagacctggctct

SEQ ID NO: 1659966 - DNA, 14 bp, Homo sapiens
gacctaccccagcc

SEQ ID NO: 1659967 - DNA, 21 bp, Homo sapiens
gacctactaggagaggggggc

SEQ ID NO: 1659968 - DNA, 18 bp, Homo sapiens
gacctactgttctaaagc

SEQ ID NO: 1659969 - DNA, 14 bp, Homo sapiens
gacctagctctttg

SEQ ID NO: 1659970 - DNA, 22 bp, Homo sapiens
gacctatgtcctaaggacacac

SEQ ID NO: 1659971 - DNA, 16 bp, Homo sapiens
gacctattcaccctcc

SEQ ID NO: 1659972 - DNA, 19 bp, Homo sapiens
gacctattcaccctccact

SEQ ID NO: 1659973 - DNA, 15 bp, Homo sapiens
gacctcaagcaacca

SEQ ID NO: 1659974 - DNA, 17 bp, Homo sapiens
gacctcaagtgatctgc

SEQ ID NO: 1659975 - DNA, 18 bp, Homo sapiens
gacctcaatgaagcagaa

SEQ ID NO: 1659976 - DNA, 20 bp, Homo sapiens
gacctcacagtgacccttcc

SEQ ID NO: 1659977 - DNA, 22 bp, Homo sapiens
gacctcacagtgacccttccca

SEQ ID NO: 1659978 - DNA, 16 bp, Homo sapiens
gacctcacctggtcct

SEQ ID NO: 1659979 - DNA, 15 bp, Homo sapiens
gacctcactgtcctg

SEQ ID NO: 1659980 - DNA, 11 bp, Homo sapiens
gacctcagcca

SEQ ID NO: 1659981 - DNA, 13 bp, Homo sapiens
gacctcagcctgt

SEQ ID NO: 1659982 - DNA, 14 bp, Homo sapiens
gacctcagcctgtg

SEQ ID NO: 1659983 - DNA, 19 bp, Homo sapiens
gacctcagcctgtgctgcc

SEQ ID NO: 1659984 - DNA, 14 bp, Homo sapiens
gacctcagccttcc

SEQ ID NO: 1659985 - DNA, 20 bp, Homo sapiens
gacctcagccttccccttgc

SEQ ID NO: 1659986 - DNA, 23 bp, Homo sapiens
gacctcagctgcacattcctggc

SEQ ID NO: 1659987 - DNA, 20 bp, Homo sapiens
gacctcagttttatcatttt

SEQ ID NO: 1659988 - DNA, 21 bp, Homo sapiens
gacctcagttttatcattttc

SEQ ID NO: 1659989 - DNA, 21 bp, Homo sapiens
gacctcatcctgctcttttgt

SEQ ID NO: 1659990 - DNA, 20 bp, Homo sapiens
gacctccagtgagtacctgc

SEQ ID NO: 1659991 - DNA, 15 bp, Homo sapiens
gacctccccacccgc

SEQ ID NO: 1659992 - DNA, 14 bp, Homo sapiens
gacctccctgtctc

SEQ ID NO: 1659993 - DNA, 13 bp, Homo sapiens
gacctcgtcctcc

SEQ ID NO: 1659994 - DNA, 16 bp, Homo sapiens
gacctcgtcctccccc

SEQ ID NO: 1659995 - DNA, 17 bp, Homo sapiens
gacctcgtcctccccct

SEQ ID NO: 1659996 - DNA, 16 bp, Homo sapiens
gacctctagagctgga

SEQ ID NO: 1659997 - DNA, 17 bp, Homo sapiens
gacctctgtaggcagca

SEQ ID NO: 1659998 - DNA, 17 bp, Homo sapiens
gacctcttccctctggg

SEQ ID NO: 1659999 - DNA, 22 bp, Homo sapiens
gacctcttccctctgggcctgt

SEQ ID NO: 1660000 - DNA, 16 bp, Homo sapiens
gacctcttctggagat

SEQ ID NO: 1660001 - DNA, 18 bp, Homo sapiens
gacctgaaataatatatt

SEQ ID NO: 1660002 - DNA, 23 bp, Homo sapiens
gacctgaaattccaaagtctcta

SEQ ID NO: 1660003 - DNA, 16 bp, Homo sapiens
gacctgaatgcttctg

SEQ ID NO: 1660004 - DNA, 15 bp, Homo sapiens
gacctgactattgaa

SEQ ID NO: 1660005 - DNA, 15 bp, Homo sapiens
gacctgatcctggag

SEQ ID NO: 1660006 - DNA, 21 bp, Homo sapiens
gacctgatcctggaggcccag

SEQ ID NO: 1660007 - DNA, 20 bp, Homo sapiens
gacctgatttattgaaattt

SEQ ID NO: 1660008 - DNA, 17 bp, Homo sapiens
gacctgcatccttcctg

SEQ ID NO: 1660009 - DNA, 21 bp, Homo sapiens
gacctgcatccttcctgggga

SEQ ID NO: 1660010 - DNA, 19 bp, Homo sapiens
gacctgccaggcaggggtg

SEQ ID NO: 1660011 - DNA, 21 bp, Homo sapiens
gacctgccccgcccagctgca

SEQ ID NO: 1660012 - DNA, 22 bp, Homo sapiens
gacctgcctcctgcctgcccct

SEQ ID NO: 1660013 - DNA, 18 bp, Homo sapiens
gacctgcctctcacacac

SEQ ID NO: 1660014 - DNA, 22 bp, Homo sapiens
gacctgcctctcacacacatag

SEQ ID NO: 1660015 - DNA, 20 bp, Homo sapiens
gacctgctcatcatattcca

SEQ ID NO: 1660016 - DNA, 23 bp, Homo sapiens
gacctgctcatcatattccaacc

SEQ ID NO: 1660017 - DNA, 19 bp, Homo sapiens
gacctgctgagggaccagc

SEQ ID NO: 1660018 - DNA, 20 bp, Homo sapiens
gacctgctgagggaccagcc

SEQ ID NO: 1660019 - DNA, 13 bp, Homo sapiens
gacctgctgctcc

SEQ ID NO: 1660020 - DNA, 20 bp, Homo sapiens
gacctgcttagctgccttga

SEQ ID NO: 1660021 - DNA, 14 bp, Homo sapiens
gacctggaaccaga

SEQ ID NO: 1660022 - DNA, 14 bp, Homo sapiens
gacctggaagaaca

SEQ ID NO: 1660023 - DNA, 20 bp, Homo sapiens
gacctggaagaacaggcctc

SEQ ID NO: 1660024 - DNA, 16 bp, Homo sapiens
gacctggacactaggg

SEQ ID NO: 1660025 - DNA, 13 bp, Homo sapiens
gacctggagcccc

SEQ ID NO: 1660026 - DNA, 16 bp, Homo sapiens
gacctggcagctctgg

SEQ ID NO: 1660027 - DNA, 15 bp, Homo sapiens
gacctggctctcaga

SEQ ID NO: 1660028 - DNA, 16 bp, Homo sapiens
gacctgggatttgaga

SEQ ID NO: 1660029 - DNA, 21 bp, Homo sapiens
gacctgggtatcccctgcctc

SEQ ID NO: 1660030 - DNA, 23 bp, Homo sapiens
gacctggtaccctcctggctctt

SEQ ID NO: 1660031 - DNA, 18 bp, Homo sapiens
gacctggtgggagcacct

SEQ ID NO: 1660032 - DNA, 21 bp, Homo sapiens
gacctgtcatgcccccctcaa

SEQ ID NO: 1660033 - DNA, 13 bp, Homo sapiens
gacctgtcttcca

SEQ ID NO: 1660034 - DNA, 17 bp, Homo sapiens
gacctgtcttccaagga

SEQ ID NO: 1660035 - DNA, 14 bp, Homo sapiens
gacctgtgtgaact

SEQ ID NO: 1660036 - DNA, 22 bp, Homo sapiens
gaccttactcctctttccttcc

SEQ ID NO: 1660037 - DNA, 13 bp, Homo sapiens
gaccttagaaatc

SEQ ID NO: 1660038 - DNA, 15 bp, Homo sapiens
gaccttagcgttctg

SEQ ID NO: 1660039 - DNA, 14 bp, Homo sapiens
gaccttcctcatcc

SEQ ID NO: 1660040 - DNA, 22 bp, Homo sapiens
gaccttcctcatccaccccatc

SEQ ID NO: 1660041 - DNA, 18 bp, Homo sapiens
gaccttggggtacaattg

SEQ ID NO: 1660042 - DNA, 16 bp, Homo sapiens
gaccttgtgggaccag

SEQ ID NO: 1660043 - DNA, 17 bp, Homo sapiens
gaccttgttacttctga

SEQ ID NO: 1660044 - DNA, 17 bp, Homo sapiens
gacctttattcacccct

SEQ ID NO: 1660045 - DNA, 13 bp, Homo sapiens
gacctttccacca

SEQ ID NO: 1660046 - DNA, 18 bp, Homo sapiens
gacctttccaccacagcc

SEQ ID NO: 1660047 - DNA, 23 bp, Homo sapiens
gacctttccaccacagccagcac

SEQ ID NO: 1660048 - DNA, 17 bp, Homo sapiens
gacctttcctgaggaag

SEQ ID NO: 1660049 - DNA, 17 bp, Homo sapiens
gacctttgggttctttc

SEQ ID NO: 1660050 - DNA, 18 bp, Homo sapiens
gacctttgggttctttct

SEQ ID NO: 1660051 - DNA, 13 bp, Homo sapiens
gactggctgtgag

SEQ ID NO: 1660052 - DNA, 23 bp, Homo sapiens
gactggctgtgagacgaggcagg

SEQ ID NO: 1660053 - DNA, 17 bp, Homo sapiens
gactggctgtgcccctg

SEQ ID NO: 1660054 - DNA, 22 bp, Homo sapiens
gactggctgtgcccctgatgca

SEQ ID NO: 1660055 - DNA, 22 bp, Homo sapiens
gactgggaagataggctctgca

SEQ ID NO: 1660056 - DNA, 16 bp, Homo sapiens
gactgggcccaggcag

SEQ ID NO: 1660057 - DNA, 18 bp, Homo sapiens
gactgggcccaggcaggt

SEQ ID NO: 1660058 - DNA, 21 bp, Homo sapiens
gactgggcccaggcaggtctg

SEQ ID NO: 1660059 - DNA, 16 bp, Homo sapiens
gactggggagggctgc

SEQ ID NO: 1660060 - DNA, 18 bp, Homo sapiens
gactgggtaatttataaa

SEQ ID NO: 1660061 - DNA, 21 bp, Homo sapiens
gactgggtaggaaagaggaag

SEQ ID NO: 1660062 - DNA, 17 bp, Homo sapiens
gactgggtctgacctgg

SEQ ID NO: 1660063 - DNA, 20 bp, Homo sapiens
gactgggtctgacctggtgg

SEQ ID NO: 1660064 - DNA, 21 bp, Homo sapiens
gactgggtttggaccccagct

SEQ ID NO: 1660065 - DNA, 23 bp, Homo sapiens
gactgggtttggaccccagctgg

SEQ ID NO: 1660066 - DNA, 19 bp, Homo sapiens
gactggtccagctctgaca

SEQ ID NO: 1660067 - DNA, 20 bp, Homo sapiens
gactggtccagctctgacat

SEQ ID NO: 1660068 - DNA, 16 bp, Homo sapiens
gactggtctcgaactc

SEQ ID NO: 1660069 - DNA, 11 bp, Homo sapiens
gactggtgcga

SEQ ID NO: 1660070 - DNA, 18 bp, Homo sapiens
gactggtgcgacccccca

SEQ ID NO: 1660071 - DNA, 20 bp, Homo sapiens
gactgtagattgcttctgta

SEQ ID NO: 1660072 - DNA, 21 bp, Homo sapiens
gactgtagattgcttctgtag

SEQ ID NO: 1660073 - DNA, 23 bp, Homo sapiens
gactgtagggagggcggcagggg

SEQ ID NO: 1660074 - DNA, 17 bp, Homo sapiens
gactgtatctgtgtaga

SEQ ID NO: 1660075 - DNA, 22 bp, Homo sapiens
gactgtcaagtacaagcaagac

SEQ ID NO: 1660076 - DNA, 14 bp, Homo sapiens
gactgtcagctgag

SEQ ID NO: 1660077 - DNA, 22 bp, Homo sapiens
gactgtcagtggggcagcctct

SEQ ID NO: 1660078 - DNA, 15 bp, Homo sapiens
gactgtcctgaggag

SEQ ID NO: 1660079 - DNA, 16 bp, Homo sapiens
gactgtcgttctccac

SEQ ID NO: 1660080 - DNA, 23 bp, Homo sapiens
gactgtctcaagagggcactggt

SEQ ID NO: 1660081 - DNA, 13 bp, Homo sapiens
gactgtgatgcca

SEQ ID NO: 1660082 - DNA, 12 bp, Homo sapiens
gactgtgattta

SEQ ID NO: 1660083 - DNA, 18 bp, Homo sapiens
gactgtgatttatttgga

SEQ ID NO: 1660084 - DNA, 12 bp, Homo sapiens
gactgtgcagaa

SEQ ID NO: 1660085 - DNA, 15 bp, Homo sapiens
gactgtgctggtgca

SEQ ID NO: 1660086 - DNA, 17 bp, Homo sapiens
gactgtggaaatgccaa

SEQ ID NO: 1660087 - DNA, 15 bp, Homo sapiens
gactgtggctgctag

SEQ ID NO: 1660088 - DNA, 20 bp, Homo sapiens
gactgtggtaggggcaggga

SEQ ID NO: 1660089 - DNA, 21 bp, Homo sapiens
gactgtggtaggggcagggag

SEQ ID NO: 1660090 - DNA, 14 bp, Homo sapiens
gactgtgtttgcat

SEQ ID NO: 1660091 - DNA, 21 bp, Homo sapiens
gactgttcttggtaactgatt

SEQ ID NO: 1660092 - DNA, 18 bp, Homo sapiens
gactgtttatttaaggat

SEQ ID NO: 1660093 - DNA, 23 bp, Homo sapiens
gactgtttatttaaggatggatg

SEQ ID NO: 1660094 - DNA, 19 bp, Homo sapiens
gactgttttctctcggctc

SEQ ID NO: 1660095 - DNA, 21 bp, Homo sapiens
gactgttttctctcggctccc

SEQ ID NO: 1660096 - DNA, 19 bp, Homo sapiens
gacttaaaattagtctttt

SEQ ID NO: 1660097 - DNA, 20 bp, Homo sapiens
gacttaaaattagtcttttg

SEQ ID NO: 1660098 - DNA, 16 bp, Homo sapiens
gacttaacggctccag

SEQ ID NO: 1660099 - DNA, 15 bp, Homo sapiens
gacttaactttaact

SEQ ID NO: 1660100 - DNA, 22 bp, Homo sapiens
gacttaactttaacttttgaaa

SEQ ID NO: 1660101 - DNA, 22 bp, Homo sapiens
gacttaagacaaatgggactga

SEQ ID NO: 1660102 - DNA, 22 bp, Homo sapiens
gacttaagcatctggctctaat

SEQ ID NO: 1660103 - DNA, 19 bp, Homo sapiens
gacttagcgtcaagacatt

SEQ ID NO: 1660104 - DNA, 16 bp, Homo sapiens
gacttagggcaccagg

SEQ ID NO: 1660105 - DNA, 17 bp, Homo sapiens
gacttagtatattttct

SEQ ID NO: 1660106 - DNA, 12 bp, Homo sapiens
gacttatttctg

SEQ ID NO: 1660107 - DNA, 17 bp, Homo sapiens
gacttatttctgctctg

SEQ ID NO: 1660108 - DNA, 13 bp, Homo sapiens
gacttcacactgc

SEQ ID NO: 1660109 - DNA, 16 bp, Homo sapiens
gacttcacactgcaag

SEQ ID NO: 1660110 - DNA, 22 bp, Homo sapiens
gacttcacactgcaagagcctt

SEQ ID NO: 1660111 - DNA, 21 bp, Homo sapiens
gacttcacagcgtctgctcat

SEQ ID NO: 1660112 - DNA, 20 bp, Homo sapiens
gacttcactgtatataaaca

SEQ ID NO: 1660113 - DNA, 20 bp, Homo sapiens
gacttccccaatatcttgct

SEQ ID NO: 1660114 - DNA, 14 bp, Homo sapiens
gacttccccatccc

SEQ ID NO: 1660115 - DNA, 13 bp, Homo sapiens
gacttccctgtgt

SEQ ID NO: 1660116 - DNA, 22 bp, Homo sapiens
gacttcctggggccccgctggg

SEQ ID NO: 1660117 - DNA, 19 bp, Homo sapiens
gacttcctgtccagctcca

SEQ ID NO: 1660118 - DNA, 14 bp, Homo sapiens
gacttccttgagac

SEQ ID NO: 1660119 - DNA, 16 bp, Homo sapiens
gacttctaagtaaaac

SEQ ID NO: 1660120 - DNA, 19 bp, Homo sapiens
gacttctaagtaaaaccac

SEQ ID NO: 1660121 - DNA, 16 bp, Homo sapiens
gacttctcccctgccc

SEQ ID NO: 1660122 - DNA, 12 bp, Homo sapiens
gacttctgagat

SEQ ID NO: 1660123 - DNA, 13 bp, Homo sapiens
gacttctgcctgg

SEQ ID NO: 1660124 - DNA, 17 bp, Homo sapiens
gacttctgcctggagac

SEQ ID NO: 1660125 - DNA, 17 bp, Homo sapiens
gacttctggaaggctgg

SEQ ID NO: 1660126 - DNA, 21 bp, Homo sapiens
gacttctggaaggctggctga

SEQ ID NO: 1660127 - DNA, 16 bp, Homo sapiens
gacttcttcctctaga

SEQ ID NO: 1660128 - DNA, 20 bp, Homo sapiens
gacttcttggtttggggaga

SEQ ID NO: 1660129 - DNA, 23 bp, Homo sapiens
gacttcttggtttggggagaaat

SEQ ID NO: 1660130 - DNA, 13 bp, Homo sapiens
gacttgaaaagaa

SEQ ID NO: 1660131 - DNA, 17 bp, Homo sapiens
gacttgaagcacagagg

SEQ ID NO: 1660132 - DNA, 21 bp, Homo sapiens
gacttgaatattcctggactt

SEQ ID NO: 1660133 - DNA, 23 bp, Homo sapiens
gacttgagtgttcctttttaaat

SEQ ID NO: 1660134 - DNA, 23 bp, Homo sapiens
gacttgccgtcccctaaggaaat

SEQ ID NO: 1660135 - DNA, 23 bp, Homo sapiens
gacttgctaaagcactttgcact

SEQ ID NO: 1660136 - DNA, 22 bp, Homo sapiens
gacttgctgttttgttctgtgg

SEQ ID NO: 1660137 - DNA, 16 bp, Homo sapiens
gacttggaacctcatt

SEQ ID NO: 1660138 - DNA, 15 bp, Homo sapiens
gacttggacttttga

SEQ ID NO: 1660139 - DNA, 19 bp, Homo sapiens
gacttggagactcctggtc

SEQ ID NO: 1660140 - DNA, 15 bp, Homo sapiens
gacttggatcccagg

SEQ ID NO: 1660141 - DNA, 13 bp, Homo sapiens
gacttggcactta

SEQ ID NO: 1660142 - DNA, 12 bp, Homo sapiens
gacttgggatgg

SEQ ID NO: 1660143 - DNA, 18 bp, Homo sapiens
gacttgtgattggctgca

SEQ ID NO: 1660144 - DNA, 16 bp, Homo sapiens
gacttgtgtctctgtg

SEQ ID NO: 1660145 - DNA, 17 bp, Homo sapiens
gacttgtttagagagcc

SEQ ID NO: 1660146 - DNA, 23 bp, Homo sapiens
gacttgtttagagagcctgtcac

SEQ ID NO: 1660147 - DNA, 13 bp, Homo sapiens
gacttgttttaat

SEQ ID NO: 1660148 - DNA, 22 bp, Homo sapiens
gactttaaactttcccttggct

SEQ ID NO: 1660149 - DNA, 19 bp, Homo sapiens
gactttacttgtggtgtga

SEQ ID NO: 1660150 - DNA, 19 bp, Homo sapiens
gactttatcctgagtccct

SEQ ID NO: 1660151 - DNA, 17 bp, Homo sapiens
gactttatgtagttttt

SEQ ID NO: 1660152 - DNA, 14 bp, Homo sapiens
gactttatttattt

SEQ ID NO: 1660153 - DNA, 17 bp, Homo sapiens
gactttatttatttcta

SEQ ID NO: 1660154 - DNA, 12 bp, Homo sapiens
gactttcaggta

SEQ ID NO: 1660155 - DNA, 13 bp, Homo sapiens
gactttcccctct

SEQ ID NO: 1660156 - DNA, 11 bp, Homo sapiens
gactttcctgc

SEQ ID NO: 1660157 - DNA, 14 bp, Homo sapiens
gactttctgcctgg

SEQ ID NO: 1660158 - DNA, 12 bp, Homo sapiens
gactttctgtga

SEQ ID NO: 1660159 - DNA, 18 bp, Homo sapiens
gactttgacaattactca

SEQ ID NO: 1660160 - DNA, 23 bp, Homo sapiens
gactttgacaattactcaggttt

SEQ ID NO: 1660161 - DNA, 21 bp, Homo sapiens
gactttgcagccggcacaggg

SEQ ID NO: 1660162 - DNA, 15 bp, Homo sapiens
gactttgcttcccat

SEQ ID NO: 1660163 - DNA, 15 bp, Homo sapiens
gactttgcttgcttt

SEQ ID NO: 1660164 - DNA, 15 bp, Homo sapiens
gactttggaatttgc

SEQ ID NO: 1660165 - DNA, 13 bp, Homo sapiens
gagactgggaaga

SEQ ID NO: 1660166 - DNA, 21 bp, Homo sapiens
gagactgggaagataggctct

SEQ ID NO: 1660167 - DNA, 19 bp, Homo sapiens
gagactgggctctggctct

SEQ ID NO: 1660168 - DNA, 23 bp, Homo sapiens
gagactggtctcgaactcctggc

SEQ ID NO: 1660169 - DNA, 13 bp, Homo sapiens
gagactgtagatt

SEQ ID NO: 1660170 - DNA, 13 bp, Homo sapiens
gagactgtccctg

SEQ ID NO: 1660171 - DNA, 17 bp, Homo sapiens
gagactgtgaggcggca

SEQ ID NO: 1660172 - DNA, 21 bp, Homo sapiens
gagactgtgaggcggcagctg

SEQ ID NO: 1660173 - DNA, 22 bp, Homo sapiens
gagactgtgaggcggcagctgg

SEQ ID NO: 1660174 - DNA, 11 bp, Homo sapiens
gagactgtggt

SEQ ID NO: 1660175 - DNA, 20 bp, Homo sapiens
gagactgtggtaggggcagg

SEQ ID NO: 1660176 - DNA, 18 bp, Homo sapiens
gagacttaaaacatggtg

SEQ ID NO: 1660177 - DNA, 21 bp, Homo sapiens
gagacttgtgctcaaggaatc

SEQ ID NO: 1660178 - DNA, 11 bp, Homo sapiens
gagagaaaaaa

SEQ ID NO: 1660179 - DNA, 18 bp, Homo sapiens
gagagaaaagctggacct

SEQ ID NO: 1660180 - DNA, 17 bp, Homo sapiens
gagagaaagagagaagc

SEQ ID NO: 1660181 - DNA, 22 bp, Homo sapiens
gagagaaagtgtgagcaaacta

SEQ ID NO: 1660182 - DNA, 11 bp, Homo sapiens
gagagaaatat

SEQ ID NO: 1660183 - DNA, 13 bp, Homo sapiens
gagagaagccagc

SEQ ID NO: 1660184 - DNA, 18 bp, Homo sapiens
gagagaagccagccacag

SEQ ID NO: 1660185 - DNA, 22 bp, Homo sapiens
gagagaataaattggattattt

SEQ ID NO: 1660186 - DNA, 15 bp, Homo sapiens
gagagaatagagctg

SEQ ID NO: 1660187 - DNA, 16 bp, Homo sapiens
gagagaatagagctgc

SEQ ID NO: 1660188 - DNA, 17 bp, Homo sapiens
gagagaatagagctgcc

SEQ ID NO: 1660189 - DNA, 21 bp, Homo sapiens
gagagaatagagctgccactg

SEQ ID NO: 1660190 - DNA, 17 bp, Homo sapiens
gagagacaagaagcaaa

SEQ ID NO: 1660191 - DNA, 14 bp, Homo sapiens
gagagacccaagga

SEQ ID NO: 1660192 - DNA, 15 bp, Homo sapiens
gagagaccccgcacc

SEQ ID NO: 1660193 - DNA, 20 bp, Homo sapiens
gagagaccccgcacccggct

SEQ ID NO: 1660194 - DNA, 16 bp, Homo sapiens
gagagacccgggaagg

SEQ ID NO: 1660195 - DNA, 14 bp, Homo sapiens
gagagaccctcact

SEQ ID NO: 1660196 - DNA, 14 bp, Homo sapiens
gagagacctgccct

SEQ ID NO: 1660197 - DNA, 15 bp, Homo sapiens
gagagactgagcagc

SEQ ID NO: 1660198 - DNA, 17 bp, Homo sapiens
gagagactgagcagccg

SEQ ID NO: 1660199 - DNA, 12 bp, Homo sapiens
gagagacttgtt

SEQ ID NO: 1660200 - DNA, 11 bp, Homo sapiens
gagagagaaaa

SEQ ID NO: 1660201 - DNA, 12 bp, Homo sapiens
gagagagaaaga

SEQ ID NO: 1660202 - DNA, 13 bp, Homo sapiens
gagagagagaaag

SEQ ID NO: 1660203 - DNA, 14 bp, Homo sapiens
gagagagagagaga

SEQ ID NO: 1660204 - DNA, 13 bp, Homo sapiens
gagagagagagga

SEQ ID NO: 1660205 - DNA, 14 bp, Homo sapiens
gagagagagaggac

SEQ ID NO: 1660206 - DNA, 12 bp, Homo sapiens
gagagagaggct

SEQ ID NO: 1660207 - DNA, 14 bp, Homo sapiens
gagagagaggctgc

SEQ ID NO: 1660208 - DNA, 13 bp, Homo sapiens
gagagaggacagc

SEQ ID NO: 1660209 - DNA, 13 bp, Homo sapiens
gagagagggactc

SEQ ID NO: 1660210 - DNA, 17 bp, Homo sapiens
gagagaggttgaaaaac

SEQ ID NO: 1660211 - DNA, 16 bp, Homo sapiens
gagagcaaatgcaaaa

SEQ ID NO: 1660212 - DNA, 16 bp, Homo sapiens
gagagcagaggtctcc

SEQ ID NO: 1660213 - DNA, 13 bp, Homo sapiens
gagagcagcagca

SEQ ID NO: 1660214 - DNA, 16 bp, Homo sapiens
gagagcagtgggcagg

SEQ ID NO: 1660215 - DNA, 21 bp, Homo sapiens
gagagccaagacggaggaggg

SEQ ID NO: 1660216 - DNA, 19 bp, Homo sapiens
gagagccagatgcctcccc

SEQ ID NO: 1660217 - DNA, 20 bp, Homo sapiens
gagagccagatgcctcccca

SEQ ID NO: 1660218 - DNA, 11 bp, Homo sapiens
gagagccagcc

SEQ ID NO: 1660219 - DNA, 14 bp, Homo sapiens
gagagccagccctc

SEQ ID NO: 1660220 - DNA, 20 bp, Homo sapiens
gagagccagccctccctgtc

SEQ ID NO: 1660221 - DNA, 19 bp, Homo sapiens
gagagccaggatgcccaga

SEQ ID NO: 1660222 - DNA, 10 bp, Homo sapiens
gagagcccag

SEQ ID NO: 1660223 - DNA, 19 bp, Homo sapiens
gagagccctgaggcctaga

SEQ ID NO: 1660224 - DNA, 14 bp, Homo sapiens
gagagcctgctgca

SEQ ID NO: 1660225 - DNA, 17 bp, Homo sapiens
gagagcctgtcaccaga

SEQ ID NO: 1660226 - DNA, 17 bp, Homo sapiens
gagagccttaacttctt

SEQ ID NO: 1660227 - DNA, 16 bp, Homo sapiens
gagagcgacacagacg

SEQ ID NO: 1660228 - DNA, 17 bp, Homo sapiens
gagagcggctggagaaa

SEQ ID NO: 1660229 - DNA, 14 bp, Homo sapiens
gagagctctggccc

SEQ ID NO: 1660230 - DNA, 13 bp, Homo sapiens
gagagctggtgcc

SEQ ID NO: 1660231 - DNA, 14 bp, Homo sapiens
gagagctggtgccc

SEQ ID NO: 1660232 - DNA, 18 bp, Homo sapiens
gagagcttggactacaca

SEQ ID NO: 1660233 - DNA, 19 bp, Homo sapiens
gagagcttggactacacaa

SEQ ID NO: 1660234 - DNA, 19 bp, Homo sapiens
gagaggaatgcctgtgtga

SEQ ID NO: 1660235 - DNA, 10 bp, Homo sapiens
gagaggacag

SEQ ID NO: 1660236 - DNA, 13 bp, Homo sapiens
gagaggacagagg

SEQ ID NO: 1660237 - DNA, 15 bp, Homo sapiens
gagaggacagcttga

SEQ ID NO: 1660238 - DNA, 18 bp, Homo sapiens
gagaggacagcttgagcc

SEQ ID NO: 1660239 - DNA, 17 bp, Homo sapiens
gagaggagacggagggg

SEQ ID NO: 1660240 - DNA, 16 bp, Homo sapiens
gagaggatacatttaa

SEQ ID NO: 1660241 - DNA, 20 bp, Homo sapiens
gagaggatacatttaataaa

SEQ ID NO: 1660242 - DNA, 21 bp, Homo sapiens
gagaggatacatttaataaaa

SEQ ID NO: 1660243 - DNA, 20 bp, Homo sapiens
gagaggcagaagaaccctgg

SEQ ID NO: 1660244 - DNA, 18 bp, Homo sapiens
gagaggcagcatgcttgg

SEQ ID NO: 1660245 - DNA, 15 bp, Homo sapiens
gagaggcaggcatag

SEQ ID NO: 1660246 - DNA, 14 bp, Homo sapiens
gagaggcatggctg

SEQ ID NO: 1660247 - DNA, 16 bp, Homo sapiens
gagaggcccgcccgcc

SEQ ID NO: 1660248 - DNA, 13 bp, Homo sapiens
gagaggcctggag

SEQ ID NO: 1660249 - DNA, 18 bp, Homo sapiens
gagaggccttttgtttaa

SEQ ID NO: 1660250 - DNA, 14 bp, Homo sapiens
gagaggctctccgt

SEQ ID NO: 1660251 - DNA, 14 bp, Homo sapiens
gagagggaagctgg

SEQ ID NO: 1660252 - DNA, 20 bp, Homo sapiens
gagagggactcaagggaaag

SEQ ID NO: 1660253 - DNA, 21 bp, Homo sapiens
gagagggcaatctttgccttt

SEQ ID NO: 1660254 - DNA, 21 bp, Homo sapiens
gagagggctggtccttattta

SEQ ID NO: 1660255 - DNA, 21 bp, Homo sapiens
gagaggggaataatagaagaa

SEQ ID NO: 1660256 - DNA, 13 bp, Homo sapiens
gagaggggcctgc

SEQ ID NO: 1660257 - DNA, 14 bp, Homo sapiens
gagaggggcctgca

SEQ ID NO: 1660258 - DNA, 20 bp, Homo sapiens
gagaggggctgctctccaga

SEQ ID NO: 1660259 - DNA, 19 bp, Homo sapiens
gagagggggcctgggactt

SEQ ID NO: 1660260 - DNA, 23 bp, Homo sapiens
gagagggggcctgggacttccat

SEQ ID NO: 1660261 - DNA, 21 bp, Homo sapiens
gagaggtcaccagctgctgtg

SEQ ID NO: 1660262 - DNA, 15 bp, Homo sapiens
gagaggtctcaggtt

SEQ ID NO: 1660263 - DNA, 17 bp, Homo sapiens
gagaggtggagaactgg

SEQ ID NO: 1660264 - DNA, 14 bp, Homo sapiens
gagaggtgggccag

SEQ ID NO: 1660265 - DNA, 20 bp, Homo sapiens
gagagtagccgagagcctgc

SEQ ID NO: 1660266 - DNA, 17 bp, Homo sapiens
gagagtatttttataca

SEQ ID NO: 1660267 - DNA, 20 bp, Homo sapiens
gagagtcagctctctgccct

SEQ ID NO: 1660268 - DNA, 17 bp, Homo sapiens
gagagtcccagagcagg

SEQ ID NO: 1660269 - DNA, 18 bp, Homo sapiens
gagagtcccagagcagga

SEQ ID NO: 1660270 - DNA, 17 bp, Homo sapiens
gagagtcggtctgcttt

SEQ ID NO: 1660271 - DNA, 20 bp, Homo sapiens
gagagtcggtctgctttgga

SEQ ID NO: 1660272 - DNA, 13 bp, Homo sapiens
gagagtctagatt

SEQ ID NO: 1660273 - DNA, 14 bp, Homo sapiens
gagagtctgtctca

SEQ ID NO: 1660274 - DNA, 17 bp, Homo sapiens
gagagtgagcatgagct

SEQ ID NO: 1660275 - DNA, 21 bp, Homo sapiens
gagagtgcagatctgtgctca

SEQ ID NO: 1660276 - DNA, 19 bp, Homo sapiens
gagagtggggcctgccctc

SEQ ID NO: 1660277 - DNA, 12 bp, Homo sapiens
gagagtgtgctc

SEQ ID NO: 1660278 - DNA, 17 bp, Homo sapiens
gagagtgtgtgggcagg

SEQ ID NO: 1660279 - DNA, 15 bp, Homo sapiens
gagagttaaaagcag

SEQ ID NO: 1660280 - DNA, 19 bp, Homo sapiens
gagagttaaaagcagcagc

SEQ ID NO: 1660281 - DNA, 17 bp, Homo sapiens
gagcgcccgcgcccgcg

SEQ ID NO: 1660282 - DNA, 18 bp, Homo sapiens
gagcgctgtggactgtcc

SEQ ID NO: 1660283 - DNA, 19 bp, Homo sapiens
gagcgcttcagttcagctt

SEQ ID NO: 1660284 - DNA, 13 bp, Homo sapiens
gagcggaggttgc

SEQ ID NO: 1660285 - DNA, 12 bp, Homo sapiens
gagcggctggag

SEQ ID NO: 1660286 - DNA, 13 bp, Homo sapiens
gagcggctggaga

SEQ ID NO: 1660287 - DNA, 13 bp, Homo sapiens
gagcggtggcccc

SEQ ID NO: 1660288 - DNA, 16 bp, Homo sapiens
gagcgtgaatctgtat

SEQ ID NO: 1660289 - DNA, 19 bp, Homo sapiens
gagcgtggactctgctaga

SEQ ID NO: 1660290 - DNA, 16 bp, Homo sapiens
gagcgttctctgtcct

SEQ ID NO: 1660291 - DNA, 18 bp, Homo sapiens
gagctaaactccttcctg

SEQ ID NO: 1660292 - DNA, 19 bp, Homo sapiens
gagctaaactccttcctgg

SEQ ID NO: 1660293 - DNA, 14 bp, Homo sapiens
gagctactgagact

SEQ ID NO: 1660294 - DNA, 19 bp, Homo sapiens
gagctagaaaaataaaatg

SEQ ID NO: 1660295 - DNA, 14 bp, Homo sapiens
gagctagcgctgcc

SEQ ID NO: 1660296 - DNA, 17 bp, Homo sapiens
gagctagttctcagctt

SEQ ID NO: 1660297 - DNA, 17 bp, Homo sapiens
gagctatcagtgctttg

SEQ ID NO: 1660298 - DNA, 23 bp, Homo sapiens
gagctatgatttttttttccaaa

SEQ ID NO: 1660299 - DNA, 16 bp, Homo sapiens
gagctattcacctcag

SEQ ID NO: 1660300 - DNA, 18 bp, Homo sapiens
gagctcagacccccactc

SEQ ID NO: 1660301 - DNA, 21 bp, Homo sapiens
gagctcagacccccactctca

SEQ ID NO: 1660302 - DNA, 17 bp, Homo sapiens
gagctcatcccccctgc

SEQ ID NO: 1660303 - DNA, 18 bp, Homo sapiens
gagctcatcccccctgct

SEQ ID NO: 1660304 - DNA, 15 bp, Homo sapiens
gagctccacctctgg

SEQ ID NO: 1660305 - DNA, 13 bp, Homo sapiens
gagctccactctg

SEQ ID NO: 1660306 - DNA, 21 bp, Homo sapiens
gagctccactctgcttctctg

SEQ ID NO: 1660307 - DNA, 13 bp, Homo sapiens
gagctcccacctc

SEQ ID NO: 1660308 - DNA, 16 bp, Homo sapiens
gagctcccacctccct

SEQ ID NO: 1660309 - DNA, 19 bp, Homo sapiens
gagctcccacctcccttcc

SEQ ID NO: 1660310 - DNA, 17 bp, Homo sapiens
gagctcccctccacagc

SEQ ID NO: 1660311 - DNA, 18 bp, Homo sapiens
gagctcccctccacagct

SEQ ID NO: 1660312 - DNA, 22 bp, Homo sapiens
gagctcccctccacagctgcag

SEQ ID NO: 1660313 - DNA, 19 bp, Homo sapiens
gagctcccctggagccagc

SEQ ID NO: 1660314 - DNA, 19 bp, Homo sapiens
gagctccctcgctgtatga

SEQ ID NO: 1660315 - DNA, 14 bp, Homo sapiens
gagctcctgctgcg

SEQ ID NO: 1660316 - DNA, 14 bp, Homo sapiens
gagctcctggaagc

SEQ ID NO: 1660317 - DNA, 18 bp, Homo sapiens
gagctcgcggggcagcaa

SEQ ID NO: 1660318 - DNA, 20 bp, Homo sapiens
gagctcggggggctctgcct

SEQ ID NO: 1660319 - DNA, 22 bp, Homo sapiens
gagctcgtgtatcctggggctc

SEQ ID NO: 1660320 - DNA, 15 bp, Homo sapiens
gagctctccaggcca

SEQ ID NO: 1660321 - DNA, 22 bp, Homo sapiens
gagctctcccctcctgctgggc

SEQ ID NO: 1660322 - DNA, 14 bp, Homo sapiens
gagctctctctaca

SEQ ID NO: 1660323 - DNA, 16 bp, Homo sapiens
gagctctgaaatcttc

SEQ ID NO: 1660324 - DNA, 19 bp, Homo sapiens
gagctctgaaatcttccca

SEQ ID NO: 1660325 - DNA, 14 bp, Homo sapiens
gagctctgcgccag

SEQ ID NO: 1660326 - DNA, 18 bp, Homo sapiens
gagctctgcgccaggcag

SEQ ID NO: 1660327 - DNA, 19 bp, Homo sapiens
gagctctgcgccaggcaga

SEQ ID NO: 1660328 - DNA, 15 bp, Homo sapiens
gagctctggccccgc

SEQ ID NO: 1660329 - DNA, 19 bp, Homo sapiens
gagctctggccccgctagc

SEQ ID NO: 1660330 - DNA, 15 bp, Homo sapiens
gagctctggggacag

SEQ ID NO: 1660331 - DNA, 19 bp, Homo sapiens
gagctctggggacagcttc

SEQ ID NO: 1660332 - DNA, 21 bp, Homo sapiens
gagctctggggacagcttcct

SEQ ID NO: 1660333 - DNA, 19 bp, Homo sapiens
gagctctggttatttttct

SEQ ID NO: 1660334 - DNA, 17 bp, Homo sapiens
gagctctgtatggtcag

SEQ ID NO: 1660335 - DNA, 18 bp, Homo sapiens
gagctctgtatggtcagg

SEQ ID NO: 1660336 - DNA, 17 bp, Homo sapiens
gagctcttcaggcctcc

SEQ ID NO: 1660337 - DNA, 19 bp, Homo sapiens
gagctcttcaggcctccct

SEQ ID NO: 1660338 - DNA, 20 bp, Homo sapiens
gagctcttcggtttctgagc

SEQ ID NO: 1660339 - DNA, 21 bp, Homo sapiens
gagctcttcggtttctgagca

SEQ ID NO: 1660340 - DNA, 22 bp, Homo sapiens
gagctcttcggtttctgagcat

SEQ ID NO: 1660341 - DNA, 12 bp, Homo sapiens
gagctcttggaa

SEQ ID NO: 1660342 - DNA, 15 bp, Homo sapiens
gagctcttgggtcag

SEQ ID NO: 1660343 - DNA, 19 bp, Homo sapiens
gagctcttgggtcagagaa

SEQ ID NO: 1660344 - DNA, 22 bp, Homo sapiens
gagctgaaaaatcacatcctgg

SEQ ID NO: 1660345 - DNA, 23 bp, Homo sapiens
gagctgaaaaggatcgaggcatg

SEQ ID NO: 1660346 - DNA, 17 bp, Homo sapiens
gagctgagatgagcccc

SEQ ID NO: 1660347 - DNA, 13 bp, Homo sapiens
gagctgagctgga

SEQ ID NO: 1660348 - DNA, 14 bp, Homo sapiens
gagctgagtcacct

SEQ ID NO: 1660349 - DNA, 21 bp, Homo sapiens
gagctgagtcacctcctccac

SEQ ID NO: 1660350 - DNA, 15 bp, Homo sapiens
gagctgatccagagc

SEQ ID NO: 1660351 - DNA, 18 bp, Homo sapiens
gagctgattgcagaaagg

SEQ ID NO: 1660352 - DNA, 18 bp, Homo sapiens
gagctgatttccaggccc

SEQ ID NO: 1660353 - DNA, 19 bp, Homo sapiens
gagctgatttccaggcccc

SEQ ID NO: 1660354 - DNA, 20 bp, Homo sapiens
gagctgatttccaggcccct

SEQ ID NO: 1660355 - DNA, 21 bp, Homo sapiens
gagctgatttccaggcccctg

SEQ ID NO: 1660356 - DNA, 22 bp, Homo sapiens
gagctgcactgatcacccaatg

SEQ ID NO: 1660357 - DNA, 11 bp, Homo sapiens
gagctgcaggg

SEQ ID NO: 1660358 - DNA, 13 bp, Homo sapiens
gagctgccacaga

SEQ ID NO: 1660359 - DNA, 19 bp, Homo sapiens
gagctgccactgggcacct

SEQ ID NO: 1660360 - DNA, 22 bp, Homo sapiens
gagctgccactgggcacctgcg

SEQ ID NO: 1660361 - DNA, 21 bp, Homo sapiens
gagctgcccagagttgctggg

SEQ ID NO: 1660362 - DNA, 12 bp, Homo sapiens
gagctgcctgca

SEQ ID NO: 1660363 - DNA, 13 bp, Homo sapiens
gagctgcctgcag

SEQ ID NO: 1660364 - DNA, 14 bp, Homo sapiens
gagctgcctgcagc

SEQ ID NO: 1660365 - DNA, 17 bp, Homo sapiens
gagctgcctgcagcaca

SEQ ID NO: 1660366 - DNA, 12 bp, Homo sapiens
gagctgcctgga

SEQ ID NO: 1660367 - DNA, 23 bp, Homo sapiens
gagctgcctggatgagaaacagc

SEQ ID NO: 1660368 - DNA, 15 bp, Homo sapiens
gagctgccttggctc

SEQ ID NO: 1660369 - DNA, 21 bp, Homo sapiens
gagctgccttggctcagacat

SEQ ID NO: 1660370 - DNA, 14 bp, Homo sapiens
gagctgctcagaat

SEQ ID NO: 1660371 - DNA, 12 bp, Homo sapiens
gagctgctggct

SEQ ID NO: 1660372 - DNA, 16 bp, Homo sapiens
gagctgctttttttga

SEQ ID NO: 1660373 - DNA, 16 bp, Homo sapiens
gagctggaaggcaggg

SEQ ID NO: 1660374 - DNA, 18 bp, Homo sapiens
gagctggaaggcagggca

SEQ ID NO: 1660375 - DNA, 19 bp, Homo sapiens
gagctggaaggcagggcag

SEQ ID NO: 1660376 - DNA, 20 bp, Homo sapiens
gagctggaaggcagggcaga

SEQ ID NO: 1660377 - DNA, 21 bp, Homo sapiens
gagctggaaggcagggcagag

SEQ ID NO: 1660378 - DNA, 15 bp, Homo sapiens
gagctggaaggggcc

SEQ ID NO: 1660379 - DNA, 18 bp, Homo sapiens
gagctggaggggtgggga

SEQ ID NO: 1660380 - DNA, 20 bp, Homo sapiens
gagctggaggggtggggagc

SEQ ID NO: 1660381 - DNA, 18 bp, Homo sapiens
gagctggatagacttggg

SEQ ID NO: 1660382 - DNA, 15 bp, Homo sapiens
gagctggcaaccagc

SEQ ID NO: 1660383 - DNA, 23 bp, Homo sapiens
gagctggccaaagagcctttcca

SEQ ID NO: 1660384 - DNA, 12 bp, Homo sapiens
gagctggcccag

SEQ ID NO: 1660385 - DNA, 16 bp, Homo sapiens
gagctggcctctctag

SEQ ID NO: 1660386 - DNA, 12 bp, Homo sapiens
gagctggcctgt

SEQ ID NO: 1660387 - DNA, 17 bp, Homo sapiens
gagctggctctgagcgc

SEQ ID NO: 1660388 - DNA, 16 bp, Homo sapiens
gagctgggagccgggc

SEQ ID NO: 1660389 - DNA, 16 bp, Homo sapiens
gagctgggaggaaaag

SEQ ID NO: 1660390 - DNA, 17 bp, Homo sapiens
gagctgggaggaaaaga

SEQ ID NO: 1660391 - DNA, 21 bp, Homo sapiens
gagctgggaggtagaagggga

SEQ ID NO: 1660392 - DNA, 12 bp, Homo sapiens
gagctgggcccc

SEQ ID NO: 1660393 - DNA, 22 bp, Homo sapiens
gagctgggcccctgcacaggca

SEQ ID NO: 1660394 - DNA, 13 bp, Homo sapiens
gagctgggcccga

SEQ ID NO: 1660395 - DNA, 18 bp, Homo sapiens
gagctggggactcaggga

SEQ ID NO: 1660396 - DNA, 19 bp, Homo sapiens
gaggccccagcctccctga

SEQ ID NO: 1660397 - DNA, 22 bp, Homo sapiens
gaggccccagcctccctgaagc

SEQ ID NO: 1660398 - DNA, 23 bp, Homo sapiens
gaggccccagcctccctgaagcc

SEQ ID NO: 1660399 - DNA, 20 bp, Homo sapiens
gaggccccaggctgagagcc

SEQ ID NO: 1660400 - DNA, 17 bp, Homo sapiens
gaggcccccagcccagg

SEQ ID NO: 1660401 - DNA, 21 bp, Homo sapiens
gaggcccccagcccagggctc

SEQ ID NO: 1660402 - DNA, 21 bp, Homo sapiens
gaggccccgatggactcctga

SEQ ID NO: 1660403 - DNA, 13 bp, Homo sapiens
gaggcccctaggt

SEQ ID NO: 1660404 - DNA, 20 bp, Homo sapiens
gaggcccctaggtgcccagg

SEQ ID NO: 1660405 - DNA, 15 bp, Homo sapiens
gaggcccctggccca

SEQ ID NO: 1660406 - DNA, 14 bp, Homo sapiens
gaggcccctgggct

SEQ ID NO: 1660407 - DNA, 22 bp, Homo sapiens
gaggcccctgggctctcaccca

SEQ ID NO: 1660408 - DNA, 11 bp, Homo sapiens
gaggccctgga

SEQ ID NO: 1660409 - DNA, 22 bp, Homo sapiens
gaggccctggaggtctccaggg

SEQ ID NO: 1660410 - DNA, 17 bp, Homo sapiens
gaggccctgttccctgg

SEQ ID NO: 1660411 - DNA, 21 bp, Homo sapiens
gaggcccttgtcgtgggatgg

SEQ ID NO: 1660412 - DNA, 17 bp, Homo sapiens
gaggccgaaggtgcctc

SEQ ID NO: 1660413 - DNA, 18 bp, Homo sapiens
gaggccgaaggtgcctca

SEQ ID NO: 1660414 - DNA, 19 bp, Homo sapiens
gaggccgaaggtgcctcag

SEQ ID NO: 1660415 - DNA, 20 bp, Homo sapiens
gaggccgagcggtggccccg

SEQ ID NO: 1660416 - DNA, 20 bp, Homo sapiens
gaggccgaggaccaccagca

SEQ ID NO: 1660417 - DNA, 22 bp, Homo sapiens
gaggccgctagaggcctgagga

SEQ ID NO: 1660418 - DNA, 14 bp, Homo sapiens
gaggcctcaggtgc

SEQ ID NO: 1660419 - DNA, 15 bp, Homo sapiens
gaggcctcaggtgct

SEQ ID NO: 1660420 - DNA, 16 bp, Homo sapiens
gaggcctcccccagcc

SEQ ID NO: 1660421 - DNA, 18 bp, Homo sapiens
gaggcctgaagccagctg

SEQ ID NO: 1660422 - DNA, 20 bp, Homo sapiens
gaggcctgaggatgagctgg

SEQ ID NO: 1660423 - DNA, 17 bp, Homo sapiens
gaggcctgatgctgccc

SEQ ID NO: 1660424 - DNA, 19 bp, Homo sapiens
gaggcctgcctccagggct

SEQ ID NO: 1660425 - DNA, 20 bp, Homo sapiens
gaggcctgcgaccctggggg

SEQ ID NO: 1660426 - DNA, 13 bp, Homo sapiens
gaggcctgcttcc

SEQ ID NO: 1660427 - DNA, 13 bp, Homo sapiens
gaggcctggactt

SEQ ID NO: 1660428 - DNA, 16 bp, Homo sapiens
gaggccttccagctgc

SEQ ID NO: 1660429 - DNA, 17 bp, Homo sapiens
gaggccttccagctgct

SEQ ID NO: 1660430 - DNA, 17 bp, Homo sapiens
gaggccttgtgtgtcag

SEQ ID NO: 1660431 - DNA, 19 bp, Homo sapiens
gaggccttgtgtgtcaggc

SEQ ID NO: 1660432 - DNA, 13 bp, Homo sapiens
gaggcgctgctgg

SEQ ID NO: 1660433 - DNA, 14 bp, Homo sapiens
gaggcggaagaatc

SEQ ID NO: 1660434 - DNA, 16 bp, Homo sapiens
gaggcggcccggccag

SEQ ID NO: 1660435 - DNA, 19 bp, Homo sapiens
gaggcgggccagccaggcg

SEQ ID NO: 1660436 - DNA, 16 bp, Homo sapiens
gaggcgtactacccag

SEQ ID NO: 1660437 - DNA, 20 bp, Homo sapiens
gaggcgtactacccagctct

SEQ ID NO: 1660438 - DNA, 22 bp, Homo sapiens
gaggcgtactacccagctctgt

SEQ ID NO: 1660439 - DNA, 18 bp, Homo sapiens
gaggcgtgcccccctcct

SEQ ID NO: 1660440 - DNA, 23 bp, Homo sapiens
gaggctaaattactcaggaagaa

SEQ ID NO: 1660441 - DNA, 23 bp, Homo sapiens
gaggctacaggggttagcctgga

SEQ ID NO: 1660442 - DNA, 21 bp, Homo sapiens
gaggctcaggtgatctgtttg

SEQ ID NO: 1660443 - DNA, 18 bp, Homo sapiens
gaggctcggagcaccctt

SEQ ID NO: 1660444 - DNA, 21 bp, Homo sapiens
gaggctgacatgctcacacat

SEQ ID NO: 1660445 - DNA, 23 bp, Homo sapiens
gaggctgacatgctcacacatta

SEQ ID NO: 1660446 - DNA, 14 bp, Homo sapiens
gaggctgagacagg

SEQ ID NO: 1660447 - DNA, 16 bp, Homo sapiens
gaggctgaggcaagag

SEQ ID NO: 1660448 - DNA, 15 bp, Homo sapiens
gaggctgaggcagga

SEQ ID NO: 1660449 - DNA, 17 bp, Homo sapiens
gaggctgaggcaggagg

SEQ ID NO: 1660450 - DNA, 19 bp, Homo sapiens
gaggctgagttctggttca

SEQ ID NO: 1660451 - DNA, 11 bp, Homo sapiens
gaggctgcagc

SEQ ID NO: 1660452 - DNA, 14 bp, Homo sapiens
gaggctgcagcagg

SEQ ID NO: 1660453 - DNA, 16 bp, Homo sapiens
gaggctgcagcaggtg

SEQ ID NO: 1660454 - DNA, 15 bp, Homo sapiens
gaggctgcaggactt

SEQ ID NO: 1660455 - DNA, 14 bp, Homo sapiens
gaggctgcagtcag

SEQ ID NO: 1660456 - DNA, 16 bp, Homo sapiens
gaggctgcatgctctg

SEQ ID NO: 1660457 - DNA, 14 bp, Homo sapiens
gaggctgccccagg

SEQ ID NO: 1660458 - DNA, 15 bp, Homo sapiens
gaggctgcccctctc

SEQ ID NO: 1660459 - DNA, 23 bp, Homo sapiens
gaggctgcttcccagaggagcag

SEQ ID NO: 1660460 - DNA, 19 bp, Homo sapiens
gaggctgctttctgccctt

SEQ ID NO: 1660461 - DNA, 21 bp, Homo sapiens
gaggctggccaaggtgtccag

SEQ ID NO: 1660462 - DNA, 22 bp, Homo sapiens
gaggctggttttgatggctggg

SEQ ID NO: 1660463 - DNA, 20 bp, Homo sapiens
gaggctgtcttctcaggctc

SEQ ID NO: 1660464 - DNA, 14 bp, Homo sapiens
gaggcttccaggct

SEQ ID NO: 1660465 - DNA, 15 bp, Homo sapiens
gaggcttccaggctc

SEQ ID NO: 1660466 - DNA, 20 bp, Homo sapiens
gaggcttccaggctcttcct

SEQ ID NO: 1660467 - DNA, 23 bp, Homo sapiens
gaggcttctccgccagcctcctc

SEQ ID NO: 1660468 - DNA, 19 bp, Homo sapiens
gaggcttgtttacctttct

SEQ ID NO: 1660469 - DNA, 15 bp, Homo sapiens
gaggcttttcactgc

SEQ ID NO: 1660470 - DNA, 16 bp, Homo sapiens
gagggaaatctgtaaa

SEQ ID NO: 1660471 - DNA, 13 bp, Homo sapiens
gagggaaggagcc

SEQ ID NO: 1660472 - DNA, 20 bp, Homo sapiens
gagggaatgttccctgcacc

SEQ ID NO: 1660473 - DNA, 18 bp, Homo sapiens
gagggacaaactcactca

SEQ ID NO: 1660474 - DNA, 21 bp, Homo sapiens
gagggacaagggattctggga

SEQ ID NO: 1660475 - DNA, 16 bp, Homo sapiens
gagggacaggatctat

SEQ ID NO: 1660476 - DNA, 21 bp, Homo sapiens
gagggacaggctgaagagagg

SEQ ID NO: 1660477 - DNA, 13 bp, Homo sapiens
gagggacagggtg

SEQ ID NO: 1660478 - DNA, 18 bp, Homo sapiens
gagggaccaactgggccc

SEQ ID NO: 1660479 - DNA, 19 bp, Homo sapiens
gagggaccaactgggccca

SEQ ID NO: 1660480 - DNA, 19 bp, Homo sapiens
gagggactcaagggaaagg

SEQ ID NO: 1660481 - DNA, 20 bp, Homo sapiens
gagggactgtcagctgagct

SEQ ID NO: 1660482 - DNA, 21 bp, Homo sapiens
gagggactttgctgatttccc

SEQ ID NO: 1660483 - DNA, 21 bp, Homo sapiens
gagggacttttaatcagtgaa

SEQ ID NO: 1660484 - DNA, 16 bp, Homo sapiens
gagggagactgtggta

SEQ ID NO: 1660485 - DNA, 16 bp, Homo sapiens
gagggagagagagaga

SEQ ID NO: 1660486 - DNA, 15 bp, Homo sapiens
gagggagatctttcc

SEQ ID NO: 1660487 - DNA, 13 bp, Homo sapiens
gagggagccttgt

SEQ ID NO: 1660488 - DNA, 13 bp, Homo sapiens
gagggagcgacac

SEQ ID NO: 1660489 - DNA, 12 bp, Homo sapiens
gagggaggaggc

SEQ ID NO: 1660490 - DNA, 20 bp, Homo sapiens
gagggaggcactagtcaccg

SEQ ID NO: 1660491 - DNA, 20 bp, Homo sapiens
gagggagggggcgctcagga

SEQ ID NO: 1660492 - DNA, 17 bp, Homo sapiens
gagggagttagggagag

SEQ ID NO: 1660493 - DNA, 16 bp, Homo sapiens
gagggagttttgtctg

SEQ ID NO: 1660494 - DNA, 22 bp, Homo sapiens
gagggagttttgtctgtctccc

SEQ ID NO: 1660495 - DNA, 23 bp, Homo sapiens
gagggatgaagggcgagtgaatc

SEQ ID NO: 1660496 - DNA, 15 bp, Homo sapiens
gagggatggagaaag

SEQ ID NO: 1660497 - DNA, 20 bp, Homo sapiens
gagggatggagaaagaagtg

SEQ ID NO: 1660498 - DNA, 20 bp, Homo sapiens
gagggatgtttggaaaaaac

SEQ ID NO: 1660499 - DNA, 21 bp, Homo sapiens
gagggattctggttccagggt

SEQ ID NO: 1660500 - DNA, 16 bp, Homo sapiens
gagggattgaggggcc

SEQ ID NO: 1660501 - DNA, 20 bp, Homo sapiens
gagggcaagtggatgggaat

SEQ ID NO: 1660502 - DNA, 19 bp, Homo sapiens
gagggcacagccctccgac

SEQ ID NO: 1660503 - DNA, 18 bp, Homo sapiens
gagggcagactggggcat

SEQ ID NO: 1660504 - DNA, 23 bp, Homo sapiens
gagggcagactggggcatcctgt

SEQ ID NO: 1660505 - DNA, 16 bp, Homo sapiens
gagggcagagccatgg

SEQ ID NO: 1660506 - DNA, 17 bp, Homo sapiens
gagggcagagccatggg

SEQ ID NO: 1660507 - DNA, 20 bp, Homo sapiens
gagggcagagccatgggcct

SEQ ID NO: 1660508 - DNA, 14 bp, Homo sapiens
gagggcagaggctg

SEQ ID NO: 1660509 - DNA, 16 bp, Homo sapiens
gagggcagaggctgga

SEQ ID NO: 1660510 - DNA, 17 bp, Homo sapiens
gagtctagattcaaagg

SEQ ID NO: 1660511 - DNA, 13 bp, Homo sapiens
gagtctagattct

SEQ ID NO: 1660512 - DNA, 14 bp, Homo sapiens
gagtctcagagcac

SEQ ID NO: 1660513 - DNA, 16 bp, Homo sapiens
gagtctcagagcacag

SEQ ID NO: 1660514 - DNA, 18 bp, Homo sapiens
gagtctcagagcacagag

SEQ ID NO: 1660515 - DNA, 23 bp, Homo sapiens
gagtctccagggccccccaactg

SEQ ID NO: 1660516 - DNA, 12 bp, Homo sapiens
gagtctcttctc

SEQ ID NO: 1660517 - DNA, 12 bp, Homo sapiens
gagtctgagccc

SEQ ID NO: 1660518 - DNA, 14 bp, Homo sapiens
gagtctgagtcctg

SEQ ID NO: 1660519 - DNA, 14 bp, Homo sapiens
gagtctgagtctga

SEQ ID NO: 1660520 - DNA, 22 bp, Homo sapiens
gagtcttgctctgttgcccaag

SEQ ID NO: 1660521 - DNA, 20 bp, Homo sapiens
gagtcttggcggcagcagcc

SEQ ID NO: 1660522 - DNA, 23 bp, Homo sapiens
gagtcttggttctaaaggtacca

SEQ ID NO: 1660523 - DNA, 22 bp, Homo sapiens
gagtgaaacctttagggcagct

SEQ ID NO: 1660524 - DNA, 12 bp, Homo sapiens
gagtgaaccaga

SEQ ID NO: 1660525 - DNA, 15 bp, Homo sapiens
gagtgaaccatcatt

SEQ ID NO: 1660526 - DNA, 23 bp, Homo sapiens
gagtgaatgccatttagaatcta

SEQ ID NO: 1660527 - DNA, 23 bp, Homo sapiens
gagtgacagctttctgggatgtc

SEQ ID NO: 1660528 - DNA, 15 bp, Homo sapiens
gagtgactcaagaag

SEQ ID NO: 1660529 - DNA, 23 bp, Homo sapiens
gagtgactcaagaagtgaagaat

SEQ ID NO: 1660530 - DNA, 19 bp, Homo sapiens
gagtgagactccacctcaa

SEQ ID NO: 1660531 - DNA, 17 bp, Homo sapiens
gagtgagcaagggggcc

SEQ ID NO: 1660532 - DNA, 21 bp, Homo sapiens
gagtgagccacagaccacctg

SEQ ID NO: 1660533 - DNA, 17 bp, Homo sapiens
gagtgagctctggtgga

SEQ ID NO: 1660534 - DNA, 20 bp, Homo sapiens
gagtgaggcttccaggctct

SEQ ID NO: 1660535 - DNA, 15 bp, Homo sapiens
gagtgagtcacctgc

SEQ ID NO: 1660536 - DNA, 18 bp, Homo sapiens
gagtgagtcacctgctcc

SEQ ID NO: 1660537 - DNA, 20 bp, Homo sapiens
gagtgagtcacctgctccag

SEQ ID NO: 1660538 - DNA, 21 bp, Homo sapiens
gagtgataatattgtttccct

SEQ ID NO: 1660539 - DNA, 22 bp, Homo sapiens
gagtgataatattgtttccctc

SEQ ID NO: 1660540 - DNA, 22 bp, Homo sapiens
gagtgatacaacttcaagtgca

SEQ ID NO: 1660541 - DNA, 14 bp, Homo sapiens
gagtgattctagag

SEQ ID NO: 1660542 - DNA, 16 bp, Homo sapiens
gagtgcacctgcctcc

SEQ ID NO: 1660543 - DNA, 17 bp, Homo sapiens
gagtgcacctgcctcca

SEQ ID NO: 1660544 - DNA, 23 bp, Homo sapiens
gagtgcagccgtttgagaagaaa

SEQ ID NO: 1660545 - DNA, 18 bp, Homo sapiens
gagtgcaggtttctattg

SEQ ID NO: 1660546 - DNA, 13 bp, Homo sapiens
gagtgcagtggcg

SEQ ID NO: 1660547 - DNA, 19 bp, Homo sapiens
gagtgccaggaccagcctg

SEQ ID NO: 1660548 - DNA, 20 bp, Homo sapiens
gagtgccaggaccagcctgt

SEQ ID NO: 1660549 - DNA, 19 bp, Homo sapiens
gagtgcccccagcccagag

SEQ ID NO: 1660550 - DNA, 14 bp, Homo sapiens
gagtgcctggagtc

SEQ ID NO: 1660551 - DNA, 21 bp, Homo sapiens
gagtgcgctcttggtccctgg

SEQ ID NO: 1660552 - DNA, 14 bp, Homo sapiens
gagtgctctcactg

SEQ ID NO: 1660553 - DNA, 18 bp, Homo sapiens
gagtgctgaggccagggc

SEQ ID NO: 1660554 - DNA, 16 bp, Homo sapiens
gagtggaaactcagcc

SEQ ID NO: 1660555 - DNA, 13 bp, Homo sapiens
gagtggaggagga

SEQ ID NO: 1660556 - DNA, 10 bp, Homo sapiens
gagtggaggc

SEQ ID NO: 1660557 - DNA, 16 bp, Homo sapiens
gagtggcagccatgcc

SEQ ID NO: 1660558 - DNA, 18 bp, Homo sapiens
gagtggcagccatgcctc

SEQ ID NO: 1660559 - DNA, 14 bp, Homo sapiens
gagtggcaggggac

SEQ ID NO: 1660560 - DNA, 12 bp, Homo sapiens
gagtggcctggc

SEQ ID NO: 1660561 - DNA, 19 bp, Homo sapiens
gagtggcctggccaggagc

SEQ ID NO: 1660562 - DNA, 12 bp, Homo sapiens
gagtgggaagcc

SEQ ID NO: 1660563 - DNA, 20 bp, Homo sapiens
gagtgggccccgggctggag

SEQ ID NO: 1660564 - DNA, 22 bp, Homo sapiens
gagtgggctgggccctctgtcc

SEQ ID NO: 1660565 - DNA, 14 bp, Homo sapiens
gagtgggctgtagt

SEQ ID NO: 1660566 - DNA, 19 bp, Homo sapiens
gagtggggctggggaaagg

SEQ ID NO: 1660567 - DNA, 22 bp, Homo sapiens
gagtggggttgggggacagcct

SEQ ID NO: 1660568 - DNA, 21 bp, Homo sapiens
gagtggtctttctggagaggt

SEQ ID NO: 1660569 - DNA, 14 bp, Homo sapiens
gagtggttcctgtg

SEQ ID NO: 1660570 - DNA, 14 bp, Homo sapiens
gagtggttctcatt

SEQ ID NO: 1660571 - DNA, 14 bp, Homo sapiens
gagtgtaagtgtga

SEQ ID NO: 1660572 - DNA, 13 bp, Homo sapiens
gagtgtacaagta

SEQ ID NO: 1660573 - DNA, 20 bp, Homo sapiens
gagtgtagcctaaagggcag

SEQ ID NO: 1660574 - DNA, 14 bp, Homo sapiens
gagtgtagctgtaa

SEQ ID NO: 1660575 - DNA, 14 bp, Homo sapiens
gagtgtagctgtga

SEQ ID NO: 1660576 - DNA, 15 bp, Homo sapiens
gagtgtagctgtgaa

SEQ ID NO: 1660577 - DNA, 18 bp, Homo sapiens
gagtgtagctgtgaaatc

SEQ ID NO: 1660578 - DNA, 16 bp, Homo sapiens
gagtgtcatgaagtgc

SEQ ID NO: 1660579 - DNA, 19 bp, Homo sapiens
gagtgtcctgcccatgccc

SEQ ID NO: 1660580 - DNA, 14 bp, Homo sapiens
gagtgtgcagacag

SEQ ID NO: 1660581 - DNA, 18 bp, Homo sapiens
gagtgtgcagacagccat

SEQ ID NO: 1660582 - DNA, 13 bp, Homo sapiens
gagtgtgctgcta

SEQ ID NO: 1660583 - DNA, 18 bp, Homo sapiens
gagtgtgggaagggagag

SEQ ID NO: 1660584 - DNA, 15 bp, Homo sapiens
gagtgtgggctgccc

SEQ ID NO: 1660585 - DNA, 17 bp, Homo sapiens
gagtgtgggctgccctt

SEQ ID NO: 1660586 - DNA, 19 bp, Homo sapiens
gagtgtggtttctttttga

SEQ ID NO: 1660587 - DNA, 17 bp, Homo sapiens
gagtgtgtatgccaaga

SEQ ID NO: 1660588 - DNA, 12 bp, Homo sapiens
gagtgtgtctgc

SEQ ID NO: 1660589 - DNA, 15 bp, Homo sapiens
gagtgtgtgggcagg

SEQ ID NO: 1660590 - DNA, 17 bp, Homo sapiens
gagtgtgtgggcagggt

SEQ ID NO: 1660591 - DNA, 21 bp, Homo sapiens
gagtgttcattttagtgactg

SEQ ID NO: 1660592 - DNA, 12 bp, Homo sapiens
gagttaaaatgt

SEQ ID NO: 1660593 - DNA, 13 bp, Homo sapiens
gagttaaaatgtt

SEQ ID NO: 1660594 - DNA, 17 bp, Homo sapiens
gagttaaaatgtttact

SEQ ID NO: 1660595 - DNA, 14 bp, Homo sapiens
gagttaagacctgg

SEQ ID NO: 1660596 - DNA, 21 bp, Homo sapiens
gagttaagacctggcagctct

SEQ ID NO: 1660597 - DNA, 19 bp, Homo sapiens
gagttacaataaagtttac

SEQ ID NO: 1660598 - DNA, 13 bp, Homo sapiens
gagttacagttct

SEQ ID NO: 1660599 - DNA, 14 bp, Homo sapiens
gagttacagttctg

SEQ ID NO: 1660600 - DNA, 20 bp, Homo sapiens
gagttagggagagagaagca

SEQ ID NO: 1660601 - DNA, 19 bp, Homo sapiens
gagttatcatgaattttaa

SEQ ID NO: 1660602 - DNA, 23 bp, Homo sapiens
gagttatcatgaattttaaagta

SEQ ID NO: 1660603 - DNA, 22 bp, Homo sapiens
gagttcaagactagcctggcca

SEQ ID NO: 1660604 - DNA, 14 bp, Homo sapiens
gagttcaccttgga

SEQ ID NO: 1660605 - DNA, 17 bp, Homo sapiens
gagttcaccttggaagg

SEQ ID NO: 1660606 - DNA, 19 bp, Homo sapiens
gagttccagaccccctgag

SEQ ID NO: 1660607 - DNA, 15 bp, Homo sapiens
gagttccagttgaag

SEQ ID NO: 1660608 - DNA, 21 bp, Homo sapiens
gagttccctaaacaaaagcaa

SEQ ID NO: 1660609 - DNA, 21 bp, Homo sapiens
gagttccgggaaacatagcct

SEQ ID NO: 1660610 - DNA, 23 bp, Homo sapiens
gagttcctgcggagtgaagaggg

SEQ ID NO: 1660611 - DNA, 15 bp, Homo sapiens
gagttcctgctccgt

SEQ ID NO: 1660612 - DNA, 16 bp, Homo sapiens
gagttcctgctccgtg

SEQ ID NO: 1660613 - DNA, 23 bp, Homo sapiens
gagttccttatccctctcttccc

SEQ ID NO: 1660614 - DNA, 11 bp, Homo sapiens
gagttctacat

SEQ ID NO: 1660615 - DNA, 20 bp, Homo sapiens
gagttctagatttttaagag

SEQ ID NO: 1660616 - DNA, 20 bp, Homo sapiens
gagttctatccccaagctgg

SEQ ID NO: 1660617 - DNA, 22 bp, Homo sapiens
gagttctctcatcggaggccca

SEQ ID NO: 1660618 - DNA, 21 bp, Homo sapiens
gagttcttaaggattgtgata

SEQ ID NO: 1660619 - DNA, 23 bp, Homo sapiens
gagttgcctgactcctgggtggg

SEQ ID NO: 1660620 - DNA, 17 bp, Homo sapiens
gagttgctttgccagag

SEQ ID NO: 1660621 - DNA, 18 bp, Homo sapiens
gagttgctttgccagagc

SEQ ID NO: 1660622 - DNA, 22 bp, Homo sapiens
gagttgcttttcagctgaggtt

SEQ ID NO: 1660623 - DNA, 23 bp, Homo sapiens
gagttggacttcagtcttgccta

SEQ ID NO: 1660624 - DNA, 17 bp, Homo sapiens
gagttggagtactatat

SEQ ID NO: 1660625 - DNA, 21 bp, Homo sapiens
gatcatttttaactgattctt

SEQ ID NO: 1660626 - DNA, 20 bp, Homo sapiens
gatccaaaagaagcccccag

SEQ ID NO: 1660627 - DNA, 23 bp, Homo sapiens
gatccaaaagaagcccccagcta

SEQ ID NO: 1660628 - DNA, 14 bp, Homo sapiens
gatccacacacaga

SEQ ID NO: 1660629 - DNA, 18 bp, Homo sapiens
gatccacacacagaggaa

SEQ ID NO: 1660630 - DNA, 19 bp, Homo sapiens
gatccacacacagaggaag

SEQ ID NO: 1660631 - DNA, 23 bp, Homo sapiens
gatccacactttgggcttagtat

SEQ ID NO: 1660632 - DNA, 19 bp, Homo sapiens
gatccacctgtctcagcct

SEQ ID NO: 1660633 - DNA, 14 bp, Homo sapiens
gatccagaacagtg

SEQ ID NO: 1660634 - DNA, 14 bp, Homo sapiens
gatccagagcacag

SEQ ID NO: 1660635 - DNA, 11 bp, Homo sapiens
gatccagccac

SEQ ID NO: 1660636 - DNA, 12 bp, Homo sapiens
gatccagcctgg

SEQ ID NO: 1660637 - DNA, 17 bp, Homo sapiens
gatccagcctttccaag

SEQ ID NO: 1660638 - DNA, 16 bp, Homo sapiens
gatccaggcaggagca

SEQ ID NO: 1660639 - DNA, 12 bp, Homo sapiens
gatccagggaca

SEQ ID NO: 1660640 - DNA, 14 bp, Homo sapiens
gatccagggacaga

SEQ ID NO: 1660641 - DNA, 19 bp, Homo sapiens
gatccagggatggagatgg

SEQ ID NO: 1660642 - DNA, 16 bp, Homo sapiens
gatccagtataagact

SEQ ID NO: 1660643 - DNA, 17 bp, Homo sapiens
gatccagtataagacta

SEQ ID NO: 1660644 - DNA, 17 bp, Homo sapiens
gatccatccatctccag

SEQ ID NO: 1660645 - DNA, 16 bp, Homo sapiens
gatcccaaagcaagga

SEQ ID NO: 1660646 - DNA, 14 bp, Homo sapiens
gatcccatggccag

SEQ ID NO: 1660647 - DNA, 22 bp, Homo sapiens
gatcccatgtcacctcagctga

SEQ ID NO: 1660648 - DNA, 22 bp, Homo sapiens
gatccccaagacatgtggaggg

SEQ ID NO: 1660649 - DNA, 15 bp, Homo sapiens
gatccccagggcagc

SEQ ID NO: 1660650 - DNA, 15 bp, Homo sapiens
gatccccgcctggcc

SEQ ID NO: 1660651 - DNA, 20 bp, Homo sapiens
gatccccgcctggccaggag

SEQ ID NO: 1660652 - DNA, 13 bp, Homo sapiens
gatcccctccccc

SEQ ID NO: 1660653 - DNA, 19 bp, Homo sapiens
gatcccggccggccctggc

SEQ ID NO: 1660654 - DNA, 15 bp, Homo sapiens
gatccctcctgagct

SEQ ID NO: 1660655 - DNA, 20 bp, Homo sapiens
gatccctgaacccctggcca

SEQ ID NO: 1660656 - DNA, 21 bp, Homo sapiens
gatccctgaacccctggccag

SEQ ID NO: 1660657 - DNA, 16 bp, Homo sapiens
gatccctgctctctga

SEQ ID NO: 1660658 - DNA, 18 bp, Homo sapiens
gatccctgttacccagag

SEQ ID NO: 1660659 - DNA, 20 bp, Homo sapiens
gatccgactgctttggacct

SEQ ID NO: 1660660 - DNA, 13 bp, Homo sapiens
gatccgctgccac

SEQ ID NO: 1660661 - DNA, 15 bp, Homo sapiens
gatcctcctgcagac

SEQ ID NO: 1660662 - DNA, 22 bp, Homo sapiens
gatcctctatttcctgaacctg

SEQ ID NO: 1660663 - DNA, 16 bp, Homo sapiens
gatcctgcaccccagc

SEQ ID NO: 1660664 - DNA, 12 bp, Homo sapiens
gatcctgcagga

SEQ ID NO: 1660665 - DNA, 20 bp, Homo sapiens
gatcctgcaggaacgagcac

SEQ ID NO: 1660666 - DNA, 14 bp, Homo sapiens
gatcctgctccagc

SEQ ID NO: 1660667 - DNA, 10 bp, Homo sapiens
gatcctgctg

SEQ ID NO: 1660668 - DNA, 11 bp, Homo sapiens
gatcctgctga

SEQ ID NO: 1660669 - DNA, 19 bp, Homo sapiens
gatcctgctgacctcactg

SEQ ID NO: 1660670 - DNA, 12 bp, Homo sapiens
gatcctgctggg

SEQ ID NO: 1660671 - DNA, 22 bp, Homo sapiens
gatcctgctggggccgccacgg

SEQ ID NO: 1660672 - DNA, 17 bp, Homo sapiens
gatcctggaggcccagt

SEQ ID NO: 1660673 - DNA, 17 bp, Homo sapiens
gatcctgggctgggtgg

SEQ ID NO: 1660674 - DNA, 22 bp, Homo sapiens
gatcctgggtcaaaaaaaagaa

SEQ ID NO: 1660675 - DNA, 12 bp, Homo sapiens
gatcctgtctct

SEQ ID NO: 1660676 - DNA, 16 bp, Homo sapiens
gatcctgtctttaagg

SEQ ID NO: 1660677 - DNA, 19 bp, Homo sapiens
gatcctgtctttaaggaaa

SEQ ID NO: 1660678 - DNA, 19 bp, Homo sapiens
gatcctgtgtggagaggga

SEQ ID NO: 1660679 - DNA, 20 bp, Homo sapiens
gatcctgtgtggagagggaa

SEQ ID NO: 1660680 - DNA, 12 bp, Homo sapiens
gatcctgttctg

SEQ ID NO: 1660681 - DNA, 22 bp, Homo sapiens
gatccttagaggtcctctggag

SEQ ID NO: 1660682 - DNA, 21 bp, Homo sapiens
gatccttcacaggcagtgcat

SEQ ID NO: 1660683 - DNA, 17 bp, Homo sapiens
gatccttccacctcagt

SEQ ID NO: 1660684 - DNA, 21 bp, Homo sapiens
gatccttgtgttcagctcttt

SEQ ID NO: 1660685 - DNA, 17 bp, Homo sapiens
gatcgagaccatcctgg

SEQ ID NO: 1660686 - DNA, 18 bp, Homo sapiens
gatcgagtgtagctgtga

SEQ ID NO: 1660687 - DNA, 18 bp, Homo sapiens
gatcgcaccactgcactc

SEQ ID NO: 1660688 - DNA, 22 bp, Homo sapiens
gatcgcaccactgcactccagc

SEQ ID NO: 1660689 - DNA, 15 bp, Homo sapiens
gatcgcccaggctgg

SEQ ID NO: 1660690 - DNA, 14 bp, Homo sapiens
gatcgcttgagccc

SEQ ID NO: 1660691 - DNA, 18 bp, Homo sapiens
gatcgcttgagcccagga

SEQ ID NO: 1660692 - DNA, 14 bp, Homo sapiens
gatcggggcaagag

SEQ ID NO: 1660693 - DNA, 20 bp, Homo sapiens
gatcggtttcatattttaaa

SEQ ID NO: 1660694 - DNA, 23 bp, Homo sapiens
gatcggtttcatattttaaatct

SEQ ID NO: 1660695 - DNA, 22 bp, Homo sapiens
gatcgtgctactgcactccagc

SEQ ID NO: 1660696 - DNA, 21 bp, Homo sapiens
gatctaaaaataactgtaatt

SEQ ID NO: 1660697 - DNA, 16 bp, Homo sapiens
gatctaaaccagtcct

SEQ ID NO: 1660698 - DNA, 12 bp, Homo sapiens
gatctaacaaaa

SEQ ID NO: 1660699 - DNA, 18 bp, Homo sapiens
gatctaagcctttccata

SEQ ID NO: 1660700 - DNA, 13 bp, Homo sapiens
gatctaataaact

SEQ ID NO: 1660701 - DNA, 15 bp, Homo sapiens
gatctaataaacttt

SEQ ID NO: 1660702 - DNA, 16 bp, Homo sapiens
gatctaataaacttta

SEQ ID NO: 1660703 - DNA, 18 bp, Homo sapiens
gatctaataaactttatt

SEQ ID NO: 1660704 - DNA, 15 bp, Homo sapiens
gatctacacatgttg

SEQ ID NO: 1660705 - DNA, 23 bp, Homo sapiens
gatctacatgaggaactgtagat

SEQ ID NO: 1660706 - DNA, 18 bp, Homo sapiens
gatctaccagcataaata

SEQ ID NO: 1660707 - DNA, 13 bp, Homo sapiens
gatctagaaggga

SEQ ID NO: 1660708 - DNA, 17 bp, Homo sapiens
gatctataggcagcttc

SEQ ID NO: 1660709 - DNA, 21 bp, Homo sapiens
gatctataggcagcttctaag

SEQ ID NO: 1660710 - DNA, 14 bp, Homo sapiens
gatctatcacctgt

SEQ ID NO: 1660711 - DNA, 15 bp, Homo sapiens
gatctatcacctgtc

SEQ ID NO: 1660712 - DNA, 15 bp, Homo sapiens
gatctatgcctttca

SEQ ID NO: 1660713 - DNA, 15 bp, Homo sapiens
gatctcaagccagcc

SEQ ID NO: 1660714 - DNA, 16 bp, Homo sapiens
gatctcaagccagccc

SEQ ID NO: 1660715 - DNA, 17 bp, Homo sapiens
gatctcaagccagcccc

SEQ ID NO: 1660716 - DNA, 19 bp, Homo sapiens
gatctcagctcactgcaac

SEQ ID NO: 1660717 - DNA, 14 bp, Homo sapiens
gatctcagggaagc

SEQ ID NO: 1660718 - DNA, 19 bp, Homo sapiens
gatctcagggcagacagcc

SEQ ID NO: 1660719 - DNA, 14 bp, Homo sapiens
gatctcaggggctg

SEQ ID NO: 1660720 - DNA, 22 bp, Homo sapiens
gatctcatggaaactggccagg

SEQ ID NO: 1660721 - DNA, 13 bp, Homo sapiens
gatctcatgtcct

SEQ ID NO: 1660722 - DNA, 15 bp, Homo sapiens
gatctcattcagtat

SEQ ID NO: 1660723 - DNA, 17 bp, Homo sapiens
gatctccatatgttaca

SEQ ID NO: 1660724 - DNA, 14 bp, Homo sapiens
gatctccctgccgc

SEQ ID NO: 1660725 - DNA, 15 bp, Homo sapiens
gatctccctgccgcc

SEQ ID NO: 1660726 - DNA, 20 bp, Homo sapiens
gatctccctgccgcctcaat

SEQ ID NO: 1660727 - DNA, 18 bp, Homo sapiens
gatctcctgacctcgtga

SEQ ID NO: 1660728 - DNA, 14 bp, Homo sapiens
gatctccttccctt

SEQ ID NO: 1660729 - DNA, 19 bp, Homo sapiens
gatctccttcccttctctt

SEQ ID NO: 1660730 - DNA, 22 bp, Homo sapiens
gatctccttcccttctcttggg

SEQ ID NO: 1660731 - DNA, 14 bp, Homo sapiens
gatctcggtttgcc

SEQ ID NO: 1660732 - DNA, 18 bp, Homo sapiens
gatctctcaggagcacag

SEQ ID NO: 1660733 - DNA, 20 bp, Homo sapiens
gatctctcaggagcacaggc

SEQ ID NO: 1660734 - DNA, 16 bp, Homo sapiens
gatctctcttgtcctc

SEQ ID NO: 1660735 - DNA, 21 bp, Homo sapiens
gatctctcttgtcctcttctg

SEQ ID NO: 1660736 - DNA, 13 bp, Homo sapiens
gatctgagctccc

SEQ ID NO: 1660737 - DNA, 21 bp, Homo sapiens
gatctgagctcccacctccct

SEQ ID NO: 1660738 - DNA, 22 bp, Homo sapiens
gatctgagtacatattgtggtg

SEQ ID NO: 1660739 - DNA, 15 bp, Homo sapiens
gatctgagtcccagg

SEQ ID NO: 1660740 - DNA, 20 bp, Homo sapiens
gatgggatcccaggccaggg

SEQ ID NO: 1660741 - DNA, 16 bp, Homo sapiens
gatgggatttttgttt

SEQ ID NO: 1660742 - DNA, 18 bp, Homo sapiens
gatgggatttttgtttga

SEQ ID NO: 1660743 - DNA, 16 bp, Homo sapiens
gatgggcaaagcttgt

SEQ ID NO: 1660744 - DNA, 22 bp, Homo sapiens
gatgggcaaagcttgtcaaaga

SEQ ID NO: 1660745 - DNA, 16 bp, Homo sapiens
gatgggcagcccaaca

SEQ ID NO: 1660746 - DNA, 21 bp, Homo sapiens
gatgggctgtttcgtgtagtg

SEQ ID NO: 1660747 - DNA, 19 bp, Homo sapiens
gatggggaatccgtgtgtg

SEQ ID NO: 1660748 - DNA, 11 bp, Homo sapiens
gatggggagaa

SEQ ID NO: 1660749 - DNA, 18 bp, Homo sapiens
gatggggatagaggaaag

SEQ ID NO: 1660750 - DNA, 18 bp, Homo sapiens
gatggggcaagacagaaa

SEQ ID NO: 1660751 - DNA, 20 bp, Homo sapiens
gatggggccatctccttcac

SEQ ID NO: 1660752 - DNA, 18 bp, Homo sapiens
gatggggcggcggtagca

SEQ ID NO: 1660753 - DNA, 19 bp, Homo sapiens
gatggggctcccgcccgtg

SEQ ID NO: 1660754 - DNA, 22 bp, Homo sapiens
gatgggggaactcagatccagg

SEQ ID NO: 1660755 - DNA, 16 bp, Homo sapiens
gatgggggcagggctg

SEQ ID NO: 1660756 - DNA, 17 bp, Homo sapiens
gatgggggcagggctgt

SEQ ID NO: 1660757 - DNA, 18 bp, Homo sapiens
gatgggggtttcaccata

SEQ ID NO: 1660758 - DNA, 21 bp, Homo sapiens
gatgggtctgatattaatcaa

SEQ ID NO: 1660759 - DNA, 18 bp, Homo sapiens
gatgggtttgacaaggtt

SEQ ID NO: 1660760 - DNA, 18 bp, Homo sapiens
gatggtaagagaaaagag

SEQ ID NO: 1660761 - DNA, 19 bp, Homo sapiens
gatggtccatttgttcctg

SEQ ID NO: 1660762 - DNA, 20 bp, Homo sapiens
gatggtccatttgttcctgc

SEQ ID NO: 1660763 - DNA, 18 bp, Homo sapiens
gatggtccgtgcccaggc

SEQ ID NO: 1660764 - DNA, 13 bp, Homo sapiens
gatggtctcgatc

SEQ ID NO: 1660765 - DNA, 24 bp, Homo sapiens
gatggtctgagttcttgtgtcctg

SEQ ID NO: 1660766 - DNA, 17 bp, Homo sapiens
gatggtgacattgaaac

SEQ ID NO: 1660767 - DNA, 21 bp, Homo sapiens
gatggtgcatgcctgtagtct

SEQ ID NO: 1660768 - DNA, 16 bp, Homo sapiens
gatggtgctgcccagg

SEQ ID NO: 1660769 - DNA, 21 bp, Homo sapiens
gatggtgctgcccaggcctct

SEQ ID NO: 1660770 - DNA, 18 bp, Homo sapiens
gatggtgtgggtgtcctg

SEQ ID NO: 1660771 - DNA, 18 bp, Homo sapiens
gatggttaaaaaggccaa

SEQ ID NO: 1660772 - DNA, 21 bp, Homo sapiens
gatggttcccctgttcactct

SEQ ID NO: 1660773 - DNA, 18 bp, Homo sapiens
gatggttcttcacctcct

SEQ ID NO: 1660774 - DNA, 17 bp, Homo sapiens
gatggttttaaactttc

SEQ ID NO: 1660775 - DNA, 16 bp, Homo sapiens
gatgtaaacagtgcct

SEQ ID NO: 1660776 - DNA, 11 bp, Homo sapiens
gatgtaaatcc

SEQ ID NO: 1660777 - DNA, 23 bp, Homo sapiens
gatgtaacaagggttttaatgta

SEQ ID NO: 1660778 - DNA, 12 bp, Homo sapiens
gatgtaaggact

SEQ ID NO: 1660779 - DNA, 20 bp, Homo sapiens
gatgtaatctctctgcagct

SEQ ID NO: 1660780 - DNA, 22 bp, Homo sapiens
gatgtaatctctctgcagctgc

SEQ ID NO: 1660781 - DNA, 16 bp, Homo sapiens
gatgtacaattaaaaa

SEQ ID NO: 1660782 - DNA, 18 bp, Homo sapiens
gatgtacagtctgtcatg

SEQ ID NO: 1660783 - DNA, 15 bp, Homo sapiens
gatgtacatttccaa

SEQ ID NO: 1660784 - DNA, 21 bp, Homo sapiens
gatgtaccaattgtcaaatta

SEQ ID NO: 1660785 - DNA, 14 bp, Homo sapiens
gatgtaccagtttg

SEQ ID NO: 1660786 - DNA, 20 bp, Homo sapiens
gatgtacttctctgtgtgca

SEQ ID NO: 1660787 - DNA, 19 bp, Homo sapiens
gatgtagagagaacaggtg

SEQ ID NO: 1660788 - DNA, 20 bp, Homo sapiens
gatgtaggggaagagatgtt

SEQ ID NO: 1660789 - DNA, 13 bp, Homo sapiens
gatgtagtatttt

SEQ ID NO: 1660790 - DNA, 15 bp, Homo sapiens
gatgtatatgtttat

SEQ ID NO: 1660791 - DNA, 20 bp, Homo sapiens
gatgtatgaaggcttttggt

SEQ ID NO: 1660792 - DNA, 14 bp, Homo sapiens
gatgtatgtgtgaa

SEQ ID NO: 1660793 - DNA, 20 bp, Homo sapiens
gatgtatgtgtgaaacaatg

SEQ ID NO: 1660794 - DNA, 16 bp, Homo sapiens
gatgtatttttgatgt

SEQ ID NO: 1660795 - DNA, 15 bp, Homo sapiens
gatgtcaatagcatt

SEQ ID NO: 1660796 - DNA, 14 bp, Homo sapiens
gatgtcatcttgag

SEQ ID NO: 1660797 - DNA, 17 bp, Homo sapiens
gatgtccagggggagaa

SEQ ID NO: 1660798 - DNA, 15 bp, Homo sapiens
gatgtcccctgcggg

SEQ ID NO: 1660799 - DNA, 16 bp, Homo sapiens
gatgtcccctgcgggc

SEQ ID NO: 1660800 - DNA, 20 bp, Homo sapiens
gatgtccctttcttggccag

SEQ ID NO: 1660801 - DNA, 14 bp, Homo sapiens
gatgtctgccaatt

SEQ ID NO: 1660802 - DNA, 16 bp, Homo sapiens
gatgtcttctgcctgt

SEQ ID NO: 1660803 - DNA, 18 bp, Homo sapiens
gatgtcttctgcctgtta

SEQ ID NO: 1660804 - DNA, 13 bp, Homo sapiens
gatgtcttggaac

SEQ ID NO: 1660805 - DNA, 21 bp, Homo sapiens
gatgtcttggaacattggaat

SEQ ID NO: 1660806 - DNA, 20 bp, Homo sapiens
gatgtgaattattgacactg

SEQ ID NO: 1660807 - DNA, 15 bp, Homo sapiens
gatgtgacccaccag

SEQ ID NO: 1660808 - DNA, 19 bp, Homo sapiens
gatgtgacccaccagtgcc

SEQ ID NO: 1660809 - DNA, 13 bp, Homo sapiens
gatgtgagccagc

SEQ ID NO: 1660810 - DNA, 20 bp, Homo sapiens
gatgtgcaataatttgtaca

SEQ ID NO: 1660811 - DNA, 19 bp, Homo sapiens
gatgtgcaggaagaaaagc

SEQ ID NO: 1660812 - DNA, 21 bp, Homo sapiens
gatgtgcatttttgtgaaatg

SEQ ID NO: 1660813 - DNA, 17 bp, Homo sapiens
gatgtgctttgctgcac

SEQ ID NO: 1660814 - DNA, 16 bp, Homo sapiens
gatgtgcttttctcca

SEQ ID NO: 1660815 - DNA, 13 bp, Homo sapiens
gatgtggaggaag

SEQ ID NO: 1660816 - DNA, 20 bp, Homo sapiens
gatgtggaggaagagccacc

SEQ ID NO: 1660817 - DNA, 23 bp, Homo sapiens
gatgtggagtgagaacagcattt

SEQ ID NO: 1660818 - DNA, 21 bp, Homo sapiens
gatgtggccctggcctgctgg

SEQ ID NO: 1660819 - DNA, 20 bp, Homo sapiens
gatgtggtaggtgataaaga

SEQ ID NO: 1660820 - DNA, 16 bp, Homo sapiens
gatgtgtaaacaggta

SEQ ID NO: 1660821 - DNA, 18 bp, Homo sapiens
gatgtgtcctcagggagc

SEQ ID NO: 1660822 - DNA, 20 bp, Homo sapiens
gatgtgttattacttcctca

SEQ ID NO: 1660823 - DNA, 22 bp, Homo sapiens
gatgtgttcattcaagctattt

SEQ ID NO: 1660824 - DNA, 23 bp, Homo sapiens
gatgtgttcattcaagctattta

SEQ ID NO: 1660825 - DNA, 17 bp, Homo sapiens
gatgtgttttgcacgtc

SEQ ID NO: 1660826 - DNA, 20 bp, Homo sapiens
gatgttaacaagaggggaaa

SEQ ID NO: 1660827 - DNA, 14 bp, Homo sapiens
gatgttaaccagaa

SEQ ID NO: 1660828 - DNA, 21 bp, Homo sapiens
gatgttagcagacccagctta

SEQ ID NO: 1660829 - DNA, 19 bp, Homo sapiens
gatgttatgaacagctgtg

SEQ ID NO: 1660830 - DNA, 23 bp, Homo sapiens
gatgttatgaacagctgtgtctg

SEQ ID NO: 1660831 - DNA, 14 bp, Homo sapiens
gatgttcaaatatt

SEQ ID NO: 1660832 - DNA, 18 bp, Homo sapiens
gatgttccacctgccaca

SEQ ID NO: 1660833 - DNA, 17 bp, Homo sapiens
gatgttccagtgaggaa

SEQ ID NO: 1660834 - DNA, 22 bp, Homo sapiens
gatgttccttaccaaggatttt

SEQ ID NO: 1660835 - DNA, 22 bp, Homo sapiens
gatgttctattttttgttttgt

SEQ ID NO: 1660836 - DNA, 23 bp, Homo sapiens
gatgttgaatgcccacaggcaaa

SEQ ID NO: 1660837 - DNA, 17 bp, Homo sapiens
gatgttgccatgtgttt

SEQ ID NO: 1660838 - DNA, 19 bp, Homo sapiens
gatgttgccatgtgtttta

SEQ ID NO: 1660839 - DNA, 16 bp, Homo sapiens
gatgttgcttttgaaa

SEQ ID NO: 1660840 - DNA, 19 bp, Homo sapiens
gatgtttattcttctagag

SEQ ID NO: 1660841 - DNA, 12 bp, Homo sapiens
gatgtttccaga

SEQ ID NO: 1660842 - DNA, 13 bp, Homo sapiens
gatgtttccagac

SEQ ID NO: 1660843 - DNA, 16 bp, Homo sapiens
gatgtttccagctgcc

SEQ ID NO: 1660844 - DNA, 15 bp, Homo sapiens
gatgtttcctggaag

SEQ ID NO: 1660845 - DNA, 20 bp, Homo sapiens
gatgtttcctggaagcagag

SEQ ID NO: 1660846 - DNA, 12 bp, Homo sapiens
gatgtttctgtg

SEQ ID NO: 1660847 - DNA, 15 bp, Homo sapiens
gatgtttctgtgaaa

SEQ ID NO: 1660848 - DNA, 13 bp, Homo sapiens
gatgtttgcccaa

SEQ ID NO: 1660849 - DNA, 14 bp, Homo sapiens
gatgtttgcccaaa

SEQ ID NO: 1660850 - DNA, 22 bp, Homo sapiens
gatgtttggaaaaaactctgaa

SEQ ID NO: 1660851 - DNA, 13 bp, Homo sapiens
gatgtttgtggcc

SEQ ID NO: 1660852 - DNA, 15 bp, Homo sapiens
gatgtttgtggcctc

SEQ ID NO: 1660853 - DNA, 17 bp, Homo sapiens
gatgtttgtggcctcag

SEQ ID NO: 1660854 - DNA, 21 bp, Homo sapiens
gcaacaagcccgttagcccca

SEQ ID NO: 1660855 - DNA, 14 bp, Homo sapiens
gcaacacagcctgg

SEQ ID NO: 1660856 - DNA, 23 bp, Homo sapiens
gcaacacagcctgggccccagct

SEQ ID NO: 1660857 - DNA, 19 bp, Homo sapiens
gcaacagacaagtgactgt

SEQ ID NO: 1660858 - DNA, 13 bp, Homo sapiens
gcaacagatctgg

SEQ ID NO: 1660859 - DNA, 18 bp, Homo sapiens
gcaacagatctggaacct

SEQ ID NO: 1660860 - DNA, 23 bp, Homo sapiens
gcaacagcctacaaagagatgct

SEQ ID NO: 1660861 - DNA, 18 bp, Homo sapiens
gcaacaggaatctcagag

SEQ ID NO: 1660862 - DNA, 20 bp, Homo sapiens
gcaacaggattgatcattct

SEQ ID NO: 1660863 - DNA, 21 bp, Homo sapiens
gcaacagggagcacctgtctg

SEQ ID NO: 1660864 - DNA, 21 bp, Homo sapiens
gcaacaggggaggaaaaaaga

SEQ ID NO: 1660865 - DNA, 23 bp, Homo sapiens
gcaacaggggaggaaaaaagaac

SEQ ID NO: 1660866 - DNA, 22 bp, Homo sapiens
gcaacagggtatggactatctg

SEQ ID NO: 1660867 - DNA, 13 bp, Homo sapiens
gcaacaggtttta

SEQ ID NO: 1660868 - DNA, 18 bp, Homo sapiens
gcaacatctagcaaatgt

SEQ ID NO: 1660869 - DNA, 16 bp, Homo sapiens
gcaacatctctgaatc

SEQ ID NO: 1660870 - DNA, 16 bp, Homo sapiens
gcaacattccacagct

SEQ ID NO: 1660871 - DNA, 16 bp, Homo sapiens
gcaaccagccagcgtc

SEQ ID NO: 1660872 - DNA, 20 bp, Homo sapiens
gcaaccaggaacagcaaatg

SEQ ID NO: 1660873 - DNA, 13 bp, Homo sapiens
gcaacccacagct

SEQ ID NO: 1660874 - DNA, 14 bp, Homo sapiens
gcaacccacgtgta

SEQ ID NO: 1660875 - DNA, 20 bp, Homo sapiens
gcaacccttcctgctgctgc

SEQ ID NO: 1660876 - DNA, 18 bp, Homo sapiens
gcaacctacccagcgtgg

SEQ ID NO: 1660877 - DNA, 13 bp, Homo sapiens
gcaacctctgcct

SEQ ID NO: 1660878 - DNA, 13 bp, Homo sapiens
gcaacgcccctcc

SEQ ID NO: 1660879 - DNA, 15 bp, Homo sapiens
gcaacgcccctccaa

SEQ ID NO: 1660880 - DNA, 16 bp, Homo sapiens
gcaacggccagggttg

SEQ ID NO: 1660881 - DNA, 15 bp, Homo sapiens
gcaacgtagcctggg

SEQ ID NO: 1660882 - DNA, 22 bp, Homo sapiens
gcaacgtttacaccgactagcc

SEQ ID NO: 1660883 - DNA, 18 bp, Homo sapiens
gcaactacagaagtggaa

SEQ ID NO: 1660884 - DNA, 19 bp, Homo sapiens
gcaactacagaagtggaag

SEQ ID NO: 1660885 - DNA, 14 bp, Homo sapiens
gcaactagccaagg

SEQ ID NO: 1660886 - DNA, 18 bp, Homo sapiens
gcaactcttttaagtgcc

SEQ ID NO: 1660887 - DNA, 19 bp, Homo sapiens
gcaactgaggcagacagca

SEQ ID NO: 1660888 - DNA, 18 bp, Homo sapiens
gcaactgctcagctctgg

SEQ ID NO: 1660889 - DNA, 16 bp, Homo sapiens
gcaactgctggtgatt

SEQ ID NO: 1660890 - DNA, 18 bp, Homo sapiens
gcaactgctggtgatttt

SEQ ID NO: 1660891 - DNA, 18 bp, Homo sapiens
gcaacttccgcctcctgt

SEQ ID NO: 1660892 - DNA, 18 bp, Homo sapiens
gcaacttcttctccatcc

SEQ ID NO: 1660893 - DNA, 21 bp, Homo sapiens
gcaacttgtctttttctggac

SEQ ID NO: 1660894 - DNA, 17 bp, Homo sapiens
gcaacttttcttggaac

SEQ ID NO: 1660895 - DNA, 17 bp, Homo sapiens
gcaagaaatggcgtctg

SEQ ID NO: 1660896 - DNA, 21 bp, Homo sapiens
gcaagaagattctaaaacatt

SEQ ID NO: 1660897 - DNA, 17 bp, Homo sapiens
gcaagaataaaaaagaa

SEQ ID NO: 1660898 - DNA, 15 bp, Homo sapiens
gcaagaatttgatcg

SEQ ID NO: 1660899 - DNA, 13 bp, Homo sapiens
gcaagacagaaaa

SEQ ID NO: 1660900 - DNA, 23 bp, Homo sapiens
gcaagaccacggagggagcgaca

SEQ ID NO: 1660901 - DNA, 17 bp, Homo sapiens
gcaagaccctcccatgg

SEQ ID NO: 1660902 - DNA, 16 bp, Homo sapiens
gcaagaccctgtctct

SEQ ID NO: 1660903 - DNA, 17 bp, Homo sapiens
gcaagacctagtcccct

SEQ ID NO: 1660904 - DNA, 12 bp, Homo sapiens
gcaagacctcat

SEQ ID NO: 1660905 - DNA, 18 bp, Homo sapiens
gcaagacctcatctgtgg

SEQ ID NO: 1660906 - DNA, 16 bp, Homo sapiens
gcaagactcgaataaa

SEQ ID NO: 1660907 - DNA, 18 bp, Homo sapiens
gcaagagaatctgatcaa

SEQ ID NO: 1660908 - DNA, 14 bp, Homo sapiens
gcaagagagatgtt

SEQ ID NO: 1660909 - DNA, 13 bp, Homo sapiens
gcaagagccttgg

SEQ ID NO: 1660910 - DNA, 13 bp, Homo sapiens
gcaagatatttat

SEQ ID NO: 1660911 - DNA, 15 bp, Homo sapiens
gcaagatatttatat

SEQ ID NO: 1660912 - DNA, 17 bp, Homo sapiens
gcaagatcttgtctcca

SEQ ID NO: 1660913 - DNA, 13 bp, Homo sapiens
gcaagatgaattt

SEQ ID NO: 1660914 - DNA, 17 bp, Homo sapiens
gcaagatgaattttatc

SEQ ID NO: 1660915 - DNA, 13 bp, Homo sapiens
gcaagatgtgaat

SEQ ID NO: 1660916 - DNA, 14 bp, Homo sapiens
gcaagatgtgaatt

SEQ ID NO: 1660917 - DNA, 17 bp, Homo sapiens
gcaagatgtgaattatt

SEQ ID NO: 1660918 - DNA, 12 bp, Homo sapiens
gcaagatgtggg

SEQ ID NO: 1660919 - DNA, 13 bp, Homo sapiens
gcaagattgctta

SEQ ID NO: 1660920 - DNA, 13 bp, Homo sapiens
gcaagcagaggac

SEQ ID NO: 1660921 - DNA, 19 bp, Homo sapiens
gcaagcagctggtcagtct

SEQ ID NO: 1660922 - DNA, 14 bp, Homo sapiens
gcaagcagggaaag

SEQ ID NO: 1660923 - DNA, 22 bp, Homo sapiens
gcaagcagggaaagctccacgg

SEQ ID NO: 1660924 - DNA, 11 bp, Homo sapiens
gcaagcatgct

SEQ ID NO: 1660925 - DNA, 20 bp, Homo sapiens
gcaagcatttatgtttattt

SEQ ID NO: 1660926 - DNA, 19 bp, Homo sapiens
gcaagccccagggcctggg

SEQ ID NO: 1660927 - DNA, 20 bp, Homo sapiens
gcaagccccagggcctgggg

SEQ ID NO: 1660928 - DNA, 14 bp, Homo sapiens
gcaagcccctcagc

SEQ ID NO: 1660929 - DNA, 15 bp, Homo sapiens
gcaagcccctcagcc

SEQ ID NO: 1660930 - DNA, 16 bp, Homo sapiens
gcaagcccctcagccc

SEQ ID NO: 1660931 - DNA, 20 bp, Homo sapiens
gcaagccctacagagctgtg

SEQ ID NO: 1660932 - DNA, 21 bp, Homo sapiens
gcaagccctacagagctgtgg

SEQ ID NO: 1660933 - DNA, 19 bp, Homo sapiens
gcaagcctaagggatcctg

SEQ ID NO: 1660934 - DNA, 22 bp, Homo sapiens
gcaagccttctaaatgagtcac

SEQ ID NO: 1660935 - DNA, 13 bp, Homo sapiens
gcaagcgggagcc

SEQ ID NO: 1660936 - DNA, 21 bp, Homo sapiens
gcaagctctcagcaagtgccc

SEQ ID NO: 1660937 - DNA, 16 bp, Homo sapiens
gcaagcttcttgctga

SEQ ID NO: 1660938 - DNA, 13 bp, Homo sapiens
gcaaggaaggaaa

SEQ ID NO: 1660939 - DNA, 14 bp, Homo sapiens
gcaaggaaggaaag

SEQ ID NO: 1660940 - DNA, 20 bp, Homo sapiens
gcaaggaccaggactccctc

SEQ ID NO: 1660941 - DNA, 21 bp, Homo sapiens
gcaaggaccaggactccctcc

SEQ ID NO: 1660942 - DNA, 21 bp, Homo sapiens
gcaaggagtttattacaatgt

SEQ ID NO: 1660943 - DNA, 13 bp, Homo sapiens
gcaaggcaggtgc

SEQ ID NO: 1660944 - DNA, 20 bp, Homo sapiens
gcaaggcctggtgtttcttg

SEQ ID NO: 1660945 - DNA, 14 bp, Homo sapiens
gcaaggcctgtgct

SEQ ID NO: 1660946 - DNA, 17 bp, Homo sapiens
gcaaggcctgtgctgca

SEQ ID NO: 1660947 - DNA, 23 bp, Homo sapiens
gcaaggccttggtggagcagcca

SEQ ID NO: 1660948 - DNA, 15 bp, Homo sapiens
gcaagggcatcaggc

SEQ ID NO: 1660949 - DNA, 19 bp, Homo sapiens
gcaagggcatcaggcactg

SEQ ID NO: 1660950 - DNA, 20 bp, Homo sapiens
gcaagggcatcaggcactgg

SEQ ID NO: 1660951 - DNA, 12 bp, Homo sapiens
gcaagggcccag

SEQ ID NO: 1660952 - DNA, 16 bp, Homo sapiens
gcaagggcccagagtg

SEQ ID NO: 1660953 - DNA, 15 bp, Homo sapiens
gcaagggctccagca

SEQ ID NO: 1660954 - DNA, 16 bp, Homo sapiens
gcaaggggctcagaac

SEQ ID NO: 1660955 - DNA, 14 bp, Homo sapiens
gcaaggggctctgc

SEQ ID NO: 1660956 - DNA, 14 bp, Homo sapiens
gcaagggtgatggg

SEQ ID NO: 1660957 - DNA, 17 bp, Homo sapiens
gcaaggtggcctctgcc

SEQ ID NO: 1660958 - DNA, 18 bp, Homo sapiens
gcaaggtggcctctgcct

SEQ ID NO: 1660959 - DNA, 21 bp, Homo sapiens
gcaaggtggcctctgcctggg

SEQ ID NO: 1660960 - DNA, 22 bp, Homo sapiens
gcaaggtggcctctgcctgggg

SEQ ID NO: 1660961 - DNA, 14 bp, Homo sapiens
gcaaggtgtccctg

SEQ ID NO: 1660962 - DNA, 19 bp, Homo sapiens
gcaaggttaagcaaggtgg

SEQ ID NO: 1660963 - DNA, 22 bp, Homo sapiens
gcaaggtttacactgcggaagc

SEQ ID NO: 1660964 - DNA, 18 bp, Homo sapiens
gcaagtagctttccacat

SEQ ID NO: 1660965 - DNA, 22 bp, Homo sapiens
gcaagtcccttcagactggccc

SEQ ID NO: 1660966 - DNA, 23 bp, Homo sapiens
gcaagtgcccagtggagcctgcc

SEQ ID NO: 1660967 - DNA, 22 bp, Homo sapiens
gcaagtttctagctagaaatat

SEQ ID NO: 1660968 - DNA, 23 bp, Homo sapiens
gcaagtttctgtttcaaagcaca

SEQ ID NO: 1660969 - DNA, 21 bp, Homo sapiens
gcactccatgcttagtcactg

SEQ ID NO: 1660970 - DNA, 23 bp, Homo sapiens
gcactccatgcttagtcactgcc

SEQ ID NO: 1660971 - DNA, 18 bp, Homo sapiens
gcactccatggccacccc

SEQ ID NO: 1660972 - DNA, 14 bp, Homo sapiens
gcactccctcctgg

SEQ ID NO: 1660973 - DNA, 13 bp, Homo sapiens
gcactccctggcc

SEQ ID NO: 1660974 - DNA, 13 bp, Homo sapiens
gcactcccttgag

SEQ ID NO: 1660975 - DNA, 15 bp, Homo sapiens
gcactcccttgagga

SEQ ID NO: 1660976 - DNA, 22 bp, Homo sapiens
gcactccgcgccgatgccaccg

SEQ ID NO: 1660977 - DNA, 16 bp, Homo sapiens
gcactccggcctgggt

SEQ ID NO: 1660978 - DNA, 20 bp, Homo sapiens
gcactcctcggtactcccat

SEQ ID NO: 1660979 - DNA, 17 bp, Homo sapiens
gcactcgagaccatcct

SEQ ID NO: 1660980 - DNA, 20 bp, Homo sapiens
gcactcgagaccatcctggc

SEQ ID NO: 1660981 - DNA, 15 bp, Homo sapiens
gcactctccccgctc

SEQ ID NO: 1660982 - DNA, 17 bp, Homo sapiens
gcactctccccgctcag

SEQ ID NO: 1660983 - DNA, 20 bp, Homo sapiens
gcactctccccgctcagggg

SEQ ID NO: 1660984 - DNA, 22 bp, Homo sapiens
gcactctctaaatcttccttgt

SEQ ID NO: 1660985 - DNA, 19 bp, Homo sapiens
gcactgaaaacttagccag

SEQ ID NO: 1660986 - DNA, 20 bp, Homo sapiens
gcactgaagccggacagctg

SEQ ID NO: 1660987 - DNA, 17 bp, Homo sapiens
gcactgaagtgcttagt

SEQ ID NO: 1660988 - DNA, 15 bp, Homo sapiens
gcactgacccttcca

SEQ ID NO: 1660989 - DNA, 13 bp, Homo sapiens
gcactgagagggc

SEQ ID NO: 1660990 - DNA, 15 bp, Homo sapiens
gcactgagagggcaa

SEQ ID NO: 1660991 - DNA, 13 bp, Homo sapiens
gcactgagccccc

SEQ ID NO: 1660992 - DNA, 18 bp, Homo sapiens
gcactgaggaagaacggg

SEQ ID NO: 1660993 - DNA, 14 bp, Homo sapiens
gcactgagggccac

SEQ ID NO: 1660994 - DNA, 18 bp, Homo sapiens
gcactgatgctgcccctc

SEQ ID NO: 1660995 - DNA, 22 bp, Homo sapiens
gcactgatgctgcccctcatct

SEQ ID NO: 1660996 - DNA, 18 bp, Homo sapiens
gcactgatgttgtgtttt

SEQ ID NO: 1660997 - DNA, 12 bp, Homo sapiens
gcactgatttca

SEQ ID NO: 1660998 - DNA, 15 bp, Homo sapiens
gcactgatttcacaa

SEQ ID NO: 1660999 - DNA, 14 bp, Homo sapiens
gcactgcagtgatg

SEQ ID NO: 1661000 - DNA, 21 bp, Homo sapiens
gcactgcctgcatgagctggc

SEQ ID NO: 1661001 - DNA, 22 bp, Homo sapiens
gcactgcctgcatgagctggca

SEQ ID NO: 1661002 - DNA, 21 bp, Homo sapiens
gcactgctcacgtctctgccg

SEQ ID NO: 1661003 - DNA, 14 bp, Homo sapiens
gcactggccagaga

SEQ ID NO: 1661004 - DNA, 18 bp, Homo sapiens
gcactggccagagagggc

SEQ ID NO: 1661005 - DNA, 19 bp, Homo sapiens
gcactggccagagagggcc

SEQ ID NO: 1661006 - DNA, 21 bp, Homo sapiens
gcactggccagagagggccca

SEQ ID NO: 1661007 - DNA, 22 bp, Homo sapiens
gcactggccagagagggcccag

SEQ ID NO: 1661008 - DNA, 23 bp, Homo sapiens
gcactggccagagagggcccagc

SEQ ID NO: 1661009 - DNA, 12 bp, Homo sapiens
gcactgggccac

SEQ ID NO: 1661010 - DNA, 14 bp, Homo sapiens
gcactgggccacgg

SEQ ID NO: 1661011 - DNA, 12 bp, Homo sapiens
gcactgggctgt

SEQ ID NO: 1661012 - DNA, 24 bp, Homo sapiens
gcactggtggcccgacagcctggc

SEQ ID NO: 1661013 - DNA, 13 bp, Homo sapiens
gcactgtaaaatg

SEQ ID NO: 1661014 - DNA, 17 bp, Homo sapiens
gcactgtagttctaaga

SEQ ID NO: 1661015 - DNA, 19 bp, Homo sapiens
gcactgtagttctaagact

SEQ ID NO: 1661016 - DNA, 15 bp, Homo sapiens
gcactgtatgctgga

SEQ ID NO: 1661017 - DNA, 23 bp, Homo sapiens
gcactgtcccagtagccaaggcc

SEQ ID NO: 1661018 - DNA, 20 bp, Homo sapiens
gcactgtctcagtttcactt

SEQ ID NO: 1661019 - DNA, 14 bp, Homo sapiens
gcactgtgaaggac

SEQ ID NO: 1661020 - DNA, 18 bp, Homo sapiens
gcactgtgaaggaccctt

SEQ ID NO: 1661021 - DNA, 18 bp, Homo sapiens
gcactgtgaatcctggca

SEQ ID NO: 1661022 - DNA, 20 bp, Homo sapiens
gcactgtgaatcctggcaag

SEQ ID NO: 1661023 - DNA, 13 bp, Homo sapiens
gcactgtggtttc

SEQ ID NO: 1661024 - DNA, 19 bp, Homo sapiens
gcactgtggtttcagatgt

SEQ ID NO: 1661025 - DNA, 22 bp, Homo sapiens
gcactgttaatacacagtactt

SEQ ID NO: 1661026 - DNA, 21 bp, Homo sapiens
gcactgttacaagaggccatt

SEQ ID NO: 1661027 - DNA, 12 bp, Homo sapiens
gcacttaaaaat

SEQ ID NO: 1661028 - DNA, 17 bp, Homo sapiens
gcacttaagtgcacttt

SEQ ID NO: 1661029 - DNA, 18 bp, Homo sapiens
gcacttaagtgcactttt

SEQ ID NO: 1661030 - DNA, 20 bp, Homo sapiens
gcacttacacttataaaata

SEQ ID NO: 1661031 - DNA, 21 bp, Homo sapiens
gcacttacacttataaaataa

SEQ ID NO: 1661032 - DNA, 21 bp, Homo sapiens
gcacttagcccaagaggtctg

SEQ ID NO: 1661033 - DNA, 19 bp, Homo sapiens
gcacttattgaccattttt

SEQ ID NO: 1661034 - DNA, 23 bp, Homo sapiens
gcacttcattgagagttttgtct

SEQ ID NO: 1661035 - DNA, 22 bp, Homo sapiens
gcacttcccaggatctgctcca

SEQ ID NO: 1661036 - DNA, 15 bp, Homo sapiens
gcacttgcgtcctgc

SEQ ID NO: 1661037 - DNA, 17 bp, Homo sapiens
gcacttgcgtcctgcag

SEQ ID NO: 1661038 - DNA, 20 bp, Homo sapiens
gcacttgcgtcctgcagagg

SEQ ID NO: 1661039 - DNA, 14 bp, Homo sapiens
gcacttgtgatcct

SEQ ID NO: 1661040 - DNA, 19 bp, Homo sapiens
gcacttgtgatcctaaaat

SEQ ID NO: 1661041 - DNA, 18 bp, Homo sapiens
gcactttaaatgaagcta

SEQ ID NO: 1661042 - DNA, 16 bp, Homo sapiens
gcactttaagctcctt

SEQ ID NO: 1661043 - DNA, 13 bp, Homo sapiens
gcactttccccct

SEQ ID NO: 1661044 - DNA, 17 bp, Homo sapiens
gcactttcccccttccc

SEQ ID NO: 1661045 - DNA, 21 bp, Homo sapiens
gcactttcccccttcccgcct

SEQ ID NO: 1661046 - DNA, 16 bp, Homo sapiens
gcactttctaatgttt

SEQ ID NO: 1661047 - DNA, 16 bp, Homo sapiens
gcactttgagaggctg

SEQ ID NO: 1661048 - DNA, 20 bp, Homo sapiens
gcactttgggaggctgaggc

SEQ ID NO: 1661049 - DNA, 21 bp, Homo sapiens
gcactttgggaggctgaggcg

SEQ ID NO: 1661050 - DNA, 14 bp, Homo sapiens
gcacttttaaaaaa

SEQ ID NO: 1661051 - DNA, 20 bp, Homo sapiens
gcactttttaattcaccaaa

SEQ ID NO: 1661052 - DNA, 22 bp, Homo sapiens
gcactttttcttaatcattttt

SEQ ID NO: 1661053 - DNA, 21 bp, Homo sapiens
gcacttttttatgaagaaaaa

SEQ ID NO: 1661054 - DNA, 17 bp, Homo sapiens
gcagaaaacccttgggc

SEQ ID NO: 1661055 - DNA, 21 bp, Homo sapiens
gcagaaaacccttgggccaga

SEQ ID NO: 1661056 - DNA, 22 bp, Homo sapiens
gcagaaaacggagagtgcttgg

SEQ ID NO: 1661057 - DNA, 16 bp, Homo sapiens
gcagaaaagaggagac

SEQ ID NO: 1661058 - DNA, 18 bp, Homo sapiens
gcagaaaataaaggaagc

SEQ ID NO: 1661059 - DNA, 17 bp, Homo sapiens
gcagaaaatatttaata

SEQ ID NO: 1661060 - DNA, 22 bp, Homo sapiens
gcagaaaatcttttactagtgt

SEQ ID NO: 1661061 - DNA, 14 bp, Homo sapiens
gcagaaaattgcac

SEQ ID NO: 1661062 - DNA, 19 bp, Homo sapiens
gcagaaagatacagacatt

SEQ ID NO: 1661063 - DNA, 16 bp, Homo sapiens
gcagaaatagacaaaa

SEQ ID NO: 1661064 - DNA, 19 bp, Homo sapiens
gcagaaatatagtgcaata

SEQ ID NO: 1661065 - DNA, 23 bp, Homo sapiens
gcagaaatcgagagtgtgctctc

SEQ ID NO: 1661066 - DNA, 12 bp, Homo sapiens
gcagaaattctg

SEQ ID NO: 1661067 - DNA, 14 bp, Homo sapiens
gcagaaattctgtt

SEQ ID NO: 1661068 - DNA, 21 bp, Homo sapiens
gcagaaattctgtttttaaaa

SEQ ID NO: 1661069 - DNA, 16 bp, Homo sapiens
gcagaacactgcagtc

SEQ ID NO: 1661070 - DNA, 19 bp, Homo sapiens
gcagaacccaccaaccaga

SEQ ID NO: 1661071 - DNA, 19 bp, Homo sapiens
gcagaactaaactcattta

SEQ ID NO: 1661072 - DNA, 23 bp, Homo sapiens
gcagaagaattgaacccaggagg

SEQ ID NO: 1661073 - DNA, 16 bp, Homo sapiens
gcagaagacaaaaaga

SEQ ID NO: 1661074 - DNA, 20 bp, Homo sapiens
gcagaagactagaggccagg

SEQ ID NO: 1661075 - DNA, 16 bp, Homo sapiens
gcagaagagaaaggac

SEQ ID NO: 1661076 - DNA, 16 bp, Homo sapiens
gcagaagagggtgtgt

SEQ ID NO: 1661077 - DNA, 21 bp, Homo sapiens
gcagaagcaagggggtgatgt

SEQ ID NO: 1661078 - DNA, 13 bp, Homo sapiens
gcagaagccaagg

SEQ ID NO: 1661079 - DNA, 15 bp, Homo sapiens
gcagaaggagagtga

SEQ ID NO: 1661080 - DNA, 18 bp, Homo sapiens
gcagaaggagagtgagtg

SEQ ID NO: 1661081 - DNA, 15 bp, Homo sapiens
gcagaagggggtggt

SEQ ID NO: 1661082 - DNA, 14 bp, Homo sapiens
gcagaagtctggct

SEQ ID NO: 1661083 - DNA, 13 bp, Homo sapiens
gcagctactggaa

SEQ ID NO: 1661084 - DNA, 21 bp, Homo sapiens
gcagctagactggagtgaggc

SEQ ID NO: 1661085 - DNA, 14 bp, Homo sapiens
gcagctagtgcctt

SEQ ID NO: 1661086 - DNA, 14 bp, Homo sapiens
gcagctagttttct

SEQ ID NO: 1661087 - DNA, 18 bp, Homo sapiens
gcagctcaacctaccctg

SEQ ID NO: 1661088 - DNA, 20 bp, Homo sapiens
gcagctcaacctaccctggt

SEQ ID NO: 1661089 - DNA, 23 bp, Homo sapiens
gcagctcaagcagcgaccgcccc

SEQ ID NO: 1661090 - DNA, 18 bp, Homo sapiens
gcagctcaagggctggca

SEQ ID NO: 1661091 - DNA, 16 bp, Homo sapiens
gcagctcacaccctac

SEQ ID NO: 1661092 - DNA, 13 bp, Homo sapiens
gcagctcctctcc

SEQ ID NO: 1661093 - DNA, 14 bp, Homo sapiens
gcagctcctctcct

SEQ ID NO: 1661094 - DNA, 18 bp, Homo sapiens
gcagctgaaattgaaaag

SEQ ID NO: 1661095 - DNA, 17 bp, Homo sapiens
gcagctgagagccctgc

SEQ ID NO: 1661096 - DNA, 11 bp, Homo sapiens
gcagctgagca

SEQ ID NO: 1661097 - DNA, 19 bp, Homo sapiens
gcagctgatgcctccttgg

SEQ ID NO: 1661098 - DNA, 21 bp, Homo sapiens
gcagctgatgttggaagagaa

SEQ ID NO: 1661099 - DNA, 20 bp, Homo sapiens
gcagctgcccctggcacctg

SEQ ID NO: 1661100 - DNA, 11 bp, Homo sapiens
gcagctgcctc

SEQ ID NO: 1661101 - DNA, 14 bp, Homo sapiens
gcagctgcctctgc

SEQ ID NO: 1661102 - DNA, 17 bp, Homo sapiens
gcagctgcgggtctgaa

SEQ ID NO: 1661103 - DNA, 23 bp, Homo sapiens
gcagctgctatccccatctccct

SEQ ID NO: 1661104 - DNA, 18 bp, Homo sapiens
gcagctgctcttagtgcc

SEQ ID NO: 1661105 - DNA, 22 bp, Homo sapiens
gcagctgctgaagttctgagcc

SEQ ID NO: 1661106 - DNA, 16 bp, Homo sapiens
gcagctggactaccca

SEQ ID NO: 1661107 - DNA, 21 bp, Homo sapiens
gcagctggcccactgctggct

SEQ ID NO: 1661108 - DNA, 19 bp, Homo sapiens
gcagctgggacccctccca

SEQ ID NO: 1661109 - DNA, 22 bp, Homo sapiens
gcagctgggacccctcccaacc

SEQ ID NO: 1661110 - DNA, 14 bp, Homo sapiens
gcagctgggcccca

SEQ ID NO: 1661111 - DNA, 16 bp, Homo sapiens
gcagctgggccccatg

SEQ ID NO: 1661112 - DNA, 18 bp, Homo sapiens
gcagctggggagcagctg

SEQ ID NO: 1661113 - DNA, 20 bp, Homo sapiens
gcagctggggccggagcctt

SEQ ID NO: 1661114 - DNA, 19 bp, Homo sapiens
gcagctggggggctgtcct

SEQ ID NO: 1661115 - DNA, 21 bp, Homo sapiens
gcagctggtcagtctttgctc

SEQ ID NO: 1661116 - DNA, 15 bp, Homo sapiens
gcagctgtcccttgc

SEQ ID NO: 1661117 - DNA, 12 bp, Homo sapiens
gcagctgtgaga

SEQ ID NO: 1661118 - DNA, 16 bp, Homo sapiens
gcagctgtttctcatg

SEQ ID NO: 1661119 - DNA, 13 bp, Homo sapiens
gcagcttattgtt

SEQ ID NO: 1661120 - DNA, 21 bp, Homo sapiens
gcagcttccttctgggactgg

SEQ ID NO: 1661121 - DNA, 23 bp, Homo sapiens
gcagcttgagagggcaaacccaa

SEQ ID NO: 1661122 - DNA, 12 bp, Homo sapiens
gcagcttgcccc

SEQ ID NO: 1661123 - DNA, 16 bp, Homo sapiens
gcagcttttggtctcc

SEQ ID NO: 1661124 - DNA, 17 bp, Homo sapiens
gcaggaacaatgactac

SEQ ID NO: 1661125 - DNA, 19 bp, Homo sapiens
gcaggaacgagcactggcc

SEQ ID NO: 1661126 - DNA, 20 bp, Homo sapiens
gcaggaacgagcactggcca

SEQ ID NO: 1661127 - DNA, 16 bp, Homo sapiens
gcaggaactgggctgg

SEQ ID NO: 1661128 - DNA, 18 bp, Homo sapiens
gcaggaactgggctgggc

SEQ ID NO: 1661129 - DNA, 20 bp, Homo sapiens
gcaggaactgggctgggcct

SEQ ID NO: 1661130 - DNA, 16 bp, Homo sapiens
gcaggaagaggcccac

SEQ ID NO: 1661131 - DNA, 21 bp, Homo sapiens
gcaggaaggacaggaagctgg

SEQ ID NO: 1661132 - DNA, 23 bp, Homo sapiens
gcaggaaggacaggaagctggca

SEQ ID NO: 1661133 - DNA, 15 bp, Homo sapiens
gcaggaaggagagcc

SEQ ID NO: 1661134 - DNA, 23 bp, Homo sapiens
gcaggaaggagagcctgctgcat

SEQ ID NO: 1661135 - DNA, 18 bp, Homo sapiens
gcaggaattggtggcaga

SEQ ID NO: 1661136 - DNA, 17 bp, Homo sapiens
gcaggacacatcccggc

SEQ ID NO: 1661137 - DNA, 22 bp, Homo sapiens
gcaggacacatcccggcctctt

SEQ ID NO: 1661138 - DNA, 20 bp, Homo sapiens
gcaggacctactaggagagg

SEQ ID NO: 1661139 - DNA, 20 bp, Homo sapiens
gcaggaccttcgggctgtgc

SEQ ID NO: 1661140 - DNA, 21 bp, Homo sapiens
gcaggaccttcgggctgtgcc

SEQ ID NO: 1661141 - DNA, 17 bp, Homo sapiens
gcaggaccttgggcaca

SEQ ID NO: 1661142 - DNA, 19 bp, Homo sapiens
gcaggacttgctaaagcac

SEQ ID NO: 1661143 - DNA, 20 bp, Homo sapiens
gcaggagagtgtgtgggcag

SEQ ID NO: 1661144 - DNA, 16 bp, Homo sapiens
gcaggagcagctgtgc

SEQ ID NO: 1661145 - DNA, 20 bp, Homo sapiens
gcaggagcagctgtgctgca

SEQ ID NO: 1661146 - DNA, 22 bp, Homo sapiens
gcaggagcagctgtgctgcacc

SEQ ID NO: 1661147 - DNA, 14 bp, Homo sapiens
gcaggagccccgcc

SEQ ID NO: 1661148 - DNA, 16 bp, Homo sapiens
gcaggagccccgccac

SEQ ID NO: 1661149 - DNA, 17 bp, Homo sapiens
gcaggagcctacttcta

SEQ ID NO: 1661150 - DNA, 16 bp, Homo sapiens
gcaggagctcctggaa

SEQ ID NO: 1661151 - DNA, 16 bp, Homo sapiens
gcaggaggccccaggc

SEQ ID NO: 1661152 - DNA, 18 bp, Homo sapiens
gcaggaggccccaggctg

SEQ ID NO: 1661153 - DNA, 18 bp, Homo sapiens
gcaggaggcccctggccc

SEQ ID NO: 1661154 - DNA, 19 bp, Homo sapiens
gcaggaggcccctggccca

SEQ ID NO: 1661155 - DNA, 22 bp, Homo sapiens
gcaggaggcccttgtcgtggga

SEQ ID NO: 1661156 - DNA, 11 bp, Homo sapiens
gcaggagggag

SEQ ID NO: 1661157 - DNA, 15 bp, Homo sapiens
gcaggaggtggagaa

SEQ ID NO: 1661158 - DNA, 20 bp, Homo sapiens
gcaggaggttctgggcctct

SEQ ID NO: 1661159 - DNA, 21 bp, Homo sapiens
gcaggaggttctgggcctctg

SEQ ID NO: 1661160 - DNA, 12 bp, Homo sapiens
gcaggagtgcca

SEQ ID NO: 1661161 - DNA, 17 bp, Homo sapiens
gcaggagtgccaggacc

SEQ ID NO: 1661162 - DNA, 23 bp, Homo sapiens
gcaggagtgccaggaccagcctg

SEQ ID NO: 1661163 - DNA, 20 bp, Homo sapiens
gcaggagtgtcctggctgtg

SEQ ID NO: 1661164 - DNA, 15 bp, Homo sapiens
gcaggatcagatgac

SEQ ID NO: 1661165 - DNA, 17 bp, Homo sapiens
gcaggatccgctgccac

SEQ ID NO: 1661166 - DNA, 18 bp, Homo sapiens
gcaggatctcaagccagc

SEQ ID NO: 1661167 - DNA, 19 bp, Homo sapiens
gcaggatctcaagccagcc

SEQ ID NO: 1661168 - DNA, 20 bp, Homo sapiens
gcaggatgaattttctgcag

SEQ ID NO: 1661169 - DNA, 21 bp, Homo sapiens
gcaggatgaattttctgcagc

SEQ ID NO: 1661170 - DNA, 15 bp, Homo sapiens
gcaggattcccttct

SEQ ID NO: 1661171 - DNA, 17 bp, Homo sapiens
gcaggattcccttctgg

SEQ ID NO: 1661172 - DNA, 18 bp, Homo sapiens
gcaggattcccttctggg

SEQ ID NO: 1661173 - DNA, 17 bp, Homo sapiens
gcaggattctgcagctg

SEQ ID NO: 1661174 - DNA, 18 bp, Homo sapiens
gcaggcacgggtggtccc

SEQ ID NO: 1661175 - DNA, 23 bp, Homo sapiens
gcaggcagataagttggagcagg

SEQ ID NO: 1661176 - DNA, 18 bp, Homo sapiens
gcaggcaggaacaaacag

SEQ ID NO: 1661177 - DNA, 16 bp, Homo sapiens
gcaggcagggctgggc

SEQ ID NO: 1661178 - DNA, 17 bp, Homo sapiens
gcaggcagggctgggcc

SEQ ID NO: 1661179 - DNA, 18 bp, Homo sapiens
gcaggcagggctgggcca

SEQ ID NO: 1661180 - DNA, 16 bp, Homo sapiens
gcaggcagttctagaa

SEQ ID NO: 1661181 - DNA, 17 bp, Homo sapiens
gcaggcatagaggcttc

SEQ ID NO: 1661182 - DNA, 23 bp, Homo sapiens
gcaggccaaggccttctcctccc

SEQ ID NO: 1661183 - DNA, 20 bp, Homo sapiens
gcaggccaagtcaggccctt

SEQ ID NO: 1661184 - DNA, 14 bp, Homo sapiens
gcaggccaggctgc

SEQ ID NO: 1661185 - DNA, 22 bp, Homo sapiens
gcaggcccactccccagcccca

SEQ ID NO: 1661186 - DNA, 14 bp, Homo sapiens
gcaggcccagagga

SEQ ID NO: 1661187 - DNA, 11 bp, Homo sapiens
gcaggcccagc

SEQ ID NO: 1661188 - DNA, 18 bp, Homo sapiens
gcaggcccagcatgcagg

SEQ ID NO: 1661189 - DNA, 17 bp, Homo sapiens
gcaggccgaggcaggtg

SEQ ID NO: 1661190 - DNA, 22 bp, Homo sapiens
gcaggcctgagaatgagtggga

SEQ ID NO: 1661191 - DNA, 22 bp, Homo sapiens
gcaggcctgggacccagctact

SEQ ID NO: 1661192 - DNA, 22 bp, Homo sapiens
gcaggcgatggggcaagacaga

SEQ ID NO: 1661193 - DNA, 15 bp, Homo sapiens
gcaggctactgtcag

SEQ ID NO: 1661194 - DNA, 22 bp, Homo sapiens
gcaggctcactgccaggccagc

SEQ ID NO: 1661195 - DNA, 15 bp, Homo sapiens
gcaggctccatgcac

SEQ ID NO: 1661196 - DNA, 17 bp, Homo sapiens
gcaggctccatgcacct

SEQ ID NO: 1661197 - DNA, 22 bp, Homo sapiens
gcatggacatttagaagaaaga

SEQ ID NO: 1661198 - DNA, 15 bp, Homo sapiens
gcatggagaataaac

SEQ ID NO: 1661199 - DNA, 13 bp, Homo sapiens
gcatggcaggctg

SEQ ID NO: 1661200 - DNA, 16 bp, Homo sapiens
gcatggcaggctgggt

SEQ ID NO: 1661201 - DNA, 18 bp, Homo sapiens
gcatggcatatttttcac

SEQ ID NO: 1661202 - DNA, 14 bp, Homo sapiens
gcatggccaggtgg

SEQ ID NO: 1661203 - DNA, 18 bp, Homo sapiens
gcatggctccagaaatgt

SEQ ID NO: 1661204 - DNA, 19 bp, Homo sapiens
gcatgggcagtttcagttt

SEQ ID NO: 1661205 - DNA, 22 bp, Homo sapiens
gcatgggcctggccacctctct

SEQ ID NO: 1661206 - DNA, 22 bp, Homo sapiens
gcatgggctcgccgtgtctcag

SEQ ID NO: 1661207 - DNA, 17 bp, Homo sapiens
gcatggggaggcagcag

SEQ ID NO: 1661208 - DNA, 14 bp, Homo sapiens
gcatggggcatgtc

SEQ ID NO: 1661209 - DNA, 20 bp, Homo sapiens
gcatggggcatgtcctttcc

SEQ ID NO: 1661210 - DNA, 21 bp, Homo sapiens
gcatggggcccctggcccaga

SEQ ID NO: 1661211 - DNA, 15 bp, Homo sapiens
gcatgggggctgcca

SEQ ID NO: 1661212 - DNA, 16 bp, Homo sapiens
gcatgggggctgccag

SEQ ID NO: 1661213 - DNA, 17 bp, Homo sapiens
gcatgggggctgccagc

SEQ ID NO: 1661214 - DNA, 21 bp, Homo sapiens
gcatgggtgaagggagagcca

SEQ ID NO: 1661215 - DNA, 19 bp, Homo sapiens
gcatggtgaggtgaaagta

SEQ ID NO: 1661216 - DNA, 16 bp, Homo sapiens
gcatggtgccccagga

SEQ ID NO: 1661217 - DNA, 18 bp, Homo sapiens
gcatggtgccccaggacc

SEQ ID NO: 1661218 - DNA, 20 bp, Homo sapiens
gcatggtgccccaggaccag

SEQ ID NO: 1661219 - DNA, 21 bp, Homo sapiens
gcatggtgccccaggaccagc

SEQ ID NO: 1661220 - DNA, 13 bp, Homo sapiens
gcatggtggcatg

SEQ ID NO: 1661221 - DNA, 13 bp, Homo sapiens
gcatggtggccag

SEQ ID NO: 1661222 - DNA, 15 bp, Homo sapiens
gcatggtggccagag

SEQ ID NO: 1661223 - DNA, 19 bp, Homo sapiens
gcatggtggcgcaagcctg

SEQ ID NO: 1661224 - DNA, 17 bp, Homo sapiens
gcatggtggctcatgcc

SEQ ID NO: 1661225 - DNA, 22 bp, Homo sapiens
gcatgtaaaagcctaggtctat

SEQ ID NO: 1661226 - DNA, 20 bp, Homo sapiens
gcatgtactctgttgagtaa

SEQ ID NO: 1661227 - DNA, 18 bp, Homo sapiens
gcatgtagaggcttgttt

SEQ ID NO: 1661228 - DNA, 15 bp, Homo sapiens
gcatgtaggagaatc

SEQ ID NO: 1661229 - DNA, 16 bp, Homo sapiens
gcatgtagtaacacta

SEQ ID NO: 1661230 - DNA, 17 bp, Homo sapiens
gcatgtagtaacactaa

SEQ ID NO: 1661231 - DNA, 23 bp, Homo sapiens
gcatgtagtaacactaatatatt

SEQ ID NO: 1661232 - DNA, 24 bp, Homo sapiens
gcatgtagtaacactaatatattt

SEQ ID NO: 1661233 - DNA, 15 bp, Homo sapiens
gcatgtatgaatgta

SEQ ID NO: 1661234 - DNA, 14 bp, Homo sapiens
gcatgtatgtcttg

SEQ ID NO: 1661235 - DNA, 16 bp, Homo sapiens
gcatgtattggcctgg

SEQ ID NO: 1661236 - DNA, 17 bp, Homo sapiens
gcatgtattggcctgga

SEQ ID NO: 1661237 - DNA, 14 bp, Homo sapiens
gcatgtcaaacatg

SEQ ID NO: 1661238 - DNA, 21 bp, Homo sapiens
gcatgtcaaacatgagatgtg

SEQ ID NO: 1661239 - DNA, 21 bp, Homo sapiens
gcatgtcagacagaacttgaa

SEQ ID NO: 1661240 - DNA, 23 bp, Homo sapiens
gcatgtccctaccgagtctcttc

SEQ ID NO: 1661241 - DNA, 17 bp, Homo sapiens
gcatgtgaagcatgctt

SEQ ID NO: 1661242 - DNA, 22 bp, Homo sapiens
gcatgtgaagcatgctttgctg

SEQ ID NO: 1661243 - DNA, 13 bp, Homo sapiens
gcatgtgatctcc

SEQ ID NO: 1661244 - DNA, 11 bp, Homo sapiens
gcatgtggaga

SEQ ID NO: 1661245 - DNA, 12 bp, Homo sapiens
gcatgtggcctg

SEQ ID NO: 1661246 - DNA, 16 bp, Homo sapiens
gcatgtggcctgtggc

SEQ ID NO: 1661247 - DNA, 16 bp, Homo sapiens
gcatgtggcctttatc

SEQ ID NO: 1661248 - DNA, 20 bp, Homo sapiens
gcatgtggcctttatctcaa

SEQ ID NO: 1661249 - DNA, 13 bp, Homo sapiens
gcatgtgtgcctg

SEQ ID NO: 1661250 - DNA, 15 bp, Homo sapiens
gcatgtgtgcctgtg

SEQ ID NO: 1661251 - DNA, 20 bp, Homo sapiens
gcatgtgtgcctgtggcaga

SEQ ID NO: 1661252 - DNA, 15 bp, Homo sapiens
gcatgtgtgtgtctg

SEQ ID NO: 1661253 - DNA, 13 bp, Homo sapiens
gcatgtgtgtgtg

SEQ ID NO: 1661254 - DNA, 14 bp, Homo sapiens
gcatgttcctcctt

SEQ ID NO: 1661255 - DNA, 15 bp, Homo sapiens
gcatgtttccagcag

SEQ ID NO: 1661256 - DNA, 13 bp, Homo sapiens
gcatgttttgcat

SEQ ID NO: 1661257 - DNA, 15 bp, Homo sapiens
gcatgttttgttgct

SEQ ID NO: 1661258 - DNA, 19 bp, Homo sapiens
gcattaaatataatatgca

SEQ ID NO: 1661259 - DNA, 13 bp, Homo sapiens
gcattaacacaaa

SEQ ID NO: 1661260 - DNA, 13 bp, Homo sapiens
gcattaatgtttc

SEQ ID NO: 1661261 - DNA, 14 bp, Homo sapiens
gcattaatgtttct

SEQ ID NO: 1661262 - DNA, 12 bp, Homo sapiens
gcattacattat

SEQ ID NO: 1661263 - DNA, 21 bp, Homo sapiens
gcattactgtccccttgatat

SEQ ID NO: 1661264 - DNA, 21 bp, Homo sapiens
gcattagaaatagacagtata

SEQ ID NO: 1661265 - DNA, 15 bp, Homo sapiens
gcattagaattattt

SEQ ID NO: 1661266 - DNA, 17 bp, Homo sapiens
gcattagaattatttaa

SEQ ID NO: 1661267 - DNA, 18 bp, Homo sapiens
gcattattaaattgtaaa

SEQ ID NO: 1661268 - DNA, 20 bp, Homo sapiens
gcattattgacgaactggct

SEQ ID NO: 1661269 - DNA, 22 bp, Homo sapiens
gcattcaaaatagttctatttc

SEQ ID NO: 1661270 - DNA, 24 bp, Homo sapiens
gcattcaaaatagttctatttcta

SEQ ID NO: 1661271 - DNA, 19 bp, Homo sapiens
gcattcacatttagaaaag

SEQ ID NO: 1661272 - DNA, 15 bp, Homo sapiens
gcattcacccagaca

SEQ ID NO: 1661273 - DNA, 19 bp, Homo sapiens
gcattcacccagacagctc

SEQ ID NO: 1661274 - DNA, 11 bp, Homo sapiens
gcattccagaa

SEQ ID NO: 1661275 - DNA, 16 bp, Homo sapiens
gcattccagaatcttg

SEQ ID NO: 1661276 - DNA, 16 bp, Homo sapiens
gcattccagcccctct

SEQ ID NO: 1661277 - DNA, 19 bp, Homo sapiens
gcattccagcccctctggt

SEQ ID NO: 1661278 - DNA, 22 bp, Homo sapiens
gcattccagctgtcactctgtg

SEQ ID NO: 1661279 - DNA, 22 bp, Homo sapiens
gcattccctgagtcaccaggaa

SEQ ID NO: 1661280 - DNA, 19 bp, Homo sapiens
gcattcctacaaagatgtt

SEQ ID NO: 1661281 - DNA, 22 bp, Homo sapiens
gcattcggtacttacccggaga

SEQ ID NO: 1661282 - DNA, 21 bp, Homo sapiens
gcattctccccagtgtatgtc

SEQ ID NO: 1661283 - DNA, 19 bp, Homo sapiens
gcattctctcccatcctgg

SEQ ID NO: 1661284 - DNA, 20 bp, Homo sapiens
gcattctctcccatcctggg

SEQ ID NO: 1661285 - DNA, 14 bp, Homo sapiens
gcattctctgaaga

SEQ ID NO: 1661286 - DNA, 22 bp, Homo sapiens
gcattctgccgtgtgccctcgg

SEQ ID NO: 1661287 - DNA, 17 bp, Homo sapiens
gcattctggccaagggg

SEQ ID NO: 1661288 - DNA, 21 bp, Homo sapiens
gcattcttgtcacaataaatg

SEQ ID NO: 1661289 - DNA, 15 bp, Homo sapiens
gcattctttggtaat

SEQ ID NO: 1661290 - DNA, 21 bp, Homo sapiens
gcattgaaagaagagatgaga

SEQ ID NO: 1661291 - DNA, 16 bp, Homo sapiens
gcattgaatatattat

SEQ ID NO: 1661292 - DNA, 18 bp, Homo sapiens
gcattgagaaactgaata

SEQ ID NO: 1661293 - DNA, 16 bp, Homo sapiens
gcattgagcttgcatg

SEQ ID NO: 1661294 - DNA, 15 bp, Homo sapiens
gcattgctagataaa

SEQ ID NO: 1661295 - DNA, 18 bp, Homo sapiens
gcattgctagataaaagc

SEQ ID NO: 1661296 - DNA, 14 bp, Homo sapiens
gcattgctcagccc

SEQ ID NO: 1661297 - DNA, 16 bp, Homo sapiens
gcattgctcagcccgc

SEQ ID NO: 1661298 - DNA, 23 bp, Homo sapiens
gcattgctcagcccgcttggcca

SEQ ID NO: 1661299 - DNA, 14 bp, Homo sapiens
gcattgctgtgtga

SEQ ID NO: 1661300 - DNA, 12 bp, Homo sapiens
gcattgctttcc

SEQ ID NO: 1661301 - DNA, 16 bp, Homo sapiens
gcattggaagacccca

SEQ ID NO: 1661302 - DNA, 12 bp, Homo sapiens
gcattggatatt

SEQ ID NO: 1661303 - DNA, 18 bp, Homo sapiens
gcattggatattttttac

SEQ ID NO: 1661304 - DNA, 21 bp, Homo sapiens
gcattggccagaccacagcag

SEQ ID NO: 1661305 - DNA, 16 bp, Homo sapiens
gcattggcccctgagc

SEQ ID NO: 1661306 - DNA, 19 bp, Homo sapiens
gcattggcccctgagccca

SEQ ID NO: 1661307 - DNA, 13 bp, Homo sapiens
gcattggcctctg

SEQ ID NO: 1661308 - DNA, 15 bp, Homo sapiens
gcattgggctgacac

SEQ ID NO: 1661309 - DNA, 16 bp, Homo sapiens
gcattgtaaaataatt

SEQ ID NO: 1661310 - DNA, 14 bp, Homo sapiens
gcattgtcttgtgg

SEQ ID NO: 1661311 - DNA, 19 bp, Homo sapiens
gcattgttattgtggaaga

SEQ ID NO: 1661312 - DNA, 22 bp, Homo sapiens
gccagcaatgatgtccagaaga

SEQ ID NO: 1661313 - DNA, 20 bp, Homo sapiens
gccagcacagaaacagagga

SEQ ID NO: 1661314 - DNA, 23 bp, Homo sapiens
gccagcacagtaggtcccggcca

SEQ ID NO: 1661315 - DNA, 13 bp, Homo sapiens
gccagcaccacct

SEQ ID NO: 1661316 - DNA, 14 bp, Homo sapiens
gccagcacctggca

SEQ ID NO: 1661317 - DNA, 14 bp, Homo sapiens
gccagcacgcctgg

SEQ ID NO: 1661318 - DNA, 20 bp, Homo sapiens
gccagcactggaggggccca

SEQ ID NO: 1661319 - DNA, 23 bp, Homo sapiens
gccagcactggaggggcccaccc

SEQ ID NO: 1661320 - DNA, 16 bp, Homo sapiens
gccagcagcagcaggt

SEQ ID NO: 1661321 - DNA, 20 bp, Homo sapiens
gccagcagccagctctcagc

SEQ ID NO: 1661322 - DNA, 14 bp, Homo sapiens
gccagcagcctcgc

SEQ ID NO: 1661323 - DNA, 22 bp, Homo sapiens
gccagcagcctcgcacaggccc

SEQ ID NO: 1661324 - DNA, 14 bp, Homo sapiens
gccagcaggctcct

SEQ ID NO: 1661325 - DNA, 15 bp, Homo sapiens
gccagcaggctcctg

SEQ ID NO: 1661326 - DNA, 22 bp, Homo sapiens
gccagcaggctcctggctgtgc

SEQ ID NO: 1661327 - DNA, 12 bp, Homo sapiens
gccagcagggct

SEQ ID NO: 1661328 - DNA, 21 bp, Homo sapiens
gccagcaggggggctgtgcca

SEQ ID NO: 1661329 - DNA, 13 bp, Homo sapiens
gccagcattcagc

SEQ ID NO: 1661330 - DNA, 14 bp, Homo sapiens
gccagccacagacc

SEQ ID NO: 1661331 - DNA, 15 bp, Homo sapiens
gccagccacagaccc

SEQ ID NO: 1661332 - DNA, 16 bp, Homo sapiens
gccagccacagacccc

SEQ ID NO: 1661333 - DNA, 19 bp, Homo sapiens
gccagccagcagccagctc

SEQ ID NO: 1661334 - DNA, 15 bp, Homo sapiens
gccagccaggccctg

SEQ ID NO: 1661335 - DNA, 15 bp, Homo sapiens
gccagcccagccagg

SEQ ID NO: 1661336 - DNA, 17 bp, Homo sapiens
gccagcccatggccccc

SEQ ID NO: 1661337 - DNA, 13 bp, Homo sapiens
gccagccccaccc

SEQ ID NO: 1661338 - DNA, 18 bp, Homo sapiens
gccagccccacccaggag

SEQ ID NO: 1661339 - DNA, 19 bp, Homo sapiens
gccagccccacccaggagg

SEQ ID NO: 1661340 - DNA, 16 bp, Homo sapiens
gccagccccctccagc

SEQ ID NO: 1661341 - DNA, 20 bp, Homo sapiens
gccagccccctccagctcat

SEQ ID NO: 1661342 - DNA, 21 bp, Homo sapiens
gccagccccctccagctcatg

SEQ ID NO: 1661343 - DNA, 15 bp, Homo sapiens
gccagcccctcttcc

SEQ ID NO: 1661344 - DNA, 13 bp, Homo sapiens
gccagccctccct

SEQ ID NO: 1661345 - DNA, 22 bp, Homo sapiens
gccagccctccctggctgtgag

SEQ ID NO: 1661346 - DNA, 15 bp, Homo sapiens
gccagccctccctgt

SEQ ID NO: 1661347 - DNA, 20 bp, Homo sapiens
gccagccctccctgtcctcc

SEQ ID NO: 1661348 - DNA, 19 bp, Homo sapiens
gccagcctcagaaggcccc

SEQ ID NO: 1661349 - DNA, 14 bp, Homo sapiens
gccagcctcagtgc

SEQ ID NO: 1661350 - DNA, 18 bp, Homo sapiens
gccagcctcagtgccact

SEQ ID NO: 1661351 - DNA, 17 bp, Homo sapiens
gccagcctcctctggac

SEQ ID NO: 1661352 - DNA, 19 bp, Homo sapiens
gccagcctggctctgcccc

SEQ ID NO: 1661353 - DNA, 22 bp, Homo sapiens
gccagcctggctctgccccctc

SEQ ID NO: 1661354 - DNA, 17 bp, Homo sapiens
gccagcctggcttctgg

SEQ ID NO: 1661355 - DNA, 18 bp, Homo sapiens
gccagcctggcttctgga

SEQ ID NO: 1661356 - DNA, 15 bp, Homo sapiens
gccagcctgggactc

SEQ ID NO: 1661357 - DNA, 17 bp, Homo sapiens
gccagccttcctctgca

SEQ ID NO: 1661358 - DNA, 22 bp, Homo sapiens
gccagccttgagccctggctgt

SEQ ID NO: 1661359 - DNA, 12 bp, Homo sapiens
gccagcgaactt

SEQ ID NO: 1661360 - DNA, 22 bp, Homo sapiens
gccagcgctgtggaccttacaa

SEQ ID NO: 1661361 - DNA, 13 bp, Homo sapiens
gccagcggctcca

SEQ ID NO: 1661362 - DNA, 15 bp, Homo sapiens
gccagcgtcccttgg

SEQ ID NO: 1661363 - DNA, 14 bp, Homo sapiens
gccagcgtggcgca

SEQ ID NO: 1661364 - DNA, 16 bp, Homo sapiens
gccagcgtgtggagca

SEQ ID NO: 1661365 - DNA, 23 bp, Homo sapiens
gccagctacttcctcctccccac

SEQ ID NO: 1661366 - DNA, 17 bp, Homo sapiens
gccagctcacagtgctg

SEQ ID NO: 1661367 - DNA, 19 bp, Homo sapiens
gccagctcacagtgctgtg

SEQ ID NO: 1661368 - DNA, 16 bp, Homo sapiens
gccagctcagtcccat

SEQ ID NO: 1661369 - DNA, 21 bp, Homo sapiens
gccagctcctgggcagcttga

SEQ ID NO: 1661370 - DNA, 14 bp, Homo sapiens
gccagctccttggg

SEQ ID NO: 1661371 - DNA, 12 bp, Homo sapiens
gccagctctgag

SEQ ID NO: 1661372 - DNA, 19 bp, Homo sapiens
gccagctctgaggggaggc

SEQ ID NO: 1661373 - DNA, 14 bp, Homo sapiens
gccagctgcactga

SEQ ID NO: 1661374 - DNA, 15 bp, Homo sapiens
gccagctgccctatg

SEQ ID NO: 1661375 - DNA, 20 bp, Homo sapiens
gccagctgccgaccagagcc

SEQ ID NO: 1661376 - DNA, 18 bp, Homo sapiens
gccagctgccgcaccagc

SEQ ID NO: 1661377 - DNA, 12 bp, Homo sapiens
gccagctgcctt

SEQ ID NO: 1661378 - DNA, 22 bp, Homo sapiens
gccagctgccttcctcatcccc

SEQ ID NO: 1661379 - DNA, 14 bp, Homo sapiens
gccagctgggagca

SEQ ID NO: 1661380 - DNA, 17 bp, Homo sapiens
gccagctgggcccagca

SEQ ID NO: 1661381 - DNA, 12 bp, Homo sapiens
gccagctgtgca

SEQ ID NO: 1661382 - DNA, 17 bp, Homo sapiens
gccagctgtgcactttc

SEQ ID NO: 1661383 - DNA, 22 bp, Homo sapiens
gccagcttaaacccatacaatg

SEQ ID NO: 1661384 - DNA, 14 bp, Homo sapiens
gccagcttctctct

SEQ ID NO: 1661385 - DNA, 20 bp, Homo sapiens
gccagcttctctctccaggg

SEQ ID NO: 1661386 - DNA, 21 bp, Homo sapiens
gccagcttctctctccagggt

SEQ ID NO: 1661387 - DNA, 22 bp, Homo sapiens
gccagcttggggccaccaaagc

SEQ ID NO: 1661388 - DNA, 18 bp, Homo sapiens
gccagcttgttatttata

SEQ ID NO: 1661389 - DNA, 15 bp, Homo sapiens
gccaggaacctgtcc

SEQ ID NO: 1661390 - DNA, 17 bp, Homo sapiens
gccaggaagtacttcca

SEQ ID NO: 1661391 - DNA, 13 bp, Homo sapiens
gccaggaatattg

SEQ ID NO: 1661392 - DNA, 17 bp, Homo sapiens
gccaggaatttcccagg

SEQ ID NO: 1661393 - DNA, 23 bp, Homo sapiens
gccaggaatttcccaggaccctg

SEQ ID NO: 1661394 - DNA, 22 bp, Homo sapiens
gccaggacatgcaataaaattt

SEQ ID NO: 1661395 - DNA, 11 bp, Homo sapiens
gccaggaccag

SEQ ID NO: 1661396 - DNA, 12 bp, Homo sapiens
gccaggaccagc

SEQ ID NO: 1661397 - DNA, 18 bp, Homo sapiens
gccaggacccgccagccc

SEQ ID NO: 1661398 - DNA, 22 bp, Homo sapiens
gccaggacccgccagccccgct

SEQ ID NO: 1661399 - DNA, 17 bp, Homo sapiens
gccaggacgggccacac

SEQ ID NO: 1661400 - DNA, 11 bp, Homo sapiens
gccaggactgt

SEQ ID NO: 1661401 - DNA, 14 bp, Homo sapiens
gccaggactgtgtt

SEQ ID NO: 1661402 - DNA, 14 bp, Homo sapiens
gccaggagaagctc

SEQ ID NO: 1661403 - DNA, 17 bp, Homo sapiens
gccaggagaagctcagc

SEQ ID NO: 1661404 - DNA, 22 bp, Homo sapiens
gccaggagaagctcagctgcat

SEQ ID NO: 1661405 - DNA, 19 bp, Homo sapiens
gccaggagccgggcctccc

SEQ ID NO: 1661406 - DNA, 23 bp, Homo sapiens
gccaggagctgggcagaaggcca

SEQ ID NO: 1661407 - DNA, 23 bp, Homo sapiens
gccaggagctgtcaccaaggaaa

SEQ ID NO: 1661408 - DNA, 16 bp, Homo sapiens
gccaggaggccaggct

SEQ ID NO: 1661409 - DNA, 13 bp, Homo sapiens
gccaggagtaaga

SEQ ID NO: 1661410 - DNA, 17 bp, Homo sapiens
gccaggagtaagacaag

SEQ ID NO: 1661411 - DNA, 14 bp, Homo sapiens
gccaggagtctgtg

SEQ ID NO: 1661412 - DNA, 19 bp, Homo sapiens
gccaggagtctgtgctctt

SEQ ID NO: 1661413 - DNA, 18 bp, Homo sapiens
gccaggcacagggcccgc

SEQ ID NO: 1661414 - DNA, 18 bp, Homo sapiens
gccaggcacccatgtggg

SEQ ID NO: 1661415 - DNA, 19 bp, Homo sapiens
gccaggcacccatgtgggc

SEQ ID NO: 1661416 - DNA, 16 bp, Homo sapiens
gccaggcacctggcct

SEQ ID NO: 1661417 - DNA, 19 bp, Homo sapiens
gccaggcacctggcctgct

SEQ ID NO: 1661418 - DNA, 21 bp, Homo sapiens
gccaggcacctggcctgctgg

SEQ ID NO: 1661419 - DNA, 20 bp, Homo sapiens
gccaggcactgcccttttca

SEQ ID NO: 1661420 - DNA, 22 bp, Homo sapiens
gccaggcactgcccttttcagg

SEQ ID NO: 1661421 - DNA, 10 bp, Homo sapiens
gccaggcaga

SEQ ID NO: 1661422 - DNA, 13 bp, Homo sapiens
gccaggcagagct

SEQ ID NO: 1661423 - DNA, 14 bp, Homo sapiens
gccaggcagagctg

SEQ ID NO: 1661424 - DNA, 20 bp, Homo sapiens
gccaggcagggagtgtctgc

SEQ ID NO: 1661425 - DNA, 22 bp, Homo sapiens
gccaggcagggagtgtctgcag

SEQ ID NO: 1661426 - DNA, 23 bp, Homo sapiens
gccaggccaatgttgctgatggc

SEQ ID NO: 1661427 - DNA, 20 bp, Homo sapiens
gcccagggggcctggagcat

SEQ ID NO: 1661428 - DNA, 14 bp, Homo sapiens
gcccaggggtgccc

SEQ ID NO: 1661429 - DNA, 15 bp, Homo sapiens
gcccaggggtgcccc

SEQ ID NO: 1661430 - DNA, 16 bp, Homo sapiens
gcccagggtcctgtgc

SEQ ID NO: 1661431 - DNA, 21 bp, Homo sapiens
gcccagggtcctgtgcctgga

SEQ ID NO: 1661432 - DNA, 23 bp, Homo sapiens
gcccagggtgtttgcagctgtga

SEQ ID NO: 1661433 - DNA, 20 bp, Homo sapiens
gcccaggttggagtgcagtg

SEQ ID NO: 1661434 - DNA, 14 bp, Homo sapiens
gcccagtacattta

SEQ ID NO: 1661435 - DNA, 19 bp, Homo sapiens
gcccagtacatttaaattt

SEQ ID NO: 1661436 - DNA, 14 bp, Homo sapiens
gcccagtccctgga

SEQ ID NO: 1661437 - DNA, 16 bp, Homo sapiens
gcccagtccctggagc

SEQ ID NO: 1661438 - DNA, 14 bp, Homo sapiens
gcccagtcgacccc

SEQ ID NO: 1661439 - DNA, 15 bp, Homo sapiens
gcccagtcgacccca

SEQ ID NO: 1661440 - DNA, 14 bp, Homo sapiens
gcccagtctgttga

SEQ ID NO: 1661441 - DNA, 18 bp, Homo sapiens
gcccagtgcaaaccactt

SEQ ID NO: 1661442 - DNA, 11 bp, Homo sapiens
gcccagtgcat

SEQ ID NO: 1661443 - DNA, 17 bp, Homo sapiens
gcccagtgccactgccc

SEQ ID NO: 1661444 - DNA, 17 bp, Homo sapiens
gcccagtgccctggggc

SEQ ID NO: 1661445 - DNA, 15 bp, Homo sapiens
gcccagtggagcctg

SEQ ID NO: 1661446 - DNA, 19 bp, Homo sapiens
gcccagtgttgtttgtaaa

SEQ ID NO: 1661447 - DNA, 19 bp, Homo sapiens
gcccagttcaccctgattt

SEQ ID NO: 1661448 - DNA, 18 bp, Homo sapiens
gcccagttcatcaccatt

SEQ ID NO: 1661449 - DNA, 19 bp, Homo sapiens
gcccataatagttagccct

SEQ ID NO: 1661450 - DNA, 21 bp, Homo sapiens
gcccataatagttagccctca

SEQ ID NO: 1661451 - DNA, 23 bp, Homo sapiens
gcccataatagttagccctcagt

SEQ ID NO: 1661452 - DNA, 22 bp, Homo sapiens
gcccatacccgtgacagtggct

SEQ ID NO: 1661453 - DNA, 23 bp, Homo sapiens
gcccatacccgtgacagtggctg

SEQ ID NO: 1661454 - DNA, 15 bp, Homo sapiens
gcccataccttctgg

SEQ ID NO: 1661455 - DNA, 16 bp, Homo sapiens
gcccatactggttggc

SEQ ID NO: 1661456 - DNA, 18 bp, Homo sapiens
gcccatagaaacatgaca

SEQ ID NO: 1661457 - DNA, 17 bp, Homo sapiens
gcccatcacagggttgg

SEQ ID NO: 1661458 - DNA, 21 bp, Homo sapiens
gcccatcacagggttgggccc

SEQ ID NO: 1661459 - DNA, 14 bp, Homo sapiens
gcccatcaggcagt

SEQ ID NO: 1661460 - DNA, 18 bp, Homo sapiens
gcccatccccaggcacct

SEQ ID NO: 1661461 - DNA, 16 bp, Homo sapiens
gcccatcctgaccagc

SEQ ID NO: 1661462 - DNA, 13 bp, Homo sapiens
gcccatccttccc

SEQ ID NO: 1661463 - DNA, 19 bp, Homo sapiens
gcccatcgtgaagaagcct

SEQ ID NO: 1661464 - DNA, 22 bp, Homo sapiens
gcccatctatgtcccttgctgt

SEQ ID NO: 1661465 - DNA, 14 bp, Homo sapiens
gcccatctcaggac

SEQ ID NO: 1661466 - DNA, 19 bp, Homo sapiens
gcccatctcaggtgccact

SEQ ID NO: 1661467 - DNA, 24 bp, Homo sapiens
gcccatctcaggtgccactccctg

SEQ ID NO: 1661468 - DNA, 17 bp, Homo sapiens
gcccatgagtccttgaa

SEQ ID NO: 1661469 - DNA, 22 bp, Homo sapiens
gcccatggcctctggccaggca

SEQ ID NO: 1661470 - DNA, 17 bp, Homo sapiens
gcccatgtgttccctct

SEQ ID NO: 1661471 - DNA, 16 bp, Homo sapiens
gcccattcattagaag

SEQ ID NO: 1661472 - DNA, 17 bp, Homo sapiens
gcccattcgtctgtccc

SEQ ID NO: 1661473 - DNA, 18 bp, Homo sapiens
gcccattcgtctgtccca

SEQ ID NO: 1661474 - DNA, 14 bp, Homo sapiens
gcccattgtcctcc

SEQ ID NO: 1661475 - DNA, 15 bp, Homo sapiens
gcccattgtcctcct

SEQ ID NO: 1661476 - DNA, 21 bp, Homo sapiens
gcccattgtcctccttttcac

SEQ ID NO: 1661477 - DNA, 20 bp, Homo sapiens
gcccattttcaactgctttg

SEQ ID NO: 1661478 - DNA, 17 bp, Homo sapiens
gccccaaacaaatatgc

SEQ ID NO: 1661479 - DNA, 20 bp, Homo sapiens
gccccaaacgggctgccctg

SEQ ID NO: 1661480 - DNA, 14 bp, Homo sapiens
gccccaacctgctg

SEQ ID NO: 1661481 - DNA, 15 bp, Homo sapiens
gccccaactcctgga

SEQ ID NO: 1661482 - DNA, 16 bp, Homo sapiens
gccccaactcctggaa

SEQ ID NO: 1661483 - DNA, 17 bp, Homo sapiens
gccccaactcctggaag

SEQ ID NO: 1661484 - DNA, 14 bp, Homo sapiens
gccccaagcagcca

SEQ ID NO: 1661485 - DNA, 16 bp, Homo sapiens
gccccaagcagccagc

SEQ ID NO: 1661486 - DNA, 17 bp, Homo sapiens
gccccaagcagccagcc

SEQ ID NO: 1661487 - DNA, 18 bp, Homo sapiens
gccccaagcagccagcca

SEQ ID NO: 1661488 - DNA, 22 bp, Homo sapiens
gccccaagcagccagccagtct

SEQ ID NO: 1661489 - DNA, 13 bp, Homo sapiens
gccccaagctggg

SEQ ID NO: 1661490 - DNA, 18 bp, Homo sapiens
gccccaagggcccagacc

SEQ ID NO: 1661491 - DNA, 20 bp, Homo sapiens
gccccaagggcccagaccct

SEQ ID NO: 1661492 - DNA, 19 bp, Homo sapiens
gccccaagtcctgaagagg

SEQ ID NO: 1661493 - DNA, 20 bp, Homo sapiens
gccccaagtcctgaagaggc

SEQ ID NO: 1661494 - DNA, 19 bp, Homo sapiens
gccccaatccctttattac

SEQ ID NO: 1661495 - DNA, 23 bp, Homo sapiens
gccccacatgtccagcaccttgt

SEQ ID NO: 1661496 - DNA, 20 bp, Homo sapiens
gccccaccacctaggccact

SEQ ID NO: 1661497 - DNA, 23 bp, Homo sapiens
gccccacccaccccacacctgca

SEQ ID NO: 1661498 - DNA, 11 bp, Homo sapiens
gccccacccag

SEQ ID NO: 1661499 - DNA, 15 bp, Homo sapiens
gccccacccaggagg

SEQ ID NO: 1661500 - DNA, 22 bp, Homo sapiens
gccccaccccacctcacagcta

SEQ ID NO: 1661501 - DNA, 20 bp, Homo sapiens
gccccaccccatccagccag

SEQ ID NO: 1661502 - DNA, 19 bp, Homo sapiens
gccccaccctgggccctgg

SEQ ID NO: 1661503 - DNA, 20 bp, Homo sapiens
gccccaccctgggccctggg

SEQ ID NO: 1661504 - DNA, 15 bp, Homo sapiens
gccccaccggccagg

SEQ ID NO: 1661505 - DNA, 17 bp, Homo sapiens
gccccaccggccaggcc

SEQ ID NO: 1661506 - DNA, 12 bp, Homo sapiens
gccccacctgcc

SEQ ID NO: 1661507 - DNA, 13 bp, Homo sapiens
gccccacctgccg

SEQ ID NO: 1661508 - DNA, 15 bp, Homo sapiens
gccccacctgccgca

SEQ ID NO: 1661509 - DNA, 18 bp, Homo sapiens
gccccacctgcctggtgc

SEQ ID NO: 1661510 - DNA, 23 bp, Homo sapiens
gccccacctttattaaaatctta

SEQ ID NO: 1661511 - DNA, 14 bp, Homo sapiens
gccccactccagcc

SEQ ID NO: 1661512 - DNA, 14 bp, Homo sapiens
gccccactctgcct

SEQ ID NO: 1661513 - DNA, 12 bp, Homo sapiens
gccccactgcca

SEQ ID NO: 1661514 - DNA, 15 bp, Homo sapiens
gccccactgccagca

SEQ ID NO: 1661515 - DNA, 18 bp, Homo sapiens
gccccactttgaagggca

SEQ ID NO: 1661516 - DNA, 19 bp, Homo sapiens
gccccactttgaagggcaa

SEQ ID NO: 1661517 - DNA, 13 bp, Homo sapiens
gccccagaaaatg

SEQ ID NO: 1661518 - DNA, 16 bp, Homo sapiens
gccccagacctggaag

SEQ ID NO: 1661519 - DNA, 16 bp, Homo sapiens
gccccagactgagctc

SEQ ID NO: 1661520 - DNA, 22 bp, Homo sapiens
gccccagactgggcccaggcag

SEQ ID NO: 1661521 - DNA, 23 bp, Homo sapiens
gccccagactgggcccaggcagg

SEQ ID NO: 1661522 - DNA, 15 bp, Homo sapiens
gccccagagagaccc

SEQ ID NO: 1661523 - DNA, 19 bp, Homo sapiens
gccccagagagaccctgca

SEQ ID NO: 1661524 - DNA, 14 bp, Homo sapiens
gccccagaggccct

SEQ ID NO: 1661525 - DNA, 19 bp, Homo sapiens
gccccagaggccctggagg

SEQ ID NO: 1661526 - DNA, 23 bp, Homo sapiens
gccccagaggtcgcagctaccct

SEQ ID NO: 1661527 - DNA, 18 bp, Homo sapiens
gccccagatcaccagccc

SEQ ID NO: 1661528 - DNA, 19 bp, Homo sapiens
gccccagatcaccagcccg

SEQ ID NO: 1661529 - DNA, 20 bp, Homo sapiens
gccccagatctgcctgggcc

SEQ ID NO: 1661530 - DNA, 22 bp, Homo sapiens
gccccagcacacgagttccaga

SEQ ID NO: 1661531 - DNA, 13 bp, Homo sapiens
gccccagcacagc

SEQ ID NO: 1661532 - DNA, 17 bp, Homo sapiens
gccccagcactaaagca

SEQ ID NO: 1661533 - DNA, 23 bp, Homo sapiens
gccccagcactaaagcagtggac

SEQ ID NO: 1661534 - DNA, 10 bp, Homo sapiens
gccccagcca

SEQ ID NO: 1661535 - DNA, 14 bp, Homo sapiens
gccccagccagagt

SEQ ID NO: 1661536 - DNA, 12 bp, Homo sapiens
gccccagcccag

SEQ ID NO: 1661537 - DNA, 14 bp, Homo sapiens
gccccagcccagat

SEQ ID NO: 1661538 - DNA, 14 bp, Homo sapiens
gccccagccctgct

SEQ ID NO: 1661539 - DNA, 16 bp, Homo sapiens
gccccagccctgctgg

SEQ ID NO: 1661540 - DNA, 16 bp, Homo sapiens
gccccagcctccctga

SEQ ID NO: 1661541 - DNA, 12 bp, Homo sapiens
gccccagcctgt

SEQ ID NO: 1661542 - DNA, 17 bp, Homo sapiens
gccctgcattggcctgg

SEQ ID NO: 1661543 - DNA, 21 bp, Homo sapiens
gccctgcattggcctggcctc

SEQ ID NO: 1661544 - DNA, 12 bp, Homo sapiens
gccctgccactc

SEQ ID NO: 1661545 - DNA, 19 bp, Homo sapiens
gccctgccactcactaggc

SEQ ID NO: 1661546 - DNA, 21 bp, Homo sapiens
gccctgccactcactaggccc

SEQ ID NO: 1661547 - DNA, 18 bp, Homo sapiens
gccctgccatcttcccag

SEQ ID NO: 1661548 - DNA, 13 bp, Homo sapiens
gccctgccccacc

SEQ ID NO: 1661549 - DNA, 23 bp, Homo sapiens
gccctgccccaccccatccagcc

SEQ ID NO: 1661550 - DNA, 21 bp, Homo sapiens
gccctgcccccatctccccag

SEQ ID NO: 1661551 - DNA, 13 bp, Homo sapiens
gccctgccccctc

SEQ ID NO: 1661552 - DNA, 15 bp, Homo sapiens
gccctgcccctagga

SEQ ID NO: 1661553 - DNA, 16 bp, Homo sapiens
gccctgccctagctcc

SEQ ID NO: 1661554 - DNA, 15 bp, Homo sapiens
gccctgccctcccaa

SEQ ID NO: 1661555 - DNA, 23 bp, Homo sapiens
gccctgcctccaccgagccagct

SEQ ID NO: 1661556 - DNA, 15 bp, Homo sapiens
gccctgcctctgtgt

SEQ ID NO: 1661557 - DNA, 14 bp, Homo sapiens
gccctgcctgagga

SEQ ID NO: 1661558 - DNA, 16 bp, Homo sapiens
gccctgcctgagggcc

SEQ ID NO: 1661559 - DNA, 19 bp, Homo sapiens
gccctgcctgagggcccct

SEQ ID NO: 1661560 - DNA, 20 bp, Homo sapiens
gccctgcctgagggcccctc

SEQ ID NO: 1661561 - DNA, 13 bp, Homo sapiens
gccctgcctgccc

SEQ ID NO: 1661562 - DNA, 20 bp, Homo sapiens
gccctgcgttggagccactc

SEQ ID NO: 1661563 - DNA, 14 bp, Homo sapiens
gccctgctcctccc

SEQ ID NO: 1661564 - DNA, 17 bp, Homo sapiens
gccctgctcctccctgg

SEQ ID NO: 1661565 - DNA, 18 bp, Homo sapiens
gccctgctcctccctggc

SEQ ID NO: 1661566 - DNA, 21 bp, Homo sapiens
gccctgctcctccctggctgc

SEQ ID NO: 1661567 - DNA, 20 bp, Homo sapiens
gccctgctgaagctgctgca

SEQ ID NO: 1661568 - DNA, 12 bp, Homo sapiens
gccctgctgagg

SEQ ID NO: 1661569 - DNA, 13 bp, Homo sapiens
gccctgctgagtc

SEQ ID NO: 1661570 - DNA, 22 bp, Homo sapiens
gccctgctgtgggagagcgaag

SEQ ID NO: 1661571 - DNA, 15 bp, Homo sapiens
gccctgcttcctgct

SEQ ID NO: 1661572 - DNA, 16 bp, Homo sapiens
gccctgcttcctgctt

SEQ ID NO: 1661573 - DNA, 22 bp, Homo sapiens
gccctgctttgggctgccctgg

SEQ ID NO: 1661574 - DNA, 18 bp, Homo sapiens
gccctgctttttttctta

SEQ ID NO: 1661575 - DNA, 14 bp, Homo sapiens
gccctggagagccc

SEQ ID NO: 1661576 - DNA, 18 bp, Homo sapiens
gccctggagagccccatg

SEQ ID NO: 1661577 - DNA, 23 bp, Homo sapiens
gccctggagccagggcagaggaa

SEQ ID NO: 1661578 - DNA, 18 bp, Homo sapiens
gccctggaggtctccagg

SEQ ID NO: 1661579 - DNA, 19 bp, Homo sapiens
gccctggaggtctccaggg

SEQ ID NO: 1661580 - DNA, 19 bp, Homo sapiens
gccctggcaacatagtgag

SEQ ID NO: 1661581 - DNA, 16 bp, Homo sapiens
gccctggcagcagcag

SEQ ID NO: 1661582 - DNA, 12 bp, Homo sapiens
gccctggcagga

SEQ ID NO: 1661583 - DNA, 17 bp, Homo sapiens
gccctggcagggggcat

SEQ ID NO: 1661584 - DNA, 16 bp, Homo sapiens
gccctggccctgccca

SEQ ID NO: 1661585 - DNA, 14 bp, Homo sapiens
gccctggcctcccc

SEQ ID NO: 1661586 - DNA, 19 bp, Homo sapiens
gccctggcctcccctgcca

SEQ ID NO: 1661587 - DNA, 12 bp, Homo sapiens
gccctggcctgc

SEQ ID NO: 1661588 - DNA, 13 bp, Homo sapiens
gccctggcctgct

SEQ ID NO: 1661589 - DNA, 14 bp, Homo sapiens
gccctggcctgctg

SEQ ID NO: 1661590 - DNA, 15 bp, Homo sapiens
gccctggcctgctgg

SEQ ID NO: 1661591 - DNA, 11 bp, Homo sapiens
gccctggctgc

SEQ ID NO: 1661592 - DNA, 16 bp, Homo sapiens
gccctggctgctgccc

SEQ ID NO: 1661593 - DNA, 15 bp, Homo sapiens
gccctggctgttctg

SEQ ID NO: 1661594 - DNA, 13 bp, Homo sapiens
gccctggcttgga

SEQ ID NO: 1661595 - DNA, 15 bp, Homo sapiens
gccctgggaaccact

SEQ ID NO: 1661596 - DNA, 17 bp, Homo sapiens
gccctgggaaccactcc

SEQ ID NO: 1661597 - DNA, 18 bp, Homo sapiens
gccctgggcacccacctc

SEQ ID NO: 1661598 - DNA, 17 bp, Homo sapiens
gccctgggccacactga

SEQ ID NO: 1661599 - DNA, 17 bp, Homo sapiens
gccctgggcgagcccct

SEQ ID NO: 1661600 - DNA, 12 bp, Homo sapiens
gccctgggctgg

SEQ ID NO: 1661601 - DNA, 16 bp, Homo sapiens
gccctgggctggaatc

SEQ ID NO: 1661602 - DNA, 18 bp, Homo sapiens
gccctgggctggaatcag

SEQ ID NO: 1661603 - DNA, 19 bp, Homo sapiens
gccctggggatcttcccac

SEQ ID NO: 1661604 - DNA, 13 bp, Homo sapiens
gccctggtccagg

SEQ ID NO: 1661605 - DNA, 20 bp, Homo sapiens
gccctggtccagggaagctg

SEQ ID NO: 1661606 - DNA, 23 bp, Homo sapiens
gccctggtccagggaagctggcc

SEQ ID NO: 1661607 - DNA, 14 bp, Homo sapiens
gccctggtcctggc

SEQ ID NO: 1661608 - DNA, 15 bp, Homo sapiens
gccctggtccttcca

SEQ ID NO: 1661609 - DNA, 16 bp, Homo sapiens
gccctggtgctgccac

SEQ ID NO: 1661610 - DNA, 17 bp, Homo sapiens
gccctggtgctgccaca

SEQ ID NO: 1661611 - DNA, 21 bp, Homo sapiens
gccctggtggagaaagcactg

SEQ ID NO: 1661612 - DNA, 18 bp, Homo sapiens
gccctggtgtcaggcagg

SEQ ID NO: 1661613 - DNA, 13 bp, Homo sapiens
gccctgtctggaa

SEQ ID NO: 1661614 - DNA, 12 bp, Homo sapiens
gccctgtgcctg

SEQ ID NO: 1661615 - DNA, 15 bp, Homo sapiens
gccctgtgcctgggc

SEQ ID NO: 1661616 - DNA, 23 bp, Homo sapiens
gccctgtgcctgggccctgggct

SEQ ID NO: 1661617 - DNA, 17 bp, Homo sapiens
gccctgtggacaggatg

SEQ ID NO: 1661618 - DNA, 17 bp, Homo sapiens
gccctgtggccgccacc

SEQ ID NO: 1661619 - DNA, 18 bp, Homo sapiens
gccctgtggccgccacct

SEQ ID NO: 1661620 - DNA, 12 bp, Homo sapiens
gccctgtgtgca

SEQ ID NO: 1661621 - DNA, 13 bp, Homo sapiens
gccctgttaaaag

SEQ ID NO: 1661622 - DNA, 17 bp, Homo sapiens
gccctgttaaaagatga

SEQ ID NO: 1661623 - DNA, 22 bp, Homo sapiens
gccctgttccctggagtcaggg

SEQ ID NO: 1661624 - DNA, 17 bp, Homo sapiens
gccctgttctcctcccc

SEQ ID NO: 1661625 - DNA, 15 bp, Homo sapiens
gccctgttctcctgt

SEQ ID NO: 1661626 - DNA, 19 bp, Homo sapiens
gccctgttctcctgtccct

SEQ ID NO: 1661627 - DNA, 17 bp, Homo sapiens
gccctgttgtgtataga

SEQ ID NO: 1661628 - DNA, 14 bp, Homo sapiens
gccctgtttctgtt

SEQ ID NO: 1661629 - DNA, 15 bp, Homo sapiens
gcccttcagattgtt

SEQ ID NO: 1661630 - DNA, 14 bp, Homo sapiens
gcccttcagtctgc

SEQ ID NO: 1661631 - DNA, 21 bp, Homo sapiens
gcccttcagtctgctccacca

SEQ ID NO: 1661632 - DNA, 16 bp, Homo sapiens
gcccttccatgtgcct

SEQ ID NO: 1661633 - DNA, 17 bp, Homo sapiens
gcccttccatgtgcctt

SEQ ID NO: 1661634 - DNA, 14 bp, Homo sapiens
gcccttcccctccc

SEQ ID NO: 1661635 - DNA, 23 bp, Homo sapiens
gcccttcccctcccccactcctc

SEQ ID NO: 1661636 - DNA, 15 bp, Homo sapiens
gcccttccctgtccc

SEQ ID NO: 1661637 - DNA, 16 bp, Homo sapiens
gcccttccgtagtttg

SEQ ID NO: 1661638 - DNA, 14 bp, Homo sapiens
gcccttcctcctga

SEQ ID NO: 1661639 - DNA, 18 bp, Homo sapiens
gcccttcctctccactgc

SEQ ID NO: 1661640 - DNA, 20 bp, Homo sapiens
gcccttcctctccactgcct

SEQ ID NO: 1661641 - DNA, 21 bp, Homo sapiens
gcccttctatacccacccaga

SEQ ID NO: 1661642 - DNA, 15 bp, Homo sapiens
gcccttctgactgtt

SEQ ID NO: 1661643 - DNA, 19 bp, Homo sapiens
gcccttctgattcccctcc

SEQ ID NO: 1661644 - DNA, 21 bp, Homo sapiens
gcccttgcagttcagcaccac

SEQ ID NO: 1661645 - DNA, 19 bp, Homo sapiens
gcccttgcccccatccctc

SEQ ID NO: 1661646 - DNA, 20 bp, Homo sapiens
gcccttgcccttggagctgc

SEQ ID NO: 1661647 - DNA, 23 bp, Homo sapiens
gcccttgctttcggagctcctgt

SEQ ID NO: 1661648 - DNA, 18 bp, Homo sapiens
gcccttggaacaccctgg

SEQ ID NO: 1661649 - DNA, 15 bp, Homo sapiens
gcccttggagctgcc

SEQ ID NO: 1661650 - DNA, 12 bp, Homo sapiens
gcccttggctgc

SEQ ID NO: 1661651 - DNA, 14 bp, Homo sapiens
gcccttggggcctg

SEQ ID NO: 1661652 - DNA, 18 bp, Homo sapiens
gcccttggggcctggctt

SEQ ID NO: 1661653 - DNA, 19 bp, Homo sapiens
gcccttgggtccccccgag

SEQ ID NO: 1661654 - DNA, 20 bp, Homo sapiens
gcccttgtcgtgggatggca

SEQ ID NO: 1661655 - DNA, 18 bp, Homo sapiens
gccctttccttgccttct

SEQ ID NO: 1661656 - DNA, 14 bp, Homo sapiens
gccctttcctttgg

SEQ ID NO: 1661657 - DNA, 23 bp, Homo sapiens
gccctttgagatctggggaggca

SEQ ID NO: 1661658 - DNA, 13 bp, Homo sapiens
gcctcgggacctc

SEQ ID NO: 1661659 - DNA, 16 bp, Homo sapiens
gcctcggtatctggct

SEQ ID NO: 1661660 - DNA, 23 bp, Homo sapiens
gcctcggtatctggcttccctgg

SEQ ID NO: 1661661 - DNA, 13 bp, Homo sapiens
gcctcgtgccagc

SEQ ID NO: 1661662 - DNA, 18 bp, Homo sapiens
gcctcgtgccagcagcct

SEQ ID NO: 1661663 - DNA, 24 bp, Homo sapiens
gcctcgtgccagcagcctcgcaca

SEQ ID NO: 1661664 - DNA, 21 bp, Homo sapiens
gcctcgttccagtggcggcac

SEQ ID NO: 1661665 - DNA, 16 bp, Homo sapiens
gcctctacagccgtcc

SEQ ID NO: 1661666 - DNA, 21 bp, Homo sapiens
gcctctagtccccaaggcctc

SEQ ID NO: 1661667 - DNA, 23 bp, Homo sapiens
gcctctagtccccaaggcctctc

SEQ ID NO: 1661668 - DNA, 20 bp, Homo sapiens
gcctctcattccagaggaag

SEQ ID NO: 1661669 - DNA, 21 bp, Homo sapiens
gcctctccaaccactgtgcca

SEQ ID NO: 1661670 - DNA, 10 bp, Homo sapiens
gcctctccca

SEQ ID NO: 1661671 - DNA, 13 bp, Homo sapiens
gcctctcccaccc

SEQ ID NO: 1661672 - DNA, 18 bp, Homo sapiens
gcctctcccgcaccaggc

SEQ ID NO: 1661673 - DNA, 17 bp, Homo sapiens
gcctctcccggctgcct

SEQ ID NO: 1661674 - DNA, 19 bp, Homo sapiens
gcctctcccggctgcctgc

SEQ ID NO: 1661675 - DNA, 19 bp, Homo sapiens
gcctctcccgtcagggccc

SEQ ID NO: 1661676 - DNA, 23 bp, Homo sapiens
gcctctcccgtcagggcccaagt

SEQ ID NO: 1661677 - DNA, 14 bp, Homo sapiens
gcctctccctggcc

SEQ ID NO: 1661678 - DNA, 16 bp, Homo sapiens
gcctctccctggccct

SEQ ID NO: 1661679 - DNA, 16 bp, Homo sapiens
gcctctcctgccctct

SEQ ID NO: 1661680 - DNA, 14 bp, Homo sapiens
gcctctctctccct

SEQ ID NO: 1661681 - DNA, 15 bp, Homo sapiens
gcctctctggcctcc

SEQ ID NO: 1661682 - DNA, 15 bp, Homo sapiens
gcctctgaaaatatt

SEQ ID NO: 1661683 - DNA, 18 bp, Homo sapiens
gcctctgacagtccacag

SEQ ID NO: 1661684 - DNA, 19 bp, Homo sapiens
gcctctgacagtccacagg

SEQ ID NO: 1661685 - DNA, 23 bp, Homo sapiens
gcctctgacagtccacaggggcc

SEQ ID NO: 1661686 - DNA, 13 bp, Homo sapiens
gcctctgatatgg

SEQ ID NO: 1661687 - DNA, 17 bp, Homo sapiens
gcctctgatatgggact

SEQ ID NO: 1661688 - DNA, 12 bp, Homo sapiens
gcctctgcagtc

SEQ ID NO: 1661689 - DNA, 20 bp, Homo sapiens
gcctctgcagtctcatttct

SEQ ID NO: 1661690 - DNA, 16 bp, Homo sapiens
gcctctgccactgact

SEQ ID NO: 1661691 - DNA, 13 bp, Homo sapiens
gcctctgcctccc

SEQ ID NO: 1661692 - DNA, 15 bp, Homo sapiens
gcctctgcctgggac

SEQ ID NO: 1661693 - DNA, 17 bp, Homo sapiens
gcctctgcctggggcct

SEQ ID NO: 1661694 - DNA, 20 bp, Homo sapiens
gcctctgcctggggcctcca

SEQ ID NO: 1661695 - DNA, 16 bp, Homo sapiens
gcctctgcgtcttttt

SEQ ID NO: 1661696 - DNA, 13 bp, Homo sapiens
gcctctgctccct

SEQ ID NO: 1661697 - DNA, 16 bp, Homo sapiens
gcctctgctccctctg

SEQ ID NO: 1661698 - DNA, 22 bp, Homo sapiens
gcctctgctggaaggggcagca

SEQ ID NO: 1661699 - DNA, 23 bp, Homo sapiens
gcctctgctggaaggggcagcag

SEQ ID NO: 1661700 - DNA, 15 bp, Homo sapiens
gcctctggaaagcaa

SEQ ID NO: 1661701 - DNA, 21 bp, Homo sapiens
gcctctggactggcctgtctg

SEQ ID NO: 1661702 - DNA, 17 bp, Homo sapiens
gcctctggccgccaccc

SEQ ID NO: 1661703 - DNA, 19 bp, Homo sapiens
gcctctggccgccaccccc

SEQ ID NO: 1661704 - DNA, 12 bp, Homo sapiens
gcctctggctag

SEQ ID NO: 1661705 - DNA, 16 bp, Homo sapiens
gcctctgggcagtgtg

SEQ ID NO: 1661706 - DNA, 18 bp, Homo sapiens
gcctctgtaccgcccggc

SEQ ID NO: 1661707 - DNA, 16 bp, Homo sapiens
gcctctgtctggagcc

SEQ ID NO: 1661708 - DNA, 14 bp, Homo sapiens
gcctctgtgcacag

SEQ ID NO: 1661709 - DNA, 12 bp, Homo sapiens
gcctctgtgcct

SEQ ID NO: 1661710 - DNA, 12 bp, Homo sapiens
gcctctgtgctg

SEQ ID NO: 1661711 - DNA, 14 bp, Homo sapiens
gcctctgtgtacaa

SEQ ID NO: 1661712 - DNA, 21 bp, Homo sapiens
gcctctgtgtagccgccctga

SEQ ID NO: 1661713 - DNA, 23 bp, Homo sapiens
gcctcttaccttcccgcctcggc

SEQ ID NO: 1661714 - DNA, 15 bp, Homo sapiens
gcctcttacttgcca

SEQ ID NO: 1661715 - DNA, 14 bp, Homo sapiens
gcctcttccaccca

SEQ ID NO: 1661716 - DNA, 21 bp, Homo sapiens
gcctcttccagtcttcctgac

SEQ ID NO: 1661717 - DNA, 17 bp, Homo sapiens
gcctcttctagagccgt

SEQ ID NO: 1661718 - DNA, 16 bp, Homo sapiens
gcctcttctgtccctg

SEQ ID NO: 1661719 - DNA, 15 bp, Homo sapiens
gcctcttcttcttca

SEQ ID NO: 1661720 - DNA, 16 bp, Homo sapiens
gcctcttcttcttcag

SEQ ID NO: 1661721 - DNA, 14 bp, Homo sapiens
gcctcttctttgtg

SEQ ID NO: 1661722 - DNA, 18 bp, Homo sapiens
gcctcttctttgtgcctt

SEQ ID NO: 1661723 - DNA, 19 bp, Homo sapiens
gcctcttctttgtgccttt

SEQ ID NO: 1661724 - DNA, 17 bp, Homo sapiens
gcctcttgaatttttga

SEQ ID NO: 1661725 - DNA, 16 bp, Homo sapiens
gcctcttgaccaggct

SEQ ID NO: 1661726 - DNA, 18 bp, Homo sapiens
gcctcttgagcagtggct

SEQ ID NO: 1661727 - DNA, 20 bp, Homo sapiens
gcctcttgagcagtggctgg

SEQ ID NO: 1661728 - DNA, 22 bp, Homo sapiens
gcctcttggctatttctgtgtc

SEQ ID NO: 1661729 - DNA, 24 bp, Homo sapiens
gcctcttggctatttctgtgtcca

SEQ ID NO: 1661730 - DNA, 14 bp, Homo sapiens
gcctcttgtgctca

SEQ ID NO: 1661731 - DNA, 22 bp, Homo sapiens
gcctcttgtgctcacgctcccc

SEQ ID NO: 1661732 - DNA, 13 bp, Homo sapiens
gcctcttgttgca

SEQ ID NO: 1661733 - DNA, 12 bp, Homo sapiens
gcctctttccct

SEQ ID NO: 1661734 - DNA, 18 bp, Homo sapiens
gcctcttttctctgtgct

SEQ ID NO: 1661735 - DNA, 16 bp, Homo sapiens
gcctgaaaagggcgga

SEQ ID NO: 1661736 - DNA, 23 bp, Homo sapiens
gcctgaaagaggctgaggcctgg

SEQ ID NO: 1661737 - DNA, 20 bp, Homo sapiens
gcctgaaatgttacacatta

SEQ ID NO: 1661738 - DNA, 14 bp, Homo sapiens
gcctgaactgagga

SEQ ID NO: 1661739 - DNA, 14 bp, Homo sapiens
gcctgaactgaggc

SEQ ID NO: 1661740 - DNA, 20 bp, Homo sapiens
gcctgaactgaggccttgtg

SEQ ID NO: 1661741 - DNA, 11 bp, Homo sapiens
gcctgaagagc

SEQ ID NO: 1661742 - DNA, 15 bp, Homo sapiens
gcctgaagccagctg

SEQ ID NO: 1661743 - DNA, 14 bp, Homo sapiens
gcctgaagcctgga

SEQ ID NO: 1661744 - DNA, 15 bp, Homo sapiens
gcctgaagcctggat

SEQ ID NO: 1661745 - DNA, 20 bp, Homo sapiens
gcctgacaaccactggtctg

SEQ ID NO: 1661746 - DNA, 15 bp, Homo sapiens
gcctgacacactaac

SEQ ID NO: 1661747 - DNA, 15 bp, Homo sapiens
gcctgacaccccctc

SEQ ID NO: 1661748 - DNA, 20 bp, Homo sapiens
gcctgacaccccctccccgc

SEQ ID NO: 1661749 - DNA, 13 bp, Homo sapiens
gcctgactgctca

SEQ ID NO: 1661750 - DNA, 15 bp, Homo sapiens
gcctgagaggcaggc

SEQ ID NO: 1661751 - DNA, 16 bp, Homo sapiens
gcctgagaggggaagc

SEQ ID NO: 1661752 - DNA, 20 bp, Homo sapiens
gcctgagagtcagctctctg

SEQ ID NO: 1661753 - DNA, 15 bp, Homo sapiens
gcctgagattcttta

SEQ ID NO: 1661754 - DNA, 18 bp, Homo sapiens
gcctgagattctttaagg

SEQ ID NO: 1661755 - DNA, 21 bp, Homo sapiens
gcctgagattctttaaggaga

SEQ ID NO: 1661756 - DNA, 20 bp, Homo sapiens
gcctgagcaacatctcggga

SEQ ID NO: 1661757 - DNA, 17 bp, Homo sapiens
gcctgagcacctcccag

SEQ ID NO: 1661758 - DNA, 20 bp, Homo sapiens
gcctgagcacctcccagccc

SEQ ID NO: 1661759 - DNA, 14 bp, Homo sapiens
gcctgagcccagga

SEQ ID NO: 1661760 - DNA, 17 bp, Homo sapiens
gcctgagcccaggagct

SEQ ID NO: 1661761 - DNA, 14 bp, Homo sapiens
gcctgagctcctgc

SEQ ID NO: 1661762 - DNA, 15 bp, Homo sapiens
gcctgagctcctgct

SEQ ID NO: 1661763 - DNA, 16 bp, Homo sapiens
gcctgagctcctgctg

SEQ ID NO: 1661764 - DNA, 14 bp, Homo sapiens
gcctgagctggggc

SEQ ID NO: 1661765 - DNA, 16 bp, Homo sapiens
gcctgagctggggcca

SEQ ID NO: 1661766 - DNA, 23 bp, Homo sapiens
gcctgaggaggaggacacagcac

SEQ ID NO: 1661767 - DNA, 14 bp, Homo sapiens
gcctgaggatgagc

SEQ ID NO: 1661768 - DNA, 17 bp, Homo sapiens
gcctgaggatgagctgg

SEQ ID NO: 1661769 - DNA, 17 bp, Homo sapiens
gcctgaggccttccaga

SEQ ID NO: 1661770 - DNA, 16 bp, Homo sapiens
gcctgagggcccctct

SEQ ID NO: 1661771 - DNA, 21 bp, Homo sapiens
gcctgagggcccctctgccca

SEQ ID NO: 1661772 - DNA, 18 bp, Homo sapiens
gcctgagggtccacctgg

SEQ ID NO: 1661773 - DNA, 13 bp, Homo sapiens
gccttcccttctc

SEQ ID NO: 1661774 - DNA, 14 bp, Homo sapiens
gccttcccttctct

SEQ ID NO: 1661775 - DNA, 16 bp, Homo sapiens
gccttcccttctctgg

SEQ ID NO: 1661776 - DNA, 18 bp, Homo sapiens
gccttcccttctctggtc

SEQ ID NO: 1661777 - DNA, 22 bp, Homo sapiens
gccttccgggtctcgcagcctg

SEQ ID NO: 1661778 - DNA, 17 bp, Homo sapiens
gccttcctcatcccctc

SEQ ID NO: 1661779 - DNA, 16 bp, Homo sapiens
gccttcctcctccaca

SEQ ID NO: 1661780 - DNA, 16 bp, Homo sapiens
gccttcctctctccag

SEQ ID NO: 1661781 - DNA, 16 bp, Homo sapiens
gccttcctctgcagct

SEQ ID NO: 1661782 - DNA, 17 bp, Homo sapiens
gccttcctctgcagctg

SEQ ID NO: 1661783 - DNA, 19 bp, Homo sapiens
gccttcctttctcctgccc

SEQ ID NO: 1661784 - DNA, 17 bp, Homo sapiens
gccttcgcttcttgcct

SEQ ID NO: 1661785 - DNA, 21 bp, Homo sapiens
gccttcgcttcttgcctctgt

SEQ ID NO: 1661786 - DNA, 20 bp, Homo sapiens
gccttctcccacatgaggcc

SEQ ID NO: 1661787 - DNA, 19 bp, Homo sapiens
gccttctctaaacatttca

SEQ ID NO: 1661788 - DNA, 15 bp, Homo sapiens
gccttctctcagctc

SEQ ID NO: 1661789 - DNA, 17 bp, Homo sapiens
gccttctctcagctccc

SEQ ID NO: 1661790 - DNA, 21 bp, Homo sapiens
gccttctctcagctcccaggc

SEQ ID NO: 1661791 - DNA, 22 bp, Homo sapiens
gccttctctcagctcccaggcc

SEQ ID NO: 1661792 - DNA, 21 bp, Homo sapiens
gccttctgaactccatacagc

SEQ ID NO: 1661793 - DNA, 15 bp, Homo sapiens
gccttctggatccat

SEQ ID NO: 1661794 - DNA, 14 bp, Homo sapiens
gccttctggccttg

SEQ ID NO: 1661795 - DNA, 18 bp, Homo sapiens
gccttcttattctcactc

SEQ ID NO: 1661796 - DNA, 12 bp, Homo sapiens
gccttctttcca

SEQ ID NO: 1661797 - DNA, 18 bp, Homo sapiens
gccttgaagactccctga

SEQ ID NO: 1661798 - DNA, 15 bp, Homo sapiens
gccttgaagccactg

SEQ ID NO: 1661799 - DNA, 23 bp, Homo sapiens
gccttgagacccccaagcttcca

SEQ ID NO: 1661800 - DNA, 21 bp, Homo sapiens
gccttgagagaaaaagtgccc

SEQ ID NO: 1661801 - DNA, 14 bp, Homo sapiens
gccttgagtagaaa

SEQ ID NO: 1661802 - DNA, 22 bp, Homo sapiens
gccttgcagatatctgcatgtg

SEQ ID NO: 1661803 - DNA, 12 bp, Homo sapiens
gccttgcagctg

SEQ ID NO: 1661804 - DNA, 14 bp, Homo sapiens
gccttgcccagaga

SEQ ID NO: 1661805 - DNA, 19 bp, Homo sapiens
gccttgcccgtcgtgtgct

SEQ ID NO: 1661806 - DNA, 19 bp, Homo sapiens
gccttgctacctcaagggg

SEQ ID NO: 1661807 - DNA, 17 bp, Homo sapiens
gccttgctgacaataaa

SEQ ID NO: 1661808 - DNA, 13 bp, Homo sapiens
gccttgctgctct

SEQ ID NO: 1661809 - DNA, 14 bp, Homo sapiens
gccttgctgggcca

SEQ ID NO: 1661810 - DNA, 15 bp, Homo sapiens
gccttgctgggccag

SEQ ID NO: 1661811 - DNA, 17 bp, Homo sapiens
gccttgctgggccaggg

SEQ ID NO: 1661812 - DNA, 22 bp, Homo sapiens
gccttgctttgggctttgcagg

SEQ ID NO: 1661813 - DNA, 13 bp, Homo sapiens
gccttggaaattc

SEQ ID NO: 1661814 - DNA, 19 bp, Homo sapiens
gccttggataatgctgttg

SEQ ID NO: 1661815 - DNA, 18 bp, Homo sapiens
gccttggccttgcagctg

SEQ ID NO: 1661816 - DNA, 14 bp, Homo sapiens
gccttggctcagac

SEQ ID NO: 1661817 - DNA, 22 bp, Homo sapiens
gccttgggctatttggactcag

SEQ ID NO: 1661818 - DNA, 16 bp, Homo sapiens
gccttgggctgctcct

SEQ ID NO: 1661819 - DNA, 24 bp, Homo sapiens
gccttggggctcagccacagcctg

SEQ ID NO: 1661820 - DNA, 18 bp, Homo sapiens
gccttggtgaacacacac

SEQ ID NO: 1661821 - DNA, 16 bp, Homo sapiens
gccttggtggagcagc

SEQ ID NO: 1661822 - DNA, 17 bp, Homo sapiens
gccttggtggagcagcc

SEQ ID NO: 1661823 - DNA, 19 bp, Homo sapiens
gccttggtggagcagccag

SEQ ID NO: 1661824 - DNA, 20 bp, Homo sapiens
gccttggtggagcagccaga

SEQ ID NO: 1661825 - DNA, 23 bp, Homo sapiens
gccttggtggagcagccagagct

SEQ ID NO: 1661826 - DNA, 22 bp, Homo sapiens
gccttggtttttactgctctga

SEQ ID NO: 1661827 - DNA, 23 bp, Homo sapiens
gccttggtttttactgctctgag

SEQ ID NO: 1661828 - DNA, 17 bp, Homo sapiens
gccttgtaattctaaat

SEQ ID NO: 1661829 - DNA, 19 bp, Homo sapiens
gccttgtataatattgaaa

SEQ ID NO: 1661830 - DNA, 21 bp, Homo sapiens
gccttgtataatattgaaaat

SEQ ID NO: 1661831 - DNA, 22 bp, Homo sapiens
gccttgtataatattgaaaatt

SEQ ID NO: 1661832 - DNA, 22 bp, Homo sapiens
gccttgtccctctcactcccca

SEQ ID NO: 1661833 - DNA, 14 bp, Homo sapiens
gccttgttttattc

SEQ ID NO: 1661834 - DNA, 22 bp, Homo sapiens
gccttgttttattcaaagacag

SEQ ID NO: 1661835 - DNA, 16 bp, Homo sapiens
gcctttaagccaaaga

SEQ ID NO: 1661836 - DNA, 20 bp, Homo sapiens
gcctttagcctggaccaaag

SEQ ID NO: 1661837 - DNA, 17 bp, Homo sapiens
gcctttatcttgaagtc

SEQ ID NO: 1661838 - DNA, 15 bp, Homo sapiens
gcctttcattttgct

SEQ ID NO: 1661839 - DNA, 22 bp, Homo sapiens
gcctttcgttctgctgaccaaa

SEQ ID NO: 1661840 - DNA, 18 bp, Homo sapiens
gcctttctcccaggccag

SEQ ID NO: 1661841 - DNA, 14 bp, Homo sapiens
gcctttctgcagtt

SEQ ID NO: 1661842 - DNA, 15 bp, Homo sapiens
gcctttctgtgttta

SEQ ID NO: 1661843 - DNA, 11 bp, Homo sapiens
gcctttcttct

SEQ ID NO: 1661844 - DNA, 16 bp, Homo sapiens
gcctttcttctgtgtt

SEQ ID NO: 1661845 - DNA, 16 bp, Homo sapiens
gcctttcttggggaga

SEQ ID NO: 1661846 - DNA, 22 bp, Homo sapiens
gcctttcttgtagccatggctg

SEQ ID NO: 1661847 - DNA, 13 bp, Homo sapiens
gcctttctttgcc

SEQ ID NO: 1661848 - DNA, 14 bp, Homo sapiens
gcctttctttgcct

SEQ ID NO: 1661849 - DNA, 16 bp, Homo sapiens
gcctttctttgcctct

SEQ ID NO: 1661850 - DNA, 17 bp, Homo sapiens
gcctttctttgcctctg

SEQ ID NO: 1661851 - DNA, 18 bp, Homo sapiens
gcctttgcaagatgcttg

SEQ ID NO: 1661852 - DNA, 16 bp, Homo sapiens
gcctttgggtcctggg

SEQ ID NO: 1661853 - DNA, 20 bp, Homo sapiens
gcctttgggtcctgggcagg

SEQ ID NO: 1661854 - DNA, 11 bp, Homo sapiens
gcctttgtaag

SEQ ID NO: 1661855 - DNA, 15 bp, Homo sapiens
gcctttgtaagttat

SEQ ID NO: 1661856 - DNA, 15 bp, Homo sapiens
gcctttgttgctcag

SEQ ID NO: 1661857 - DNA, 22 bp, Homo sapiens
gccttttatcccaaagttgttg

SEQ ID NO: 1661858 - DNA, 21 bp, Homo sapiens
gccttttccacacgcattaat

SEQ ID NO: 1661859 - DNA, 16 bp, Homo sapiens
gccttttctggcaccg

SEQ ID NO: 1661860 - DNA, 15 bp, Homo sapiens
gccttttctgtgatt

SEQ ID NO: 1661861 - DNA, 14 bp, Homo sapiens
gccttttgctctct

SEQ ID NO: 1661862 - DNA, 15 bp, Homo sapiens
gccttttgctctctg

SEQ ID NO: 1661863 - DNA, 16 bp, Homo sapiens
gccttttgctctctgt

SEQ ID NO: 1661864 - DNA, 18 bp, Homo sapiens
gccttttgctctctgtga

SEQ ID NO: 1661865 - DNA, 18 bp, Homo sapiens
gcctttttagatgtattt

SEQ ID NO: 1661866 - DNA, 23 bp, Homo sapiens
gcctttttcacaattccatttcc

SEQ ID NO: 1661867 - DNA, 14 bp, Homo sapiens
gcctttttcattta

SEQ ID NO: 1661868 - DNA, 15 bp, Homo sapiens
gcctttttcatttat

SEQ ID NO: 1661869 - DNA, 22 bp, Homo sapiens
gcctttttcatttatctataat

SEQ ID NO: 1661870 - DNA, 23 bp, Homo sapiens
gcgaaaggatgtaaacagtgcct

SEQ ID NO: 1661871 - DNA, 14 bp, Homo sapiens
gcgaaggggccctg

SEQ ID NO: 1661872 - DNA, 19 bp, Homo sapiens
gcgacaaaatctcctggct

SEQ ID NO: 1661873 - DNA, 23 bp, Homo sapiens
gcgacagagcgagagtctgtctc

SEQ ID NO: 1661874 - DNA, 15 bp, Homo sapiens
gcgaccgccccctcc

SEQ ID NO: 1661875 - DNA, 17 bp, Homo sapiens
gcgacggagagaaaaaa

SEQ ID NO: 1661876 - DNA, 21 bp, Homo sapiens
gcgactctatagactctagga

SEQ ID NO: 1661877 - DNA, 16 bp, Homo sapiens
gcgactttctgcctgg

SEQ ID NO: 1661878 - DNA, 20 bp, Homo sapiens
gcgagaacctaagtttcagt

SEQ ID NO: 1661879 - DNA, 22 bp, Homo sapiens
gcgagacgcacacagctgagca

SEQ ID NO: 1661880 - DNA, 16 bp, Homo sapiens
gcgagactctgtctca

SEQ ID NO: 1661881 - DNA, 18 bp, Homo sapiens
gcgagaggcagcaaggtg

SEQ ID NO: 1661882 - DNA, 23 bp, Homo sapiens
gcgagatagggggaagacagata

SEQ ID NO: 1661883 - DNA, 15 bp, Homo sapiens
gcgagcatcccccaa

SEQ ID NO: 1661884 - DNA, 12 bp, Homo sapiens
gcgagccaggca

SEQ ID NO: 1661885 - DNA, 13 bp, Homo sapiens
gcgagccaggcaa

SEQ ID NO: 1661886 - DNA, 15 bp, Homo sapiens
gcgagcccctccttc

SEQ ID NO: 1661887 - DNA, 18 bp, Homo sapiens
gcgtgcagggacaaagag

SEQ ID NO: 1661888 - DNA, 19 bp, Homo sapiens
gcgtgcagggacaaagagg

SEQ ID NO: 1661889 - DNA, 16 bp, Homo sapiens
gcgtgcccccctcctc

SEQ ID NO: 1661890 - DNA, 18 bp, Homo sapiens
gcgtgcccccctcctcca

SEQ ID NO: 1661891 - DNA, 22 bp, Homo sapiens
gcgtgcccccctcctccagtac

SEQ ID NO: 1661892 - DNA, 23 bp, Homo sapiens
gcgtgcgtgttagtgtgtgtgca

SEQ ID NO: 1661893 - DNA, 15 bp, Homo sapiens
gcgtgctcagaccca

SEQ ID NO: 1661894 - DNA, 16 bp, Homo sapiens
gcgtgctgagaggcga

SEQ ID NO: 1661895 - DNA, 17 bp, Homo sapiens
gcgtggactctgctaga

SEQ ID NO: 1661896 - DNA, 20 bp, Homo sapiens
gcgtggagggaggccccagg

SEQ ID NO: 1661897 - DNA, 22 bp, Homo sapiens
gcgtggatcgagtgtagctgtg

SEQ ID NO: 1661898 - DNA, 20 bp, Homo sapiens
gcgtggcgcagtggccctga

SEQ ID NO: 1661899 - DNA, 21 bp, Homo sapiens
gcgtggcgcagtggccctgag

SEQ ID NO: 1661900 - DNA, 13 bp, Homo sapiens
gcgtggctgtggc

SEQ ID NO: 1661901 - DNA, 15 bp, Homo sapiens
gcgtggctgtggcac

SEQ ID NO: 1661902 - DNA, 18 bp, Homo sapiens
gcgtggctgtggcacaga

SEQ ID NO: 1661903 - DNA, 21 bp, Homo sapiens
gcgtggtataatctccatttc

SEQ ID NO: 1661904 - DNA, 23 bp, Homo sapiens
gcgtggtggcgggcacctgtagt

SEQ ID NO: 1661905 - DNA, 20 bp, Homo sapiens
gcgtggtgtgtccctggaca

SEQ ID NO: 1661906 - DNA, 15 bp, Homo sapiens
gcgtggttcctttct

SEQ ID NO: 1661907 - DNA, 19 bp, Homo sapiens
gcgtgtcgtgggtgtgtgt

SEQ ID NO: 1661908 - DNA, 16 bp, Homo sapiens
gcgtgtctctgccatg

SEQ ID NO: 1661909 - DNA, 16 bp, Homo sapiens
gcgtgtgcctgtgtgc

SEQ ID NO: 1661910 - DNA, 17 bp, Homo sapiens
gcgtgtgcctgtgtgcg

SEQ ID NO: 1661911 - DNA, 16 bp, Homo sapiens
gcgtgtgctcctctcc

SEQ ID NO: 1661912 - DNA, 12 bp, Homo sapiens
gcgtgtggagca

SEQ ID NO: 1661913 - DNA, 17 bp, Homo sapiens
gcgtgtgggtctctggg

SEQ ID NO: 1661914 - DNA, 19 bp, Homo sapiens
gcgtgtgtgacactgatga

SEQ ID NO: 1661915 - DNA, 13 bp, Homo sapiens
gcgtgtgtgtatg

SEQ ID NO: 1661916 - DNA, 17 bp, Homo sapiens
gcgttacaccctttctt

SEQ ID NO: 1661917 - DNA, 23 bp, Homo sapiens
gcgttctaccaggcaaattcact

SEQ ID NO: 1661918 - DNA, 14 bp, Homo sapiens
gcgttctcaagaat

SEQ ID NO: 1661919 - DNA, 21 bp, Homo sapiens
gcgttctgctgcccctgcagt

SEQ ID NO: 1661920 - DNA, 15 bp, Homo sapiens
gcgttggagccactc

SEQ ID NO: 1661921 - DNA, 17 bp, Homo sapiens
gcgttgggagcctagct

SEQ ID NO: 1661922 - DNA, 14 bp, Homo sapiens
gcgttggtgccact

SEQ ID NO: 1661923 - DNA, 12 bp, Homo sapiens
gctaaaaaataa

SEQ ID NO: 1661924 - DNA, 18 bp, Homo sapiens
gctaaaaaataaataaaa

SEQ ID NO: 1661925 - DNA, 15 bp, Homo sapiens
gctaaaaatgaaaat

SEQ ID NO: 1661926 - DNA, 18 bp, Homo sapiens
gctaaaaatgagcttgat

SEQ ID NO: 1661927 - DNA, 13 bp, Homo sapiens
gctaaaaggaaaa

SEQ ID NO: 1661928 - DNA, 14 bp, Homo sapiens
gctaaaaggaaaag

SEQ ID NO: 1661929 - DNA, 20 bp, Homo sapiens
gctaaagactgatctcaggg

SEQ ID NO: 1661930 - DNA, 14 bp, Homo sapiens
gctaaagagccctt

SEQ ID NO: 1661931 - DNA, 18 bp, Homo sapiens
gctaaagagcccttgcct

SEQ ID NO: 1661932 - DNA, 23 bp, Homo sapiens
gctaaagagcccttgcctcccca

SEQ ID NO: 1661933 - DNA, 14 bp, Homo sapiens
gctaaagatgatga

SEQ ID NO: 1661934 - DNA, 22 bp, Homo sapiens
gctaaataaacatgtgccctca

SEQ ID NO: 1661935 - DNA, 19 bp, Homo sapiens
gctaaatcctttactgtta

SEQ ID NO: 1661936 - DNA, 23 bp, Homo sapiens
gctaaatggtcgcccaggagaca

SEQ ID NO: 1661937 - DNA, 21 bp, Homo sapiens
gctaaatgtaacttattccaa

SEQ ID NO: 1661938 - DNA, 18 bp, Homo sapiens
gctaaattacaattgtca

SEQ ID NO: 1661939 - DNA, 18 bp, Homo sapiens
gctaaattgattgaatta

SEQ ID NO: 1661940 - DNA, 21 bp, Homo sapiens
gctaaattgattgaattaaat

SEQ ID NO: 1661941 - DNA, 20 bp, Homo sapiens
gctaacacggtgaaaccccg

SEQ ID NO: 1661942 - DNA, 19 bp, Homo sapiens
gctaactccgagagcagtg

SEQ ID NO: 1661943 - DNA, 12 bp, Homo sapiens
gctaactggaag

SEQ ID NO: 1661944 - DNA, 13 bp, Homo sapiens
gctaactggaagc

SEQ ID NO: 1661945 - DNA, 13 bp, Homo sapiens
gctaactgtaaat

SEQ ID NO: 1661946 - DNA, 23 bp, Homo sapiens
gctaagaaaccaggagtaaaaga

SEQ ID NO: 1661947 - DNA, 15 bp, Homo sapiens
gctaagaaatgctga

SEQ ID NO: 1661948 - DNA, 23 bp, Homo sapiens
gctaagaacctggaacttgggga

SEQ ID NO: 1661949 - DNA, 18 bp, Homo sapiens
gctaagatagaaagctgg

SEQ ID NO: 1661950 - DNA, 19 bp, Homo sapiens
gctaagatagaaagctgga

SEQ ID NO: 1661951 - DNA, 23 bp, Homo sapiens
gctaagatagaaagctggactga

SEQ ID NO: 1661952 - DNA, 21 bp, Homo sapiens
gctaagatgagatttgccagc

SEQ ID NO: 1661953 - DNA, 23 bp, Homo sapiens
gctaagatgagatttgccagcac

SEQ ID NO: 1661954 - DNA, 15 bp, Homo sapiens
gctaagctaggaatg

SEQ ID NO: 1661955 - DNA, 19 bp, Homo sapiens
gctaagctaggaatgaaat

SEQ ID NO: 1661956 - DNA, 22 bp, Homo sapiens
gctaagctcacgtcctgagaaa

SEQ ID NO: 1661957 - DNA, 15 bp, Homo sapiens
gctaagctggctctg

SEQ ID NO: 1661958 - DNA, 17 bp, Homo sapiens
gctaaggacatttccca

SEQ ID NO: 1661959 - DNA, 11 bp, Homo sapiens
gctaaggctct

SEQ ID NO: 1661960 - DNA, 14 bp, Homo sapiens
gctaaggttctaag

SEQ ID NO: 1661961 - DNA, 22 bp, Homo sapiens
gctaataaaattcgctttctaa

SEQ ID NO: 1661962 - DNA, 16 bp, Homo sapiens
gctaatcagcattctc

SEQ ID NO: 1661963 - DNA, 17 bp, Homo sapiens
gctaatcagcattctca

SEQ ID NO: 1661964 - DNA, 17 bp, Homo sapiens
gctaatctgtagggctg

SEQ ID NO: 1661965 - DNA, 21 bp, Homo sapiens
gctaatctgtagggctggacc

SEQ ID NO: 1661966 - DNA, 22 bp, Homo sapiens
gctaatctgtagggctggacct

SEQ ID NO: 1661967 - DNA, 21 bp, Homo sapiens
gctaatgaagggaaaggatat

SEQ ID NO: 1661968 - DNA, 14 bp, Homo sapiens
gctaattctttgca

SEQ ID NO: 1661969 - DNA, 21 bp, Homo sapiens
gctaattgtgtatatgttggt

SEQ ID NO: 1661970 - DNA, 15 bp, Homo sapiens
gctaatttaaagaga

SEQ ID NO: 1661971 - DNA, 16 bp, Homo sapiens
gctaatttaaagagac

SEQ ID NO: 1661972 - DNA, 20 bp, Homo sapiens
gctaatttatcctgaaattt

SEQ ID NO: 1661973 - DNA, 13 bp, Homo sapiens
gctaatttttgta

SEQ ID NO: 1661974 - DNA, 16 bp, Homo sapiens
gctacaaatttatgca

SEQ ID NO: 1661975 - DNA, 17 bp, Homo sapiens
gctacaaatttatgcat

SEQ ID NO: 1661976 - DNA, 22 bp, Homo sapiens
gctacaaccctaccctggcagg

SEQ ID NO: 1661977 - DNA, 19 bp, Homo sapiens
gctacaggaagcaccccat

SEQ ID NO: 1661978 - DNA, 20 bp, Homo sapiens
gctacaggaagcaccccatg

SEQ ID NO: 1661979 - DNA, 20 bp, Homo sapiens
gctacaggatggtgggcagg

SEQ ID NO: 1661980 - DNA, 21 bp, Homo sapiens
gctacaggatggtgggcagga

SEQ ID NO: 1661981 - DNA, 23 bp, Homo sapiens
gctacagggcgagactctgtctc

SEQ ID NO: 1661982 - DNA, 12 bp, Homo sapiens
gctacattcctc

SEQ ID NO: 1661983 - DNA, 15 bp, Homo sapiens
gctacattcctcagc

SEQ ID NO: 1661984 - DNA, 16 bp, Homo sapiens
gctacattcctcagct

SEQ ID NO: 1661985 - DNA, 20 bp, Homo sapiens
gctacattcctcagctgcca

SEQ ID NO: 1661986 - DNA, 14 bp, Homo sapiens
gctaccaagtcaga

SEQ ID NO: 1661987 - DNA, 16 bp, Homo sapiens
gctaccacagacttgc

SEQ ID NO: 1661988 - DNA, 16 bp, Homo sapiens
gctaccagagctctat

SEQ ID NO: 1661989 - DNA, 14 bp, Homo sapiens
gctaccagtattta

SEQ ID NO: 1661990 - DNA, 16 bp, Homo sapiens
gctaccatctgcatgg

SEQ ID NO: 1661991 - DNA, 13 bp, Homo sapiens
gctaccctcagcc

SEQ ID NO: 1661992 - DNA, 17 bp, Homo sapiens
gctaccctcagcctcca

SEQ ID NO: 1661993 - DNA, 20 bp, Homo sapiens
gctaccctcagcctccaatg

SEQ ID NO: 1661994 - DNA, 22 bp, Homo sapiens
gctaccctcagcctccaatgca

SEQ ID NO: 1661995 - DNA, 19 bp, Homo sapiens
gctaccctttttctccagc

SEQ ID NO: 1661996 - DNA, 20 bp, Homo sapiens
gctaccctttttctccagct

SEQ ID NO: 1661997 - DNA, 21 bp, Homo sapiens
gctaccctttttctccagctg

SEQ ID NO: 1661998 - DNA, 17 bp, Homo sapiens
gctacctcaagggggac

SEQ ID NO: 1661999 - DNA, 12 bp, Homo sapiens
gctacctccctc

SEQ ID NO: 1662000 - DNA, 14 bp, Homo sapiens
gctacctccctccc

SEQ ID NO: 1662001 - DNA, 23 bp, Homo sapiens
gctctagggactgccaggctgtt

SEQ ID NO: 1662002 - DNA, 19 bp, Homo sapiens
gctctaggtacgatgacag

SEQ ID NO: 1662003 - DNA, 15 bp, Homo sapiens
gctctagtgggacag

SEQ ID NO: 1662004 - DNA, 19 bp, Homo sapiens
gctctatcgcccaggctgg

SEQ ID NO: 1662005 - DNA, 14 bp, Homo sapiens
gctctatgagtcta

SEQ ID NO: 1662006 - DNA, 12 bp, Homo sapiens
gctctattaaga

SEQ ID NO: 1662007 - DNA, 22 bp, Homo sapiens
gctctattaagattggaaatgt

SEQ ID NO: 1662008 - DNA, 14 bp, Homo sapiens
gctctcacccagtc

SEQ ID NO: 1662009 - DNA, 20 bp, Homo sapiens
gctctcacccagtccccacc

SEQ ID NO: 1662010 - DNA, 21 bp, Homo sapiens
gctctcacccagtccccaccc

SEQ ID NO: 1662011 - DNA, 22 bp, Homo sapiens
gctctcacccagtccccacccg

SEQ ID NO: 1662012 - DNA, 23 bp, Homo sapiens
gctctcacccagtccccacccgc

SEQ ID NO: 1662013 - DNA, 16 bp, Homo sapiens
gctctcacccccatcc

SEQ ID NO: 1662014 - DNA, 17 bp, Homo sapiens
gctctcacccccatccc

SEQ ID NO: 1662015 - DNA, 17 bp, Homo sapiens
gctctcacctggccctg

SEQ ID NO: 1662016 - DNA, 14 bp, Homo sapiens
gctctcagaggaaa

SEQ ID NO: 1662017 - DNA, 13 bp, Homo sapiens
gctctcagcctcc

SEQ ID NO: 1662018 - DNA, 17 bp, Homo sapiens
gctctcagcctcccaac

SEQ ID NO: 1662019 - DNA, 15 bp, Homo sapiens
gctctcagtagttta

SEQ ID NO: 1662020 - DNA, 17 bp, Homo sapiens
gctctccaaaggggctg

SEQ ID NO: 1662021 - DNA, 20 bp, Homo sapiens
gctctccaaaggggctgctg

SEQ ID NO: 1662022 - DNA, 19 bp, Homo sapiens
gctctccaagtgccagagg

SEQ ID NO: 1662023 - DNA, 20 bp, Homo sapiens
gctctccaagtgccagaggt

SEQ ID NO: 1662024 - DNA, 13 bp, Homo sapiens
gctctccaccacc

SEQ ID NO: 1662025 - DNA, 17 bp, Homo sapiens
gctctccacctcagcct

SEQ ID NO: 1662026 - DNA, 11 bp, Homo sapiens
gctctccaggc

SEQ ID NO: 1662027 - DNA, 14 bp, Homo sapiens
gctctccaggccag

SEQ ID NO: 1662028 - DNA, 15 bp, Homo sapiens
gctctccaggccagg

SEQ ID NO: 1662029 - DNA, 17 bp, Homo sapiens
gctctcccatttcctga

SEQ ID NO: 1662030 - DNA, 19 bp, Homo sapiens
gctctccccggcaggcctg

SEQ ID NO: 1662031 - DNA, 20 bp, Homo sapiens
gctctccccggcaggcctga

SEQ ID NO: 1662032 - DNA, 18 bp, Homo sapiens
gctctcccctcctgctgg

SEQ ID NO: 1662033 - DNA, 19 bp, Homo sapiens
gctctcccggttcttccag

SEQ ID NO: 1662034 - DNA, 20 bp, Homo sapiens
gctctcccggttcttccagt

SEQ ID NO: 1662035 - DNA, 18 bp, Homo sapiens
gctctccctaccttgcct

SEQ ID NO: 1662036 - DNA, 19 bp, Homo sapiens
gctctccctaccttgcctc

SEQ ID NO: 1662037 - DNA, 11 bp, Homo sapiens
gctctccctgt

SEQ ID NO: 1662038 - DNA, 13 bp, Homo sapiens
gctctccctgtca

SEQ ID NO: 1662039 - DNA, 16 bp, Homo sapiens
gctctccgagctctgg

SEQ ID NO: 1662040 - DNA, 19 bp, Homo sapiens
gctctccgagctctggtgc

SEQ ID NO: 1662041 - DNA, 13 bp, Homo sapiens
gctctccgtgcag

SEQ ID NO: 1662042 - DNA, 14 bp, Homo sapiens
gctctcctggacgc

SEQ ID NO: 1662043 - DNA, 22 bp, Homo sapiens
gctctcctggacgcccccgccc

SEQ ID NO: 1662044 - DNA, 14 bp, Homo sapiens
gctctcgctctctc

SEQ ID NO: 1662045 - DNA, 17 bp, Homo sapiens
gctctctctcgctgcgt

SEQ ID NO: 1662046 - DNA, 21 bp, Homo sapiens
gctctctctcgctgcgtcctc

SEQ ID NO: 1662047 - DNA, 22 bp, Homo sapiens
gctctctctcgctgcgtcctca

SEQ ID NO: 1662048 - DNA, 18 bp, Homo sapiens
gctctctgacgcttgtga

SEQ ID NO: 1662049 - DNA, 19 bp, Homo sapiens
gctctctgacgcttgtgac

SEQ ID NO: 1662050 - DNA, 17 bp, Homo sapiens
gctctctgcagccagcc

SEQ ID NO: 1662051 - DNA, 19 bp, Homo sapiens
gctctctgcagccagccca

SEQ ID NO: 1662052 - DNA, 21 bp, Homo sapiens
gctctctgcagccagcccagc

SEQ ID NO: 1662053 - DNA, 12 bp, Homo sapiens
gctctctgccct

SEQ ID NO: 1662054 - DNA, 17 bp, Homo sapiens
gctctctgggacctcct

SEQ ID NO: 1662055 - DNA, 13 bp, Homo sapiens
gctctctgggctt

SEQ ID NO: 1662056 - DNA, 22 bp, Homo sapiens
gctctcttcaggaggccctggt

SEQ ID NO: 1662057 - DNA, 14 bp, Homo sapiens
gctctctttctgtc

SEQ ID NO: 1662058 - DNA, 17 bp, Homo sapiens
gctctgaatattttgta

SEQ ID NO: 1662059 - DNA, 15 bp, Homo sapiens
gctctgacaagatgg

SEQ ID NO: 1662060 - DNA, 15 bp, Homo sapiens
gctctgacatccctt

SEQ ID NO: 1662061 - DNA, 17 bp, Homo sapiens
gctctgacatcccttcc

SEQ ID NO: 1662062 - DNA, 21 bp, Homo sapiens
gctctgacatcccttcctgga

SEQ ID NO: 1662063 - DNA, 21 bp, Homo sapiens
gctctgaccacttgaggcctg

SEQ ID NO: 1662064 - DNA, 16 bp, Homo sapiens
gctctgacccaagtgg

SEQ ID NO: 1662065 - DNA, 17 bp, Homo sapiens
gctctgacccaagtggg

SEQ ID NO: 1662066 - DNA, 14 bp, Homo sapiens
gctctgagaatcac

SEQ ID NO: 1662067 - DNA, 14 bp, Homo sapiens
gctctgagagtcta

SEQ ID NO: 1662068 - DNA, 18 bp, Homo sapiens
gctctgagcgcctccatc

SEQ ID NO: 1662069 - DNA, 14 bp, Homo sapiens
gctctgaggggcac

SEQ ID NO: 1662070 - DNA, 17 bp, Homo sapiens
gctctgcacagacaagc

SEQ ID NO: 1662071 - DNA, 14 bp, Homo sapiens
gctctgcaggccac

SEQ ID NO: 1662072 - DNA, 15 bp, Homo sapiens
gctctgccatcttca

SEQ ID NO: 1662073 - DNA, 16 bp, Homo sapiens
gctctgccatcttcag

SEQ ID NO: 1662074 - DNA, 16 bp, Homo sapiens
gctctgccccaagccc

SEQ ID NO: 1662075 - DNA, 18 bp, Homo sapiens
gctctgccccaagccccc

SEQ ID NO: 1662076 - DNA, 19 bp, Homo sapiens
gctctgccccaagccccca

SEQ ID NO: 1662077 - DNA, 12 bp, Homo sapiens
gctctgccccag

SEQ ID NO: 1662078 - DNA, 13 bp, Homo sapiens
gctctgccccagg

SEQ ID NO: 1662079 - DNA, 14 bp, Homo sapiens
gctctgccccaggc

SEQ ID NO: 1662080 - DNA, 17 bp, Homo sapiens
gctctgccccaggccct

SEQ ID NO: 1662081 - DNA, 22 bp, Homo sapiens
gctctgcccccgcgggttctag

SEQ ID NO: 1662082 - DNA, 23 bp, Homo sapiens
gctctgcccccgcgggttctaga

SEQ ID NO: 1662083 - DNA, 17 bp, Homo sapiens
gctctgccccctccccc

SEQ ID NO: 1662084 - DNA, 20 bp, Homo sapiens
gctctgccctccctccttcc

SEQ ID NO: 1662085 - DNA, 15 bp, Homo sapiens
gctctgcctgtctgg

SEQ ID NO: 1662086 - DNA, 17 bp, Homo sapiens
gctctgccttctcaggc

SEQ ID NO: 1662087 - DNA, 18 bp, Homo sapiens
gctctgccttctcaggcc

SEQ ID NO: 1662088 - DNA, 17 bp, Homo sapiens
gctctgcgccaggcaga

SEQ ID NO: 1662089 - DNA, 21 bp, Homo sapiens
gctctgcgccaggcagagctg

SEQ ID NO: 1662090 - DNA, 21 bp, Homo sapiens
gctctgcttgacaacatctga

SEQ ID NO: 1662091 - DNA, 14 bp, Homo sapiens
gctctggaagagag

SEQ ID NO: 1662092 - DNA, 24 bp, Homo sapiens
gctctggaataaagttgcagatga

SEQ ID NO: 1662093 - DNA, 16 bp, Homo sapiens
gctctggacagcccca

SEQ ID NO: 1662094 - DNA, 18 bp, Homo sapiens
gctctggaggaagttctc

SEQ ID NO: 1662095 - DNA, 20 bp, Homo sapiens
gctctggaggaagttctcca

SEQ ID NO: 1662096 - DNA, 17 bp, Homo sapiens
gctctggatgaaggcaa

SEQ ID NO: 1662097 - DNA, 14 bp, Homo sapiens
gctctggcacagtg

SEQ ID NO: 1662098 - DNA, 14 bp, Homo sapiens
gctctggcaccatc

SEQ ID NO: 1662099 - DNA, 17 bp, Homo sapiens
gctctggcaccatcagc

SEQ ID NO: 1662100 - DNA, 21 bp, Homo sapiens
gctctggcaccatcagcctgt

SEQ ID NO: 1662101 - DNA, 12 bp, Homo sapiens
gctctggccacc

SEQ ID NO: 1662102 - DNA, 13 bp, Homo sapiens
gctctggccaccc

SEQ ID NO: 1662103 - DNA, 21 bp, Homo sapiens
gctctggccaccctggcccgc

SEQ ID NO: 1662104 - DNA, 18 bp, Homo sapiens
gctctggccccaggcttg

SEQ ID NO: 1662105 - DNA, 17 bp, Homo sapiens
gctctggcggcttcctg

SEQ ID NO: 1662106 - DNA, 21 bp, Homo sapiens
gctctggctgaaccctgtgct

SEQ ID NO: 1662107 - DNA, 20 bp, Homo sapiens
gctctgggacgtggacatgc

SEQ ID NO: 1662108 - DNA, 21 bp, Homo sapiens
gctctgggacgtggacatgcc

SEQ ID NO: 1662109 - DNA, 21 bp, Homo sapiens
gctctgggatagctgacccag

SEQ ID NO: 1662110 - DNA, 21 bp, Homo sapiens
gctctgggccgggcctggggc

SEQ ID NO: 1662111 - DNA, 18 bp, Homo sapiens
gctctgggctcagggctg

SEQ ID NO: 1662112 - DNA, 23 bp, Homo sapiens
gctctgggctcagggctggagtg

SEQ ID NO: 1662113 - DNA, 11 bp, Homo sapiens
gctctggggac

SEQ ID NO: 1662114 - DNA, 19 bp, Homo sapiens
gctctggggacagcttcct

SEQ ID NO: 1662115 - DNA, 19 bp, Homo sapiens
gctctggggatttctggga

SEQ ID NO: 1662116 - DNA, 13 bp, Homo sapiens
gctgcctggccag

SEQ ID NO: 1662117 - DNA, 14 bp, Homo sapiens
gctgcctggccagg

SEQ ID NO: 1662118 - DNA, 19 bp, Homo sapiens
gctgcctggccaggccctg

SEQ ID NO: 1662119 - DNA, 16 bp, Homo sapiens
gctgcctgggcccgga

SEQ ID NO: 1662120 - DNA, 18 bp, Homo sapiens
gctgcctgggctgttggc

SEQ ID NO: 1662121 - DNA, 19 bp, Homo sapiens
gctgcctgggctgttggca

SEQ ID NO: 1662122 - DNA, 22 bp, Homo sapiens
gctgccttaatgacattcccct

SEQ ID NO: 1662123 - DNA, 16 bp, Homo sapiens
gctgccttctttccat

SEQ ID NO: 1662124 - DNA, 12 bp, Homo sapiens
gctgccttgagc

SEQ ID NO: 1662125 - DNA, 14 bp, Homo sapiens
gctgccttgcttct

SEQ ID NO: 1662126 - DNA, 16 bp, Homo sapiens
gctgccttggctcaga

SEQ ID NO: 1662127 - DNA, 22 bp, Homo sapiens
gctgcctttatcttgaagtcag

SEQ ID NO: 1662128 - DNA, 19 bp, Homo sapiens
gctgcgcccttaccttccc

SEQ ID NO: 1662129 - DNA, 13 bp, Homo sapiens
gctgcgccggaca

SEQ ID NO: 1662130 - DNA, 22 bp, Homo sapiens
gctgcgcgtgtgggtctctggg

SEQ ID NO: 1662131 - DNA, 16 bp, Homo sapiens
gctgcgcttgcttttc

SEQ ID NO: 1662132 - DNA, 17 bp, Homo sapiens
gctgcggaggagctgcc

SEQ ID NO: 1662133 - DNA, 15 bp, Homo sapiens
gctgcggtgtttggc

SEQ ID NO: 1662134 - DNA, 22 bp, Homo sapiens
gctgcgtcctcatttcccctcc

SEQ ID NO: 1662135 - DNA, 16 bp, Homo sapiens
gctgctaattctttgc

SEQ ID NO: 1662136 - DNA, 18 bp, Homo sapiens
gctgctacatcagactct

SEQ ID NO: 1662137 - DNA, 15 bp, Homo sapiens
gctgctaccagcgcc

SEQ ID NO: 1662138 - DNA, 14 bp, Homo sapiens
gctgctacccagaa

SEQ ID NO: 1662139 - DNA, 13 bp, Homo sapiens
gctgctactgctg

SEQ ID NO: 1662140 - DNA, 16 bp, Homo sapiens
gctgctagagccagca

SEQ ID NO: 1662141 - DNA, 23 bp, Homo sapiens
gctgctagcacttggagccaagg

SEQ ID NO: 1662142 - DNA, 22 bp, Homo sapiens
gctgctatccccatctccctgc

SEQ ID NO: 1662143 - DNA, 18 bp, Homo sapiens
gctgctcaggcccatgct

SEQ ID NO: 1662144 - DNA, 19 bp, Homo sapiens
gctgctcccagcctcttgc

SEQ ID NO: 1662145 - DNA, 13 bp, Homo sapiens
gctgctccctggc

SEQ ID NO: 1662146 - DNA, 12 bp, Homo sapiens
gctgctccgccc

SEQ ID NO: 1662147 - DNA, 11 bp, Homo sapiens
gctgctcctcc

SEQ ID NO: 1662148 - DNA, 12 bp, Homo sapiens
gctgctcctcca

SEQ ID NO: 1662149 - DNA, 15 bp, Homo sapiens
gctgctctagctggc

SEQ ID NO: 1662150 - DNA, 13 bp, Homo sapiens
gctgctctcagcc

SEQ ID NO: 1662151 - DNA, 21 bp, Homo sapiens
gctgctctctccgaggggtgg

SEQ ID NO: 1662152 - DNA, 14 bp, Homo sapiens
gctgctctgagcca

SEQ ID NO: 1662153 - DNA, 12 bp, Homo sapiens
gctgctctgccc

SEQ ID NO: 1662154 - DNA, 10 bp, Homo sapiens
gctgctcttc

SEQ ID NO: 1662155 - DNA, 17 bp, Homo sapiens
gctgctcttgcatctgg

SEQ ID NO: 1662156 - DNA, 13 bp, Homo sapiens
gctgctgaaacaa

SEQ ID NO: 1662157 - DNA, 10 bp, Homo sapiens
gctgctgacc

SEQ ID NO: 1662158 - DNA, 12 bp, Homo sapiens
gctgctgaccaa

SEQ ID NO: 1662159 - DNA, 23 bp, Homo sapiens
gctgctgaccaattgtgctgcca

SEQ ID NO: 1662160 - DNA, 16 bp, Homo sapiens
gctgctgactgatgtt

SEQ ID NO: 1662161 - DNA, 16 bp, Homo sapiens
gctgctgatgtaggag

SEQ ID NO: 1662162 - DNA, 20 bp, Homo sapiens
gctgctgatgtaggagctgg

SEQ ID NO: 1662163 - DNA, 16 bp, Homo sapiens
gctgctgcaggacatt

SEQ ID NO: 1662164 - DNA, 14 bp, Homo sapiens
gctgctgccatcca

SEQ ID NO: 1662165 - DNA, 16 bp, Homo sapiens
gctgctgccatccatg

SEQ ID NO: 1662166 - DNA, 15 bp, Homo sapiens
gctgctgcctccctg

SEQ ID NO: 1662167 - DNA, 12 bp, Homo sapiens
gctgctgcctgc

SEQ ID NO: 1662168 - DNA, 16 bp, Homo sapiens
gctgctgcctgctcat

SEQ ID NO: 1662169 - DNA, 15 bp, Homo sapiens
gctgctgcggctgtg

SEQ ID NO: 1662170 - DNA, 15 bp, Homo sapiens
gctgctgctactgct

SEQ ID NO: 1662171 - DNA, 19 bp, Homo sapiens
gctgctggagcccgcactg

SEQ ID NO: 1662172 - DNA, 11 bp, Homo sapiens
gctgctggcca

SEQ ID NO: 1662173 - DNA, 22 bp, Homo sapiens
gctgctggccaaatagcaaaga

SEQ ID NO: 1662174 - DNA, 15 bp, Homo sapiens
gctgctggcttgcag

SEQ ID NO: 1662175 - DNA, 15 bp, Homo sapiens
gctgctggggcatgt

SEQ ID NO: 1662176 - DNA, 17 bp, Homo sapiens
gctgctggtgcacagcc

SEQ ID NO: 1662177 - DNA, 16 bp, Homo sapiens
gctgctgtaactgctg

SEQ ID NO: 1662178 - DNA, 17 bp, Homo sapiens
gctgctgtaactgctga

SEQ ID NO: 1662179 - DNA, 20 bp, Homo sapiens
gctgctgtaactgctgagcc

SEQ ID NO: 1662180 - DNA, 21 bp, Homo sapiens
gctgctgtaactgctgagcca

SEQ ID NO: 1662181 - DNA, 16 bp, Homo sapiens
gctgctgtccctcccc

SEQ ID NO: 1662182 - DNA, 14 bp, Homo sapiens
gctgctgtcttgtt

SEQ ID NO: 1662183 - DNA, 22 bp, Homo sapiens
gctgctgtgcaacggtctcctg

SEQ ID NO: 1662184 - DNA, 16 bp, Homo sapiens
gctgctgtttgggttg

SEQ ID NO: 1662185 - DNA, 15 bp, Homo sapiens
gctgcttaaactgga

SEQ ID NO: 1662186 - DNA, 18 bp, Homo sapiens
gctgcttaggtctcatgg

SEQ ID NO: 1662187 - DNA, 15 bp, Homo sapiens
gctgcttcatgtttg

SEQ ID NO: 1662188 - DNA, 14 bp, Homo sapiens
gctgcttcccagag

SEQ ID NO: 1662189 - DNA, 14 bp, Homo sapiens
gctgcttctccacc

SEQ ID NO: 1662190 - DNA, 15 bp, Homo sapiens
gctgcttctccacct

SEQ ID NO: 1662191 - DNA, 17 bp, Homo sapiens
gctgcttctccacctcc

SEQ ID NO: 1662192 - DNA, 18 bp, Homo sapiens
gctgcttctccacctccc

SEQ ID NO: 1662193 - DNA, 21 bp, Homo sapiens
gctgcttctctacagaggtga

SEQ ID NO: 1662194 - DNA, 16 bp, Homo sapiens
gctgcttgacctagct

SEQ ID NO: 1662195 - DNA, 18 bp, Homo sapiens
gctgcttgtcctgctctc

SEQ ID NO: 1662196 - DNA, 14 bp, Homo sapiens
gctgcttgtgggcc

SEQ ID NO: 1662197 - DNA, 17 bp, Homo sapiens
gctgctttcccctgtgg

SEQ ID NO: 1662198 - DNA, 18 bp, Homo sapiens
gctgctttcccctgtggg

SEQ ID NO: 1662199 - DNA, 20 bp, Homo sapiens
gctgctttcccctgtgggga

SEQ ID NO: 1662200 - DNA, 12 bp, Homo sapiens
gctgcttttctt

SEQ ID NO: 1662201 - DNA, 17 bp, Homo sapiens
gctgctttttggcacag

SEQ ID NO: 1662202 - DNA, 20 bp, Homo sapiens
gctggaaagttgggcccctg

SEQ ID NO: 1662203 - DNA, 21 bp, Homo sapiens
gctggaaagttgggcccctga

SEQ ID NO: 1662204 - DNA, 24 bp, Homo sapiens
gctggaaagttgggcccctgagga

SEQ ID NO: 1662205 - DNA, 15 bp, Homo sapiens
gctggaaataaaaca

SEQ ID NO: 1662206 - DNA, 23 bp, Homo sapiens
gctggaagaagtgagcagtgttg

SEQ ID NO: 1662207 - DNA, 20 bp, Homo sapiens
gctggaagactgtgcagaag

SEQ ID NO: 1662208 - DNA, 14 bp, Homo sapiens
gctggaagagccaa

SEQ ID NO: 1662209 - DNA, 14 bp, Homo sapiens
gctggaagatcctg

SEQ ID NO: 1662210 - DNA, 15 bp, Homo sapiens
gctggaagatcctgc

SEQ ID NO: 1662211 - DNA, 18 bp, Homo sapiens
gctggaagatcctgcggg

SEQ ID NO: 1662212 - DNA, 13 bp, Homo sapiens
gctggaagcccag

SEQ ID NO: 1662213 - DNA, 22 bp, Homo sapiens
gctggaagcccagcccctactg

SEQ ID NO: 1662214 - DNA, 17 bp, Homo sapiens
gctggaaggcagggcag

SEQ ID NO: 1662215 - DNA, 18 bp, Homo sapiens
gctggaaggcagggcaga

SEQ ID NO: 1662216 - DNA, 23 bp, Homo sapiens
gctggaaggcagggcagagggaa

SEQ ID NO: 1662217 - DNA, 16 bp, Homo sapiens
gctggaaggggcagca

SEQ ID NO: 1662218 - DNA, 19 bp, Homo sapiens
gctggaaggggcagcagga

SEQ ID NO: 1662219 - DNA, 23 bp, Homo sapiens
gctggaagtctccatgaagagct

SEQ ID NO: 1662220 - DNA, 20 bp, Homo sapiens
gctggaattccacagggacc

SEQ ID NO: 1662221 - DNA, 16 bp, Homo sapiens
gctggacaccctctgc

SEQ ID NO: 1662222 - DNA, 18 bp, Homo sapiens
gctggacaccctctgccg

SEQ ID NO: 1662223 - DNA, 14 bp, Homo sapiens
gctggactacccac

SEQ ID NO: 1662224 - DNA, 23 bp, Homo sapiens
gctggactgaccaaagactgcag

SEQ ID NO: 1662225 - DNA, 14 bp, Homo sapiens
gctggactgaggcc

SEQ ID NO: 1662226 - DNA, 17 bp, Homo sapiens
gctggactgaggcctga

SEQ ID NO: 1662227 - DNA, 18 bp, Homo sapiens
gctggactgaggcctgag

SEQ ID NO: 1662228 - DNA, 19 bp, Homo sapiens
gctggactgaggcctgagc

SEQ ID NO: 1662229 - DNA, 20 bp, Homo sapiens
gctggacttctacctgccct

SEQ ID NO: 1662230 - DNA, 19 bp, Homo sapiens
gctggagaaagagctgcct

SEQ ID NO: 1662231 - DNA, 24 bp, Homo sapiens
gctggagcagcggattgctctgga

SEQ ID NO: 1662232 - DNA, 18 bp, Homo sapiens
gctgtcctgctgccctcc

SEQ ID NO: 1662233 - DNA, 13 bp, Homo sapiens
gctgtcctggtgg

SEQ ID NO: 1662234 - DNA, 22 bp, Homo sapiens
gctgtcgatgtaggcattctgg

SEQ ID NO: 1662235 - DNA, 15 bp, Homo sapiens
gctgtcgctgcctcc

SEQ ID NO: 1662236 - DNA, 21 bp, Homo sapiens
gctgtctacagtagctgctac

SEQ ID NO: 1662237 - DNA, 13 bp, Homo sapiens
gctgtctagaatg

SEQ ID NO: 1662238 - DNA, 13 bp, Homo sapiens
gctgtctctctgg

SEQ ID NO: 1662239 - DNA, 15 bp, Homo sapiens
gctgtctctctgggc

SEQ ID NO: 1662240 - DNA, 18 bp, Homo sapiens
gctgtctctgaggggtgg

SEQ ID NO: 1662241 - DNA, 16 bp, Homo sapiens
gctgtctgaccagaga

SEQ ID NO: 1662242 - DNA, 17 bp, Homo sapiens
gctgtctgaccagagaa

SEQ ID NO: 1662243 - DNA, 18 bp, Homo sapiens
gctgtctgaccagagaat

SEQ ID NO: 1662244 - DNA, 22 bp, Homo sapiens
gctgtctgaccagagaatgcac

SEQ ID NO: 1662245 - DNA, 15 bp, Homo sapiens
gctgtctggccctgg

SEQ ID NO: 1662246 - DNA, 23 bp, Homo sapiens
gctgtcttcagtctcacagagaa

SEQ ID NO: 1662247 - DNA, 22 bp, Homo sapiens
gctgtcttctcaggctctgccc

SEQ ID NO: 1662248 - DNA, 12 bp, Homo sapiens
gctgtgaaatcc

SEQ ID NO: 1662249 - DNA, 21 bp, Homo sapiens
gctgtgaaccctggggcctga

SEQ ID NO: 1662250 - DNA, 23 bp, Homo sapiens
gctgtgacacctggtgcgggcct

SEQ ID NO: 1662251 - DNA, 18 bp, Homo sapiens
gctgtgactctgggcagg

SEQ ID NO: 1662252 - DNA, 18 bp, Homo sapiens
gctgtgagcagcctccac

SEQ ID NO: 1662253 - DNA, 13 bp, Homo sapiens
gctgtgagggagg

SEQ ID NO: 1662254 - DNA, 14 bp, Homo sapiens
gctgtgagggaggg

SEQ ID NO: 1662255 - DNA, 18 bp, Homo sapiens
gctgtgagtgtaagtgtg

SEQ ID NO: 1662256 - DNA, 20 bp, Homo sapiens
gctgtgatacgatgcttcaa

SEQ ID NO: 1662257 - DNA, 13 bp, Homo sapiens
gctgtgcaacgcc

SEQ ID NO: 1662258 - DNA, 23 bp, Homo sapiens
gctgtgcaacgccgtgggctgcg

SEQ ID NO: 1662259 - DNA, 15 bp, Homo sapiens
gctgtgcccagcagg

SEQ ID NO: 1662260 - DNA, 18 bp, Homo sapiens
gctgtgcccagcaggccc

SEQ ID NO: 1662261 - DNA, 19 bp, Homo sapiens
gctgtgcccagcaggccca

SEQ ID NO: 1662262 - DNA, 14 bp, Homo sapiens
gctgtgcctgctag

SEQ ID NO: 1662263 - DNA, 15 bp, Homo sapiens
gctgtgcctgctaga

SEQ ID NO: 1662264 - DNA, 16 bp, Homo sapiens
gctgtgcctgctagag

SEQ ID NO: 1662265 - DNA, 22 bp, Homo sapiens
gctgtgcctgctagagcaaccc

SEQ ID NO: 1662266 - DNA, 17 bp, Homo sapiens
gctgtgcctgctcagca

SEQ ID NO: 1662267 - DNA, 18 bp, Homo sapiens
gctgtgcctgctcagcag

SEQ ID NO: 1662268 - DNA, 23 bp, Homo sapiens
gctgtgcctgctcagcagccagt

SEQ ID NO: 1662269 - DNA, 18 bp, Homo sapiens
gctgtgctccatatttga

SEQ ID NO: 1662270 - DNA, 11 bp, Homo sapiens
gctgtgctgca

SEQ ID NO: 1662271 - DNA, 11 bp, Homo sapiens
gctgtgctgga

SEQ ID NO: 1662272 - DNA, 12 bp, Homo sapiens
gctgtgctggaa

SEQ ID NO: 1662273 - DNA, 19 bp, Homo sapiens
gctgtgcttgaaggccctg

SEQ ID NO: 1662274 - DNA, 23 bp, Homo sapiens
gctgtgcttgaaggccctgctga

SEQ ID NO: 1662275 - DNA, 20 bp, Homo sapiens
gctgtggaccgtggacaggc

SEQ ID NO: 1662276 - DNA, 24 bp, Homo sapiens
gctgtggaccgtggacaggcccag

SEQ ID NO: 1662277 - DNA, 19 bp, Homo sapiens
gctgtggactgtcctgagg

SEQ ID NO: 1662278 - DNA, 17 bp, Homo sapiens
gctgtggaggattgcta

SEQ ID NO: 1662279 - DNA, 23 bp, Homo sapiens
gctgtggaggattgctatctgga

SEQ ID NO: 1662280 - DNA, 12 bp, Homo sapiens
gctgtggcacag

SEQ ID NO: 1662281 - DNA, 16 bp, Homo sapiens
gctgtggctccctcct

SEQ ID NO: 1662282 - DNA, 17 bp, Homo sapiens
gctgtgggatgtgccag

SEQ ID NO: 1662283 - DNA, 18 bp, Homo sapiens
gctgtgggcgagcatggg

SEQ ID NO: 1662284 - DNA, 23 bp, Homo sapiens
gctgtggggaacatggctggcct

SEQ ID NO: 1662285 - DNA, 22 bp, Homo sapiens
gctgtggtaagggttgggcccc

SEQ ID NO: 1662286 - DNA, 20 bp, Homo sapiens
gctgtggtggggagaggcat

SEQ ID NO: 1662287 - DNA, 18 bp, Homo sapiens
gctgtgtccttgcacctg

SEQ ID NO: 1662288 - DNA, 18 bp, Homo sapiens
gctgtgtctcctctcaga

SEQ ID NO: 1662289 - DNA, 19 bp, Homo sapiens
gctgtgtctgccaaacaca

SEQ ID NO: 1662290 - DNA, 21 bp, Homo sapiens
gctgtgtctgccaaacacatt

SEQ ID NO: 1662291 - DNA, 21 bp, Homo sapiens
gctgtgtcttcattttcatta

SEQ ID NO: 1662292 - DNA, 20 bp, Homo sapiens
gctgtgtgaatacctgctca

SEQ ID NO: 1662293 - DNA, 22 bp, Homo sapiens
gctgtgtgacagaatcttgtat

SEQ ID NO: 1662294 - DNA, 14 bp, Homo sapiens
gctgtgtgattaga

SEQ ID NO: 1662295 - DNA, 12 bp, Homo sapiens
gctgtgtgcccc

SEQ ID NO: 1662296 - DNA, 19 bp, Homo sapiens
gctgtgtgccccactccag

SEQ ID NO: 1662297 - DNA, 18 bp, Homo sapiens
gctgtgtgctttttttgt

SEQ ID NO: 1662298 - DNA, 23 bp, Homo sapiens
gctgtgtgtcccaggcagggaga

SEQ ID NO: 1662299 - DNA, 18 bp, Homo sapiens
gctgtgtgttagttccca

SEQ ID NO: 1662300 - DNA, 18 bp, Homo sapiens
gctgtgttaaataaacct

SEQ ID NO: 1662301 - DNA, 18 bp, Homo sapiens
gctgtgttttgtctgagc

SEQ ID NO: 1662302 - DNA, 15 bp, Homo sapiens
gctgttaatatttct

SEQ ID NO: 1662303 - DNA, 16 bp, Homo sapiens
gctgttattcttgtta

SEQ ID NO: 1662304 - DNA, 20 bp, Homo sapiens
gctgttatttcttccctgct

SEQ ID NO: 1662305 - DNA, 22 bp, Homo sapiens
gctgttatttcttccctgcttt

SEQ ID NO: 1662306 - DNA, 20 bp, Homo sapiens
gctgttcacccacagggcta

SEQ ID NO: 1662307 - DNA, 21 bp, Homo sapiens
gctgttcctgttcagtaataa

SEQ ID NO: 1662308 - DNA, 21 bp, Homo sapiens
gctgttctgtggttcctctgc

SEQ ID NO: 1662309 - DNA, 23 bp, Homo sapiens
gctgttcttcaactcctgggctc

SEQ ID NO: 1662310 - DNA, 12 bp, Homo sapiens
gctgttgagctg

SEQ ID NO: 1662311 - DNA, 16 bp, Homo sapiens
gctgttgccatagccc

SEQ ID NO: 1662312 - DNA, 17 bp, Homo sapiens
gctgttgccatagcccc

SEQ ID NO: 1662313 - DNA, 18 bp, Homo sapiens
gctgttgctatttgtatt

SEQ ID NO: 1662314 - DNA, 17 bp, Homo sapiens
gctgttggacagctgct

SEQ ID NO: 1662315 - DNA, 13 bp, Homo sapiens
gctgttggcactc

SEQ ID NO: 1662316 - DNA, 17 bp, Homo sapiens
gctgttgggagaaagca

SEQ ID NO: 1662317 - DNA, 13 bp, Homo sapiens
gctgttgggatat

SEQ ID NO: 1662318 - DNA, 16 bp, Homo sapiens
gctgttggtcctctct

SEQ ID NO: 1662319 - DNA, 15 bp, Homo sapiens
gctgtttactgcttt

SEQ ID NO: 1662320 - DNA, 17 bp, Homo sapiens
gctgtttatggcctcag

SEQ ID NO: 1662321 - DNA, 21 bp, Homo sapiens
gctgtttattttttttggcct

SEQ ID NO: 1662322 - DNA, 13 bp, Homo sapiens
gctgtttccatag

SEQ ID NO: 1662323 - DNA, 16 bp, Homo sapiens
gctgtttctcatgaag

SEQ ID NO: 1662324 - DNA, 18 bp, Homo sapiens
gctgtttctcatgaagct

SEQ ID NO: 1662325 - DNA, 21 bp, Homo sapiens
gctgtttgggttgttggtctg

SEQ ID NO: 1662326 - DNA, 22 bp, Homo sapiens
gctgtttgggttgttggtctgt

SEQ ID NO: 1662327 - DNA, 12 bp, Homo sapiens
gctgtttgtcat

SEQ ID NO: 1662328 - DNA, 17 bp, Homo sapiens
gctgtttgtcctgagat

SEQ ID NO: 1662329 - DNA, 17 bp, Homo sapiens
gctgttttccctgacct

SEQ ID NO: 1662330 - DNA, 18 bp, Homo sapiens
gctgttttgttctgtggt

SEQ ID NO: 1662331 - DNA, 14 bp, Homo sapiens
gcttaaaaaaacaa

SEQ ID NO: 1662332 - DNA, 21 bp, Homo sapiens
gcttaaaataagcaggtggat

SEQ ID NO: 1662333 - DNA, 19 bp, Homo sapiens
gcttaaacacaagaaggaa

SEQ ID NO: 1662334 - DNA, 18 bp, Homo sapiens
gcttaaacccatacaatg

SEQ ID NO: 1662335 - DNA, 20 bp, Homo sapiens
gcttaaacccatacaatgta

SEQ ID NO: 1662336 - DNA, 21 bp, Homo sapiens
gcttaaacccatacaatgtat

SEQ ID NO: 1662337 - DNA, 23 bp, Homo sapiens
gcttaaacccatacaatgtatgt

SEQ ID NO: 1662338 - DNA, 22 bp, Homo sapiens
gcttaaacccatattgtaaaac

SEQ ID NO: 1662339 - DNA, 12 bp, Homo sapiens
gcttaaagatgt

SEQ ID NO: 1662340 - DNA, 19 bp, Homo sapiens
gcttaaagcatcctcctcc

SEQ ID NO: 1662341 - DNA, 14 bp, Homo sapiens
gcttaaatccagtt

SEQ ID NO: 1662342 - DNA, 13 bp, Homo sapiens
gcttaaatttctt

SEQ ID NO: 1662343 - DNA, 20 bp, Homo sapiens
gcttaacattgacttcttgg

SEQ ID NO: 1662344 - DNA, 16 bp, Homo sapiens
gcttaatcattttcat

SEQ ID NO: 1662345 - DNA, 21 bp, Homo sapiens
gcttaatcattttcattccta

SEQ ID NO: 1662346 - DNA, 22 bp, Homo sapiens
gctttacagtttttttctttgt

SEQ ID NO: 1662347 - DNA, 17 bp, Homo sapiens
gctttacatgctgtgct

SEQ ID NO: 1662348 - DNA, 18 bp, Homo sapiens
gctttagagataattgct

SEQ ID NO: 1662349 - DNA, 19 bp, Homo sapiens
gctttagagataattgctt

SEQ ID NO: 1662350 - DNA, 15 bp, Homo sapiens
gctttagtttcacat

SEQ ID NO: 1662351 - DNA, 21 bp, Homo sapiens
gctttatgataatagattctc

SEQ ID NO: 1662352 - DNA, 16 bp, Homo sapiens
gctttatgggggggag

SEQ ID NO: 1662353 - DNA, 21 bp, Homo sapiens
gctttatttgttttttttgtt

SEQ ID NO: 1662354 - DNA, 17 bp, Homo sapiens
gctttcagagccagtga

SEQ ID NO: 1662355 - DNA, 18 bp, Homo sapiens
gctttcatgattagcaag

SEQ ID NO: 1662356 - DNA, 21 bp, Homo sapiens
gctttccatgttgctgccaac

SEQ ID NO: 1662357 - DNA, 15 bp, Homo sapiens
gctttcccacttccc

SEQ ID NO: 1662358 - DNA, 22 bp, Homo sapiens
gctttcccacttcccaccctgc

SEQ ID NO: 1662359 - DNA, 20 bp, Homo sapiens
gctttcccagaggacaccta

SEQ ID NO: 1662360 - DNA, 17 bp, Homo sapiens
gctttcccaggagaaag

SEQ ID NO: 1662361 - DNA, 21 bp, Homo sapiens
gctttccccgggggaggaagg

SEQ ID NO: 1662362 - DNA, 18 bp, Homo sapiens
gctttccctgaggaatga

SEQ ID NO: 1662363 - DNA, 20 bp, Homo sapiens
gctttcctcaaaaagcagaa

SEQ ID NO: 1662364 - DNA, 19 bp, Homo sapiens
gctttcctgccccaggcct

SEQ ID NO: 1662365 - DNA, 15 bp, Homo sapiens
gctttcctggtccct

SEQ ID NO: 1662366 - DNA, 16 bp, Homo sapiens
gctttcctggtccctc

SEQ ID NO: 1662367 - DNA, 18 bp, Homo sapiens
gctttccttctccaggaa

SEQ ID NO: 1662368 - DNA, 19 bp, Homo sapiens
gctttcctttctttactat

SEQ ID NO: 1662369 - DNA, 19 bp, Homo sapiens
gctttccttttatttttta

SEQ ID NO: 1662370 - DNA, 22 bp, Homo sapiens
gctttcctttttcccaataaat

SEQ ID NO: 1662371 - DNA, 17 bp, Homo sapiens
gctttcgtccatgtttc

SEQ ID NO: 1662372 - DNA, 13 bp, Homo sapiens
gctttctcaatgt

SEQ ID NO: 1662373 - DNA, 15 bp, Homo sapiens
gctttctccggggtc

SEQ ID NO: 1662374 - DNA, 15 bp, Homo sapiens
gctttctcctgtgcc

SEQ ID NO: 1662375 - DNA, 16 bp, Homo sapiens
gctttctcctgtgccc

SEQ ID NO: 1662376 - DNA, 20 bp, Homo sapiens
gctttctctctggcttctct

SEQ ID NO: 1662377 - DNA, 21 bp, Homo sapiens
gctttctctctggcttctctc

SEQ ID NO: 1662378 - DNA, 22 bp, Homo sapiens
gctttctctctggcttctctct

SEQ ID NO: 1662379 - DNA, 23 bp, Homo sapiens
gctttctctctggcttctctctt

SEQ ID NO: 1662380 - DNA, 14 bp, Homo sapiens
gctttctcttcata

SEQ ID NO: 1662381 - DNA, 21 bp, Homo sapiens
gctttctcttccccttcctgt

SEQ ID NO: 1662382 - DNA, 14 bp, Homo sapiens
gctttctgaattgg

SEQ ID NO: 1662383 - DNA, 22 bp, Homo sapiens
gctttctgggatgtcacagtcc

SEQ ID NO: 1662384 - DNA, 14 bp, Homo sapiens
gctttctggggcct

SEQ ID NO: 1662385 - DNA, 15 bp, Homo sapiens
gctttcttacctact

SEQ ID NO: 1662386 - DNA, 19 bp, Homo sapiens
gctttctttagaattttta

SEQ ID NO: 1662387 - DNA, 21 bp, Homo sapiens
gctttctttggtaggtaaatc

SEQ ID NO: 1662388 - DNA, 15 bp, Homo sapiens
gctttgaaagaagca

SEQ ID NO: 1662389 - DNA, 17 bp, Homo sapiens
gctttgaaagaagcaag

SEQ ID NO: 1662390 - DNA, 21 bp, Homo sapiens
gctttgcaaattcaagagcct

SEQ ID NO: 1662391 - DNA, 14 bp, Homo sapiens
gctttgcaggctct

SEQ ID NO: 1662392 - DNA, 21 bp, Homo sapiens
gctttgccaaaataccagagc

SEQ ID NO: 1662393 - DNA, 19 bp, Homo sapiens
gctttgccataaccacatt

SEQ ID NO: 1662394 - DNA, 14 bp, Homo sapiens
gctttgcccacccc

SEQ ID NO: 1662395 - DNA, 22 bp, Homo sapiens
gctttgctacaaatttatgcat

SEQ ID NO: 1662396 - DNA, 22 bp, Homo sapiens
gctttgctgcacaaacatgaaa

SEQ ID NO: 1662397 - DNA, 12 bp, Homo sapiens
gctttgctgcta

SEQ ID NO: 1662398 - DNA, 14 bp, Homo sapiens
gctttgctgctatg

SEQ ID NO: 1662399 - DNA, 15 bp, Homo sapiens
gctttgctgctatga

SEQ ID NO: 1662400 - DNA, 15 bp, Homo sapiens
gctttggctgagacc

SEQ ID NO: 1662401 - DNA, 16 bp, Homo sapiens
gctttggctgagacct

SEQ ID NO: 1662402 - DNA, 21 bp, Homo sapiens
gctttgggaacactggcctgg

SEQ ID NO: 1662403 - DNA, 22 bp, Homo sapiens
gctttgggaacactggcctggg

SEQ ID NO: 1662404 - DNA, 14 bp, Homo sapiens
gctttgggaggcca

SEQ ID NO: 1662405 - DNA, 17 bp, Homo sapiens
gctttgggaggccaagg

SEQ ID NO: 1662406 - DNA, 19 bp, Homo sapiens
gctttgggaggccaaggca

SEQ ID NO: 1662407 - DNA, 21 bp, Homo sapiens
gctttgggaggccaaggcagg

SEQ ID NO: 1662408 - DNA, 19 bp, Homo sapiens
gctttgggtgaccagccac

SEQ ID NO: 1662409 - DNA, 17 bp, Homo sapiens
gctttggttaaaaatgg

SEQ ID NO: 1662410 - DNA, 18 bp, Homo sapiens
gctttggttccttctctg

SEQ ID NO: 1662411 - DNA, 19 bp, Homo sapiens
gctttggttccttctctgg

SEQ ID NO: 1662412 - DNA, 20 bp, Homo sapiens
gctttgtagagttttgtcat

SEQ ID NO: 1662413 - DNA, 13 bp, Homo sapiens
gctttgtctctgt

SEQ ID NO: 1662414 - DNA, 19 bp, Homo sapiens
gctttgtgattccatggat

SEQ ID NO: 1662415 - DNA, 14 bp, Homo sapiens
gctttgtttgttct

SEQ ID NO: 1662416 - DNA, 15 bp, Homo sapiens
gctttgtttgttctt

SEQ ID NO: 1662417 - DNA, 15 bp, Homo sapiens
gcttttaaaaatgtt

SEQ ID NO: 1662418 - DNA, 17 bp, Homo sapiens
gcttttaaaaatgtttg

SEQ ID NO: 1662419 - DNA, 19 bp, Homo sapiens
gcttttaagaaacacaggg

SEQ ID NO: 1662420 - DNA, 16 bp, Homo sapiens
gcttttaattctcatt

SEQ ID NO: 1662421 - DNA, 19 bp, Homo sapiens
gcttttaattctcatttgt

SEQ ID NO: 1662422 - DNA, 20 bp, Homo sapiens
gcttttaccatgcccctgag

SEQ ID NO: 1662423 - DNA, 16 bp, Homo sapiens
gcttttagaatgcagg

SEQ ID NO: 1662424 - DNA, 22 bp, Homo sapiens
gcttttatagaggctagcttct

SEQ ID NO: 1662425 - DNA, 22 bp, Homo sapiens
gcttttcctcaaagggagagag

SEQ ID NO: 1662426 - DNA, 20 bp, Homo sapiens
gcttttcctgttaaggcaga

SEQ ID NO: 1662427 - DNA, 17 bp, Homo sapiens
gcttttctgccactcca

SEQ ID NO: 1662428 - DNA, 14 bp, Homo sapiens
gcttttctgccctg

SEQ ID NO: 1662429 - DNA, 16 bp, Homo sapiens
gcttttctgccctggc

SEQ ID NO: 1662430 - DNA, 19 bp, Homo sapiens
gcttttctgccctggctgc

SEQ ID NO: 1662431 - DNA, 22 bp, Homo sapiens
gcttttctgccctggctgctgc

SEQ ID NO: 1662432 - DNA, 12 bp, Homo sapiens
gcttttctgtcc

SEQ ID NO: 1662433 - DNA, 15 bp, Homo sapiens
gcttttctttttctg

SEQ ID NO: 1662434 - DNA, 21 bp, Homo sapiens
gcttttgccactttggcttct

SEQ ID NO: 1662435 - DNA, 22 bp, Homo sapiens
gcttttgccactttggcttctc

SEQ ID NO: 1662436 - DNA, 13 bp, Homo sapiens
gcttttgctagat

SEQ ID NO: 1662437 - DNA, 14 bp, Homo sapiens
gcttttggttaata

SEQ ID NO: 1662438 - DNA, 15 bp, Homo sapiens
gcttttgttgtgact

SEQ ID NO: 1662439 - DNA, 14 bp, Homo sapiens
gcttttgttgttta

SEQ ID NO: 1662440 - DNA, 21 bp, Homo sapiens
gcttttgtttcctttttcaga

SEQ ID NO: 1662441 - DNA, 14 bp, Homo sapiens
gcttttgttttttt

SEQ ID NO: 1662442 - DNA, 11 bp, Homo sapiens
gctttttaatg

SEQ ID NO: 1662443 - DNA, 13 bp, Homo sapiens
gctttttcacagt

SEQ ID NO: 1662444 - DNA, 15 bp, Homo sapiens
gctttttcacagtca

SEQ ID NO: 1662445 - DNA, 12 bp, Homo sapiens
gctttttggaaa

SEQ ID NO: 1662446 - DNA, 12 bp, Homo sapiens
gctttttggaat

SEQ ID NO: 1662447 - DNA, 20 bp, Homo sapiens
gcttttttaggctacagtgt

SEQ ID NO: 1662448 - DNA, 20 bp, Homo sapiens
gcttttttccaaaacaaaaa

SEQ ID NO: 1662449 - DNA, 18 bp, Homo sapiens
gcttttttgttttgtgct

SEQ ID NO: 1662450 - DNA, 20 bp, Homo sapiens
gctttttttgaaactttgag

SEQ ID NO: 1662451 - DNA, 15 bp, Homo sapiens
ggaaaaaaaaacagc

SEQ ID NO: 1662452 - DNA, 15 bp, Homo sapiens
ggaaaaaaacaaaaa

SEQ ID NO: 1662453 - DNA, 21 bp, Homo sapiens
ggaaaaaaacataaaaagcag

SEQ ID NO: 1662454 - DNA, 14 bp, Homo sapiens
ggaaaaaaatgact

SEQ ID NO: 1662455 - DNA, 13 bp, Homo sapiens
ggaaaaaaattac

SEQ ID NO: 1662456 - DNA, 15 bp, Homo sapiens
ggaaaaaagcaaaaa

SEQ ID NO: 1662457 - DNA, 15 bp, Homo sapiens
ggaaaaaagttttga

SEQ ID NO: 1662458 - DNA, 21 bp, Homo sapiens
ggaaaaacatctgaaagccac

SEQ ID NO: 1662459 - DNA, 19 bp, Homo sapiens
ggaaaaagtgggtttttta

SEQ ID NO: 1662460 - DNA, 22 bp, Homo sapiens
ggaagtgaatccttaaccctaa

SEQ ID NO: 1662461 - DNA, 14 bp, Homo sapiens
ggaagtgaggccca

SEQ ID NO: 1662462 - DNA, 12 bp, Homo sapiens
ggaagtgcccag

SEQ ID NO: 1662463 - DNA, 16 bp, Homo sapiens
ggaagtgcccagcccc

SEQ ID NO: 1662464 - DNA, 17 bp, Homo sapiens
ggaagtgcttgatatgt

SEQ ID NO: 1662465 - DNA, 23 bp, Homo sapiens
ggaagttatggcagtgatgccga

SEQ ID NO: 1662466 - DNA, 13 bp, Homo sapiens
ggaagttctccag

SEQ ID NO: 1662467 - DNA, 13 bp, Homo sapiens
ggaagtttagaga

SEQ ID NO: 1662468 - DNA, 19 bp, Homo sapiens
ggaagtttggtcagagtga

SEQ ID NO: 1662469 - DNA, 15 bp, Homo sapiens
ggaataaaaggcttg

SEQ ID NO: 1662470 - DNA, 15 bp, Homo sapiens
ggaataaaatgattt

SEQ ID NO: 1662471 - DNA, 22 bp, Homo sapiens
ggaataaaatgatttgtggaaa

SEQ ID NO: 1662472 - DNA, 22 bp, Homo sapiens
ggaataaattatggcatttcta

SEQ ID NO: 1662473 - DNA, 14 bp, Homo sapiens
ggaataacactgca

SEQ ID NO: 1662474 - DNA, 17 bp, Homo sapiens
ggaataacactgcagcc

SEQ ID NO: 1662475 - DNA, 15 bp, Homo sapiens
ggaataacctttctg

SEQ ID NO: 1662476 - DNA, 14 bp, Homo sapiens
ggaataattgcttt

SEQ ID NO: 1662477 - DNA, 15 bp, Homo sapiens
ggaatagccagagag

SEQ ID NO: 1662478 - DNA, 20 bp, Homo sapiens
ggaatagggagacagggtag

SEQ ID NO: 1662479 - DNA, 19 bp, Homo sapiens
ggaatagtgcttgctggcc

SEQ ID NO: 1662480 - DNA, 23 bp, Homo sapiens
ggaatataaggaaagcaataaat

SEQ ID NO: 1662481 - DNA, 18 bp, Homo sapiens
ggaatatatgtgtgccta

SEQ ID NO: 1662482 - DNA, 15 bp, Homo sapiens
ggaatattttatcct

SEQ ID NO: 1662483 - DNA, 16 bp, Homo sapiens
ggaatattttatcctg

SEQ ID NO: 1662484 - DNA, 20 bp, Homo sapiens
ggaatccaaaagacaaaaat

SEQ ID NO: 1662485 - DNA, 20 bp, Homo sapiens
ggaatccaagcctccacagc

SEQ ID NO: 1662486 - DNA, 21 bp, Homo sapiens
ggaatccaagcctccacagcg

SEQ ID NO: 1662487 - DNA, 14 bp, Homo sapiens
ggaatcctcctcca

SEQ ID NO: 1662488 - DNA, 17 bp, Homo sapiens
ggaatctgtttctctgc

SEQ ID NO: 1662489 - DNA, 18 bp, Homo sapiens
ggaatctgtttctctgct

SEQ ID NO: 1662490 - DNA, 17 bp, Homo sapiens
ggaatcttcacctcaga

SEQ ID NO: 1662491 - DNA, 22 bp, Homo sapiens
ggaatcttcacctcagagtgga

SEQ ID NO: 1662492 - DNA, 13 bp, Homo sapiens
ggaatcttcacta

SEQ ID NO: 1662493 - DNA, 20 bp, Homo sapiens
ggaatgaaattaacacaaag

SEQ ID NO: 1662494 - DNA, 14 bp, Homo sapiens
ggaatgactgggga

SEQ ID NO: 1662495 - DNA, 19 bp, Homo sapiens
ggaatgcccttcactgtca

SEQ ID NO: 1662496 - DNA, 19 bp, Homo sapiens
ggaatgccgctgtctctga

SEQ ID NO: 1662497 - DNA, 16 bp, Homo sapiens
ggaatgcctgtgccaa

SEQ ID NO: 1662498 - DNA, 14 bp, Homo sapiens
ggaatgctggactg

SEQ ID NO: 1662499 - DNA, 20 bp, Homo sapiens
ggaatggggggcgggccagg

SEQ ID NO: 1662500 - DNA, 21 bp, Homo sapiens
ggaatggggggcgggccaggg

SEQ ID NO: 1662501 - DNA, 18 bp, Homo sapiens
ggaatgtcagggccaggt

SEQ ID NO: 1662502 - DNA, 15 bp, Homo sapiens
ggaatgtgtggcctg

SEQ ID NO: 1662503 - DNA, 16 bp, Homo sapiens
ggaatgttaaagtcag

SEQ ID NO: 1662504 - DNA, 17 bp, Homo sapiens
ggaatgttccctgcacc

SEQ ID NO: 1662505 - DNA, 21 bp, Homo sapiens
ggaatgttccctgcaccctgg

SEQ ID NO: 1662506 - DNA, 14 bp, Homo sapiens
ggaattaaaaagaa

SEQ ID NO: 1662507 - DNA, 16 bp, Homo sapiens
ggaattaaaaagaaga

SEQ ID NO: 1662508 - DNA, 21 bp, Homo sapiens
ggaattcagcaccctgggtgc

SEQ ID NO: 1662509 - DNA, 19 bp, Homo sapiens
ggaattcagtgccttcaac

SEQ ID NO: 1662510 - DNA, 20 bp, Homo sapiens
ggaattccacagggaccagg

SEQ ID NO: 1662511 - DNA, 15 bp, Homo sapiens
ggaattccctccccc

SEQ ID NO: 1662512 - DNA, 19 bp, Homo sapiens
ggaattcctctttaacaag

SEQ ID NO: 1662513 - DNA, 20 bp, Homo sapiens
ggaattcctcttttgcttaa

SEQ ID NO: 1662514 - DNA, 16 bp, Homo sapiens
ggaattctactggaaa

SEQ ID NO: 1662515 - DNA, 10 bp, Homo sapiens
ggaattgaaa

SEQ ID NO: 1662516 - DNA, 21 bp, Homo sapiens
ggaattggtggcagattttac

SEQ ID NO: 1662517 - DNA, 11 bp, Homo sapiens
ggaatttaaaa

SEQ ID NO: 1662518 - DNA, 13 bp, Homo sapiens
ggaatttgtactt

SEQ ID NO: 1662519 - DNA, 14 bp, Homo sapiens
ggaatttgtacttc

SEQ ID NO: 1662520 - DNA, 13 bp, Homo sapiens
ggaatttgtcagc

SEQ ID NO: 1662521 - DNA, 23 bp, Homo sapiens
ggaatttttttttcctggaattt

SEQ ID NO: 1662522 - DNA, 18 bp, Homo sapiens
ggacaaaacccaccttgt

SEQ ID NO: 1662523 - DNA, 13 bp, Homo sapiens
ggacaaaatgtta

SEQ ID NO: 1662524 - DNA, 18 bp, Homo sapiens
ggacaaagtctccagccc

SEQ ID NO: 1662525 - DNA, 20 bp, Homo sapiens
ggacaaagtctccagcccac

SEQ ID NO: 1662526 - DNA, 24 bp, Homo sapiens
ggacaaagtctccagcccacgttc

SEQ ID NO: 1662527 - DNA, 20 bp, Homo sapiens
ggacaacattttactactga

SEQ ID NO: 1662528 - DNA, 17 bp, Homo sapiens
ggacaacttatttaaaa

SEQ ID NO: 1662529 - DNA, 16 bp, Homo sapiens
ggacaagacccccagc

SEQ ID NO: 1662530 - DNA, 16 bp, Homo sapiens
ggacaagggaggcagt

SEQ ID NO: 1662531 - DNA, 23 bp, Homo sapiens
ggacaagggggaggaaaggggcg

SEQ ID NO: 1662532 - DNA, 18 bp, Homo sapiens
ggacaatcagtcccctcc

SEQ ID NO: 1662533 - DNA, 22 bp, Homo sapiens
ggacaatcagtcccctcccatc

SEQ ID NO: 1662534 - DNA, 21 bp, Homo sapiens
ggacaatcatgaaatatgcat

SEQ ID NO: 1662535 - DNA, 19 bp, Homo sapiens
ggacacacatggtgagcct

SEQ ID NO: 1662536 - DNA, 21 bp, Homo sapiens
ggacacagcacaagggcacat

SEQ ID NO: 1662537 - DNA, 13 bp, Homo sapiens
ggacacagctctt

SEQ ID NO: 1662538 - DNA, 14 bp, Homo sapiens
ggacacagctcttc

SEQ ID NO: 1662539 - DNA, 22 bp, Homo sapiens
ggacacagctcttcattccatt

SEQ ID NO: 1662540 - DNA, 15 bp, Homo sapiens
ggacacagtggagcc

SEQ ID NO: 1662541 - DNA, 17 bp, Homo sapiens
ggacacagttcctggga

SEQ ID NO: 1662542 - DNA, 18 bp, Homo sapiens
ggacacagttcctgggaa

SEQ ID NO: 1662543 - DNA, 14 bp, Homo sapiens
ggacacatcccggc

SEQ ID NO: 1662544 - DNA, 20 bp, Homo sapiens
ggacacatcccggcctcttc

SEQ ID NO: 1662545 - DNA, 22 bp, Homo sapiens
ggacacatcccggcctcttcca

SEQ ID NO: 1662546 - DNA, 16 bp, Homo sapiens
ggacaccagtgaaaga

SEQ ID NO: 1662547 - DNA, 22 bp, Homo sapiens
ggacaccatagtgtcacagaga

SEQ ID NO: 1662548 - DNA, 21 bp, Homo sapiens
ggacaccattaccaaaataat

SEQ ID NO: 1662549 - DNA, 23 bp, Homo sapiens
ggacacctggccgcctccaggag

SEQ ID NO: 1662550 - DNA, 14 bp, Homo sapiens
ggacacgagccaca

SEQ ID NO: 1662551 - DNA, 22 bp, Homo sapiens
ggacacgagccacaagctgcac

SEQ ID NO: 1662552 - DNA, 23 bp, Homo sapiens
ggacacgagccacaagctgcact

SEQ ID NO: 1662553 - DNA, 20 bp, Homo sapiens
ggacacggcttcactgacca

SEQ ID NO: 1662554 - DNA, 20 bp, Homo sapiens
ggacactcctcctcggaaga

SEQ ID NO: 1662555 - DNA, 23 bp, Homo sapiens
ggacactcctcctcggaagagcc

SEQ ID NO: 1662556 - DNA, 13 bp, Homo sapiens
ggacactgggcag

SEQ ID NO: 1662557 - DNA, 15 bp, Homo sapiens
ggacactgggcagca

SEQ ID NO: 1662558 - DNA, 21 bp, Homo sapiens
ggacacttccctctgtttctc

SEQ ID NO: 1662559 - DNA, 14 bp, Homo sapiens
ggacacttcctgcc

SEQ ID NO: 1662560 - DNA, 15 bp, Homo sapiens
ggacacttcctgcct

SEQ ID NO: 1662561 - DNA, 20 bp, Homo sapiens
ggacactttgaaatgtgttt

SEQ ID NO: 1662562 - DNA, 18 bp, Homo sapiens
ggacagaaggactggtgc

SEQ ID NO: 1662563 - DNA, 22 bp, Homo sapiens
ggacagaatgtgttcttttctc

SEQ ID NO: 1662564 - DNA, 14 bp, Homo sapiens
ggacagagacacct

SEQ ID NO: 1662565 - DNA, 17 bp, Homo sapiens
ggacagagacacctgca

SEQ ID NO: 1662566 - DNA, 18 bp, Homo sapiens
ggacagagacacctgcac

SEQ ID NO: 1662567 - DNA, 11 bp, Homo sapiens
ggacagagcca

SEQ ID NO: 1662568 - DNA, 18 bp, Homo sapiens
ggacagagcttgaagcct

SEQ ID NO: 1662569 - DNA, 23 bp, Homo sapiens
ggacagaggccccagcctccctg

SEQ ID NO: 1662570 - DNA, 16 bp, Homo sapiens
ggacagagggcacatg

SEQ ID NO: 1662571 - DNA, 18 bp, Homo sapiens
ggacagagggcacatgaa

SEQ ID NO: 1662572 - DNA, 16 bp, Homo sapiens
ggacagagggtggctg

SEQ ID NO: 1662573 - DNA, 17 bp, Homo sapiens
ggacagagggtggctgg

SEQ ID NO: 1662574 - DNA, 15 bp, Homo sapiens
ggagcagccagagct

SEQ ID NO: 1662575 - DNA, 14 bp, Homo sapiens
ggagcagctgtgct

SEQ ID NO: 1662576 - DNA, 21 bp, Homo sapiens
ggagcagcttccttctgggac

SEQ ID NO: 1662577 - DNA, 13 bp, Homo sapiens
ggagcagggaagg

SEQ ID NO: 1662578 - DNA, 19 bp, Homo sapiens
ggagcagggaaggcctgac

SEQ ID NO: 1662579 - DNA, 17 bp, Homo sapiens
ggagcaggttccccaag

SEQ ID NO: 1662580 - DNA, 18 bp, Homo sapiens
ggagcaggttccccaagg

SEQ ID NO: 1662581 - DNA, 23 bp, Homo sapiens
ggagcaggttccccaagggccct

SEQ ID NO: 1662582 - DNA, 12 bp, Homo sapiens
ggagcagtgtct

SEQ ID NO: 1662583 - DNA, 17 bp, Homo sapiens
ggagcagttttcccctg

SEQ ID NO: 1662584 - DNA, 22 bp, Homo sapiens
ggagcagttttcccctggcctc

SEQ ID NO: 1662585 - DNA, 22 bp, Homo sapiens
ggagcatatgattgctccagag

SEQ ID NO: 1662586 - DNA, 18 bp, Homo sapiens
ggagcatgcgcagaggcc

SEQ ID NO: 1662587 - DNA, 14 bp, Homo sapiens
ggagcatgggcctg

SEQ ID NO: 1662588 - DNA, 16 bp, Homo sapiens
ggagcattggcccctg

SEQ ID NO: 1662589 - DNA, 15 bp, Homo sapiens
ggagccaagtggtcc

SEQ ID NO: 1662590 - DNA, 16 bp, Homo sapiens
ggagccaatgaacagc

SEQ ID NO: 1662591 - DNA, 17 bp, Homo sapiens
ggagccactcctgtccc

SEQ ID NO: 1662592 - DNA, 15 bp, Homo sapiens
ggagccacttctccc

SEQ ID NO: 1662593 - DNA, 14 bp, Homo sapiens
ggagccagcagggc

SEQ ID NO: 1662594 - DNA, 12 bp, Homo sapiens
ggagccagctct

SEQ ID NO: 1662595 - DNA, 12 bp, Homo sapiens
ggagccaggagt

SEQ ID NO: 1662596 - DNA, 22 bp, Homo sapiens
ggagccaggagtaagacaagtg

SEQ ID NO: 1662597 - DNA, 12 bp, Homo sapiens
ggagccagggca

SEQ ID NO: 1662598 - DNA, 14 bp, Homo sapiens
ggagccagggcaga

SEQ ID NO: 1662599 - DNA, 20 bp, Homo sapiens
ggagccaggttgtcgggccc

SEQ ID NO: 1662600 - DNA, 15 bp, Homo sapiens
ggagccagtcctcca

SEQ ID NO: 1662601 - DNA, 21 bp, Homo sapiens
ggagccatcccttcggagcca

SEQ ID NO: 1662602 - DNA, 22 bp, Homo sapiens
ggagccatgcgccccctccgcc

SEQ ID NO: 1662603 - DNA, 12 bp, Homo sapiens
ggagcccactgt

SEQ ID NO: 1662604 - DNA, 23 bp, Homo sapiens
ggagcccactgtcctgggcctgc

SEQ ID NO: 1662605 - DNA, 13 bp, Homo sapiens
ggagcccagaggg

SEQ ID NO: 1662606 - DNA, 19 bp, Homo sapiens
ggagcccagccctccccat

SEQ ID NO: 1662607 - DNA, 19 bp, Homo sapiens
ggagcccagcctgggagcc

SEQ ID NO: 1662608 - DNA, 15 bp, Homo sapiens
ggagcccagggcatc

SEQ ID NO: 1662609 - DNA, 21 bp, Homo sapiens
ggagcccataggccaccccct

SEQ ID NO: 1662610 - DNA, 17 bp, Homo sapiens
ggagccccagctaccct

SEQ ID NO: 1662611 - DNA, 18 bp, Homo sapiens
ggagccccagctaccctt

SEQ ID NO: 1662612 - DNA, 14 bp, Homo sapiens
ggagccccagtgcc

SEQ ID NO: 1662613 - DNA, 15 bp, Homo sapiens
ggagccccctctgcc

SEQ ID NO: 1662614 - DNA, 20 bp, Homo sapiens
ggagcccctcctcccccggc

SEQ ID NO: 1662615 - DNA, 21 bp, Homo sapiens
ggagcccctcctcccccggct

SEQ ID NO: 1662616 - DNA, 22 bp, Homo sapiens
ggagcccctcctctgagcagcc

SEQ ID NO: 1662617 - DNA, 16 bp, Homo sapiens
ggagcccctgggtggg

SEQ ID NO: 1662618 - DNA, 19 bp, Homo sapiens
ggagcccgatattctccct

SEQ ID NO: 1662619 - DNA, 18 bp, Homo sapiens
ggagcccgcactgtccca

SEQ ID NO: 1662620 - DNA, 16 bp, Homo sapiens
ggagcccgtctcagtg

SEQ ID NO: 1662621 - DNA, 17 bp, Homo sapiens
ggagccgcgggacagcc

SEQ ID NO: 1662622 - DNA, 16 bp, Homo sapiens
ggagccggcggcctct

SEQ ID NO: 1662623 - DNA, 15 bp, Homo sapiens
ggagccgggcctccc

SEQ ID NO: 1662624 - DNA, 16 bp, Homo sapiens
ggagccgggcctccca

SEQ ID NO: 1662625 - DNA, 19 bp, Homo sapiens
ggagccggtaactgtcctg

SEQ ID NO: 1662626 - DNA, 20 bp, Homo sapiens
ggagccggtaactgtcctgt

SEQ ID NO: 1662627 - DNA, 23 bp, Homo sapiens
ggagccggtaactgtcctgtcct

SEQ ID NO: 1662628 - DNA, 23 bp, Homo sapiens
ggagcctaccccctgaaagtgac

SEQ ID NO: 1662629 - DNA, 13 bp, Homo sapiens
ggagcctcagaag

SEQ ID NO: 1662630 - DNA, 20 bp, Homo sapiens
ggagcctccactgcctctgg

SEQ ID NO: 1662631 - DNA, 22 bp, Homo sapiens
ggagcctgcaaactcactgctc

SEQ ID NO: 1662632 - DNA, 13 bp, Homo sapiens
ggagcctgcaggg

SEQ ID NO: 1662633 - DNA, 22 bp, Homo sapiens
ggagcctgcagggtggtgctgg

SEQ ID NO: 1662634 - DNA, 12 bp, Homo sapiens
ggagcctgctct

SEQ ID NO: 1662635 - DNA, 20 bp, Homo sapiens
ggagcctggcacaggactga

SEQ ID NO: 1662636 - DNA, 19 bp, Homo sapiens
ggagcctgtgcgtcccagc

SEQ ID NO: 1662637 - DNA, 13 bp, Homo sapiens
ggagccttcccaa

SEQ ID NO: 1662638 - DNA, 21 bp, Homo sapiens
ggagccttcccaagttgtgct

SEQ ID NO: 1662639 - DNA, 23 bp, Homo sapiens
ggagccttcccaagttgtgcttg

SEQ ID NO: 1662640 - DNA, 21 bp, Homo sapiens
ggagccttcctttctcctgcc

SEQ ID NO: 1662641 - DNA, 19 bp, Homo sapiens
ggagccttgctgggccagg

SEQ ID NO: 1662642 - DNA, 20 bp, Homo sapiens
ggagccttgctgggccaggg

SEQ ID NO: 1662643 - DNA, 21 bp, Homo sapiens
ggagccttgctgggccaggga

SEQ ID NO: 1662644 - DNA, 23 bp, Homo sapiens
ggagcgaactggcgcctccgagg

SEQ ID NO: 1662645 - DNA, 12 bp, Homo sapiens
ggagcggtggct

SEQ ID NO: 1662646 - DNA, 23 bp, Homo sapiens
ggagcgtggactctgctagactc

SEQ ID NO: 1662647 - DNA, 18 bp, Homo sapiens
ggagcgttctctgtccta

SEQ ID NO: 1662648 - DNA, 15 bp, Homo sapiens
ggagctaaggctcta

SEQ ID NO: 1662649 - DNA, 17 bp, Homo sapiens
ggagctactgacattcc

SEQ ID NO: 1662650 - DNA, 18 bp, Homo sapiens
ggagctactgacattcct

SEQ ID NO: 1662651 - DNA, 22 bp, Homo sapiens
ggagctagcccagtccctggag

SEQ ID NO: 1662652 - DNA, 19 bp, Homo sapiens
ggagctagttctcagcttg

SEQ ID NO: 1662653 - DNA, 15 bp, Homo sapiens
ggagctatcaggaac

SEQ ID NO: 1662654 - DNA, 22 bp, Homo sapiens
ggagctatgatttttttttcca

SEQ ID NO: 1662655 - DNA, 15 bp, Homo sapiens
ggagctcaccctgcc

SEQ ID NO: 1662656 - DNA, 15 bp, Homo sapiens
ggagctctgcgccag

SEQ ID NO: 1662657 - DNA, 17 bp, Homo sapiens
ggagctcttcaggcctc

SEQ ID NO: 1662658 - DNA, 20 bp, Homo sapiens
ggagctcttcaggcctccct

SEQ ID NO: 1662659 - DNA, 15 bp, Homo sapiens
ggagctcttggaaga

SEQ ID NO: 1662660 - DNA, 16 bp, Homo sapiens
ggagctcttgggtcag

SEQ ID NO: 1662661 - DNA, 16 bp, Homo sapiens
ggagctgagtcacctc

SEQ ID NO: 1662662 - DNA, 16 bp, Homo sapiens
ggagctgatggcagct

SEQ ID NO: 1662663 - DNA, 17 bp, Homo sapiens
ggagctgatggcagctg

SEQ ID NO: 1662664 - DNA, 18 bp, Homo sapiens
ggagctgatggcagctgg

SEQ ID NO: 1662665 - DNA, 22 bp, Homo sapiens
ggagctgatttccaggcccctg

SEQ ID NO: 1662666 - DNA, 13 bp, Homo sapiens
ggagctgccacag

SEQ ID NO: 1662667 - DNA, 14 bp, Homo sapiens
ggagctgcctgcag

SEQ ID NO: 1662668 - DNA, 20 bp, Homo sapiens
ggagctgcctgcagcacatg

SEQ ID NO: 1662669 - DNA, 15 bp, Homo sapiens
ggagctggaggggtg

SEQ ID NO: 1662670 - DNA, 16 bp, Homo sapiens
ggagctggaggggtgg

SEQ ID NO: 1662671 - DNA, 17 bp, Homo sapiens
ggagctggaggggtggg

SEQ ID NO: 1662672 - DNA, 14 bp, Homo sapiens
ggagctggcctgtg

SEQ ID NO: 1662673 - DNA, 16 bp, Homo sapiens
ggagctggcctgtggc

SEQ ID NO: 1662674 - DNA, 18 bp, Homo sapiens
ggagctggcctgtggcac

SEQ ID NO: 1662675 - DNA, 18 bp, Homo sapiens
ggagctgggcagaaggcc

SEQ ID NO: 1662676 - DNA, 12 bp, Homo sapiens
ggagctgggccc

SEQ ID NO: 1662677 - DNA, 18 bp, Homo sapiens
ggagctggttagaaatgc

SEQ ID NO: 1662678 - DNA, 21 bp, Homo sapiens
ggagcttagccaatgtgggag

SEQ ID NO: 1662679 - DNA, 20 bp, Homo sapiens
ggagcttcccacacctgcct

SEQ ID NO: 1662680 - DNA, 17 bp, Homo sapiens
ggagcttcggggcctcc

SEQ ID NO: 1662681 - DNA, 20 bp, Homo sapiens
ggagcttcttgtttccttgt

SEQ ID NO: 1662682 - DNA, 23 bp, Homo sapiens
ggagcttgcaagaagcaggaagg

SEQ ID NO: 1662683 - DNA, 15 bp, Homo sapiens
ggagcttgggaatgg

SEQ ID NO: 1662684 - DNA, 14 bp, Homo sapiens
ggagctttctcaat

SEQ ID NO: 1662685 - DNA, 15 bp, Homo sapiens
ggagctttggaatat

SEQ ID NO: 1662686 - DNA, 20 bp, Homo sapiens
ggaggaaaaccaagccgtgg

SEQ ID NO: 1662687 - DNA, 20 bp, Homo sapiens
ggaggaaagggcctggccag

SEQ ID NO: 1662688 - DNA, 19 bp, Homo sapiens
ggatttcttcgctgctcta

SEQ ID NO: 1662689 - DNA, 19 bp, Homo sapiens
ggatttgaacttgctcttt

SEQ ID NO: 1662690 - DNA, 23 bp, Homo sapiens
ggatttgatgagttaactgtgaa

SEQ ID NO: 1662691 - DNA, 20 bp, Homo sapiens
ggattttaatttcaggaaaa

SEQ ID NO: 1662692 - DNA, 16 bp, Homo sapiens
ggatttttagaattaa

SEQ ID NO: 1662693 - DNA, 13 bp, Homo sapiens
ggatttttgtttg

SEQ ID NO: 1662694 - DNA, 14 bp, Homo sapiens
ggattttttccctt

SEQ ID NO: 1662695 - DNA, 19 bp, Homo sapiens
ggcaaaacacgcaagggca

SEQ ID NO: 1662696 - DNA, 20 bp, Homo sapiens
ggcaaacagagctactgaga

SEQ ID NO: 1662697 - DNA, 19 bp, Homo sapiens
ggcaaacgtttctcaaatc

SEQ ID NO: 1662698 - DNA, 21 bp, Homo sapiens
ggcaaagtgctgtacccttcc

SEQ ID NO: 1662699 - DNA, 22 bp, Homo sapiens
ggcaaatctaaaatttaaaatt

SEQ ID NO: 1662700 - DNA, 19 bp, Homo sapiens
ggcaaatgacatgcactga

SEQ ID NO: 1662701 - DNA, 20 bp, Homo sapiens
ggcaaatgacatgcactgac

SEQ ID NO: 1662702 - DNA, 21 bp, Homo sapiens
ggcaacaagagcaaaactccg

SEQ ID NO: 1662703 - DNA, 14 bp, Homo sapiens
ggcaacacagaggc

SEQ ID NO: 1662704 - DNA, 21 bp, Homo sapiens
ggcaacacagcgagactccgt

SEQ ID NO: 1662705 - DNA, 12 bp, Homo sapiens
ggcaacaggatt

SEQ ID NO: 1662706 - DNA, 13 bp, Homo sapiens
ggcaacagggagc

SEQ ID NO: 1662707 - DNA, 16 bp, Homo sapiens
ggcaacagggagcacc

SEQ ID NO: 1662708 - DNA, 14 bp, Homo sapiens
ggcaaccagccagc

SEQ ID NO: 1662709 - DNA, 22 bp, Homo sapiens
ggcaacctcccatcccaccccc

SEQ ID NO: 1662710 - DNA, 15 bp, Homo sapiens
ggcaacgtagcctgg

SEQ ID NO: 1662711 - DNA, 19 bp, Homo sapiens
ggcaacgtagcctgggctc

SEQ ID NO: 1662712 - DNA, 20 bp, Homo sapiens
ggcaactgaggcagacagca

SEQ ID NO: 1662713 - DNA, 23 bp, Homo sapiens
ggcaactgaggcagacagcagct

SEQ ID NO: 1662714 - DNA, 12 bp, Homo sapiens
ggcaagaaaagg

SEQ ID NO: 1662715 - DNA, 21 bp, Homo sapiens
ggcaagaacccaagtgcctca

SEQ ID NO: 1662716 - DNA, 17 bp, Homo sapiens
ggcaagacagaaaagtg

SEQ ID NO: 1662717 - DNA, 17 bp, Homo sapiens
ggcaagagactgggagc

SEQ ID NO: 1662718 - DNA, 12 bp, Homo sapiens
ggcaagaggggt

SEQ ID NO: 1662719 - DNA, 14 bp, Homo sapiens
ggcaagaggggtgg

SEQ ID NO: 1662720 - DNA, 17 bp, Homo sapiens
ggcaagcagctggtcag

SEQ ID NO: 1662721 - DNA, 13 bp, Homo sapiens
ggcaagcagggaa

SEQ ID NO: 1662722 - DNA, 13 bp, Homo sapiens
ggcaagccaggct

SEQ ID NO: 1662723 - DNA, 16 bp, Homo sapiens
ggcaagcccctcagcc

SEQ ID NO: 1662724 - DNA, 19 bp, Homo sapiens
ggcaagctaggccccagag

SEQ ID NO: 1662725 - DNA, 16 bp, Homo sapiens
ggcaagcttgaggcca

SEQ ID NO: 1662726 - DNA, 19 bp, Homo sapiens
ggcaagcttgaggccaaga

SEQ ID NO: 1662727 - DNA, 21 bp, Homo sapiens
ggcaagcttgaggccaagatg

SEQ ID NO: 1662728 - DNA, 10 bp, Homo sapiens
ggcaaggaaa

SEQ ID NO: 1662729 - DNA, 22 bp, Homo sapiens
ggcaaggaaaggggagaaggga

SEQ ID NO: 1662730 - DNA, 18 bp, Homo sapiens
ggcaaggactttgtacat

SEQ ID NO: 1662731 - DNA, 16 bp, Homo sapiens
ggcaaggagtttatta

SEQ ID NO: 1662732 - DNA, 16 bp, Homo sapiens
ggcaaggggctggctg

SEQ ID NO: 1662733 - DNA, 19 bp, Homo sapiens
ggcaagggttaaggcctga

SEQ ID NO: 1662734 - DNA, 21 bp, Homo sapiens
ggcaaggtttacactgcggaa

SEQ ID NO: 1662735 - DNA, 22 bp, Homo sapiens
ggcaagtccctgactctctgtg

SEQ ID NO: 1662736 - DNA, 22 bp, Homo sapiens
ggcaagtcgagagggctgttgg

SEQ ID NO: 1662737 - DNA, 17 bp, Homo sapiens
ggcaagtggatgggaat

SEQ ID NO: 1662738 - DNA, 20 bp, Homo sapiens
ggcaagtggatgggaatttg

SEQ ID NO: 1662739 - DNA, 20 bp, Homo sapiens
ggcaataagatacacagctc

SEQ ID NO: 1662740 - DNA, 16 bp, Homo sapiens
ggcaatagggtagaat

SEQ ID NO: 1662741 - DNA, 14 bp, Homo sapiens
ggcaatattaacct

SEQ ID NO: 1662742 - DNA, 15 bp, Homo sapiens
ggcaatgatggcaat

SEQ ID NO: 1662743 - DNA, 18 bp, Homo sapiens
ggcaattagtgtgacagt

SEQ ID NO: 1662744 - DNA, 18 bp, Homo sapiens
ggcaattattttggatct

SEQ ID NO: 1662745 - DNA, 16 bp, Homo sapiens
ggcaattttagtgtat

SEQ ID NO: 1662746 - DNA, 19 bp, Homo sapiens
ggcaattttagtgtattaa

SEQ ID NO: 1662747 - DNA, 18 bp, Homo sapiens
ggcacaagtcctggatgt

SEQ ID NO: 1662748 - DNA, 13 bp, Homo sapiens
ggcacacagagat

SEQ ID NO: 1662749 - DNA, 16 bp, Homo sapiens
ggcacaccactgccct

SEQ ID NO: 1662750 - DNA, 14 bp, Homo sapiens
ggcacagacgactg

SEQ ID NO: 1662751 - DNA, 13 bp, Homo sapiens
ggcacagcagctg

SEQ ID NO: 1662752 - DNA, 12 bp, Homo sapiens
ggcacagccctc

SEQ ID NO: 1662753 - DNA, 19 bp, Homo sapiens
ggcacagccctgagtgtcc

SEQ ID NO: 1662754 - DNA, 16 bp, Homo sapiens
ggcacaggaggcaggc

SEQ ID NO: 1662755 - DNA, 20 bp, Homo sapiens
ggcacaggaggcaggcatgg

SEQ ID NO: 1662756 - DNA, 18 bp, Homo sapiens
ggcacagggcaccagagg

SEQ ID NO: 1662757 - DNA, 19 bp, Homo sapiens
ggcacagggcaccagaggc

SEQ ID NO: 1662758 - DNA, 14 bp, Homo sapiens
ggcacagggcccgc

SEQ ID NO: 1662759 - DNA, 23 bp, Homo sapiens
ggcacagggcccgcagtgctggg

SEQ ID NO: 1662760 - DNA, 17 bp, Homo sapiens
ggcacagggtctgctct

SEQ ID NO: 1662761 - DNA, 16 bp, Homo sapiens
ggcacagtgggagctg

SEQ ID NO: 1662762 - DNA, 17 bp, Homo sapiens
ggcacagtgggagctga

SEQ ID NO: 1662763 - DNA, 19 bp, Homo sapiens
ggcacagtgggagctgagc

SEQ ID NO: 1662764 - DNA, 21 bp, Homo sapiens
ggcacagtgggagctgagctg

SEQ ID NO: 1662765 - DNA, 17 bp, Homo sapiens
ggcacatcagaaaggaa

SEQ ID NO: 1662766 - DNA, 18 bp, Homo sapiens
ggcacatgccacctggca

SEQ ID NO: 1662767 - DNA, 16 bp, Homo sapiens
ggcacatgccccgatg

SEQ ID NO: 1662768 - DNA, 14 bp, Homo sapiens
ggcacatggaggag

SEQ ID NO: 1662769 - DNA, 14 bp, Homo sapiens
ggcacattgcccat

SEQ ID NO: 1662770 - DNA, 17 bp, Homo sapiens
ggcaccaccaggagcag

SEQ ID NO: 1662771 - DNA, 19 bp, Homo sapiens
ggcaccaccaggagcagca

SEQ ID NO: 1662772 - DNA, 24 bp, Homo sapiens
ggcaccaccaggagcagcagccag

SEQ ID NO: 1662773 - DNA, 18 bp, Homo sapiens
ggcaccagctctgtggcc

SEQ ID NO: 1662774 - DNA, 22 bp, Homo sapiens
ggcaccagctctgtggcctgtg

SEQ ID NO: 1662775 - DNA, 14 bp, Homo sapiens
ggcaccaggaagcc

SEQ ID NO: 1662776 - DNA, 15 bp, Homo sapiens
ggcaccaggaagccg

SEQ ID NO: 1662777 - DNA, 16 bp, Homo sapiens
ggcacccacaaataaa

SEQ ID NO: 1662778 - DNA, 14 bp, Homo sapiens
ggcacccatgtggg

SEQ ID NO: 1662779 - DNA, 23 bp, Homo sapiens
ggcacccatgtgggcgcccaccc

SEQ ID NO: 1662780 - DNA, 13 bp, Homo sapiens
ggcaccccttgtt

SEQ ID NO: 1662781 - DNA, 21 bp, Homo sapiens
ggcaccccttgtttctgttgt

SEQ ID NO: 1662782 - DNA, 19 bp, Homo sapiens
ggcaccgccacgtcccagc

SEQ ID NO: 1662783 - DNA, 13 bp, Homo sapiens
ggcaccggcgctg

SEQ ID NO: 1662784 - DNA, 14 bp, Homo sapiens
ggcaccggcgctgc

SEQ ID NO: 1662785 - DNA, 17 bp, Homo sapiens
ggcaccggcgctgcagg

SEQ ID NO: 1662786 - DNA, 19 bp, Homo sapiens
ggcaccggcgctgcaggta

SEQ ID NO: 1662787 - DNA, 16 bp, Homo sapiens
ggcaccgtccaggccc

SEQ ID NO: 1662788 - DNA, 18 bp, Homo sapiens
ggcacctaatccaggcag

SEQ ID NO: 1662789 - DNA, 17 bp, Homo sapiens
ggcacctacatccccag

SEQ ID NO: 1662790 - DNA, 20 bp, Homo sapiens
ggcacctacatccccaggtc

SEQ ID NO: 1662791 - DNA, 19 bp, Homo sapiens
ggcacctcacaggccccag

SEQ ID NO: 1662792 - DNA, 20 bp, Homo sapiens
ggcacctccaggcaggccag

SEQ ID NO: 1662793 - DNA, 20 bp, Homo sapiens
ggcacctccccgctctccct

SEQ ID NO: 1662794 - DNA, 14 bp, Homo sapiens
ggcacctcctgaga

SEQ ID NO: 1662795 - DNA, 12 bp, Homo sapiens
ggcacctggcct

SEQ ID NO: 1662796 - DNA, 19 bp, Homo sapiens
ggcacctggcctgctggga

SEQ ID NO: 1662797 - DNA, 16 bp, Homo sapiens
ggcacctgtcgcccag

SEQ ID NO: 1662798 - DNA, 19 bp, Homo sapiens
ggcacgaacccacctgctg

SEQ ID NO: 1662799 - DNA, 14 bp, Homo sapiens
ggcacgcaccactg

SEQ ID NO: 1662800 - DNA, 16 bp, Homo sapiens
ggcacgcaccactgct

SEQ ID NO: 1662801 - DNA, 21 bp, Homo sapiens
ggcacgccctactccactgcc

SEQ ID NO: 1662802 - DNA, 23 bp, Homo sapiens
ggcacgccctactccactgccct

SEQ ID NO: 1662803 - DNA, 16 bp, Homo sapiens
ggcatctgcccctccc

SEQ ID NO: 1662804 - DNA, 12 bp, Homo sapiens
ggcatcttctgg

SEQ ID NO: 1662805 - DNA, 13 bp, Homo sapiens
ggcatcttctgga

SEQ ID NO: 1662806 - DNA, 16 bp, Homo sapiens
ggcatcttgctggcta

SEQ ID NO: 1662807 - DNA, 17 bp, Homo sapiens
ggcatcttttgtattaa

SEQ ID NO: 1662808 - DNA, 13 bp, Homo sapiens
ggcatgaccagat

SEQ ID NO: 1662809 - DNA, 13 bp, Homo sapiens
ggcatgagaaaga

SEQ ID NO: 1662810 - DNA, 13 bp, Homo sapiens
ggcatgaggaggt

SEQ ID NO: 1662811 - DNA, 14 bp, Homo sapiens
ggcatgaggaggtc

SEQ ID NO: 1662812 - DNA, 19 bp, Homo sapiens
ggcatgagggatcacaggg

SEQ ID NO: 1662813 - DNA, 17 bp, Homo sapiens
ggcatgcacacggctgg

SEQ ID NO: 1662814 - DNA, 18 bp, Homo sapiens
ggcatgcacgggcatgca

SEQ ID NO: 1662815 - DNA, 23 bp, Homo sapiens
ggcatgcctctgatatgggactg

SEQ ID NO: 1662816 - DNA, 17 bp, Homo sapiens
ggcatgcggtcgggcag

SEQ ID NO: 1662817 - DNA, 12 bp, Homo sapiens
ggcatgctgggg

SEQ ID NO: 1662818 - DNA, 14 bp, Homo sapiens
ggcatgctggggca

SEQ ID NO: 1662819 - DNA, 18 bp, Homo sapiens
ggcatgggtccagggcct

SEQ ID NO: 1662820 - DNA, 23 bp, Homo sapiens
ggcatgggtccagggcctgacac

SEQ ID NO: 1662821 - DNA, 13 bp, Homo sapiens
ggcatgggtggag

SEQ ID NO: 1662822 - DNA, 19 bp, Homo sapiens
ggcatggtcccttaaggca

SEQ ID NO: 1662823 - DNA, 18 bp, Homo sapiens
ggcatggtgtgtggtgct

SEQ ID NO: 1662824 - DNA, 22 bp, Homo sapiens
ggcatggttccttccctgggaa

SEQ ID NO: 1662825 - DNA, 15 bp, Homo sapiens
ggcatgtattggcct

SEQ ID NO: 1662826 - DNA, 18 bp, Homo sapiens
ggcatgtattggcctgga

SEQ ID NO: 1662827 - DNA, 19 bp, Homo sapiens
ggcatgtattggcctggag

SEQ ID NO: 1662828 - DNA, 12 bp, Homo sapiens
ggcatgtggaga

SEQ ID NO: 1662829 - DNA, 16 bp, Homo sapiens
ggcatgtttccagcag

SEQ ID NO: 1662830 - DNA, 20 bp, Homo sapiens
ggcatgttttctttgtttcc

SEQ ID NO: 1662831 - DNA, 12 bp, Homo sapiens
ggcatgttttga

SEQ ID NO: 1662832 - DNA, 17 bp, Homo sapiens
ggcattagaattattta

SEQ ID NO: 1662833 - DNA, 16 bp, Homo sapiens
ggcattcctgaaggga

SEQ ID NO: 1662834 - DNA, 15 bp, Homo sapiens
ggcattcctgcttat

SEQ ID NO: 1662835 - DNA, 16 bp, Homo sapiens
ggcattcggggaagct

SEQ ID NO: 1662836 - DNA, 17 bp, Homo sapiens
ggcattgggctgacacc

SEQ ID NO: 1662837 - DNA, 18 bp, Homo sapiens
ggcattgggctgacacct

SEQ ID NO: 1662838 - DNA, 21 bp, Homo sapiens
ggcatttcaattcctggccct

SEQ ID NO: 1662839 - DNA, 21 bp, Homo sapiens
ggcatttgcagggtcctcttc

SEQ ID NO: 1662840 - DNA, 20 bp, Homo sapiens
ggcatttggtctcaggcagc

SEQ ID NO: 1662841 - DNA, 21 bp, Homo sapiens
ggcatttggtgagagtcaaag

SEQ ID NO: 1662842 - DNA, 12 bp, Homo sapiens
ggcatttgttca

SEQ ID NO: 1662843 - DNA, 17 bp, Homo sapiens
ggccaaaagcagtaaat

SEQ ID NO: 1662844 - DNA, 14 bp, Homo sapiens
ggccaaaatcaaga

SEQ ID NO: 1662845 - DNA, 17 bp, Homo sapiens
ggccaaacatcagacct

SEQ ID NO: 1662846 - DNA, 19 bp, Homo sapiens
ggccaaacatcagacctgt

SEQ ID NO: 1662847 - DNA, 15 bp, Homo sapiens
ggccaaacccttgct

SEQ ID NO: 1662848 - DNA, 15 bp, Homo sapiens
ggccaaagataaaag

SEQ ID NO: 1662849 - DNA, 21 bp, Homo sapiens
ggccaaatccttggagtccca

SEQ ID NO: 1662850 - DNA, 19 bp, Homo sapiens
ggccaaatgcacaagctca

SEQ ID NO: 1662851 - DNA, 22 bp, Homo sapiens
ggccaaatgcacaagctcagaa

SEQ ID NO: 1662852 - DNA, 16 bp, Homo sapiens
ggccaacagcaagtgt

SEQ ID NO: 1662853 - DNA, 23 bp, Homo sapiens
ggccaacatggtgaaaccctgta

SEQ ID NO: 1662854 - DNA, 14 bp, Homo sapiens
ggccaaccagcccg

SEQ ID NO: 1662855 - DNA, 16 bp, Homo sapiens
ggccaacgtggacctg

SEQ ID NO: 1662856 - DNA, 15 bp, Homo sapiens
ggccaagagatctgt

SEQ ID NO: 1662857 - DNA, 19 bp, Homo sapiens
ggccaagagatctgtgtgg

SEQ ID NO: 1662858 - DNA, 14 bp, Homo sapiens
ggccaagatggctg

SEQ ID NO: 1662859 - DNA, 18 bp, Homo sapiens
ggccaagatggctgctgc

SEQ ID NO: 1662860 - DNA, 13 bp, Homo sapiens
ggccaagcagaaa

SEQ ID NO: 1662861 - DNA, 15 bp, Homo sapiens
ggccaaggcaggtag

SEQ ID NO: 1662862 - DNA, 19 bp, Homo sapiens
ggccaaggccttctcctcc

SEQ ID NO: 1662863 - DNA, 20 bp, Homo sapiens
ggccaagtctaatgaagaga

SEQ ID NO: 1662864 - DNA, 18 bp, Homo sapiens
ggccaatggtgcttcccc

SEQ ID NO: 1662865 - DNA, 15 bp, Homo sapiens
ggccaatgttgctga

SEQ ID NO: 1662866 - DNA, 23 bp, Homo sapiens
ggccaatgttgctgatggcccct

SEQ ID NO: 1662867 - DNA, 22 bp, Homo sapiens
ggccacaaatcaaagcaagggc

SEQ ID NO: 1662868 - DNA, 16 bp, Homo sapiens
ggccacacccagcggc

SEQ ID NO: 1662869 - DNA, 18 bp, Homo sapiens
ggccacacctgagcgctg

SEQ ID NO: 1662870 - DNA, 19 bp, Homo sapiens
ggccacacctgagcgctgt

SEQ ID NO: 1662871 - DNA, 17 bp, Homo sapiens
ggccacacgctgcacct

SEQ ID NO: 1662872 - DNA, 18 bp, Homo sapiens
ggccacacgtggctggcg

SEQ ID NO: 1662873 - DNA, 14 bp, Homo sapiens
ggccacagctgctg

SEQ ID NO: 1662874 - DNA, 15 bp, Homo sapiens
ggccacagctgctgg

SEQ ID NO: 1662875 - DNA, 17 bp, Homo sapiens
ggccacagctgctggag

SEQ ID NO: 1662876 - DNA, 12 bp, Homo sapiens
ggccaccaggct

SEQ ID NO: 1662877 - DNA, 14 bp, Homo sapiens
ggccaccaggctgg

SEQ ID NO: 1662878 - DNA, 19 bp, Homo sapiens
ggccaccaggctggcgcag

SEQ ID NO: 1662879 - DNA, 17 bp, Homo sapiens
ggccaccatgtctggct

SEQ ID NO: 1662880 - DNA, 20 bp, Homo sapiens
ggccaccccgtgccacccgt

SEQ ID NO: 1662881 - DNA, 10 bp, Homo sapiens
ggccaccctc

SEQ ID NO: 1662882 - DNA, 15 bp, Homo sapiens
ggccaccctccttcc

SEQ ID NO: 1662883 - DNA, 16 bp, Homo sapiens
ggccaccctccttccc

SEQ ID NO: 1662884 - DNA, 18 bp, Homo sapiens
ggccaccgggacagacct

SEQ ID NO: 1662885 - DNA, 19 bp, Homo sapiens
ggccacctagaagtctccc

SEQ ID NO: 1662886 - DNA, 22 bp, Homo sapiens
ggccacctagaagtctccctgc

SEQ ID NO: 1662887 - DNA, 20 bp, Homo sapiens
ggccacctcccactcctgct

SEQ ID NO: 1662888 - DNA, 23 bp, Homo sapiens
ggccacctcccactcctgctgca

SEQ ID NO: 1662889 - DNA, 16 bp, Homo sapiens
ggccacctccccagca

SEQ ID NO: 1662890 - DNA, 11 bp, Homo sapiens
ggccacctctc

SEQ ID NO: 1662891 - DNA, 13 bp, Homo sapiens
ggccacctctcca

SEQ ID NO: 1662892 - DNA, 18 bp, Homo sapiens
ggccacctctccaagggc

SEQ ID NO: 1662893 - DNA, 20 bp, Homo sapiens
ggccacctctccaagggctt

SEQ ID NO: 1662894 - DNA, 12 bp, Homo sapiens
ggccacctctgc

SEQ ID NO: 1662895 - DNA, 13 bp, Homo sapiens
ggccacctctgcc

SEQ ID NO: 1662896 - DNA, 21 bp, Homo sapiens
ggccacctgaggtgggcccag

SEQ ID NO: 1662897 - DNA, 15 bp, Homo sapiens
ggccacgcagccagg

SEQ ID NO: 1662898 - DNA, 16 bp, Homo sapiens
ggccacgcagccagga

SEQ ID NO: 1662899 - DNA, 16 bp, Homo sapiens
ggccacgggggcagtg

SEQ ID NO: 1662900 - DNA, 17 bp, Homo sapiens
ggccacgtgccaggccc

SEQ ID NO: 1662901 - DNA, 16 bp, Homo sapiens
ggccactaaagcttca

SEQ ID NO: 1662902 - DNA, 13 bp, Homo sapiens
ggccactcctcca

SEQ ID NO: 1662903 - DNA, 21 bp, Homo sapiens
ggccactctgcctctgcctgc

SEQ ID NO: 1662904 - DNA, 20 bp, Homo sapiens
ggccactgtggccagagctg

SEQ ID NO: 1662905 - DNA, 21 bp, Homo sapiens
ggccacttctgggtggggcag

SEQ ID NO: 1662906 - DNA, 22 bp, Homo sapiens
ggccactttcagagcccccagc

SEQ ID NO: 1662907 - DNA, 15 bp, Homo sapiens
ggccacttttgacta

SEQ ID NO: 1662908 - DNA, 15 bp, Homo sapiens
ggccagaaaaatttg

SEQ ID NO: 1662909 - DNA, 23 bp, Homo sapiens
ggccagaaactccttttgctgtc

SEQ ID NO: 1662910 - DNA, 15 bp, Homo sapiens
ggccagaaggagggc

SEQ ID NO: 1662911 - DNA, 19 bp, Homo sapiens
ggccagaaggagggcagag

SEQ ID NO: 1662912 - DNA, 16 bp, Homo sapiens
ggccagacacaggccc

SEQ ID NO: 1662913 - DNA, 12 bp, Homo sapiens
ggccagacatgg

SEQ ID NO: 1662914 - DNA, 22 bp, Homo sapiens
ggccagactggaagacacttca

SEQ ID NO: 1662915 - DNA, 16 bp, Homo sapiens
ggccagagagggccca

SEQ ID NO: 1662916 - DNA, 11 bp, Homo sapiens
ggccagagcca

SEQ ID NO: 1662917 - DNA, 13 bp, Homo sapiens
ggccagagccagg

SEQ ID NO: 1662918 - DNA, 13 bp, Homo sapiens
ggccagagctgaa

SEQ ID NO: 1662919 - DNA, 13 bp, Homo sapiens
ggcctcaggctct

SEQ ID NO: 1662920 - DNA, 14 bp, Homo sapiens
ggcctcaggctctg

SEQ ID NO: 1662921 - DNA, 15 bp, Homo sapiens
ggcctcaggctctgc

SEQ ID NO: 1662922 - DNA, 18 bp, Homo sapiens
ggcctcagggcgctcaga

SEQ ID NO: 1662923 - DNA, 16 bp, Homo sapiens
ggcctcaggtgctgtc

SEQ ID NO: 1662924 - DNA, 19 bp, Homo sapiens
ggcctcaggtgctgtccat

SEQ ID NO: 1662925 - DNA, 14 bp, Homo sapiens
ggcctcagttccca

SEQ ID NO: 1662926 - DNA, 23 bp, Homo sapiens
ggcctcagttcccagctcccccc

SEQ ID NO: 1662927 - DNA, 19 bp, Homo sapiens
ggcctcagtttctccatca

SEQ ID NO: 1662928 - DNA, 20 bp, Homo sapiens
ggcctcagtttctccatcag

SEQ ID NO: 1662929 - DNA, 14 bp, Homo sapiens
ggcctcatccctcg

SEQ ID NO: 1662930 - DNA, 15 bp, Homo sapiens
ggcctcatgtggctg

SEQ ID NO: 1662931 - DNA, 16 bp, Homo sapiens
ggcctcatgtggctgg

SEQ ID NO: 1662932 - DNA, 17 bp, Homo sapiens
ggcctcatgtggctgga

SEQ ID NO: 1662933 - DNA, 23 bp, Homo sapiens
ggcctccaacgcccctgtggcca

SEQ ID NO: 1662934 - DNA, 14 bp, Homo sapiens
ggcctccactcccc

SEQ ID NO: 1662935 - DNA, 16 bp, Homo sapiens
ggcctccagaagctgc

SEQ ID NO: 1662936 - DNA, 14 bp, Homo sapiens
ggcctccagcctct

SEQ ID NO: 1662937 - DNA, 18 bp, Homo sapiens
ggcctccagctcccactc

SEQ ID NO: 1662938 - DNA, 20 bp, Homo sapiens
ggcctccatgccccagctct

SEQ ID NO: 1662939 - DNA, 17 bp, Homo sapiens
ggcctccattcctggag

SEQ ID NO: 1662940 - DNA, 17 bp, Homo sapiens
ggcctcccaaagtgctg

SEQ ID NO: 1662941 - DNA, 11 bp, Homo sapiens
ggcctcccacc

SEQ ID NO: 1662942 - DNA, 12 bp, Homo sapiens
ggcctcccaccc

SEQ ID NO: 1662943 - DNA, 13 bp, Homo sapiens
ggcctcccacccg

SEQ ID NO: 1662944 - DNA, 15 bp, Homo sapiens
ggcctcccctgccac

SEQ ID NO: 1662945 - DNA, 14 bp, Homo sapiens
ggcctcccctgggc

SEQ ID NO: 1662946 - DNA, 13 bp, Homo sapiens
ggcctccctgcag

SEQ ID NO: 1662947 - DNA, 17 bp, Homo sapiens
ggcctcctcggagagca

SEQ ID NO: 1662948 - DNA, 24 bp, Homo sapiens
ggcctcctgcctccgggcaggcaa

SEQ ID NO: 1662949 - DNA, 19 bp, Homo sapiens
ggcctccttcccatgcctg

SEQ ID NO: 1662950 - DNA, 22 bp, Homo sapiens
ggcctccttcccatgcctgtct

SEQ ID NO: 1662951 - DNA, 21 bp, Homo sapiens
ggcctccttcttccacttctc

SEQ ID NO: 1662952 - DNA, 19 bp, Homo sapiens
ggcctcggagcctcatccg

SEQ ID NO: 1662953 - DNA, 22 bp, Homo sapiens
ggcctcggagcctcatccgagg

SEQ ID NO: 1662954 - DNA, 20 bp, Homo sapiens
ggcctctcattccagaggaa

SEQ ID NO: 1662955 - DNA, 19 bp, Homo sapiens
ggcctctccaaccactgtg

SEQ ID NO: 1662956 - DNA, 23 bp, Homo sapiens
ggcctctccaaccactgtgccac

SEQ ID NO: 1662957 - DNA, 15 bp, Homo sapiens
ggcctctccatttgc

SEQ ID NO: 1662958 - DNA, 18 bp, Homo sapiens
ggcctctcctgccctctg

SEQ ID NO: 1662959 - DNA, 21 bp, Homo sapiens
ggcctctcgacggcacgcact

SEQ ID NO: 1662960 - DNA, 18 bp, Homo sapiens
ggcctctcggtgctccat

SEQ ID NO: 1662961 - DNA, 22 bp, Homo sapiens
ggcctctctatcctctcttcct

SEQ ID NO: 1662962 - DNA, 23 bp, Homo sapiens
ggcctctctatcctctcttcctc

SEQ ID NO: 1662963 - DNA, 16 bp, Homo sapiens
ggcctctctctgcctg

SEQ ID NO: 1662964 - DNA, 18 bp, Homo sapiens
ggcctctctcttcccagc

SEQ ID NO: 1662965 - DNA, 15 bp, Homo sapiens
ggcctctctgcctgg

SEQ ID NO: 1662966 - DNA, 13 bp, Homo sapiens
ggcctctctggcc

SEQ ID NO: 1662967 - DNA, 15 bp, Homo sapiens
ggcctctctggcctc

SEQ ID NO: 1662968 - DNA, 12 bp, Homo sapiens
ggcctctgcctg

SEQ ID NO: 1662969 - DNA, 18 bp, Homo sapiens
ggcctctgcctgctgggg

SEQ ID NO: 1662970 - DNA, 16 bp, Homo sapiens
ggcctctgcctggggc

SEQ ID NO: 1662971 - DNA, 13 bp, Homo sapiens
ggcctctgggcag

SEQ ID NO: 1662972 - DNA, 13 bp, Homo sapiens
ggcctcttgagca

SEQ ID NO: 1662973 - DNA, 12 bp, Homo sapiens
ggcctcttggct

SEQ ID NO: 1662974 - DNA, 22 bp, Homo sapiens
ggcctcttggctatttctgtgt

SEQ ID NO: 1662975 - DNA, 19 bp, Homo sapiens
ggcctcttgggtcccccac

SEQ ID NO: 1662976 - DNA, 15 bp, Homo sapiens
ggcctgaactgagga

SEQ ID NO: 1662977 - DNA, 17 bp, Homo sapiens
ggcctgaagccagctgc

SEQ ID NO: 1662978 - DNA, 21 bp, Homo sapiens
ggcctgaagtcttctcctcca

SEQ ID NO: 1662979 - DNA, 21 bp, Homo sapiens
ggcctgaatcatgagcctgct

SEQ ID NO: 1662980 - DNA, 22 bp, Homo sapiens
ggcctgaatcatgagcctgctg

SEQ ID NO: 1662981 - DNA, 16 bp, Homo sapiens
ggcctgactctcagca

SEQ ID NO: 1662982 - DNA, 15 bp, Homo sapiens
ggcctgactgctcag

SEQ ID NO: 1662983 - DNA, 19 bp, Homo sapiens
ggcctgagaatgagtggga

SEQ ID NO: 1662984 - DNA, 20 bp, Homo sapiens
ggcctgagaatgagtgggaa

SEQ ID NO: 1662985 - DNA, 18 bp, Homo sapiens
ggcctgagagtcagctct

SEQ ID NO: 1662986 - DNA, 22 bp, Homo sapiens
ggcctgagatttcatctgctct

SEQ ID NO: 1662987 - DNA, 12 bp, Homo sapiens
ggcctgagctgg

SEQ ID NO: 1662988 - DNA, 16 bp, Homo sapiens
ggcctgagctggggcc

SEQ ID NO: 1662989 - DNA, 17 bp, Homo sapiens
ggcctgagctggggcca

SEQ ID NO: 1662990 - DNA, 19 bp, Homo sapiens
ggcctgagctggggccaca

SEQ ID NO: 1662991 - DNA, 22 bp, Homo sapiens
ggcctgagctggggccacaaat

SEQ ID NO: 1662992 - DNA, 14 bp, Homo sapiens
ggcctgagggtcca

SEQ ID NO: 1662993 - DNA, 20 bp, Homo sapiens
ggcctgagggtccacctgga

SEQ ID NO: 1662994 - DNA, 18 bp, Homo sapiens
ggcctgatgctccctccc

SEQ ID NO: 1662995 - DNA, 22 bp, Homo sapiens
ggcctgatgctccctcccctgc

SEQ ID NO: 1662996 - DNA, 16 bp, Homo sapiens
ggcctgatgctgcccc

SEQ ID NO: 1662997 - DNA, 13 bp, Homo sapiens
ggcctgcactaat

SEQ ID NO: 1662998 - DNA, 19 bp, Homo sapiens
ggcctgcaggtgagcaggc

SEQ ID NO: 1662999 - DNA, 15 bp, Homo sapiens
ggcctgcccaatgct

SEQ ID NO: 1663000 - DNA, 21 bp, Homo sapiens
ggcctgcccaatgctttggga

SEQ ID NO: 1663001 - DNA, 15 bp, Homo sapiens
ggcctgcccagttgc

SEQ ID NO: 1663002 - DNA, 14 bp, Homo sapiens
ggcctgccctctgc

SEQ ID NO: 1663003 - DNA, 14 bp, Homo sapiens
ggcctgccgggctg

SEQ ID NO: 1663004 - DNA, 23 bp, Homo sapiens
ggcctgcgtcttttttctcttcc

SEQ ID NO: 1663005 - DNA, 15 bp, Homo sapiens
ggcctgcgtgcgctg

SEQ ID NO: 1663006 - DNA, 16 bp, Homo sapiens
ggcctgctccagacct

SEQ ID NO: 1663007 - DNA, 17 bp, Homo sapiens
ggcctgctgccagtgca

SEQ ID NO: 1663008 - DNA, 18 bp, Homo sapiens
ggcctgctgccagtgcag

SEQ ID NO: 1663009 - DNA, 19 bp, Homo sapiens
ggcctgctgccagtgcagc

SEQ ID NO: 1663010 - DNA, 16 bp, Homo sapiens
ggcctgctggaggcct

SEQ ID NO: 1663011 - DNA, 17 bp, Homo sapiens
ggcctgctggaggcctc

SEQ ID NO: 1663012 - DNA, 21 bp, Homo sapiens
ggcctgctggaggcctcaggt

SEQ ID NO: 1663013 - DNA, 23 bp, Homo sapiens
ggcctgctgggaaccccgcagcc

SEQ ID NO: 1663014 - DNA, 20 bp, Homo sapiens
ggcctgctgggctctccacc

SEQ ID NO: 1663015 - DNA, 10 bp, Homo sapiens
ggcctgctgt

SEQ ID NO: 1663016 - DNA, 16 bp, Homo sapiens
ggcctgcttccccctc

SEQ ID NO: 1663017 - DNA, 17 bp, Homo sapiens
ggcctgcttttccagga

SEQ ID NO: 1663018 - DNA, 13 bp, Homo sapiens
ggcctggacctgc

SEQ ID NO: 1663019 - DNA, 16 bp, Homo sapiens
ggcctggacctgggat

SEQ ID NO: 1663020 - DNA, 21 bp, Homo sapiens
ggcctggactttcctgcaact

SEQ ID NO: 1663021 - DNA, 11 bp, Homo sapiens
ggcctggagat

SEQ ID NO: 1663022 - DNA, 18 bp, Homo sapiens
ggcctggagatcctcctg

SEQ ID NO: 1663023 - DNA, 11 bp, Homo sapiens
ggcctggaggt

SEQ ID NO: 1663024 - DNA, 17 bp, Homo sapiens
ggcctggcacatcagaa

SEQ ID NO: 1663025 - DNA, 14 bp, Homo sapiens
ggcctggcagccgt

SEQ ID NO: 1663026 - DNA, 16 bp, Homo sapiens
ggcctggccaggagct

SEQ ID NO: 1663027 - DNA, 19 bp, Homo sapiens
ggcctggccgttcagcctg

SEQ ID NO: 1663028 - DNA, 21 bp, Homo sapiens
ggcctggccgttcagcctgtc

SEQ ID NO: 1663029 - DNA, 12 bp, Homo sapiens
ggcctggcctct

SEQ ID NO: 1663030 - DNA, 13 bp, Homo sapiens
ggcctggcctctg

SEQ ID NO: 1663031 - DNA, 17 bp, Homo sapiens
ggcctggcctctgggca

SEQ ID NO: 1663032 - DNA, 12 bp, Homo sapiens
ggcctggcctga

SEQ ID NO: 1663033 - DNA, 13 bp, Homo sapiens
ggcctggcctgag

SEQ ID NO: 1663034 - DNA, 14 bp, Homo sapiens
ggctctcacccagt

SEQ ID NO: 1663035 - DNA, 15 bp, Homo sapiens
ggctctcacccagtc

SEQ ID NO: 1663036 - DNA, 20 bp, Homo sapiens
ggctctccaaaggggctgct

SEQ ID NO: 1663037 - DNA, 21 bp, Homo sapiens
ggctctccaaaggggctgctg

SEQ ID NO: 1663038 - DNA, 23 bp, Homo sapiens
ggctctccaaaggggctgctggg

SEQ ID NO: 1663039 - DNA, 18 bp, Homo sapiens
ggctctccaagtgccaga

SEQ ID NO: 1663040 - DNA, 12 bp, Homo sapiens
ggctctccacct

SEQ ID NO: 1663041 - DNA, 19 bp, Homo sapiens
ggctctccacctcagcctt

SEQ ID NO: 1663042 - DNA, 17 bp, Homo sapiens
ggctctcgggtggggga

SEQ ID NO: 1663043 - DNA, 18 bp, Homo sapiens
ggctctcgggtgggggag

SEQ ID NO: 1663044 - DNA, 22 bp, Homo sapiens
ggctctcgggtgggggagccag

SEQ ID NO: 1663045 - DNA, 20 bp, Homo sapiens
ggctctgagagtctagattc

SEQ ID NO: 1663046 - DNA, 22 bp, Homo sapiens
ggctctgagagtctagattctc

SEQ ID NO: 1663047 - DNA, 20 bp, Homo sapiens
ggctctgaggtgcctgtccc

SEQ ID NO: 1663048 - DNA, 23 bp, Homo sapiens
ggctctgaggtgcctgtcccacc

SEQ ID NO: 1663049 - DNA, 12 bp, Homo sapiens
ggctctgcacag

SEQ ID NO: 1663050 - DNA, 14 bp, Homo sapiens
ggctctgcaggcca

SEQ ID NO: 1663051 - DNA, 15 bp, Homo sapiens
ggctctgcaggccac

SEQ ID NO: 1663052 - DNA, 14 bp, Homo sapiens
ggctctgccccagc

SEQ ID NO: 1663053 - DNA, 23 bp, Homo sapiens
ggctctgccccagctctggcttc

SEQ ID NO: 1663054 - DNA, 15 bp, Homo sapiens
ggctctgccccctcc

SEQ ID NO: 1663055 - DNA, 16 bp, Homo sapiens
ggctctgccccctccc

SEQ ID NO: 1663056 - DNA, 18 bp, Homo sapiens
ggctctgccccctccccc

SEQ ID NO: 1663057 - DNA, 16 bp, Homo sapiens
ggctctgccttctcag

SEQ ID NO: 1663058 - DNA, 20 bp, Homo sapiens
ggctctgccttctcaggccc

SEQ ID NO: 1663059 - DNA, 18 bp, Homo sapiens
ggctctgcttcctcagcc

SEQ ID NO: 1663060 - DNA, 21 bp, Homo sapiens
ggctctggccaccctggcccg

SEQ ID NO: 1663061 - DNA, 12 bp, Homo sapiens
ggctctggctct

SEQ ID NO: 1663062 - DNA, 23 bp, Homo sapiens
ggctctgggatagctgacccagc

SEQ ID NO: 1663063 - DNA, 16 bp, Homo sapiens
ggctctgggcctgagg

SEQ ID NO: 1663064 - DNA, 18 bp, Homo sapiens
ggctctgggctcagggct

SEQ ID NO: 1663065 - DNA, 20 bp, Homo sapiens
ggctctgggctcagggctgg

SEQ ID NO: 1663066 - DNA, 15 bp, Homo sapiens
ggctctgtgcaggga

SEQ ID NO: 1663067 - DNA, 11 bp, Homo sapiens
ggctctgtttg

SEQ ID NO: 1663068 - DNA, 14 bp, Homo sapiens
ggctcttaagcagc

SEQ ID NO: 1663069 - DNA, 22 bp, Homo sapiens
ggctcttaagcagcatggaaaa

SEQ ID NO: 1663070 - DNA, 23 bp, Homo sapiens
ggctcttaagcagcatggaaaaa

SEQ ID NO: 1663071 - DNA, 18 bp, Homo sapiens
ggctcttagcagcttcca

SEQ ID NO: 1663072 - DNA, 21 bp, Homo sapiens
ggctcttagcagcttccagat

SEQ ID NO: 1663073 - DNA, 20 bp, Homo sapiens
ggctcttctcatttcacccc

SEQ ID NO: 1663074 - DNA, 22 bp, Homo sapiens
ggctcttctcatttcacccctc

SEQ ID NO: 1663075 - DNA, 12 bp, Homo sapiens
ggctcttctcct

SEQ ID NO: 1663076 - DNA, 14 bp, Homo sapiens
ggctgaaattctcc

SEQ ID NO: 1663077 - DNA, 17 bp, Homo sapiens
ggctgaaattctcctgg

SEQ ID NO: 1663078 - DNA, 19 bp, Homo sapiens
ggctgaaattctcctggag

SEQ ID NO: 1663079 - DNA, 15 bp, Homo sapiens
ggctgaaccctgtgc

SEQ ID NO: 1663080 - DNA, 13 bp, Homo sapiens
ggctgaagagagg

SEQ ID NO: 1663081 - DNA, 19 bp, Homo sapiens
ggctgaagagagggacagg

SEQ ID NO: 1663082 - DNA, 13 bp, Homo sapiens
ggctgaagctgga

SEQ ID NO: 1663083 - DNA, 15 bp, Homo sapiens
ggctgaagctggagc

SEQ ID NO: 1663084 - DNA, 18 bp, Homo sapiens
ggctgaatcttctggaga

SEQ ID NO: 1663085 - DNA, 19 bp, Homo sapiens
ggctgacacctaccatgct

SEQ ID NO: 1663086 - DNA, 21 bp, Homo sapiens
ggctgacacctaccatgctgc

SEQ ID NO: 1663087 - DNA, 17 bp, Homo sapiens
ggctgacatgctcacac

SEQ ID NO: 1663088 - DNA, 15 bp, Homo sapiens
ggctgacccagcatc

SEQ ID NO: 1663089 - DNA, 20 bp, Homo sapiens
ggctgacccagcatctccca

SEQ ID NO: 1663090 - DNA, 19 bp, Homo sapiens
ggctgacccagtccctggg

SEQ ID NO: 1663091 - DNA, 22 bp, Homo sapiens
ggctgacccagtccctggggga

SEQ ID NO: 1663092 - DNA, 14 bp, Homo sapiens
ggctgacccctctg

SEQ ID NO: 1663093 - DNA, 23 bp, Homo sapiens
ggctgacgtgtgagggaggacag

SEQ ID NO: 1663094 - DNA, 10 bp, Homo sapiens
ggctgagaag

SEQ ID NO: 1663095 - DNA, 14 bp, Homo sapiens
ggctgagaaggaac

SEQ ID NO: 1663096 - DNA, 19 bp, Homo sapiens
ggctgagaaggaacaggga

SEQ ID NO: 1663097 - DNA, 11 bp, Homo sapiens
ggctgagacct

SEQ ID NO: 1663098 - DNA, 20 bp, Homo sapiens
ggctgagatagcagaggggc

SEQ ID NO: 1663099 - DNA, 21 bp, Homo sapiens
ggctgagatagcagaggggct

SEQ ID NO: 1663100 - DNA, 14 bp, Homo sapiens
ggctgagccatgag

SEQ ID NO: 1663101 - DNA, 15 bp, Homo sapiens
ggctgagccatgagg

SEQ ID NO: 1663102 - DNA, 23 bp, Homo sapiens
ggctgagccatgaggagcgtgga

SEQ ID NO: 1663103 - DNA, 22 bp, Homo sapiens
ggctgagcccctaccccacacc

SEQ ID NO: 1663104 - DNA, 15 bp, Homo sapiens
ggctgagcccctggg

SEQ ID NO: 1663105 - DNA, 19 bp, Homo sapiens
ggctgagcccctggggaaa

SEQ ID NO: 1663106 - DNA, 15 bp, Homo sapiens
ggctgagcctggctg

SEQ ID NO: 1663107 - DNA, 21 bp, Homo sapiens
ggctgaggaagcacagcagca

SEQ ID NO: 1663108 - DNA, 23 bp, Homo sapiens
ggctgaggacgagacccccatcc

SEQ ID NO: 1663109 - DNA, 13 bp, Homo sapiens
ggctgaggcagaa

SEQ ID NO: 1663110 - DNA, 15 bp, Homo sapiens
ggctgaggcaggaga

SEQ ID NO: 1663111 - DNA, 17 bp, Homo sapiens
ggctgaggcaggagaat

SEQ ID NO: 1663112 - DNA, 23 bp, Homo sapiens
ggctgaggcaggagaatggtgtg

SEQ ID NO: 1663113 - DNA, 12 bp, Homo sapiens
ggctgagggcct

SEQ ID NO: 1663114 - DNA, 13 bp, Homo sapiens
ggctgagggcctg

SEQ ID NO: 1663115 - DNA, 14 bp, Homo sapiens
ggctgagggcctgc

SEQ ID NO: 1663116 - DNA, 17 bp, Homo sapiens
ggctgagggcctgctgg

SEQ ID NO: 1663117 - DNA, 21 bp, Homo sapiens
ggctgagggcctgctggaggc

SEQ ID NO: 1663118 - DNA, 16 bp, Homo sapiens
ggctgagggtgccctt

SEQ ID NO: 1663119 - DNA, 23 bp, Homo sapiens
ggctgagggtgcccttttccagc

SEQ ID NO: 1663120 - DNA, 14 bp, Homo sapiens
ggctgaggttcctc

SEQ ID NO: 1663121 - DNA, 18 bp, Homo sapiens
ggctgaggttcctctgcc

SEQ ID NO: 1663122 - DNA, 19 bp, Homo sapiens
ggctgaggttcctctgcct

SEQ ID NO: 1663123 - DNA, 23 bp, Homo sapiens
ggctgaggttcctctgcctgccc

SEQ ID NO: 1663124 - DNA, 22 bp, Homo sapiens
ggctgagtcatgatctccctgc

SEQ ID NO: 1663125 - DNA, 19 bp, Homo sapiens
ggctgagtggaatgcaggg

SEQ ID NO: 1663126 - DNA, 18 bp, Homo sapiens
ggctgagtggcagcagcc

SEQ ID NO: 1663127 - DNA, 17 bp, Homo sapiens
ggctgagtggggagcag

SEQ ID NO: 1663128 - DNA, 13 bp, Homo sapiens
ggctgatctcagg

SEQ ID NO: 1663129 - DNA, 19 bp, Homo sapiens
ggctgatctcagggaagcc

SEQ ID NO: 1663130 - DNA, 13 bp, Homo sapiens
ggctgatgaagaa

SEQ ID NO: 1663131 - DNA, 17 bp, Homo sapiens
ggctgatgaagaagggg

SEQ ID NO: 1663132 - DNA, 16 bp, Homo sapiens
ggctgatgatccagaa

SEQ ID NO: 1663133 - DNA, 16 bp, Homo sapiens
ggctgatggaggaaaa

SEQ ID NO: 1663134 - DNA, 22 bp, Homo sapiens
ggctgatgtcaatttctgtgtt

SEQ ID NO: 1663135 - DNA, 24 bp, Homo sapiens
ggctgatgtcaatttctgtgttgc

SEQ ID NO: 1663136 - DNA, 17 bp, Homo sapiens
ggctgatgtggactgtc

SEQ ID NO: 1663137 - DNA, 18 bp, Homo sapiens
ggctgatgtggactgtct

SEQ ID NO: 1663138 - DNA, 23 bp, Homo sapiens
ggctgcaaataaggacagcagct

SEQ ID NO: 1663139 - DNA, 14 bp, Homo sapiens
ggctgcaatgccct

SEQ ID NO: 1663140 - DNA, 22 bp, Homo sapiens
ggctgcacattgcctgttctgc

SEQ ID NO: 1663141 - DNA, 21 bp, Homo sapiens
ggctgcactcttgaactgggc

SEQ ID NO: 1663142 - DNA, 13 bp, Homo sapiens
ggctgcagaggcc

SEQ ID NO: 1663143 - DNA, 16 bp, Homo sapiens
ggctgcagcaggtgct

SEQ ID NO: 1663144 - DNA, 20 bp, Homo sapiens
ggctgcagcaggtgctgggc

SEQ ID NO: 1663145 - DNA, 22 bp, Homo sapiens
ggctgcagcaggtgctgggctg

SEQ ID NO: 1663146 - DNA, 21 bp, Homo sapiens
ggctgcagcatgttgctgagg

SEQ ID NO: 1663147 - DNA, 14 bp, Homo sapiens
ggctgcagcctcca

SEQ ID NO: 1663148 - DNA, 14 bp, Homo sapiens
gggactgccagggc

SEQ ID NO: 1663149 - DNA, 20 bp, Homo sapiens
gggactgggtttggacccca

SEQ ID NO: 1663150 - DNA, 21 bp, Homo sapiens
gggactgtctttcagatacat

SEQ ID NO: 1663151 - DNA, 13 bp, Homo sapiens
gggacttgtgtct

SEQ ID NO: 1663152 - DNA, 12 bp, Homo sapiens
gggacttttatt

SEQ ID NO: 1663153 - DNA, 11 bp, Homo sapiens
gggagaaaaga

SEQ ID NO: 1663154 - DNA, 14 bp, Homo sapiens
gggagaaaatcatc

SEQ ID NO: 1663155 - DNA, 14 bp, Homo sapiens
gggagaaagcaata

SEQ ID NO: 1663156 - DNA, 15 bp, Homo sapiens
gggagaaagggcaaa

SEQ ID NO: 1663157 - DNA, 13 bp, Homo sapiens
gggagaaagtagg

SEQ ID NO: 1663158 - DNA, 14 bp, Homo sapiens
gggagaagaagaat

SEQ ID NO: 1663159 - DNA, 19 bp, Homo sapiens
gggagaaggaagggcagag

SEQ ID NO: 1663160 - DNA, 23 bp, Homo sapiens
gggagaatgtcaaggaagacttt

SEQ ID NO: 1663161 - DNA, 19 bp, Homo sapiens
gggagacactggcccctca

SEQ ID NO: 1663162 - DNA, 12 bp, Homo sapiens
gggagacagcat

SEQ ID NO: 1663163 - DNA, 9 bp, Homo sapiens
gggagacct

SEQ ID NO: 1663164 - DNA, 11 bp, Homo sapiens
gggagacctgg

SEQ ID NO: 1663165 - DNA, 18 bp, Homo sapiens
gggagacggtttccaggg

SEQ ID NO: 1663166 - DNA, 20 bp, Homo sapiens
gggagacggtttccagggag

SEQ ID NO: 1663167 - DNA, 19 bp, Homo sapiens
gggagacttgttctagaga

SEQ ID NO: 1663168 - DNA, 14 bp, Homo sapiens
gggagactttctga

SEQ ID NO: 1663169 - DNA, 19 bp, Homo sapiens
gggagagagaagcaggcag

SEQ ID NO: 1663170 - DNA, 21 bp, Homo sapiens
gggagagatccctgcagaacc

SEQ ID NO: 1663171 - DNA, 13 bp, Homo sapiens
gggagagcctgct

SEQ ID NO: 1663172 - DNA, 15 bp, Homo sapiens
gggagagcggctgga

SEQ ID NO: 1663173 - DNA, 15 bp, Homo sapiens
gggagagctgagcca

SEQ ID NO: 1663174 - DNA, 17 bp, Homo sapiens
gggagaggcatggctgg

SEQ ID NO: 1663175 - DNA, 12 bp, Homo sapiens
gggagcacccag

SEQ ID NO: 1663176 - DNA, 11 bp, Homo sapiens
gggagcactgg

SEQ ID NO: 1663177 - DNA, 14 bp, Homo sapiens
gggagcactggagt

SEQ ID NO: 1663178 - DNA, 16 bp, Homo sapiens
gggagcactggagtgc

SEQ ID NO: 1663179 - DNA, 13 bp, Homo sapiens
gggagcagagaca

SEQ ID NO: 1663180 - DNA, 21 bp, Homo sapiens
gggagcaggttccccaagggc

SEQ ID NO: 1663181 - DNA, 22 bp, Homo sapiens
gggagcagttttcccctggcct

SEQ ID NO: 1663182 - DNA, 22 bp, Homo sapiens
gggagcatttaatggcagctag

SEQ ID NO: 1663183 - DNA, 22 bp, Homo sapiens
gggagccaaaatctcaagaaat

SEQ ID NO: 1663184 - DNA, 11 bp, Homo sapiens
gggagccagcc

SEQ ID NO: 1663185 - DNA, 14 bp, Homo sapiens
gggagccagctgct

SEQ ID NO: 1663186 - DNA, 15 bp, Homo sapiens
gggagccagctgctt

SEQ ID NO: 1663187 - DNA, 20 bp, Homo sapiens
gggagccagctgctttttgt

SEQ ID NO: 1663188 - DNA, 12 bp, Homo sapiens
gggagccagggc

SEQ ID NO: 1663189 - DNA, 15 bp, Homo sapiens
gggagccatttgaga

SEQ ID NO: 1663190 - DNA, 19 bp, Homo sapiens
gggagcccactgtcctggg

SEQ ID NO: 1663191 - DNA, 20 bp, Homo sapiens
gggagcccctcctctgagca

SEQ ID NO: 1663192 - DNA, 17 bp, Homo sapiens
gggagccggcggcctct

SEQ ID NO: 1663193 - DNA, 16 bp, Homo sapiens
gggagccgggccgcag

SEQ ID NO: 1663194 - DNA, 21 bp, Homo sapiens
gggagcctttggttctggcca

SEQ ID NO: 1663195 - DNA, 19 bp, Homo sapiens
gggagctccactctgcttc

SEQ ID NO: 1663196 - DNA, 15 bp, Homo sapiens
gggagctctggggac

SEQ ID NO: 1663197 - DNA, 18 bp, Homo sapiens
gggagctctggggacagc

SEQ ID NO: 1663198 - DNA, 13 bp, Homo sapiens
gggagctctgtat

SEQ ID NO: 1663199 - DNA, 22 bp, Homo sapiens
gggagctgagctggaaggggcc

SEQ ID NO: 1663200 - DNA, 18 bp, Homo sapiens
gggagctgaggagccctt

SEQ ID NO: 1663201 - DNA, 23 bp, Homo sapiens
gggagcttcccacacctgcctgc

SEQ ID NO: 1663202 - DNA, 17 bp, Homo sapiens
gggagcttccgctttga

SEQ ID NO: 1663203 - DNA, 22 bp, Homo sapiens
gggaggagcctgtgcgtcccag

SEQ ID NO: 1663204 - DNA, 17 bp, Homo sapiens
gggaggaggccacctct

SEQ ID NO: 1663205 - DNA, 14 bp, Homo sapiens
gggaggagggagag

SEQ ID NO: 1663206 - DNA, 16 bp, Homo sapiens
gggaggcaagaaaagg

SEQ ID NO: 1663207 - DNA, 18 bp, Homo sapiens
gggaggcaagtgtggggg

SEQ ID NO: 1663208 - DNA, 20 bp, Homo sapiens
gggaggcacactttctggca

SEQ ID NO: 1663209 - DNA, 14 bp, Homo sapiens
gggaggcaccagct

SEQ ID NO: 1663210 - DNA, 19 bp, Homo sapiens
gggaggcagatggagccca

SEQ ID NO: 1663211 - DNA, 12 bp, Homo sapiens
gggaggcagccg

SEQ ID NO: 1663212 - DNA, 19 bp, Homo sapiens
gggaggccaaggcaggtag

SEQ ID NO: 1663213 - DNA, 18 bp, Homo sapiens
gggaggcgtgcccccctc

SEQ ID NO: 1663214 - DNA, 18 bp, Homo sapiens
gggaggctgaggcagaag

SEQ ID NO: 1663215 - DNA, 20 bp, Homo sapiens
gggaggctgctttctgccct

SEQ ID NO: 1663216 - DNA, 16 bp, Homo sapiens
gggaggggcgctggcc

SEQ ID NO: 1663217 - DNA, 19 bp, Homo sapiens
gggaggggcgctggcccag

SEQ ID NO: 1663218 - DNA, 23 bp, Homo sapiens
gggaggggcggcaggagggaggt

SEQ ID NO: 1663219 - DNA, 17 bp, Homo sapiens
gggaggggttgttttgg

SEQ ID NO: 1663220 - DNA, 17 bp, Homo sapiens
gggagggttggggaggg

SEQ ID NO: 1663221 - DNA, 14 bp, Homo sapiens
gggaggtggctggg

SEQ ID NO: 1663222 - DNA, 14 bp, Homo sapiens
gggaggtggtcctc

SEQ ID NO: 1663223 - DNA, 21 bp, Homo sapiens
gggaggttttattctgacttc

SEQ ID NO: 1663224 - DNA, 18 bp, Homo sapiens
gggagtggttcctgtgga

SEQ ID NO: 1663225 - DNA, 14 bp, Homo sapiens
gggagttagggaga

SEQ ID NO: 1663226 - DNA, 20 bp, Homo sapiens
gggagttagggagagagaag

SEQ ID NO: 1663227 - DNA, 20 bp, Homo sapiens
gggagttcgagaccaacctg

SEQ ID NO: 1663228 - DNA, 23 bp, Homo sapiens
gggagttcgagaccaacctgacc

SEQ ID NO: 1663229 - DNA, 22 bp, Homo sapiens
gggagttgtcaagtctctgctg

SEQ ID NO: 1663230 - DNA, 14 bp, Homo sapiens
gggataatttattt

SEQ ID NO: 1663231 - DNA, 15 bp, Homo sapiens
gggataatttatttt

SEQ ID NO: 1663232 - DNA, 21 bp, Homo sapiens
gggatagtgttctgctcctgc

SEQ ID NO: 1663233 - DNA, 17 bp, Homo sapiens
gggatataatacatatt

SEQ ID NO: 1663234 - DNA, 20 bp, Homo sapiens
gggatattgccttatttgtc

SEQ ID NO: 1663235 - DNA, 21 bp, Homo sapiens
gggatatttcctaaggcatgt

SEQ ID NO: 1663236 - DNA, 17 bp, Homo sapiens
gggatcaataggaaagc

SEQ ID NO: 1663237 - DNA, 12 bp, Homo sapiens
gggatcactggc

SEQ ID NO: 1663238 - DNA, 13 bp, Homo sapiens
gggatccagccac

SEQ ID NO: 1663239 - DNA, 17 bp, Homo sapiens
gggatccccgcctggcc

SEQ ID NO: 1663240 - DNA, 20 bp, Homo sapiens
gggatcctccacagagagga

SEQ ID NO: 1663241 - DNA, 22 bp, Homo sapiens
gggatcggggcaagagaggctg

SEQ ID NO: 1663242 - DNA, 18 bp, Homo sapiens
gggatctctctacaagag

SEQ ID NO: 1663243 - DNA, 13 bp, Homo sapiens
gggatctgggcaa

SEQ ID NO: 1663244 - DNA, 19 bp, Homo sapiens
gggatcttcccacaggagg

SEQ ID NO: 1663245 - DNA, 22 bp, Homo sapiens
gggatgaggtcaccaggggagg

SEQ ID NO: 1663246 - DNA, 16 bp, Homo sapiens
gggatgattgcttgag

SEQ ID NO: 1663247 - DNA, 15 bp, Homo sapiens
gggatgccaatttcc

SEQ ID NO: 1663248 - DNA, 20 bp, Homo sapiens
gggatgccactcctccctcc

SEQ ID NO: 1663249 - DNA, 13 bp, Homo sapiens
gggatgctgctcc

SEQ ID NO: 1663250 - DNA, 14 bp, Homo sapiens
gggatgctgggctg

SEQ ID NO: 1663251 - DNA, 17 bp, Homo sapiens
gggatgctgggctgggc

SEQ ID NO: 1663252 - DNA, 21 bp, Homo sapiens
gggatggacttgtgattggct

SEQ ID NO: 1663253 - DNA, 22 bp, Homo sapiens
gggatggacttgtgattggctg

SEQ ID NO: 1663254 - DNA, 12 bp, Homo sapiens
gggatggggagg

SEQ ID NO: 1663255 - DNA, 20 bp, Homo sapiens
gggatggtcggatctcacag

SEQ ID NO: 1663256 - DNA, 17 bp, Homo sapiens
gggatggtgcccctagg

SEQ ID NO: 1663257 - DNA, 14 bp, Homo sapiens
gggatgtctctcat

SEQ ID NO: 1663258 - DNA, 14 bp, Homo sapiens
gggatgtgacatgc

SEQ ID NO: 1663259 - DNA, 21 bp, Homo sapiens
gggatgtgggtaagaggagca

SEQ ID NO: 1663260 - DNA, 16 bp, Homo sapiens
gggatgttctggccct

SEQ ID NO: 1663261 - DNA, 16 bp, Homo sapiens
gggattaacctctgca

SEQ ID NO: 1663262 - DNA, 14 bp, Homo sapiens
gggattcaggctgc

SEQ ID NO: 1663263 - DNA, 20 bp, Homo sapiens
gggccgtaggggctcctgag

SEQ ID NO: 1663264 - DNA, 15 bp, Homo sapiens
gggccgtgcccttgc

SEQ ID NO: 1663265 - DNA, 20 bp, Homo sapiens
gggccgtgtcccgcggtgct

SEQ ID NO: 1663266 - DNA, 17 bp, Homo sapiens
gggcctactagagtctg

SEQ ID NO: 1663267 - DNA, 17 bp, Homo sapiens
gggcctccagaagctgc

SEQ ID NO: 1663268 - DNA, 12 bp, Homo sapiens
gggcctccaggg

SEQ ID NO: 1663269 - DNA, 17 bp, Homo sapiens
gggcctccatgccccag

SEQ ID NO: 1663270 - DNA, 18 bp, Homo sapiens
gggcctccatgccccagc

SEQ ID NO: 1663271 - DNA, 18 bp, Homo sapiens
gggcctcccaccgcagcg

SEQ ID NO: 1663272 - DNA, 16 bp, Homo sapiens
gggcctcccactcctg

SEQ ID NO: 1663273 - DNA, 21 bp, Homo sapiens
gggcctcctcacccaccctgt

SEQ ID NO: 1663274 - DNA, 13 bp, Homo sapiens
gggcctcctgcct

SEQ ID NO: 1663275 - DNA, 20 bp, Homo sapiens
gggcctcctgcctccgggca

SEQ ID NO: 1663276 - DNA, 18 bp, Homo sapiens
gggcctccttcccatgcc

SEQ ID NO: 1663277 - DNA, 22 bp, Homo sapiens
gggcctccttcccatgcctgtc

SEQ ID NO: 1663278 - DNA, 15 bp, Homo sapiens
gggcctccttcttcc

SEQ ID NO: 1663279 - DNA, 17 bp, Homo sapiens
gggcctccttgtccagg

SEQ ID NO: 1663280 - DNA, 18 bp, Homo sapiens
gggcctccttgtccaggt

SEQ ID NO: 1663281 - DNA, 17 bp, Homo sapiens
gggcctcggagcctcat

SEQ ID NO: 1663282 - DNA, 14 bp, Homo sapiens
gggcctcgggacct

SEQ ID NO: 1663283 - DNA, 15 bp, Homo sapiens
gggcctctcctgccc

SEQ ID NO: 1663284 - DNA, 14 bp, Homo sapiens
gggcctgagcagct

SEQ ID NO: 1663285 - DNA, 14 bp, Homo sapiens
gggcctgccctctg

SEQ ID NO: 1663286 - DNA, 19 bp, Homo sapiens
gggcctgccctctgcccca

SEQ ID NO: 1663287 - DNA, 19 bp, Homo sapiens
gggcctgcgccagtcctgc

SEQ ID NO: 1663288 - DNA, 13 bp, Homo sapiens
gggcctgctccag

SEQ ID NO: 1663289 - DNA, 15 bp, Homo sapiens
gggcctgctccagac

SEQ ID NO: 1663290 - DNA, 14 bp, Homo sapiens
gggcctgctggagg

SEQ ID NO: 1663291 - DNA, 18 bp, Homo sapiens
gggcctgcttttccagga

SEQ ID NO: 1663292 - DNA, 13 bp, Homo sapiens
gggcctggacctg

SEQ ID NO: 1663293 - DNA, 16 bp, Homo sapiens
gggcctggacctgcct

SEQ ID NO: 1663294 - DNA, 21 bp, Homo sapiens
gggcctggagatcctcctgca

SEQ ID NO: 1663295 - DNA, 15 bp, Homo sapiens
gggcctggagcatgg

SEQ ID NO: 1663296 - DNA, 16 bp, Homo sapiens
gggcctggagcatgga

SEQ ID NO: 1663297 - DNA, 11 bp, Homo sapiens
gggcctggagg

SEQ ID NO: 1663298 - DNA, 20 bp, Homo sapiens
gggcctggattcatttcctg

SEQ ID NO: 1663299 - DNA, 19 bp, Homo sapiens
gggcctggccagtcctggt

SEQ ID NO: 1663300 - DNA, 23 bp, Homo sapiens
gggcctggccagtcctggtcctg

SEQ ID NO: 1663301 - DNA, 13 bp, Homo sapiens
gggcctggcctga

SEQ ID NO: 1663302 - DNA, 22 bp, Homo sapiens
gggcctggcctgagctggggcc

SEQ ID NO: 1663303 - DNA, 16 bp, Homo sapiens
gggcctggcttgctcc

SEQ ID NO: 1663304 - DNA, 22 bp, Homo sapiens
gggcctggcttgctccagggtc

SEQ ID NO: 1663305 - DNA, 23 bp, Homo sapiens
gggcctggcttgctccagggtct

SEQ ID NO: 1663306 - DNA, 14 bp, Homo sapiens
gggcctgggcctcc

SEQ ID NO: 1663307 - DNA, 12 bp, Homo sapiens
gggcctggggct

SEQ ID NO: 1663308 - DNA, 20 bp, Homo sapiens
gggcctgggggcagtgactg

SEQ ID NO: 1663309 - DNA, 20 bp, Homo sapiens
gggcctgtgcagcagcccag

SEQ ID NO: 1663310 - DNA, 21 bp, Homo sapiens
gggccttagggcactgggctg

SEQ ID NO: 1663311 - DNA, 11 bp, Homo sapiens
gggccttcctt

SEQ ID NO: 1663312 - DNA, 14 bp, Homo sapiens
gggccttccttttg

SEQ ID NO: 1663313 - DNA, 12 bp, Homo sapiens
gggccttgccca

SEQ ID NO: 1663314 - DNA, 14 bp, Homo sapiens
gggccttgcccaga

SEQ ID NO: 1663315 - DNA, 22 bp, Homo sapiens
gggccttgcccagagatgcctc

SEQ ID NO: 1663316 - DNA, 15 bp, Homo sapiens
gggccttggatcgct

SEQ ID NO: 1663317 - DNA, 18 bp, Homo sapiens
gggccttttctggcaccg

SEQ ID NO: 1663318 - DNA, 20 bp, Homo sapiens
gggcgagactctgtctcaaa

SEQ ID NO: 1663319 - DNA, 19 bp, Homo sapiens
gggcgagcccctccttctc

SEQ ID NO: 1663320 - DNA, 17 bp, Homo sapiens
gggcgcccaccctgggc

SEQ ID NO: 1663321 - DNA, 23 bp, Homo sapiens
gggcgcccattcgtctgtcccag

SEQ ID NO: 1663322 - DNA, 19 bp, Homo sapiens
gggcgccctctctgctcct

SEQ ID NO: 1663323 - DNA, 18 bp, Homo sapiens
gggcgcgatcccacacag

SEQ ID NO: 1663324 - DNA, 21 bp, Homo sapiens
gggcgctcagacggcggccag

SEQ ID NO: 1663325 - DNA, 17 bp, Homo sapiens
gggcgctcaggacccag

SEQ ID NO: 1663326 - DNA, 19 bp, Homo sapiens
gggcgctcaggacccaggc

SEQ ID NO: 1663327 - DNA, 22 bp, Homo sapiens
gggcgctcaggacccaggccct

SEQ ID NO: 1663328 - DNA, 15 bp, Homo sapiens
gggcgctgcagcctc

SEQ ID NO: 1663329 - DNA, 17 bp, Homo sapiens
gggcgctgcagcctccc

SEQ ID NO: 1663330 - DNA, 14 bp, Homo sapiens
gggcgctggcccag

SEQ ID NO: 1663331 - DNA, 23 bp, Homo sapiens
gggcgctggcccagccggcctct

SEQ ID NO: 1663332 - DNA, 13 bp, Homo sapiens
gggcggaagagtt

SEQ ID NO: 1663333 - DNA, 17 bp, Homo sapiens
gggcggcaggggcctgg

SEQ ID NO: 1663334 - DNA, 21 bp, Homo sapiens
gggcggcaggggcctggagat

SEQ ID NO: 1663335 - DNA, 16 bp, Homo sapiens
gggcgggccagggtgg

SEQ ID NO: 1663336 - DNA, 12 bp, Homo sapiens
gggcggggcagg

SEQ ID NO: 1663337 - DNA, 14 bp, Homo sapiens
gggctacaggatgg

SEQ ID NO: 1663338 - DNA, 22 bp, Homo sapiens
gggctaccctaaagggagaagg

SEQ ID NO: 1663339 - DNA, 14 bp, Homo sapiens
gggctatggcaagg

SEQ ID NO: 1663340 - DNA, 17 bp, Homo sapiens
gggctatttctctcccc

SEQ ID NO: 1663341 - DNA, 18 bp, Homo sapiens
gggctatttctctcccca

SEQ ID NO: 1663342 - DNA, 18 bp, Homo sapiens
gggctcaaagcccttcct

SEQ ID NO: 1663343 - DNA, 18 bp, Homo sapiens
gggctcagagtggggtag

SEQ ID NO: 1663344 - DNA, 11 bp, Homo sapiens
gggctcagcct

SEQ ID NO: 1663345 - DNA, 12 bp, Homo sapiens
gggctcagcctg

SEQ ID NO: 1663346 - DNA, 13 bp, Homo sapiens
gggctcagggctg

SEQ ID NO: 1663347 - DNA, 14 bp, Homo sapiens
gggctcagggctgg

SEQ ID NO: 1663348 - DNA, 15 bp, Homo sapiens
gggctcagggctgga

SEQ ID NO: 1663349 - DNA, 18 bp, Homo sapiens
gggctccacacagcagtg

SEQ ID NO: 1663350 - DNA, 22 bp, Homo sapiens
gggctccacacagcagtgtccc

SEQ ID NO: 1663351 - DNA, 13 bp, Homo sapiens
gggctccagcatc

SEQ ID NO: 1663352 - DNA, 17 bp, Homo sapiens
gggctccagcatccagc

SEQ ID NO: 1663353 - DNA, 20 bp, Homo sapiens
gggctccagcatccagcctg

SEQ ID NO: 1663354 - DNA, 11 bp, Homo sapiens
gggctcccagg

SEQ ID NO: 1663355 - DNA, 15 bp, Homo sapiens
gggctccctctctgg

SEQ ID NO: 1663356 - DNA, 19 bp, Homo sapiens
gggctccctctctggtttc

SEQ ID NO: 1663357 - DNA, 11 bp, Homo sapiens
gggctcctgga

SEQ ID NO: 1663358 - DNA, 13 bp, Homo sapiens
gggctcctggctg

SEQ ID NO: 1663359 - DNA, 21 bp, Homo sapiens
gggctcctgtggcagctgccc

SEQ ID NO: 1663360 - DNA, 12 bp, Homo sapiens
gggctccttccc

SEQ ID NO: 1663361 - DNA, 15 bp, Homo sapiens
gggctccttcccctg

SEQ ID NO: 1663362 - DNA, 20 bp, Homo sapiens
gggctcgaggggtgggctgg

SEQ ID NO: 1663363 - DNA, 14 bp, Homo sapiens
gggctcgccatgcc

SEQ ID NO: 1663364 - DNA, 21 bp, Homo sapiens
gggctcgccgtgtctcagcct

SEQ ID NO: 1663365 - DNA, 22 bp, Homo sapiens
gggctctcacccagtccccacc

SEQ ID NO: 1663366 - DNA, 13 bp, Homo sapiens
gggctctccaaag

SEQ ID NO: 1663367 - DNA, 19 bp, Homo sapiens
gggctctccaaaggggctg

SEQ ID NO: 1663368 - DNA, 23 bp, Homo sapiens
gggctctccaaaggggctgctgg

SEQ ID NO: 1663369 - DNA, 14 bp, Homo sapiens
gggctctccacctc

SEQ ID NO: 1663370 - DNA, 18 bp, Homo sapiens
gggctctccacctcagcc

SEQ ID NO: 1663371 - DNA, 21 bp, Homo sapiens
gggctctccacctcagccttg

SEQ ID NO: 1663372 - DNA, 19 bp, Homo sapiens
gggctctctgctgtacata

SEQ ID NO: 1663373 - DNA, 21 bp, Homo sapiens
gggctctgcaattcccctctg

SEQ ID NO: 1663374 - DNA, 13 bp, Homo sapiens
gggctctgcccca

SEQ ID NO: 1663375 - DNA, 21 bp, Homo sapiens
gggctctgccccagctctggc

SEQ ID NO: 1663376 - DNA, 21 bp, Homo sapiens
gggctctgccctccctccttc

SEQ ID NO: 1663377 - DNA, 14 bp, Homo sapiens
gggctctggccacc

SEQ ID NO: 1663378 - DNA, 14 bp, Homo sapiens
ggtcaacagagaag

SEQ ID NO: 1663379 - DNA, 20 bp, Homo sapiens
ggtcaacagagaaggcagga

SEQ ID NO: 1663380 - DNA, 23 bp, Homo sapiens
ggtcaacatcttttacattctgc

SEQ ID NO: 1663381 - DNA, 20 bp, Homo sapiens
ggtcaagattttgaatgctt

SEQ ID NO: 1663382 - DNA, 13 bp, Homo sapiens
ggtcaagcccaga

SEQ ID NO: 1663383 - DNA, 20 bp, Homo sapiens
ggtcaaggccacctctgcct

SEQ ID NO: 1663384 - DNA, 22 bp, Homo sapiens
ggtcaaggccacctctgcctct

SEQ ID NO: 1663385 - DNA, 21 bp, Homo sapiens
ggtcaagggcttactatttct

SEQ ID NO: 1663386 - DNA, 11 bp, Homo sapiens
ggtcaataaac

SEQ ID NO: 1663387 - DNA, 16 bp, Homo sapiens
ggtcacagcatggagg

SEQ ID NO: 1663388 - DNA, 15 bp, Homo sapiens
ggtcacagcggaggt

SEQ ID NO: 1663389 - DNA, 21 bp, Homo sapiens
ggtcacagcggaggtgtggag

SEQ ID NO: 1663390 - DNA, 14 bp, Homo sapiens
ggtcacatccatcc

SEQ ID NO: 1663391 - DNA, 16 bp, Homo sapiens
ggtcacatccatccct

SEQ ID NO: 1663392 - DNA, 13 bp, Homo sapiens
ggtcaccagctgc

SEQ ID NO: 1663393 - DNA, 15 bp, Homo sapiens
ggtcaccagctgctg

SEQ ID NO: 1663394 - DNA, 16 bp, Homo sapiens
ggtcaccagctgctgt

SEQ ID NO: 1663395 - DNA, 21 bp, Homo sapiens
ggtcaccaggggaggagcctg

SEQ ID NO: 1663396 - DNA, 22 bp, Homo sapiens
ggtcaccaggggaggagcctgt

SEQ ID NO: 1663397 - DNA, 15 bp, Homo sapiens
ggtcaccatgaaact

SEQ ID NO: 1663398 - DNA, 20 bp, Homo sapiens
ggtcactcaggcctctgcag

SEQ ID NO: 1663399 - DNA, 22 bp, Homo sapiens
ggtcactcaggcctctgcagaa

SEQ ID NO: 1663400 - DNA, 19 bp, Homo sapiens
ggtcactctgccctctgct

SEQ ID NO: 1663401 - DNA, 18 bp, Homo sapiens
ggtcactggctctccaag

SEQ ID NO: 1663402 - DNA, 17 bp, Homo sapiens
ggtcagaaccagagggc

SEQ ID NO: 1663403 - DNA, 22 bp, Homo sapiens
ggtcagagaaaatgagaaagga

SEQ ID NO: 1663404 - DNA, 17 bp, Homo sapiens
ggtcagagatgggctga

SEQ ID NO: 1663405 - DNA, 23 bp, Homo sapiens
ggtcagagatgggctgaactgag

SEQ ID NO: 1663406 - DNA, 13 bp, Homo sapiens
ggtcagagccact

SEQ ID NO: 1663407 - DNA, 14 bp, Homo sapiens
ggtcagagggccca

SEQ ID NO: 1663408 - DNA, 14 bp, Homo sapiens
ggtcagagtgccac

SEQ ID NO: 1663409 - DNA, 21 bp, Homo sapiens
ggtcagcatgtctattcagct

SEQ ID NO: 1663410 - DNA, 13 bp, Homo sapiens
ggtcagcccagca

SEQ ID NO: 1663411 - DNA, 14 bp, Homo sapiens
ggtcagcccagcac

SEQ ID NO: 1663412 - DNA, 15 bp, Homo sapiens
ggtcagcctggaagg

SEQ ID NO: 1663413 - DNA, 17 bp, Homo sapiens
ggtcaggagatcgagac

SEQ ID NO: 1663414 - DNA, 21 bp, Homo sapiens
ggtcaggagttcctaaccagc

SEQ ID NO: 1663415 - DNA, 18 bp, Homo sapiens
ggtcaggagttgtgtcta

SEQ ID NO: 1663416 - DNA, 22 bp, Homo sapiens
ggtcaggatgtaggggttaact

SEQ ID NO: 1663417 - DNA, 19 bp, Homo sapiens
ggtcaggcggggtgctgtg

SEQ ID NO: 1663418 - DNA, 22 bp, Homo sapiens
ggtcaggcggggtgctgtggtg

SEQ ID NO: 1663419 - DNA, 17 bp, Homo sapiens
ggtcaggtgtcaggccc

SEQ ID NO: 1663420 - DNA, 18 bp, Homo sapiens
ggtcaggtgtcaggcccg

SEQ ID NO: 1663421 - DNA, 20 bp, Homo sapiens
ggtcaggttatactcctcct

SEQ ID NO: 1663422 - DNA, 16 bp, Homo sapiens
ggtcatagtttcctga

SEQ ID NO: 1663423 - DNA, 18 bp, Homo sapiens
ggtcatattaatatattt

SEQ ID NO: 1663424 - DNA, 14 bp, Homo sapiens
ggtcatcagggagg

SEQ ID NO: 1663425 - DNA, 17 bp, Homo sapiens
ggtcatcatgaaaggtt

SEQ ID NO: 1663426 - DNA, 14 bp, Homo sapiens
ggtcatctggcgga

SEQ ID NO: 1663427 - DNA, 17 bp, Homo sapiens
ggtcatgcagttcctgg

SEQ ID NO: 1663428 - DNA, 22 bp, Homo sapiens
ggtcatgcttttgccactttgg

SEQ ID NO: 1663429 - DNA, 16 bp, Homo sapiens
ggtcatgtatgatgag

SEQ ID NO: 1663430 - DNA, 21 bp, Homo sapiens
ggtccaaaaaaaggaaaaata

SEQ ID NO: 1663431 - DNA, 17 bp, Homo sapiens
ggtccaacgccgccttg

SEQ ID NO: 1663432 - DNA, 12 bp, Homo sapiens
ggtccacagctg

SEQ ID NO: 1663433 - DNA, 14 bp, Homo sapiens
ggtccacagctgga

SEQ ID NO: 1663434 - DNA, 18 bp, Homo sapiens
ggtccacaggtctagact

SEQ ID NO: 1663435 - DNA, 14 bp, Homo sapiens
ggtccacctggaga

SEQ ID NO: 1663436 - DNA, 18 bp, Homo sapiens
ggtccagaaactcctgtt

SEQ ID NO: 1663437 - DNA, 18 bp, Homo sapiens
ggtccagagaccacacca

SEQ ID NO: 1663438 - DNA, 23 bp, Homo sapiens
ggtccagcgtcactccagtgctc

SEQ ID NO: 1663439 - DNA, 11 bp, Homo sapiens
ggtccagctct

SEQ ID NO: 1663440 - DNA, 20 bp, Homo sapiens
ggtccagctctgacatccct

SEQ ID NO: 1663441 - DNA, 22 bp, Homo sapiens
ggtccagctctgacatcccttc

SEQ ID NO: 1663442 - DNA, 23 bp, Homo sapiens
ggtccagctctgacatcccttcc

SEQ ID NO: 1663443 - DNA, 13 bp, Homo sapiens
ggtccagctctgg

SEQ ID NO: 1663444 - DNA, 22 bp, Homo sapiens
ggtccagctctggaggggaggg

SEQ ID NO: 1663445 - DNA, 12 bp, Homo sapiens
ggtccagctctt

SEQ ID NO: 1663446 - DNA, 23 bp, Homo sapiens
ggtccagctcttggcccctgtgt

SEQ ID NO: 1663447 - DNA, 20 bp, Homo sapiens
ggtccagctggcctggacag

SEQ ID NO: 1663448 - DNA, 17 bp, Homo sapiens
ggtccagctgggcctcc

SEQ ID NO: 1663449 - DNA, 22 bp, Homo sapiens
ggtccagctgggcctcctgcct

SEQ ID NO: 1663450 - DNA, 15 bp, Homo sapiens
ggtccaggaaggcag

SEQ ID NO: 1663451 - DNA, 16 bp, Homo sapiens
ggtccaggaaggcagc

SEQ ID NO: 1663452 - DNA, 17 bp, Homo sapiens
ggtccaggaaggcagct

SEQ ID NO: 1663453 - DNA, 12 bp, Homo sapiens
ggtccaggcccg

SEQ ID NO: 1663454 - DNA, 21 bp, Homo sapiens
ggtccagggcctgacaccccc

SEQ ID NO: 1663455 - DNA, 22 bp, Homo sapiens
ggtccagggcctgacaccccct

SEQ ID NO: 1663456 - DNA, 14 bp, Homo sapiens
ggtccatttgttcc

SEQ ID NO: 1663457 - DNA, 11 bp, Homo sapiens
ggtcccagtgg

SEQ ID NO: 1663458 - DNA, 19 bp, Homo sapiens
ggtcccagtgggaggggca

SEQ ID NO: 1663459 - DNA, 21 bp, Homo sapiens
ggtcccagtgggaggggcagg

SEQ ID NO: 1663460 - DNA, 13 bp, Homo sapiens
ggtcccatccagg

SEQ ID NO: 1663461 - DNA, 16 bp, Homo sapiens
ggtcccatccaggcag

SEQ ID NO: 1663462 - DNA, 16 bp, Homo sapiens
ggtcccatgctccacc

SEQ ID NO: 1663463 - DNA, 20 bp, Homo sapiens
ggtcccatggctgaagctgg

SEQ ID NO: 1663464 - DNA, 20 bp, Homo sapiens
ggtccccagctccccaggac

SEQ ID NO: 1663465 - DNA, 17 bp, Homo sapiens
ggtcccccatgccacca

SEQ ID NO: 1663466 - DNA, 20 bp, Homo sapiens
ggtcccccatgccaccaccc

SEQ ID NO: 1663467 - DNA, 16 bp, Homo sapiens
ggtcccccctgagtgg

SEQ ID NO: 1663468 - DNA, 22 bp, Homo sapiens
ggtccccgttccaccccaagag

SEQ ID NO: 1663469 - DNA, 14 bp, Homo sapiens
ggtcccctggcagt

SEQ ID NO: 1663470 - DNA, 20 bp, Homo sapiens
ggtcccgcactctgccccca

SEQ ID NO: 1663471 - DNA, 19 bp, Homo sapiens
ggtcccggccagctctgga

SEQ ID NO: 1663472 - DNA, 22 bp, Homo sapiens
ggtcccggttcagacccctgcc

SEQ ID NO: 1663473 - DNA, 24 bp, Homo sapiens
ggtccctaattctcttcgctgtga

SEQ ID NO: 1663474 - DNA, 21 bp, Homo sapiens
ggtccctccaccccacagaac

SEQ ID NO: 1663475 - DNA, 17 bp, Homo sapiens
ggtccctccccttctct

SEQ ID NO: 1663476 - DNA, 11 bp, Homo sapiens
ggtccctcctc

SEQ ID NO: 1663477 - DNA, 22 bp, Homo sapiens
ggtccctcgtccacaggggcag

SEQ ID NO: 1663478 - DNA, 14 bp, Homo sapiens
ggtccctctgtgta

SEQ ID NO: 1663479 - DNA, 22 bp, Homo sapiens
ggtccctgccctcccctgctcc

SEQ ID NO: 1663480 - DNA, 17 bp, Homo sapiens
ggtccctggaccagcct

SEQ ID NO: 1663481 - DNA, 23 bp, Homo sapiens
ggtccctgtgctgatcctgctga

SEQ ID NO: 1663482 - DNA, 19 bp, Homo sapiens
ggtcccttgaaggaagagg

SEQ ID NO: 1663483 - DNA, 20 bp, Homo sapiens
ggtcccttgagacctcagcc

SEQ ID NO: 1663484 - DNA, 23 bp, Homo sapiens
ggtcccttgcagctagttttcta

SEQ ID NO: 1663485 - DNA, 23 bp, Homo sapiens
ggtccgagagggaagctggctgg

SEQ ID NO: 1663486 - DNA, 14 bp, Homo sapiens
ggtccgcaccagct

SEQ ID NO: 1663487 - DNA, 15 bp, Homo sapiens
ggtccgcaccagctg

SEQ ID NO: 1663488 - DNA, 19 bp, Homo sapiens
ggtccgcaccagctgctct

SEQ ID NO: 1663489 - DNA, 23 bp, Homo sapiens
ggtccgcaccagctgctctgccc

SEQ ID NO: 1663490 - DNA, 20 bp, Homo sapiens
ggtccgcatccctgcttctg

SEQ ID NO: 1663491 - DNA, 17 bp, Homo sapiens
ggtccggtgttctaaga

SEQ ID NO: 1663492 - DNA, 20 bp, Homo sapiens
ggtggcacctcctgagaagg

SEQ ID NO: 1663493 - DNA, 15 bp, Homo sapiens
ggtggcagccctgta

SEQ ID NO: 1663494 - DNA, 15 bp, Homo sapiens
ggtggcatacgcctg

SEQ ID NO: 1663495 - DNA, 14 bp, Homo sapiens
ggtggccacagcag

SEQ ID NO: 1663496 - DNA, 20 bp, Homo sapiens
ggtggccactccagacccct

SEQ ID NO: 1663497 - DNA, 23 bp, Homo sapiens
ggtggccactccagacccctggc

SEQ ID NO: 1663498 - DNA, 22 bp, Homo sapiens
ggtggccaggcaggcgggggct

SEQ ID NO: 1663499 - DNA, 23 bp, Homo sapiens
ggtggcccctgctgtctctctgg

SEQ ID NO: 1663500 - DNA, 17 bp, Homo sapiens
ggtggcccgacagcctg

SEQ ID NO: 1663501 - DNA, 20 bp, Homo sapiens
ggtggcccgacagcctggca

SEQ ID NO: 1663502 - DNA, 20 bp, Homo sapiens
ggtggccgctgagtggcagg

SEQ ID NO: 1663503 - DNA, 21 bp, Homo sapiens
ggtggccgctgagtggcaggg

SEQ ID NO: 1663504 - DNA, 15 bp, Homo sapiens
ggtggccgggcacag

SEQ ID NO: 1663505 - DNA, 14 bp, Homo sapiens
ggtggcctctgcct

SEQ ID NO: 1663506 - DNA, 19 bp, Homo sapiens
ggtggcctctgcctggggc

SEQ ID NO: 1663507 - DNA, 17 bp, Homo sapiens
ggtggctagtcagagag

SEQ ID NO: 1663508 - DNA, 14 bp, Homo sapiens
ggtggctcactact

SEQ ID NO: 1663509 - DNA, 15 bp, Homo sapiens
ggtggctcactactg

SEQ ID NO: 1663510 - DNA, 15 bp, Homo sapiens
ggtggctccccctct

SEQ ID NO: 1663511 - DNA, 18 bp, Homo sapiens
ggtggctccccctctgct

SEQ ID NO: 1663512 - DNA, 23 bp, Homo sapiens
ggtggctgacccagtccctgggg

SEQ ID NO: 1663513 - DNA, 20 bp, Homo sapiens
ggtggctgccccggcctcct

SEQ ID NO: 1663514 - DNA, 20 bp, Homo sapiens
ggtggctgggcccagcaggg

SEQ ID NO: 1663515 - DNA, 18 bp, Homo sapiens
ggtggcttaagtgagcag

SEQ ID NO: 1663516 - DNA, 23 bp, Homo sapiens
ggtggcttaagtgagcagaacag

SEQ ID NO: 1663517 - DNA, 11 bp, Homo sapiens
ggtgggacccc

SEQ ID NO: 1663518 - DNA, 22 bp, Homo sapiens
ggtgggaccctgtccggcccag

SEQ ID NO: 1663519 - DNA, 16 bp, Homo sapiens
ggtgggagagcccagc

SEQ ID NO: 1663520 - DNA, 18 bp, Homo sapiens
ggtgggagctgaaaagga

SEQ ID NO: 1663521 - DNA, 22 bp, Homo sapiens
ggtgggaggaaagggcctggcc

SEQ ID NO: 1663522 - DNA, 17 bp, Homo sapiens
ggtgggagtgtgtctgc

SEQ ID NO: 1663523 - DNA, 19 bp, Homo sapiens
ggtgggagtgtgtctgctg

SEQ ID NO: 1663524 - DNA, 18 bp, Homo sapiens
ggtgggatccagaatgga

SEQ ID NO: 1663525 - DNA, 13 bp, Homo sapiens
ggtgggcagctgg

SEQ ID NO: 1663526 - DNA, 15 bp, Homo sapiens
ggtgggccagagctg

SEQ ID NO: 1663527 - DNA, 16 bp, Homo sapiens
ggtgggccagagctga

SEQ ID NO: 1663528 - DNA, 12 bp, Homo sapiens
ggtgggcccagg

SEQ ID NO: 1663529 - DNA, 21 bp, Homo sapiens
ggtgggcccaggaccagctgg

SEQ ID NO: 1663530 - DNA, 14 bp, Homo sapiens
ggtgggcctggcct

SEQ ID NO: 1663531 - DNA, 19 bp, Homo sapiens
ggtgggctggggctgctcc

SEQ ID NO: 1663532 - DNA, 16 bp, Homo sapiens
ggtgggctggtatctc

SEQ ID NO: 1663533 - DNA, 13 bp, Homo sapiens
ggtggggaggggc

SEQ ID NO: 1663534 - DNA, 13 bp, Homo sapiens
ggtggggccctgc

SEQ ID NO: 1663535 - DNA, 14 bp, Homo sapiens
ggtggggctgtcct

SEQ ID NO: 1663536 - DNA, 15 bp, Homo sapiens
ggtgggggtgccgct

SEQ ID NO: 1663537 - DNA, 19 bp, Homo sapiens
ggtgggggtgctctctctg

SEQ ID NO: 1663538 - DNA, 13 bp, Homo sapiens
ggtgggggtgctg

SEQ ID NO: 1663539 - DNA, 18 bp, Homo sapiens
ggtgggggtgctgctctc

SEQ ID NO: 1663540 - DNA, 23 bp, Homo sapiens
ggtggggtcctggagcagaccac

SEQ ID NO: 1663541 - DNA, 21 bp, Homo sapiens
ggtgggtaattgtacaataaa

SEQ ID NO: 1663542 - DNA, 22 bp, Homo sapiens
ggtgggtaattgtacaataaat

SEQ ID NO: 1663543 - DNA, 15 bp, Homo sapiens
ggtgggtgtggccag

SEQ ID NO: 1663544 - DNA, 14 bp, Homo sapiens
ggtggtaactgcca

SEQ ID NO: 1663545 - DNA, 16 bp, Homo sapiens
ggtggtaactgccagc

SEQ ID NO: 1663546 - DNA, 22 bp, Homo sapiens
ggtggtctgttggcaggctggc

SEQ ID NO: 1663547 - DNA, 14 bp, Homo sapiens
ggtggtgcccgtgc

SEQ ID NO: 1663548 - DNA, 17 bp, Homo sapiens
ggtggtggcactgagcc

SEQ ID NO: 1663549 - DNA, 14 bp, Homo sapiens
ggtggtggggaggg

SEQ ID NO: 1663550 - DNA, 23 bp, Homo sapiens
ggtggtgtcagaccctggaggcc

SEQ ID NO: 1663551 - DNA, 22 bp, Homo sapiens
ggtggttattggactccaggcc

SEQ ID NO: 1663552 - DNA, 22 bp, Homo sapiens
ggtggttatttggtattaaact

SEQ ID NO: 1663553 - DNA, 15 bp, Homo sapiens
ggtggtttgccatgt

SEQ ID NO: 1663554 - DNA, 15 bp, Homo sapiens
ggtgtaacttcctgc

SEQ ID NO: 1663555 - DNA, 14 bp, Homo sapiens
ggtgtagaaaaggt

SEQ ID NO: 1663556 - DNA, 22 bp, Homo sapiens
ggtgtagaacactaattcataa

SEQ ID NO: 1663557 - DNA, 14 bp, Homo sapiens
ggtgtagctgtcct

SEQ ID NO: 1663558 - DNA, 18 bp, Homo sapiens
ggtgtagctgtcctctca

SEQ ID NO: 1663559 - DNA, 20 bp, Homo sapiens
ggtgtaggggccacctcctc

SEQ ID NO: 1663560 - DNA, 21 bp, Homo sapiens
ggtgtatagtgttcacaaact

SEQ ID NO: 1663561 - DNA, 17 bp, Homo sapiens
ggtgtcacatggggcct

SEQ ID NO: 1663562 - DNA, 23 bp, Homo sapiens
ggtgtcagaccctggaggcccca

SEQ ID NO: 1663563 - DNA, 13 bp, Homo sapiens
ggtgtcaggcagg

SEQ ID NO: 1663564 - DNA, 23 bp, Homo sapiens
ggtgtcaggcccgtcggagctgc

SEQ ID NO: 1663565 - DNA, 15 bp, Homo sapiens
ggtgtccccaacgtc

SEQ ID NO: 1663566 - DNA, 15 bp, Homo sapiens
ggtgtcctgaagctg

SEQ ID NO: 1663567 - DNA, 20 bp, Homo sapiens
ggtgtcctgaagctgctgga

SEQ ID NO: 1663568 - DNA, 12 bp, Homo sapiens
ggtgtcctgacc

SEQ ID NO: 1663569 - DNA, 18 bp, Homo sapiens
ggtgtcctgcctgtctgc

SEQ ID NO: 1663570 - DNA, 21 bp, Homo sapiens
ggtgtcctgcctgtctgcccc

SEQ ID NO: 1663571 - DNA, 10 bp, Homo sapiens
ggtgtctttt

SEQ ID NO: 1663572 - DNA, 16 bp, Homo sapiens
ggtgtgaacatgttct

SEQ ID NO: 1663573 - DNA, 15 bp, Homo sapiens
ggtgtgaacccggga

SEQ ID NO: 1663574 - DNA, 17 bp, Homo sapiens
ggtgtgaccatgttcat

SEQ ID NO: 1663575 - DNA, 24 bp, Homo sapiens
ggtgtgcacgtggcatgtggcctg

SEQ ID NO: 1663576 - DNA, 14 bp, Homo sapiens
ggtgtgcctgcagc

SEQ ID NO: 1663577 - DNA, 16 bp, Homo sapiens
ggtgtgcctgtgctcc

SEQ ID NO: 1663578 - DNA, 20 bp, Homo sapiens
ggtgtgcgtgcgtgtgcgtg

SEQ ID NO: 1663579 - DNA, 19 bp, Homo sapiens
ggtgtgctagaacaaggtc

SEQ ID NO: 1663580 - DNA, 14 bp, Homo sapiens
ggtgtgctgccaac

SEQ ID NO: 1663581 - DNA, 12 bp, Homo sapiens
ggtgtgctggga

SEQ ID NO: 1663582 - DNA, 19 bp, Homo sapiens
ggtgtgctgggagctccac

SEQ ID NO: 1663583 - DNA, 16 bp, Homo sapiens
ggtgtggagccgaggc

SEQ ID NO: 1663584 - DNA, 12 bp, Homo sapiens
ggtgtggctcct

SEQ ID NO: 1663585 - DNA, 15 bp, Homo sapiens
ggtgtggctgtgaag

SEQ ID NO: 1663586 - DNA, 15 bp, Homo sapiens
ggtgtggggctgccg

SEQ ID NO: 1663587 - DNA, 16 bp, Homo sapiens
ggtgtgtccctggaca

SEQ ID NO: 1663588 - DNA, 19 bp, Homo sapiens
ggtgtgtccctggacacag

SEQ ID NO: 1663589 - DNA, 23 bp, Homo sapiens
ggtgtgtccctggacacagctct

SEQ ID NO: 1663590 - DNA, 19 bp, Homo sapiens
ggtgtgtggccgcctggca

SEQ ID NO: 1663591 - DNA, 14 bp, Homo sapiens
ggtgtgtgtagcca

SEQ ID NO: 1663592 - DNA, 22 bp, Homo sapiens
ggtgttaattttgctaactggg

SEQ ID NO: 1663593 - DNA, 12 bp, Homo sapiens
ggtgttcctgga

SEQ ID NO: 1663594 - DNA, 13 bp, Homo sapiens
ggtgttcctggaa

SEQ ID NO: 1663595 - DNA, 15 bp, Homo sapiens
ggtgttcctggaagc

SEQ ID NO: 1663596 - DNA, 17 bp, Homo sapiens
ggtgttcgtttccatca

SEQ ID NO: 1663597 - DNA, 13 bp, Homo sapiens
ggtgttctaagat

SEQ ID NO: 1663598 - DNA, 13 bp, Homo sapiens
ggtgttctgctga

SEQ ID NO: 1663599 - DNA, 12 bp, Homo sapiens
ggtgttctggct

SEQ ID NO: 1663600 - DNA, 21 bp, Homo sapiens
ggtgttgccaaatatgtcctg

SEQ ID NO: 1663601 - DNA, 15 bp, Homo sapiens
ggtgttgtatgcctt

SEQ ID NO: 1663602 - DNA, 13 bp, Homo sapiens
ggtgtttattgca

SEQ ID NO: 1663603 - DNA, 21 bp, Homo sapiens
ggtgtttggtttcttcattct

SEQ ID NO: 1663604 - DNA, 19 bp, Homo sapiens
ggttaaacattaatattta

SEQ ID NO: 1663605 - DNA, 22 bp, Homo sapiens
ggttaacccttcatcttcctgt

SEQ ID NO: 1663606 - DNA, 16 bp, Homo sapiens
ggttaaggccagggcc

SEQ ID NO: 1663607 - DNA, 18 bp, Homo sapiens
gtaagaacacattttaaa

SEQ ID NO: 1663608 - DNA, 18 bp, Homo sapiens
gtaagaactgtacattgt

SEQ ID NO: 1663609 - DNA, 12 bp, Homo sapiens
gtaagaagaaag

SEQ ID NO: 1663610 - DNA, 16 bp, Homo sapiens
gtaagaagacaaactg

SEQ ID NO: 1663611 - DNA, 15 bp, Homo sapiens
gtaagaagagactgg

SEQ ID NO: 1663612 - DNA, 18 bp, Homo sapiens
gtaagaagaggagcctca

SEQ ID NO: 1663613 - DNA, 21 bp, Homo sapiens
gtaagaagaggagcctcagaa

SEQ ID NO: 1663614 - DNA, 13 bp, Homo sapiens
gtaagaaggcaat

SEQ ID NO: 1663615 - DNA, 14 bp, Homo sapiens
gtaagaatggccaa

SEQ ID NO: 1663616 - DNA, 14 bp, Homo sapiens
gtaagacaagtggg

SEQ ID NO: 1663617 - DNA, 13 bp, Homo sapiens
gtaagacatctca

SEQ ID NO: 1663618 - DNA, 20 bp, Homo sapiens
gtaagacatttgtatattgt

SEQ ID NO: 1663619 - DNA, 16 bp, Homo sapiens
gtaagagcaaaagcct

SEQ ID NO: 1663620 - DNA, 16 bp, Homo sapiens
gtaagaggagcagagg

SEQ ID NO: 1663621 - DNA, 19 bp, Homo sapiens
gtaagaggagcagagggca

SEQ ID NO: 1663622 - DNA, 21 bp, Homo sapiens
gtaagaggagcagagggcagg

SEQ ID NO: 1663623 - DNA, 21 bp, Homo sapiens
gtaagagtgagctctggtgga

SEQ ID NO: 1663624 - DNA, 17 bp, Homo sapiens
gtaagattgatatctat

SEQ ID NO: 1663625 - DNA, 12 bp, Homo sapiens
gtaagcagtgtt

SEQ ID NO: 1663626 - DNA, 14 bp, Homo sapiens
gtaagccagagcct

SEQ ID NO: 1663627 - DNA, 16 bp, Homo sapiens
gtaagccagagcctgg

SEQ ID NO: 1663628 - DNA, 20 bp, Homo sapiens
gtaaggaacacgattttcaa

SEQ ID NO: 1663629 - DNA, 19 bp, Homo sapiens
gtaaggatccggaaagaag

SEQ ID NO: 1663630 - DNA, 14 bp, Homo sapiens
gtaaggctctagat

SEQ ID NO: 1663631 - DNA, 16 bp, Homo sapiens
gtaaggctctagatca

SEQ ID NO: 1663632 - DNA, 17 bp, Homo sapiens
gtaagggaaactgccag

SEQ ID NO: 1663633 - DNA, 18 bp, Homo sapiens
gtaagggaaactgccagc

SEQ ID NO: 1663634 - DNA, 11 bp, Homo sapiens
gtaagggcagt

SEQ ID NO: 1663635 - DNA, 15 bp, Homo sapiens
gtaagggcagtgccc

SEQ ID NO: 1663636 - DNA, 23 bp, Homo sapiens
gtaagggtctttggtgtttttaa

SEQ ID NO: 1663637 - DNA, 18 bp, Homo sapiens
gtaagtaccactcaggcc

SEQ ID NO: 1663638 - DNA, 14 bp, Homo sapiens
gtaagtatttccat

SEQ ID NO: 1663639 - DNA, 22 bp, Homo sapiens
gtaagtcatctacttaataaat

SEQ ID NO: 1663640 - DNA, 15 bp, Homo sapiens
gtaagtgaaattaag

SEQ ID NO: 1663641 - DNA, 16 bp, Homo sapiens
gtaagtgagagagaca

SEQ ID NO: 1663642 - DNA, 17 bp, Homo sapiens
gtaagtggagtcctgga

SEQ ID NO: 1663643 - DNA, 16 bp, Homo sapiens
gtaagtgggcccaccc

SEQ ID NO: 1663644 - DNA, 23 bp, Homo sapiens
gtaagttgaatggcctgccttga

SEQ ID NO: 1663645 - DNA, 17 bp, Homo sapiens
gtaataaaaagcctctt

SEQ ID NO: 1663646 - DNA, 14 bp, Homo sapiens
gtaataaaggtctt

SEQ ID NO: 1663647 - DNA, 22 bp, Homo sapiens
gtaataaattcaaaacctgcag

SEQ ID NO: 1663648 - DNA, 15 bp, Homo sapiens
gtaataactgtgaag

SEQ ID NO: 1663649 - DNA, 20 bp, Homo sapiens
gtaataagatggctgtggca

SEQ ID NO: 1663650 - DNA, 15 bp, Homo sapiens
gtaatacctgattga

SEQ ID NO: 1663651 - DNA, 15 bp, Homo sapiens
gtaatactttacaaa

SEQ ID NO: 1663652 - DNA, 13 bp, Homo sapiens
gtaatagctcaga

SEQ ID NO: 1663653 - DNA, 15 bp, Homo sapiens
gtaatagcttctgtg

SEQ ID NO: 1663654 - DNA, 16 bp, Homo sapiens
gtaatagcttctgtgt

SEQ ID NO: 1663655 - DNA, 14 bp, Homo sapiens
gtaataggaaaatg

SEQ ID NO: 1663656 - DNA, 22 bp, Homo sapiens
gtaatataatacacaaaatcaa

SEQ ID NO: 1663657 - DNA, 17 bp, Homo sapiens
gtaatataatgtatttt

SEQ ID NO: 1663658 - DNA, 11 bp, Homo sapiens
gtaatatatga

SEQ ID NO: 1663659 - DNA, 15 bp, Homo sapiens
gtaatatattgtaca

SEQ ID NO: 1663660 - DNA, 19 bp, Homo sapiens
gtaatatatttcagacatt

SEQ ID NO: 1663661 - DNA, 20 bp, Homo sapiens
gtaatatcttactaaggcct

SEQ ID NO: 1663662 - DNA, 18 bp, Homo sapiens
gtaatatttatatattta

SEQ ID NO: 1663663 - DNA, 20 bp, Homo sapiens
gtaatcaagcctttatggct

SEQ ID NO: 1663664 - DNA, 22 bp, Homo sapiens
gtaatcagcattattcttcaga

SEQ ID NO: 1663665 - DNA, 15 bp, Homo sapiens
gtaatcatttgttta

SEQ ID NO: 1663666 - DNA, 15 bp, Homo sapiens
gtaatccacctgcct

SEQ ID NO: 1663667 - DNA, 17 bp, Homo sapiens
gtaatccatcactagcc

SEQ ID NO: 1663668 - DNA, 12 bp, Homo sapiens
gtaatcccagca

SEQ ID NO: 1663669 - DNA, 14 bp, Homo sapiens
gtaatcccagcact

SEQ ID NO: 1663670 - DNA, 20 bp, Homo sapiens
gtaatcccagcactttggga

SEQ ID NO: 1663671 - DNA, 13 bp, Homo sapiens
gtaatcccagcag

SEQ ID NO: 1663672 - DNA, 12 bp, Homo sapiens
gtaatcccagct

SEQ ID NO: 1663673 - DNA, 14 bp, Homo sapiens
gtaatcccagctac

SEQ ID NO: 1663674 - DNA, 17 bp, Homo sapiens
gtaatcccagctactca

SEQ ID NO: 1663675 - DNA, 21 bp, Homo sapiens
gtaatcccagctactcaggag

SEQ ID NO: 1663676 - DNA, 17 bp, Homo sapiens
gtaatcccctaaaataa

SEQ ID NO: 1663677 - DNA, 20 bp, Homo sapiens
gtaatcccctaaaataacag

SEQ ID NO: 1663678 - DNA, 17 bp, Homo sapiens
gtaatcgcttaaagatg

SEQ ID NO: 1663679 - DNA, 17 bp, Homo sapiens
gtaatctacaccaatga

SEQ ID NO: 1663680 - DNA, 18 bp, Homo sapiens
gtaatctacaccaatgaa

SEQ ID NO: 1663681 - DNA, 21 bp, Homo sapiens
gtaatctctctgcagctgccg

SEQ ID NO: 1663682 - DNA, 23 bp, Homo sapiens
gtaatctctgattaaatttaata

SEQ ID NO: 1663683 - DNA, 22 bp, Homo sapiens
gtaatctgaataaagtgtaaca

SEQ ID NO: 1663684 - DNA, 17 bp, Homo sapiens
gtaatcttgggtttcta

SEQ ID NO: 1663685 - DNA, 20 bp, Homo sapiens
gtaatctttacctgtataca

SEQ ID NO: 1663686 - DNA, 16 bp, Homo sapiens
gtaatgacgtgtgtgg

SEQ ID NO: 1663687 - DNA, 16 bp, Homo sapiens
gtaatgccagcgcttt

SEQ ID NO: 1663688 - DNA, 14 bp, Homo sapiens
gtaatgggcctgcc

SEQ ID NO: 1663689 - DNA, 15 bp, Homo sapiens
gtaatgggcctgccc

SEQ ID NO: 1663690 - DNA, 19 bp, Homo sapiens
gtaatggtactgactttgc

SEQ ID NO: 1663691 - DNA, 14 bp, Homo sapiens
gtaatggtgtagaa

SEQ ID NO: 1663692 - DNA, 23 bp, Homo sapiens
gtaatgtaaataaactatttata

SEQ ID NO: 1663693 - DNA, 20 bp, Homo sapiens
gtaatgttaatgttatatca

SEQ ID NO: 1663694 - DNA, 18 bp, Homo sapiens
gtaatgttgtgaataatt

SEQ ID NO: 1663695 - DNA, 19 bp, Homo sapiens
gtaattaaaagcaaatcat

SEQ ID NO: 1663696 - DNA, 20 bp, Homo sapiens
gtaattaaaagcaaatcatt

SEQ ID NO: 1663697 - DNA, 14 bp, Homo sapiens
gtaattaagtacta

SEQ ID NO: 1663698 - DNA, 13 bp, Homo sapiens
gtaattatttgaa

SEQ ID NO: 1663699 - DNA, 23 bp, Homo sapiens
gtaattattttttagataataac

SEQ ID NO: 1663700 - DNA, 17 bp, Homo sapiens
gtaattcctctccaggc

SEQ ID NO: 1663701 - DNA, 22 bp, Homo sapiens
gtaattctaaatgaatgtttac

SEQ ID NO: 1663702 - DNA, 23 bp, Homo sapiens
gtaattctaccaaggtcttctta

SEQ ID NO: 1663703 - DNA, 14 bp, Homo sapiens
gtaattctttctgt

SEQ ID NO: 1663704 - DNA, 20 bp, Homo sapiens
gtaattctttctgtctccct

SEQ ID NO: 1663705 - DNA, 21 bp, Homo sapiens
gtaattgacagagtaaaagta

SEQ ID NO: 1663706 - DNA, 19 bp, Homo sapiens
gtaattgcatgacaaacct

SEQ ID NO: 1663707 - DNA, 20 bp, Homo sapiens
gtaattgcctacaataaaaa

SEQ ID NO: 1663708 - DNA, 17 bp, Homo sapiens
gtaattggaatcttcac

SEQ ID NO: 1663709 - DNA, 21 bp, Homo sapiens
gtaattggaatcttcacctca

SEQ ID NO: 1663710 - DNA, 14 bp, Homo sapiens
gtaattgtacaata

SEQ ID NO: 1663711 - DNA, 15 bp, Homo sapiens
gtaattgtacaataa

SEQ ID NO: 1663712 - DNA, 16 bp, Homo sapiens
gtaattgtacaataaa

SEQ ID NO: 1663713 - DNA, 19 bp, Homo sapiens
gtaattgtacaataaattt

SEQ ID NO: 1663714 - DNA, 14 bp, Homo sapiens
gtaattgtgaaaaa

SEQ ID NO: 1663715 - DNA, 19 bp, Homo sapiens
gtaattgtggattaatgtc

SEQ ID NO: 1663716 - DNA, 22 bp, Homo sapiens
gtaattgtggattaatgtcaat

SEQ ID NO: 1663717 - DNA, 15 bp, Homo sapiens
gtaattgtgtggatt

SEQ ID NO: 1663718 - DNA, 19 bp, Homo sapiens
gtaattgttttttaaagca

SEQ ID NO: 1663719 - DNA, 23 bp, Homo sapiens
gtaatttaaaattgtgatgtgtc

SEQ ID NO: 1663720 - DNA, 14 bp, Homo sapiens
gtaatttaaacagg

SEQ ID NO: 1663721 - DNA, 23 bp, Homo sapiens
gtaatttaaacatttgttcctgg

SEQ ID NO: 1663722 - DNA, 15 bp, Homo sapiens
gtatacctgattttt

SEQ ID NO: 1663723 - DNA, 14 bp, Homo sapiens
gtatacgtataaat

SEQ ID NO: 1663724 - DNA, 18 bp, Homo sapiens
gtatacgtataaatatca

SEQ ID NO: 1663725 - DNA, 20 bp, Homo sapiens
gtatacttcagtgctcaccc

SEQ ID NO: 1663726 - DNA, 21 bp, Homo sapiens
gtatacttccttacttttaag

SEQ ID NO: 1663727 - DNA, 21 bp, Homo sapiens
gtatagaccaaagcaaagaaa

SEQ ID NO: 1663728 - DNA, 18 bp, Homo sapiens
gtatagatgcaagatatt

SEQ ID NO: 1663729 - DNA, 15 bp, Homo sapiens
gtatagccatgattt

SEQ ID NO: 1663730 - DNA, 21 bp, Homo sapiens
gtatagcctatggcagaaaaa

SEQ ID NO: 1663731 - DNA, 20 bp, Homo sapiens
gtataggtctcatctcttca

SEQ ID NO: 1663732 - DNA, 19 bp, Homo sapiens
gtatagtactggcatggta

SEQ ID NO: 1663733 - DNA, 19 bp, Homo sapiens
gtatagttgatgtaacatt

SEQ ID NO: 1663734 - DNA, 16 bp, Homo sapiens
gtatataaaatatttt

SEQ ID NO: 1663735 - DNA, 18 bp, Homo sapiens
gtatataagttgctgtgt

SEQ ID NO: 1663736 - DNA, 21 bp, Homo sapiens
gtatataatttttttatgttt

SEQ ID NO: 1663737 - DNA, 23 bp, Homo sapiens
gtatatactttgaaaggagatgt

SEQ ID NO: 1663738 - DNA, 17 bp, Homo sapiens
gtatatagaacacaagg

SEQ ID NO: 1663739 - DNA, 18 bp, Homo sapiens
gtatatagtatatttata

SEQ ID NO: 1663740 - DNA, 20 bp, Homo sapiens
gtatatagtatatttatact

SEQ ID NO: 1663741 - DNA, 21 bp, Homo sapiens
gtatatatatatagtaactac

SEQ ID NO: 1663742 - DNA, 13 bp, Homo sapiens
gtatatattttgt

SEQ ID NO: 1663743 - DNA, 17 bp, Homo sapiens
gtatatcattctaaaga

SEQ ID NO: 1663744 - DNA, 19 bp, Homo sapiens
gtatatctaagactcatcc

SEQ ID NO: 1663745 - DNA, 18 bp, Homo sapiens
gtatatctggacaagcca

SEQ ID NO: 1663746 - DNA, 15 bp, Homo sapiens
gtatatgacatttaa

SEQ ID NO: 1663747 - DNA, 21 bp, Homo sapiens
gtatatgtattcccttgtatt

SEQ ID NO: 1663748 - DNA, 22 bp, Homo sapiens
gtatatgtcaagccataattgt

SEQ ID NO: 1663749 - DNA, 18 bp, Homo sapiens
gtatatgtgcgtctctct

SEQ ID NO: 1663750 - DNA, 13 bp, Homo sapiens
gtatatgttggtt

SEQ ID NO: 1663751 - DNA, 15 bp, Homo sapiens
gtatatgttgtaata

SEQ ID NO: 1663752 - DNA, 17 bp, Homo sapiens
gtatatgttgtaataaa

SEQ ID NO: 1663753 - DNA, 16 bp, Homo sapiens
gtatatgtttatatac

SEQ ID NO: 1663754 - DNA, 17 bp, Homo sapiens
gtatatgtttatatact

SEQ ID NO: 1663755 - DNA, 19 bp, Homo sapiens
gtatatgtttatatactgg

SEQ ID NO: 1663756 - DNA, 12 bp, Homo sapiens
gtatattcagga

SEQ ID NO: 1663757 - DNA, 22 bp, Homo sapiens
gtatattctttggttgtgaatc

SEQ ID NO: 1663758 - DNA, 22 bp, Homo sapiens
gtatattgtataggggcaactg

SEQ ID NO: 1663759 - DNA, 16 bp, Homo sapiens
gtatatttatactcta

SEQ ID NO: 1663760 - DNA, 22 bp, Homo sapiens
gtatatttatagtcacaagagc

SEQ ID NO: 1663761 - DNA, 14 bp, Homo sapiens
gtatatttattcat

SEQ ID NO: 1663762 - DNA, 17 bp, Homo sapiens
gtatatttgtaaagcta

SEQ ID NO: 1663763 - DNA, 14 bp, Homo sapiens
gtatcaaatctgta

SEQ ID NO: 1663764 - DNA, 14 bp, Homo sapiens
gtatcacagatgta

SEQ ID NO: 1663765 - DNA, 14 bp, Homo sapiens
gtatcacagtgttt

SEQ ID NO: 1663766 - DNA, 12 bp, Homo sapiens
gtatcagcacta

SEQ ID NO: 1663767 - DNA, 14 bp, Homo sapiens
gtatcagtgtcctt

SEQ ID NO: 1663768 - DNA, 17 bp, Homo sapiens
gtatcagtgtcctttcc

SEQ ID NO: 1663769 - DNA, 16 bp, Homo sapiens
gtatcataaaaataaa

SEQ ID NO: 1663770 - DNA, 19 bp, Homo sapiens
gtatcatatattaaaacaa

SEQ ID NO: 1663771 - DNA, 13 bp, Homo sapiens
gtatcatgaagaa

SEQ ID NO: 1663772 - DNA, 19 bp, Homo sapiens
gtatcatgaagaaaactga

SEQ ID NO: 1663773 - DNA, 19 bp, Homo sapiens
gtatccaaccaacttggtt

SEQ ID NO: 1663774 - DNA, 18 bp, Homo sapiens
gtatccaatgtcttttga

SEQ ID NO: 1663775 - DNA, 21 bp, Homo sapiens
gtatcccctgcctcctgccac

SEQ ID NO: 1663776 - DNA, 21 bp, Homo sapiens
gtatccgtgaattgctttatg

SEQ ID NO: 1663777 - DNA, 18 bp, Homo sapiens
gtatcctccctggcagac

SEQ ID NO: 1663778 - DNA, 21 bp, Homo sapiens
gtatcctccctggcagacaca

SEQ ID NO: 1663779 - DNA, 20 bp, Homo sapiens
gtatcctgataaacattaaa

SEQ ID NO: 1663780 - DNA, 16 bp, Homo sapiens
gtatcctgcccagtgt

SEQ ID NO: 1663781 - DNA, 17 bp, Homo sapiens
gtatcctgcccagtgtt

SEQ ID NO: 1663782 - DNA, 18 bp, Homo sapiens
gtatcctgcccagtgttg

SEQ ID NO: 1663783 - DNA, 13 bp, Homo sapiens
gtatcctggggct

SEQ ID NO: 1663784 - DNA, 18 bp, Homo sapiens
gtatcctgggggacccaa

SEQ ID NO: 1663785 - DNA, 20 bp, Homo sapiens
gtatcctgtgacatgtaaca

SEQ ID NO: 1663786 - DNA, 14 bp, Homo sapiens
gtatcggagacagt

SEQ ID NO: 1663787 - DNA, 19 bp, Homo sapiens
gtatctaaaaaataactgt

SEQ ID NO: 1663788 - DNA, 14 bp, Homo sapiens
gtatctatttgtac

SEQ ID NO: 1663789 - DNA, 20 bp, Homo sapiens
gtatctcaagatattcaggt

SEQ ID NO: 1663790 - DNA, 13 bp, Homo sapiens
gtatctcagaaag

SEQ ID NO: 1663791 - DNA, 18 bp, Homo sapiens
gtatctcagaaagtgcct

SEQ ID NO: 1663792 - DNA, 21 bp, Homo sapiens
gtatctcagaaagtgcctgac

SEQ ID NO: 1663793 - DNA, 20 bp, Homo sapiens
gtatctcgtaatagcttctg

SEQ ID NO: 1663794 - DNA, 12 bp, Homo sapiens
gtatctcttcag

SEQ ID NO: 1663795 - DNA, 22 bp, Homo sapiens
gtatctctttcacattgtttgc

SEQ ID NO: 1663796 - DNA, 13 bp, Homo sapiens
gtatctggcttcc

SEQ ID NO: 1663797 - DNA, 15 bp, Homo sapiens
gtatctggcttccct

SEQ ID NO: 1663798 - DNA, 18 bp, Homo sapiens
gtatctggcttccctgga

SEQ ID NO: 1663799 - DNA, 21 bp, Homo sapiens
gtatctggcttccctggaagc

SEQ ID NO: 1663800 - DNA, 21 bp, Homo sapiens
gtatctgtatataagttgctg

SEQ ID NO: 1663801 - DNA, 19 bp, Homo sapiens
gtatcttgacacaggaaat

SEQ ID NO: 1663802 - DNA, 16 bp, Homo sapiens
gtatcttgtgcttctt

SEQ ID NO: 1663803 - DNA, 23 bp, Homo sapiens
gtatcttgtttttccactactgc

SEQ ID NO: 1663804 - DNA, 15 bp, Homo sapiens
gtatctttatgctgt

SEQ ID NO: 1663805 - DNA, 13 bp, Homo sapiens
gtatctttattaa

SEQ ID NO: 1663806 - DNA, 15 bp, Homo sapiens
gtatctttccaggct

SEQ ID NO: 1663807 - DNA, 13 bp, Homo sapiens
gtatgaaggcttt

SEQ ID NO: 1663808 - DNA, 20 bp, Homo sapiens
gtatgaatctatgccaaaga

SEQ ID NO: 1663809 - DNA, 15 bp, Homo sapiens
gtatgaatgcagtgg

SEQ ID NO: 1663810 - DNA, 15 bp, Homo sapiens
gtatgattccaatct

SEQ ID NO: 1663811 - DNA, 21 bp, Homo sapiens
gtatgatttgttttgaatttt

SEQ ID NO: 1663812 - DNA, 22 bp, Homo sapiens
gtatgatttgttttgaattttg

SEQ ID NO: 1663813 - DNA, 15 bp, Homo sapiens
gtatgcacaattcca

SEQ ID NO: 1663814 - DNA, 19 bp, Homo sapiens
gtatgcagtactaaaatta

SEQ ID NO: 1663815 - DNA, 20 bp, Homo sapiens
gtatgcagttgataagagga

SEQ ID NO: 1663816 - DNA, 16 bp, Homo sapiens
gtatgcattattaaat

SEQ ID NO: 1663817 - DNA, 22 bp, Homo sapiens
gtatgcctttaaatctgtgatg

SEQ ID NO: 1663818 - DNA, 21 bp, Homo sapiens
gtatgctgatcatcgccagag

SEQ ID NO: 1663819 - DNA, 17 bp, Homo sapiens
gtatgctttccctgagg

SEQ ID NO: 1663820 - DNA, 19 bp, Homo sapiens
gtatgctttccctgaggaa

SEQ ID NO: 1663821 - DNA, 13 bp, Homo sapiens
gtatggaaataaa

SEQ ID NO: 1663822 - DNA, 17 bp, Homo sapiens
gtatggaagttttccta

SEQ ID NO: 1663823 - DNA, 17 bp, Homo sapiens
gtatggaatacagtgtt

SEQ ID NO: 1663824 - DNA, 16 bp, Homo sapiens
gtatgtacaatacaat

SEQ ID NO: 1663825 - DNA, 21 bp, Homo sapiens
gtatgtacaatacaatgtaca

SEQ ID NO: 1663826 - DNA, 23 bp, Homo sapiens
gtatgtacttagctgtactataa

SEQ ID NO: 1663827 - DNA, 13 bp, Homo sapiens
gtatgtattattt

SEQ ID NO: 1663828 - DNA, 17 bp, Homo sapiens
gtatgtcatttccttca

SEQ ID NO: 1663829 - DNA, 18 bp, Homo sapiens
gtatgtccccataagaca

SEQ ID NO: 1663830 - DNA, 13 bp, Homo sapiens
gtatgtctccagt

SEQ ID NO: 1663831 - DNA, 11 bp, Homo sapiens
gtatgtctgtg

SEQ ID NO: 1663832 - DNA, 12 bp, Homo sapiens
gtatgtctgttt

SEQ ID NO: 1663833 - DNA, 21 bp, Homo sapiens
gtatgtctgtttttgtatctt

SEQ ID NO: 1663834 - DNA, 23 bp, Homo sapiens
gtatgtctgtttttgtatcttta

SEQ ID NO: 1663835 - DNA, 16 bp, Homo sapiens
gtatgtgctgtaattt

SEQ ID NO: 1663836 - DNA, 21 bp, Homo sapiens
gtcagaggctaattctgcaga

SEQ ID NO: 1663837 - DNA, 18 bp, Homo sapiens
gtcagatgggaagacatg

SEQ ID NO: 1663838 - DNA, 11 bp, Homo sapiens
gtcagcacctt

SEQ ID NO: 1663839 - DNA, 15 bp, Homo sapiens
gtcagcaccttggcc

SEQ ID NO: 1663840 - DNA, 22 bp, Homo sapiens
gtcagcaccttggcccaggagc

SEQ ID NO: 1663841 - DNA, 24 bp, Homo sapiens
gtcagcaccttggcccaggagctc

SEQ ID NO: 1663842 - DNA, 11 bp, Homo sapiens
gtcagcatctg

SEQ ID NO: 1663843 - DNA, 16 bp, Homo sapiens
gtcagcatctgaccat

SEQ ID NO: 1663844 - DNA, 20 bp, Homo sapiens
gtcagcatctgaccatctgt

SEQ ID NO: 1663845 - DNA, 21 bp, Homo sapiens
gtcagcatctgaccatctgtg

SEQ ID NO: 1663846 - DNA, 16 bp, Homo sapiens
gtcagcatctggctgt

SEQ ID NO: 1663847 - DNA, 18 bp, Homo sapiens
gtcagcatctggctgtct

SEQ ID NO: 1663848 - DNA, 15 bp, Homo sapiens
gtcagccaaatgtaa

SEQ ID NO: 1663849 - DNA, 16 bp, Homo sapiens
gtcagccacactgggc

SEQ ID NO: 1663850 - DNA, 19 bp, Homo sapiens
gtcagccacactgggcctg

SEQ ID NO: 1663851 - DNA, 20 bp, Homo sapiens
gtcagccacactgggcctgg

SEQ ID NO: 1663852 - DNA, 20 bp, Homo sapiens
gtcagccaggagctgtcacc

SEQ ID NO: 1663853 - DNA, 13 bp, Homo sapiens
gtcagcccagcac

SEQ ID NO: 1663854 - DNA, 14 bp, Homo sapiens
gtcagcccagcacc

SEQ ID NO: 1663855 - DNA, 16 bp, Homo sapiens
gtcagcccgtttcaga

SEQ ID NO: 1663856 - DNA, 17 bp, Homo sapiens
gtcagcccgtttcagaa

SEQ ID NO: 1663857 - DNA, 20 bp, Homo sapiens
gtcagccgagccgggcctgg

SEQ ID NO: 1663858 - DNA, 17 bp, Homo sapiens
gtcagccgggccctgag

SEQ ID NO: 1663859 - DNA, 22 bp, Homo sapiens
gtcagcctcttaccttcccgcc

SEQ ID NO: 1663860 - DNA, 19 bp, Homo sapiens
gtcagctcccctcggagaa

SEQ ID NO: 1663861 - DNA, 14 bp, Homo sapiens
gtcagctctctgcc

SEQ ID NO: 1663862 - DNA, 15 bp, Homo sapiens
gtcagctctctgccc

SEQ ID NO: 1663863 - DNA, 18 bp, Homo sapiens
gtcagctctctgccctgt

SEQ ID NO: 1663864 - DNA, 23 bp, Homo sapiens
gtcagctgaggctgggggagagc

SEQ ID NO: 1663865 - DNA, 23 bp, Homo sapiens
gtcagctgtggggaacacagcta

SEQ ID NO: 1663866 - DNA, 14 bp, Homo sapiens
gtcagctttcagag

SEQ ID NO: 1663867 - DNA, 17 bp, Homo sapiens
gtcagctttcagagcca

SEQ ID NO: 1663868 - DNA, 19 bp, Homo sapiens
gtcagctttcagagccagt

SEQ ID NO: 1663869 - DNA, 21 bp, Homo sapiens
gtcagctttcagagccagtga

SEQ ID NO: 1663870 - DNA, 15 bp, Homo sapiens
gtcaggaacagaagg

SEQ ID NO: 1663871 - DNA, 17 bp, Homo sapiens
gtcaggaacagaaggat

SEQ ID NO: 1663872 - DNA, 15 bp, Homo sapiens
gtcaggaagaaatca

SEQ ID NO: 1663873 - DNA, 19 bp, Homo sapiens
gtcaggcccgtcggagctg

SEQ ID NO: 1663874 - DNA, 13 bp, Homo sapiens
gtcaggccctctg

SEQ ID NO: 1663875 - DNA, 17 bp, Homo sapiens
gtcaggccctctgcctg

SEQ ID NO: 1663876 - DNA, 16 bp, Homo sapiens
gtcagggacagcagcc

SEQ ID NO: 1663877 - DNA, 20 bp, Homo sapiens
gtcagggagaggtcaccagc

SEQ ID NO: 1663878 - DNA, 14 bp, Homo sapiens
gtcagggcagggct

SEQ ID NO: 1663879 - DNA, 19 bp, Homo sapiens
gtcagggcccaagtccctg

SEQ ID NO: 1663880 - DNA, 20 bp, Homo sapiens
gtcagggcccaagtccctgt

SEQ ID NO: 1663881 - DNA, 21 bp, Homo sapiens
gtcagggcccaagtccctgtt

SEQ ID NO: 1663882 - DNA, 17 bp, Homo sapiens
gtcaggggtcaggtgtc

SEQ ID NO: 1663883 - DNA, 15 bp, Homo sapiens
gtcagggtgggaaga

SEQ ID NO: 1663884 - DNA, 22 bp, Homo sapiens
gtcaggtaatatacctggttta

SEQ ID NO: 1663885 - DNA, 23 bp, Homo sapiens
gtcaggtaatatacctggtttac

SEQ ID NO: 1663886 - DNA, 14 bp, Homo sapiens
gtcaggtgaccctg

SEQ ID NO: 1663887 - DNA, 15 bp, Homo sapiens
gtcaggtgtcaggcc

SEQ ID NO: 1663888 - DNA, 17 bp, Homo sapiens
gtcaggtgtcaggcccg

SEQ ID NO: 1663889 - DNA, 15 bp, Homo sapiens
gtcaggtgtcgaggc

SEQ ID NO: 1663890 - DNA, 21 bp, Homo sapiens
gtcagtaggtccaagggccat

SEQ ID NO: 1663891 - DNA, 14 bp, Homo sapiens
gtcagtatccaggc

SEQ ID NO: 1663892 - DNA, 16 bp, Homo sapiens
gtcagtatccaggctt

SEQ ID NO: 1663893 - DNA, 21 bp, Homo sapiens
gtcagtatgtggaagtgtggg

SEQ ID NO: 1663894 - DNA, 18 bp, Homo sapiens
gtcagtctttgctcagtg

SEQ ID NO: 1663895 - DNA, 15 bp, Homo sapiens
gtcagtgcatttcaa

SEQ ID NO: 1663896 - DNA, 23 bp, Homo sapiens
gtcagtgctctcagctggcagtg

SEQ ID NO: 1663897 - DNA, 19 bp, Homo sapiens
gtcagtggagagatgtttg

SEQ ID NO: 1663898 - DNA, 21 bp, Homo sapiens
gtcagtgtacacgtctggacc

SEQ ID NO: 1663899 - DNA, 15 bp, Homo sapiens
gtcagtgtggagagg

SEQ ID NO: 1663900 - DNA, 19 bp, Homo sapiens
gtcagtgttaaagattttg

SEQ ID NO: 1663901 - DNA, 17 bp, Homo sapiens
gtcagttcccggagcac

SEQ ID NO: 1663902 - DNA, 13 bp, Homo sapiens
gtcagttgtaata

SEQ ID NO: 1663903 - DNA, 18 bp, Homo sapiens
gtcataaaatagaataat

SEQ ID NO: 1663904 - DNA, 19 bp, Homo sapiens
gtcataaattactgttttg

SEQ ID NO: 1663905 - DNA, 23 bp, Homo sapiens
gtcataactagattaagatctgt

SEQ ID NO: 1663906 - DNA, 15 bp, Homo sapiens
gtcataccagaaagc

SEQ ID NO: 1663907 - DNA, 17 bp, Homo sapiens
gtcatagccaaagccag

SEQ ID NO: 1663908 - DNA, 20 bp, Homo sapiens
gtcataggttttaaatctgc

SEQ ID NO: 1663909 - DNA, 23 bp, Homo sapiens
gtcataggttttaaatctgcttt

SEQ ID NO: 1663910 - DNA, 18 bp, Homo sapiens
gtcatcaaacatttgcca

SEQ ID NO: 1663911 - DNA, 13 bp, Homo sapiens
gtcatcaaagcag

SEQ ID NO: 1663912 - DNA, 16 bp, Homo sapiens
gtcatcactccctgga

SEQ ID NO: 1663913 - DNA, 14 bp, Homo sapiens
gtcatcatgaactg

SEQ ID NO: 1663914 - DNA, 18 bp, Homo sapiens
gtcatcatgaactggctt

SEQ ID NO: 1663915 - DNA, 18 bp, Homo sapiens
gtcatcatttgtcctgtt

SEQ ID NO: 1663916 - DNA, 20 bp, Homo sapiens
gtcatccacacaacaccagg

SEQ ID NO: 1663917 - DNA, 18 bp, Homo sapiens
gtcatccagactcagagc

SEQ ID NO: 1663918 - DNA, 22 bp, Homo sapiens
gtcatcgattcaaactgctcca

SEQ ID NO: 1663919 - DNA, 15 bp, Homo sapiens
gtcatctacttaata

SEQ ID NO: 1663920 - DNA, 16 bp, Homo sapiens
gtcatctcccctcctg

SEQ ID NO: 1663921 - DNA, 12 bp, Homo sapiens
gtcatcttgagc

SEQ ID NO: 1663922 - DNA, 23 bp, Homo sapiens
gtcatctttcttttctttgagtc

SEQ ID NO: 1663923 - DNA, 18 bp, Homo sapiens
gtcatgaacatgttcctg

SEQ ID NO: 1663924 - DNA, 19 bp, Homo sapiens
gtcatgacaagatgggaca

SEQ ID NO: 1663925 - DNA, 14 bp, Homo sapiens
gtcatgatctccct

SEQ ID NO: 1663926 - DNA, 17 bp, Homo sapiens
gtcatgatctccctgcc

SEQ ID NO: 1663927 - DNA, 22 bp, Homo sapiens
gtcatgatctccctgccgcctc

SEQ ID NO: 1663928 - DNA, 15 bp, Homo sapiens
gtcatgatggcacca

SEQ ID NO: 1663929 - DNA, 14 bp, Homo sapiens
gtcatgcaaagatt

SEQ ID NO: 1663930 - DNA, 19 bp, Homo sapiens
gtcatgcacagtatttgta

SEQ ID NO: 1663931 - DNA, 24 bp, Homo sapiens
gtcatgcacagtatttgtaattaa

SEQ ID NO: 1663932 - DNA, 18 bp, Homo sapiens
gtcatgctcagccttgct

SEQ ID NO: 1663933 - DNA, 22 bp, Homo sapiens
gtcatgctcagccttgctgctc

SEQ ID NO: 1663934 - DNA, 23 bp, Homo sapiens
gtcatgggccactgcttttccct

SEQ ID NO: 1663935 - DNA, 20 bp, Homo sapiens
gtcatggggatcaattttca

SEQ ID NO: 1663936 - DNA, 21 bp, Homo sapiens
gtcatggtcctttctggaagt

SEQ ID NO: 1663937 - DNA, 15 bp, Homo sapiens
gtcatgtaccatcaa

SEQ ID NO: 1663938 - DNA, 17 bp, Homo sapiens
gtcatgtaccatcaata

SEQ ID NO: 1663939 - DNA, 18 bp, Homo sapiens
gtcatgtacttcctgtgt

SEQ ID NO: 1663940 - DNA, 18 bp, Homo sapiens
gtcatgtgcatctggtgt

SEQ ID NO: 1663941 - DNA, 12 bp, Homo sapiens
gtcatgtgtata

SEQ ID NO: 1663942 - DNA, 13 bp, Homo sapiens
gtcatgtgtataa

SEQ ID NO: 1663943 - DNA, 14 bp, Homo sapiens
gtcatgtgtgcatg

SEQ ID NO: 1663944 - DNA, 16 bp, Homo sapiens
gtcatgtgtgcatgtg

SEQ ID NO: 1663945 - DNA, 18 bp, Homo sapiens
gtcattcccctttgcact

SEQ ID NO: 1663946 - DNA, 23 bp, Homo sapiens
gtcattgataataatatagtttt

SEQ ID NO: 1663947 - DNA, 14 bp, Homo sapiens
gtcattgctgctgc

SEQ ID NO: 1663948 - DNA, 13 bp, Homo sapiens
gtcattgtaatgt

SEQ ID NO: 1663949 - DNA, 13 bp, Homo sapiens
gtcattttgcact

SEQ ID NO: 1663950 - DNA, 18 bp, Homo sapiens
gtcccttgagacctcagc

SEQ ID NO: 1663951 - DNA, 19 bp, Homo sapiens
gtcccttgagacctcagcc

SEQ ID NO: 1663952 - DNA, 20 bp, Homo sapiens
gtcccttgagacctcagcca

SEQ ID NO: 1663953 - DNA, 14 bp, Homo sapiens
gtcccttgcctcaa

SEQ ID NO: 1663954 - DNA, 13 bp, Homo sapiens
gtcccttgcctct

SEQ ID NO: 1663955 - DNA, 20 bp, Homo sapiens
gtcccttgcctctgccctgg

SEQ ID NO: 1663956 - DNA, 21 bp, Homo sapiens
gtcccttgcctctgccctgga

SEQ ID NO: 1663957 - DNA, 20 bp, Homo sapiens
gtcccttgcttgcctgcagg

SEQ ID NO: 1663958 - DNA, 22 bp, Homo sapiens
gtcccttgcttgcctgcagggc

SEQ ID NO: 1663959 - DNA, 13 bp, Homo sapiens
gtccctttcccta

SEQ ID NO: 1663960 - DNA, 15 bp, Homo sapiens
gtcccttttccctta

SEQ ID NO: 1663961 - DNA, 20 bp, Homo sapiens
gtccctttttctccacactc

SEQ ID NO: 1663962 - DNA, 13 bp, Homo sapiens
gtccgatgctgga

SEQ ID NO: 1663963 - DNA, 14 bp, Homo sapiens
gtccgcaccagctg

SEQ ID NO: 1663964 - DNA, 17 bp, Homo sapiens
gtccgcaccagctgctc

SEQ ID NO: 1663965 - DNA, 18 bp, Homo sapiens
gtccgcaccagctgctct

SEQ ID NO: 1663966 - DNA, 19 bp, Homo sapiens
gtccgcaccagctgctctg

SEQ ID NO: 1663967 - DNA, 20 bp, Homo sapiens
gtccgcaccagctgctctgc

SEQ ID NO: 1663968 - DNA, 12 bp, Homo sapiens
gtccgccctgct

SEQ ID NO: 1663969 - DNA, 21 bp, Homo sapiens
gtccggatttctaacagtcct

SEQ ID NO: 1663970 - DNA, 16 bp, Homo sapiens
gtccggcccagtgcca

SEQ ID NO: 1663971 - DNA, 17 bp, Homo sapiens
gtccggtgtccttttca

SEQ ID NO: 1663972 - DNA, 17 bp, Homo sapiens
gtccggtgttctaagat

SEQ ID NO: 1663973 - DNA, 20 bp, Homo sapiens
gtccgtccacccttccatca

SEQ ID NO: 1663974 - DNA, 15 bp, Homo sapiens
gtccgtctctcttgc

SEQ ID NO: 1663975 - DNA, 20 bp, Homo sapiens
gtccgtctctcttgcttgag

SEQ ID NO: 1663976 - DNA, 12 bp, Homo sapiens
gtccgtctgtct

SEQ ID NO: 1663977 - DNA, 13 bp, Homo sapiens
gtccgtctgtctc

SEQ ID NO: 1663978 - DNA, 16 bp, Homo sapiens
gtccgtgcccaggccc

SEQ ID NO: 1663979 - DNA, 19 bp, Homo sapiens
gtccgtgggacggtgccca

SEQ ID NO: 1663980 - DNA, 19 bp, Homo sapiens
gtccgttcacatgtgtggt

SEQ ID NO: 1663981 - DNA, 14 bp, Homo sapiens
gtccgtttactcca

SEQ ID NO: 1663982 - DNA, 22 bp, Homo sapiens
gtcctaagaaagaggagtgctt

SEQ ID NO: 1663983 - DNA, 20 bp, Homo sapiens
gtcctaagtgctaagtgctt

SEQ ID NO: 1663984 - DNA, 21 bp, Homo sapiens
gtcctagctcctcctcctggg

SEQ ID NO: 1663985 - DNA, 14 bp, Homo sapiens
gtcctagtaagaag

SEQ ID NO: 1663986 - DNA, 17 bp, Homo sapiens
gtcctatggacaactta

SEQ ID NO: 1663987 - DNA, 19 bp, Homo sapiens
gtcctatggacaacttatt

SEQ ID NO: 1663988 - DNA, 15 bp, Homo sapiens
gtcctcacaagcctc

SEQ ID NO: 1663989 - DNA, 21 bp, Homo sapiens
gtcctcacaagcctcttctga

SEQ ID NO: 1663990 - DNA, 22 bp, Homo sapiens
gtcctcacttctagatctcagc

SEQ ID NO: 1663991 - DNA, 23 bp, Homo sapiens
gtcctcacttctagatctcagcc

SEQ ID NO: 1663992 - DNA, 24 bp, Homo sapiens
gtcctcacttctagatctcagcca

SEQ ID NO: 1663993 - DNA, 20 bp, Homo sapiens
gtcctcagagaatttctacc

SEQ ID NO: 1663994 - DNA, 18 bp, Homo sapiens
gtcctcaggaagggggcc

SEQ ID NO: 1663995 - DNA, 13 bp, Homo sapiens
gtcctccaccatg

SEQ ID NO: 1663996 - DNA, 13 bp, Homo sapiens
gtcctccagaagc

SEQ ID NO: 1663997 - DNA, 14 bp, Homo sapiens
gtcctccagaagcc

SEQ ID NO: 1663998 - DNA, 21 bp, Homo sapiens
gtcctccagaagcctctggct

SEQ ID NO: 1663999 - DNA, 22 bp, Homo sapiens
gtcctccagaagcctctggcta

SEQ ID NO: 1664000 - DNA, 15 bp, Homo sapiens
gtcctccaggagctt

SEQ ID NO: 1664001 - DNA, 22 bp, Homo sapiens
gtcctccatcccaacagccatg

SEQ ID NO: 1664002 - DNA, 21 bp, Homo sapiens
gtcctcccaccttggcctccc

SEQ ID NO: 1664003 - DNA, 13 bp, Homo sapiens
gtcctccccttgg

SEQ ID NO: 1664004 - DNA, 21 bp, Homo sapiens
gtcctcccgagctcctcttcc

SEQ ID NO: 1664005 - DNA, 15 bp, Homo sapiens
gtcctccctcccaag

SEQ ID NO: 1664006 - DNA, 20 bp, Homo sapiens
gtcctcctatctccctggct

SEQ ID NO: 1664007 - DNA, 22 bp, Homo sapiens
gtcctcctatctccctggctca

SEQ ID NO: 1664008 - DNA, 23 bp, Homo sapiens
gtcctcctatctccctggctcac

SEQ ID NO: 1664009 - DNA, 13 bp, Homo sapiens
gtcctcctgtgct

SEQ ID NO: 1664010 - DNA, 21 bp, Homo sapiens
gtcctcgaattttatctgtgg

SEQ ID NO: 1664011 - DNA, 23 bp, Homo sapiens
gtcctcgaattttatctgtggag

SEQ ID NO: 1664012 - DNA, 22 bp, Homo sapiens
gtcctcgtggcggggcagcagg

SEQ ID NO: 1664013 - DNA, 21 bp, Homo sapiens
gtcctctagcccactccctgc

SEQ ID NO: 1664014 - DNA, 17 bp, Homo sapiens
gtcctctcagaactcct

SEQ ID NO: 1664015 - DNA, 18 bp, Homo sapiens
gtcctctcagaactcctg

SEQ ID NO: 1664016 - DNA, 19 bp, Homo sapiens
gtcctctcagttctctccc

SEQ ID NO: 1664017 - DNA, 20 bp, Homo sapiens
gtcctctcagttctctccct

SEQ ID NO: 1664018 - DNA, 23 bp, Homo sapiens
gtcctctcagttctctcccttcc

SEQ ID NO: 1664019 - DNA, 16 bp, Homo sapiens
gtcctctccctgccaa

SEQ ID NO: 1664020 - DNA, 13 bp, Homo sapiens
gtcctctctctgt

SEQ ID NO: 1664021 - DNA, 21 bp, Homo sapiens
gtcctctctctgtggggctga

SEQ ID NO: 1664022 - DNA, 10 bp, Homo sapiens
gtcctctgct

SEQ ID NO: 1664023 - DNA, 14 bp, Homo sapiens
gtcctctgctccag

SEQ ID NO: 1664024 - DNA, 19 bp, Homo sapiens
gtcctcttccctctctgca

SEQ ID NO: 1664025 - DNA, 22 bp, Homo sapiens
gtcctcttctgctcttttcctg

SEQ ID NO: 1664026 - DNA, 23 bp, Homo sapiens
gtcctcttctgctcttttcctgg

SEQ ID NO: 1664027 - DNA, 20 bp, Homo sapiens
gtcctctttacatgaaacta

SEQ ID NO: 1664028 - DNA, 17 bp, Homo sapiens
gtcctgaagaggcgggc

SEQ ID NO: 1664029 - DNA, 21 bp, Homo sapiens
gtcctgaagaggcgggccagc

SEQ ID NO: 1664030 - DNA, 22 bp, Homo sapiens
gtcctgaagaggcgggccagcc

SEQ ID NO: 1664031 - DNA, 17 bp, Homo sapiens
gtcctgaagctgctgga

SEQ ID NO: 1664032 - DNA, 13 bp, Homo sapiens
gtcctgaccaccc

SEQ ID NO: 1664033 - DNA, 21 bp, Homo sapiens
gtcctgaccaccctcccctct

SEQ ID NO: 1664034 - DNA, 16 bp, Homo sapiens
gtcctgacctgtctca

SEQ ID NO: 1664035 - DNA, 20 bp, Homo sapiens
gtcctgagatggaaaagtgt

SEQ ID NO: 1664036 - DNA, 14 bp, Homo sapiens
gtcctgaggagccc

SEQ ID NO: 1664037 - DNA, 20 bp, Homo sapiens
gtcctgcagaggaccacagt

SEQ ID NO: 1664038 - DNA, 23 bp, Homo sapiens
gtcctgcagcaaacactccaccc

SEQ ID NO: 1664039 - DNA, 12 bp, Homo sapiens
gtcctgccagct

SEQ ID NO: 1664040 - DNA, 15 bp, Homo sapiens
gtcctgccagctgcc

SEQ ID NO: 1664041 - DNA, 17 bp, Homo sapiens
gtcctgccagctgcctt

SEQ ID NO: 1664042 - DNA, 22 bp, Homo sapiens
gtcctgccagctgccttcctca

SEQ ID NO: 1664043 - DNA, 18 bp, Homo sapiens
gtcctgcccatgccccag

SEQ ID NO: 1664044 - DNA, 12 bp, Homo sapiens
gtcctgccctgc

SEQ ID NO: 1664045 - DNA, 13 bp, Homo sapiens
gtcctgccggtgg

SEQ ID NO: 1664046 - DNA, 17 bp, Homo sapiens
gtcctgccggtgggacc

SEQ ID NO: 1664047 - DNA, 20 bp, Homo sapiens
gtcctgcctggccaggcaga

SEQ ID NO: 1664048 - DNA, 14 bp, Homo sapiens
gtcctgcctgtctg

SEQ ID NO: 1664049 - DNA, 21 bp, Homo sapiens
gtcctgcctgtctgccccagc

SEQ ID NO: 1664050 - DNA, 15 bp, Homo sapiens
gtcctgcctgtggcg

SEQ ID NO: 1664051 - DNA, 22 bp, Homo sapiens
gtcctgcctgtggcgccgtctc

SEQ ID NO: 1664052 - DNA, 21 bp, Homo sapiens
gtcctgctcattatgccactt

SEQ ID NO: 1664053 - DNA, 16 bp, Homo sapiens
gtcctgctccgctgcc

SEQ ID NO: 1664054 - DNA, 19 bp, Homo sapiens
gtcctgctccgctgcctgg

SEQ ID NO: 1664055 - DNA, 14 bp, Homo sapiens
gtcctgctgccctc

SEQ ID NO: 1664056 - DNA, 11 bp, Homo sapiens
gtcctgctgtg

SEQ ID NO: 1664057 - DNA, 19 bp, Homo sapiens
gtcctggagcagaccaccc

SEQ ID NO: 1664058 - DNA, 14 bp, Homo sapiens
gtcctggaggggct

SEQ ID NO: 1664059 - DNA, 23 bp, Homo sapiens
gtcctggcccttcagtctgctcc

SEQ ID NO: 1664060 - DNA, 19 bp, Homo sapiens
gtcctggctacatcccagc

SEQ ID NO: 1664061 - DNA, 20 bp, Homo sapiens
gtcctggctacatcccagcc

SEQ ID NO: 1664062 - DNA, 11 bp, Homo sapiens
gtcctggctcc

SEQ ID NO: 1664063 - DNA, 14 bp, Homo sapiens
gtcctggctcctga

SEQ ID NO: 1664064 - DNA, 17 bp, Homo sapiens
gtggcggggcagcagga

SEQ ID NO: 1664065 - DNA, 21 bp, Homo sapiens
gtggcgttctgctgcccctgc

SEQ ID NO: 1664066 - DNA, 22 bp, Homo sapiens
gtggcgttctgctgcccctgca

SEQ ID NO: 1664067 - DNA, 14 bp, Homo sapiens
gtggctcactactg

SEQ ID NO: 1664068 - DNA, 15 bp, Homo sapiens
gtggctcactactga

SEQ ID NO: 1664069 - DNA, 15 bp, Homo sapiens
gtggctccccctctg

SEQ ID NO: 1664070 - DNA, 17 bp, Homo sapiens
gtggctccccctctgct

SEQ ID NO: 1664071 - DNA, 15 bp, Homo sapiens
gtggctcctcctagg

SEQ ID NO: 1664072 - DNA, 20 bp, Homo sapiens
gtggctcctcctaggaaacc

SEQ ID NO: 1664073 - DNA, 19 bp, Homo sapiens
gtggctcctgggccggctg

SEQ ID NO: 1664074 - DNA, 21 bp, Homo sapiens
gtggctctgaggtgcctgtcc

SEQ ID NO: 1664075 - DNA, 20 bp, Homo sapiens
gtggctgatgctttgaacat

SEQ ID NO: 1664076 - DNA, 20 bp, Homo sapiens
gtggctgccccacctgccgc

SEQ ID NO: 1664077 - DNA, 12 bp, Homo sapiens
gtggctggaaga

SEQ ID NO: 1664078 - DNA, 12 bp, Homo sapiens
gtggctggagga

SEQ ID NO: 1664079 - DNA, 18 bp, Homo sapiens
gtggctggaggagctggc

SEQ ID NO: 1664080 - DNA, 20 bp, Homo sapiens
gtggctggaggagctggcct

SEQ ID NO: 1664081 - DNA, 21 bp, Homo sapiens
gtggctggaggagctggcctg

SEQ ID NO: 1664082 - DNA, 12 bp, Homo sapiens
gtggctgggcag

SEQ ID NO: 1664083 - DNA, 11 bp, Homo sapiens
gtggctggggg

SEQ ID NO: 1664084 - DNA, 22 bp, Homo sapiens
gtggctgggggcaggagggccc

SEQ ID NO: 1664085 - DNA, 16 bp, Homo sapiens
gtggctggtagaaaaa

SEQ ID NO: 1664086 - DNA, 16 bp, Homo sapiens
gtggctgtggcacaga

SEQ ID NO: 1664087 - DNA, 20 bp, Homo sapiens
gtggcttaagtgagcagaac

SEQ ID NO: 1664088 - DNA, 22 bp, Homo sapiens
gtggcttaagtgagcagaacag

SEQ ID NO: 1664089 - DNA, 18 bp, Homo sapiens
gtggcttcagaggcctgg

SEQ ID NO: 1664090 - DNA, 21 bp, Homo sapiens
gtggcttctctgtgaattgcc

SEQ ID NO: 1664091 - DNA, 18 bp, Homo sapiens
gtggctttaattgtataa

SEQ ID NO: 1664092 - DNA, 12 bp, Homo sapiens
gtgggaaaacac

SEQ ID NO: 1664093 - DNA, 20 bp, Homo sapiens
gtgggaagcccatcctgacc

SEQ ID NO: 1664094 - DNA, 15 bp, Homo sapiens
gtgggaaggacttgg

SEQ ID NO: 1664095 - DNA, 14 bp, Homo sapiens
gtgggaagggagag

SEQ ID NO: 1664096 - DNA, 21 bp, Homo sapiens
gtgggaatgtggtagtaccca

SEQ ID NO: 1664097 - DNA, 17 bp, Homo sapiens
gtgggacactgggcagc

SEQ ID NO: 1664098 - DNA, 13 bp, Homo sapiens
gtgggacagccca

SEQ ID NO: 1664099 - DNA, 18 bp, Homo sapiens
gtgggacagcccagagcc

SEQ ID NO: 1664100 - DNA, 21 bp, Homo sapiens
gtgggacagcccagagcctgg

SEQ ID NO: 1664101 - DNA, 17 bp, Homo sapiens
gtgggaccagtcccaca

SEQ ID NO: 1664102 - DNA, 19 bp, Homo sapiens
gtgggaccctgtccggccc

SEQ ID NO: 1664103 - DNA, 19 bp, Homo sapiens
gtgggagacagcagcctgt

SEQ ID NO: 1664104 - DNA, 13 bp, Homo sapiens
gtgggagctcctc

SEQ ID NO: 1664105 - DNA, 13 bp, Homo sapiens
gtgggagcttccc

SEQ ID NO: 1664106 - DNA, 22 bp, Homo sapiens
gtgggaggaaagggcctggcca

SEQ ID NO: 1664107 - DNA, 16 bp, Homo sapiens
gtgggaggggcaggct

SEQ ID NO: 1664108 - DNA, 13 bp, Homo sapiens
gtgggaggtcagg

SEQ ID NO: 1664109 - DNA, 13 bp, Homo sapiens
gtgggatcctccc

SEQ ID NO: 1664110 - DNA, 16 bp, Homo sapiens
gtgggatgaaccagcc

SEQ ID NO: 1664111 - DNA, 24 bp, Homo sapiens
gtgggatgttcagcactgtccctt

SEQ ID NO: 1664112 - DNA, 20 bp, Homo sapiens
gtgggcaggatctcaagcca

SEQ ID NO: 1664113 - DNA, 22 bp, Homo sapiens
gtgggcaggatctcaagccagc

SEQ ID NO: 1664114 - DNA, 14 bp, Homo sapiens
gtgggcagtgccac

SEQ ID NO: 1664115 - DNA, 13 bp, Homo sapiens
gtgggccagagct

SEQ ID NO: 1664116 - DNA, 14 bp, Homo sapiens
gtgggccagagctg

SEQ ID NO: 1664117 - DNA, 14 bp, Homo sapiens
gtgggccaggacag

SEQ ID NO: 1664118 - DNA, 12 bp, Homo sapiens
gtgggcccaccc

SEQ ID NO: 1664119 - DNA, 17 bp, Homo sapiens
gtgggccccgggctgga

SEQ ID NO: 1664120 - DNA, 20 bp, Homo sapiens
gtgggccccgggctggagaa

SEQ ID NO: 1664121 - DNA, 18 bp, Homo sapiens
gtgggccccttagcaatg

SEQ ID NO: 1664122 - DNA, 14 bp, Homo sapiens
gtgggcctggcctg

SEQ ID NO: 1664123 - DNA, 18 bp, Homo sapiens
gtgggcctggcctgagct

SEQ ID NO: 1664124 - DNA, 12 bp, Homo sapiens
gtgggcgcccac

SEQ ID NO: 1664125 - DNA, 19 bp, Homo sapiens
gtgggcgcccaccctgggc

SEQ ID NO: 1664126 - DNA, 18 bp, Homo sapiens
gtgggcgttgggagccta

SEQ ID NO: 1664127 - DNA, 20 bp, Homo sapiens
gtgggcgttgggagcctagc

SEQ ID NO: 1664128 - DNA, 14 bp, Homo sapiens
gtgggctaattaaa

SEQ ID NO: 1664129 - DNA, 19 bp, Homo sapiens
gtgggctggacttctacct

SEQ ID NO: 1664130 - DNA, 20 bp, Homo sapiens
gtgggctgggaatgggggag

SEQ ID NO: 1664131 - DNA, 18 bp, Homo sapiens
gtgggctggggctgctcc

SEQ ID NO: 1664132 - DNA, 13 bp, Homo sapiens
gtgggctgtgagt

SEQ ID NO: 1664133 - DNA, 14 bp, Homo sapiens
gtgggctgtgagtg

SEQ ID NO: 1664134 - DNA, 11 bp, Homo sapiens
gtgggctgtgg

SEQ ID NO: 1664135 - DNA, 16 bp, Homo sapiens
gtgggcttatgtctct

SEQ ID NO: 1664136 - DNA, 19 bp, Homo sapiens
gtgggcttatgtctctgcc

SEQ ID NO: 1664137 - DNA, 21 bp, Homo sapiens
gtgggctttctccggggtctg

SEQ ID NO: 1664138 - DNA, 18 bp, Homo sapiens
gtggggaacacagctaca

SEQ ID NO: 1664139 - DNA, 23 bp, Homo sapiens
gtggggaacatggctggcctggt

SEQ ID NO: 1664140 - DNA, 14 bp, Homo sapiens
gtggggacagggct

SEQ ID NO: 1664141 - DNA, 22 bp, Homo sapiens
gtggggagggacaagggattct

SEQ ID NO: 1664142 - DNA, 13 bp, Homo sapiens
gtggggaggggcg

SEQ ID NO: 1664143 - DNA, 22 bp, Homo sapiens
gtggggcaggagtgccaggacc

SEQ ID NO: 1664144 - DNA, 14 bp, Homo sapiens
gtggggccaggacc

SEQ ID NO: 1664145 - DNA, 14 bp, Homo sapiens
gtggggcccactgc

SEQ ID NO: 1664146 - DNA, 15 bp, Homo sapiens
gtggggcctagatcc

SEQ ID NO: 1664147 - DNA, 16 bp, Homo sapiens
gtggggcctccttgtc

SEQ ID NO: 1664148 - DNA, 14 bp, Homo sapiens
gtggggcctgggag

SEQ ID NO: 1664149 - DNA, 13 bp, Homo sapiens
gtggggccttggt

SEQ ID NO: 1664150 - DNA, 18 bp, Homo sapiens
gtggggctcgtggccttc

SEQ ID NO: 1664151 - DNA, 12 bp, Homo sapiens
gtggggctgagc

SEQ ID NO: 1664152 - DNA, 13 bp, Homo sapiens
gtggggctgagcc

SEQ ID NO: 1664153 - DNA, 16 bp, Homo sapiens
gtggggctgagcctga

SEQ ID NO: 1664154 - DNA, 18 bp, Homo sapiens
gtggggctgagctgggga

SEQ ID NO: 1664155 - DNA, 16 bp, Homo sapiens
gtggggctgctcctcc

SEQ ID NO: 1664156 - DNA, 12 bp, Homo sapiens
gtgggggagcca

SEQ ID NO: 1664157 - DNA, 14 bp, Homo sapiens
gtgggggcagaggg

SEQ ID NO: 1664158 - DNA, 14 bp, Homo sapiens
gtgggggctgtcct

SEQ ID NO: 1664159 - DNA, 15 bp, Homo sapiens
gtgggggtggaggct

SEQ ID NO: 1664160 - DNA, 18 bp, Homo sapiens
gtgggggttgctgtataa

SEQ ID NO: 1664161 - DNA, 18 bp, Homo sapiens
gtggggtacatttctctg

SEQ ID NO: 1664162 - DNA, 23 bp, Homo sapiens
gtggggtcccccctgagtgggct

SEQ ID NO: 1664163 - DNA, 14 bp, Homo sapiens
gtggggtctccctc

SEQ ID NO: 1664164 - DNA, 13 bp, Homo sapiens
gtggggtgtgctg

SEQ ID NO: 1664165 - DNA, 16 bp, Homo sapiens
gtggggtgtgctggga

SEQ ID NO: 1664166 - DNA, 18 bp, Homo sapiens
gtgggtaagaggagcaga

SEQ ID NO: 1664167 - DNA, 22 bp, Homo sapiens
gtgggtaatccaggcacagctg

SEQ ID NO: 1664168 - DNA, 22 bp, Homo sapiens
gtgggtcacacacacgcactgc

SEQ ID NO: 1664169 - DNA, 16 bp, Homo sapiens
gtgggtcagaacatgt

SEQ ID NO: 1664170 - DNA, 16 bp, Homo sapiens
gtgggtcagcccagca

SEQ ID NO: 1664171 - DNA, 18 bp, Homo sapiens
gtgggtcagcccagcacc

SEQ ID NO: 1664172 - DNA, 22 bp, Homo sapiens
gtgggtccaggaaggcagctgc

SEQ ID NO: 1664173 - DNA, 17 bp, Homo sapiens
gtgggtccgcatccctg

SEQ ID NO: 1664174 - DNA, 19 bp, Homo sapiens
gtgggtctatgttccccag

SEQ ID NO: 1664175 - DNA, 14 bp, Homo sapiens
gtgggtctctgaag

SEQ ID NO: 1664176 - DNA, 13 bp, Homo sapiens
gtgggtctctggg

SEQ ID NO: 1664177 - DNA, 13 bp, Homo sapiens
gtgggtctgggat

SEQ ID NO: 1664178 - DNA, 19 bp, Homo sapiens
gtgggtgattcctcccagg

SEQ ID NO: 1664179 - DNA, 18 bp, Homo sapiens
gtgggtggcacctcctga

SEQ ID NO: 1664180 - DNA, 16 bp, Homo sapiens
gtgtgggaagggagag

SEQ ID NO: 1664181 - DNA, 21 bp, Homo sapiens
gtgtgggacacctgggagaag

SEQ ID NO: 1664182 - DNA, 14 bp, Homo sapiens
gtgtgggctgtgtc

SEQ ID NO: 1664183 - DNA, 20 bp, Homo sapiens
gtgtggggacacagcagtga

SEQ ID NO: 1664184 - DNA, 13 bp, Homo sapiens
gtgtggggtgggg

SEQ ID NO: 1664185 - DNA, 13 bp, Homo sapiens
gtgtgggtcccgc

SEQ ID NO: 1664186 - DNA, 16 bp, Homo sapiens
gtgtgggtctctgggc

SEQ ID NO: 1664187 - DNA, 14 bp, Homo sapiens
gtgtgggtctgtgt

SEQ ID NO: 1664188 - DNA, 23 bp, Homo sapiens
gtgtgggtgtcctgcctgtctgc

SEQ ID NO: 1664189 - DNA, 17 bp, Homo sapiens
gtgtggtatgagggggt

SEQ ID NO: 1664190 - DNA, 20 bp, Homo sapiens
gtgtggtgaggggctttctc

SEQ ID NO: 1664191 - DNA, 16 bp, Homo sapiens
gtgtggtggagccagg

SEQ ID NO: 1664192 - DNA, 20 bp, Homo sapiens
gtgtggtggagccagggcct

SEQ ID NO: 1664193 - DNA, 13 bp, Homo sapiens
gtgtggtggctca

SEQ ID NO: 1664194 - DNA, 18 bp, Homo sapiens
gtgtgtaattatgtaaat

SEQ ID NO: 1664195 - DNA, 17 bp, Homo sapiens
gtgtgtagacaaatatt

SEQ ID NO: 1664196 - DNA, 19 bp, Homo sapiens
gtgtgtagacaaatatttg

SEQ ID NO: 1664197 - DNA, 20 bp, Homo sapiens
gtgtgtcacccttaggccag

SEQ ID NO: 1664198 - DNA, 13 bp, Homo sapiens
gtgtgtcaggccc

SEQ ID NO: 1664199 - DNA, 17 bp, Homo sapiens
gtgtgtcaggccctctg

SEQ ID NO: 1664200 - DNA, 19 bp, Homo sapiens
gtgtgtccctggacacagc

SEQ ID NO: 1664201 - DNA, 20 bp, Homo sapiens
gtgtgtccctggacacagct

SEQ ID NO: 1664202 - DNA, 16 bp, Homo sapiens
gtgtgtctgctcagta

SEQ ID NO: 1664203 - DNA, 13 bp, Homo sapiens
gtgtgtctgctga

SEQ ID NO: 1664204 - DNA, 15 bp, Homo sapiens
gtgtgtctgttcact

SEQ ID NO: 1664205 - DNA, 17 bp, Homo sapiens
gtgtgtgacaattctgt

SEQ ID NO: 1664206 - DNA, 11 bp, Homo sapiens
gtgtgtgccct

SEQ ID NO: 1664207 - DNA, 20 bp, Homo sapiens
gtgtgtggaaggcacccgcc

SEQ ID NO: 1664208 - DNA, 13 bp, Homo sapiens
gtgtgtggctggg

SEQ ID NO: 1664209 - DNA, 13 bp, Homo sapiens
gtgtgtgggcagg

SEQ ID NO: 1664210 - DNA, 14 bp, Homo sapiens
gtgtgtgggcaggg

SEQ ID NO: 1664211 - DNA, 21 bp, Homo sapiens
gtgtgtggtgaggggctttct

SEQ ID NO: 1664212 - DNA, 14 bp, Homo sapiens
gtgtgtgtctgtct

SEQ ID NO: 1664213 - DNA, 13 bp, Homo sapiens
gtgtgtgtgcatg

SEQ ID NO: 1664214 - DNA, 12 bp, Homo sapiens
gtgtgtgtgtat

SEQ ID NO: 1664215 - DNA, 11 bp, Homo sapiens
gtgtgtgtgtg

SEQ ID NO: 1664216 - DNA, 13 bp, Homo sapiens
gtgtgtgtgtggc

SEQ ID NO: 1664217 - DNA, 17 bp, Homo sapiens
gtgtgtgttgtgtgtgg

SEQ ID NO: 1664218 - DNA, 21 bp, Homo sapiens
gtgtgttctgtaatggaactg

SEQ ID NO: 1664219 - DNA, 15 bp, Homo sapiens
gtgtgtttatgtgtg

SEQ ID NO: 1664220 - DNA, 19 bp, Homo sapiens
gtgttaaaaggaaaaataa

SEQ ID NO: 1664221 - DNA, 11 bp, Homo sapiens
gtgttaaacac

SEQ ID NO: 1664222 - DNA, 20 bp, Homo sapiens
gtgttaaacactacacattt

SEQ ID NO: 1664223 - DNA, 14 bp, Homo sapiens
gtgttaacattcca

SEQ ID NO: 1664224 - DNA, 16 bp, Homo sapiens
gtgttaattttgctaa

SEQ ID NO: 1664225 - DNA, 17 bp, Homo sapiens
gtgttaattttgctaac

SEQ ID NO: 1664226 - DNA, 20 bp, Homo sapiens
gtgttaattttgctaactgg

SEQ ID NO: 1664227 - DNA, 21 bp, Homo sapiens
gtgttaattttgctaactggg

SEQ ID NO: 1664228 - DNA, 14 bp, Homo sapiens
gtgttacagaggac

SEQ ID NO: 1664229 - DNA, 20 bp, Homo sapiens
gtgttactaaaaaaaagatg

SEQ ID NO: 1664230 - DNA, 21 bp, Homo sapiens
gtgttactaaaaaaaagatga

SEQ ID NO: 1664231 - DNA, 20 bp, Homo sapiens
gtgttactgctttgcaaaga

SEQ ID NO: 1664232 - DNA, 19 bp, Homo sapiens
gtgttagaagcccattcat

SEQ ID NO: 1664233 - DNA, 16 bp, Homo sapiens
gtgttaggaggctgca

SEQ ID NO: 1664234 - DNA, 21 bp, Homo sapiens
gtgttaggaggctgcatgctc

SEQ ID NO: 1664235 - DNA, 17 bp, Homo sapiens
gtgttatttccccagcc

SEQ ID NO: 1664236 - DNA, 20 bp, Homo sapiens
gtgttatttccccagccaca

SEQ ID NO: 1664237 - DNA, 22 bp, Homo sapiens
gtgttatttccccagccacagg

SEQ ID NO: 1664238 - DNA, 24 bp, Homo sapiens
gtgttcaccttcaaaatgttctat

SEQ ID NO: 1664239 - DNA, 20 bp, Homo sapiens
gtgttcagctctttccaaat

SEQ ID NO: 1664240 - DNA, 21 bp, Homo sapiens
gtgttcccatttcagctgatc

SEQ ID NO: 1664241 - DNA, 11 bp, Homo sapiens
gtgttcctgga

SEQ ID NO: 1664242 - DNA, 19 bp, Homo sapiens
gtgttcgtttccatcatgt

SEQ ID NO: 1664243 - DNA, 20 bp, Homo sapiens
gtgttcgtttccatcatgtc

SEQ ID NO: 1664244 - DNA, 21 bp, Homo sapiens
gtgttcgtttccatcatgtct

SEQ ID NO: 1664245 - DNA, 22 bp, Homo sapiens
gtgttctaagatgtgatattct

SEQ ID NO: 1664246 - DNA, 14 bp, Homo sapiens
gtgttctaagcaat

SEQ ID NO: 1664247 - DNA, 22 bp, Homo sapiens
gtgttctgctcctgcttttctg

SEQ ID NO: 1664248 - DNA, 23 bp, Homo sapiens
gtgttctgctcctgcttttctgt

SEQ ID NO: 1664249 - DNA, 23 bp, Homo sapiens
gtgttctgtttgttattgttttg

SEQ ID NO: 1664250 - DNA, 13 bp, Homo sapiens
gtgttcttaggtt

SEQ ID NO: 1664251 - DNA, 17 bp, Homo sapiens
gtgttcttaggtttact

SEQ ID NO: 1664252 - DNA, 23 bp, Homo sapiens
gtgttcttaggtttactgtgaag

SEQ ID NO: 1664253 - DNA, 14 bp, Homo sapiens
gtgttgacacatat

SEQ ID NO: 1664254 - DNA, 14 bp, Homo sapiens
gtgttgccatttct

SEQ ID NO: 1664255 - DNA, 19 bp, Homo sapiens
gtgttgccatttctctgct

SEQ ID NO: 1664256 - DNA, 20 bp, Homo sapiens
gtgttgcccaggctggtctc

SEQ ID NO: 1664257 - DNA, 13 bp, Homo sapiens
gtgttgctgtggc

SEQ ID NO: 1664258 - DNA, 12 bp, Homo sapiens
gtgttgtctcta

SEQ ID NO: 1664259 - DNA, 14 bp, Homo sapiens
gtgttgtgtctgtg

SEQ ID NO: 1664260 - DNA, 15 bp, Homo sapiens
gtgttgtgtgtggga

SEQ ID NO: 1664261 - DNA, 15 bp, Homo sapiens
gtgttgtgttcctgg

SEQ ID NO: 1664262 - DNA, 19 bp, Homo sapiens
gtgttgttgttgctgctgt

SEQ ID NO: 1664263 - DNA, 18 bp, Homo sapiens
gtgtttactatgtgccag

SEQ ID NO: 1664264 - DNA, 12 bp, Homo sapiens
gtgtttatgtgt

SEQ ID NO: 1664265 - DNA, 16 bp, Homo sapiens
gtgtttatgtgtgtgt

SEQ ID NO: 1664266 - DNA, 13 bp, Homo sapiens
gtgtttatttata

SEQ ID NO: 1664267 - DNA, 18 bp, Homo sapiens
gtgtttccatattttata

SEQ ID NO: 1664268 - DNA, 15 bp, Homo sapiens
gtgtttctcaaaaga

SEQ ID NO: 1664269 - DNA, 13 bp, Homo sapiens
gtgtttctgactc

SEQ ID NO: 1664270 - DNA, 13 bp, Homo sapiens
gtgtttgattggc

SEQ ID NO: 1664271 - DNA, 18 bp, Homo sapiens
gtgtttggatcaaaaaga

SEQ ID NO: 1664272 - DNA, 16 bp, Homo sapiens
gtgtttgtatgtctgt

SEQ ID NO: 1664273 - DNA, 19 bp, Homo sapiens
gtgtttgtatgtctgtgta

SEQ ID NO: 1664274 - DNA, 14 bp, Homo sapiens
gtgtttgtctgtgt

SEQ ID NO: 1664275 - DNA, 16 bp, Homo sapiens
gtgtttgtgagcatgg

SEQ ID NO: 1664276 - DNA, 16 bp, Homo sapiens
gtgttttaattgtaaa

SEQ ID NO: 1664277 - DNA, 15 bp, Homo sapiens
gtgttttaatttaaa

SEQ ID NO: 1664278 - DNA, 14 bp, Homo sapiens
gtgttttagggtga

SEQ ID NO: 1664279 - DNA, 15 bp, Homo sapiens
gtgttttataaaata

SEQ ID NO: 1664280 - DNA, 16 bp, Homo sapiens
gtgttttcattttaga

SEQ ID NO: 1664281 - DNA, 17 bp, Homo sapiens
gtgttttcccaaagcac

SEQ ID NO: 1664282 - DNA, 15 bp, Homo sapiens
gtgttttgaaagaat

SEQ ID NO: 1664283 - DNA, 19 bp, Homo sapiens
gtgttttgtcagacttcca

SEQ ID NO: 1664284 - DNA, 17 bp, Homo sapiens
gtgttttgtctgagcct

SEQ ID NO: 1664285 - DNA, 13 bp, Homo sapiens
gtgttttttaaga

SEQ ID NO: 1664286 - DNA, 14 bp, Homo sapiens
gtgttttttaagat

SEQ ID NO: 1664287 - DNA, 23 bp, Homo sapiens
gtgttttttctttttttttaagt

SEQ ID NO: 1664288 - DNA, 14 bp, Homo sapiens
gttaaaaaggccaa

SEQ ID NO: 1664289 - DNA, 22 bp, Homo sapiens
gttaaaaaggccaaagataaaa

SEQ ID NO: 1664290 - DNA, 17 bp, Homo sapiens
gttaaaaatcagctggg

SEQ ID NO: 1664291 - DNA, 20 bp, Homo sapiens
gttaaaactgtacatttaaa

SEQ ID NO: 1664292 - DNA, 22 bp, Homo sapiens
gttaaaactgtacatttaaaat

SEQ ID NO: 1664293 - DNA, 20 bp, Homo sapiens
gttaaaagatgaaaatattt

SEQ ID NO: 1664294 - DNA, 22 bp, Homo sapiens
gttaaaataaagcctatttttc

SEQ ID NO: 1664295 - DNA, 21 bp, Homo sapiens
gttagggtgtgtgttcacctt

SEQ ID NO: 1664296 - DNA, 13 bp, Homo sapiens
gttagtagaaatt

SEQ ID NO: 1664297 - DNA, 16 bp, Homo sapiens
gttagtatctaacatg

SEQ ID NO: 1664298 - DNA, 15 bp, Homo sapiens
gttagtgtgtgtgca

SEQ ID NO: 1664299 - DNA, 21 bp, Homo sapiens
gttagtgtgtgtgcatgtgtg

SEQ ID NO: 1664300 - DNA, 23 bp, Homo sapiens
gttagtgtgtgtgcatgtgtgtg

SEQ ID NO: 1664301 - DNA, 21 bp, Homo sapiens
gttagtttgtatatattatta

SEQ ID NO: 1664302 - DNA, 15 bp, Homo sapiens
gttataaaaaatggt

SEQ ID NO: 1664303 - DNA, 16 bp, Homo sapiens
gttataaaaaatggtt

SEQ ID NO: 1664304 - DNA, 17 bp, Homo sapiens
gttataaatcaatgtca

SEQ ID NO: 1664305 - DNA, 14 bp, Homo sapiens
gttataagactctc

SEQ ID NO: 1664306 - DNA, 19 bp, Homo sapiens
gttatactgtcggtttttt

SEQ ID NO: 1664307 - DNA, 18 bp, Homo sapiens
gttataggtcctttagaa

SEQ ID NO: 1664308 - DNA, 16 bp, Homo sapiens
gttatagtatatctgg

SEQ ID NO: 1664309 - DNA, 19 bp, Homo sapiens
gttatagtatatctggaca

SEQ ID NO: 1664310 - DNA, 22 bp, Homo sapiens
gttatagtgacagctttccatg

SEQ ID NO: 1664311 - DNA, 18 bp, Homo sapiens
gttatatatctcttttgg

SEQ ID NO: 1664312 - DNA, 14 bp, Homo sapiens
gttatatttttgtg

SEQ ID NO: 1664313 - DNA, 13 bp, Homo sapiens
gttatcagtgctt

SEQ ID NO: 1664314 - DNA, 13 bp, Homo sapiens
gttatcatgaatt

SEQ ID NO: 1664315 - DNA, 16 bp, Homo sapiens
gttatcatgaatttta

SEQ ID NO: 1664316 - DNA, 17 bp, Homo sapiens
gttatcatgaattttaa

SEQ ID NO: 1664317 - DNA, 20 bp, Homo sapiens
gttatcatgaattttaaagt

SEQ ID NO: 1664318 - DNA, 22 bp, Homo sapiens
gttatcatgaattttaaagtat

SEQ ID NO: 1664319 - DNA, 20 bp, Homo sapiens
gttatccacctgccttggct

SEQ ID NO: 1664320 - DNA, 13 bp, Homo sapiens
gttatcctgctag

SEQ ID NO: 1664321 - DNA, 12 bp, Homo sapiens
gttatctctgtg

SEQ ID NO: 1664322 - DNA, 14 bp, Homo sapiens
gttatctctgtgtt

SEQ ID NO: 1664323 - DNA, 21 bp, Homo sapiens
gttatcttctcaagttctaag

SEQ ID NO: 1664324 - DNA, 22 bp, Homo sapiens
gttatcttctcaagttctaaga

SEQ ID NO: 1664325 - DNA, 23 bp, Homo sapiens
gttatcttctcaagttctaagat

SEQ ID NO: 1664326 - DNA, 18 bp, Homo sapiens
gttatgaacagctgtgtc

SEQ ID NO: 1664327 - DNA, 21 bp, Homo sapiens
gttatgaacagctgtgtctgc

SEQ ID NO: 1664328 - DNA, 20 bp, Homo sapiens
gttatgatttttttttcata

SEQ ID NO: 1664329 - DNA, 17 bp, Homo sapiens
gttatgcactgcctgcc

SEQ ID NO: 1664330 - DNA, 15 bp, Homo sapiens
gttatgcactgtggt

SEQ ID NO: 1664331 - DNA, 17 bp, Homo sapiens
gttatggtgatgactta

SEQ ID NO: 1664332 - DNA, 14 bp, Homo sapiens
gttatgtatatggt

SEQ ID NO: 1664333 - DNA, 12 bp, Homo sapiens
gttatgtattta

SEQ ID NO: 1664334 - DNA, 13 bp, Homo sapiens
gttatgtccagaa

SEQ ID NO: 1664335 - DNA, 12 bp, Homo sapiens
gttattaaaatt

SEQ ID NO: 1664336 - DNA, 13 bp, Homo sapiens
gttattcaaattt

SEQ ID NO: 1664337 - DNA, 13 bp, Homo sapiens
gttattctcttca

SEQ ID NO: 1664338 - DNA, 12 bp, Homo sapiens
gttattctttgc

SEQ ID NO: 1664339 - DNA, 15 bp, Homo sapiens
gttattctttgcact

SEQ ID NO: 1664340 - DNA, 17 bp, Homo sapiens
gttattgcaataaagta

SEQ ID NO: 1664341 - DNA, 19 bp, Homo sapiens
gttattggactccaggcct

SEQ ID NO: 1664342 - DNA, 20 bp, Homo sapiens
gttattgggcaagtgattga

SEQ ID NO: 1664343 - DNA, 15 bp, Homo sapiens
gttatttaaatgagt

SEQ ID NO: 1664344 - DNA, 12 bp, Homo sapiens
gttatttagact

SEQ ID NO: 1664345 - DNA, 20 bp, Homo sapiens
gttatttatacaagattgaa

SEQ ID NO: 1664346 - DNA, 14 bp, Homo sapiens
gttatttcttccct

SEQ ID NO: 1664347 - DNA, 18 bp, Homo sapiens
gttatttggtattaaact

SEQ ID NO: 1664348 - DNA, 16 bp, Homo sapiens
gttatttgttcattat

SEQ ID NO: 1664349 - DNA, 14 bp, Homo sapiens
gttattttctacag

SEQ ID NO: 1664350 - DNA, 15 bp, Homo sapiens
gttattttctacagt

SEQ ID NO: 1664351 - DNA, 21 bp, Homo sapiens
gttattttctttatcattgct

SEQ ID NO: 1664352 - DNA, 23 bp, Homo sapiens
gttattttctttgaaattgttta

SEQ ID NO: 1664353 - DNA, 15 bp, Homo sapiens
gttattttgataaca

SEQ ID NO: 1664354 - DNA, 14 bp, Homo sapiens
gttattttgctttg

SEQ ID NO: 1664355 - DNA, 16 bp, Homo sapiens
gttattttgctttggt

SEQ ID NO: 1664356 - DNA, 13 bp, Homo sapiens
gttatttttacag

SEQ ID NO: 1664357 - DNA, 16 bp, Homo sapiens
gttatttttatatcag

SEQ ID NO: 1664358 - DNA, 23 bp, Homo sapiens
gttatttttatatcagcctgagt

SEQ ID NO: 1664359 - DNA, 23 bp, Homo sapiens
gttatttttctgccctgggttct

SEQ ID NO: 1664360 - DNA, 13 bp, Homo sapiens
gttcaaaatgtct

SEQ ID NO: 1664361 - DNA, 23 bp, Homo sapiens
gttcaaagccacattatttctag

SEQ ID NO: 1664362 - DNA, 15 bp, Homo sapiens
gttcaaagtgtatat

SEQ ID NO: 1664363 - DNA, 18 bp, Homo sapiens
gttcaaagtgtatattta

SEQ ID NO: 1664364 - DNA, 13 bp, Homo sapiens
gttcaacaaagaa

SEQ ID NO: 1664365 - DNA, 23 bp, Homo sapiens
gttcaacaaagaaacaaagatgt

SEQ ID NO: 1664366 - DNA, 16 bp, Homo sapiens
gttcaacccacagcta

SEQ ID NO: 1664367 - DNA, 14 bp, Homo sapiens
gttcaagcctgtgg

SEQ ID NO: 1664368 - DNA, 21 bp, Homo sapiens
gttcaatatcagctttgataa

SEQ ID NO: 1664369 - DNA, 12 bp, Homo sapiens
gttcaatatttt

SEQ ID NO: 1664370 - DNA, 18 bp, Homo sapiens
gttcaatctcccgctgct

SEQ ID NO: 1664371 - DNA, 18 bp, Homo sapiens
gttcaatgcaaagtaaaa

SEQ ID NO: 1664372 - DNA, 16 bp, Homo sapiens
gttcacaaactacctc

SEQ ID NO: 1664373 - DNA, 13 bp, Homo sapiens
gttcacaaactgt

SEQ ID NO: 1664374 - DNA, 14 bp, Homo sapiens
gttcacagaaaaag

SEQ ID NO: 1664375 - DNA, 16 bp, Homo sapiens
gttcacagtctctgga

SEQ ID NO: 1664376 - DNA, 16 bp, Homo sapiens
gttcacattagaatta

SEQ ID NO: 1664377 - DNA, 17 bp, Homo sapiens
gttcacattagaattag

SEQ ID NO: 1664378 - DNA, 22 bp, Homo sapiens
gttcacctccaagcatttcatg

SEQ ID NO: 1664379 - DNA, 21 bp, Homo sapiens
gttcacgtaagatacaagttt

SEQ ID NO: 1664380 - DNA, 24 bp, Homo sapiens
gttcactctacttagcatgtccct

SEQ ID NO: 1664381 - DNA, 20 bp, Homo sapiens
gttcactgaaggtgattcac

SEQ ID NO: 1664382 - DNA, 17 bp, Homo sapiens
gttcacttcaaagctaa

SEQ ID NO: 1664383 - DNA, 20 bp, Homo sapiens
gttcacttgccatgcaggaa

SEQ ID NO: 1664384 - DNA, 21 bp, Homo sapiens
gttcagaaatgctgcctgcct

SEQ ID NO: 1664385 - DNA, 16 bp, Homo sapiens
gttcagagactcaggg

SEQ ID NO: 1664386 - DNA, 19 bp, Homo sapiens
gttcagataattgaataag

SEQ ID NO: 1664387 - DNA, 24 bp, Homo sapiens
gttcagcaaactaaccagcattcc

SEQ ID NO: 1664388 - DNA, 17 bp, Homo sapiens
gttcagcaccaccctag

SEQ ID NO: 1664389 - DNA, 14 bp, Homo sapiens
gttcagcactgtcc

SEQ ID NO: 1664390 - DNA, 22 bp, Homo sapiens
gttcagcactgtcccttgcctc

SEQ ID NO: 1664391 - DNA, 18 bp, Homo sapiens
gttcagcagtacagccga

SEQ ID NO: 1664392 - DNA, 22 bp, Homo sapiens
gttcagctaagctaggaatgaa

SEQ ID NO: 1664393 - DNA, 20 bp, Homo sapiens
gttcaggagtcccaaggaaa

SEQ ID NO: 1664394 - DNA, 15 bp, Homo sapiens
gttcaggggactcag

SEQ ID NO: 1664395 - DNA, 20 bp, Homo sapiens
gttcaggggactcagccctg

SEQ ID NO: 1664396 - DNA, 15 bp, Homo sapiens
gttcagtagaattac

SEQ ID NO: 1664397 - DNA, 18 bp, Homo sapiens
gttcagtattatgtagtt

SEQ ID NO: 1664398 - DNA, 23 bp, Homo sapiens
gttcatacatatttttgtagcac

SEQ ID NO: 1664399 - DNA, 16 bp, Homo sapiens
gttcatacatttgagg

SEQ ID NO: 1664400 - DNA, 13 bp, Homo sapiens
gttcatagcccag

SEQ ID NO: 1664401 - DNA, 20 bp, Homo sapiens
gttcataggtcactggctct

SEQ ID NO: 1664402 - DNA, 18 bp, Homo sapiens
gttcatatctggagcctg

SEQ ID NO: 1664403 - DNA, 19 bp, Homo sapiens
gttcatatgtacttgtttg

SEQ ID NO: 1664404 - DNA, 20 bp, Homo sapiens
gttcatcaccatttcctcct

SEQ ID NO: 1664405 - DNA, 18 bp, Homo sapiens
gttcatccaatcctcact

SEQ ID NO: 1664406 - DNA, 22 bp, Homo sapiens
gttcatccaatcctcactgggt

SEQ ID NO: 1664407 - DNA, 21 bp, Homo sapiens
gttcatcctcattgcctcctg

SEQ ID NO: 1664408 - DNA, 17 bp, Homo sapiens
gttcatcgtataacaca

SEQ ID NO: 1664409 - DNA, 23 bp, Homo sapiens
gttcatctcatttgtattccatt

SEQ ID NO: 1664410 - DNA, 13 bp, Homo sapiens
gttgataagagga

SEQ ID NO: 1664411 - DNA, 15 bp, Homo sapiens
gttgatctggaaccc

SEQ ID NO: 1664412 - DNA, 17 bp, Homo sapiens
gttgatctggaacccag

SEQ ID NO: 1664413 - DNA, 13 bp, Homo sapiens
gttgattatcttc

SEQ ID NO: 1664414 - DNA, 13 bp, Homo sapiens
gttgcaaccactg

SEQ ID NO: 1664415 - DNA, 14 bp, Homo sapiens
gttgcaaccactgc

SEQ ID NO: 1664416 - DNA, 15 bp, Homo sapiens
gttgcaagatgtgaa

SEQ ID NO: 1664417 - DNA, 17 bp, Homo sapiens
gttgcaagtactgctgt

SEQ ID NO: 1664418 - DNA, 17 bp, Homo sapiens
gttgcacacagtacaca

SEQ ID NO: 1664419 - DNA, 16 bp, Homo sapiens
gttgcaccatctgctt

SEQ ID NO: 1664420 - DNA, 19 bp, Homo sapiens
gttgcaccatctgcttggt

SEQ ID NO: 1664421 - DNA, 19 bp, Homo sapiens
gttgcacttatgatttcat

SEQ ID NO: 1664422 - DNA, 23 bp, Homo sapiens
gttgcagataaactgatgtttga

SEQ ID NO: 1664423 - DNA, 11 bp, Homo sapiens
gttgcagctgc

SEQ ID NO: 1664424 - DNA, 12 bp, Homo sapiens
gttgcagctgct

SEQ ID NO: 1664425 - DNA, 15 bp, Homo sapiens
gttgcagtgagctga

SEQ ID NO: 1664426 - DNA, 23 bp, Homo sapiens
gttgcatagcagtatatgttaat

SEQ ID NO: 1664427 - DNA, 18 bp, Homo sapiens
gttgcattcctttgtctt

SEQ ID NO: 1664428 - DNA, 17 bp, Homo sapiens
gttgccaaacagccaca

SEQ ID NO: 1664429 - DNA, 18 bp, Homo sapiens
gttgccaaacagccacac

SEQ ID NO: 1664430 - DNA, 19 bp, Homo sapiens
gttgccaaagttttgctgt

SEQ ID NO: 1664431 - DNA, 19 bp, Homo sapiens
gttgccaaattgctgcata

SEQ ID NO: 1664432 - DNA, 15 bp, Homo sapiens
gttgccaagctccaa

SEQ ID NO: 1664433 - DNA, 14 bp, Homo sapiens
gttgccagtcagca

SEQ ID NO: 1664434 - DNA, 15 bp, Homo sapiens
gttgccagtcagcaa

SEQ ID NO: 1664435 - DNA, 22 bp, Homo sapiens
gttgccatggtaaccagccaca

SEQ ID NO: 1664436 - DNA, 18 bp, Homo sapiens
gttgccatttctctgctt

SEQ ID NO: 1664437 - DNA, 20 bp, Homo sapiens
gttgcgacggagagaaaaaa

SEQ ID NO: 1664438 - DNA, 20 bp, Homo sapiens
gttgcggatggatggaaggt

SEQ ID NO: 1664439 - DNA, 20 bp, Homo sapiens
gttgctcaaatctattcaga

SEQ ID NO: 1664440 - DNA, 20 bp, Homo sapiens
gttgctctaggaagacattt

SEQ ID NO: 1664441 - DNA, 22 bp, Homo sapiens
gttgctgatccctgctctctga

SEQ ID NO: 1664442 - DNA, 17 bp, Homo sapiens
gttgctgatggcccctc

SEQ ID NO: 1664443 - DNA, 14 bp, Homo sapiens
gttgctgattttat

SEQ ID NO: 1664444 - DNA, 18 bp, Homo sapiens
gttgctgattttattctt

SEQ ID NO: 1664445 - DNA, 14 bp, Homo sapiens
gttgctgtcactgt

SEQ ID NO: 1664446 - DNA, 19 bp, Homo sapiens
gttgctgtcataagaatga

SEQ ID NO: 1664447 - DNA, 13 bp, Homo sapiens
gttgctgtggctc

SEQ ID NO: 1664448 - DNA, 15 bp, Homo sapiens
gttgctgtttatttt

SEQ ID NO: 1664449 - DNA, 23 bp, Homo sapiens
gttgcttagatgagggtgactgt

SEQ ID NO: 1664450 - DNA, 23 bp, Homo sapiens
gttgcttaggatgtgtgcatgtg

SEQ ID NO: 1664451 - DNA, 11 bp, Homo sapiens
gttgcttcccg

SEQ ID NO: 1664452 - DNA, 21 bp, Homo sapiens
gttgcttgcctgatataaatg

SEQ ID NO: 1664453 - DNA, 13 bp, Homo sapiens
gttgcttgtcttc

SEQ ID NO: 1664454 - DNA, 17 bp, Homo sapiens
gttgctttgccagagca

SEQ ID NO: 1664455 - DNA, 17 bp, Homo sapiens
gttgcttttgaaaagtt

SEQ ID NO: 1664456 - DNA, 16 bp, Homo sapiens
gttggaactctgtgca

SEQ ID NO: 1664457 - DNA, 14 bp, Homo sapiens
gttggaaggatctg

SEQ ID NO: 1664458 - DNA, 14 bp, Homo sapiens
gttggacagccccc

SEQ ID NO: 1664459 - DNA, 15 bp, Homo sapiens
gttggacagctgctt

SEQ ID NO: 1664460 - DNA, 21 bp, Homo sapiens
gttggaccagaggaagcccct

SEQ ID NO: 1664461 - DNA, 17 bp, Homo sapiens
gttggacttttcgttaa

SEQ ID NO: 1664462 - DNA, 23 bp, Homo sapiens
gttggacttttcgttaacattga

SEQ ID NO: 1664463 - DNA, 20 bp, Homo sapiens
gttggagccactcctgtccc

SEQ ID NO: 1664464 - DNA, 16 bp, Homo sapiens
gttggagctcattctg

SEQ ID NO: 1664465 - DNA, 20 bp, Homo sapiens
gttggaggtggggaaggctt

SEQ ID NO: 1664466 - DNA, 15 bp, Homo sapiens
gttggagtgcagtgg

SEQ ID NO: 1664467 - DNA, 14 bp, Homo sapiens
gttggagtgcttgt

SEQ ID NO: 1664468 - DNA, 20 bp, Homo sapiens
gttggatttgctcattgctg

SEQ ID NO: 1664469 - DNA, 12 bp, Homo sapiens
gttggatttgtt

SEQ ID NO: 1664470 - DNA, 18 bp, Homo sapiens
gttggcagagaaggcctc

SEQ ID NO: 1664471 - DNA, 20 bp, Homo sapiens
gttggcagagaaggcctctt

SEQ ID NO: 1664472 - DNA, 12 bp, Homo sapiens
gttggcaggccc

SEQ ID NO: 1664473 - DNA, 15 bp, Homo sapiens
gttggcaggcccact

SEQ ID NO: 1664474 - DNA, 13 bp, Homo sapiens
gttggcaggctgg

SEQ ID NO: 1664475 - DNA, 15 bp, Homo sapiens
gttggcaggctggcc

SEQ ID NO: 1664476 - DNA, 20 bp, Homo sapiens
gttggcaggctggccagtcc

SEQ ID NO: 1664477 - DNA, 13 bp, Homo sapiens
gttggcctccggc

SEQ ID NO: 1664478 - DNA, 14 bp, Homo sapiens
gttggctcaggcag

SEQ ID NO: 1664479 - DNA, 14 bp, Homo sapiens
gttgggagaaagca

SEQ ID NO: 1664480 - DNA, 21 bp, Homo sapiens
gttgggagaatgtcagtatgt

SEQ ID NO: 1664481 - DNA, 16 bp, Homo sapiens
gttgggagcctagctc

SEQ ID NO: 1664482 - DNA, 18 bp, Homo sapiens
gttgggattcctgaccca

SEQ ID NO: 1664483 - DNA, 20 bp, Homo sapiens
gttgggattcctgacccagg

SEQ ID NO: 1664484 - DNA, 21 bp, Homo sapiens
gttgggattcctgacccaggc

SEQ ID NO: 1664485 - DNA, 21 bp, Homo sapiens
gttgggattgggggctggtgc

SEQ ID NO: 1664486 - DNA, 19 bp, Homo sapiens
gttgggcagccagaccagc

SEQ ID NO: 1664487 - DNA, 22 bp, Homo sapiens
gttgggcagggtgaccctgaag

SEQ ID NO: 1664488 - DNA, 19 bp, Homo sapiens
gttgggccgaaagagagag

SEQ ID NO: 1664489 - DNA, 21 bp, Homo sapiens
gttgggctatagcacacagtt

SEQ ID NO: 1664490 - DNA, 17 bp, Homo sapiens
gttggggtctgttcttg

SEQ ID NO: 1664491 - DNA, 16 bp, Homo sapiens
gttggggtgcttcctt

SEQ ID NO: 1664492 - DNA, 15 bp, Homo sapiens
gttgggtagggtgtt

SEQ ID NO: 1664493 - DNA, 23 bp, Homo sapiens
gttgggtagggtgttctggcttt

SEQ ID NO: 1664494 - DNA, 23 bp, Homo sapiens
gttggtcaaggccacctctgcct

SEQ ID NO: 1664495 - DNA, 14 bp, Homo sapiens
gttggtcctctctc

SEQ ID NO: 1664496 - DNA, 16 bp, Homo sapiens
gttggtcggtgggttg

SEQ ID NO: 1664497 - DNA, 14 bp, Homo sapiens
gttggtctgtgtaa

SEQ ID NO: 1664498 - DNA, 13 bp, Homo sapiens
gttggtgccactt

SEQ ID NO: 1664499 - DNA, 14 bp, Homo sapiens
gttggtggggggtc

SEQ ID NO: 1664500 - DNA, 20 bp, Homo sapiens
gttggtggggggtccagtct

SEQ ID NO: 1664501 - DNA, 19 bp, Homo sapiens
gttggtttagctttggaaa

SEQ ID NO: 1664502 - DNA, 14 bp, Homo sapiens
gttggtttgtatga

SEQ ID NO: 1664503 - DNA, 23 bp, Homo sapiens
gttgtaaacaacgtgtatagtgc

SEQ ID NO: 1664504 - DNA, 16 bp, Homo sapiens
gttgtaaaccaagtga

SEQ ID NO: 1664505 - DNA, 21 bp, Homo sapiens
gttgtaaagtatgtattattt

SEQ ID NO: 1664506 - DNA, 14 bp, Homo sapiens
gttgtaaatattta

SEQ ID NO: 1664507 - DNA, 18 bp, Homo sapiens
gttgtacgttttgcacat

SEQ ID NO: 1664508 - DNA, 16 bp, Homo sapiens
gttgtatgattccaat

SEQ ID NO: 1664509 - DNA, 14 bp, Homo sapiens
gttgtatgccttta

SEQ ID NO: 1664510 - DNA, 23 bp, Homo sapiens
gttgtatgcctttaaatctgtga

SEQ ID NO: 1664511 - DNA, 22 bp, Homo sapiens
gttgtatgtttgctgattattt

SEQ ID NO: 1664512 - DNA, 20 bp, Homo sapiens
gttgtcaaggaagaagaaat

SEQ ID NO: 1664513 - DNA, 15 bp, Homo sapiens
gttgtccaatttgta

SEQ ID NO: 1664514 - DNA, 20 bp, Homo sapiens
gttgtccaatttgtaagtaa

SEQ ID NO: 1664515 - DNA, 22 bp, Homo sapiens
gttgtccaatttgtaagtaaca

SEQ ID NO: 1664516 - DNA, 12 bp, Homo sapiens
gttgtccaggaa

SEQ ID NO: 1664517 - DNA, 19 bp, Homo sapiens
gttgtcctccccttgggcg

SEQ ID NO: 1664518 - DNA, 23 bp, Homo sapiens
gttgtctaaaaataaaatgcatt

SEQ ID NO: 1664519 - DNA, 12 bp, Homo sapiens
gttgtctccctc

SEQ ID NO: 1664520 - DNA, 18 bp, Homo sapiens
gttgtctccctctttctc

SEQ ID NO: 1664521 - DNA, 22 bp, Homo sapiens
gttgtctgaagtcactgcacag

SEQ ID NO: 1664522 - DNA, 16 bp, Homo sapiens
gttgtgaaatttaatg

SEQ ID NO: 1664523 - DNA, 13 bp, Homo sapiens
gttgtgcagggtg

SEQ ID NO: 1664524 - DNA, 19 bp, Homo sapiens
gttgtggaaagcctctgct

SEQ ID NO: 1664525 - DNA, 22 bp, Homo sapiens
gtttgggtatcctgcccagtgt

SEQ ID NO: 1664526 - DNA, 17 bp, Homo sapiens
gtttgggtgattcctaa

SEQ ID NO: 1664527 - DNA, 17 bp, Homo sapiens
gtttgggtttttttcct

SEQ ID NO: 1664528 - DNA, 16 bp, Homo sapiens
gtttggtagttagcca

SEQ ID NO: 1664529 - DNA, 14 bp, Homo sapiens
gtttggttgtaaat

SEQ ID NO: 1664530 - DNA, 21 bp, Homo sapiens
gtttggtttcccattggttca

SEQ ID NO: 1664531 - DNA, 22 bp, Homo sapiens
gtttggtttcccattggttcac

SEQ ID NO: 1664532 - DNA, 19 bp, Homo sapiens
gtttgtaaaattgttcctg

SEQ ID NO: 1664533 - DNA, 18 bp, Homo sapiens
gtttgtaaataagagatt

SEQ ID NO: 1664534 - DNA, 15 bp, Homo sapiens
gtttgtaatatacag

SEQ ID NO: 1664535 - DNA, 13 bp, Homo sapiens
gtttgtagccagg

SEQ ID NO: 1664536 - DNA, 13 bp, Homo sapiens
gtttgtatattgt

SEQ ID NO: 1664537 - DNA, 14 bp, Homo sapiens
gtttgtatgagatg

SEQ ID NO: 1664538 - DNA, 15 bp, Homo sapiens
gtttgtatgtctgtg

SEQ ID NO: 1664539 - DNA, 16 bp, Homo sapiens
gtttgtattcatgttc

SEQ ID NO: 1664540 - DNA, 16 bp, Homo sapiens
gtttgtattttttatt

SEQ ID NO: 1664541 - DNA, 19 bp, Homo sapiens
gtttgtcagcatctgacca

SEQ ID NO: 1664542 - DNA, 18 bp, Homo sapiens
gtttgtcgctcatgtgtg

SEQ ID NO: 1664543 - DNA, 19 bp, Homo sapiens
gtttgtctattttaaaata

SEQ ID NO: 1664544 - DNA, 18 bp, Homo sapiens
gtttgtctgtttgtttca

SEQ ID NO: 1664545 - DNA, 23 bp, Homo sapiens
gtttgtgcatatctgcctcccct

SEQ ID NO: 1664546 - DNA, 14 bp, Homo sapiens
gtttgtggcctcag

SEQ ID NO: 1664547 - DNA, 13 bp, Homo sapiens
gtttgtgtgattt

SEQ ID NO: 1664548 - DNA, 18 bp, Homo sapiens
gtttgtgtgatttcctaa

SEQ ID NO: 1664549 - DNA, 16 bp, Homo sapiens
gtttgtgtgtatttgt

SEQ ID NO: 1664550 - DNA, 22 bp, Homo sapiens
gtttgtgtgtatttgtattaat

SEQ ID NO: 1664551 - DNA, 15 bp, Homo sapiens
gtttgtgtgttgtct

SEQ ID NO: 1664552 - DNA, 20 bp, Homo sapiens
gtttgtgtgttgtctcttga

SEQ ID NO: 1664553 - DNA, 20 bp, Homo sapiens
gtttgtgttctgtttgttaa

SEQ ID NO: 1664554 - DNA, 22 bp, Homo sapiens
gtttgtgttctgtttgttaaaa

SEQ ID NO: 1664555 - DNA, 14 bp, Homo sapiens
gtttgttaaaactg

SEQ ID NO: 1664556 - DNA, 17 bp, Homo sapiens
gtttgttaaaactggca

SEQ ID NO: 1664557 - DNA, 16 bp, Homo sapiens
gtttgttatagattta

SEQ ID NO: 1664558 - DNA, 20 bp, Homo sapiens
gtttgttcataataaaagtg

SEQ ID NO: 1664559 - DNA, 13 bp, Homo sapiens
gtttgttggaaag

SEQ ID NO: 1664560 - DNA, 16 bp, Homo sapiens
gtttgtttacataaga

SEQ ID NO: 1664561 - DNA, 21 bp, Homo sapiens
gtttgtttacataagagaaag

SEQ ID NO: 1664562 - DNA, 18 bp, Homo sapiens
gtttgtttctccccctgg

SEQ ID NO: 1664563 - DNA, 20 bp, Homo sapiens
gtttgttttagaaccagccg

SEQ ID NO: 1664564 - DNA, 15 bp, Homo sapiens
gtttgttttgtgaat

SEQ ID NO: 1664565 - DNA, 16 bp, Homo sapiens
gtttgtttttcaaagc

SEQ ID NO: 1664566 - DNA, 12 bp, Homo sapiens
gtttgttttttt

SEQ ID NO: 1664567 - DNA, 16 bp, Homo sapiens
gttttaaaaagccagt

SEQ ID NO: 1664568 - DNA, 21 bp, Homo sapiens
gttttaaaactggacctgtat

SEQ ID NO: 1664569 - DNA, 15 bp, Homo sapiens
gttttaaagtgatta

SEQ ID NO: 1664570 - DNA, 20 bp, Homo sapiens
gttttaaagttcattgcaat

SEQ ID NO: 1664571 - DNA, 19 bp, Homo sapiens
gttttaaatttatttcaaa

SEQ ID NO: 1664572 - DNA, 15 bp, Homo sapiens
gttttaactgtggat

SEQ ID NO: 1664573 - DNA, 16 bp, Homo sapiens
gttttaactgtggata

SEQ ID NO: 1664574 - DNA, 22 bp, Homo sapiens
gttttaactgtggatattgtta

SEQ ID NO: 1664575 - DNA, 18 bp, Homo sapiens
gttttaagttgtttgcat

SEQ ID NO: 1664576 - DNA, 14 bp, Homo sapiens
gttttaataaaaga

SEQ ID NO: 1664577 - DNA, 19 bp, Homo sapiens
gttttaataagaacagatc

SEQ ID NO: 1664578 - DNA, 12 bp, Homo sapiens
gttttaattgta

SEQ ID NO: 1664579 - DNA, 19 bp, Homo sapiens
gttttacattccatttcat

SEQ ID NO: 1664580 - DNA, 13 bp, Homo sapiens
gttttactgtcta

SEQ ID NO: 1664581 - DNA, 20 bp, Homo sapiens
gttttactgttttaattgta

SEQ ID NO: 1664582 - DNA, 13 bp, Homo sapiens
gttttagaaaaca

SEQ ID NO: 1664583 - DNA, 18 bp, Homo sapiens
gttttagaggcattgtta

SEQ ID NO: 1664584 - DNA, 19 bp, Homo sapiens
gttttagagttaacaatga

SEQ ID NO: 1664585 - DNA, 21 bp, Homo sapiens
gttttagattttctggttcta

SEQ ID NO: 1664586 - DNA, 22 bp, Homo sapiens
gttttagggagtggttcctgtg

SEQ ID NO: 1664587 - DNA, 23 bp, Homo sapiens
gttttagggagtggttcctgtgg

SEQ ID NO: 1664588 - DNA, 17 bp, Homo sapiens
gttttaggttctaaagt

SEQ ID NO: 1664589 - DNA, 17 bp, Homo sapiens
gttttagtgtaaaattg

SEQ ID NO: 1664590 - DNA, 23 bp, Homo sapiens
gttttataaaccacttgagccta

SEQ ID NO: 1664591 - DNA, 16 bp, Homo sapiens
gttttataatgaaccc

SEQ ID NO: 1664592 - DNA, 23 bp, Homo sapiens
gttttatactgtacttaataaat

SEQ ID NO: 1664593 - DNA, 21 bp, Homo sapiens
gttttatagaaaacctgactt

SEQ ID NO: 1664594 - DNA, 13 bp, Homo sapiens
gttttatatacct

SEQ ID NO: 1664595 - DNA, 19 bp, Homo sapiens
gttttatatttttatagac

SEQ ID NO: 1664596 - DNA, 17 bp, Homo sapiens
gttttatgtcatactct

SEQ ID NO: 1664597 - DNA, 23 bp, Homo sapiens
gttttattattatcgctttatgt

SEQ ID NO: 1664598 - DNA, 15 bp, Homo sapiens
gttttattctgactt

SEQ ID NO: 1664599 - DNA, 17 bp, Homo sapiens
gttttattcttggtttt

SEQ ID NO: 1664600 - DNA, 13 bp, Homo sapiens
gttttatttgtat

SEQ ID NO: 1664601 - DNA, 13 bp, Homo sapiens
gttttattttaat

SEQ ID NO: 1664602 - DNA, 16 bp, Homo sapiens
gttttcaaaacacata

SEQ ID NO: 1664603 - DNA, 19 bp, Homo sapiens
gttttcaacctctagaatt

SEQ ID NO: 1664604 - DNA, 14 bp, Homo sapiens
gttttcacactgct

SEQ ID NO: 1664605 - DNA, 14 bp, Homo sapiens
gttttcacttgtat

SEQ ID NO: 1664606 - DNA, 22 bp, Homo sapiens
gttttcacttgtattgacttta

SEQ ID NO: 1664607 - DNA, 16 bp, Homo sapiens
gttttcagtgtacatg

SEQ ID NO: 1664608 - DNA, 16 bp, Homo sapiens
gttttcattatctcaa

SEQ ID NO: 1664609 - DNA, 15 bp, Homo sapiens
gttttccctgaagtt

SEQ ID NO: 1664610 - DNA, 14 bp, Homo sapiens
gttttcctgctggt

SEQ ID NO: 1664611 - DNA, 16 bp, Homo sapiens
gttttctcctcccagg

SEQ ID NO: 1664612 - DNA, 21 bp, Homo sapiens
gttttctcctcccaggaactg

SEQ ID NO: 1664613 - DNA, 22 bp, Homo sapiens
gttttctctgcataagtaatta

SEQ ID NO: 1664614 - DNA, 16 bp, Homo sapiens
gttttctgagaaagac

SEQ ID NO: 1664615 - DNA, 17 bp, Homo sapiens
gttttctgagaaagact

SEQ ID NO: 1664616 - DNA, 19 bp, Homo sapiens
gttttctgagcccgggctg

SEQ ID NO: 1664617 - DNA, 20 bp, Homo sapiens
gttttcttcccatcactgga

SEQ ID NO: 1664618 - DNA, 11 bp, Homo sapiens
gttttcttctt

SEQ ID NO: 1664619 - DNA, 14 bp, Homo sapiens
gttttcttctttcc

SEQ ID NO: 1664620 - DNA, 12 bp, Homo sapiens
gttttcttgtaa

SEQ ID NO: 1664621 - DNA, 17 bp, Homo sapiens
gttttcttgtaaatgtt

SEQ ID NO: 1664622 - DNA, 22 bp, Homo sapiens
gttttgatgtttgtggcctcag

SEQ ID NO: 1664623 - DNA, 23 bp, Homo sapiens
gttttgattaatgtttcttaaat

SEQ ID NO: 1664624 - DNA, 19 bp, Homo sapiens
gttttgatttgtactgaaa

SEQ ID NO: 1664625 - DNA, 14 bp, Homo sapiens
gttttgcaataact

SEQ ID NO: 1664626 - DNA, 22 bp, Homo sapiens
gttttgcacagccaaatttaaa

SEQ ID NO: 1664627 - DNA, 14 bp, Homo sapiens
gttttgcacatttt

SEQ ID NO: 1664628 - DNA, 14 bp, Homo sapiens
gttttgcttttgtt

SEQ ID NO: 1664629 - DNA, 16 bp, Homo sapiens
gttttggactccatct

SEQ ID NO: 1664630 - DNA, 21 bp, Homo sapiens
gttttggaggttctgaaatac

SEQ ID NO: 1664631 - DNA, 23 bp, Homo sapiens
gttttggctgaaattctcctgga

SEQ ID NO: 1664632 - DNA, 19 bp, Homo sapiens
gttttgggtgtttttcatg

SEQ ID NO: 1664633 - DNA, 14 bp, Homo sapiens
gttttggttttttt

SEQ ID NO: 1664634 - DNA, 15 bp, Homo sapiens
gttttgtaaaagaaa

SEQ ID NO: 1664635 - DNA, 17 bp, Homo sapiens
gttttgtaagatgctgg

SEQ ID NO: 1664636 - DNA, 17 bp, Homo sapiens
gttttgtaggagacttg

SEQ ID NO: 1664637 - DNA, 22 bp, Homo sapiens
gttttgtataaataataaagaa

SEQ ID NO: 1664638 - DNA, 24 bp, Homo sapiens
gttttgtcaaactgtagaaatgat

SEQ ID NO: 1664639 - DNA, 15 bp, Homo sapiens
gttttgtcagacttc

SEQ ID NO: 1664640 - DNA, 14 bp, Homo sapiens
taaactcatttata

SEQ ID NO: 1664641 - DNA, 17 bp, Homo sapiens
taaactctgaatttatc

SEQ ID NO: 1664642 - DNA, 22 bp, Homo sapiens
taaactctggacactctatatg

SEQ ID NO: 1664643 - DNA, 15 bp, Homo sapiens
taaactctgttgcaa

SEQ ID NO: 1664644 - DNA, 15 bp, Homo sapiens
taaactgatgtttga

SEQ ID NO: 1664645 - DNA, 22 bp, Homo sapiens
taaactggcatctgctctagat

SEQ ID NO: 1664646 - DNA, 20 bp, Homo sapiens
taaactggtattttatcttt

SEQ ID NO: 1664647 - DNA, 16 bp, Homo sapiens
taaactgtattaaatc

SEQ ID NO: 1664648 - DNA, 18 bp, Homo sapiens
taaactgtattaaatctt

SEQ ID NO: 1664649 - DNA, 17 bp, Homo sapiens
taaactgtgtattccaa

SEQ ID NO: 1664650 - DNA, 13 bp, Homo sapiens
taaactgtgttta

SEQ ID NO: 1664651 - DNA, 13 bp, Homo sapiens
taaactgttgctc

SEQ ID NO: 1664652 - DNA, 18 bp, Homo sapiens
taaactgttttcatgtgt

SEQ ID NO: 1664653 - DNA, 15 bp, Homo sapiens
taaacttagaggaaa

SEQ ID NO: 1664654 - DNA, 21 bp, Homo sapiens
taaacttagaggaaaatgagt

SEQ ID NO: 1664655 - DNA, 22 bp, Homo sapiens
taaacttgtttgctgtgaacaa

SEQ ID NO: 1664656 - DNA, 14 bp, Homo sapiens
taaactttagactt

SEQ ID NO: 1664657 - DNA, 18 bp, Homo sapiens
taaactttagacttccca

SEQ ID NO: 1664658 - DNA, 12 bp, Homo sapiens
taaactttttgt

SEQ ID NO: 1664659 - DNA, 18 bp, Homo sapiens
taaacttttttttgagaa

SEQ ID NO: 1664660 - DNA, 20 bp, Homo sapiens
taaagaaaaatatcttggcc

SEQ ID NO: 1664661 - DNA, 14 bp, Homo sapiens
taaagaaaaatatt

SEQ ID NO: 1664662 - DNA, 21 bp, Homo sapiens
taaagaaaaatatttaatgtt

SEQ ID NO: 1664663 - DNA, 13 bp, Homo sapiens
taaagaaacagct

SEQ ID NO: 1664664 - DNA, 23 bp, Homo sapiens
taaagaaacagctttcaagtgcc

SEQ ID NO: 1664665 - DNA, 15 bp, Homo sapiens
taaagaaagcagaat

SEQ ID NO: 1664666 - DNA, 16 bp, Homo sapiens
taaagaaaggaaaaga

SEQ ID NO: 1664667 - DNA, 17 bp, Homo sapiens
taaagaaaggaaaagaa

SEQ ID NO: 1664668 - DNA, 13 bp, Homo sapiens
taaagaaagtgta

SEQ ID NO: 1664669 - DNA, 15 bp, Homo sapiens
taaagaaagtgtatt

SEQ ID NO: 1664670 - DNA, 17 bp, Homo sapiens
taaagaaagtgtatttg

SEQ ID NO: 1664671 - DNA, 24 bp, Homo sapiens
taaagaaagtgtatttggaaataa

SEQ ID NO: 1664672 - DNA, 21 bp, Homo sapiens
taaagaactccttattttgta

SEQ ID NO: 1664673 - DNA, 14 bp, Homo sapiens
taaagaagaaaata

SEQ ID NO: 1664674 - DNA, 15 bp, Homo sapiens
taaagaataatatgc

SEQ ID NO: 1664675 - DNA, 20 bp, Homo sapiens
taaagaatccttatctataa

SEQ ID NO: 1664676 - DNA, 15 bp, Homo sapiens
taaagaattttcatc

SEQ ID NO: 1664677 - DNA, 16 bp, Homo sapiens
taaagaattttcatcc

SEQ ID NO: 1664678 - DNA, 18 bp, Homo sapiens
taaagacaatcactgcca

SEQ ID NO: 1664679 - DNA, 10 bp, Homo sapiens
taaagacagg

SEQ ID NO: 1664680 - DNA, 21 bp, Homo sapiens
taaagacccagggggagaatg

SEQ ID NO: 1664681 - DNA, 23 bp, Homo sapiens
taaagagcatggaaaaatactgc

SEQ ID NO: 1664682 - DNA, 17 bp, Homo sapiens
taaagagcccttgcctc

SEQ ID NO: 1664683 - DNA, 21 bp, Homo sapiens
taaagagcccttgcctcccca

SEQ ID NO: 1664684 - DNA, 21 bp, Homo sapiens
taaagaggcatcttttctaga

SEQ ID NO: 1664685 - DNA, 16 bp, Homo sapiens
taaagagtgaatgcca

SEQ ID NO: 1664686 - DNA, 17 bp, Homo sapiens
taaagataaagccagaa

SEQ ID NO: 1664687 - DNA, 17 bp, Homo sapiens
taaagatatcagagctc

SEQ ID NO: 1664688 - DNA, 14 bp, Homo sapiens
taaagatatttcca

SEQ ID NO: 1664689 - DNA, 18 bp, Homo sapiens
taaagatatttttatctt

SEQ ID NO: 1664690 - DNA, 14 bp, Homo sapiens
taaagatgctgtcg

SEQ ID NO: 1664691 - DNA, 16 bp, Homo sapiens
taaagatggtttatgc

SEQ ID NO: 1664692 - DNA, 21 bp, Homo sapiens
taaagatggtttatgcatgta

SEQ ID NO: 1664693 - DNA, 12 bp, Homo sapiens
taaagatgtgaa

SEQ ID NO: 1664694 - DNA, 17 bp, Homo sapiens
taaagatgtgaaaactc

SEQ ID NO: 1664695 - DNA, 15 bp, Homo sapiens
taaagattgtactta

SEQ ID NO: 1664696 - DNA, 12 bp, Homo sapiens
taaagatttctg

SEQ ID NO: 1664697 - DNA, 14 bp, Homo sapiens
taaagatttctgtt

SEQ ID NO: 1664698 - DNA, 14 bp, Homo sapiens
taaagattttgatc

SEQ ID NO: 1664699 - DNA, 19 bp, Homo sapiens
taaagattttgatctcaca

SEQ ID NO: 1664700 - DNA, 21 bp, Homo sapiens
taaagattttgatctcacatt

SEQ ID NO: 1664701 - DNA, 14 bp, Homo sapiens
taaagcactgagca

SEQ ID NO: 1664702 - DNA, 15 bp, Homo sapiens
taaagcactttgcac

SEQ ID NO: 1664703 - DNA, 13 bp, Homo sapiens
taaagcagccagc

SEQ ID NO: 1664704 - DNA, 13 bp, Homo sapiens
taaagcagtggac

SEQ ID NO: 1664705 - DNA, 19 bp, Homo sapiens
taaagcagtggacaccagg

SEQ ID NO: 1664706 - DNA, 14 bp, Homo sapiens
taaagcatcagaga

SEQ ID NO: 1664707 - DNA, 21 bp, Homo sapiens
taaagcatcagagatggtaat

SEQ ID NO: 1664708 - DNA, 18 bp, Homo sapiens
taaagcatgaaatgtgaa

SEQ ID NO: 1664709 - DNA, 22 bp, Homo sapiens
taaagcatgaatggtatggaac

SEQ ID NO: 1664710 - DNA, 21 bp, Homo sapiens
taaagcattactctttttcaa

SEQ ID NO: 1664711 - DNA, 15 bp, Homo sapiens
taaagcattctttaa

SEQ ID NO: 1664712 - DNA, 14 bp, Homo sapiens
taaagcatttccta

SEQ ID NO: 1664713 - DNA, 16 bp, Homo sapiens
taaagccaaccagcct

SEQ ID NO: 1664714 - DNA, 18 bp, Homo sapiens
taaagccaagaagaattt

SEQ ID NO: 1664715 - DNA, 11 bp, Homo sapiens
taaagccaagg

SEQ ID NO: 1664716 - DNA, 21 bp, Homo sapiens
taaagcctaccctattctatc

SEQ ID NO: 1664717 - DNA, 20 bp, Homo sapiens
taaagcctgtattctcaaac

SEQ ID NO: 1664718 - DNA, 14 bp, Homo sapiens
taaagctaaatttt

SEQ ID NO: 1664719 - DNA, 18 bp, Homo sapiens
taaagctcaaatgaaatg

SEQ ID NO: 1664720 - DNA, 19 bp, Homo sapiens
taaagctcaaatgaaatgt

SEQ ID NO: 1664721 - DNA, 23 bp, Homo sapiens
taaagctggaacatttgatattt

SEQ ID NO: 1664722 - DNA, 19 bp, Homo sapiens
taaagctgttattcttgtt

SEQ ID NO: 1664723 - DNA, 23 bp, Homo sapiens
taaagcttgtggccccttttact

SEQ ID NO: 1664724 - DNA, 21 bp, Homo sapiens
taaaggaggaatagtgcttgc

SEQ ID NO: 1664725 - DNA, 12 bp, Homo sapiens
taaaggcagctg

SEQ ID NO: 1664726 - DNA, 15 bp, Homo sapiens
taaaggcagctgcct

SEQ ID NO: 1664727 - DNA, 17 bp, Homo sapiens
taaaggcagctgcctct

SEQ ID NO: 1664728 - DNA, 21 bp, Homo sapiens
taaaggcagctgcctctgctc

SEQ ID NO: 1664729 - DNA, 17 bp, Homo sapiens
taaaggcagttttctaa

SEQ ID NO: 1664730 - DNA, 17 bp, Homo sapiens
taaaggcatccttgtct

SEQ ID NO: 1664731 - DNA, 20 bp, Homo sapiens
taaaggcattgtccaaagtt

SEQ ID NO: 1664732 - DNA, 11 bp, Homo sapiens
taaaggcctgg

SEQ ID NO: 1664733 - DNA, 13 bp, Homo sapiens
taaagggaagaaa

SEQ ID NO: 1664734 - DNA, 14 bp, Homo sapiens
taaagggagaagga

SEQ ID NO: 1664735 - DNA, 22 bp, Homo sapiens
taaagggatatttttttctatt

SEQ ID NO: 1664736 - DNA, 21 bp, Homo sapiens
taaagggcagggcccacgtgt

SEQ ID NO: 1664737 - DNA, 18 bp, Homo sapiens
taaagggcccaatgaatt

SEQ ID NO: 1664738 - DNA, 14 bp, Homo sapiens
taaaggggggaggg

SEQ ID NO: 1664739 - DNA, 18 bp, Homo sapiens
taaagggtgtacttatat

SEQ ID NO: 1664740 - DNA, 23 bp, Homo sapiens
taaaggtacgattatacttgaga

SEQ ID NO: 1664741 - DNA, 21 bp, Homo sapiens
taaaggtattccttgttcttc

SEQ ID NO: 1664742 - DNA, 21 bp, Homo sapiens
taaaggtccacaggtctagac

SEQ ID NO: 1664743 - DNA, 22 bp, Homo sapiens
taaaggtccacaggtctagact

SEQ ID NO: 1664744 - DNA, 13 bp, Homo sapiens
taaaggtggattt

SEQ ID NO: 1664745 - DNA, 14 bp, Homo sapiens
taaaggtgtattta

SEQ ID NO: 1664746 - DNA, 20 bp, Homo sapiens
taaaggttgacaataaatgt

SEQ ID NO: 1664747 - DNA, 13 bp, Homo sapiens
taaagtaattggt

SEQ ID NO: 1664748 - DNA, 12 bp, Homo sapiens
taaagtacaaat

SEQ ID NO: 1664749 - DNA, 15 bp, Homo sapiens
taaagtacaaatgaa

SEQ ID NO: 1664750 - DNA, 17 bp, Homo sapiens
taaagtagtcctgtgaa

SEQ ID NO: 1664751 - DNA, 13 bp, Homo sapiens
taaagtataatgt

SEQ ID NO: 1664752 - DNA, 14 bp, Homo sapiens
taaagtatatattt

SEQ ID NO: 1664753 - DNA, 17 bp, Homo sapiens
taaagtatatatttatt

SEQ ID NO: 1664754 - DNA, 18 bp, Homo sapiens
taaagtatatgtgcagtc

SEQ ID NO: 1664755 - DNA, 14 bp, Homo sapiens
taactaaattttaa

SEQ ID NO: 1664756 - DNA, 19 bp, Homo sapiens
taactaaattttaaagcca

SEQ ID NO: 1664757 - DNA, 16 bp, Homo sapiens
taactaacatgtcctg

SEQ ID NO: 1664758 - DNA, 17 bp, Homo sapiens
taactaatgctaagaaa

SEQ ID NO: 1664759 - DNA, 14 bp, Homo sapiens
taactaatttgtgg

SEQ ID NO: 1664760 - DNA, 20 bp, Homo sapiens
taactaattttgttgaaaat

SEQ ID NO: 1664761 - DNA, 16 bp, Homo sapiens
taactactttataact

SEQ ID NO: 1664762 - DNA, 23 bp, Homo sapiens
taactactttataactaacatgt

SEQ ID NO: 1664763 - DNA, 17 bp, Homo sapiens
taactactttttatact

SEQ ID NO: 1664764 - DNA, 15 bp, Homo sapiens
taactagaattagta

SEQ ID NO: 1664765 - DNA, 16 bp, Homo sapiens
taactagaattagtat

SEQ ID NO: 1664766 - DNA, 17 bp, Homo sapiens
taactagaattagtatg

SEQ ID NO: 1664767 - DNA, 18 bp, Homo sapiens
taactagaattagtatgt

SEQ ID NO: 1664768 - DNA, 15 bp, Homo sapiens
taactagaatttatt

SEQ ID NO: 1664769 - DNA, 17 bp, Homo sapiens
taactagaatttattca

SEQ ID NO: 1664770 - DNA, 20 bp, Homo sapiens
taactagacaccaaagttct

SEQ ID NO: 1664771 - DNA, 18 bp, Homo sapiens
taactataacaatcactg

SEQ ID NO: 1664772 - DNA, 21 bp, Homo sapiens
taactataacaatcactggct

SEQ ID NO: 1664773 - DNA, 22 bp, Homo sapiens
taactatcgaaatgacggtgtt

SEQ ID NO: 1664774 - DNA, 13 bp, Homo sapiens
taactatgcttta

SEQ ID NO: 1664775 - DNA, 18 bp, Homo sapiens
taactatgtggctgaaaa

SEQ ID NO: 1664776 - DNA, 17 bp, Homo sapiens
taactattgggtgaata

SEQ ID NO: 1664777 - DNA, 14 bp, Homo sapiens
taactatttttcct

SEQ ID NO: 1664778 - DNA, 14 bp, Homo sapiens
taactatttttgta

SEQ ID NO: 1664779 - DNA, 14 bp, Homo sapiens
taactcaaaagttg

SEQ ID NO: 1664780 - DNA, 21 bp, Homo sapiens
taactcaaaagttgagatttt

SEQ ID NO: 1664781 - DNA, 21 bp, Homo sapiens
taactcaaatacacatttgct

SEQ ID NO: 1664782 - DNA, 23 bp, Homo sapiens
taactcaaggataccttcttatt

SEQ ID NO: 1664783 - DNA, 14 bp, Homo sapiens
taactcagaattat

SEQ ID NO: 1664784 - DNA, 15 bp, Homo sapiens
taactccccacccca

SEQ ID NO: 1664785 - DNA, 16 bp, Homo sapiens
taactccctccaccag

SEQ ID NO: 1664786 - DNA, 23 bp, Homo sapiens
taactccgagagcagtgggcagg

SEQ ID NO: 1664787 - DNA, 19 bp, Homo sapiens
taactcctgccattcttct

SEQ ID NO: 1664788 - DNA, 17 bp, Homo sapiens
taactcctgtccctttt

SEQ ID NO: 1664789 - DNA, 19 bp, Homo sapiens
taactcctgtcccttttcc

SEQ ID NO: 1664790 - DNA, 16 bp, Homo sapiens
taactctaaaagatcc

SEQ ID NO: 1664791 - DNA, 18 bp, Homo sapiens
taactctaaaagatcctt

SEQ ID NO: 1664792 - DNA, 24 bp, Homo sapiens
taactcttagaagtgttgtaaaag

SEQ ID NO: 1664793 - DNA, 16 bp, Homo sapiens
taactcttttctattt

SEQ ID NO: 1664794 - DNA, 14 bp, Homo sapiens
taactgaaaatgtg

SEQ ID NO: 1664795 - DNA, 20 bp, Homo sapiens
taactgaaaatgtgctatac

SEQ ID NO: 1664796 - DNA, 13 bp, Homo sapiens
taactgaatttgg

SEQ ID NO: 1664797 - DNA, 13 bp, Homo sapiens
taactgacaactt

SEQ ID NO: 1664798 - DNA, 20 bp, Homo sapiens
taactgacaagccatcttga

SEQ ID NO: 1664799 - DNA, 14 bp, Homo sapiens
taactgagagaaag

SEQ ID NO: 1664800 - DNA, 23 bp, Homo sapiens
taactgattagtaagtcttgcct

SEQ ID NO: 1664801 - DNA, 19 bp, Homo sapiens
taactgcaaagtgaagttg

SEQ ID NO: 1664802 - DNA, 13 bp, Homo sapiens
taactgcagacca

SEQ ID NO: 1664803 - DNA, 14 bp, Homo sapiens
taactgcattttac

SEQ ID NO: 1664804 - DNA, 15 bp, Homo sapiens
taactgccaatcctt

SEQ ID NO: 1664805 - DNA, 23 bp, Homo sapiens
taactgccatcaagatgagagaa

SEQ ID NO: 1664806 - DNA, 17 bp, Homo sapiens
taactgccgtaatttaa

SEQ ID NO: 1664807 - DNA, 14 bp, Homo sapiens
taactgctgagcca

SEQ ID NO: 1664808 - DNA, 17 bp, Homo sapiens
taactgctgagccactc

SEQ ID NO: 1664809 - DNA, 15 bp, Homo sapiens
taactggaaaacaga

SEQ ID NO: 1664810 - DNA, 20 bp, Homo sapiens
taactggaaaacagaacact

SEQ ID NO: 1664811 - DNA, 22 bp, Homo sapiens
taactggaaggccttccactgt

SEQ ID NO: 1664812 - DNA, 15 bp, Homo sapiens
taactggacatgaag

SEQ ID NO: 1664813 - DNA, 22 bp, Homo sapiens
taactgggttacagtgttttat

SEQ ID NO: 1664814 - DNA, 15 bp, Homo sapiens
taactggtgaagaga

SEQ ID NO: 1664815 - DNA, 12 bp, Homo sapiens
taactggttaaa

SEQ ID NO: 1664816 - DNA, 14 bp, Homo sapiens
taactgtcttctgg

SEQ ID NO: 1664817 - DNA, 14 bp, Homo sapiens
taactgtcttgttt

SEQ ID NO: 1664818 - DNA, 16 bp, Homo sapiens
taactgtcttgtttca

SEQ ID NO: 1664819 - DNA, 16 bp, Homo sapiens
taactgtgaaatacca

SEQ ID NO: 1664820 - DNA, 18 bp, Homo sapiens
taactgtgaagtttacat

SEQ ID NO: 1664821 - DNA, 15 bp, Homo sapiens
taactgtgattcttt

SEQ ID NO: 1664822 - DNA, 13 bp, Homo sapiens
taactgtgtatgt

SEQ ID NO: 1664823 - DNA, 14 bp, Homo sapiens
taactgtgtatgta

SEQ ID NO: 1664824 - DNA, 22 bp, Homo sapiens
taactgtgtatgtacatatata

SEQ ID NO: 1664825 - DNA, 17 bp, Homo sapiens
taacttaaaaatgtaaa

SEQ ID NO: 1664826 - DNA, 20 bp, Homo sapiens
taacttaaaaatgtaaatat

SEQ ID NO: 1664827 - DNA, 21 bp, Homo sapiens
taacttaaaaatgtaaatatt

SEQ ID NO: 1664828 - DNA, 15 bp, Homo sapiens
taacttactgtatat

SEQ ID NO: 1664829 - DNA, 18 bp, Homo sapiens
taacttagagactttaga

SEQ ID NO: 1664830 - DNA, 15 bp, Homo sapiens
taacttagcatgtgt

SEQ ID NO: 1664831 - DNA, 16 bp, Homo sapiens
taacttatattgaaga

SEQ ID NO: 1664832 - DNA, 15 bp, Homo sapiens
taacttatttagaga

SEQ ID NO: 1664833 - DNA, 23 bp, Homo sapiens
taacttcacccgagttcctctgg

SEQ ID NO: 1664834 - DNA, 10 bp, Homo sapiens
taacttcctg

SEQ ID NO: 1664835 - DNA, 13 bp, Homo sapiens
taacttcctgctg

SEQ ID NO: 1664836 - DNA, 21 bp, Homo sapiens
taacttcctgctgcaccctgc

SEQ ID NO: 1664837 - DNA, 14 bp, Homo sapiens
taacttcctgtact

SEQ ID NO: 1664838 - DNA, 21 bp, Homo sapiens
taacttccttggactcatttt

SEQ ID NO: 1664839 - DNA, 13 bp, Homo sapiens
taacttctgtgtt

SEQ ID NO: 1664840 - DNA, 17 bp, Homo sapiens
taacttcttaaaccatt

SEQ ID NO: 1664841 - DNA, 23 bp, Homo sapiens
taacttcttaaaccatttttgct

SEQ ID NO: 1664842 - DNA, 15 bp, Homo sapiens
taacttcttgcttct

SEQ ID NO: 1664843 - DNA, 15 bp, Homo sapiens
taacttgcgcagaaa

SEQ ID NO: 1664844 - DNA, 19 bp, Homo sapiens
taacttgcttaaatttctt

SEQ ID NO: 1664845 - DNA, 20 bp, Homo sapiens
taacttgcttaaatttctta

SEQ ID NO: 1664846 - DNA, 17 bp, Homo sapiens
taacttggatgagtttt

SEQ ID NO: 1664847 - DNA, 19 bp, Homo sapiens
taacttgggagtgtggttt

SEQ ID NO: 1664848 - DNA, 14 bp, Homo sapiens
taacttggggaggc

SEQ ID NO: 1664849 - DNA, 21 bp, Homo sapiens
taacttggtcagagccactct

SEQ ID NO: 1664850 - DNA, 20 bp, Homo sapiens
taacttgtatattccaccat

SEQ ID NO: 1664851 - DNA, 17 bp, Homo sapiens
taacttgtctaaataag

SEQ ID NO: 1664852 - DNA, 14 bp, Homo sapiens
taacttgtttgagg

SEQ ID NO: 1664853 - DNA, 22 bp, Homo sapiens
taactttaattctctttcaaag

SEQ ID NO: 1664854 - DNA, 16 bp, Homo sapiens
taactttataaatcca

SEQ ID NO: 1664855 - DNA, 15 bp, Homo sapiens
taactttatcacatt

SEQ ID NO: 1664856 - DNA, 18 bp, Homo sapiens
taactttatgtgtaaata

SEQ ID NO: 1664857 - DNA, 13 bp, Homo sapiens
taactttcagaag

SEQ ID NO: 1664858 - DNA, 13 bp, Homo sapiens
taactttcccatg

SEQ ID NO: 1664859 - DNA, 13 bp, Homo sapiens
taactttctgggt

SEQ ID NO: 1664860 - DNA, 20 bp, Homo sapiens
taacttttgtaaatacacat

SEQ ID NO: 1664861 - DNA, 12 bp, Homo sapiens
taacttttgtga

SEQ ID NO: 1664862 - DNA, 22 bp, Homo sapiens
taacttttttgtggcaattagt

SEQ ID NO: 1664863 - DNA, 20 bp, Homo sapiens
taacttttttgtgtatgtac

SEQ ID NO: 1664864 - DNA, 19 bp, Homo sapiens
taacttttttttctctctt

SEQ ID NO: 1664865 - DNA, 10 bp, Homo sapiens
taagaaaaac

SEQ ID NO: 1664866 - DNA, 12 bp, Homo sapiens
taagaaaaacat

SEQ ID NO: 1664867 - DNA, 16 bp, Homo sapiens
taagaaaaacatgtca

SEQ ID NO: 1664868 - DNA, 11 bp, Homo sapiens
taagaaaaact

SEQ ID NO: 1664869 - DNA, 15 bp, Homo sapiens
taagaaaaacttttt

SEQ ID NO: 1664870 - DNA, 17 bp, Homo sapiens
taagtattatgtctctt

SEQ ID NO: 1664871 - DNA, 21 bp, Homo sapiens
taagtattatgtctcttctga

SEQ ID NO: 1664872 - DNA, 14 bp, Homo sapiens
taagtatttatata

SEQ ID NO: 1664873 - DNA, 17 bp, Homo sapiens
taagtatttatatattt

SEQ ID NO: 1664874 - DNA, 23 bp, Homo sapiens
taagtatttatatatttataact

SEQ ID NO: 1664875 - DNA, 13 bp, Homo sapiens
taagtatttctga

SEQ ID NO: 1664876 - DNA, 14 bp, Homo sapiens
taagtatttggaat

SEQ ID NO: 1664877 - DNA, 18 bp, Homo sapiens
taagtcaagcacatgtaa

SEQ ID NO: 1664878 - DNA, 20 bp, Homo sapiens
taagtcaagcacatgtaata

SEQ ID NO: 1664879 - DNA, 21 bp, Homo sapiens
taagtcaagcacatgtaataa

SEQ ID NO: 1664880 - DNA, 19 bp, Homo sapiens
taagtcagtatggtctaac

SEQ ID NO: 1664881 - DNA, 20 bp, Homo sapiens
taagtcatctacttaataaa

SEQ ID NO: 1664882 - DNA, 13 bp, Homo sapiens
taagtcatttaac

SEQ ID NO: 1664883 - DNA, 16 bp, Homo sapiens
taagtccttccacctg

SEQ ID NO: 1664884 - DNA, 18 bp, Homo sapiens
taagtccttccacctgcc

SEQ ID NO: 1664885 - DNA, 20 bp, Homo sapiens
taagtcctttatgtggaaaa

SEQ ID NO: 1664886 - DNA, 16 bp, Homo sapiens
taagtctcctgtctta

SEQ ID NO: 1664887 - DNA, 19 bp, Homo sapiens
taagtctgggatgtagaac

SEQ ID NO: 1664888 - DNA, 15 bp, Homo sapiens
taagtcttccttaaa

SEQ ID NO: 1664889 - DNA, 21 bp, Homo sapiens
taagtcttccttaaatgactt

SEQ ID NO: 1664890 - DNA, 21 bp, Homo sapiens
taagtgaagaatacatcagaa

SEQ ID NO: 1664891 - DNA, 14 bp, Homo sapiens
taagtgaaggagaa

SEQ ID NO: 1664892 - DNA, 16 bp, Homo sapiens
taagtgacacagacat

SEQ ID NO: 1664893 - DNA, 19 bp, Homo sapiens
taagtgacacagacatttt

SEQ ID NO: 1664894 - DNA, 21 bp, Homo sapiens
taagtgacacagacattttgt

SEQ ID NO: 1664895 - DNA, 24 bp, Homo sapiens
taagtgagagagacaagaagcaaa

SEQ ID NO: 1664896 - DNA, 17 bp, Homo sapiens
taagtgatttgcctgta

SEQ ID NO: 1664897 - DNA, 23 bp, Homo sapiens
taagtgcagggaggaaaagtgca

SEQ ID NO: 1664898 - DNA, 15 bp, Homo sapiens
taagtgctttgtaat

SEQ ID NO: 1664899 - DNA, 21 bp, Homo sapiens
taagtggattggctttgtgct

SEQ ID NO: 1664900 - DNA, 13 bp, Homo sapiens
taagtggctgcct

SEQ ID NO: 1664901 - DNA, 18 bp, Homo sapiens
taagtgggcccacccggt

SEQ ID NO: 1664902 - DNA, 21 bp, Homo sapiens
taagtggggttgcaaccactg

SEQ ID NO: 1664903 - DNA, 14 bp, Homo sapiens
taagtgtagctcaa

SEQ ID NO: 1664904 - DNA, 21 bp, Homo sapiens
taagtgtgcttagttttaata

SEQ ID NO: 1664905 - DNA, 18 bp, Homo sapiens
taagtgtggttttgtaat

SEQ ID NO: 1664906 - DNA, 24 bp, Homo sapiens
taagtgtgtcttcctagaattcga

SEQ ID NO: 1664907 - DNA, 14 bp, Homo sapiens
taagtgtttctcaa

SEQ ID NO: 1664908 - DNA, 18 bp, Homo sapiens
taagtgtttctcaaaaga

SEQ ID NO: 1664909 - DNA, 23 bp, Homo sapiens
taagttatgcctctgacagtcca

SEQ ID NO: 1664910 - DNA, 20 bp, Homo sapiens
taagttatttcttgtttgtt

SEQ ID NO: 1664911 - DNA, 19 bp, Homo sapiens
taagttatttttgtacatg

SEQ ID NO: 1664912 - DNA, 13 bp, Homo sapiens
taagttcacatta

SEQ ID NO: 1664913 - DNA, 12 bp, Homo sapiens
taagttcataca

SEQ ID NO: 1664914 - DNA, 13 bp, Homo sapiens
taagttcatacat

SEQ ID NO: 1664915 - DNA, 22 bp, Homo sapiens
taagttcatattccatatttat

SEQ ID NO: 1664916 - DNA, 16 bp, Homo sapiens
taagttcatgtttgta

SEQ ID NO: 1664917 - DNA, 13 bp, Homo sapiens
taagttctaagtt

SEQ ID NO: 1664918 - DNA, 22 bp, Homo sapiens
taagttctcccaacaacatgaa

SEQ ID NO: 1664919 - DNA, 14 bp, Homo sapiens
taagttgaaggaaa

SEQ ID NO: 1664920 - DNA, 17 bp, Homo sapiens
taagttgaatggcctgc

SEQ ID NO: 1664921 - DNA, 20 bp, Homo sapiens
taagttggaccagaggaagc

SEQ ID NO: 1664922 - DNA, 15 bp, Homo sapiens
taagttgtttgcatg

SEQ ID NO: 1664923 - DNA, 21 bp, Homo sapiens
taagtttcactcacatagcca

SEQ ID NO: 1664924 - DNA, 23 bp, Homo sapiens
taagtttctaagattctaaaggt

SEQ ID NO: 1664925 - DNA, 15 bp, Homo sapiens
taagtttctcttcac

SEQ ID NO: 1664926 - DNA, 18 bp, Homo sapiens
taagtttgaaaatagtta

SEQ ID NO: 1664927 - DNA, 12 bp, Homo sapiens
taagtttgcact

SEQ ID NO: 1664928 - DNA, 16 bp, Homo sapiens
taagttttagtcttta

SEQ ID NO: 1664929 - DNA, 15 bp, Homo sapiens
taagttttttttctg

SEQ ID NO: 1664930 - DNA, 16 bp, Homo sapiens
taataaaaagattgaa

SEQ ID NO: 1664931 - DNA, 22 bp, Homo sapiens
taataaaaagcatttggtgcct

SEQ ID NO: 1664932 - DNA, 12 bp, Homo sapiens
taataaaaatac

SEQ ID NO: 1664933 - DNA, 13 bp, Homo sapiens
taataaaaattat

SEQ ID NO: 1664934 - DNA, 19 bp, Homo sapiens
taataaaacaatactcaaa

SEQ ID NO: 1664935 - DNA, 22 bp, Homo sapiens
taataaaactgcgaggacatca

SEQ ID NO: 1664936 - DNA, 16 bp, Homo sapiens
taataaaagatttaca

SEQ ID NO: 1664937 - DNA, 12 bp, Homo sapiens
taataaaagtga

SEQ ID NO: 1664938 - DNA, 22 bp, Homo sapiens
taataaacatccttcaagaact

SEQ ID NO: 1664939 - DNA, 15 bp, Homo sapiens
taataaactgtgttt

SEQ ID NO: 1664940 - DNA, 17 bp, Homo sapiens
taataaactttaatata

SEQ ID NO: 1664941 - DNA, 14 bp, Homo sapiens
taataaactttatt

SEQ ID NO: 1664942 - DNA, 19 bp, Homo sapiens
taataaacttttttttgag

SEQ ID NO: 1664943 - DNA, 13 bp, Homo sapiens
taataaagacagg

SEQ ID NO: 1664944 - DNA, 11 bp, Homo sapiens
taataaagcat

SEQ ID NO: 1664945 - DNA, 15 bp, Homo sapiens
taataaagttgcttt

SEQ ID NO: 1664946 - DNA, 18 bp, Homo sapiens
taataaagtttttttcca

SEQ ID NO: 1664947 - DNA, 14 bp, Homo sapiens
taataaatatatac

SEQ ID NO: 1664948 - DNA, 19 bp, Homo sapiens
taataaatatttttgccat

SEQ ID NO: 1664949 - DNA, 18 bp, Homo sapiens
taataaattgaataggta

SEQ ID NO: 1664950 - DNA, 20 bp, Homo sapiens
taataactcggattccagcc

SEQ ID NO: 1664951 - DNA, 13 bp, Homo sapiens
taataactgcagt

SEQ ID NO: 1664952 - DNA, 17 bp, Homo sapiens
taataactgtcttctgg

SEQ ID NO: 1664953 - DNA, 18 bp, Homo sapiens
taataactgtcttctgga

SEQ ID NO: 1664954 - DNA, 13 bp, Homo sapiens
taataactgtgta

SEQ ID NO: 1664955 - DNA, 14 bp, Homo sapiens
taataagaacagat

SEQ ID NO: 1664956 - DNA, 19 bp, Homo sapiens
taataagagaatgttccta

SEQ ID NO: 1664957 - DNA, 15 bp, Homo sapiens
taataagcactgtaa

SEQ ID NO: 1664958 - DNA, 16 bp, Homo sapiens
taataagggaaaaatc

SEQ ID NO: 1664959 - DNA, 14 bp, Homo sapiens
taataagtgaagaa

SEQ ID NO: 1664960 - DNA, 17 bp, Homo sapiens
taataagtgatgtgctg

SEQ ID NO: 1664961 - DNA, 12 bp, Homo sapiens
taataatactga

SEQ ID NO: 1664962 - DNA, 10 bp, Homo sapiens
taataatatt

SEQ ID NO: 1664963 - DNA, 17 bp, Homo sapiens
taataattattattaaa

SEQ ID NO: 1664964 - DNA, 16 bp, Homo sapiens
taataatttctaatgt

SEQ ID NO: 1664965 - DNA, 21 bp, Homo sapiens
taatacaaggtataataaaat

SEQ ID NO: 1664966 - DNA, 16 bp, Homo sapiens
taatacacaaaatcaa

SEQ ID NO: 1664967 - DNA, 17 bp, Homo sapiens
taatacacaaaatcaaa

SEQ ID NO: 1664968 - DNA, 22 bp, Homo sapiens
taatacagcaacaatttatgaa

SEQ ID NO: 1664969 - DNA, 13 bp, Homo sapiens
taatacaggaaat

SEQ ID NO: 1664970 - DNA, 13 bp, Homo sapiens
taatacctctgtg

SEQ ID NO: 1664971 - DNA, 17 bp, Homo sapiens
taataccttagaaggta

SEQ ID NO: 1664972 - DNA, 16 bp, Homo sapiens
taatactcaaatgagt

SEQ ID NO: 1664973 - DNA, 20 bp, Homo sapiens
taatactcaaatgagtaaca

SEQ ID NO: 1664974 - DNA, 16 bp, Homo sapiens
taatactccagagaca

SEQ ID NO: 1664975 - DNA, 12 bp, Homo sapiens
taatactgacct

SEQ ID NO: 1664976 - DNA, 17 bp, Homo sapiens
taatactgacctacctc

SEQ ID NO: 1664977 - DNA, 15 bp, Homo sapiens
taatactgttattct

SEQ ID NO: 1664978 - DNA, 20 bp, Homo sapiens
taatactgttattctttgca

SEQ ID NO: 1664979 - DNA, 22 bp, Homo sapiens
taatactgttattctttgcact

SEQ ID NO: 1664980 - DNA, 19 bp, Homo sapiens
taatacttcatttggtgct

SEQ ID NO: 1664981 - DNA, 20 bp, Homo sapiens
taatagaaataaattcctaa

SEQ ID NO: 1664982 - DNA, 12 bp, Homo sapiens
taatagattctc

SEQ ID NO: 1664983 - DNA, 20 bp, Homo sapiens
taatagcaacttttgtgtaa

SEQ ID NO: 1664984 - DNA, 14 bp, Homo sapiens
taatagcagccttt

SEQ ID NO: 1664985 - DNA, 14 bp, Homo sapiens
taatttttacctaa

SEQ ID NO: 1664986 - DNA, 15 bp, Homo sapiens
taatttttcctgcat

SEQ ID NO: 1664987 - DNA, 16 bp, Homo sapiens
taatttttcctgcatg

SEQ ID NO: 1664988 - DNA, 17 bp, Homo sapiens
taatttttcctgcatgt

SEQ ID NO: 1664989 - DNA, 21 bp, Homo sapiens
taatttttcctgcatgttctg

SEQ ID NO: 1664990 - DNA, 22 bp, Homo sapiens
taatttttggagaaatgtcata

SEQ ID NO: 1664991 - DNA, 23 bp, Homo sapiens
taatttttgtacattacactaaa

SEQ ID NO: 1664992 - DNA, 15 bp, Homo sapiens
taatttttgtagaga

SEQ ID NO: 1664993 - DNA, 21 bp, Homo sapiens
taatttttgtattatttttgt

SEQ ID NO: 1664994 - DNA, 16 bp, Homo sapiens
taatttttttcaatat

SEQ ID NO: 1664995 - DNA, 17 bp, Homo sapiens
taattttttttaaaata

SEQ ID NO: 1664996 - DNA, 14 bp, Homo sapiens
taattttttttcct

SEQ ID NO: 1664997 - DNA, 19 bp, Homo sapiens
taattttttttgttttttg

SEQ ID NO: 1664998 - DNA, 18 bp, Homo sapiens
taatttttttttcataga

SEQ ID NO: 1664999 - DNA, 19 bp, Homo sapiens
tacaaaaagtaaaaattaa

SEQ ID NO: 1665000 - DNA, 17 bp, Homo sapiens
tacaaaaattagccggg

SEQ ID NO: 1665001 - DNA, 11 bp, Homo sapiens
tacaaaacaat

SEQ ID NO: 1665002 - DNA, 19 bp, Homo sapiens
tacaaaacctgatgttaaa

SEQ ID NO: 1665003 - DNA, 18 bp, Homo sapiens
tacaaaactgtaaataaa

SEQ ID NO: 1665004 - DNA, 13 bp, Homo sapiens
tacaaaagatgta

SEQ ID NO: 1665005 - DNA, 16 bp, Homo sapiens
tacaaaagctttttaa

SEQ ID NO: 1665006 - DNA, 19 bp, Homo sapiens
tacaaaataaacaaataac

SEQ ID NO: 1665007 - DNA, 20 bp, Homo sapiens
tacaaaataaacaaataaca

SEQ ID NO: 1665008 - DNA, 22 bp, Homo sapiens
tacaaaatatttaagtgaagga

SEQ ID NO: 1665009 - DNA, 15 bp, Homo sapiens
tacaaaattaagcaa

SEQ ID NO: 1665010 - DNA, 19 bp, Homo sapiens
tacaaaatttgaaatttag

SEQ ID NO: 1665011 - DNA, 18 bp, Homo sapiens
tacaaacaaaatttctat

SEQ ID NO: 1665012 - DNA, 12 bp, Homo sapiens
tacaaacaatgg

SEQ ID NO: 1665013 - DNA, 15 bp, Homo sapiens
tacaaacagtatttc

SEQ ID NO: 1665014 - DNA, 13 bp, Homo sapiens
tacaaacctacca

SEQ ID NO: 1665015 - DNA, 19 bp, Homo sapiens
tacaaactcccacttgtca

SEQ ID NO: 1665016 - DNA, 22 bp, Homo sapiens
tacaaactgcaatagagactgt

SEQ ID NO: 1665017 - DNA, 16 bp, Homo sapiens
tacaaactggtattct

SEQ ID NO: 1665018 - DNA, 18 bp, Homo sapiens
tacaaagagatgcttgga

SEQ ID NO: 1665019 - DNA, 19 bp, Homo sapiens
tacaaagagatgcttggag

SEQ ID NO: 1665020 - DNA, 17 bp, Homo sapiens
tacaaagggaaagcctc

SEQ ID NO: 1665021 - DNA, 14 bp, Homo sapiens
tacaaataaacctg

SEQ ID NO: 1665022 - DNA, 19 bp, Homo sapiens
tacaaatactcttaggaag

SEQ ID NO: 1665023 - DNA, 16 bp, Homo sapiens
tacaaatcagaagtca

SEQ ID NO: 1665024 - DNA, 20 bp, Homo sapiens
tacaaatcagaagtcatctt

SEQ ID NO: 1665025 - DNA, 14 bp, Homo sapiens
tacaaatgaagaaa

SEQ ID NO: 1665026 - DNA, 15 bp, Homo sapiens
tacaaatgaagaaag

SEQ ID NO: 1665027 - DNA, 21 bp, Homo sapiens
tacaaatggacataggactca

SEQ ID NO: 1665028 - DNA, 21 bp, Homo sapiens
tacaaatgtaagcaaaggctc

SEQ ID NO: 1665029 - DNA, 21 bp, Homo sapiens
tacaaattgcttactttggaa

SEQ ID NO: 1665030 - DNA, 16 bp, Homo sapiens
tacaaatttatgcatt

SEQ ID NO: 1665031 - DNA, 22 bp, Homo sapiens
tacaaatttatgcatttcattc

SEQ ID NO: 1665032 - DNA, 24 bp, Homo sapiens
tacaaatttggccttaagaactgt

SEQ ID NO: 1665033 - DNA, 15 bp, Homo sapiens
tacaacacaaagaga

SEQ ID NO: 1665034 - DNA, 17 bp, Homo sapiens
tacaacacatctaatta

SEQ ID NO: 1665035 - DNA, 20 bp, Homo sapiens
tacaacacatctaattaaat

SEQ ID NO: 1665036 - DNA, 15 bp, Homo sapiens
tacaacatttatgtg

SEQ ID NO: 1665037 - DNA, 23 bp, Homo sapiens
tacaaccaagctctctgcatcta

SEQ ID NO: 1665038 - DNA, 15 bp, Homo sapiens
tacaacggagtcaaa

SEQ ID NO: 1665039 - DNA, 19 bp, Homo sapiens
tacaactagatcaaggagc

SEQ ID NO: 1665040 - DNA, 17 bp, Homo sapiens
tacaactgattgcaaca

SEQ ID NO: 1665041 - DNA, 23 bp, Homo sapiens
tacaactggagtttttttataca

SEQ ID NO: 1665042 - DNA, 14 bp, Homo sapiens
tacaagaaaatgta

SEQ ID NO: 1665043 - DNA, 16 bp, Homo sapiens
tacaagagcagcctgt

SEQ ID NO: 1665044 - DNA, 19 bp, Homo sapiens
tacaagagcagcctgtggc

SEQ ID NO: 1665045 - DNA, 13 bp, Homo sapiens
tacaagattagaa

SEQ ID NO: 1665046 - DNA, 16 bp, Homo sapiens
tacaagcctgcacaat

SEQ ID NO: 1665047 - DNA, 17 bp, Homo sapiens
tacaaggcaatggaaac

SEQ ID NO: 1665048 - DNA, 20 bp, Homo sapiens
tacaaggtataataaaatta

SEQ ID NO: 1665049 - DNA, 14 bp, Homo sapiens
tacaagtaatgtaa

SEQ ID NO: 1665050 - DNA, 19 bp, Homo sapiens
tacaagtggtaatttttgt

SEQ ID NO: 1665051 - DNA, 22 bp, Homo sapiens
tacaagtggtaatttttgtaca

SEQ ID NO: 1665052 - DNA, 19 bp, Homo sapiens
tacaagtgttcttaggttt

SEQ ID NO: 1665053 - DNA, 13 bp, Homo sapiens
tacaagttagaaa

SEQ ID NO: 1665054 - DNA, 21 bp, Homo sapiens
tacaagttccaacatgcaata

SEQ ID NO: 1665055 - DNA, 17 bp, Homo sapiens
tacaagtttatatatat

SEQ ID NO: 1665056 - DNA, 16 bp, Homo sapiens
tacaagtttcagacag

SEQ ID NO: 1665057 - DNA, 14 bp, Homo sapiens
tacaagttttgtat

SEQ ID NO: 1665058 - DNA, 14 bp, Homo sapiens
tacaataaaaagaa

SEQ ID NO: 1665059 - DNA, 21 bp, Homo sapiens
tacaataaaactttgctgcca

SEQ ID NO: 1665060 - DNA, 15 bp, Homo sapiens
tacaataaagtttac

SEQ ID NO: 1665061 - DNA, 15 bp, Homo sapiens
tacaataaataatct

SEQ ID NO: 1665062 - DNA, 14 bp, Homo sapiens
tacaataaatattc

SEQ ID NO: 1665063 - DNA, 11 bp, Homo sapiens
tacaataaatt

SEQ ID NO: 1665064 - DNA, 12 bp, Homo sapiens
tacaataaattt

SEQ ID NO: 1665065 - DNA, 13 bp, Homo sapiens
tacaataatctct

SEQ ID NO: 1665066 - DNA, 16 bp, Homo sapiens
tacaatacaatgtaca

SEQ ID NO: 1665067 - DNA, 13 bp, Homo sapiens
tacaatagaattt

SEQ ID NO: 1665068 - DNA, 12 bp, Homo sapiens
tacaatatatat

SEQ ID NO: 1665069 - DNA, 20 bp, Homo sapiens
tacaatcaaaggaaaatagt

SEQ ID NO: 1665070 - DNA, 17 bp, Homo sapiens
tacaatctctttttgtt

SEQ ID NO: 1665071 - DNA, 14 bp, Homo sapiens
tacaatctggctca

SEQ ID NO: 1665072 - DNA, 21 bp, Homo sapiens
tacaatgaacacttataagtg

SEQ ID NO: 1665073 - DNA, 14 bp, Homo sapiens
tacaatgaactgct

SEQ ID NO: 1665074 - DNA, 18 bp, Homo sapiens
tacaatggaataaattat

SEQ ID NO: 1665075 - DNA, 23 bp, Homo sapiens
tacaatggtttattcccaagtat

SEQ ID NO: 1665076 - DNA, 12 bp, Homo sapiens
tacaatgtacaa

SEQ ID NO: 1665077 - DNA, 16 bp, Homo sapiens
tacaatgtatctttat

SEQ ID NO: 1665078 - DNA, 21 bp, Homo sapiens
tacaatgtatctttattaaaa

SEQ ID NO: 1665079 - DNA, 16 bp, Homo sapiens
tacaatgtatgtacaa

SEQ ID NO: 1665080 - DNA, 14 bp, Homo sapiens
tacaatgtatttat

SEQ ID NO: 1665081 - DNA, 19 bp, Homo sapiens
tacaatgtatttatttaaa

SEQ ID NO: 1665082 - DNA, 22 bp, Homo sapiens
tacaatgtatttatttaaaaga

SEQ ID NO: 1665083 - DNA, 22 bp, Homo sapiens
tacaattaatagtttgtctatt

SEQ ID NO: 1665084 - DNA, 22 bp, Homo sapiens
tacaattatttttacagttctc

SEQ ID NO: 1665085 - DNA, 13 bp, Homo sapiens
tacaattcattgt

SEQ ID NO: 1665086 - DNA, 18 bp, Homo sapiens
tacaattctacattgtca

SEQ ID NO: 1665087 - DNA, 14 bp, Homo sapiens
tacaattgcactgc

SEQ ID NO: 1665088 - DNA, 19 bp, Homo sapiens
tacaattgcactgctgttc

SEQ ID NO: 1665089 - DNA, 16 bp, Homo sapiens
tacaatttgtactttt

SEQ ID NO: 1665090 - DNA, 14 bp, Homo sapiens
tacaattttaaagt

SEQ ID NO: 1665091 - DNA, 19 bp, Homo sapiens
tacaattttaaagttctta

SEQ ID NO: 1665092 - DNA, 12 bp, Homo sapiens
tacaattttatc

SEQ ID NO: 1665093 - DNA, 13 bp, Homo sapiens
tacaattttctgt

SEQ ID NO: 1665094 - DNA, 16 bp, Homo sapiens
tacaatttttaataaa

SEQ ID NO: 1665095 - DNA, 17 bp, Homo sapiens
tacaattttttatcatg

SEQ ID NO: 1665096 - DNA, 23 bp, Homo sapiens
tacaattttttatcatgcatgtc

SEQ ID NO: 1665097 - DNA, 13 bp, Homo sapiens
tacacaaaatcaa

SEQ ID NO: 1665098 - DNA, 21 bp, Homo sapiens
tacacaaagaacttgctgctg

SEQ ID NO: 1665099 - DNA, 13 bp, Homo sapiens
tacacaagaatct

SEQ ID NO: 1665100 - DNA, 16 bp, Homo sapiens
taccctagccattcct

SEQ ID NO: 1665101 - DNA, 15 bp, Homo sapiens
taccctcagcctcca

SEQ ID NO: 1665102 - DNA, 21 bp, Homo sapiens
taccctcaggcataggcctgg

SEQ ID NO: 1665103 - DNA, 23 bp, Homo sapiens
taccctcaggcataggcctgggt

SEQ ID NO: 1665104 - DNA, 15 bp, Homo sapiens
taccctcctgtaaat

SEQ ID NO: 1665105 - DNA, 18 bp, Homo sapiens
taccctcgggcccacctg

SEQ ID NO: 1665106 - DNA, 21 bp, Homo sapiens
taccctcgggcccacctggcc

SEQ ID NO: 1665107 - DNA, 15 bp, Homo sapiens
taccctctcagctcc

SEQ ID NO: 1665108 - DNA, 16 bp, Homo sapiens
taccctctttgctgca

SEQ ID NO: 1665109 - DNA, 19 bp, Homo sapiens
taccctgaggtcactgcta

SEQ ID NO: 1665110 - DNA, 16 bp, Homo sapiens
taccctgatctggacc

SEQ ID NO: 1665111 - DNA, 20 bp, Homo sapiens
taccctggcactataatgta

SEQ ID NO: 1665112 - DNA, 12 bp, Homo sapiens
taccctggcagg

SEQ ID NO: 1665113 - DNA, 16 bp, Homo sapiens
taccctgtctgtccct

SEQ ID NO: 1665114 - DNA, 21 bp, Homo sapiens
taccctgtctgtcccttttct

SEQ ID NO: 1665115 - DNA, 20 bp, Homo sapiens
tacccttcacctttggtgca

SEQ ID NO: 1665116 - DNA, 23 bp, Homo sapiens
tacccttgagacctggaaccaga

SEQ ID NO: 1665117 - DNA, 21 bp, Homo sapiens
tacccttgtgagagcccattc

SEQ ID NO: 1665118 - DNA, 13 bp, Homo sapiens
tacccttttcccc

SEQ ID NO: 1665119 - DNA, 19 bp, Homo sapiens
taccctttttctccagctg

SEQ ID NO: 1665120 - DNA, 20 bp, Homo sapiens
taccgaagtaaactgatgta

SEQ ID NO: 1665121 - DNA, 22 bp, Homo sapiens
taccgagtctcttctccactgg

SEQ ID NO: 1665122 - DNA, 20 bp, Homo sapiens
taccgagttcaagtgatttt

SEQ ID NO: 1665123 - DNA, 12 bp, Homo sapiens
taccgcaggccc

SEQ ID NO: 1665124 - DNA, 16 bp, Homo sapiens
taccgcccggcagccc

SEQ ID NO: 1665125 - DNA, 17 bp, Homo sapiens
taccgcctcgtgccagc

SEQ ID NO: 1665126 - DNA, 18 bp, Homo sapiens
taccgcctcgtgccagca

SEQ ID NO: 1665127 - DNA, 15 bp, Homo sapiens
taccgctcagtattt

SEQ ID NO: 1665128 - DNA, 17 bp, Homo sapiens
taccggagagagaatgt

SEQ ID NO: 1665129 - DNA, 18 bp, Homo sapiens
taccggagagagaatgta

SEQ ID NO: 1665130 - DNA, 14 bp, Homo sapiens
taccgtagcctccg

SEQ ID NO: 1665131 - DNA, 16 bp, Homo sapiens
taccgtggatctcctt

SEQ ID NO: 1665132 - DNA, 15 bp, Homo sapiens
tacctaaacagatat

SEQ ID NO: 1665133 - DNA, 22 bp, Homo sapiens
tacctaaacagatataaatggc

SEQ ID NO: 1665134 - DNA, 17 bp, Homo sapiens
tacctaagattacaaat

SEQ ID NO: 1665135 - DNA, 15 bp, Homo sapiens
tacctaagatttctg

SEQ ID NO: 1665136 - DNA, 19 bp, Homo sapiens
tacctaagatttctgtctt

SEQ ID NO: 1665137 - DNA, 13 bp, Homo sapiens
tacctaattatta

SEQ ID NO: 1665138 - DNA, 15 bp, Homo sapiens
tacctacatacaatt

SEQ ID NO: 1665139 - DNA, 17 bp, Homo sapiens
tacctaccacagtgtct

SEQ ID NO: 1665140 - DNA, 14 bp, Homo sapiens
tacctactgtgtgc

SEQ ID NO: 1665141 - DNA, 13 bp, Homo sapiens
tacctactttgac

SEQ ID NO: 1665142 - DNA, 18 bp, Homo sapiens
tacctatctgtggaaagc

SEQ ID NO: 1665143 - DNA, 20 bp, Homo sapiens
tacctatctgtggaaagcta

SEQ ID NO: 1665144 - DNA, 16 bp, Homo sapiens
tacctcaaagggcagt

SEQ ID NO: 1665145 - DNA, 19 bp, Homo sapiens
tacctcaaagggcagtttt

SEQ ID NO: 1665146 - DNA, 22 bp, Homo sapiens
tacctcaacccccatttctatt

SEQ ID NO: 1665147 - DNA, 22 bp, Homo sapiens
tacctcaagccccatttcctca

SEQ ID NO: 1665148 - DNA, 16 bp, Homo sapiens
tacctcagccctggcc

SEQ ID NO: 1665149 - DNA, 16 bp, Homo sapiens
tacctcaggcagctca

SEQ ID NO: 1665150 - DNA, 15 bp, Homo sapiens
tacctccaccctgca

SEQ ID NO: 1665151 - DNA, 17 bp, Homo sapiens
tacctccaccctgcatt

SEQ ID NO: 1665152 - DNA, 22 bp, Homo sapiens
tacctccaccctgcattttcct

SEQ ID NO: 1665153 - DNA, 21 bp, Homo sapiens
tacctccctccccgtctcatt

SEQ ID NO: 1665154 - DNA, 13 bp, Homo sapiens
tacctcctctcag

SEQ ID NO: 1665155 - DNA, 14 bp, Homo sapiens
tacctcctctcagt

SEQ ID NO: 1665156 - DNA, 11 bp, Homo sapiens
tacctcctgcc

SEQ ID NO: 1665157 - DNA, 13 bp, Homo sapiens
tacctcctgccca

SEQ ID NO: 1665158 - DNA, 16 bp, Homo sapiens
tacctcctgcccagga

SEQ ID NO: 1665159 - DNA, 21 bp, Homo sapiens
tacctctaataaacactgttt

SEQ ID NO: 1665160 - DNA, 21 bp, Homo sapiens
tacctctattttaattactgc

SEQ ID NO: 1665161 - DNA, 14 bp, Homo sapiens
tacctctctgtccc

SEQ ID NO: 1665162 - DNA, 15 bp, Homo sapiens
tacctctctgtccct

SEQ ID NO: 1665163 - DNA, 18 bp, Homo sapiens
tacctctctgtcccttgc

SEQ ID NO: 1665164 - DNA, 21 bp, Homo sapiens
tacctctcttatagaatattt

SEQ ID NO: 1665165 - DNA, 16 bp, Homo sapiens
tacctctgagaagaca

SEQ ID NO: 1665166 - DNA, 15 bp, Homo sapiens
tacctctgatacctc

SEQ ID NO: 1665167 - DNA, 14 bp, Homo sapiens
tacctctgtgtgct

SEQ ID NO: 1665168 - DNA, 16 bp, Homo sapiens
tacctcttactttgct

SEQ ID NO: 1665169 - DNA, 21 bp, Homo sapiens
tacctcttactttgcttgaga

SEQ ID NO: 1665170 - DNA, 16 bp, Homo sapiens
tacctgactcctgact

SEQ ID NO: 1665171 - DNA, 12 bp, Homo sapiens
tacctgagacca

SEQ ID NO: 1665172 - DNA, 12 bp, Homo sapiens
tacctgattttt

SEQ ID NO: 1665173 - DNA, 15 bp, Homo sapiens
tacctgcaaaaatga

SEQ ID NO: 1665174 - DNA, 16 bp, Homo sapiens
tacctgcaaaaatgag

SEQ ID NO: 1665175 - DNA, 13 bp, Homo sapiens
tacctgcaagcag

SEQ ID NO: 1665176 - DNA, 13 bp, Homo sapiens
tacctgcaggctc

SEQ ID NO: 1665177 - DNA, 16 bp, Homo sapiens
tacctgcaggctccat

SEQ ID NO: 1665178 - DNA, 19 bp, Homo sapiens
tacctgcaggctccatgca

SEQ ID NO: 1665179 - DNA, 20 bp, Homo sapiens
tacctgcaggctccatgcac

SEQ ID NO: 1665180 - DNA, 21 bp, Homo sapiens
tacctgctcacgtcaaatgca

SEQ ID NO: 1665181 - DNA, 15 bp, Homo sapiens
tacctggagaagaat

SEQ ID NO: 1665182 - DNA, 23 bp, Homo sapiens
tacctggagaagaatggctttca

SEQ ID NO: 1665183 - DNA, 15 bp, Homo sapiens
tacctggatgttctt

SEQ ID NO: 1665184 - DNA, 19 bp, Homo sapiens
tacctgggaaaggacccac

SEQ ID NO: 1665185 - DNA, 22 bp, Homo sapiens
tacctgggaaaggacccaccca

SEQ ID NO: 1665186 - DNA, 19 bp, Homo sapiens
tacctgtacactgacttga

SEQ ID NO: 1665187 - DNA, 16 bp, Homo sapiens
tacctgtcattttgca

SEQ ID NO: 1665188 - DNA, 19 bp, Homo sapiens
tacctgtcattttgcactg

SEQ ID NO: 1665189 - DNA, 18 bp, Homo sapiens
tacctgtccctccaggcc

SEQ ID NO: 1665190 - DNA, 15 bp, Homo sapiens
tacctgtctgctgcc

SEQ ID NO: 1665191 - DNA, 24 bp, Homo sapiens
tacctgtgctttcccagaggacac

SEQ ID NO: 1665192 - DNA, 20 bp, Homo sapiens
tacctgtgtccgatgctgga

SEQ ID NO: 1665193 - DNA, 20 bp, Homo sapiens
tacctgttatttatcaattt

SEQ ID NO: 1665194 - DNA, 23 bp, Homo sapiens
tacctgttatttatcaatttttc

SEQ ID NO: 1665195 - DNA, 18 bp, Homo sapiens
taccttatagttactgtg

SEQ ID NO: 1665196 - DNA, 14 bp, Homo sapiens
taccttatcttaca

SEQ ID NO: 1665197 - DNA, 12 bp, Homo sapiens
taccttatttat

SEQ ID NO: 1665198 - DNA, 14 bp, Homo sapiens
taccttcatgtggt

SEQ ID NO: 1665199 - DNA, 13 bp, Homo sapiens
taccttccccaga

SEQ ID NO: 1665200 - DNA, 22 bp, Homo sapiens
taccttccccagacttgcactg

SEQ ID NO: 1665201 - DNA, 16 bp, Homo sapiens
taccttcccgcctcgg

SEQ ID NO: 1665202 - DNA, 18 bp, Homo sapiens
taccttcccgcctcggct

SEQ ID NO: 1665203 - DNA, 18 bp, Homo sapiens
taccttccttaagccagg

SEQ ID NO: 1665204 - DNA, 14 bp, Homo sapiens
taccttccttccct

SEQ ID NO: 1665205 - DNA, 19 bp, Homo sapiens
taccttctctacccatctc

SEQ ID NO: 1665206 - DNA, 14 bp, Homo sapiens
taccttctggttgc

SEQ ID NO: 1665207 - DNA, 14 bp, Homo sapiens
taccttgcctcctt

SEQ ID NO: 1665208 - DNA, 15 bp, Homo sapiens
taccttgttgcagat

SEQ ID NO: 1665209 - DNA, 21 bp, Homo sapiens
taccttgttgcagatgggtga

SEQ ID NO: 1665210 - DNA, 15 bp, Homo sapiens
taccttgttgtgttt

SEQ ID NO: 1665211 - DNA, 16 bp, Homo sapiens
tacctttatggtttct

SEQ ID NO: 1665212 - DNA, 15 bp, Homo sapiens
tacctttcaaagctt

SEQ ID NO: 1665213 - DNA, 23 bp, Homo sapiens
tacctttcctgatgcccctgaca

SEQ ID NO: 1665214 - DNA, 12 bp, Homo sapiens
tacctttgtcac

SEQ ID NO: 1665215 - DNA, 15 bp, Homo sapiens
tagaactcactctgg

SEQ ID NO: 1665216 - DNA, 16 bp, Homo sapiens
tagaactcactctggg

SEQ ID NO: 1665217 - DNA, 18 bp, Homo sapiens
tagaactcactctgggct

SEQ ID NO: 1665218 - DNA, 23 bp, Homo sapiens
tagaactctccatcttattttca

SEQ ID NO: 1665219 - DNA, 18 bp, Homo sapiens
tagaactgttcatttcca

SEQ ID NO: 1665220 - DNA, 17 bp, Homo sapiens
tagaactttaagtctca

SEQ ID NO: 1665221 - DNA, 20 bp, Homo sapiens
tagaactttattaagtaaaa

SEQ ID NO: 1665222 - DNA, 22 bp, Homo sapiens
tagaagaacatccaaggagaaa

SEQ ID NO: 1665223 - DNA, 18 bp, Homo sapiens
tagaagaaccaaatacct

SEQ ID NO: 1665224 - DNA, 16 bp, Homo sapiens
tagaagaagaggaaga

SEQ ID NO: 1665225 - DNA, 13 bp, Homo sapiens
tagaagaatttta

SEQ ID NO: 1665226 - DNA, 18 bp, Homo sapiens
tagaagacaaaatgttca

SEQ ID NO: 1665227 - DNA, 13 bp, Homo sapiens
tagaagacattta

SEQ ID NO: 1665228 - DNA, 15 bp, Homo sapiens
tagaagacatttata

SEQ ID NO: 1665229 - DNA, 22 bp, Homo sapiens
tagaagagaagagccatcttgg

SEQ ID NO: 1665230 - DNA, 19 bp, Homo sapiens
tagaagagggttttaggta

SEQ ID NO: 1665231 - DNA, 22 bp, Homo sapiens
tagaagaggtagtgtgaatatt

SEQ ID NO: 1665232 - DNA, 17 bp, Homo sapiens
tagaagccgtgggaaga

SEQ ID NO: 1665233 - DNA, 16 bp, Homo sapiens
tagaaggaatttgtac

SEQ ID NO: 1665234 - DNA, 18 bp, Homo sapiens
tagaaggaatttgtactt

SEQ ID NO: 1665235 - DNA, 19 bp, Homo sapiens
tagaaggaatttgtacttc

SEQ ID NO: 1665236 - DNA, 17 bp, Homo sapiens
tagaaggatgtacattt

SEQ ID NO: 1665237 - DNA, 21 bp, Homo sapiens
tagaaggatgtacatttccaa

SEQ ID NO: 1665238 - DNA, 15 bp, Homo sapiens
tagaaggcttctctc

SEQ ID NO: 1665239 - DNA, 16 bp, Homo sapiens
tagaaggtttgggaac

SEQ ID NO: 1665240 - DNA, 20 bp, Homo sapiens
tagaagtaggaggaaacagt

SEQ ID NO: 1665241 - DNA, 16 bp, Homo sapiens
tagaagtcttagatgt

SEQ ID NO: 1665242 - DNA, 20 bp, Homo sapiens
tagaagtcttagatgtatat

SEQ ID NO: 1665243 - DNA, 21 bp, Homo sapiens
tagaagtgagtttgtaaatat

SEQ ID NO: 1665244 - DNA, 18 bp, Homo sapiens
tagaagtggaccaggaca

SEQ ID NO: 1665245 - DNA, 20 bp, Homo sapiens
tagaagtgggccaggacagg

SEQ ID NO: 1665246 - DNA, 20 bp, Homo sapiens
tagaagttactgaatgcacc

SEQ ID NO: 1665247 - DNA, 23 bp, Homo sapiens
tagaataaaagctataaagtata

SEQ ID NO: 1665248 - DNA, 14 bp, Homo sapiens
tagaataaggagga

SEQ ID NO: 1665249 - DNA, 22 bp, Homo sapiens
tagaataaggaggaggagggag

SEQ ID NO: 1665250 - DNA, 22 bp, Homo sapiens
tagaataatctattatttggag

SEQ ID NO: 1665251 - DNA, 11 bp, Homo sapiens
tagaataattc

SEQ ID NO: 1665252 - DNA, 14 bp, Homo sapiens
tagaataattcttt

SEQ ID NO: 1665253 - DNA, 15 bp, Homo sapiens
tagaatacattttgt

SEQ ID NO: 1665254 - DNA, 16 bp, Homo sapiens
tagaatacattttgta

SEQ ID NO: 1665255 - DNA, 22 bp, Homo sapiens
tagaataggcagggggccctgc

SEQ ID NO: 1665256 - DNA, 18 bp, Homo sapiens
tagaatataattatcgga

SEQ ID NO: 1665257 - DNA, 18 bp, Homo sapiens
tagaatatcctatactgg

SEQ ID NO: 1665258 - DNA, 22 bp, Homo sapiens
tagaatatcctatactggttat

SEQ ID NO: 1665259 - DNA, 12 bp, Homo sapiens
tagaatatttat

SEQ ID NO: 1665260 - DNA, 15 bp, Homo sapiens
tagaatatttattac

SEQ ID NO: 1665261 - DNA, 18 bp, Homo sapiens
tagaatcccagcagcaga

SEQ ID NO: 1665262 - DNA, 16 bp, Homo sapiens
tagaatccgaagggaa

SEQ ID NO: 1665263 - DNA, 14 bp, Homo sapiens
tagaatctagaaat

SEQ ID NO: 1665264 - DNA, 17 bp, Homo sapiens
tagaatgaatttatctt

SEQ ID NO: 1665265 - DNA, 19 bp, Homo sapiens
tagaatgaatttatcttta

SEQ ID NO: 1665266 - DNA, 16 bp, Homo sapiens
tagaatgattaatcaa

SEQ ID NO: 1665267 - DNA, 20 bp, Homo sapiens
tagaatgcatctcatcaact

SEQ ID NO: 1665268 - DNA, 19 bp, Homo sapiens
tagaatggaggaagaacaa

SEQ ID NO: 1665269 - DNA, 19 bp, Homo sapiens
tagaatggtgattttaaat

SEQ ID NO: 1665270 - DNA, 23 bp, Homo sapiens
tagaatgtagtttgaggaaattt

SEQ ID NO: 1665271 - DNA, 21 bp, Homo sapiens
tagaattccttcgaaaggcct

SEQ ID NO: 1665272 - DNA, 22 bp, Homo sapiens
tagaattccttcgaaaggcctt

SEQ ID NO: 1665273 - DNA, 16 bp, Homo sapiens
tagaattctagtgctg

SEQ ID NO: 1665274 - DNA, 20 bp, Homo sapiens
tagaattctagtgctgctga

SEQ ID NO: 1665275 - DNA, 13 bp, Homo sapiens
tagaattgaaaat

SEQ ID NO: 1665276 - DNA, 16 bp, Homo sapiens
tagaattgctggatgc

SEQ ID NO: 1665277 - DNA, 13 bp, Homo sapiens
tagaattgtatat

SEQ ID NO: 1665278 - DNA, 15 bp, Homo sapiens
tagaattgtatatag

SEQ ID NO: 1665279 - DNA, 15 bp, Homo sapiens
tagaatttattcaat

SEQ ID NO: 1665280 - DNA, 23 bp, Homo sapiens
tagaattttaagcctttgttgaa

SEQ ID NO: 1665281 - DNA, 22 bp, Homo sapiens
tagaattttgagtattccatga

SEQ ID NO: 1665282 - DNA, 14 bp, Homo sapiens
tagacaaaaagtat

SEQ ID NO: 1665283 - DNA, 15 bp, Homo sapiens
tagacaaaaagtata

SEQ ID NO: 1665284 - DNA, 20 bp, Homo sapiens
tagacaaaaagtatattaaa

SEQ ID NO: 1665285 - DNA, 17 bp, Homo sapiens
tagacaaatagaaaatg

SEQ ID NO: 1665286 - DNA, 19 bp, Homo sapiens
tagacaaatagaaaatggt

SEQ ID NO: 1665287 - DNA, 19 bp, Homo sapiens
tagacaaatatttggaggg

SEQ ID NO: 1665288 - DNA, 15 bp, Homo sapiens
tagacaaatttgtgt

SEQ ID NO: 1665289 - DNA, 15 bp, Homo sapiens
tagacaacctttctg

SEQ ID NO: 1665290 - DNA, 17 bp, Homo sapiens
tagacaacctttctgta

SEQ ID NO: 1665291 - DNA, 13 bp, Homo sapiens
tagacaactagat

SEQ ID NO: 1665292 - DNA, 15 bp, Homo sapiens
tagacaactagattt

SEQ ID NO: 1665293 - DNA, 17 bp, Homo sapiens
tagacaactagatttgt

SEQ ID NO: 1665294 - DNA, 13 bp, Homo sapiens
tagacacatgaag

SEQ ID NO: 1665295 - DNA, 21 bp, Homo sapiens
tagacacatgaaggtaaataa

SEQ ID NO: 1665296 - DNA, 22 bp, Homo sapiens
tagacacatgaaggtaaataaa

SEQ ID NO: 1665297 - DNA, 18 bp, Homo sapiens
tagacaccaaagttctaa

SEQ ID NO: 1665298 - DNA, 21 bp, Homo sapiens
tagacaccaaagttctaataa

SEQ ID NO: 1665299 - DNA, 14 bp, Homo sapiens
tagacagaacacct

SEQ ID NO: 1665300 - DNA, 22 bp, Homo sapiens
tagacagatatttcaaacatca

SEQ ID NO: 1665301 - DNA, 18 bp, Homo sapiens
tagacagcaaaaactatc

SEQ ID NO: 1665302 - DNA, 14 bp, Homo sapiens
tagacagtaaaata

SEQ ID NO: 1665303 - DNA, 11 bp, Homo sapiens
tagacatgaaa

SEQ ID NO: 1665304 - DNA, 21 bp, Homo sapiens
tagacatggaggttctaaggc

SEQ ID NO: 1665305 - DNA, 20 bp, Homo sapiens
tagacatttgtgtggaaatc

SEQ ID NO: 1665306 - DNA, 21 bp, Homo sapiens
tagacatttgtgtggaaatca

SEQ ID NO: 1665307 - DNA, 13 bp, Homo sapiens
tagaccaaaataa

SEQ ID NO: 1665308 - DNA, 13 bp, Homo sapiens
tagaccaaagcaa

SEQ ID NO: 1665309 - DNA, 23 bp, Homo sapiens
tagaccacggctgccccttccac

SEQ ID NO: 1665310 - DNA, 19 bp, Homo sapiens
tagaccagcagacagagcc

SEQ ID NO: 1665311 - DNA, 22 bp, Homo sapiens
tagaccagcagacagagccagg

SEQ ID NO: 1665312 - DNA, 23 bp, Homo sapiens
tagaccatgtcttatcttgtttc

SEQ ID NO: 1665313 - DNA, 23 bp, Homo sapiens
tagaccatttatctgggattatg

SEQ ID NO: 1665314 - DNA, 13 bp, Homo sapiens
tagacccaggtgg

SEQ ID NO: 1665315 - DNA, 18 bp, Homo sapiens
tagaccccatacaagttt

SEQ ID NO: 1665316 - DNA, 15 bp, Homo sapiens
tagacccgccaggtc

SEQ ID NO: 1665317 - DNA, 18 bp, Homo sapiens
tagacccgccaggtcaag

SEQ ID NO: 1665318 - DNA, 20 bp, Homo sapiens
tagaccctgggtgggctctg

SEQ ID NO: 1665319 - DNA, 16 bp, Homo sapiens
tagacctacagacctg

SEQ ID NO: 1665320 - DNA, 12 bp, Homo sapiens
tagacctcagcc

SEQ ID NO: 1665321 - DNA, 21 bp, Homo sapiens
tagacctcagcctgtgctgcc

SEQ ID NO: 1665322 - DNA, 19 bp, Homo sapiens
tagaccttgttacttctga

SEQ ID NO: 1665323 - DNA, 18 bp, Homo sapiens
tagacgcccctcccaagc

SEQ ID NO: 1665324 - DNA, 18 bp, Homo sapiens
tagacgggttgaaagaca

SEQ ID NO: 1665325 - DNA, 14 bp, Homo sapiens
tagacggtgctcac

SEQ ID NO: 1665326 - DNA, 13 bp, Homo sapiens
tagactaaatgaa

SEQ ID NO: 1665327 - DNA, 14 bp, Homo sapiens
tagactaaatgaaa

SEQ ID NO: 1665328 - DNA, 14 bp, Homo sapiens
tagactactgttca

SEQ ID NO: 1665329 - DNA, 20 bp, Homo sapiens
tagcctccgtttatgggcct

SEQ ID NO: 1665330 - DNA, 15 bp, Homo sapiens
tagcctctcccaccc

SEQ ID NO: 1665331 - DNA, 19 bp, Homo sapiens
tagcctgatctttctagag

SEQ ID NO: 1665332 - DNA, 16 bp, Homo sapiens
tagcctgcctgatccc

SEQ ID NO: 1665333 - DNA, 22 bp, Homo sapiens
tagcctggatattattcttgta

SEQ ID NO: 1665334 - DNA, 20 bp, Homo sapiens
tagcctgggctcactgtgct

SEQ ID NO: 1665335 - DNA, 15 bp, Homo sapiens
tagcctggtggtttt

SEQ ID NO: 1665336 - DNA, 14 bp, Homo sapiens
tagccttattcacc

SEQ ID NO: 1665337 - DNA, 12 bp, Homo sapiens
tagccttgcttg

SEQ ID NO: 1665338 - DNA, 16 bp, Homo sapiens
tagccttgtgccctgc

SEQ ID NO: 1665339 - DNA, 19 bp, Homo sapiens
tagccttgtgccctgcccc

SEQ ID NO: 1665340 - DNA, 22 bp, Homo sapiens
tagcctttacctgtgaagtgtt

SEQ ID NO: 1665341 - DNA, 15 bp, Homo sapiens
tagcctttgccctgt

SEQ ID NO: 1665342 - DNA, 17 bp, Homo sapiens
tagcctttttgtataaa

SEQ ID NO: 1665343 - DNA, 17 bp, Homo sapiens
tagcgatctctcctggc

SEQ ID NO: 1665344 - DNA, 16 bp, Homo sapiens
tagcggagcccagcct

SEQ ID NO: 1665345 - DNA, 15 bp, Homo sapiens
tagcgtcctgccctg

SEQ ID NO: 1665346 - DNA, 16 bp, Homo sapiens
tagcgtcctgccctgc

SEQ ID NO: 1665347 - DNA, 18 bp, Homo sapiens
tagcgtcctgccctgccc

SEQ ID NO: 1665348 - DNA, 22 bp, Homo sapiens
tagcgttctggactctgcccca

SEQ ID NO: 1665349 - DNA, 22 bp, Homo sapiens
tagcgtttaaggtgagcataaa

SEQ ID NO: 1665350 - DNA, 12 bp, Homo sapiens
tagctaatgtaa

SEQ ID NO: 1665351 - DNA, 13 bp, Homo sapiens
tagctacagcttg

SEQ ID NO: 1665352 - DNA, 23 bp, Homo sapiens
tagctaccttctctacccatctc

SEQ ID NO: 1665353 - DNA, 20 bp, Homo sapiens
tagctagaagtgggccagga

SEQ ID NO: 1665354 - DNA, 12 bp, Homo sapiens
tagctagtagca

SEQ ID NO: 1665355 - DNA, 20 bp, Homo sapiens
tagctataacaactctattt

SEQ ID NO: 1665356 - DNA, 21 bp, Homo sapiens
tagctcactgaatcttcacga

SEQ ID NO: 1665357 - DNA, 18 bp, Homo sapiens
tagctcagtcatcaaagc

SEQ ID NO: 1665358 - DNA, 14 bp, Homo sapiens
tagctcccctccaa

SEQ ID NO: 1665359 - DNA, 17 bp, Homo sapiens
tagctccctcctcccat

SEQ ID NO: 1665360 - DNA, 23 bp, Homo sapiens
tagctcctataaagggcccacac

SEQ ID NO: 1665361 - DNA, 17 bp, Homo sapiens
tagctcctcctcctggg

SEQ ID NO: 1665362 - DNA, 20 bp, Homo sapiens
tagctcctgtggccccaccc

SEQ ID NO: 1665363 - DNA, 14 bp, Homo sapiens
tagctctctaggcc

SEQ ID NO: 1665364 - DNA, 22 bp, Homo sapiens
tagctgaaaagggcactcccaa

SEQ ID NO: 1665365 - DNA, 22 bp, Homo sapiens
tagctgaagaattgaaaagttt

SEQ ID NO: 1665366 - DNA, 21 bp, Homo sapiens
tagctgatgaacttattctgt

SEQ ID NO: 1665367 - DNA, 23 bp, Homo sapiens
tagctgatgaacttattctgtag

SEQ ID NO: 1665368 - DNA, 21 bp, Homo sapiens
tagctgcagataagtggcctt

SEQ ID NO: 1665369 - DNA, 11 bp, Homo sapiens
tagctggcagg

SEQ ID NO: 1665370 - DNA, 15 bp, Homo sapiens
tagctggcaggacac

SEQ ID NO: 1665371 - DNA, 16 bp, Homo sapiens
tagctggcaggacaca

SEQ ID NO: 1665372 - DNA, 19 bp, Homo sapiens
tagctggggcttcaccagt

SEQ ID NO: 1665373 - DNA, 20 bp, Homo sapiens
tagctgtaagggcagtgccc

SEQ ID NO: 1665374 - DNA, 21 bp, Homo sapiens
tagctgtagttttccctgcac

SEQ ID NO: 1665375 - DNA, 17 bp, Homo sapiens
tagctgtctagagtagc

SEQ ID NO: 1665376 - DNA, 21 bp, Homo sapiens
tagctgtctgctcagacagaa

SEQ ID NO: 1665377 - DNA, 10 bp, Homo sapiens
tagctgtggg

SEQ ID NO: 1665378 - DNA, 13 bp, Homo sapiens
tagctgtgggggt

SEQ ID NO: 1665379 - DNA, 14 bp, Homo sapiens
tagctgtgtgaaat

SEQ ID NO: 1665380 - DNA, 11 bp, Homo sapiens
tagctgtgtta

SEQ ID NO: 1665381 - DNA, 17 bp, Homo sapiens
tagctgttgagctgttt

SEQ ID NO: 1665382 - DNA, 14 bp, Homo sapiens
tagcttacactgag

SEQ ID NO: 1665383 - DNA, 15 bp, Homo sapiens
tagcttacactgagg

SEQ ID NO: 1665384 - DNA, 15 bp, Homo sapiens
tagcttacaggaagc

SEQ ID NO: 1665385 - DNA, 14 bp, Homo sapiens
tagcttactgataa

SEQ ID NO: 1665386 - DNA, 16 bp, Homo sapiens
tagcttagacctcagc

SEQ ID NO: 1665387 - DNA, 18 bp, Homo sapiens
tagcttagacctcagcct

SEQ ID NO: 1665388 - DNA, 19 bp, Homo sapiens
tagcttagacctcagcctg

SEQ ID NO: 1665389 - DNA, 20 bp, Homo sapiens
tagcttagacctcagcctgt

SEQ ID NO: 1665390 - DNA, 23 bp, Homo sapiens
tagcttagacctcagcctgtgct

SEQ ID NO: 1665391 - DNA, 17 bp, Homo sapiens
tagcttataagagggca

SEQ ID NO: 1665392 - DNA, 12 bp, Homo sapiens
tagcttccatga

SEQ ID NO: 1665393 - DNA, 12 bp, Homo sapiens
tagcttctgtgt

SEQ ID NO: 1665394 - DNA, 15 bp, Homo sapiens
tagcttctgtgtgtg

SEQ ID NO: 1665395 - DNA, 19 bp, Homo sapiens
tagctttaaaaccacagct

SEQ ID NO: 1665396 - DNA, 21 bp, Homo sapiens
tagctttaaaaccacagctgg

SEQ ID NO: 1665397 - DNA, 17 bp, Homo sapiens
tagctttagaccctggg

SEQ ID NO: 1665398 - DNA, 18 bp, Homo sapiens
tagctttagaccctgggt

SEQ ID NO: 1665399 - DNA, 15 bp, Homo sapiens
tagctttattcttca

SEQ ID NO: 1665400 - DNA, 15 bp, Homo sapiens
tagctttggaaagtt

SEQ ID NO: 1665401 - DNA, 16 bp, Homo sapiens
tagctttgggtgcctt

SEQ ID NO: 1665402 - DNA, 14 bp, Homo sapiens
tagcttttccttcc

SEQ ID NO: 1665403 - DNA, 16 bp, Homo sapiens
taggaaaaaattgaaa

SEQ ID NO: 1665404 - DNA, 22 bp, Homo sapiens
taggaaaaaattgaaagaactt

SEQ ID NO: 1665405 - DNA, 16 bp, Homo sapiens
taggaaatttaagact

SEQ ID NO: 1665406 - DNA, 20 bp, Homo sapiens
taggaacggtaaatttctgt

SEQ ID NO: 1665407 - DNA, 14 bp, Homo sapiens
taggaacttcagag

SEQ ID NO: 1665408 - DNA, 16 bp, Homo sapiens
taggaacttcagagat

SEQ ID NO: 1665409 - DNA, 23 bp, Homo sapiens
taggaagaacgttttttcctcag

SEQ ID NO: 1665410 - DNA, 21 bp, Homo sapiens
taggaagagcccgcagggcca

SEQ ID NO: 1665411 - DNA, 15 bp, Homo sapiens
taggaagggaccaag

SEQ ID NO: 1665412 - DNA, 18 bp, Homo sapiens
taggaagtgtaacagctg

SEQ ID NO: 1665413 - DNA, 20 bp, Homo sapiens
taggaagtgtaacagctgag

SEQ ID NO: 1665414 - DNA, 21 bp, Homo sapiens
taggaagtgtaacagctgagg

SEQ ID NO: 1665415 - DNA, 22 bp, Homo sapiens
taggaagtgtaacagctgaggt

SEQ ID NO: 1665416 - DNA, 16 bp, Homo sapiens
taggaataacactgca

SEQ ID NO: 1665417 - DNA, 22 bp, Homo sapiens
taggaatcattcagaaatgttg

SEQ ID NO: 1665418 - DNA, 22 bp, Homo sapiens
taggaatctcttcactaccctg

SEQ ID NO: 1665419 - DNA, 18 bp, Homo sapiens
taggaattaagttatctt

SEQ ID NO: 1665420 - DNA, 20 bp, Homo sapiens
taggacaatcagtcccctcc

SEQ ID NO: 1665421 - DNA, 20 bp, Homo sapiens
taggacaattactgtacaca

SEQ ID NO: 1665422 - DNA, 19 bp, Homo sapiens
taggacacagttcctggga

SEQ ID NO: 1665423 - DNA, 14 bp, Homo sapiens
taggacatcttaaa

SEQ ID NO: 1665424 - DNA, 22 bp, Homo sapiens
taggaccaagcatcttgggggg

SEQ ID NO: 1665425 - DNA, 19 bp, Homo sapiens
taggaccatggttaagagt

SEQ ID NO: 1665426 - DNA, 23 bp, Homo sapiens
taggacctgcatccttcctgggg

SEQ ID NO: 1665427 - DNA, 17 bp, Homo sapiens
taggactaccgcaggcc

SEQ ID NO: 1665428 - DNA, 19 bp, Homo sapiens
taggactaccgcaggcccg

SEQ ID NO: 1665429 - DNA, 13 bp, Homo sapiens
taggactcagaaa

SEQ ID NO: 1665430 - DNA, 18 bp, Homo sapiens
taggactctgaggctctt

SEQ ID NO: 1665431 - DNA, 14 bp, Homo sapiens
taggactgcagtgt

SEQ ID NO: 1665432 - DNA, 21 bp, Homo sapiens
taggacttaaaattagtcttt

SEQ ID NO: 1665433 - DNA, 21 bp, Homo sapiens
taggagaatagcagagagcca

SEQ ID NO: 1665434 - DNA, 21 bp, Homo sapiens
taggagacacgacagcacaca

SEQ ID NO: 1665435 - DNA, 17 bp, Homo sapiens
taggagacagagccaag

SEQ ID NO: 1665436 - DNA, 20 bp, Homo sapiens
taggagacttgccagagccg

SEQ ID NO: 1665437 - DNA, 23 bp, Homo sapiens
taggagagtcggtctgctttgga

SEQ ID NO: 1665438 - DNA, 19 bp, Homo sapiens
taggagcactggggtgggg

SEQ ID NO: 1665439 - DNA, 11 bp, Homo sapiens
taggagcccca

SEQ ID NO: 1665440 - DNA, 14 bp, Homo sapiens
taggagccccagct

SEQ ID NO: 1665441 - DNA, 14 bp, Homo sapiens
taggagctgggagg

SEQ ID NO: 1665442 - DNA, 18 bp, Homo sapiens
taggagctgggaggaaaa

SEQ ID NO: 1665443 - DNA, 13 bp, Homo sapiens
tagtgcttgctgg

SEQ ID NO: 1665444 - DNA, 23 bp, Homo sapiens
tagtggaagagcagcctgatggc

SEQ ID NO: 1665445 - DNA, 15 bp, Homo sapiens
tagtggatggaatat

SEQ ID NO: 1665446 - DNA, 17 bp, Homo sapiens
tagtggattactgccat

SEQ ID NO: 1665447 - DNA, 23 bp, Homo sapiens
tagtggattactgccattcactt

SEQ ID NO: 1665448 - DNA, 13 bp, Homo sapiens
tagtgggcaggtg

SEQ ID NO: 1665449 - DNA, 17 bp, Homo sapiens
tagtggggcctgggagg

SEQ ID NO: 1665450 - DNA, 20 bp, Homo sapiens
tagtggggtctccctctcct

SEQ ID NO: 1665451 - DNA, 21 bp, Homo sapiens
tagtggggtctccctctcctg

SEQ ID NO: 1665452 - DNA, 14 bp, Homo sapiens
tagtggtagtatct

SEQ ID NO: 1665453 - DNA, 14 bp, Homo sapiens
tagtggtcataaaa

SEQ ID NO: 1665454 - DNA, 23 bp, Homo sapiens
tagtgtaacttgcttaaatttct

SEQ ID NO: 1665455 - DNA, 18 bp, Homo sapiens
tagtgtaagaactgtaca

SEQ ID NO: 1665456 - DNA, 21 bp, Homo sapiens
tagtgtacctcctctcagtgt

SEQ ID NO: 1665457 - DNA, 18 bp, Homo sapiens
tagtgtattaatcataga

SEQ ID NO: 1665458 - DNA, 17 bp, Homo sapiens
tagtgtcatcactcttt

SEQ ID NO: 1665459 - DNA, 22 bp, Homo sapiens
tagtgtgaatattaattagttt

SEQ ID NO: 1665460 - DNA, 19 bp, Homo sapiens
tagtgtgacagtttccaaa

SEQ ID NO: 1665461 - DNA, 17 bp, Homo sapiens
tagtgtgagtggcagcc

SEQ ID NO: 1665462 - DNA, 12 bp, Homo sapiens
tagtgtgtgtgc

SEQ ID NO: 1665463 - DNA, 20 bp, Homo sapiens
tagtgtgtgtgcagagtcca

SEQ ID NO: 1665464 - DNA, 17 bp, Homo sapiens
tagtgtgtgtgcatgtg

SEQ ID NO: 1665465 - DNA, 19 bp, Homo sapiens
tagtgtgtgtgcatgtgtg

SEQ ID NO: 1665466 - DNA, 13 bp, Homo sapiens
tagtgttcacaaa

SEQ ID NO: 1665467 - DNA, 14 bp, Homo sapiens
tagtgttcacaaac

SEQ ID NO: 1665468 - DNA, 19 bp, Homo sapiens
tagtgttcacaaactgtga

SEQ ID NO: 1665469 - DNA, 21 bp, Homo sapiens
tagtgttcacaaactgtgaaa

SEQ ID NO: 1665470 - DNA, 15 bp, Homo sapiens
tagtgttctgctcct

SEQ ID NO: 1665471 - DNA, 16 bp, Homo sapiens
tagtgttctgctcctg

SEQ ID NO: 1665472 - DNA, 17 bp, Homo sapiens
tagtgttctgctcctgc

SEQ ID NO: 1665473 - DNA, 20 bp, Homo sapiens
tagtgttctgctcctgcttt

SEQ ID NO: 1665474 - DNA, 23 bp, Homo sapiens
tagttaaaagactgcagctgctg

SEQ ID NO: 1665475 - DNA, 18 bp, Homo sapiens
tagttaaagaaaggaaaa

SEQ ID NO: 1665476 - DNA, 20 bp, Homo sapiens
tagttaaatgttacctctga

SEQ ID NO: 1665477 - DNA, 19 bp, Homo sapiens
tagttaacctagaagtatt

SEQ ID NO: 1665478 - DNA, 18 bp, Homo sapiens
tagttaaggtgtgcaaag

SEQ ID NO: 1665479 - DNA, 20 bp, Homo sapiens
tagttaaggtgtgcaaagat

SEQ ID NO: 1665480 - DNA, 14 bp, Homo sapiens
tagttaccttatag

SEQ ID NO: 1665481 - DNA, 22 bp, Homo sapiens
tagttaccttatagttactgtg

SEQ ID NO: 1665482 - DNA, 14 bp, Homo sapiens
tagttactgtaaaa

SEQ ID NO: 1665483 - DNA, 16 bp, Homo sapiens
tagttagatctttgta

SEQ ID NO: 1665484 - DNA, 19 bp, Homo sapiens
tagttagcatgcgcgctgt

SEQ ID NO: 1665485 - DNA, 23 bp, Homo sapiens
tagttagtttggaaatggtactt

SEQ ID NO: 1665486 - DNA, 18 bp, Homo sapiens
tagttattattgctgttt

SEQ ID NO: 1665487 - DNA, 21 bp, Homo sapiens
tagttccagaaaacctctcct

SEQ ID NO: 1665488 - DNA, 16 bp, Homo sapiens
tagttcctgtggccag

SEQ ID NO: 1665489 - DNA, 18 bp, Homo sapiens
tagttcctgtggccagga

SEQ ID NO: 1665490 - DNA, 15 bp, Homo sapiens
tagttccttgcctta

SEQ ID NO: 1665491 - DNA, 16 bp, Homo sapiens
tagttccttgccttaa

SEQ ID NO: 1665492 - DNA, 19 bp, Homo sapiens
tagttccttgccttaataa

SEQ ID NO: 1665493 - DNA, 14 bp, Homo sapiens
tagttctaagactc

SEQ ID NO: 1665494 - DNA, 11 bp, Homo sapiens
tagttctagac

SEQ ID NO: 1665495 - DNA, 12 bp, Homo sapiens
tagttctagaca

SEQ ID NO: 1665496 - DNA, 22 bp, Homo sapiens
tagttctatcaggaaaacaaat

SEQ ID NO: 1665497 - DNA, 9 bp, Homo sapiens
tagttctgt

SEQ ID NO: 1665498 - DNA, 18 bp, Homo sapiens
tagttctgtgtacttttt

SEQ ID NO: 1665499 - DNA, 18 bp, Homo sapiens
tagttcttagctttgaaa

SEQ ID NO: 1665500 - DNA, 19 bp, Homo sapiens
tagttgaaaggcctcaaga

SEQ ID NO: 1665501 - DNA, 21 bp, Homo sapiens
tagttgaacaagatttcccta

SEQ ID NO: 1665502 - DNA, 23 bp, Homo sapiens
tagttgaacaagatttccctaaa

SEQ ID NO: 1665503 - DNA, 23 bp, Homo sapiens
tagttgaattttttttaacattc

SEQ ID NO: 1665504 - DNA, 18 bp, Homo sapiens
tagttgacaacctagaat

SEQ ID NO: 1665505 - DNA, 17 bp, Homo sapiens
tagttgagccccaagtc

SEQ ID NO: 1665506 - DNA, 12 bp, Homo sapiens
tagttgaggccg

SEQ ID NO: 1665507 - DNA, 14 bp, Homo sapiens
tagttgcaattgaa

SEQ ID NO: 1665508 - DNA, 17 bp, Homo sapiens
tagttgcactaactgct

SEQ ID NO: 1665509 - DNA, 18 bp, Homo sapiens
tagttgcagactcagttt

SEQ ID NO: 1665510 - DNA, 23 bp, Homo sapiens
tagttgcagactcagtttgtcag

SEQ ID NO: 1665511 - DNA, 19 bp, Homo sapiens
tagttgcatagcagtatat

SEQ ID NO: 1665512 - DNA, 17 bp, Homo sapiens
tagttgccttaaaataa

SEQ ID NO: 1665513 - DNA, 22 bp, Homo sapiens
tagttgcgtggactctgcacat

SEQ ID NO: 1665514 - DNA, 13 bp, Homo sapiens
tagttgcttgcct

SEQ ID NO: 1665515 - DNA, 19 bp, Homo sapiens
tagttgggagagttggaga

SEQ ID NO: 1665516 - DNA, 15 bp, Homo sapiens
tagttgggatgccaa

SEQ ID NO: 1665517 - DNA, 21 bp, Homo sapiens
tagttgggatgccaatttcct

SEQ ID NO: 1665518 - DNA, 23 bp, Homo sapiens
tagttggtaatgcttggaatggc

SEQ ID NO: 1665519 - DNA, 20 bp, Homo sapiens
tagttgtagacaaagtacat

SEQ ID NO: 1665520 - DNA, 20 bp, Homo sapiens
tagtttacagaaaaatcttg

SEQ ID NO: 1665521 - DNA, 22 bp, Homo sapiens
tagtttacctgaataaatggta

SEQ ID NO: 1665522 - DNA, 11 bp, Homo sapiens
tagtttactgt

SEQ ID NO: 1665523 - DNA, 21 bp, Homo sapiens
tagtttatattactctcattc

SEQ ID NO: 1665524 - DNA, 18 bp, Homo sapiens
tagtttatgatgcaaatc

SEQ ID NO: 1665525 - DNA, 13 bp, Homo sapiens
tagtttccagtgg

SEQ ID NO: 1665526 - DNA, 16 bp, Homo sapiens
tagtttctttctgtct

SEQ ID NO: 1665527 - DNA, 17 bp, Homo sapiens
tagtttgcatttcagaa

SEQ ID NO: 1665528 - DNA, 18 bp, Homo sapiens
tagtttgcatttcagaaa

SEQ ID NO: 1665529 - DNA, 22 bp, Homo sapiens
tagtttgtctattttaaaataa

SEQ ID NO: 1665530 - DNA, 19 bp, Homo sapiens
tagtttgtgtgttgtctct

SEQ ID NO: 1665531 - DNA, 14 bp, Homo sapiens
tagttttactttta

SEQ ID NO: 1665532 - DNA, 14 bp, Homo sapiens
tagttttagaggca

SEQ ID NO: 1665533 - DNA, 20 bp, Homo sapiens
tagttttagaggcattgtta

SEQ ID NO: 1665534 - DNA, 12 bp, Homo sapiens
tagttttcaaaa

SEQ ID NO: 1665535 - DNA, 15 bp, Homo sapiens
tagttttcagccttg

SEQ ID NO: 1665536 - DNA, 13 bp, Homo sapiens
tagttttgtcaaa

SEQ ID NO: 1665537 - DNA, 22 bp, Homo sapiens
tagtttttaacaatctaacaat

SEQ ID NO: 1665538 - DNA, 20 bp, Homo sapiens
tagtttttacagctgtgtta

SEQ ID NO: 1665539 - DNA, 18 bp, Homo sapiens
tagtttttacctaccaca

SEQ ID NO: 1665540 - DNA, 15 bp, Homo sapiens
tagtttttatatgtt

SEQ ID NO: 1665541 - DNA, 14 bp, Homo sapiens
tagtttttcagcta

SEQ ID NO: 1665542 - DNA, 14 bp, Homo sapiens
tagtttttcagctt

SEQ ID NO: 1665543 - DNA, 23 bp, Homo sapiens
tagtttttgatcaagaatgcaat

SEQ ID NO: 1665544 - DNA, 14 bp, Homo sapiens
tataaaaaatggtt

SEQ ID NO: 1665545 - DNA, 16 bp, Homo sapiens
tataaaaaatggttca

SEQ ID NO: 1665546 - DNA, 16 bp, Homo sapiens
tataaaaaatgtaaca

SEQ ID NO: 1665547 - DNA, 21 bp, Homo sapiens
tataaaaagaaaagataaaga

SEQ ID NO: 1665548 - DNA, 23 bp, Homo sapiens
tataaaaagaaaagataaagatg

SEQ ID NO: 1665549 - DNA, 19 bp, Homo sapiens
tataaaaataaaaaagatc

SEQ ID NO: 1665550 - DNA, 22 bp, Homo sapiens
tataaaaataaaaaagatccca

SEQ ID NO: 1665551 - DNA, 18 bp, Homo sapiens
tataaaacttaaaaacaa

SEQ ID NO: 1665552 - DNA, 19 bp, Homo sapiens
tataaaaggcaaatgtgta

SEQ ID NO: 1665553 - DNA, 17 bp, Homo sapiens
tataaaaggttgccaaa

SEQ ID NO: 1665554 - DNA, 12 bp, Homo sapiens
tataaaatagac

SEQ ID NO: 1665555 - DNA, 19 bp, Homo sapiens
tataaaatataaacaaaga

SEQ ID NO: 1665556 - DNA, 22 bp, Homo sapiens
tataaaatccaaaatgaatgca

SEQ ID NO: 1665557 - DNA, 18 bp, Homo sapiens
tatatatctatatcatat

SEQ ID NO: 1665558 - DNA, 13 bp, Homo sapiens
tatatatctatta

SEQ ID NO: 1665559 - DNA, 19 bp, Homo sapiens
tatatatggtcatatacat

SEQ ID NO: 1665560 - DNA, 21 bp, Homo sapiens
tatatatgtgtatgcacagta

SEQ ID NO: 1665561 - DNA, 23 bp, Homo sapiens
tatatatgtgtatgcacagtaaa

SEQ ID NO: 1665562 - DNA, 14 bp, Homo sapiens
tatatattaagtgt

SEQ ID NO: 1665563 - DNA, 23 bp, Homo sapiens
tatatattaggatctgcaaacaa

SEQ ID NO: 1665564 - DNA, 20 bp, Homo sapiens
tatatattcttataaaaatg

SEQ ID NO: 1665565 - DNA, 19 bp, Homo sapiens
tatatatttctaactatat

SEQ ID NO: 1665566 - DNA, 18 bp, Homo sapiens
tatatattttgtgtgaaa

SEQ ID NO: 1665567 - DNA, 23 bp, Homo sapiens
tatatattttgtgtgaaattgca

SEQ ID NO: 1665568 - DNA, 20 bp, Homo sapiens
tatatatttttggttgtcaa

SEQ ID NO: 1665569 - DNA, 16 bp, Homo sapiens
tatatcaaaaaacctt

SEQ ID NO: 1665570 - DNA, 15 bp, Homo sapiens
tatatcagcctgagt

SEQ ID NO: 1665571 - DNA, 22 bp, Homo sapiens
tatatcagtcgttttagtgtct

SEQ ID NO: 1665572 - DNA, 14 bp, Homo sapiens
tatatcataactat

SEQ ID NO: 1665573 - DNA, 17 bp, Homo sapiens
tatatcattctaaagat

SEQ ID NO: 1665574 - DNA, 14 bp, Homo sapiens
tatatcctgtgact

SEQ ID NO: 1665575 - DNA, 15 bp, Homo sapiens
tatatcctgtgactg

SEQ ID NO: 1665576 - DNA, 17 bp, Homo sapiens
tatatcctgtgactgtc

SEQ ID NO: 1665577 - DNA, 17 bp, Homo sapiens
tatatctatatatataa

SEQ ID NO: 1665578 - DNA, 14 bp, Homo sapiens
tatatctatatcat

SEQ ID NO: 1665579 - DNA, 12 bp, Homo sapiens
tatatctccttt

SEQ ID NO: 1665580 - DNA, 15 bp, Homo sapiens
tatatctctatttga

SEQ ID NO: 1665581 - DNA, 18 bp, Homo sapiens
tatatgaagaaaatcact

SEQ ID NO: 1665582 - DNA, 19 bp, Homo sapiens
tatatgaagaaaatcactt

SEQ ID NO: 1665583 - DNA, 16 bp, Homo sapiens
tatatgaataaagtgt

SEQ ID NO: 1665584 - DNA, 15 bp, Homo sapiens
tatatgatgaaattc

SEQ ID NO: 1665585 - DNA, 21 bp, Homo sapiens
tatatgatgaaattcttatgt

SEQ ID NO: 1665586 - DNA, 15 bp, Homo sapiens
tatatgcaatgtcca

SEQ ID NO: 1665587 - DNA, 15 bp, Homo sapiens
tatatgcacacatat

SEQ ID NO: 1665588 - DNA, 19 bp, Homo sapiens
tatatgcatatatatatgt

SEQ ID NO: 1665589 - DNA, 20 bp, Homo sapiens
tatatgctctgcatgttaca

SEQ ID NO: 1665590 - DNA, 18 bp, Homo sapiens
tatatgctttattaatgt

SEQ ID NO: 1665591 - DNA, 19 bp, Homo sapiens
tatatgctttttctcagat

SEQ ID NO: 1665592 - DNA, 19 bp, Homo sapiens
tatatggatgattcagaaa

SEQ ID NO: 1665593 - DNA, 22 bp, Homo sapiens
tatatggatgattcagaaattg

SEQ ID NO: 1665594 - DNA, 17 bp, Homo sapiens
tatatggttctccaaga

SEQ ID NO: 1665595 - DNA, 23 bp, Homo sapiens
tatatggttctccaagaaactga

SEQ ID NO: 1665596 - DNA, 13 bp, Homo sapiens
tatatgtatatat

SEQ ID NO: 1665597 - DNA, 14 bp, Homo sapiens
tatatgtatatgta

SEQ ID NO: 1665598 - DNA, 17 bp, Homo sapiens
tatatgtatatgtatat

SEQ ID NO: 1665599 - DNA, 21 bp, Homo sapiens
tatatgtatggatctatattt

SEQ ID NO: 1665600 - DNA, 14 bp, Homo sapiens
tatatgtattccct

SEQ ID NO: 1665601 - DNA, 18 bp, Homo sapiens
tatatgtgcagtcttgct

SEQ ID NO: 1665602 - DNA, 17 bp, Homo sapiens
tatatgtgccacatttt

SEQ ID NO: 1665603 - DNA, 14 bp, Homo sapiens
tatatgtgtatgta

SEQ ID NO: 1665604 - DNA, 14 bp, Homo sapiens
tatatgtgtgccta

SEQ ID NO: 1665605 - DNA, 14 bp, Homo sapiens
tatatgttggttta

SEQ ID NO: 1665606 - DNA, 15 bp, Homo sapiens
tatatgttgtaataa

SEQ ID NO: 1665607 - DNA, 20 bp, Homo sapiens
tatatgtttaccttttaatt

SEQ ID NO: 1665608 - DNA, 14 bp, Homo sapiens
tatatgtttatata

SEQ ID NO: 1665609 - DNA, 15 bp, Homo sapiens
tatattaaaacaata

SEQ ID NO: 1665610 - DNA, 22 bp, Homo sapiens
tatattaaacatacataataca

SEQ ID NO: 1665611 - DNA, 14 bp, Homo sapiens
tatattaaagtaaa

SEQ ID NO: 1665612 - DNA, 13 bp, Homo sapiens
tatattaagcaga

SEQ ID NO: 1665613 - DNA, 15 bp, Homo sapiens
tatattaagcagaaa

SEQ ID NO: 1665614 - DNA, 20 bp, Homo sapiens
tatattaagtgtgccaaatc

SEQ ID NO: 1665615 - DNA, 11 bp, Homo sapiens
tatattacaag

SEQ ID NO: 1665616 - DNA, 17 bp, Homo sapiens
tatattagctgaaacaa

SEQ ID NO: 1665617 - DNA, 22 bp, Homo sapiens
tatattaggatctgcaaacaat

SEQ ID NO: 1665618 - DNA, 19 bp, Homo sapiens
tatattatgtcttcttttg

SEQ ID NO: 1665619 - DNA, 12 bp, Homo sapiens
tatattattata

SEQ ID NO: 1665620 - DNA, 20 bp, Homo sapiens
tatattcaatgcatttaaaa

SEQ ID NO: 1665621 - DNA, 22 bp, Homo sapiens
tatattcatatacaaacatgta

SEQ ID NO: 1665622 - DNA, 12 bp, Homo sapiens
tatattctttca

SEQ ID NO: 1665623 - DNA, 21 bp, Homo sapiens
tatattgaacttttgtactga

SEQ ID NO: 1665624 - DNA, 17 bp, Homo sapiens
tatattgaagacaattt

SEQ ID NO: 1665625 - DNA, 18 bp, Homo sapiens
tatattgaagacaatttg

SEQ ID NO: 1665626 - DNA, 20 bp, Homo sapiens
tatattggaattataaatat

SEQ ID NO: 1665627 - DNA, 22 bp, Homo sapiens
tatattgtacaaatgtaagcaa

SEQ ID NO: 1665628 - DNA, 17 bp, Homo sapiens
tatattgtatcatttga

SEQ ID NO: 1665629 - DNA, 19 bp, Homo sapiens
tatattgtcagatattttt

SEQ ID NO: 1665630 - DNA, 15 bp, Homo sapiens
tatattgttgaagag

SEQ ID NO: 1665631 - DNA, 17 bp, Homo sapiens
tatatttaaaaattgtt

SEQ ID NO: 1665632 - DNA, 22 bp, Homo sapiens
tatatttaaaaattgtttcttg

SEQ ID NO: 1665633 - DNA, 15 bp, Homo sapiens
tatatttaatgataa

SEQ ID NO: 1665634 - DNA, 20 bp, Homo sapiens
tatatttacatgctactaaa

SEQ ID NO: 1665635 - DNA, 12 bp, Homo sapiens
tatatttataac

SEQ ID NO: 1665636 - DNA, 14 bp, Homo sapiens
tatatttataactc

SEQ ID NO: 1665637 - DNA, 12 bp, Homo sapiens
tatatttatact

SEQ ID NO: 1665638 - DNA, 14 bp, Homo sapiens
tatatttatactct

SEQ ID NO: 1665639 - DNA, 11 bp, Homo sapiens
tatatttcctt

SEQ ID NO: 1665640 - DNA, 14 bp, Homo sapiens
tatatttcctttat

SEQ ID NO: 1665641 - DNA, 16 bp, Homo sapiens
tatatttcctttatgt

SEQ ID NO: 1665642 - DNA, 20 bp, Homo sapiens
tatatttcctttatgtgaat

SEQ ID NO: 1665643 - DNA, 13 bp, Homo sapiens
tatatttctatta

SEQ ID NO: 1665644 - DNA, 14 bp, Homo sapiens
tatatttcttcttc

SEQ ID NO: 1665645 - DNA, 16 bp, Homo sapiens
tatatttgaaatagta

SEQ ID NO: 1665646 - DNA, 21 bp, Homo sapiens
tatatttgaaatagtatacat

SEQ ID NO: 1665647 - DNA, 21 bp, Homo sapiens
tatatttgattatgtatggat

SEQ ID NO: 1665648 - DNA, 14 bp, Homo sapiens
tatatttggaaaga

SEQ ID NO: 1665649 - DNA, 18 bp, Homo sapiens
tatatttggaaagagacc

SEQ ID NO: 1665650 - DNA, 21 bp, Homo sapiens
tatatttgggttatgatgtca

SEQ ID NO: 1665651 - DNA, 15 bp, Homo sapiens
tatatttgtaaagct

SEQ ID NO: 1665652 - DNA, 12 bp, Homo sapiens
tatatttgtaca

SEQ ID NO: 1665653 - DNA, 15 bp, Homo sapiens
tatatttgtacaaaa

SEQ ID NO: 1665654 - DNA, 15 bp, Homo sapiens
tatatttgtcttccg

SEQ ID NO: 1665655 - DNA, 15 bp, Homo sapiens
tatattttaatagaa

SEQ ID NO: 1665656 - DNA, 22 bp, Homo sapiens
tatattttaatgtttttaaaaa

SEQ ID NO: 1665657 - DNA, 14 bp, Homo sapiens
tatattttatgaac

SEQ ID NO: 1665658 - DNA, 20 bp, Homo sapiens
tatattttatgaacattgta

SEQ ID NO: 1665659 - DNA, 14 bp, Homo sapiens
tatattttcagtac

SEQ ID NO: 1665660 - DNA, 17 bp, Homo sapiens
tatattttgttgttcct

SEQ ID NO: 1665661 - DNA, 17 bp, Homo sapiens
tatatttttaagataat

SEQ ID NO: 1665662 - DNA, 19 bp, Homo sapiens
tatatttttggttgtcaat

SEQ ID NO: 1665663 - DNA, 12 bp, Homo sapiens
tatatttttgta

SEQ ID NO: 1665664 - DNA, 15 bp, Homo sapiens
tatatttttgtacat

SEQ ID NO: 1665665 - DNA, 16 bp, Homo sapiens
tatatttttgtacata

SEQ ID NO: 1665666 - DNA, 16 bp, Homo sapiens
tatatttttgtgtttt

SEQ ID NO: 1665667 - DNA, 18 bp, Homo sapiens
tatatttttgtgttttct

SEQ ID NO: 1665668 - DNA, 21 bp, Homo sapiens
tatcaaaaagctaatgtgcag

SEQ ID NO: 1665669 - DNA, 23 bp, Homo sapiens
tatcaaaaagtattatcattgct

SEQ ID NO: 1665670 - DNA, 15 bp, Homo sapiens
tatcaaacattaaaa

SEQ ID NO: 1665671 - DNA, 19 bp, Homo sapiens
tatcaaaccctagccttgc

SEQ ID NO: 1665672 - DNA, 21 bp, Homo sapiens
tatgactaaagagagaatgta

SEQ ID NO: 1665673 - DNA, 15 bp, Homo sapiens
tatgactacattttg

SEQ ID NO: 1665674 - DNA, 13 bp, Homo sapiens
tatgactttttat

SEQ ID NO: 1665675 - DNA, 21 bp, Homo sapiens
tatgagatggttaaaaaggcc

SEQ ID NO: 1665676 - DNA, 16 bp, Homo sapiens
tatgagccagacaaat

SEQ ID NO: 1665677 - DNA, 17 bp, Homo sapiens
tatgagccagacaaatg

SEQ ID NO: 1665678 - DNA, 15 bp, Homo sapiens
tatgagcctgccctc

SEQ ID NO: 1665679 - DNA, 18 bp, Homo sapiens
tatgagcttccttctgtg

SEQ ID NO: 1665680 - DNA, 23 bp, Homo sapiens
tatgaggacttgtgtctctgtgc

SEQ ID NO: 1665681 - DNA, 13 bp, Homo sapiens
tatgaggagggga

SEQ ID NO: 1665682 - DNA, 15 bp, Homo sapiens
tatgagggaaaatga

SEQ ID NO: 1665683 - DNA, 14 bp, Homo sapiens
tatgagggggtggt

SEQ ID NO: 1665684 - DNA, 14 bp, Homo sapiens
tatgagtctagatg

SEQ ID NO: 1665685 - DNA, 22 bp, Homo sapiens
tatgagttgttttcagactcag

SEQ ID NO: 1665686 - DNA, 21 bp, Homo sapiens
tatgagtttttgatagcttta

SEQ ID NO: 1665687 - DNA, 23 bp, Homo sapiens
tatgagtttttgatagctttatt

SEQ ID NO: 1665688 - DNA, 16 bp, Homo sapiens
tatgataatagattct

SEQ ID NO: 1665689 - DNA, 15 bp, Homo sapiens
tatgatattttctgt

SEQ ID NO: 1665690 - DNA, 15 bp, Homo sapiens
tatgatcgtccctgg

SEQ ID NO: 1665691 - DNA, 13 bp, Homo sapiens
tatgatctaataa

SEQ ID NO: 1665692 - DNA, 15 bp, Homo sapiens
tatgatctaataaac

SEQ ID NO: 1665693 - DNA, 21 bp, Homo sapiens
tatgatgcatacagttttcta

SEQ ID NO: 1665694 - DNA, 12 bp, Homo sapiens
tatgatgctaag

SEQ ID NO: 1665695 - DNA, 15 bp, Homo sapiens
tatgatggagcaact

SEQ ID NO: 1665696 - DNA, 22 bp, Homo sapiens
tatgatggcaggtcctctgttg

SEQ ID NO: 1665697 - DNA, 13 bp, Homo sapiens
tatgatggtgaca

SEQ ID NO: 1665698 - DNA, 21 bp, Homo sapiens
tatgattcagattgttatcta

SEQ ID NO: 1665699 - DNA, 14 bp, Homo sapiens
tatgattctctgtg

SEQ ID NO: 1665700 - DNA, 22 bp, Homo sapiens
tatgattctcttgagataaggt

SEQ ID NO: 1665701 - DNA, 14 bp, Homo sapiens
tatgatttaaaaca

SEQ ID NO: 1665702 - DNA, 19 bp, Homo sapiens
tatgatttataaacagaca

SEQ ID NO: 1665703 - DNA, 20 bp, Homo sapiens
tatgatttataaacagacaa

SEQ ID NO: 1665704 - DNA, 16 bp, Homo sapiens
tatgattttatttgac

SEQ ID NO: 1665705 - DNA, 22 bp, Homo sapiens
tatgcaaaagcagctaaatgta

SEQ ID NO: 1665706 - DNA, 11 bp, Homo sapiens
tatgcaaaagg

SEQ ID NO: 1665707 - DNA, 20 bp, Homo sapiens
tatgcaaaatagacatcttt

SEQ ID NO: 1665708 - DNA, 22 bp, Homo sapiens
tatgcaaaatagacatctttaa

SEQ ID NO: 1665709 - DNA, 17 bp, Homo sapiens
tatgcaaacctcatctt

SEQ ID NO: 1665710 - DNA, 20 bp, Homo sapiens
tatgcaaatgcctccaagcc

SEQ ID NO: 1665711 - DNA, 23 bp, Homo sapiens
tatgcaatgctatcactgtcttt

SEQ ID NO: 1665712 - DNA, 15 bp, Homo sapiens
tatgcaatgcttcat

SEQ ID NO: 1665713 - DNA, 20 bp, Homo sapiens
tatgcaatgtatagtgtcta

SEQ ID NO: 1665714 - DNA, 15 bp, Homo sapiens
tatgcacaattccat

SEQ ID NO: 1665715 - DNA, 20 bp, Homo sapiens
tatgcacaattccatgacaa

SEQ ID NO: 1665716 - DNA, 21 bp, Homo sapiens
tatgcacacctcccaccccct

SEQ ID NO: 1665717 - DNA, 20 bp, Homo sapiens
tatgcacatatggactctgc

SEQ ID NO: 1665718 - DNA, 18 bp, Homo sapiens
tatgcaccttgtgtctgt

SEQ ID NO: 1665719 - DNA, 19 bp, Homo sapiens
tatgcaccttgtgtctgta

SEQ ID NO: 1665720 - DNA, 15 bp, Homo sapiens
tatgcactgtggttt

SEQ ID NO: 1665721 - DNA, 16 bp, Homo sapiens
tatgcactgtggtttc

SEQ ID NO: 1665722 - DNA, 23 bp, Homo sapiens
tatgcactgtggtttcagatgtg

SEQ ID NO: 1665723 - DNA, 16 bp, Homo sapiens
tatgcagacagtctgt

SEQ ID NO: 1665724 - DNA, 13 bp, Homo sapiens
tatgcagccaacc

SEQ ID NO: 1665725 - DNA, 20 bp, Homo sapiens
tatgcagggagcactgttca

SEQ ID NO: 1665726 - DNA, 22 bp, Homo sapiens
tatgcagttgataagaggaatt

SEQ ID NO: 1665727 - DNA, 13 bp, Homo sapiens
tatgcataaagcc

SEQ ID NO: 1665728 - DNA, 20 bp, Homo sapiens
tatgcatatatatatgtgtg

SEQ ID NO: 1665729 - DNA, 15 bp, Homo sapiens
tatgcatatttgttt

SEQ ID NO: 1665730 - DNA, 22 bp, Homo sapiens
tatgcatgaaatgaatgtctga

SEQ ID NO: 1665731 - DNA, 18 bp, Homo sapiens
tatgcatggtgccccagg

SEQ ID NO: 1665732 - DNA, 22 bp, Homo sapiens
tatgcatggtgccccaggacca

SEQ ID NO: 1665733 - DNA, 14 bp, Homo sapiens
tatgcattatatca

SEQ ID NO: 1665734 - DNA, 15 bp, Homo sapiens
tatgcatttcattca

SEQ ID NO: 1665735 - DNA, 23 bp, Homo sapiens
tatgcatttcattcaaatcagtg

SEQ ID NO: 1665736 - DNA, 14 bp, Homo sapiens
tatgccaaagatca

SEQ ID NO: 1665737 - DNA, 17 bp, Homo sapiens
tatgccacacctggcct

SEQ ID NO: 1665738 - DNA, 15 bp, Homo sapiens
tatgccacttccttt

SEQ ID NO: 1665739 - DNA, 23 bp, Homo sapiens
tatgccccagttcagaaatttgg

SEQ ID NO: 1665740 - DNA, 15 bp, Homo sapiens
tatgccggatgtgct

SEQ ID NO: 1665741 - DNA, 22 bp, Homo sapiens
tatgcctgagttataaatattt

SEQ ID NO: 1665742 - DNA, 17 bp, Homo sapiens
tatgcctgtatttccaa

SEQ ID NO: 1665743 - DNA, 13 bp, Homo sapiens
tatgccttaagca

SEQ ID NO: 1665744 - DNA, 14 bp, Homo sapiens
tatgccttgtataa

SEQ ID NO: 1665745 - DNA, 16 bp, Homo sapiens
tatgcctttaaatctg

SEQ ID NO: 1665746 - DNA, 22 bp, Homo sapiens
tatgcctttaaatctgtgatga

SEQ ID NO: 1665747 - DNA, 14 bp, Homo sapiens
tatgcctttagtca

SEQ ID NO: 1665748 - DNA, 13 bp, Homo sapiens
tatgctaatcagg

SEQ ID NO: 1665749 - DNA, 22 bp, Homo sapiens
tatgctaatttttggagaaatg

SEQ ID NO: 1665750 - DNA, 18 bp, Homo sapiens
tatgctctacccttgtgt

SEQ ID NO: 1665751 - DNA, 16 bp, Homo sapiens
tatgctgccaaatttt

SEQ ID NO: 1665752 - DNA, 20 bp, Homo sapiens
tatgctgccaaattttggcc

SEQ ID NO: 1665753 - DNA, 22 bp, Homo sapiens
tatgctgccaaattttggccaa

SEQ ID NO: 1665754 - DNA, 13 bp, Homo sapiens
tatgctgtcatgg

SEQ ID NO: 1665755 - DNA, 16 bp, Homo sapiens
tatgcttactgatata

SEQ ID NO: 1665756 - DNA, 22 bp, Homo sapiens
tatgcttatacacttacacttt

SEQ ID NO: 1665757 - DNA, 15 bp, Homo sapiens
tatgctttccctgag

SEQ ID NO: 1665758 - DNA, 17 bp, Homo sapiens
tatgctttccctgagga

SEQ ID NO: 1665759 - DNA, 18 bp, Homo sapiens
tatgctttccctgaggaa

SEQ ID NO: 1665760 - DNA, 13 bp, Homo sapiens
tatggaagaaagt

SEQ ID NO: 1665761 - DNA, 22 bp, Homo sapiens
tatggaagggtttgtggctggg

SEQ ID NO: 1665762 - DNA, 18 bp, Homo sapiens
tatggaagttgcataatt

SEQ ID NO: 1665763 - DNA, 17 bp, Homo sapiens
tatggaatacagtgtta

SEQ ID NO: 1665764 - DNA, 18 bp, Homo sapiens
tatggaattacatgtaaa

SEQ ID NO: 1665765 - DNA, 22 bp, Homo sapiens
tatggaattacatgtaaaacat

SEQ ID NO: 1665766 - DNA, 15 bp, Homo sapiens
tatggaattttgcaa

SEQ ID NO: 1665767 - DNA, 18 bp, Homo sapiens
tatggactatctgtctgg

SEQ ID NO: 1665768 - DNA, 12 bp, Homo sapiens
tatggactctgc

SEQ ID NO: 1665769 - DNA, 15 bp, Homo sapiens
tatggaggatggaga

SEQ ID NO: 1665770 - DNA, 14 bp, Homo sapiens
tatggaggattctt

SEQ ID NO: 1665771 - DNA, 19 bp, Homo sapiens
tatggaggctttgcataga

SEQ ID NO: 1665772 - DNA, 20 bp, Homo sapiens
tatggagtgagtcacctgct

SEQ ID NO: 1665773 - DNA, 21 bp, Homo sapiens
tatggagtgagtcacctgctc

SEQ ID NO: 1665774 - DNA, 23 bp, Homo sapiens
tatggagtgagtcacctgctcca

SEQ ID NO: 1665775 - DNA, 13 bp, Homo sapiens
tatggataatgcc

SEQ ID NO: 1665776 - DNA, 16 bp, Homo sapiens
tatggatatatttgaa

SEQ ID NO: 1665777 - DNA, 21 bp, Homo sapiens
tatggatatatttgaaatagt

SEQ ID NO: 1665778 - DNA, 22 bp, Homo sapiens
tatggatatatttgaaatagta

SEQ ID NO: 1665779 - DNA, 15 bp, Homo sapiens
tatggatatgctgct

SEQ ID NO: 1665780 - DNA, 18 bp, Homo sapiens
tatggatatgctgcttta

SEQ ID NO: 1665781 - DNA, 18 bp, Homo sapiens
tatggatgatttaagtgt

SEQ ID NO: 1665782 - DNA, 17 bp, Homo sapiens
tatggcaggataagaaa

SEQ ID NO: 1665783 - DNA, 21 bp, Homo sapiens
tatggcagtccagccagctcc

SEQ ID NO: 1665784 - DNA, 15 bp, Homo sapiens
tatggcatttctatt

SEQ ID NO: 1665785 - DNA, 19 bp, Homo sapiens
tatggccacatttaatatc

SEQ ID NO: 1665786 - DNA, 13 bp, Homo sapiens
tattatttctgtt

SEQ ID NO: 1665787 - DNA, 17 bp, Homo sapiens
tattatttctgttctta

SEQ ID NO: 1665788 - DNA, 16 bp, Homo sapiens
tattatttcttctctt

SEQ ID NO: 1665789 - DNA, 12 bp, Homo sapiens
tattatttggag

SEQ ID NO: 1665790 - DNA, 16 bp, Homo sapiens
tattattttcacctgt

SEQ ID NO: 1665791 - DNA, 20 bp, Homo sapiens
tattatttttttaaaatttt

SEQ ID NO: 1665792 - DNA, 21 bp, Homo sapiens
tattcaaaaaatcatgtttat

SEQ ID NO: 1665793 - DNA, 14 bp, Homo sapiens
tattcaaactgaaa

SEQ ID NO: 1665794 - DNA, 15 bp, Homo sapiens
tattcaaatttgatg

SEQ ID NO: 1665795 - DNA, 16 bp, Homo sapiens
tattcaaatttgtaca

SEQ ID NO: 1665796 - DNA, 18 bp, Homo sapiens
tattcaagaatgaaaaat

SEQ ID NO: 1665797 - DNA, 15 bp, Homo sapiens
tattcaagtgcctct

SEQ ID NO: 1665798 - DNA, 17 bp, Homo sapiens
tattcaagtgcctcttg

SEQ ID NO: 1665799 - DNA, 22 bp, Homo sapiens
tattcaataaaaaaaagaaatg

SEQ ID NO: 1665800 - DNA, 13 bp, Homo sapiens
tattcaatgcatt

SEQ ID NO: 1665801 - DNA, 17 bp, Homo sapiens
tattcaatgcatttaaa

SEQ ID NO: 1665802 - DNA, 19 bp, Homo sapiens
tattcaatgcatttaaaat

SEQ ID NO: 1665803 - DNA, 17 bp, Homo sapiens
tattcaattcctctggg

SEQ ID NO: 1665804 - DNA, 16 bp, Homo sapiens
tattcaccctccactt

SEQ ID NO: 1665805 - DNA, 17 bp, Homo sapiens
tattcacctcagtagaa

SEQ ID NO: 1665806 - DNA, 15 bp, Homo sapiens
tattcacctttttaa

SEQ ID NO: 1665807 - DNA, 23 bp, Homo sapiens
tattcacgccattggttggaagc

SEQ ID NO: 1665808 - DNA, 16 bp, Homo sapiens
tattcactctccatta

SEQ ID NO: 1665809 - DNA, 20 bp, Homo sapiens
tattcactgtaagtttattt

SEQ ID NO: 1665810 - DNA, 18 bp, Homo sapiens
tattcagacaagcaacag

SEQ ID NO: 1665811 - DNA, 18 bp, Homo sapiens
tattcagcatttgatttc

SEQ ID NO: 1665812 - DNA, 22 bp, Homo sapiens
tattcagcatttgatttccatg

SEQ ID NO: 1665813 - DNA, 21 bp, Homo sapiens
tattcagcttgcacatttggt

SEQ ID NO: 1665814 - DNA, 20 bp, Homo sapiens
tattcaggacttgaaagaaa

SEQ ID NO: 1665815 - DNA, 20 bp, Homo sapiens
tattcagtaataactctacc

SEQ ID NO: 1665816 - DNA, 16 bp, Homo sapiens
tattcataatgaatta

SEQ ID NO: 1665817 - DNA, 20 bp, Homo sapiens
tattcataatgaattataac

SEQ ID NO: 1665818 - DNA, 16 bp, Homo sapiens
tattcatctaatgtat

SEQ ID NO: 1665819 - DNA, 14 bp, Homo sapiens
tattcatgttcatg

SEQ ID NO: 1665820 - DNA, 16 bp, Homo sapiens
tattcatttaaaatga

SEQ ID NO: 1665821 - DNA, 19 bp, Homo sapiens
tattcatttaaaatgatta

SEQ ID NO: 1665822 - DNA, 14 bp, Homo sapiens
tattccaggagaag

SEQ ID NO: 1665823 - DNA, 17 bp, Homo sapiens
tattccatatttattca

SEQ ID NO: 1665824 - DNA, 22 bp, Homo sapiens
tattccatgaatgtatcaggaa

SEQ ID NO: 1665825 - DNA, 23 bp, Homo sapiens
tattccatgaatgtatcaggaaa

SEQ ID NO: 1665826 - DNA, 20 bp, Homo sapiens
tattcccaagcccatgagtc

SEQ ID NO: 1665827 - DNA, 20 bp, Homo sapiens
tattcccactcaccagccct

SEQ ID NO: 1665828 - DNA, 19 bp, Homo sapiens
tattcccgacgacacatat

SEQ ID NO: 1665829 - DNA, 13 bp, Homo sapiens
tattcccttgtat

SEQ ID NO: 1665830 - DNA, 19 bp, Homo sapiens
tattcccttgtattttgtt

SEQ ID NO: 1665831 - DNA, 18 bp, Homo sapiens
tattccgtatttaaagtt

SEQ ID NO: 1665832 - DNA, 22 bp, Homo sapiens
tattcctatatagtttattgac

SEQ ID NO: 1665833 - DNA, 14 bp, Homo sapiens
tattcctgaatgaa

SEQ ID NO: 1665834 - DNA, 20 bp, Homo sapiens
tattcctgaatgaaatatca

SEQ ID NO: 1665835 - DNA, 14 bp, Homo sapiens
tattcctgtatgtt

SEQ ID NO: 1665836 - DNA, 17 bp, Homo sapiens
tattcctgtatgttgtc

SEQ ID NO: 1665837 - DNA, 19 bp, Homo sapiens
tattcctgttgctgtcttc

SEQ ID NO: 1665838 - DNA, 19 bp, Homo sapiens
tattccttttgtgtacagt

SEQ ID NO: 1665839 - DNA, 22 bp, Homo sapiens
tattcgatactgcgactttctg

SEQ ID NO: 1665840 - DNA, 22 bp, Homo sapiens
tattctaagacttactctaaga

SEQ ID NO: 1665841 - DNA, 17 bp, Homo sapiens
tattctacacatgtaaa

SEQ ID NO: 1665842 - DNA, 14 bp, Homo sapiens
tattctacatttca

SEQ ID NO: 1665843 - DNA, 15 bp, Homo sapiens
tattctacatttcac

SEQ ID NO: 1665844 - DNA, 18 bp, Homo sapiens
tattctactggcctgtaa

SEQ ID NO: 1665845 - DNA, 19 bp, Homo sapiens
tattctagctaatgtaata

SEQ ID NO: 1665846 - DNA, 19 bp, Homo sapiens
tattctataaaactctgca

SEQ ID NO: 1665847 - DNA, 15 bp, Homo sapiens
tattctatatgaatt

SEQ ID NO: 1665848 - DNA, 13 bp, Homo sapiens
tattctattaact

SEQ ID NO: 1665849 - DNA, 14 bp, Homo sapiens
tattctcaaagcag

SEQ ID NO: 1665850 - DNA, 14 bp, Homo sapiens
tattctcactccac

SEQ ID NO: 1665851 - DNA, 15 bp, Homo sapiens
tattctcactccacc

SEQ ID NO: 1665852 - DNA, 19 bp, Homo sapiens
tattctcactccaccaccc

SEQ ID NO: 1665853 - DNA, 15 bp, Homo sapiens
tattctctgcaattt

SEQ ID NO: 1665854 - DNA, 12 bp, Homo sapiens
tattctcttcac

SEQ ID NO: 1665855 - DNA, 23 bp, Homo sapiens
tattctctttaccttctaaaagc

SEQ ID NO: 1665856 - DNA, 20 bp, Homo sapiens
tattctgacatgtaagaaaa

SEQ ID NO: 1665857 - DNA, 16 bp, Homo sapiens
tattctgacttcctct

SEQ ID NO: 1665858 - DNA, 15 bp, Homo sapiens
tattctgagccttga

SEQ ID NO: 1665859 - DNA, 14 bp, Homo sapiens
tattctgattccac

SEQ ID NO: 1665860 - DNA, 20 bp, Homo sapiens
tattctgggctcctggaacc

SEQ ID NO: 1665861 - DNA, 22 bp, Homo sapiens
tattctgtagattctgtggaac

SEQ ID NO: 1665862 - DNA, 17 bp, Homo sapiens
tattctgtggattctat

SEQ ID NO: 1665863 - DNA, 18 bp, Homo sapiens
tattctgtggattctata

SEQ ID NO: 1665864 - DNA, 21 bp, Homo sapiens
tattctgtggattctatattt

SEQ ID NO: 1665865 - DNA, 15 bp, Homo sapiens
tattcttataaaaat

SEQ ID NO: 1665866 - DNA, 14 bp, Homo sapiens
tattcttcataaca

SEQ ID NO: 1665867 - DNA, 14 bp, Homo sapiens
tattcttccagaat

SEQ ID NO: 1665868 - DNA, 14 bp, Homo sapiens
tattcttctagagt

SEQ ID NO: 1665869 - DNA, 14 bp, Homo sapiens
tattcttgatgaaa

SEQ ID NO: 1665870 - DNA, 19 bp, Homo sapiens
tattcttgatgaaaagctt

SEQ ID NO: 1665871 - DNA, 16 bp, Homo sapiens
tattcttgatgtaaaa

SEQ ID NO: 1665872 - DNA, 21 bp, Homo sapiens
tattcttgctgggcatacttt

SEQ ID NO: 1665873 - DNA, 19 bp, Homo sapiens
tattcttgctttcacaaat

SEQ ID NO: 1665874 - DNA, 22 bp, Homo sapiens
tattcttgtggttaaaaacctg

SEQ ID NO: 1665875 - DNA, 15 bp, Homo sapiens
tattcttgtttgaat

SEQ ID NO: 1665876 - DNA, 15 bp, Homo sapiens
tattctttctgcctt

SEQ ID NO: 1665877 - DNA, 22 bp, Homo sapiens
tattctttgcactttttcttaa

SEQ ID NO: 1665878 - DNA, 13 bp, Homo sapiens
tattgaaagccaa

SEQ ID NO: 1665879 - DNA, 21 bp, Homo sapiens
tattgaaaggggacacctgta

SEQ ID NO: 1665880 - DNA, 23 bp, Homo sapiens
tattgaaaggggacacctgtaca

SEQ ID NO: 1665881 - DNA, 22 bp, Homo sapiens
tattgaagacaatttgatacat

SEQ ID NO: 1665882 - DNA, 21 bp, Homo sapiens
tattgaagttgtttatcaact

SEQ ID NO: 1665883 - DNA, 18 bp, Homo sapiens
tattgaatgaaacaagca

SEQ ID NO: 1665884 - DNA, 16 bp, Homo sapiens
tattgacaacagtttt

SEQ ID NO: 1665885 - DNA, 21 bp, Homo sapiens
tattgacaaccgagaaggttt

SEQ ID NO: 1665886 - DNA, 14 bp, Homo sapiens
tattgacactgaac

SEQ ID NO: 1665887 - DNA, 16 bp, Homo sapiens
tattgacactgaactt

SEQ ID NO: 1665888 - DNA, 17 bp, Homo sapiens
tattgacagttgtgcag

SEQ ID NO: 1665889 - DNA, 14 bp, Homo sapiens
tattgacatttgta

SEQ ID NO: 1665890 - DNA, 19 bp, Homo sapiens
tattgaccatgtggttcac

SEQ ID NO: 1665891 - DNA, 18 bp, Homo sapiens
tattgacccaaatgtgta

SEQ ID NO: 1665892 - DNA, 17 bp, Homo sapiens
tattgacgaactggcta

SEQ ID NO: 1665893 - DNA, 23 bp, Homo sapiens
tattgacgaactggctacagtac

SEQ ID NO: 1665894 - DNA, 18 bp, Homo sapiens
tattgactgtctttccta

SEQ ID NO: 1665895 - DNA, 19 bp, Homo sapiens
tattgacttcaatgatagt

SEQ ID NO: 1665896 - DNA, 21 bp, Homo sapiens
tattgagttccagttgaagtt

SEQ ID NO: 1665897 - DNA, 14 bp, Homo sapiens
tattgatagtactc

SEQ ID NO: 1665898 - DNA, 15 bp, Homo sapiens
tattgatagtactct

SEQ ID NO: 1665899 - DNA, 22 bp, Homo sapiens
tattgatgcaatataagcataa

SEQ ID NO: 1665900 - DNA, 19 bp, Homo sapiens
tattttacacagaaacact

SEQ ID NO: 1665901 - DNA, 23 bp, Homo sapiens
tattttacacagaaacactgcct

SEQ ID NO: 1665902 - DNA, 16 bp, Homo sapiens
tattttacatgggcca

SEQ ID NO: 1665903 - DNA, 17 bp, Homo sapiens
tattttactattggaat

SEQ ID NO: 1665904 - DNA, 21 bp, Homo sapiens
tattttagtatacgtataaat

SEQ ID NO: 1665905 - DNA, 16 bp, Homo sapiens
tattttagttttgcaa

SEQ ID NO: 1665906 - DNA, 14 bp, Homo sapiens
tattttatcctgta

SEQ ID NO: 1665907 - DNA, 23 bp, Homo sapiens
tattttatctttgattctccttc

SEQ ID NO: 1665908 - DNA, 17 bp, Homo sapiens
tattttatgaacattgt

SEQ ID NO: 1665909 - DNA, 20 bp, Homo sapiens
tattttatgaacattgtact

SEQ ID NO: 1665910 - DNA, 13 bp, Homo sapiens
tattttattccct

SEQ ID NO: 1665911 - DNA, 19 bp, Homo sapiens
tattttattctatgtatgt

SEQ ID NO: 1665912 - DNA, 17 bp, Homo sapiens
tattttatttagacaag

SEQ ID NO: 1665913 - DNA, 13 bp, Homo sapiens
tattttcaaagaa

SEQ ID NO: 1665914 - DNA, 22 bp, Homo sapiens
tattttcaaccataaaagaagt

SEQ ID NO: 1665915 - DNA, 13 bp, Homo sapiens
tattttcaagaaa

SEQ ID NO: 1665916 - DNA, 12 bp, Homo sapiens
tattttcaagag

SEQ ID NO: 1665917 - DNA, 12 bp, Homo sapiens
tattttcagagc

SEQ ID NO: 1665918 - DNA, 12 bp, Homo sapiens
tattttcagtac

SEQ ID NO: 1665919 - DNA, 14 bp, Homo sapiens
tattttcatgaaaa

SEQ ID NO: 1665920 - DNA, 13 bp, Homo sapiens
tattttcatttgt

SEQ ID NO: 1665921 - DNA, 14 bp, Homo sapiens
tattttcatttgta

SEQ ID NO: 1665922 - DNA, 15 bp, Homo sapiens
tattttcatttgtac

SEQ ID NO: 1665923 - DNA, 22 bp, Homo sapiens
tattttccataaatttggactg

SEQ ID NO: 1665924 - DNA, 16 bp, Homo sapiens
tattttccgtcactta

SEQ ID NO: 1665925 - DNA, 22 bp, Homo sapiens
tattttccgtcacttaaatttg

SEQ ID NO: 1665926 - DNA, 13 bp, Homo sapiens
tattttcgggatt

SEQ ID NO: 1665927 - DNA, 20 bp, Homo sapiens
tattttctgaattcataaaa

SEQ ID NO: 1665928 - DNA, 22 bp, Homo sapiens
tattttctgaattcataaaaat

SEQ ID NO: 1665929 - DNA, 21 bp, Homo sapiens
tattttctgtgcctgaatatt

SEQ ID NO: 1665930 - DNA, 15 bp, Homo sapiens
tattttctgttcaga

SEQ ID NO: 1665931 - DNA, 22 bp, Homo sapiens
tattttctgttcagattaaaaa

SEQ ID NO: 1665932 - DNA, 12 bp, Homo sapiens
tattttcttcat

SEQ ID NO: 1665933 - DNA, 22 bp, Homo sapiens
tattttcttttatatctgtaaa

SEQ ID NO: 1665934 - DNA, 16 bp, Homo sapiens
tattttcttttgtaaa

SEQ ID NO: 1665935 - DNA, 14 bp, Homo sapiens
tattttctttttat

SEQ ID NO: 1665936 - DNA, 11 bp, Homo sapiens
tattttgaatg

SEQ ID NO: 1665937 - DNA, 13 bp, Homo sapiens
tattttgaatgtc

SEQ ID NO: 1665938 - DNA, 16 bp, Homo sapiens
tattttgaatgtcaca

SEQ ID NO: 1665939 - DNA, 18 bp, Homo sapiens
tattttgactgtgattta

SEQ ID NO: 1665940 - DNA, 13 bp, Homo sapiens
tattttgcatact

SEQ ID NO: 1665941 - DNA, 13 bp, Homo sapiens
tattttgctaact

SEQ ID NO: 1665942 - DNA, 15 bp, Homo sapiens
tattttgctaactgg

SEQ ID NO: 1665943 - DNA, 17 bp, Homo sapiens
tattttgctaactggtt

SEQ ID NO: 1665944 - DNA, 14 bp, Homo sapiens
tattttgctgagtt

SEQ ID NO: 1665945 - DNA, 16 bp, Homo sapiens
tattttgctgatttaa

SEQ ID NO: 1665946 - DNA, 14 bp, Homo sapiens
tattttggtacttt

SEQ ID NO: 1665947 - DNA, 17 bp, Homo sapiens
tattttggtacttttat

SEQ ID NO: 1665948 - DNA, 13 bp, Homo sapiens
tattttgtaaact

SEQ ID NO: 1665949 - DNA, 16 bp, Homo sapiens
tattttgtagatgtga

SEQ ID NO: 1665950 - DNA, 18 bp, Homo sapiens
tattttgtatatttgtaa

SEQ ID NO: 1665951 - DNA, 15 bp, Homo sapiens
tattttgtgtgaaat

SEQ ID NO: 1665952 - DNA, 16 bp, Homo sapiens
tattttgttaaagctg

SEQ ID NO: 1665953 - DNA, 15 bp, Homo sapiens
tattttgttcataca

SEQ ID NO: 1665954 - DNA, 19 bp, Homo sapiens
tatttttaaaaagaaatct

SEQ ID NO: 1665955 - DNA, 20 bp, Homo sapiens
tatttttaacacttaaattt

SEQ ID NO: 1665956 - DNA, 13 bp, Homo sapiens
tatttttaatcag

SEQ ID NO: 1665957 - DNA, 12 bp, Homo sapiens
tatttttaatgg

SEQ ID NO: 1665958 - DNA, 12 bp, Homo sapiens
tatttttacagc

SEQ ID NO: 1665959 - DNA, 19 bp, Homo sapiens
tatttttagactcatcaat

SEQ ID NO: 1665960 - DNA, 20 bp, Homo sapiens
tatttttataattgtacaaa

SEQ ID NO: 1665961 - DNA, 17 bp, Homo sapiens
tatttttatacaaacct

SEQ ID NO: 1665962 - DNA, 23 bp, Homo sapiens
tatttttatacaagtaatttcct

SEQ ID NO: 1665963 - DNA, 15 bp, Homo sapiens
tatttttcaaggcat

SEQ ID NO: 1665964 - DNA, 16 bp, Homo sapiens
tatttttcaaggcatt

SEQ ID NO: 1665965 - DNA, 17 bp, Homo sapiens
tatttttcaattttgaa

SEQ ID NO: 1665966 - DNA, 16 bp, Homo sapiens
tatttttcataaacaa

SEQ ID NO: 1665967 - DNA, 21 bp, Homo sapiens
tatttttccatttatttatga

SEQ ID NO: 1665968 - DNA, 18 bp, Homo sapiens
tatttttctcttgtacca

SEQ ID NO: 1665969 - DNA, 19 bp, Homo sapiens
tatttttctcttgtaccat

SEQ ID NO: 1665970 - DNA, 20 bp, Homo sapiens
tatttttgaacccctgtgtc

SEQ ID NO: 1665971 - DNA, 18 bp, Homo sapiens
tatttttgaagtaaatta

SEQ ID NO: 1665972 - DNA, 13 bp, Homo sapiens
tatttttgacaga

SEQ ID NO: 1665973 - DNA, 15 bp, Homo sapiens
tatttttgacagaat

SEQ ID NO: 1665974 - DNA, 19 bp, Homo sapiens
tatttttgacagaatatgt

SEQ ID NO: 1665975 - DNA, 14 bp, Homo sapiens
tatttttgatgtat

SEQ ID NO: 1665976 - DNA, 13 bp, Homo sapiens
tatttttgccctg

SEQ ID NO: 1665977 - DNA, 11 bp, Homo sapiens
tatttttgccg

SEQ ID NO: 1665978 - DNA, 14 bp, Homo sapiens
tatttttggggcat

SEQ ID NO: 1665979 - DNA, 15 bp, Homo sapiens
tatttttggggcatc

SEQ ID NO: 1665980 - DNA, 21 bp, Homo sapiens
tatttttggggcatcctggat

SEQ ID NO: 1665981 - DNA, 21 bp, Homo sapiens
tatttttgggggctttccttt

SEQ ID NO: 1665982 - DNA, 23 bp, Homo sapiens
tatttttgtagtgacctgtttat

SEQ ID NO: 1665983 - DNA, 22 bp, Homo sapiens
tatttttgtagttagacaatag

SEQ ID NO: 1665984 - DNA, 19 bp, Homo sapiens
tatttttgtattttacatg

SEQ ID NO: 1665985 - DNA, 13 bp, Homo sapiens
tatttttgtgtag

SEQ ID NO: 1665986 - DNA, 15 bp, Homo sapiens
tatttttgtgtttct

SEQ ID NO: 1665987 - DNA, 22 bp, Homo sapiens
tatttttgtgttttcttgtaaa

SEQ ID NO: 1665988 - DNA, 21 bp, Homo sapiens
tattttttaaaaaatttgcgc

SEQ ID NO: 1665989 - DNA, 12 bp, Homo sapiens
tattttttaaag

SEQ ID NO: 1665990 - DNA, 13 bp, Homo sapiens
tattttttaagta

SEQ ID NO: 1665991 - DNA, 21 bp, Homo sapiens
tattttttaagtatttatata

SEQ ID NO: 1665992 - DNA, 23 bp, Homo sapiens
tattttttaatttgatgaaagct

SEQ ID NO: 1665993 - DNA, 20 bp, Homo sapiens
tattttttacttttcacact

SEQ ID NO: 1665994 - DNA, 16 bp, Homo sapiens
tattttttatatatac

SEQ ID NO: 1665995 - DNA, 11 bp, Homo sapiens
tattttttcaa

SEQ ID NO: 1665996 - DNA, 13 bp, Homo sapiens
tattttttctaca

SEQ ID NO: 1665997 - DNA, 14 bp, Homo sapiens
tattttttctacac

SEQ ID NO: 1665998 - DNA, 19 bp, Homo sapiens
tattttttcttttctttac

SEQ ID NO: 1665999 - DNA, 15 bp, Homo sapiens
tattttttcttttgt

SEQ ID NO: 1666000 - DNA, 21 bp, Homo sapiens
tattttttcttttgtaattgt

SEQ ID NO: 1666001 - DNA, 16 bp, Homo sapiens
tattttttgtataatt

SEQ ID NO: 1666002 - DNA, 17 bp, Homo sapiens
tattttttgtataattg

SEQ ID NO: 1666003 - DNA, 16 bp, Homo sapiens
tatttttttaaaattt

SEQ ID NO: 1666004 - DNA, 20 bp, Homo sapiens
tatttttttaaatcaaggaa

SEQ ID NO: 1666005 - DNA, 21 bp, Homo sapiens
tatttttttaaatcaaggaaa

SEQ ID NO: 1666006 - DNA, 18 bp, Homo sapiens
tatttttttaatttaaca

SEQ ID NO: 1666007 - DNA, 23 bp, Homo sapiens
tatttttttctacataattgtga

SEQ ID NO: 1666008 - DNA, 14 bp, Homo sapiens
tatttttttctagc

SEQ ID NO: 1666009 - DNA, 15 bp, Homo sapiens
tatttttttctagct

SEQ ID NO: 1666010 - DNA, 16 bp, Homo sapiens
tatttttttctagcta

SEQ ID NO: 1666011 - DNA, 15 bp, Homo sapiens
tatttttttctctat

SEQ ID NO: 1666012 - DNA, 13 bp, Homo sapiens
tattttttttggc

SEQ ID NO: 1666013 - DNA, 16 bp, Homo sapiens
tatttttttttctaag

SEQ ID NO: 1666014 - DNA, 14 bp, Homo sapiens
tcaaaaaacaaaaa

SEQ ID NO: 1666015 - DNA, 18 bp, Homo sapiens
tcaaaaaactctctccca

SEQ ID NO: 1666016 - DNA, 20 bp, Homo sapiens
tcaatctctggaaaaataag

SEQ ID NO: 1666017 - DNA, 15 bp, Homo sapiens
tcaatctctgttctg

SEQ ID NO: 1666018 - DNA, 16 bp, Homo sapiens
tcaatctgtaaactgt

SEQ ID NO: 1666019 - DNA, 19 bp, Homo sapiens
tcaatcttgttactgctga

SEQ ID NO: 1666020 - DNA, 15 bp, Homo sapiens
tcaatcttttaaatt

SEQ ID NO: 1666021 - DNA, 14 bp, Homo sapiens
tcaatgacctgtat

SEQ ID NO: 1666022 - DNA, 15 bp, Homo sapiens
tcaatgacctgtatt

SEQ ID NO: 1666023 - DNA, 21 bp, Homo sapiens
tcaatgcaaatagtagacatt

SEQ ID NO: 1666024 - DNA, 22 bp, Homo sapiens
tcaatgcaaatagtagacattt

SEQ ID NO: 1666025 - DNA, 18 bp, Homo sapiens
tcaatgcatttaaaatac

SEQ ID NO: 1666026 - DNA, 19 bp, Homo sapiens
tcaatgcatttaaaatacc

SEQ ID NO: 1666027 - DNA, 13 bp, Homo sapiens
tcaatgccctgcc

SEQ ID NO: 1666028 - DNA, 15 bp, Homo sapiens
tcaatgccctgccat

SEQ ID NO: 1666029 - DNA, 22 bp, Homo sapiens
tcaatggtagattcgctgtccc

SEQ ID NO: 1666030 - DNA, 15 bp, Homo sapiens
tcaatgtcttcccac

SEQ ID NO: 1666031 - DNA, 21 bp, Homo sapiens
tcaatgtttatgcaaggaagg

SEQ ID NO: 1666032 - DNA, 17 bp, Homo sapiens
tcaatgtttctggacat

SEQ ID NO: 1666033 - DNA, 22 bp, Homo sapiens
tcaatgtttctggacattctct

SEQ ID NO: 1666034 - DNA, 23 bp, Homo sapiens
tcaattaaaatagtctctttaaa

SEQ ID NO: 1666035 - DNA, 20 bp, Homo sapiens
tcaattagcgtttaaggtga

SEQ ID NO: 1666036 - DNA, 16 bp, Homo sapiens
tcaattatagtttctg

SEQ ID NO: 1666037 - DNA, 15 bp, Homo sapiens
tcaattatttgcata

SEQ ID NO: 1666038 - DNA, 18 bp, Homo sapiens
tcaattcccacctatgag

SEQ ID NO: 1666039 - DNA, 16 bp, Homo sapiens
tcaattcctctgggaa

SEQ ID NO: 1666040 - DNA, 13 bp, Homo sapiens
tcaattgtaatat

SEQ ID NO: 1666041 - DNA, 20 bp, Homo sapiens
tcaatttgtaattgcttaca

SEQ ID NO: 1666042 - DNA, 13 bp, Homo sapiens
tcaatttgtatat

SEQ ID NO: 1666043 - DNA, 13 bp, Homo sapiens
tcaattttaaaga

SEQ ID NO: 1666044 - DNA, 14 bp, Homo sapiens
tcaattttgaaaac

SEQ ID NO: 1666045 - DNA, 15 bp, Homo sapiens
tcaatttttcccagt

SEQ ID NO: 1666046 - DNA, 17 bp, Homo sapiens
tcaatttttcccagtat

SEQ ID NO: 1666047 - DNA, 23 bp, Homo sapiens
tcaatttttcttatttcatttct

SEQ ID NO: 1666048 - DNA, 14 bp, Homo sapiens
tcacaaactgtgaa

SEQ ID NO: 1666049 - DNA, 17 bp, Homo sapiens
tcacaaaggttttgtct

SEQ ID NO: 1666050 - DNA, 14 bp, Homo sapiens
tcacaaatgtcatt

SEQ ID NO: 1666051 - DNA, 15 bp, Homo sapiens
tcacaaatgtcattg

SEQ ID NO: 1666052 - DNA, 12 bp, Homo sapiens
tcacaacagatc

SEQ ID NO: 1666053 - DNA, 19 bp, Homo sapiens
tcacaacttgatggctgcg

SEQ ID NO: 1666054 - DNA, 16 bp, Homo sapiens
tcacaacttgggttct

SEQ ID NO: 1666055 - DNA, 23 bp, Homo sapiens
tcacaagatggaatttatcaaac

SEQ ID NO: 1666056 - DNA, 20 bp, Homo sapiens
tcacaagggacgctttggga

SEQ ID NO: 1666057 - DNA, 22 bp, Homo sapiens
tcacaagggcaaactttttcct

SEQ ID NO: 1666058 - DNA, 22 bp, Homo sapiens
tcacaagtgaaaaacatccaga

SEQ ID NO: 1666059 - DNA, 17 bp, Homo sapiens
tcacaatcttggggctg

SEQ ID NO: 1666060 - DNA, 21 bp, Homo sapiens
tcacaatcttggggctgatga

SEQ ID NO: 1666061 - DNA, 13 bp, Homo sapiens
tcacaatgtgaaa

SEQ ID NO: 1666062 - DNA, 14 bp, Homo sapiens
tcacaatgtgaaac

SEQ ID NO: 1666063 - DNA, 17 bp, Homo sapiens
tcacaatgtgaaactga

SEQ ID NO: 1666064 - DNA, 21 bp, Homo sapiens
tcacaatgttccttttttgta

SEQ ID NO: 1666065 - DNA, 22 bp, Homo sapiens
tcacaattccatttccagttca

SEQ ID NO: 1666066 - DNA, 20 bp, Homo sapiens
tcacacaaagactccttgtg

SEQ ID NO: 1666067 - DNA, 21 bp, Homo sapiens
tcacacacaggcaactgaggc

SEQ ID NO: 1666068 - DNA, 21 bp, Homo sapiens
tcacacacccctcaaaaaaag

SEQ ID NO: 1666069 - DNA, 23 bp, Homo sapiens
tcacacactcacaatttaaaata

SEQ ID NO: 1666070 - DNA, 23 bp, Homo sapiens
tcacacagggctctttgatggac

SEQ ID NO: 1666071 - DNA, 21 bp, Homo sapiens
tcacacatctgggtgccctga

SEQ ID NO: 1666072 - DNA, 22 bp, Homo sapiens
tcacacatctgggtgccctgaa

SEQ ID NO: 1666073 - DNA, 17 bp, Homo sapiens
tcacacattacaacagt

SEQ ID NO: 1666074 - DNA, 16 bp, Homo sapiens
tcacaccagctaagga

SEQ ID NO: 1666075 - DNA, 21 bp, Homo sapiens
tcacacccaccgtccgccctg

SEQ ID NO: 1666076 - DNA, 13 bp, Homo sapiens
tcacacccctgtc

SEQ ID NO: 1666077 - DNA, 15 bp, Homo sapiens
tcacacccctgtccc

SEQ ID NO: 1666078 - DNA, 19 bp, Homo sapiens
tcacaccctaccttcccca

SEQ ID NO: 1666079 - DNA, 21 bp, Homo sapiens
tcacaccctaccttccccaga

SEQ ID NO: 1666080 - DNA, 23 bp, Homo sapiens
tcacaccctaccttccccagact

SEQ ID NO: 1666081 - DNA, 20 bp, Homo sapiens
tcacacctgactctgaaatc

SEQ ID NO: 1666082 - DNA, 23 bp, Homo sapiens
tcacacctgactctgaaatctga

SEQ ID NO: 1666083 - DNA, 19 bp, Homo sapiens
tcacacctgtaatcccaac

SEQ ID NO: 1666084 - DNA, 23 bp, Homo sapiens
tcacacgtttaatcccagcactt

SEQ ID NO: 1666085 - DNA, 13 bp, Homo sapiens
tcacactcttcag

SEQ ID NO: 1666086 - DNA, 12 bp, Homo sapiens
tcacactgagaa

SEQ ID NO: 1666087 - DNA, 19 bp, Homo sapiens
tcacactgagaatgtaaga

SEQ ID NO: 1666088 - DNA, 20 bp, Homo sapiens
tcacactgagaatgtaagaa

SEQ ID NO: 1666089 - DNA, 24 bp, Homo sapiens
tcacactggatccatcttgagcca

SEQ ID NO: 1666090 - DNA, 23 bp, Homo sapiens
tcacactgggtggtggcctggtc

SEQ ID NO: 1666091 - DNA, 20 bp, Homo sapiens
tcacactgttactccacagc

SEQ ID NO: 1666092 - DNA, 20 bp, Homo sapiens
tcacacttcattgtaaatca

SEQ ID NO: 1666093 - DNA, 16 bp, Homo sapiens
tcacacttctgtgaga

SEQ ID NO: 1666094 - DNA, 23 bp, Homo sapiens
tcacacttctgtgagacccccac

SEQ ID NO: 1666095 - DNA, 23 bp, Homo sapiens
tcacagaaaaagcatgatgggaa

SEQ ID NO: 1666096 - DNA, 16 bp, Homo sapiens
tcacagaaatcagagg

SEQ ID NO: 1666097 - DNA, 21 bp, Homo sapiens
tcacagaaattatgatcctct

SEQ ID NO: 1666098 - DNA, 11 bp, Homo sapiens
tcacagaagaa

SEQ ID NO: 1666099 - DNA, 19 bp, Homo sapiens
tcacagacctggagcccct

SEQ ID NO: 1666100 - DNA, 15 bp, Homo sapiens
tcacagagaagctcc

SEQ ID NO: 1666101 - DNA, 19 bp, Homo sapiens
tcacagagaagctcctgct

SEQ ID NO: 1666102 - DNA, 17 bp, Homo sapiens
tcacagagtcaaggcct

SEQ ID NO: 1666103 - DNA, 21 bp, Homo sapiens
tcacagagtgagactccatct

SEQ ID NO: 1666104 - DNA, 15 bp, Homo sapiens
tcacagagtgtgctg

SEQ ID NO: 1666105 - DNA, 17 bp, Homo sapiens
tcacagagtgtgctgct

SEQ ID NO: 1666106 - DNA, 15 bp, Homo sapiens
tcacagcgtctgctc

SEQ ID NO: 1666107 - DNA, 16 bp, Homo sapiens
tcacagctactcagtg

SEQ ID NO: 1666108 - DNA, 14 bp, Homo sapiens
tcacagctgcagct

SEQ ID NO: 1666109 - DNA, 15 bp, Homo sapiens
tcacagctgcagctg

SEQ ID NO: 1666110 - DNA, 16 bp, Homo sapiens
tcacagctgcagctgg

SEQ ID NO: 1666111 - DNA, 18 bp, Homo sapiens
tcacagctgcagctgggc

SEQ ID NO: 1666112 - DNA, 22 bp, Homo sapiens
tcacagctgcagctgggcccca

SEQ ID NO: 1666113 - DNA, 14 bp, Homo sapiens
tcacagcttctcca

SEQ ID NO: 1666114 - DNA, 18 bp, Homo sapiens
tcacagcttctccaagca

SEQ ID NO: 1666115 - DNA, 20 bp, Homo sapiens
tcacagcttctccaagcatc

SEQ ID NO: 1666116 - DNA, 21 bp, Homo sapiens
tcacaggaagaaagcagaaag

SEQ ID NO: 1666117 - DNA, 17 bp, Homo sapiens
tcacaggcagtgcatgt

SEQ ID NO: 1666118 - DNA, 20 bp, Homo sapiens
tcacaggcagtgcatgtgaa

SEQ ID NO: 1666119 - DNA, 14 bp, Homo sapiens
tcacaggctgagaa

SEQ ID NO: 1666120 - DNA, 19 bp, Homo sapiens
tcacagggcagagccggga

SEQ ID NO: 1666121 - DNA, 23 bp, Homo sapiens
tcacagggccccagaaggcaggg

SEQ ID NO: 1666122 - DNA, 19 bp, Homo sapiens
tcacagggtgggcctcggc

SEQ ID NO: 1666123 - DNA, 14 bp, Homo sapiens
tcacagggttgggc

SEQ ID NO: 1666124 - DNA, 12 bp, Homo sapiens
tcacagtacttt

SEQ ID NO: 1666125 - DNA, 14 bp, Homo sapiens
tcacagtagagcca

SEQ ID NO: 1666126 - DNA, 16 bp, Homo sapiens
tcacagtagagccagc

SEQ ID NO: 1666127 - DNA, 18 bp, Homo sapiens
tcacagtagagccagctt

SEQ ID NO: 1666128 - DNA, 15 bp, Homo sapiens
tcacagtccaaccag

SEQ ID NO: 1666129 - DNA, 19 bp, Homo sapiens
tcacagtctctttaatctt

SEQ ID NO: 1666130 - DNA, 17 bp, Homo sapiens
tcactccagtcaacaga

SEQ ID NO: 1666131 - DNA, 21 bp, Homo sapiens
tcactccagtgctcagctgtg

SEQ ID NO: 1666132 - DNA, 21 bp, Homo sapiens
tcactccggtgtgcctgcagc

SEQ ID NO: 1666133 - DNA, 13 bp, Homo sapiens
tcactcctctcta

SEQ ID NO: 1666134 - DNA, 20 bp, Homo sapiens
tcactcctgcgctgacaagg

SEQ ID NO: 1666135 - DNA, 11 bp, Homo sapiens
tcactcctggg

SEQ ID NO: 1666136 - DNA, 13 bp, Homo sapiens
tcactcctggggc

SEQ ID NO: 1666137 - DNA, 20 bp, Homo sapiens
tcactcctgttacttaccta

SEQ ID NO: 1666138 - DNA, 21 bp, Homo sapiens
tcactctaattaattgtaatc

SEQ ID NO: 1666139 - DNA, 13 bp, Homo sapiens
tcactctcagtgc

SEQ ID NO: 1666140 - DNA, 23 bp, Homo sapiens
tcactctctattgtcatggggat

SEQ ID NO: 1666141 - DNA, 11 bp, Homo sapiens
tcactctgccc

SEQ ID NO: 1666142 - DNA, 13 bp, Homo sapiens
tcactctgccctc

SEQ ID NO: 1666143 - DNA, 14 bp, Homo sapiens
tcactctgccctct

SEQ ID NO: 1666144 - DNA, 16 bp, Homo sapiens
tcactctgccctctgc

SEQ ID NO: 1666145 - DNA, 17 bp, Homo sapiens
tcactctgccctctgct

SEQ ID NO: 1666146 - DNA, 18 bp, Homo sapiens
tcactctgccctctgctg

SEQ ID NO: 1666147 - DNA, 16 bp, Homo sapiens
tcactctgtcatcttt

SEQ ID NO: 1666148 - DNA, 15 bp, Homo sapiens
tcactcttccagaat

SEQ ID NO: 1666149 - DNA, 21 bp, Homo sapiens
tcactcttccagaatcccaag

SEQ ID NO: 1666150 - DNA, 18 bp, Homo sapiens
tcactcttgaagtccagg

SEQ ID NO: 1666151 - DNA, 19 bp, Homo sapiens
tcactcttgaagtccagga

SEQ ID NO: 1666152 - DNA, 21 bp, Homo sapiens
tcactcttgaagtccaggact

SEQ ID NO: 1666153 - DNA, 23 bp, Homo sapiens
tcactcttttaagatcttgttaa

SEQ ID NO: 1666154 - DNA, 22 bp, Homo sapiens
tcactgaaaattggacagattg

SEQ ID NO: 1666155 - DNA, 17 bp, Homo sapiens
tcactgaaatgtttgga

SEQ ID NO: 1666156 - DNA, 16 bp, Homo sapiens
tcactgaactccaccg

SEQ ID NO: 1666157 - DNA, 15 bp, Homo sapiens
tcactgaatcttcac

SEQ ID NO: 1666158 - DNA, 21 bp, Homo sapiens
tcactgaccagcggctgctca

SEQ ID NO: 1666159 - DNA, 22 bp, Homo sapiens
tcactgaccagcggctgctcaa

SEQ ID NO: 1666160 - DNA, 20 bp, Homo sapiens
tcactgaccctaactgcaga

SEQ ID NO: 1666161 - DNA, 17 bp, Homo sapiens
tcactgatgtacaatta

SEQ ID NO: 1666162 - DNA, 21 bp, Homo sapiens
tcactgatgtacaattaaaaa

SEQ ID NO: 1666163 - DNA, 14 bp, Homo sapiens
tcactgcaacctcc

SEQ ID NO: 1666164 - DNA, 17 bp, Homo sapiens
tcactgcaacctccgcc

SEQ ID NO: 1666165 - DNA, 17 bp, Homo sapiens
tcactgcaacctctgcc

SEQ ID NO: 1666166 - DNA, 17 bp, Homo sapiens
tcactgcaacttctgcc

SEQ ID NO: 1666167 - DNA, 18 bp, Homo sapiens
tcactgcaagctctgcct

SEQ ID NO: 1666168 - DNA, 15 bp, Homo sapiens
tcactgcacagtgca

SEQ ID NO: 1666169 - DNA, 15 bp, Homo sapiens
tcactgcagcctccg

SEQ ID NO: 1666170 - DNA, 14 bp, Homo sapiens
tcactgccaggcca

SEQ ID NO: 1666171 - DNA, 23 bp, Homo sapiens
tcactgccaggccagcctccgag

SEQ ID NO: 1666172 - DNA, 15 bp, Homo sapiens
tcactgccatgatag

SEQ ID NO: 1666173 - DNA, 16 bp, Homo sapiens
tcactgccatgatagc

SEQ ID NO: 1666174 - DNA, 18 bp, Homo sapiens
tcactgccctttttgaaa

SEQ ID NO: 1666175 - DNA, 15 bp, Homo sapiens
tcactgcctgcagag

SEQ ID NO: 1666176 - DNA, 18 bp, Homo sapiens
tcactgcgaagaccctct

SEQ ID NO: 1666177 - DNA, 19 bp, Homo sapiens
tcactgctttgcaccgtgg

SEQ ID NO: 1666178 - DNA, 15 bp, Homo sapiens
tcactggaaagggga

SEQ ID NO: 1666179 - DNA, 11 bp, Homo sapiens
tcactggagcc

SEQ ID NO: 1666180 - DNA, 22 bp, Homo sapiens
tcactggagttacattaatgtt

SEQ ID NO: 1666181 - DNA, 16 bp, Homo sapiens
tcactggcagcctgca

SEQ ID NO: 1666182 - DNA, 15 bp, Homo sapiens
tcactggcgccttct

SEQ ID NO: 1666183 - DNA, 16 bp, Homo sapiens
tcactggcgccttctc

SEQ ID NO: 1666184 - DNA, 16 bp, Homo sapiens
tcactggctctccaag

SEQ ID NO: 1666185 - DNA, 17 bp, Homo sapiens
tcactggctctccaagt

SEQ ID NO: 1666186 - DNA, 22 bp, Homo sapiens
tcactggctctccaagtgccag

SEQ ID NO: 1666187 - DNA, 13 bp, Homo sapiens
tcactggctgggg

SEQ ID NO: 1666188 - DNA, 17 bp, Homo sapiens
tcactggggcctacagc

SEQ ID NO: 1666189 - DNA, 20 bp, Homo sapiens
tcactggggtcctggggcct

SEQ ID NO: 1666190 - DNA, 11 bp, Homo sapiens
tcactgggtgg

SEQ ID NO: 1666191 - DNA, 14 bp, Homo sapiens
tcactgtaaagaca

SEQ ID NO: 1666192 - DNA, 19 bp, Homo sapiens
tcactgtaacctgattcat

SEQ ID NO: 1666193 - DNA, 15 bp, Homo sapiens
tcactgtactgcatg

SEQ ID NO: 1666194 - DNA, 18 bp, Homo sapiens
tcactgtactgcatgtga

SEQ ID NO: 1666195 - DNA, 20 bp, Homo sapiens
tcactgtactgcatgtgact

SEQ ID NO: 1666196 - DNA, 23 bp, Homo sapiens
tcactgtagtttagttctgttga

SEQ ID NO: 1666197 - DNA, 17 bp, Homo sapiens
tcactgtatataaacat

SEQ ID NO: 1666198 - DNA, 20 bp, Homo sapiens
tcactgtatataaacatatt

SEQ ID NO: 1666199 - DNA, 11 bp, Homo sapiens
tcactgtcact

SEQ ID NO: 1666200 - DNA, 15 bp, Homo sapiens
tcactgtcactgccg

SEQ ID NO: 1666201 - DNA, 18 bp, Homo sapiens
tcactgtcaggaagaaat

SEQ ID NO: 1666202 - DNA, 14 bp, Homo sapiens
tcactgtcctgtga

SEQ ID NO: 1666203 - DNA, 15 bp, Homo sapiens
tcactgtcctgtgaa

SEQ ID NO: 1666204 - DNA, 20 bp, Homo sapiens
tcactgtgaaccaaccccca

SEQ ID NO: 1666205 - DNA, 22 bp, Homo sapiens
tcactgtgaaccaacccccatc

SEQ ID NO: 1666206 - DNA, 14 bp, Homo sapiens
tcactgtgagggga

SEQ ID NO: 1666207 - DNA, 20 bp, Homo sapiens
tcactgtgaggggaaggcct

SEQ ID NO: 1666208 - DNA, 11 bp, Homo sapiens
tcactgtgctg

SEQ ID NO: 1666209 - DNA, 16 bp, Homo sapiens
tcactgtgctggggca

SEQ ID NO: 1666210 - DNA, 17 bp, Homo sapiens
tcactgtgtcacccagg

SEQ ID NO: 1666211 - DNA, 11 bp, Homo sapiens
tcactgtgtta

SEQ ID NO: 1666212 - DNA, 16 bp, Homo sapiens
tcactgtgttactgct

SEQ ID NO: 1666213 - DNA, 18 bp, Homo sapiens
tcactgtgttactgcttt

SEQ ID NO: 1666214 - DNA, 19 bp, Homo sapiens
tcactgtgttactgctttg

SEQ ID NO: 1666215 - DNA, 22 bp, Homo sapiens
tcacttaaacttgcatcactta

SEQ ID NO: 1666216 - DNA, 18 bp, Homo sapiens
tcacttaaatttgttctt

SEQ ID NO: 1666217 - DNA, 15 bp, Homo sapiens
tcacttaagtgtctg

SEQ ID NO: 1666218 - DNA, 21 bp, Homo sapiens
tcacttaataatttttaccta

SEQ ID NO: 1666219 - DNA, 23 bp, Homo sapiens
tcacttaataatttttacctaat

SEQ ID NO: 1666220 - DNA, 17 bp, Homo sapiens
tcacttacctagattta

SEQ ID NO: 1666221 - DNA, 21 bp, Homo sapiens
tcacttaggaaatggctttgt

SEQ ID NO: 1666222 - DNA, 19 bp, Homo sapiens
tcacttatcccaagagaat

SEQ ID NO: 1666223 - DNA, 15 bp, Homo sapiens
tcacttcattgtttt

SEQ ID NO: 1666224 - DNA, 15 bp, Homo sapiens
tcacttccagtgttg

SEQ ID NO: 1666225 - DNA, 20 bp, Homo sapiens
tcacttccagtgttggctgt

SEQ ID NO: 1666226 - DNA, 17 bp, Homo sapiens
tcacttcccgtagctgc

SEQ ID NO: 1666227 - DNA, 17 bp, Homo sapiens
tcacttcctacaagagc

SEQ ID NO: 1666228 - DNA, 14 bp, Homo sapiens
tcacttccttgccc

SEQ ID NO: 1666229 - DNA, 23 bp, Homo sapiens
tcacttcgcgtgccctcgctgct

SEQ ID NO: 1666230 - DNA, 13 bp, Homo sapiens
tcacttctaaatg

SEQ ID NO: 1666231 - DNA, 12 bp, Homo sapiens
tcacttcttcac

SEQ ID NO: 1666232 - DNA, 20 bp, Homo sapiens
tcacttcttcacctcttcca

SEQ ID NO: 1666233 - DNA, 17 bp, Homo sapiens
tcacttcttcctattgt

SEQ ID NO: 1666234 - DNA, 22 bp, Homo sapiens
tcacttgaggtcaggagttcct

SEQ ID NO: 1666235 - DNA, 19 bp, Homo sapiens
tcacttgatgtttcctgga

SEQ ID NO: 1666236 - DNA, 21 bp, Homo sapiens
tcacttgatgtttcctggaag

SEQ ID NO: 1666237 - DNA, 22 bp, Homo sapiens
tcacttgatgtttcctggaagc

SEQ ID NO: 1666238 - DNA, 13 bp, Homo sapiens
tcacttgccatgc

SEQ ID NO: 1666239 - DNA, 14 bp, Homo sapiens
tcacttgccatgca

SEQ ID NO: 1666240 - DNA, 9 bp, Homo sapiens
tcacttgta

SEQ ID NO: 1666241 - DNA, 13 bp, Homo sapiens
tcacttgtacaaa

SEQ ID NO: 1666242 - DNA, 16 bp, Homo sapiens
tcacttgtacaaaata

SEQ ID NO: 1666243 - DNA, 20 bp, Homo sapiens
tcacttgttgttttactaaa

SEQ ID NO: 1666244 - DNA, 22 bp, Homo sapiens
tcacttgttgttttactaaaga

SEQ ID NO: 1666245 - DNA, 16 bp, Homo sapiens
tcagagcccccagccc

SEQ ID NO: 1666246 - DNA, 18 bp, Homo sapiens
tcagagcctagccacctc

SEQ ID NO: 1666247 - DNA, 22 bp, Homo sapiens
tcagagcctagccacctcccac

SEQ ID NO: 1666248 - DNA, 23 bp, Homo sapiens
tcagagcctagccacctcccacc

SEQ ID NO: 1666249 - DNA, 14 bp, Homo sapiens
tcagagcgcacagg

SEQ ID NO: 1666250 - DNA, 14 bp, Homo sapiens
tcagagctctctct

SEQ ID NO: 1666251 - DNA, 21 bp, Homo sapiens
tcagagctcttcaagctgtcc

SEQ ID NO: 1666252 - DNA, 22 bp, Homo sapiens
tcagaggaaaaatgggagccag

SEQ ID NO: 1666253 - DNA, 14 bp, Homo sapiens
tcagaggagaagag

SEQ ID NO: 1666254 - DNA, 16 bp, Homo sapiens
tcagaggcgtgctggt

SEQ ID NO: 1666255 - DNA, 18 bp, Homo sapiens
tcagaggctaagatgaga

SEQ ID NO: 1666256 - DNA, 17 bp, Homo sapiens
tcagagggactgtcagc

SEQ ID NO: 1666257 - DNA, 19 bp, Homo sapiens
tcagaggtttgcttcctca

SEQ ID NO: 1666258 - DNA, 19 bp, Homo sapiens
tcagagtcctcattataaa

SEQ ID NO: 1666259 - DNA, 14 bp, Homo sapiens
tcagagtgaagaat

SEQ ID NO: 1666260 - DNA, 16 bp, Homo sapiens
tcagagtgacagtcat

SEQ ID NO: 1666261 - DNA, 12 bp, Homo sapiens
tcagagtgccac

SEQ ID NO: 1666262 - DNA, 16 bp, Homo sapiens
tcagagtggagttgaa

SEQ ID NO: 1666263 - DNA, 20 bp, Homo sapiens
tcagagttgtacactgtgta

SEQ ID NO: 1666264 - DNA, 13 bp, Homo sapiens
tcagatagtctat

SEQ ID NO: 1666265 - DNA, 22 bp, Homo sapiens
tcagatataagagaagtctcat

SEQ ID NO: 1666266 - DNA, 16 bp, Homo sapiens
tcagatatatttttca

SEQ ID NO: 1666267 - DNA, 23 bp, Homo sapiens
tcagatatatttttcacagtttt

SEQ ID NO: 1666268 - DNA, 16 bp, Homo sapiens
tcagatatcaaaattc

SEQ ID NO: 1666269 - DNA, 22 bp, Homo sapiens
tcagatatcttggacaaatcac

SEQ ID NO: 1666270 - DNA, 23 bp, Homo sapiens
tcagatatcttggacaaatcaca

SEQ ID NO: 1666271 - DNA, 19 bp, Homo sapiens
tcagatcactgaatttata

SEQ ID NO: 1666272 - DNA, 14 bp, Homo sapiens
tcagatccagggac

SEQ ID NO: 1666273 - DNA, 14 bp, Homo sapiens
tcagatccccctcc

SEQ ID NO: 1666274 - DNA, 13 bp, Homo sapiens
tcagatcctgtta

SEQ ID NO: 1666275 - DNA, 17 bp, Homo sapiens
tcagatcctgttacttg

SEQ ID NO: 1666276 - DNA, 17 bp, Homo sapiens
tcagatccttgtttcaa

SEQ ID NO: 1666277 - DNA, 18 bp, Homo sapiens
tcagatccttgtttcaaa

SEQ ID NO: 1666278 - DNA, 20 bp, Homo sapiens
tcagatctgaacacagttta

SEQ ID NO: 1666279 - DNA, 13 bp, Homo sapiens
tcagatctgatca

SEQ ID NO: 1666280 - DNA, 23 bp, Homo sapiens
tcagatgactatgcagaggcctg

SEQ ID NO: 1666281 - DNA, 21 bp, Homo sapiens
tcagatgcccagagggcccag

SEQ ID NO: 1666282 - DNA, 15 bp, Homo sapiens
tcagatgctccaaga

SEQ ID NO: 1666283 - DNA, 19 bp, Homo sapiens
tcagatgctccaagattct

SEQ ID NO: 1666284 - DNA, 20 bp, Homo sapiens
tcagatgctccaagattcta

SEQ ID NO: 1666285 - DNA, 18 bp, Homo sapiens
tcagatgcttctgggaga

SEQ ID NO: 1666286 - DNA, 21 bp, Homo sapiens
tcagatggaagagataaacga

SEQ ID NO: 1666287 - DNA, 15 bp, Homo sapiens
tcagatgggaacagt

SEQ ID NO: 1666288 - DNA, 13 bp, Homo sapiens
tcagatgtcttct

SEQ ID NO: 1666289 - DNA, 20 bp, Homo sapiens
tcagatgtcttctgcctgtt

SEQ ID NO: 1666290 - DNA, 22 bp, Homo sapiens
tcagatgtcttctgcctgttat

SEQ ID NO: 1666291 - DNA, 14 bp, Homo sapiens
tcagatgtgcaata

SEQ ID NO: 1666292 - DNA, 21 bp, Homo sapiens
tcagattcccagagcaaaata

SEQ ID NO: 1666293 - DNA, 22 bp, Homo sapiens
tcagattcccagagcaaaataa

SEQ ID NO: 1666294 - DNA, 20 bp, Homo sapiens
tcagatttaagccttacaaa

SEQ ID NO: 1666295 - DNA, 12 bp, Homo sapiens
tcagatttgaac

SEQ ID NO: 1666296 - DNA, 17 bp, Homo sapiens
tcagatttgccttattg

SEQ ID NO: 1666297 - DNA, 14 bp, Homo sapiens
tcagattttttcct

SEQ ID NO: 1666298 - DNA, 22 bp, Homo sapiens
tcagcaaaaatctcccagtgac

SEQ ID NO: 1666299 - DNA, 13 bp, Homo sapiens
tcagcaaaccatt

SEQ ID NO: 1666300 - DNA, 15 bp, Homo sapiens
tcagcaaactctttt

SEQ ID NO: 1666301 - DNA, 15 bp, Homo sapiens
tcagcaaagaaaaaa

SEQ ID NO: 1666302 - DNA, 19 bp, Homo sapiens
tcagcaacaagactgccag

SEQ ID NO: 1666303 - DNA, 23 bp, Homo sapiens
tcagcaacccttcctgctgctgc

SEQ ID NO: 1666304 - DNA, 21 bp, Homo sapiens
tcagcaacttattttgcttta

SEQ ID NO: 1666305 - DNA, 16 bp, Homo sapiens
tcagcaagtgcccagt

SEQ ID NO: 1666306 - DNA, 21 bp, Homo sapiens
tcagcacaggaattctcaaga

SEQ ID NO: 1666307 - DNA, 22 bp, Homo sapiens
tcagcacaggaattctcaagac

SEQ ID NO: 1666308 - DNA, 21 bp, Homo sapiens
tcagcacattcgggaccaata

SEQ ID NO: 1666309 - DNA, 22 bp, Homo sapiens
tcagcacattcgggaccaatat

SEQ ID NO: 1666310 - DNA, 14 bp, Homo sapiens
tcagcaccccttcc

SEQ ID NO: 1666311 - DNA, 12 bp, Homo sapiens
tcagcaccctgg

SEQ ID NO: 1666312 - DNA, 14 bp, Homo sapiens
tcagcaccctgggt

SEQ ID NO: 1666313 - DNA, 15 bp, Homo sapiens
tcagcaccctgggtg

SEQ ID NO: 1666314 - DNA, 23 bp, Homo sapiens
tcagcaccctgggtgccattccc

SEQ ID NO: 1666315 - DNA, 20 bp, Homo sapiens
tcagcagaacctgcacacag

SEQ ID NO: 1666316 - DNA, 12 bp, Homo sapiens
tcagcagccagt

SEQ ID NO: 1666317 - DNA, 17 bp, Homo sapiens
tcagcagccagtctcag

SEQ ID NO: 1666318 - DNA, 14 bp, Homo sapiens
tcagcagccctcct

SEQ ID NO: 1666319 - DNA, 17 bp, Homo sapiens
tcagcagccctcctcac

SEQ ID NO: 1666320 - DNA, 21 bp, Homo sapiens
tcagcagccgccttaagctga

SEQ ID NO: 1666321 - DNA, 22 bp, Homo sapiens
tcagcagccgccttaagctgat

SEQ ID NO: 1666322 - DNA, 17 bp, Homo sapiens
tcagcagcctccctgaa

SEQ ID NO: 1666323 - DNA, 20 bp, Homo sapiens
tcagcagttgacatccaaat

SEQ ID NO: 1666324 - DNA, 17 bp, Homo sapiens
tcagcatagcctgcctg

SEQ ID NO: 1666325 - DNA, 15 bp, Homo sapiens
tcagcatctgaccat

SEQ ID NO: 1666326 - DNA, 16 bp, Homo sapiens
tcagcatctgaccatc

SEQ ID NO: 1666327 - DNA, 19 bp, Homo sapiens
tcagcatctgaccatctgt

SEQ ID NO: 1666328 - DNA, 22 bp, Homo sapiens
tcagcatctgaccatctgtgac

SEQ ID NO: 1666329 - DNA, 22 bp, Homo sapiens
tcagcatctggctgtctagaat

SEQ ID NO: 1666330 - DNA, 21 bp, Homo sapiens
tcagcatgtctattcagcttc

SEQ ID NO: 1666331 - DNA, 15 bp, Homo sapiens
tcagcattcaaaata

SEQ ID NO: 1666332 - DNA, 20 bp, Homo sapiens
tcagcattctcactcctacc

SEQ ID NO: 1666333 - DNA, 23 bp, Homo sapiens
tcagcattctcactcctacctgg

SEQ ID NO: 1666334 - DNA, 22 bp, Homo sapiens
tcagcatttcttttctggccaa

SEQ ID NO: 1666335 - DNA, 16 bp, Homo sapiens
tcagccaaatgtaatt

SEQ ID NO: 1666336 - DNA, 21 bp, Homo sapiens
tcagccaacgagtaatttatt

SEQ ID NO: 1666337 - DNA, 15 bp, Homo sapiens
tcagccacacccagg

SEQ ID NO: 1666338 - DNA, 13 bp, Homo sapiens
tcagccacactgg

SEQ ID NO: 1666339 - DNA, 15 bp, Homo sapiens
tcagccacactgggc

SEQ ID NO: 1666340 - DNA, 20 bp, Homo sapiens
tcagccacactgggcctgga

SEQ ID NO: 1666341 - DNA, 17 bp, Homo sapiens
tcagccacatgccccag

SEQ ID NO: 1666342 - DNA, 14 bp, Homo sapiens
tcagccagaagact

SEQ ID NO: 1666343 - DNA, 13 bp, Homo sapiens
tcagccaggacca

SEQ ID NO: 1666344 - DNA, 18 bp, Homo sapiens
tcagccaggagctgtcac

SEQ ID NO: 1666345 - DNA, 19 bp, Homo sapiens
tcagccaggagctgtcacc

SEQ ID NO: 1666346 - DNA, 18 bp, Homo sapiens
tcagccagtggggatgag

SEQ ID NO: 1666347 - DNA, 17 bp, Homo sapiens
tcagccatcaactaaag

SEQ ID NO: 1666348 - DNA, 14 bp, Homo sapiens
tcagccatgtttgg

SEQ ID NO: 1666349 - DNA, 13 bp, Homo sapiens
tcagccattttta

SEQ ID NO: 1666350 - DNA, 11 bp, Homo sapiens
tcagcccagca

SEQ ID NO: 1666351 - DNA, 18 bp, Homo sapiens
tcagcccagcacctgctc

SEQ ID NO: 1666352 - DNA, 12 bp, Homo sapiens
tcagcccagctg

SEQ ID NO: 1666353 - DNA, 14 bp, Homo sapiens
tcagcccagctggc

SEQ ID NO: 1666354 - DNA, 19 bp, Homo sapiens
tcagcccagctggccacct

SEQ ID NO: 1666355 - DNA, 15 bp, Homo sapiens
tcagcccagtgcaaa

SEQ ID NO: 1666356 - DNA, 14 bp, Homo sapiens
tcagccccactgac

SEQ ID NO: 1666357 - DNA, 22 bp, Homo sapiens
tcagcccccaccaggggaagga

SEQ ID NO: 1666358 - DNA, 18 bp, Homo sapiens
tcagcccccatcacccaa

SEQ ID NO: 1666359 - DNA, 14 bp, Homo sapiens
tcagtcccctctct

SEQ ID NO: 1666360 - DNA, 17 bp, Homo sapiens
tcagtcccctctctctg

SEQ ID NO: 1666361 - DNA, 22 bp, Homo sapiens
tcagtcccctctctctgggtca

SEQ ID NO: 1666362 - DNA, 13 bp, Homo sapiens
tcagtccctatgt

SEQ ID NO: 1666363 - DNA, 23 bp, Homo sapiens
tcagtccctatgtatttgcagtt

SEQ ID NO: 1666364 - DNA, 19 bp, Homo sapiens
tcagtccgcctggccggct

SEQ ID NO: 1666365 - DNA, 19 bp, Homo sapiens
tcagtcgttttagtgtctg

SEQ ID NO: 1666366 - DNA, 14 bp, Homo sapiens
tcagtctaaggtct

SEQ ID NO: 1666367 - DNA, 15 bp, Homo sapiens
tcagtctcacagaga

SEQ ID NO: 1666368 - DNA, 16 bp, Homo sapiens
tcagtctcacagagaa

SEQ ID NO: 1666369 - DNA, 16 bp, Homo sapiens
tcagtctcagctgctg

SEQ ID NO: 1666370 - DNA, 17 bp, Homo sapiens
tcagtctcagctgctga

SEQ ID NO: 1666371 - DNA, 15 bp, Homo sapiens
tcagtctctatacca

SEQ ID NO: 1666372 - DNA, 14 bp, Homo sapiens
tcagtctgctccac

SEQ ID NO: 1666373 - DNA, 22 bp, Homo sapiens
tcagtctttaatctgagaggcc

SEQ ID NO: 1666374 - DNA, 16 bp, Homo sapiens
tcagtctttgctcagt

SEQ ID NO: 1666375 - DNA, 15 bp, Homo sapiens
tcagtgacagagttc

SEQ ID NO: 1666376 - DNA, 21 bp, Homo sapiens
tcagtgacatcaaagcctggc

SEQ ID NO: 1666377 - DNA, 17 bp, Homo sapiens
tcagtgactgaaaccat

SEQ ID NO: 1666378 - DNA, 17 bp, Homo sapiens
tcagtgaggagggatgt

SEQ ID NO: 1666379 - DNA, 19 bp, Homo sapiens
tcagtgatacgtacagcca

SEQ ID NO: 1666380 - DNA, 17 bp, Homo sapiens
tcagtgcagcagaggac

SEQ ID NO: 1666381 - DNA, 14 bp, Homo sapiens
tcagtgcatttcaa

SEQ ID NO: 1666382 - DNA, 20 bp, Homo sapiens
tcagtgccacttgacattcc

SEQ ID NO: 1666383 - DNA, 13 bp, Homo sapiens
tcagtgccttctc

SEQ ID NO: 1666384 - DNA, 14 bp, Homo sapiens
tcagtgccttctct

SEQ ID NO: 1666385 - DNA, 16 bp, Homo sapiens
tcagtgccttctctca

SEQ ID NO: 1666386 - DNA, 21 bp, Homo sapiens
tcagtgctataaatgccagag

SEQ ID NO: 1666387 - DNA, 12 bp, Homo sapiens
tcagtgctgtgg

SEQ ID NO: 1666388 - DNA, 15 bp, Homo sapiens
tcagtgctgtggcct

SEQ ID NO: 1666389 - DNA, 12 bp, Homo sapiens
tcagtgcttctt

SEQ ID NO: 1666390 - DNA, 19 bp, Homo sapiens
tcagtggaatagatgtctc

SEQ ID NO: 1666391 - DNA, 17 bp, Homo sapiens
tcagtggcgagaaataa

SEQ ID NO: 1666392 - DNA, 14 bp, Homo sapiens
tcagtggctctggg

SEQ ID NO: 1666393 - DNA, 22 bp, Homo sapiens
tcagtgggaacgtgactgcccc

SEQ ID NO: 1666394 - DNA, 19 bp, Homo sapiens
tcagtgggacatagccagc

SEQ ID NO: 1666395 - DNA, 19 bp, Homo sapiens
tcagtgggactcggtgagc

SEQ ID NO: 1666396 - DNA, 12 bp, Homo sapiens
tcagtgggagaa

SEQ ID NO: 1666397 - DNA, 17 bp, Homo sapiens
tcagtggggcagcctct

SEQ ID NO: 1666398 - DNA, 14 bp, Homo sapiens
tcagtggggctggc

SEQ ID NO: 1666399 - DNA, 15 bp, Homo sapiens
tcagtggggctggca

SEQ ID NO: 1666400 - DNA, 19 bp, Homo sapiens
tcagtggggctggcatcaa

SEQ ID NO: 1666401 - DNA, 11 bp, Homo sapiens
tcagtgtacat

SEQ ID NO: 1666402 - DNA, 20 bp, Homo sapiens
tcagtgtcatttatgaaaag

SEQ ID NO: 1666403 - DNA, 23 bp, Homo sapiens
tcagtgtggagaggggtgcaccc

SEQ ID NO: 1666404 - DNA, 15 bp, Homo sapiens
tcagtgttacctgtg

SEQ ID NO: 1666405 - DNA, 15 bp, Homo sapiens
tcagtgttggtatat

SEQ ID NO: 1666406 - DNA, 12 bp, Homo sapiens
tcagtgtttaca

SEQ ID NO: 1666407 - DNA, 22 bp, Homo sapiens
tcagtgtttgggtcacccctcc

SEQ ID NO: 1666408 - DNA, 18 bp, Homo sapiens
tcagtgttttcattttag

SEQ ID NO: 1666409 - DNA, 19 bp, Homo sapiens
tcagtgttttcattttaga

SEQ ID NO: 1666410 - DNA, 16 bp, Homo sapiens
tcagtgttttggactc

SEQ ID NO: 1666411 - DNA, 23 bp, Homo sapiens
tcagtgttttggactccatctct

SEQ ID NO: 1666412 - DNA, 16 bp, Homo sapiens
tcagttacccactcgg

SEQ ID NO: 1666413 - DNA, 18 bp, Homo sapiens
tcagttacccactcggtc

SEQ ID NO: 1666414 - DNA, 14 bp, Homo sapiens
tcagttactaagaa

SEQ ID NO: 1666415 - DNA, 21 bp, Homo sapiens
tcagttcatatttcatttcca

SEQ ID NO: 1666416 - DNA, 15 bp, Homo sapiens
tcagttcccagctcc

SEQ ID NO: 1666417 - DNA, 14 bp, Homo sapiens
tcagttcccggagc

SEQ ID NO: 1666418 - DNA, 21 bp, Homo sapiens
tcagttcccggagcacagccc

SEQ ID NO: 1666419 - DNA, 15 bp, Homo sapiens
tcagttcccttggcc

SEQ ID NO: 1666420 - DNA, 20 bp, Homo sapiens
tcagttcctgcccttggcct

SEQ ID NO: 1666421 - DNA, 19 bp, Homo sapiens
tcagttctacggatcatca

SEQ ID NO: 1666422 - DNA, 19 bp, Homo sapiens
tcagttctctcccttcctc

SEQ ID NO: 1666423 - DNA, 15 bp, Homo sapiens
tcagttctctgggaa

SEQ ID NO: 1666424 - DNA, 13 bp, Homo sapiens
tcagttgcttgtc

SEQ ID NO: 1666425 - DNA, 19 bp, Homo sapiens
tcagttggaatcattgcta

SEQ ID NO: 1666426 - DNA, 16 bp, Homo sapiens
tcagttggagtttgtg

SEQ ID NO: 1666427 - DNA, 13 bp, Homo sapiens
tcagttgtacagt

SEQ ID NO: 1666428 - DNA, 12 bp, Homo sapiens
tcagttgtgaat

SEQ ID NO: 1666429 - DNA, 12 bp, Homo sapiens
tcagttgtgttt

SEQ ID NO: 1666430 - DNA, 16 bp, Homo sapiens
tcagttgtgtttttta

SEQ ID NO: 1666431 - DNA, 16 bp, Homo sapiens
tcagttgtttgcttct

SEQ ID NO: 1666432 - DNA, 19 bp, Homo sapiens
tcagtttaatccttctagt

SEQ ID NO: 1666433 - DNA, 20 bp, Homo sapiens
tcagtttaatccttctagtt

SEQ ID NO: 1666434 - DNA, 23 bp, Homo sapiens
tcagtttatccaaggtgtaactc

SEQ ID NO: 1666435 - DNA, 21 bp, Homo sapiens
tcagtttattttttcttctgt

SEQ ID NO: 1666436 - DNA, 23 bp, Homo sapiens
tcagtttccccaacacacagcag

SEQ ID NO: 1666437 - DNA, 19 bp, Homo sapiens
tcagtttgctagcagaaat

SEQ ID NO: 1666438 - DNA, 16 bp, Homo sapiens
tcagtttgtgtgtctt

SEQ ID NO: 1666439 - DNA, 17 bp, Homo sapiens
tcagtttgtgtgtctta

SEQ ID NO: 1666440 - DNA, 14 bp, Homo sapiens
tcagtttgttggaa

SEQ ID NO: 1666441 - DNA, 19 bp, Homo sapiens
tcagtttgttggaaagtaa

SEQ ID NO: 1666442 - DNA, 16 bp, Homo sapiens
tcagttttatcatttt

SEQ ID NO: 1666443 - DNA, 13 bp, Homo sapiens
tcagttttccttc

SEQ ID NO: 1666444 - DNA, 13 bp, Homo sapiens
tcataaaaataac

SEQ ID NO: 1666445 - DNA, 16 bp, Homo sapiens
tcataaaatagaataa

SEQ ID NO: 1666446 - DNA, 21 bp, Homo sapiens
tcataaaatagaataattctt

SEQ ID NO: 1666447 - DNA, 21 bp, Homo sapiens
tcataaacaacttaatgttct

SEQ ID NO: 1666448 - DNA, 16 bp, Homo sapiens
tcataaaccttaagta

SEQ ID NO: 1666449 - DNA, 11 bp, Homo sapiens
tcataaagtca

SEQ ID NO: 1666450 - DNA, 16 bp, Homo sapiens
tcataaatactgtcaa

SEQ ID NO: 1666451 - DNA, 23 bp, Homo sapiens
tcataaatactgtcaaacaataa

SEQ ID NO: 1666452 - DNA, 15 bp, Homo sapiens
tcataaattactgtt

SEQ ID NO: 1666453 - DNA, 16 bp, Homo sapiens
tcataaatttatggtt

SEQ ID NO: 1666454 - DNA, 19 bp, Homo sapiens
tcataacatccagagcttt

SEQ ID NO: 1666455 - DNA, 14 bp, Homo sapiens
tcataacttgctga

SEQ ID NO: 1666456 - DNA, 21 bp, Homo sapiens
tcataacttgctgaatttcag

SEQ ID NO: 1666457 - DNA, 14 bp, Homo sapiens
tcataaggcttcaa

SEQ ID NO: 1666458 - DNA, 20 bp, Homo sapiens
tcataagtattatgtctctt

SEQ ID NO: 1666459 - DNA, 18 bp, Homo sapiens
tcataatgaattataaca

SEQ ID NO: 1666460 - DNA, 14 bp, Homo sapiens
tcataatgtattat

SEQ ID NO: 1666461 - DNA, 17 bp, Homo sapiens
tcataatgtattattta

SEQ ID NO: 1666462 - DNA, 13 bp, Homo sapiens
tcataattacatt

SEQ ID NO: 1666463 - DNA, 17 bp, Homo sapiens
tcataattacattccta

SEQ ID NO: 1666464 - DNA, 22 bp, Homo sapiens
tcataatttaaaaatctccatt

SEQ ID NO: 1666465 - DNA, 13 bp, Homo sapiens
tcataattttgca

SEQ ID NO: 1666466 - DNA, 19 bp, Homo sapiens
tcataatttttgcagaaaa

SEQ ID NO: 1666467 - DNA, 18 bp, Homo sapiens
tcatacaaactctcacca

SEQ ID NO: 1666468 - DNA, 13 bp, Homo sapiens
tcatacattgtac

SEQ ID NO: 1666469 - DNA, 16 bp, Homo sapiens
tcatacattgtacgaa

SEQ ID NO: 1666470 - DNA, 22 bp, Homo sapiens
tcataccacttgaatttattga

SEQ ID NO: 1666471 - DNA, 12 bp, Homo sapiens
tcataccagaaa

SEQ ID NO: 1666472 - DNA, 17 bp, Homo sapiens
tcataccatctgctgcc

SEQ ID NO: 1666473 - DNA, 20 bp, Homo sapiens
tcatacccatgcacagtaca

SEQ ID NO: 1666474 - DNA, 17 bp, Homo sapiens
tcatgtttgcttcataa

SEQ ID NO: 1666475 - DNA, 20 bp, Homo sapiens
tcatgttttagcatttgtat

SEQ ID NO: 1666476 - DNA, 15 bp, Homo sapiens
tcatgttttttcctt

SEQ ID NO: 1666477 - DNA, 16 bp, Homo sapiens
tcattaaactttttta

SEQ ID NO: 1666478 - DNA, 17 bp, Homo sapiens
tcattaaacttttttaa

SEQ ID NO: 1666479 - DNA, 14 bp, Homo sapiens
tcattaaataaatt

SEQ ID NO: 1666480 - DNA, 15 bp, Homo sapiens
tcattaaatggggct

SEQ ID NO: 1666481 - DNA, 17 bp, Homo sapiens
tcattaatagctgcctt

SEQ ID NO: 1666482 - DNA, 15 bp, Homo sapiens
tcattaatgacttta

SEQ ID NO: 1666483 - DNA, 23 bp, Homo sapiens
tcattaatgactttatgtattat

SEQ ID NO: 1666484 - DNA, 17 bp, Homo sapiens
tcattacaattttctgt

SEQ ID NO: 1666485 - DNA, 17 bp, Homo sapiens
tcattacagatttagtt

SEQ ID NO: 1666486 - DNA, 18 bp, Homo sapiens
tcattacagttctttcct

SEQ ID NO: 1666487 - DNA, 13 bp, Homo sapiens
tcattactggtaa

SEQ ID NO: 1666488 - DNA, 15 bp, Homo sapiens
tcattagaaatattt

SEQ ID NO: 1666489 - DNA, 10 bp, Homo sapiens
tcattagaac

SEQ ID NO: 1666490 - DNA, 16 bp, Homo sapiens
tcattaggttttgctt

SEQ ID NO: 1666491 - DNA, 23 bp, Homo sapiens
tcattataaacgtgatgatcagc

SEQ ID NO: 1666492 - DNA, 13 bp, Homo sapiens
tcattatctcaaa

SEQ ID NO: 1666493 - DNA, 18 bp, Homo sapiens
tcattatgcacttttaga

SEQ ID NO: 1666494 - DNA, 19 bp, Homo sapiens
tcattatggtagaatcatt

SEQ ID NO: 1666495 - DNA, 13 bp, Homo sapiens
tcattatgtaaaa

SEQ ID NO: 1666496 - DNA, 13 bp, Homo sapiens
tcattattcaaga

SEQ ID NO: 1666497 - DNA, 16 bp, Homo sapiens
tcattattcaagaatg

SEQ ID NO: 1666498 - DNA, 14 bp, Homo sapiens
tcattattctctgc

SEQ ID NO: 1666499 - DNA, 17 bp, Homo sapiens
tcattattctctgctat

SEQ ID NO: 1666500 - DNA, 20 bp, Homo sapiens
tcattatttttgttagcaaa

SEQ ID NO: 1666501 - DNA, 18 bp, Homo sapiens
tcattcaaaagttgaaat

SEQ ID NO: 1666502 - DNA, 22 bp, Homo sapiens
tcattcaaaagttgaaattaac

SEQ ID NO: 1666503 - DNA, 16 bp, Homo sapiens
tcattcaatacaagtg

SEQ ID NO: 1666504 - DNA, 21 bp, Homo sapiens
tcattcaatattgacatttgt

SEQ ID NO: 1666505 - DNA, 14 bp, Homo sapiens
tcattcagaaatgt

SEQ ID NO: 1666506 - DNA, 23 bp, Homo sapiens
tcattcagcagcaaattttcagc

SEQ ID NO: 1666507 - DNA, 21 bp, Homo sapiens
tcattcagtgagttaaacacg

SEQ ID NO: 1666508 - DNA, 16 bp, Homo sapiens
tcattccaattctaaa

SEQ ID NO: 1666509 - DNA, 17 bp, Homo sapiens
tcattcccctttgcact

SEQ ID NO: 1666510 - DNA, 20 bp, Homo sapiens
tcattcccctttgcactgta

SEQ ID NO: 1666511 - DNA, 13 bp, Homo sapiens
tcattccggactg

SEQ ID NO: 1666512 - DNA, 15 bp, Homo sapiens
tcattccggactggc

SEQ ID NO: 1666513 - DNA, 14 bp, Homo sapiens
tcattccgttagga

SEQ ID NO: 1666514 - DNA, 17 bp, Homo sapiens
tcattcctgcctgtctc

SEQ ID NO: 1666515 - DNA, 15 bp, Homo sapiens
tcattccttctggcc

SEQ ID NO: 1666516 - DNA, 16 bp, Homo sapiens
tcattcgcctttgtct

SEQ ID NO: 1666517 - DNA, 17 bp, Homo sapiens
tcattctcttcttgcta

SEQ ID NO: 1666518 - DNA, 16 bp, Homo sapiens
tcattctgcaagtata

SEQ ID NO: 1666519 - DNA, 19 bp, Homo sapiens
tcattctgcattgctagat

SEQ ID NO: 1666520 - DNA, 22 bp, Homo sapiens
tcattctgcattgctagataaa

SEQ ID NO: 1666521 - DNA, 13 bp, Homo sapiens
tcattctggaaac

SEQ ID NO: 1666522 - DNA, 22 bp, Homo sapiens
tcattcttacaattgcactgct

SEQ ID NO: 1666523 - DNA, 16 bp, Homo sapiens
tcattcttagctctta

SEQ ID NO: 1666524 - DNA, 17 bp, Homo sapiens
tcattcttgaaagctgt

SEQ ID NO: 1666525 - DNA, 16 bp, Homo sapiens
tcattcttgtgggaga

SEQ ID NO: 1666526 - DNA, 14 bp, Homo sapiens
tcattctttactgc

SEQ ID NO: 1666527 - DNA, 17 bp, Homo sapiens
tcattctttactgcact

SEQ ID NO: 1666528 - DNA, 19 bp, Homo sapiens
tcattctttactgcactca

SEQ ID NO: 1666529 - DNA, 22 bp, Homo sapiens
tcattctttactgcactcagat

SEQ ID NO: 1666530 - DNA, 20 bp, Homo sapiens
tcattcttttcagcttgttt

SEQ ID NO: 1666531 - DNA, 20 bp, Homo sapiens
tcattgactatcaaactgaa

SEQ ID NO: 1666532 - DNA, 21 bp, Homo sapiens
tcattgacttttataaagcat

SEQ ID NO: 1666533 - DNA, 17 bp, Homo sapiens
tcattgcacataagctt

SEQ ID NO: 1666534 - DNA, 23 bp, Homo sapiens
tcattgcacataagcttccattt

SEQ ID NO: 1666535 - DNA, 16 bp, Homo sapiens
tcattgcacctgcagg

SEQ ID NO: 1666536 - DNA, 19 bp, Homo sapiens
tcattgccaagggcccaaa

SEQ ID NO: 1666537 - DNA, 17 bp, Homo sapiens
tcattgcctcctgttct

SEQ ID NO: 1666538 - DNA, 20 bp, Homo sapiens
tcattgccttaactggagcc

SEQ ID NO: 1666539 - DNA, 13 bp, Homo sapiens
tcattgctaaaaa

SEQ ID NO: 1666540 - DNA, 14 bp, Homo sapiens
tcattgctaaaaaa

SEQ ID NO: 1666541 - DNA, 20 bp, Homo sapiens
tcattgctaaaaaataaata

SEQ ID NO: 1666542 - DNA, 18 bp, Homo sapiens
tcattgctaccacagact

SEQ ID NO: 1666543 - DNA, 19 bp, Homo sapiens
tcattgctaccacagactt

SEQ ID NO: 1666544 - DNA, 15 bp, Homo sapiens
tcattgctgagcctc

SEQ ID NO: 1666545 - DNA, 17 bp, Homo sapiens
tcattgctgagcctctg

SEQ ID NO: 1666546 - DNA, 22 bp, Homo sapiens
tcattgctgagcctctgctccc

SEQ ID NO: 1666547 - DNA, 14 bp, Homo sapiens
tcattgctgctgct

SEQ ID NO: 1666548 - DNA, 19 bp, Homo sapiens
tcattgctgtaccacatct

SEQ ID NO: 1666549 - DNA, 21 bp, Homo sapiens
tcattggcagctcaaagactt

SEQ ID NO: 1666550 - DNA, 22 bp, Homo sapiens
tcattgtctactcctagaagaa

SEQ ID NO: 1666551 - DNA, 14 bp, Homo sapiens
tcattgttacatgt

SEQ ID NO: 1666552 - DNA, 15 bp, Homo sapiens
tcattgttatttata

SEQ ID NO: 1666553 - DNA, 23 bp, Homo sapiens
tcatttaaaaaaaaaatttgttt

SEQ ID NO: 1666554 - DNA, 16 bp, Homo sapiens
tcatttacaaaagatt

SEQ ID NO: 1666555 - DNA, 22 bp, Homo sapiens
tcatttactcaaaatctgtcat

SEQ ID NO: 1666556 - DNA, 16 bp, Homo sapiens
tcatttagaacttgca

SEQ ID NO: 1666557 - DNA, 22 bp, Homo sapiens
tcatttagaacttgcagctgat

SEQ ID NO: 1666558 - DNA, 19 bp, Homo sapiens
tcatttagattgaaaactt

SEQ ID NO: 1666559 - DNA, 21 bp, Homo sapiens
tcatttataaaaccatcaaaa

SEQ ID NO: 1666560 - DNA, 12 bp, Homo sapiens
tcatttatctat

SEQ ID NO: 1666561 - DNA, 16 bp, Homo sapiens
tcatttatctataatt

SEQ ID NO: 1666562 - DNA, 18 bp, Homo sapiens
tcatttatctataattta

SEQ ID NO: 1666563 - DNA, 15 bp, Homo sapiens
tcatttatgaaaaga

SEQ ID NO: 1666564 - DNA, 18 bp, Homo sapiens
tcatttcacctgctgctt

SEQ ID NO: 1666565 - DNA, 21 bp, Homo sapiens
tcatttcagaagttagtttgt

SEQ ID NO: 1666566 - DNA, 15 bp, Homo sapiens
tcatttccagcattt

SEQ ID NO: 1666567 - DNA, 13 bp, Homo sapiens
tcatttcctgccc

SEQ ID NO: 1666568 - DNA, 21 bp, Homo sapiens
tcatttccttcaaggcatcat

SEQ ID NO: 1666569 - DNA, 20 bp, Homo sapiens
tcatttctgcagatggaaag

SEQ ID NO: 1666570 - DNA, 22 bp, Homo sapiens
tcatttctgcatcagctgctga

SEQ ID NO: 1666571 - DNA, 14 bp, Homo sapiens
tcatttctttgagt

SEQ ID NO: 1666572 - DNA, 22 bp, Homo sapiens
tcatttctttttgggagagact

SEQ ID NO: 1666573 - DNA, 17 bp, Homo sapiens
tcatttgacacaaagct

SEQ ID NO: 1666574 - DNA, 14 bp, Homo sapiens
tcatttgagataaa

SEQ ID NO: 1666575 - DNA, 22 bp, Homo sapiens
tcatttgagctcatgagggccc

SEQ ID NO: 1666576 - DNA, 16 bp, Homo sapiens
tcatttgatgctaaat

SEQ ID NO: 1666577 - DNA, 16 bp, Homo sapiens
tcatttggtctgccag

SEQ ID NO: 1666578 - DNA, 17 bp, Homo sapiens
tcatttggtctgccaga

SEQ ID NO: 1666579 - DNA, 19 bp, Homo sapiens
tcatttggtctgccagaat

SEQ ID NO: 1666580 - DNA, 19 bp, Homo sapiens
tcatttggtgttcctggaa

SEQ ID NO: 1666581 - DNA, 20 bp, Homo sapiens
tcatttggtgttcctggaag

SEQ ID NO: 1666582 - DNA, 23 bp, Homo sapiens
tcatttgtacaaggtaattgttt

SEQ ID NO: 1666583 - DNA, 16 bp, Homo sapiens
tcatttgtatgtcaaa

SEQ ID NO: 1666584 - DNA, 16 bp, Homo sapiens
tcatttgtattccatt

SEQ ID NO: 1666585 - DNA, 17 bp, Homo sapiens
tcatttgtttaaaaagg

SEQ ID NO: 1666586 - DNA, 21 bp, Homo sapiens
tcatttgtttaaaaaggcagt

SEQ ID NO: 1666587 - DNA, 15 bp, Homo sapiens
tcatttgtttacatt

SEQ ID NO: 1666588 - DNA, 19 bp, Homo sapiens
tccactcccccacctgaca

SEQ ID NO: 1666589 - DNA, 15 bp, Homo sapiens
tccactccttctctc

SEQ ID NO: 1666590 - DNA, 20 bp, Homo sapiens
tccactctaccctcccaccc

SEQ ID NO: 1666591 - DNA, 23 bp, Homo sapiens
tccactctaccctcccaccccct

SEQ ID NO: 1666592 - DNA, 14 bp, Homo sapiens
tccactctgattca

SEQ ID NO: 1666593 - DNA, 19 bp, Homo sapiens
tccactctgcttctctgac

SEQ ID NO: 1666594 - DNA, 21 bp, Homo sapiens
tccactctgcttctctgactt

SEQ ID NO: 1666595 - DNA, 20 bp, Homo sapiens
tccactgacaaacgtcccca

SEQ ID NO: 1666596 - DNA, 21 bp, Homo sapiens
tccactgagactttcccctct

SEQ ID NO: 1666597 - DNA, 12 bp, Homo sapiens
tccactgccctg

SEQ ID NO: 1666598 - DNA, 22 bp, Homo sapiens
tccactgccttcgatacaccgg

SEQ ID NO: 1666599 - DNA, 12 bp, Homo sapiens
tccactgctgga

SEQ ID NO: 1666600 - DNA, 10 bp, Homo sapiens
tccactggac

SEQ ID NO: 1666601 - DNA, 16 bp, Homo sapiens
tccactggacttgagc

SEQ ID NO: 1666602 - DNA, 14 bp, Homo sapiens
tccactgtgcacac

SEQ ID NO: 1666603 - DNA, 23 bp, Homo sapiens
tccactgttctcctgaatatttt

SEQ ID NO: 1666604 - DNA, 13 bp, Homo sapiens
tccacttcccgtc

SEQ ID NO: 1666605 - DNA, 16 bp, Homo sapiens
tccacttctggtataa

SEQ ID NO: 1666606 - DNA, 18 bp, Homo sapiens
tccagaaaaccccagcat

SEQ ID NO: 1666607 - DNA, 23 bp, Homo sapiens
tccagaaaacctctcctgacccc

SEQ ID NO: 1666608 - DNA, 18 bp, Homo sapiens
tccagaaagcaggagcag

SEQ ID NO: 1666609 - DNA, 20 bp, Homo sapiens
tccagaaagcaggagcagct

SEQ ID NO: 1666610 - DNA, 21 bp, Homo sapiens
tccagaaagcaggagcagctg

SEQ ID NO: 1666611 - DNA, 19 bp, Homo sapiens
tccagaaaggatatttaag

SEQ ID NO: 1666612 - DNA, 22 bp, Homo sapiens
tccagaaaggatatttaagaaa

SEQ ID NO: 1666613 - DNA, 18 bp, Homo sapiens
tccagaaattgtgtgtgc

SEQ ID NO: 1666614 - DNA, 22 bp, Homo sapiens
tccagaacagccctcggcctcc

SEQ ID NO: 1666615 - DNA, 23 bp, Homo sapiens
tccagaacagccctcggcctccg

SEQ ID NO: 1666616 - DNA, 15 bp, Homo sapiens
tccagaagaagagaa

SEQ ID NO: 1666617 - DNA, 19 bp, Homo sapiens
tccagaagaagagaagctg

SEQ ID NO: 1666618 - DNA, 20 bp, Homo sapiens
tccagaagaatattcaggac

SEQ ID NO: 1666619 - DNA, 16 bp, Homo sapiens
tccagaagatgccagc

SEQ ID NO: 1666620 - DNA, 19 bp, Homo sapiens
tccagaagatgccagcttc

SEQ ID NO: 1666621 - DNA, 15 bp, Homo sapiens
tccagaagctgtact

SEQ ID NO: 1666622 - DNA, 14 bp, Homo sapiens
tccagaatctaaag

SEQ ID NO: 1666623 - DNA, 18 bp, Homo sapiens
tccagaatctaaagccag

SEQ ID NO: 1666624 - DNA, 19 bp, Homo sapiens
tccagaatctgctgttgcc

SEQ ID NO: 1666625 - DNA, 21 bp, Homo sapiens
tccagaatcttgactttctga

SEQ ID NO: 1666626 - DNA, 21 bp, Homo sapiens
tccagaatttattagtttaaa

SEQ ID NO: 1666627 - DNA, 15 bp, Homo sapiens
tccagaccccctgag

SEQ ID NO: 1666628 - DNA, 15 bp, Homo sapiens
tccagaccctgcctg

SEQ ID NO: 1666629 - DNA, 22 bp, Homo sapiens
tccagaccctgcctgagcccag

SEQ ID NO: 1666630 - DNA, 18 bp, Homo sapiens
tccagacctgatcctgga

SEQ ID NO: 1666631 - DNA, 19 bp, Homo sapiens
tccagacctggctccactc

SEQ ID NO: 1666632 - DNA, 18 bp, Homo sapiens
tccagactcagagctctc

SEQ ID NO: 1666633 - DNA, 19 bp, Homo sapiens
tccagactcaggttccaga

SEQ ID NO: 1666634 - DNA, 22 bp, Homo sapiens
tccagactgcttccaattttct

SEQ ID NO: 1666635 - DNA, 19 bp, Homo sapiens
tccagacttccttgagaca

SEQ ID NO: 1666636 - DNA, 20 bp, Homo sapiens
tccagacttccttgagacac

SEQ ID NO: 1666637 - DNA, 16 bp, Homo sapiens
tccagagacaacaggt

SEQ ID NO: 1666638 - DNA, 20 bp, Homo sapiens
tccagagacatgggcctccc

SEQ ID NO: 1666639 - DNA, 17 bp, Homo sapiens
tccagagagtggctcct

SEQ ID NO: 1666640 - DNA, 10 bp, Homo sapiens
tccagagcca

SEQ ID NO: 1666641 - DNA, 14 bp, Homo sapiens
tccagagccagcct

SEQ ID NO: 1666642 - DNA, 15 bp, Homo sapiens
tccagagccagcctg

SEQ ID NO: 1666643 - DNA, 19 bp, Homo sapiens
tccagagccagcctgggac

SEQ ID NO: 1666644 - DNA, 15 bp, Homo sapiens
tccagaggtattcct

SEQ ID NO: 1666645 - DNA, 16 bp, Homo sapiens
tccagagtctgagccc

SEQ ID NO: 1666646 - DNA, 15 bp, Homo sapiens
tccagagttaaaatg

SEQ ID NO: 1666647 - DNA, 23 bp, Homo sapiens
tccagataactctctttccttga

SEQ ID NO: 1666648 - DNA, 14 bp, Homo sapiens
tccagatagagaaa

SEQ ID NO: 1666649 - DNA, 22 bp, Homo sapiens
tccagatagtgtagctgaggag

SEQ ID NO: 1666650 - DNA, 15 bp, Homo sapiens
tccagatcactgcca

SEQ ID NO: 1666651 - DNA, 14 bp, Homo sapiens
tccagatggccccc

SEQ ID NO: 1666652 - DNA, 18 bp, Homo sapiens
tccagatggtcatccaga

SEQ ID NO: 1666653 - DNA, 18 bp, Homo sapiens
tccagattctgatgcata

SEQ ID NO: 1666654 - DNA, 17 bp, Homo sapiens
tccagcaacacagcctg

SEQ ID NO: 1666655 - DNA, 18 bp, Homo sapiens
tccagcaactgcccttcc

SEQ ID NO: 1666656 - DNA, 19 bp, Homo sapiens
tccagcaacttcttctcca

SEQ ID NO: 1666657 - DNA, 21 bp, Homo sapiens
tccagcaattctcctgcctca

SEQ ID NO: 1666658 - DNA, 23 bp, Homo sapiens
tccagcacagaaggaatctgtgc

SEQ ID NO: 1666659 - DNA, 18 bp, Homo sapiens
tccagcaccttgtgcctg

SEQ ID NO: 1666660 - DNA, 19 bp, Homo sapiens
tccagcaccttgtgcctgg

SEQ ID NO: 1666661 - DNA, 17 bp, Homo sapiens
tccagcagaagacaaaa

SEQ ID NO: 1666662 - DNA, 22 bp, Homo sapiens
tccagcagatttccagccttct

SEQ ID NO: 1666663 - DNA, 19 bp, Homo sapiens
tccagcagcacacctcagc

SEQ ID NO: 1666664 - DNA, 20 bp, Homo sapiens
tccagcagcacacctcagcc

SEQ ID NO: 1666665 - DNA, 21 bp, Homo sapiens
tccagcagcacacctcagccc

SEQ ID NO: 1666666 - DNA, 14 bp, Homo sapiens
tccagcagctgcgg

SEQ ID NO: 1666667 - DNA, 23 bp, Homo sapiens
tccagcagctgcgggtctgaagg

SEQ ID NO: 1666668 - DNA, 17 bp, Homo sapiens
tccagcatccagcctgt

SEQ ID NO: 1666669 - DNA, 13 bp, Homo sapiens
tccagccagctcc

SEQ ID NO: 1666670 - DNA, 22 bp, Homo sapiens
tccagccagctcctgggcagct

SEQ ID NO: 1666671 - DNA, 15 bp, Homo sapiens
tccagccatctcatg

SEQ ID NO: 1666672 - DNA, 16 bp, Homo sapiens
tccagccccatgtgtg

SEQ ID NO: 1666673 - DNA, 14 bp, Homo sapiens
tccagcccctctgg

SEQ ID NO: 1666674 - DNA, 15 bp, Homo sapiens
tccagcccctctggt

SEQ ID NO: 1666675 - DNA, 12 bp, Homo sapiens
tccagcccctgt

SEQ ID NO: 1666676 - DNA, 13 bp, Homo sapiens
tccagcccctgtc

SEQ ID NO: 1666677 - DNA, 14 bp, Homo sapiens
tccagcccctgtcc

SEQ ID NO: 1666678 - DNA, 20 bp, Homo sapiens
tccagcccctgtcccacccc

SEQ ID NO: 1666679 - DNA, 23 bp, Homo sapiens
tccagcccctgtcccaccccctt

SEQ ID NO: 1666680 - DNA, 16 bp, Homo sapiens
tccagccgccattgcc

SEQ ID NO: 1666681 - DNA, 20 bp, Homo sapiens
tccagccgccattgccacca

SEQ ID NO: 1666682 - DNA, 13 bp, Homo sapiens
tccagcctccagg

SEQ ID NO: 1666683 - DNA, 17 bp, Homo sapiens
tccagcctccagggcat

SEQ ID NO: 1666684 - DNA, 18 bp, Homo sapiens
tccagcctccagggcatt

SEQ ID NO: 1666685 - DNA, 23 bp, Homo sapiens
tccagcctccctgtctccagctg

SEQ ID NO: 1666686 - DNA, 13 bp, Homo sapiens
tccagcctctccc

SEQ ID NO: 1666687 - DNA, 21 bp, Homo sapiens
tccagcctctcccggctgcct

SEQ ID NO: 1666688 - DNA, 16 bp, Homo sapiens
tccagcctgagtgaca

SEQ ID NO: 1666689 - DNA, 17 bp, Homo sapiens
tccagcctgagtgacag

SEQ ID NO: 1666690 - DNA, 21 bp, Homo sapiens
tccagcctgctagtctgccct

SEQ ID NO: 1666691 - DNA, 11 bp, Homo sapiens
tccagcctggg

SEQ ID NO: 1666692 - DNA, 12 bp, Homo sapiens
tccagcctgggc

SEQ ID NO: 1666693 - DNA, 22 bp, Homo sapiens
tccagcctgggcagccaggctg

SEQ ID NO: 1666694 - DNA, 17 bp, Homo sapiens
tccagcctggggtctgg

SEQ ID NO: 1666695 - DNA, 17 bp, Homo sapiens
tccagcctgggtcacag

SEQ ID NO: 1666696 - DNA, 20 bp, Homo sapiens
tccagcctggtttagcctgg

SEQ ID NO: 1666697 - DNA, 15 bp, Homo sapiens
tccagccttccaggt

SEQ ID NO: 1666698 - DNA, 15 bp, Homo sapiens
tccagcgatggtgct

SEQ ID NO: 1666699 - DNA, 14 bp, Homo sapiens
tccagcgtcactcc

SEQ ID NO: 1666700 - DNA, 15 bp, Homo sapiens
tccagcgtcactcca

SEQ ID NO: 1666701 - DNA, 22 bp, Homo sapiens
tccagctaaacaccaacccctg

SEQ ID NO: 1666702 - DNA, 15 bp, Homo sapiens
tcccaccttggcctc

SEQ ID NO: 1666703 - DNA, 21 bp, Homo sapiens
tcccacgcctcaccagccccc

SEQ ID NO: 1666704 - DNA, 22 bp, Homo sapiens
tcccactaaaggggttccaaat

SEQ ID NO: 1666705 - DNA, 12 bp, Homo sapiens
tcccactcacct

SEQ ID NO: 1666706 - DNA, 22 bp, Homo sapiens
tcccactcagaactctccaggg

SEQ ID NO: 1666707 - DNA, 14 bp, Homo sapiens
tcccactcctgctg

SEQ ID NO: 1666708 - DNA, 15 bp, Homo sapiens
tcccactcctgctgc

SEQ ID NO: 1666709 - DNA, 15 bp, Homo sapiens
tcccactgcactcca

SEQ ID NO: 1666710 - DNA, 13 bp, Homo sapiens
tcccactggggcc

SEQ ID NO: 1666711 - DNA, 13 bp, Homo sapiens
tcccactgtatga

SEQ ID NO: 1666712 - DNA, 22 bp, Homo sapiens
tcccacttagccgcaccctgca

SEQ ID NO: 1666713 - DNA, 16 bp, Homo sapiens
tcccacttcactgtga

SEQ ID NO: 1666714 - DNA, 21 bp, Homo sapiens
tcccacttcagcctcccaagc

SEQ ID NO: 1666715 - DNA, 12 bp, Homo sapiens
tcccacttgtca

SEQ ID NO: 1666716 - DNA, 18 bp, Homo sapiens
tcccagaaacatctctgg

SEQ ID NO: 1666717 - DNA, 19 bp, Homo sapiens
tcccagaaacatctctggc

SEQ ID NO: 1666718 - DNA, 22 bp, Homo sapiens
tcccagaaacatctctggccca

SEQ ID NO: 1666719 - DNA, 18 bp, Homo sapiens
tcccagaatctctgagcc

SEQ ID NO: 1666720 - DNA, 15 bp, Homo sapiens
tcccagaatgctggg

SEQ ID NO: 1666721 - DNA, 17 bp, Homo sapiens
tcccagaatgctgggtt

SEQ ID NO: 1666722 - DNA, 14 bp, Homo sapiens
tcccagagcccgct

SEQ ID NO: 1666723 - DNA, 22 bp, Homo sapiens
tcccagagctcatcccccctgc

SEQ ID NO: 1666724 - DNA, 20 bp, Homo sapiens
tcccagagcttattggccac

SEQ ID NO: 1666725 - DNA, 16 bp, Homo sapiens
tcccagaggagccacc

SEQ ID NO: 1666726 - DNA, 20 bp, Homo sapiens
tcccagaggttatctgcctg

SEQ ID NO: 1666727 - DNA, 22 bp, Homo sapiens
tcccagaggttatctgcctggc

SEQ ID NO: 1666728 - DNA, 24 bp, Homo sapiens
tcccagaggttatctgcctggcct

SEQ ID NO: 1666729 - DNA, 22 bp, Homo sapiens
tcccagagtcagaggagaagag

SEQ ID NO: 1666730 - DNA, 19 bp, Homo sapiens
tcccagattggctcacact

SEQ ID NO: 1666731 - DNA, 20 bp, Homo sapiens
tcccagattggctcacactg

SEQ ID NO: 1666732 - DNA, 22 bp, Homo sapiens
tcccagattggctcacactgag

SEQ ID NO: 1666733 - DNA, 19 bp, Homo sapiens
tcccagcagcagagaacca

SEQ ID NO: 1666734 - DNA, 18 bp, Homo sapiens
tcccagcagccctaagga

SEQ ID NO: 1666735 - DNA, 15 bp, Homo sapiens
tcccagcatccctgg

SEQ ID NO: 1666736 - DNA, 18 bp, Homo sapiens
tcccagcatccctggagc

SEQ ID NO: 1666737 - DNA, 13 bp, Homo sapiens
tcccagccacccc

SEQ ID NO: 1666738 - DNA, 24 bp, Homo sapiens
tcccagccaccccgggctctctgc

SEQ ID NO: 1666739 - DNA, 14 bp, Homo sapiens
tcccagccacgcag

SEQ ID NO: 1666740 - DNA, 15 bp, Homo sapiens
tcccagcccaaagct

SEQ ID NO: 1666741 - DNA, 14 bp, Homo sapiens
tcccagcccattgc

SEQ ID NO: 1666742 - DNA, 13 bp, Homo sapiens
tcccagcccctgc

SEQ ID NO: 1666743 - DNA, 19 bp, Homo sapiens
tcccagcccctgcccctca

SEQ ID NO: 1666744 - DNA, 22 bp, Homo sapiens
tcccagcctggggctccctctc

SEQ ID NO: 1666745 - DNA, 18 bp, Homo sapiens
tcccagcggctggtgcag

SEQ ID NO: 1666746 - DNA, 19 bp, Homo sapiens
tcccagcggctggtgcagg

SEQ ID NO: 1666747 - DNA, 20 bp, Homo sapiens
tcccagcggctggtgcaggg

SEQ ID NO: 1666748 - DNA, 23 bp, Homo sapiens
tcccagcggctggtgcagggcct

SEQ ID NO: 1666749 - DNA, 24 bp, Homo sapiens
tcccagcgtttagtttctagaggc

SEQ ID NO: 1666750 - DNA, 16 bp, Homo sapiens
tcccagctactcagaa

SEQ ID NO: 1666751 - DNA, 23 bp, Homo sapiens
tcccagctactcaggaggctgag

SEQ ID NO: 1666752 - DNA, 22 bp, Homo sapiens
tcccagctactggggaggctga

SEQ ID NO: 1666753 - DNA, 23 bp, Homo sapiens
tcccagctactggggaggctgag

SEQ ID NO: 1666754 - DNA, 16 bp, Homo sapiens
tcccagctacttggga

SEQ ID NO: 1666755 - DNA, 19 bp, Homo sapiens
tcccagctacttgggaggc

SEQ ID NO: 1666756 - DNA, 20 bp, Homo sapiens
tcccagctaggaagagcagg

SEQ ID NO: 1666757 - DNA, 16 bp, Homo sapiens
tcccagctccccccgc

SEQ ID NO: 1666758 - DNA, 16 bp, Homo sapiens
tcccagctctccctct

SEQ ID NO: 1666759 - DNA, 15 bp, Homo sapiens
tcccagctgaaggca

SEQ ID NO: 1666760 - DNA, 18 bp, Homo sapiens
tcccagctgccatgtttc

SEQ ID NO: 1666761 - DNA, 17 bp, Homo sapiens
tcccagcttcaaatgca

SEQ ID NO: 1666762 - DNA, 11 bp, Homo sapiens
tcccaggacac

SEQ ID NO: 1666763 - DNA, 15 bp, Homo sapiens
tcccaggagacagtt

SEQ ID NO: 1666764 - DNA, 18 bp, Homo sapiens
tcccaggagctgcccaga

SEQ ID NO: 1666765 - DNA, 18 bp, Homo sapiens
tcccaggaggtgcttgag

SEQ ID NO: 1666766 - DNA, 12 bp, Homo sapiens
tcccaggccagg

SEQ ID NO: 1666767 - DNA, 15 bp, Homo sapiens
tcccaggcttcaccc

SEQ ID NO: 1666768 - DNA, 22 bp, Homo sapiens
tcccaggcttcaccctgaatgg

SEQ ID NO: 1666769 - DNA, 23 bp, Homo sapiens
tcccagggccagggccctgcaga

SEQ ID NO: 1666770 - DNA, 13 bp, Homo sapiens
tcccagggccctc

SEQ ID NO: 1666771 - DNA, 17 bp, Homo sapiens
tcccagggccctcccag

SEQ ID NO: 1666772 - DNA, 18 bp, Homo sapiens
tcccagggccctcccagc

SEQ ID NO: 1666773 - DNA, 19 bp, Homo sapiens
tcccagggccctcccagcc

SEQ ID NO: 1666774 - DNA, 20 bp, Homo sapiens
tcccagggccctcccagccc

SEQ ID NO: 1666775 - DNA, 18 bp, Homo sapiens
tcccagggctctgcaggc

SEQ ID NO: 1666776 - DNA, 12 bp, Homo sapiens
tcccaggggacc

SEQ ID NO: 1666777 - DNA, 16 bp, Homo sapiens
tcccaggggagccagc

SEQ ID NO: 1666778 - DNA, 19 bp, Homo sapiens
tcccaggggagccagctgc

SEQ ID NO: 1666779 - DNA, 18 bp, Homo sapiens
tcccaggggtctccctgg

SEQ ID NO: 1666780 - DNA, 19 bp, Homo sapiens
tcccaggggtctccctggc

SEQ ID NO: 1666781 - DNA, 20 bp, Homo sapiens
tcccaggggtctccctggct

SEQ ID NO: 1666782 - DNA, 22 bp, Homo sapiens
tcccaggggtctccctggctcc

SEQ ID NO: 1666783 - DNA, 18 bp, Homo sapiens
tcccaggtaccagctgcg

SEQ ID NO: 1666784 - DNA, 21 bp, Homo sapiens
tcccaggtaccagctgcgctt

SEQ ID NO: 1666785 - DNA, 22 bp, Homo sapiens
tcccaggtgttaacattccaag

SEQ ID NO: 1666786 - DNA, 20 bp, Homo sapiens
tcccaggttcccccagcaag

SEQ ID NO: 1666787 - DNA, 19 bp, Homo sapiens
tcccagtagccaaggcccg

SEQ ID NO: 1666788 - DNA, 11 bp, Homo sapiens
tcccagtattt

SEQ ID NO: 1666789 - DNA, 17 bp, Homo sapiens
tcccagtcactcctctc

SEQ ID NO: 1666790 - DNA, 16 bp, Homo sapiens
tcccagtcagaaataa

SEQ ID NO: 1666791 - DNA, 22 bp, Homo sapiens
tcccagtcagaaataaaatttg

SEQ ID NO: 1666792 - DNA, 13 bp, Homo sapiens
tcccagtccctcg

SEQ ID NO: 1666793 - DNA, 21 bp, Homo sapiens
tcccagtgaatccctgggagc

SEQ ID NO: 1666794 - DNA, 15 bp, Homo sapiens
tcccagtgaattctt

SEQ ID NO: 1666795 - DNA, 12 bp, Homo sapiens
tcccagtgacaa

SEQ ID NO: 1666796 - DNA, 10 bp, Homo sapiens
tcccagtggg

SEQ ID NO: 1666797 - DNA, 15 bp, Homo sapiens
tcccagtgggagggg

SEQ ID NO: 1666798 - DNA, 13 bp, Homo sapiens
tcccagttttgtt

SEQ ID NO: 1666799 - DNA, 21 bp, Homo sapiens
tcccataattgctttgccaaa

SEQ ID NO: 1666800 - DNA, 22 bp, Homo sapiens
tcccatagtggggcctgggagg

SEQ ID NO: 1666801 - DNA, 15 bp, Homo sapiens
tcccatcagggaaga

SEQ ID NO: 1666802 - DNA, 13 bp, Homo sapiens
tcccatccccctg

SEQ ID NO: 1666803 - DNA, 19 bp, Homo sapiens
tcccatccccctgccctcg

SEQ ID NO: 1666804 - DNA, 20 bp, Homo sapiens
tcccatcctaccctcgggcc

SEQ ID NO: 1666805 - DNA, 18 bp, Homo sapiens
tcccatcctggggcagca

SEQ ID NO: 1666806 - DNA, 13 bp, Homo sapiens
tcccatcgctgtc

SEQ ID NO: 1666807 - DNA, 22 bp, Homo sapiens
tcccatcgtctcggccttcaca

SEQ ID NO: 1666808 - DNA, 16 bp, Homo sapiens
tcccatctccactgtt

SEQ ID NO: 1666809 - DNA, 18 bp, Homo sapiens
tcccatctcctgatttct

SEQ ID NO: 1666810 - DNA, 14 bp, Homo sapiens
tcccatctccttcc

SEQ ID NO: 1666811 - DNA, 22 bp, Homo sapiens
tcccatctccttcccccagccc

SEQ ID NO: 1666812 - DNA, 23 bp, Homo sapiens
tcccatctccttcccccagccca

SEQ ID NO: 1666813 - DNA, 13 bp, Homo sapiens
tcccatctgcacc

SEQ ID NO: 1666814 - DNA, 19 bp, Homo sapiens
tcccatctgcaccccttct

SEQ ID NO: 1666815 - DNA, 14 bp, Homo sapiens
tcccatctggcttt

SEQ ID NO: 1666816 - DNA, 16 bp, Homo sapiens
tccctcctccaggcct

SEQ ID NO: 1666817 - DNA, 15 bp, Homo sapiens
tccctcctcccatct

SEQ ID NO: 1666818 - DNA, 12 bp, Homo sapiens
tccctcctgagc

SEQ ID NO: 1666819 - DNA, 14 bp, Homo sapiens
tccctcctgagctc

SEQ ID NO: 1666820 - DNA, 16 bp, Homo sapiens
tccctcctgcacacag

SEQ ID NO: 1666821 - DNA, 14 bp, Homo sapiens
tccctcctggagct

SEQ ID NO: 1666822 - DNA, 21 bp, Homo sapiens
tccctcctggagctctgtggg

SEQ ID NO: 1666823 - DNA, 22 bp, Homo sapiens
tccctcgatcatatttcccctt

SEQ ID NO: 1666824 - DNA, 16 bp, Homo sapiens
tccctcgccctgtgag

SEQ ID NO: 1666825 - DNA, 19 bp, Homo sapiens
tccctcgccgtccctccca

SEQ ID NO: 1666826 - DNA, 21 bp, Homo sapiens
tccctcgccgtccctcccagg

SEQ ID NO: 1666827 - DNA, 22 bp, Homo sapiens
tccctcgccgtccctcccaggt

SEQ ID NO: 1666828 - DNA, 16 bp, Homo sapiens
tccctcgctgtatgat

SEQ ID NO: 1666829 - DNA, 15 bp, Homo sapiens
tccctcgtccacagg

SEQ ID NO: 1666830 - DNA, 20 bp, Homo sapiens
tccctcgtccacaggggcag

SEQ ID NO: 1666831 - DNA, 17 bp, Homo sapiens
tccctcgtcttcagctg

SEQ ID NO: 1666832 - DNA, 21 bp, Homo sapiens
tccctcgtcttcagctgcatt

SEQ ID NO: 1666833 - DNA, 19 bp, Homo sapiens
tccctctaacccagtggct

SEQ ID NO: 1666834 - DNA, 16 bp, Homo sapiens
tccctctaatgagact

SEQ ID NO: 1666835 - DNA, 14 bp, Homo sapiens
tccctctaatttat

SEQ ID NO: 1666836 - DNA, 13 bp, Homo sapiens
tccctctatttat

SEQ ID NO: 1666837 - DNA, 15 bp, Homo sapiens
tccctctcactcccc

SEQ ID NO: 1666838 - DNA, 17 bp, Homo sapiens
tccctctcactccccag

SEQ ID NO: 1666839 - DNA, 15 bp, Homo sapiens
tccctctcagtgcct

SEQ ID NO: 1666840 - DNA, 17 bp, Homo sapiens
tccctctcagtgccttc

SEQ ID NO: 1666841 - DNA, 21 bp, Homo sapiens
tccctctcagtgccttctctc

SEQ ID NO: 1666842 - DNA, 14 bp, Homo sapiens
tccctctcatctca

SEQ ID NO: 1666843 - DNA, 17 bp, Homo sapiens
tccctctcccaggcccg

SEQ ID NO: 1666844 - DNA, 12 bp, Homo sapiens
tccctctccctc

SEQ ID NO: 1666845 - DNA, 14 bp, Homo sapiens
tccctctcctaact

SEQ ID NO: 1666846 - DNA, 16 bp, Homo sapiens
tccctctcctgtagcc

SEQ ID NO: 1666847 - DNA, 12 bp, Homo sapiens
tccctctcggaa

SEQ ID NO: 1666848 - DNA, 17 bp, Homo sapiens
tccctctctcatgagaa

SEQ ID NO: 1666849 - DNA, 12 bp, Homo sapiens
tccctctctctg

SEQ ID NO: 1666850 - DNA, 23 bp, Homo sapiens
tccctctctctgggaccactggg

SEQ ID NO: 1666851 - DNA, 16 bp, Homo sapiens
tccctctctcttctgc

SEQ ID NO: 1666852 - DNA, 23 bp, Homo sapiens
tccctctctcttctgctccaccc

SEQ ID NO: 1666853 - DNA, 15 bp, Homo sapiens
tccctctctgtgcat

SEQ ID NO: 1666854 - DNA, 16 bp, Homo sapiens
tccctctcttcccctt

SEQ ID NO: 1666855 - DNA, 13 bp, Homo sapiens
tccctctcttggc

SEQ ID NO: 1666856 - DNA, 19 bp, Homo sapiens
tccctctgccccaagcagc

SEQ ID NO: 1666857 - DNA, 23 bp, Homo sapiens
tccctctgccccaagcagccagc

SEQ ID NO: 1666858 - DNA, 15 bp, Homo sapiens
tccctctgccttcag

SEQ ID NO: 1666859 - DNA, 16 bp, Homo sapiens
tccctctggccctgcc

SEQ ID NO: 1666860 - DNA, 20 bp, Homo sapiens
tccctctggccctgccttct

SEQ ID NO: 1666861 - DNA, 12 bp, Homo sapiens
tccctctgggcc

SEQ ID NO: 1666862 - DNA, 13 bp, Homo sapiens
tccctctgggcct

SEQ ID NO: 1666863 - DNA, 14 bp, Homo sapiens
tccctctgggcctg

SEQ ID NO: 1666864 - DNA, 19 bp, Homo sapiens
tccctctgggcctgttctc

SEQ ID NO: 1666865 - DNA, 20 bp, Homo sapiens
tccctctgggcctgttctct

SEQ ID NO: 1666866 - DNA, 21 bp, Homo sapiens
tccctctggtctactctagaa

SEQ ID NO: 1666867 - DNA, 12 bp, Homo sapiens
tccctcttgtaa

SEQ ID NO: 1666868 - DNA, 16 bp, Homo sapiens
tccctgaaaacccaga

SEQ ID NO: 1666869 - DNA, 18 bp, Homo sapiens
tccctgaaatttctcatt

SEQ ID NO: 1666870 - DNA, 19 bp, Homo sapiens
tccctgaacgttttcttct

SEQ ID NO: 1666871 - DNA, 16 bp, Homo sapiens
tccctgaagttatgtg

SEQ ID NO: 1666872 - DNA, 18 bp, Homo sapiens
tccctgaatctgtgcctg

SEQ ID NO: 1666873 - DNA, 17 bp, Homo sapiens
tccctgacctccctcta

SEQ ID NO: 1666874 - DNA, 21 bp, Homo sapiens
tccctgacctccctctaattt

SEQ ID NO: 1666875 - DNA, 20 bp, Homo sapiens
tccctgaccttagcgttctg

SEQ ID NO: 1666876 - DNA, 18 bp, Homo sapiens
tccctgactctctgtgac

SEQ ID NO: 1666877 - DNA, 19 bp, Homo sapiens
tccctgagaaacccaccag

SEQ ID NO: 1666878 - DNA, 21 bp, Homo sapiens
tccctgagaaacccaccagcc

SEQ ID NO: 1666879 - DNA, 11 bp, Homo sapiens
tccctgagcag

SEQ ID NO: 1666880 - DNA, 14 bp, Homo sapiens
tccctgaggaatga

SEQ ID NO: 1666881 - DNA, 20 bp, Homo sapiens
tccctgaggactgatttcag

SEQ ID NO: 1666882 - DNA, 14 bp, Homo sapiens
tccctgaggatggg

SEQ ID NO: 1666883 - DNA, 15 bp, Homo sapiens
tccctgaggatgggt

SEQ ID NO: 1666884 - DNA, 22 bp, Homo sapiens
tccctgaggatgggtcagagct

SEQ ID NO: 1666885 - DNA, 16 bp, Homo sapiens
tccctgagtcaccagg

SEQ ID NO: 1666886 - DNA, 21 bp, Homo sapiens
tccctgagtcaccaggaatgt

SEQ ID NO: 1666887 - DNA, 14 bp, Homo sapiens
tccctgataaatat

SEQ ID NO: 1666888 - DNA, 15 bp, Homo sapiens
tccctgataaatatt

SEQ ID NO: 1666889 - DNA, 16 bp, Homo sapiens
tccctgcacaagccag

SEQ ID NO: 1666890 - DNA, 12 bp, Homo sapiens
tccctgcacagc

SEQ ID NO: 1666891 - DNA, 13 bp, Homo sapiens
tccctgcacagcc

SEQ ID NO: 1666892 - DNA, 14 bp, Homo sapiens
tccctgcacagcct

SEQ ID NO: 1666893 - DNA, 23 bp, Homo sapiens
tccctgcacagtgacttctgaga

SEQ ID NO: 1666894 - DNA, 15 bp, Homo sapiens
tccctgcacccatga

SEQ ID NO: 1666895 - DNA, 17 bp, Homo sapiens
tccctgcaccctggaaa

SEQ ID NO: 1666896 - DNA, 20 bp, Homo sapiens
tccctgcactccctcctgga

SEQ ID NO: 1666897 - DNA, 13 bp, Homo sapiens
tccctgcactgtg

SEQ ID NO: 1666898 - DNA, 19 bp, Homo sapiens
tccctgccaagtctcagaa

SEQ ID NO: 1666899 - DNA, 22 bp, Homo sapiens
tccctgccaccaggcactgcct

SEQ ID NO: 1666900 - DNA, 13 bp, Homo sapiens
tccctgcccccca

SEQ ID NO: 1666901 - DNA, 20 bp, Homo sapiens
tccctgcccctcccttcaac

SEQ ID NO: 1666902 - DNA, 12 bp, Homo sapiens
tccctgccctcc

SEQ ID NO: 1666903 - DNA, 21 bp, Homo sapiens
tccctgccctcccctgctccc

SEQ ID NO: 1666904 - DNA, 17 bp, Homo sapiens
tccctgcctcagtggct

SEQ ID NO: 1666905 - DNA, 22 bp, Homo sapiens
tccctgccttcactgtgctcca

SEQ ID NO: 1666906 - DNA, 17 bp, Homo sapiens
tccctgccttgctgaca

SEQ ID NO: 1666907 - DNA, 21 bp, Homo sapiens
tccctgccttgctgacaataa

SEQ ID NO: 1666908 - DNA, 23 bp, Homo sapiens
tccctgccttgctgacaataaag

SEQ ID NO: 1666909 - DNA, 15 bp, Homo sapiens
tccctgcgagacgca

SEQ ID NO: 1666910 - DNA, 23 bp, Homo sapiens
tccctgcgagacgcacacagctg

SEQ ID NO: 1666911 - DNA, 16 bp, Homo sapiens
tccctgcgcctgtgat

SEQ ID NO: 1666912 - DNA, 17 bp, Homo sapiens
tccctgcgcctgtgatg

SEQ ID NO: 1666913 - DNA, 21 bp, Homo sapiens
tccctgctctaacacctgcct

SEQ ID NO: 1666914 - DNA, 22 bp, Homo sapiens
tccctgctctaacacctgccta

SEQ ID NO: 1666915 - DNA, 16 bp, Homo sapiens
tccctgctctctgagt

SEQ ID NO: 1666916 - DNA, 15 bp, Homo sapiens
tccctgctgaatgcc

SEQ ID NO: 1666917 - DNA, 20 bp, Homo sapiens
tccctgctgtgccatgctgg

SEQ ID NO: 1666918 - DNA, 16 bp, Homo sapiens
tccctgctttgcatct

SEQ ID NO: 1666919 - DNA, 17 bp, Homo sapiens
tccctgctttgcatctt

SEQ ID NO: 1666920 - DNA, 23 bp, Homo sapiens
tccctggaaaccttccacccagt

SEQ ID NO: 1666921 - DNA, 11 bp, Homo sapiens
tccctggaagc

SEQ ID NO: 1666922 - DNA, 15 bp, Homo sapiens
tccctggaagctgga

SEQ ID NO: 1666923 - DNA, 10 bp, Homo sapiens
tccctggaca

SEQ ID NO: 1666924 - DNA, 13 bp, Homo sapiens
tccctggacacag

SEQ ID NO: 1666925 - DNA, 14 bp, Homo sapiens
tccctggacacagc

SEQ ID NO: 1666926 - DNA, 19 bp, Homo sapiens
tccctggacacagctcttc

SEQ ID NO: 1666927 - DNA, 21 bp, Homo sapiens
tccctggacacagctcttcat

SEQ ID NO: 1666928 - DNA, 15 bp, Homo sapiens
tccctggacaggcag

SEQ ID NO: 1666929 - DNA, 17 bp, Homo sapiens
tccctggacaggcagcc

SEQ ID NO: 1666930 - DNA, 23 bp, Homo sapiens
tccctggagcaggagccccgcca

SEQ ID NO: 1666931 - DNA, 16 bp, Homo sapiens
tcctactaggcaaaat

SEQ ID NO: 1666932 - DNA, 19 bp, Homo sapiens
tcctacttctgactttact

SEQ ID NO: 1666933 - DNA, 17 bp, Homo sapiens
tcctactttagccactg

SEQ ID NO: 1666934 - DNA, 23 bp, Homo sapiens
tcctagaaccaagcttcagagcc

SEQ ID NO: 1666935 - DNA, 17 bp, Homo sapiens
tcctagaagaaccaaat

SEQ ID NO: 1666936 - DNA, 21 bp, Homo sapiens
tcctagaagaaccaaatacct

SEQ ID NO: 1666937 - DNA, 19 bp, Homo sapiens
tcctagaagttactgaatg

SEQ ID NO: 1666938 - DNA, 17 bp, Homo sapiens
tcctagaattcgaaggc

SEQ ID NO: 1666939 - DNA, 12 bp, Homo sapiens
tcctagacccag

SEQ ID NO: 1666940 - DNA, 18 bp, Homo sapiens
tcctagaggtagagaaac

SEQ ID NO: 1666941 - DNA, 15 bp, Homo sapiens
tcctagaggtgggca

SEQ ID NO: 1666942 - DNA, 19 bp, Homo sapiens
tcctagaggtgggcagctg

SEQ ID NO: 1666943 - DNA, 14 bp, Homo sapiens
tcctagataaaaag

SEQ ID NO: 1666944 - DNA, 23 bp, Homo sapiens
tcctagatcctaagggtcgaaag

SEQ ID NO: 1666945 - DNA, 23 bp, Homo sapiens
tcctagcaagtaagaatggccaa

SEQ ID NO: 1666946 - DNA, 23 bp, Homo sapiens
tcctagcactttgggaggccaag

SEQ ID NO: 1666947 - DNA, 21 bp, Homo sapiens
tcctagcctgtgcctctggga

SEQ ID NO: 1666948 - DNA, 14 bp, Homo sapiens
tcctagctcttaca

SEQ ID NO: 1666949 - DNA, 11 bp, Homo sapiens
tcctaggactt

SEQ ID NO: 1666950 - DNA, 18 bp, Homo sapiens
tcctaggacttaaaatta

SEQ ID NO: 1666951 - DNA, 20 bp, Homo sapiens
tcctaggctccaccccatcc

SEQ ID NO: 1666952 - DNA, 20 bp, Homo sapiens
tcctagggtgttttaaacac

SEQ ID NO: 1666953 - DNA, 15 bp, Homo sapiens
tcctagtttgacctc

SEQ ID NO: 1666954 - DNA, 16 bp, Homo sapiens
tcctagtttgacctca

SEQ ID NO: 1666955 - DNA, 18 bp, Homo sapiens
tcctagtttgacctcaca

SEQ ID NO: 1666956 - DNA, 21 bp, Homo sapiens
tcctagtttgacctcacagtg

SEQ ID NO: 1666957 - DNA, 13 bp, Homo sapiens
tcctagttttctc

SEQ ID NO: 1666958 - DNA, 20 bp, Homo sapiens
tcctagttttctcctcccag

SEQ ID NO: 1666959 - DNA, 22 bp, Homo sapiens
tcctataaagggcccacacctg

SEQ ID NO: 1666960 - DNA, 15 bp, Homo sapiens
tcctatatatttcta

SEQ ID NO: 1666961 - DNA, 19 bp, Homo sapiens
tcctatccccaggccaggt

SEQ ID NO: 1666962 - DNA, 19 bp, Homo sapiens
tcctatctccagcggccct

SEQ ID NO: 1666963 - DNA, 13 bp, Homo sapiens
tcctatctccctg

SEQ ID NO: 1666964 - DNA, 15 bp, Homo sapiens
tcctatctccctggc

SEQ ID NO: 1666965 - DNA, 18 bp, Homo sapiens
tcctatctccctggctca

SEQ ID NO: 1666966 - DNA, 13 bp, Homo sapiens
tcctatggaaaaa

SEQ ID NO: 1666967 - DNA, 22 bp, Homo sapiens
tcctatgtcaatttgtatatca

SEQ ID NO: 1666968 - DNA, 18 bp, Homo sapiens
tcctattaaaacacagct

SEQ ID NO: 1666969 - DNA, 14 bp, Homo sapiens
tcctattctattgc

SEQ ID NO: 1666970 - DNA, 20 bp, Homo sapiens
tcctattctgatgaatctca

SEQ ID NO: 1666971 - DNA, 14 bp, Homo sapiens
tcctattgcaaagg

SEQ ID NO: 1666972 - DNA, 14 bp, Homo sapiens
tcctatttcagaag

SEQ ID NO: 1666973 - DNA, 16 bp, Homo sapiens
tcctatttcagaagtt

SEQ ID NO: 1666974 - DNA, 16 bp, Homo sapiens
tcctcaaaaagcagaa

SEQ ID NO: 1666975 - DNA, 19 bp, Homo sapiens
tcctcaaaaagcagaagga

SEQ ID NO: 1666976 - DNA, 19 bp, Homo sapiens
tcctcaaattttttgactt

SEQ ID NO: 1666977 - DNA, 17 bp, Homo sapiens
tcctcaacccacatggg

SEQ ID NO: 1666978 - DNA, 23 bp, Homo sapiens
tcctcaactcacctaatgtttat

SEQ ID NO: 1666979 - DNA, 23 bp, Homo sapiens
tcctcaagcaataattgtttcca

SEQ ID NO: 1666980 - DNA, 18 bp, Homo sapiens
tcctcaagtccccaagat

SEQ ID NO: 1666981 - DNA, 14 bp, Homo sapiens
tcctcaagttatca

SEQ ID NO: 1666982 - DNA, 20 bp, Homo sapiens
tcctcacaggtgtctccata

SEQ ID NO: 1666983 - DNA, 21 bp, Homo sapiens
tcctcacagttgccatgtaga

SEQ ID NO: 1666984 - DNA, 16 bp, Homo sapiens
tcctcacctcatgccc

SEQ ID NO: 1666985 - DNA, 12 bp, Homo sapiens
tcctcacctctg

SEQ ID NO: 1666986 - DNA, 16 bp, Homo sapiens
tcctcacctctggact

SEQ ID NO: 1666987 - DNA, 22 bp, Homo sapiens
tcctcacctctggactggctag

SEQ ID NO: 1666988 - DNA, 23 bp, Homo sapiens
tcctcacctctggactggctaga

SEQ ID NO: 1666989 - DNA, 14 bp, Homo sapiens
tcctcactcccagt

SEQ ID NO: 1666990 - DNA, 17 bp, Homo sapiens
tcctcactcccagtcca

SEQ ID NO: 1666991 - DNA, 12 bp, Homo sapiens
tcctcacttctg

SEQ ID NO: 1666992 - DNA, 17 bp, Homo sapiens
tcctcacttctgtctcc

SEQ ID NO: 1666993 - DNA, 18 bp, Homo sapiens
tcctcacttctgtctcct

SEQ ID NO: 1666994 - DNA, 13 bp, Homo sapiens
tcctcacttggct

SEQ ID NO: 1666995 - DNA, 14 bp, Homo sapiens
tcctcagaaagtgt

SEQ ID NO: 1666996 - DNA, 17 bp, Homo sapiens
tcctcagaactctttgc

SEQ ID NO: 1666997 - DNA, 13 bp, Homo sapiens
tcctcagatgggg

SEQ ID NO: 1666998 - DNA, 13 bp, Homo sapiens
tcctcagcctcca

SEQ ID NO: 1666999 - DNA, 11 bp, Homo sapiens
tcctcagcctt

SEQ ID NO: 1667000 - DNA, 18 bp, Homo sapiens
tcctcagccttgccagag

SEQ ID NO: 1667001 - DNA, 20 bp, Homo sapiens
tcctcagccttgccagagat

SEQ ID NO: 1667002 - DNA, 19 bp, Homo sapiens
tcctcagcgagaggcagca

SEQ ID NO: 1667003 - DNA, 14 bp, Homo sapiens
tcctcagcttatct

SEQ ID NO: 1667004 - DNA, 16 bp, Homo sapiens
tcctcagggacagaga

SEQ ID NO: 1667005 - DNA, 17 bp, Homo sapiens
tcctcagggcagcctcc

SEQ ID NO: 1667006 - DNA, 14 bp, Homo sapiens
tcctcaggggtgga

SEQ ID NO: 1667007 - DNA, 19 bp, Homo sapiens
tcctcaggggtggagaagt

SEQ ID NO: 1667008 - DNA, 21 bp, Homo sapiens
tcctcaggggtggagaagtgt

SEQ ID NO: 1667009 - DNA, 19 bp, Homo sapiens
tcctcagtgcatttgtgct

SEQ ID NO: 1667010 - DNA, 15 bp, Homo sapiens
tcctcatatggccca

SEQ ID NO: 1667011 - DNA, 14 bp, Homo sapiens
tcctcatcccgtgt

SEQ ID NO: 1667012 - DNA, 13 bp, Homo sapiens
tcctcatccctga

SEQ ID NO: 1667013 - DNA, 14 bp, Homo sapiens
tcctcatgaatgta

SEQ ID NO: 1667014 - DNA, 18 bp, Homo sapiens
tcctcatgttactcagtg

SEQ ID NO: 1667015 - DNA, 15 bp, Homo sapiens
tcctcatttcccctc

SEQ ID NO: 1667016 - DNA, 17 bp, Homo sapiens
tcctccaagaatctatc

SEQ ID NO: 1667017 - DNA, 13 bp, Homo sapiens
tcctccacagaga

SEQ ID NO: 1667018 - DNA, 23 bp, Homo sapiens
tcctccacagccccaacctccca

SEQ ID NO: 1667019 - DNA, 15 bp, Homo sapiens
tcctccacagtgctg

SEQ ID NO: 1667020 - DNA, 18 bp, Homo sapiens
tcctccacagtgctgctt

SEQ ID NO: 1667021 - DNA, 19 bp, Homo sapiens
tcctccacagtgctgcttc

SEQ ID NO: 1667022 - DNA, 16 bp, Homo sapiens
tcctccacatcctttc

SEQ ID NO: 1667023 - DNA, 23 bp, Homo sapiens
tcctccacatcctttctaaacaa

SEQ ID NO: 1667024 - DNA, 15 bp, Homo sapiens
tcctccacccacccc

SEQ ID NO: 1667025 - DNA, 21 bp, Homo sapiens
tcctccacccaccccctttgg

SEQ ID NO: 1667026 - DNA, 14 bp, Homo sapiens
tcctccagcccctg

SEQ ID NO: 1667027 - DNA, 17 bp, Homo sapiens
tcctccaggagcttctt

SEQ ID NO: 1667028 - DNA, 17 bp, Homo sapiens
tcctccagggtgatttt

SEQ ID NO: 1667029 - DNA, 21 bp, Homo sapiens
tcctccagtacgtcccgctgc

SEQ ID NO: 1667030 - DNA, 17 bp, Homo sapiens
tcctccatctttctaca

SEQ ID NO: 1667031 - DNA, 12 bp, Homo sapiens
tcctccatggtg

SEQ ID NO: 1667032 - DNA, 15 bp, Homo sapiens
tcctccatggtggaa

SEQ ID NO: 1667033 - DNA, 15 bp, Homo sapiens
tcctcccaaggtttg

SEQ ID NO: 1667034 - DNA, 20 bp, Homo sapiens
tcctcccacctcagcctcct

SEQ ID NO: 1667035 - DNA, 15 bp, Homo sapiens
tcctcccagtgcctt

SEQ ID NO: 1667036 - DNA, 19 bp, Homo sapiens
tcctcccagtgccttctgg

SEQ ID NO: 1667037 - DNA, 11 bp, Homo sapiens
tcctcccataa

SEQ ID NO: 1667038 - DNA, 15 bp, Homo sapiens
tcctcccatctcctt

SEQ ID NO: 1667039 - DNA, 20 bp, Homo sapiens
tcctccccacactccactct

SEQ ID NO: 1667040 - DNA, 21 bp, Homo sapiens
tcctccccacactccactctg

SEQ ID NO: 1667041 - DNA, 21 bp, Homo sapiens
tcctccccacttgtccgctgg

SEQ ID NO: 1667042 - DNA, 14 bp, Homo sapiens
tcctccccagctct

SEQ ID NO: 1667043 - DNA, 20 bp, Homo sapiens
tcctcccccgcaccccctcc

SEQ ID NO: 1667044 - DNA, 13 bp, Homo sapiens
tcctcccccggct

SEQ ID NO: 1667045 - DNA, 15 bp, Homo sapiens
tcctccccctgcaac

SEQ ID NO: 1667046 - DNA, 21 bp, Homo sapiens
tcctgtctgccagccagcagc

SEQ ID NO: 1667047 - DNA, 22 bp, Homo sapiens
tcctgtctgccagccagcagcc

SEQ ID NO: 1667048 - DNA, 23 bp, Homo sapiens
tcctgtctggctcggacccaccc

SEQ ID NO: 1667049 - DNA, 16 bp, Homo sapiens
tcctgtgaatgccact

SEQ ID NO: 1667050 - DNA, 18 bp, Homo sapiens
tcctgtgacaacactcat

SEQ ID NO: 1667051 - DNA, 22 bp, Homo sapiens
tcctgtgatagagttcttttaa

SEQ ID NO: 1667052 - DNA, 21 bp, Homo sapiens
tcctgtgatccacccaaccct

SEQ ID NO: 1667053 - DNA, 16 bp, Homo sapiens
tcctgtgcatgggtga

SEQ ID NO: 1667054 - DNA, 23 bp, Homo sapiens
tcctgtgccctagatgcacgtgg

SEQ ID NO: 1667055 - DNA, 15 bp, Homo sapiens
tcctgtgccctgtgg

SEQ ID NO: 1667056 - DNA, 15 bp, Homo sapiens
tcctgtgctatttgt

SEQ ID NO: 1667057 - DNA, 18 bp, Homo sapiens
tcctgtgctatttgtaca

SEQ ID NO: 1667058 - DNA, 21 bp, Homo sapiens
tcctgtggaaggcagagaaat

SEQ ID NO: 1667059 - DNA, 17 bp, Homo sapiens
tcctgtggcagctgccc

SEQ ID NO: 1667060 - DNA, 18 bp, Homo sapiens
tcctgtgtggagagggaa

SEQ ID NO: 1667061 - DNA, 21 bp, Homo sapiens
tcctgtgtggagagggaatgt

SEQ ID NO: 1667062 - DNA, 23 bp, Homo sapiens
tcctgtgttcaatatttagaaaa

SEQ ID NO: 1667063 - DNA, 18 bp, Homo sapiens
tcctgttacttacctaaa

SEQ ID NO: 1667064 - DNA, 22 bp, Homo sapiens
tcctgttaggtattagaaagtg

SEQ ID NO: 1667065 - DNA, 15 bp, Homo sapiens
tcctgttcagtgaga

SEQ ID NO: 1667066 - DNA, 20 bp, Homo sapiens
tcctgttccttgctagccct

SEQ ID NO: 1667067 - DNA, 20 bp, Homo sapiens
tcctgttctgcgctgtgtac

SEQ ID NO: 1667068 - DNA, 22 bp, Homo sapiens
tcctgttctgcgctgtgtacaa

SEQ ID NO: 1667069 - DNA, 18 bp, Homo sapiens
tcctgtttcagacccccc

SEQ ID NO: 1667070 - DNA, 18 bp, Homo sapiens
tcctgtttgaaatatcat

SEQ ID NO: 1667071 - DNA, 15 bp, Homo sapiens
tcctgtttgcaggcc

SEQ ID NO: 1667072 - DNA, 17 bp, Homo sapiens
tcctgttttgcacagcc

SEQ ID NO: 1667073 - DNA, 19 bp, Homo sapiens
tccttaaaaatcacactgt

SEQ ID NO: 1667074 - DNA, 20 bp, Homo sapiens
tccttaaaattaagttgaaa

SEQ ID NO: 1667075 - DNA, 14 bp, Homo sapiens
tccttaaactgtgt

SEQ ID NO: 1667076 - DNA, 23 bp, Homo sapiens
tccttaaataaactcaatgagct

SEQ ID NO: 1667077 - DNA, 15 bp, Homo sapiens
tccttaaatatatat

SEQ ID NO: 1667078 - DNA, 19 bp, Homo sapiens
tccttaacccacctctcct

SEQ ID NO: 1667079 - DNA, 22 bp, Homo sapiens
tccttaactaaatgataaatgt

SEQ ID NO: 1667080 - DNA, 16 bp, Homo sapiens
tccttaagaacacaaa

SEQ ID NO: 1667081 - DNA, 14 bp, Homo sapiens
tccttaagcatctg

SEQ ID NO: 1667082 - DNA, 14 bp, Homo sapiens
tccttaatgatccg

SEQ ID NO: 1667083 - DNA, 19 bp, Homo sapiens
tccttaattcactcccaca

SEQ ID NO: 1667084 - DNA, 15 bp, Homo sapiens
tccttacctttttat

SEQ ID NO: 1667085 - DNA, 15 bp, Homo sapiens
tccttactctgagga

SEQ ID NO: 1667086 - DNA, 15 bp, Homo sapiens
tccttacttttaagg

SEQ ID NO: 1667087 - DNA, 19 bp, Homo sapiens
tccttagaaaaaaaattat

SEQ ID NO: 1667088 - DNA, 17 bp, Homo sapiens
tccttagcaaggggctc

SEQ ID NO: 1667089 - DNA, 15 bp, Homo sapiens
tccttagccctgtct

SEQ ID NO: 1667090 - DNA, 19 bp, Homo sapiens
tccttagcttagacctcag

SEQ ID NO: 1667091 - DNA, 22 bp, Homo sapiens
tccttagcttagacctcagcct

SEQ ID NO: 1667092 - DNA, 23 bp, Homo sapiens
tccttagcttagacctcagcctg

SEQ ID NO: 1667093 - DNA, 18 bp, Homo sapiens
tccttatagacacttgct

SEQ ID NO: 1667094 - DNA, 15 bp, Homo sapiens
tccttatccctctct

SEQ ID NO: 1667095 - DNA, 21 bp, Homo sapiens
tccttatccctctcttcccct

SEQ ID NO: 1667096 - DNA, 15 bp, Homo sapiens
tccttatgcatgaaa

SEQ ID NO: 1667097 - DNA, 19 bp, Homo sapiens
tccttatgcatgaaatgaa

SEQ ID NO: 1667098 - DNA, 18 bp, Homo sapiens
tccttatgtcctgtcata

SEQ ID NO: 1667099 - DNA, 14 bp, Homo sapiens
tccttatttgcctt

SEQ ID NO: 1667100 - DNA, 21 bp, Homo sapiens
tccttatttgccttctactcc

SEQ ID NO: 1667101 - DNA, 20 bp, Homo sapiens
tccttcaagaactctgggct

SEQ ID NO: 1667102 - DNA, 21 bp, Homo sapiens
tccttcaagaactctgggctg

SEQ ID NO: 1667103 - DNA, 23 bp, Homo sapiens
tccttcaagttagctcaggaggc

SEQ ID NO: 1667104 - DNA, 16 bp, Homo sapiens
tccttcactcatccag

SEQ ID NO: 1667105 - DNA, 20 bp, Homo sapiens
tccttcactggcgccttctc

SEQ ID NO: 1667106 - DNA, 23 bp, Homo sapiens
tccttcactggcgccttctcgga

SEQ ID NO: 1667107 - DNA, 15 bp, Homo sapiens
tccttcactgttccc

SEQ ID NO: 1667108 - DNA, 12 bp, Homo sapiens
tccttcagacac

SEQ ID NO: 1667109 - DNA, 13 bp, Homo sapiens
tccttcagacacc

SEQ ID NO: 1667110 - DNA, 12 bp, Homo sapiens
tccttcagagct

SEQ ID NO: 1667111 - DNA, 13 bp, Homo sapiens
tccttcagagctc

SEQ ID NO: 1667112 - DNA, 23 bp, Homo sapiens
tccttcagagctcttcaagctgt

SEQ ID NO: 1667113 - DNA, 13 bp, Homo sapiens
tccttcagcacag

SEQ ID NO: 1667114 - DNA, 14 bp, Homo sapiens
tccttcagccctca

SEQ ID NO: 1667115 - DNA, 13 bp, Homo sapiens
tccttcaggtttt

SEQ ID NO: 1667116 - DNA, 19 bp, Homo sapiens
tccttcattccgttaggaa

SEQ ID NO: 1667117 - DNA, 15 bp, Homo sapiens
tccttccacctcagt

SEQ ID NO: 1667118 - DNA, 13 bp, Homo sapiens
tccttccacctgc

SEQ ID NO: 1667119 - DNA, 16 bp, Homo sapiens
tccttccatccctacc

SEQ ID NO: 1667120 - DNA, 14 bp, Homo sapiens
tccttccatcttgt

SEQ ID NO: 1667121 - DNA, 17 bp, Homo sapiens
tccttccatcttgtggg

SEQ ID NO: 1667122 - DNA, 14 bp, Homo sapiens
tccttcccaggccc

SEQ ID NO: 1667123 - DNA, 16 bp, Homo sapiens
tccttcccaggccctt

SEQ ID NO: 1667124 - DNA, 15 bp, Homo sapiens
tccttcccatgcctg

SEQ ID NO: 1667125 - DNA, 18 bp, Homo sapiens
tccttcccatgcctgtct

SEQ ID NO: 1667126 - DNA, 15 bp, Homo sapiens
tccttccccaacttc

SEQ ID NO: 1667127 - DNA, 17 bp, Homo sapiens
tccttccccaacttccc

SEQ ID NO: 1667128 - DNA, 18 bp, Homo sapiens
tccttcccccagcccaat

SEQ ID NO: 1667129 - DNA, 19 bp, Homo sapiens
tccttcccccagcccaata

SEQ ID NO: 1667130 - DNA, 22 bp, Homo sapiens
tccttcccccagcccaataaag

SEQ ID NO: 1667131 - DNA, 15 bp, Homo sapiens
tccttccctctcctg

SEQ ID NO: 1667132 - DNA, 14 bp, Homo sapiens
tccttccctggctt

SEQ ID NO: 1667133 - DNA, 14 bp, Homo sapiens
tccttccctgggaa

SEQ ID NO: 1667134 - DNA, 14 bp, Homo sapiens
tccttcccttctct

SEQ ID NO: 1667135 - DNA, 17 bp, Homo sapiens
tccttcccttctcttgg

SEQ ID NO: 1667136 - DNA, 19 bp, Homo sapiens
tccttccgatgacagtgct

SEQ ID NO: 1667137 - DNA, 14 bp, Homo sapiens
tccttcctctcaag

SEQ ID NO: 1667138 - DNA, 15 bp, Homo sapiens
tccttcctcttggct

SEQ ID NO: 1667139 - DNA, 12 bp, Homo sapiens
tccttcctgggg

SEQ ID NO: 1667140 - DNA, 12 bp, Homo sapiens
tccttcctgtct

SEQ ID NO: 1667141 - DNA, 15 bp, Homo sapiens
tccttccttcccacc

SEQ ID NO: 1667142 - DNA, 14 bp, Homo sapiens
tccttccttccctg

SEQ ID NO: 1667143 - DNA, 15 bp, Homo sapiens
tccttccttccctgg

SEQ ID NO: 1667144 - DNA, 15 bp, Homo sapiens
tccttcgaaaggcct

SEQ ID NO: 1667145 - DNA, 18 bp, Homo sapiens
tccttcgaaaggccttca

SEQ ID NO: 1667146 - DNA, 21 bp, Homo sapiens
tccttcgaaaggccttcagac

SEQ ID NO: 1667147 - DNA, 18 bp, Homo sapiens
tccttcgtgtctctccca

SEQ ID NO: 1667148 - DNA, 21 bp, Homo sapiens
tccttctaccccaaggccagt

SEQ ID NO: 1667149 - DNA, 16 bp, Homo sapiens
tccttctagtttccca

SEQ ID NO: 1667150 - DNA, 12 bp, Homo sapiens
tccttctcccct

SEQ ID NO: 1667151 - DNA, 12 bp, Homo sapiens
tccttctccctt

SEQ ID NO: 1667152 - DNA, 12 bp, Homo sapiens
tccttctccttc

SEQ ID NO: 1667153 - DNA, 20 bp, Homo sapiens
tccttctgtgaaagtacatt

SEQ ID NO: 1667154 - DNA, 17 bp, Homo sapiens
tccttctttcacaggca

SEQ ID NO: 1667155 - DNA, 23 bp, Homo sapiens
tccttctttttcatatttctacc

SEQ ID NO: 1667156 - DNA, 15 bp, Homo sapiens
tccttgaaaaacaaa

SEQ ID NO: 1667157 - DNA, 18 bp, Homo sapiens
tccttgaagaactgcagg

SEQ ID NO: 1667158 - DNA, 21 bp, Homo sapiens
tccttgaagaactgcaggccc

SEQ ID NO: 1667159 - DNA, 13 bp, Homo sapiens
tccttgaagaagg

SEQ ID NO: 1667160 - DNA, 13 bp, Homo sapiens
tccttgaccagca

SEQ ID NO: 1667161 - DNA, 23 bp, Homo sapiens
tcggaagcagtgccttccataat

SEQ ID NO: 1667162 - DNA, 20 bp, Homo sapiens
tcggaagccgtctgactcca

SEQ ID NO: 1667163 - DNA, 19 bp, Homo sapiens
tcggaaggctggctgggca

SEQ ID NO: 1667164 - DNA, 18 bp, Homo sapiens
tcggacagtgcccatgca

SEQ ID NO: 1667165 - DNA, 14 bp, Homo sapiens
tcggacatagagtt

SEQ ID NO: 1667166 - DNA, 17 bp, Homo sapiens
tcggacccaccccaact

SEQ ID NO: 1667167 - DNA, 13 bp, Homo sapiens
tcggactgccaaa

SEQ ID NO: 1667168 - DNA, 21 bp, Homo sapiens
tcggagacagtgatctccata

SEQ ID NO: 1667169 - DNA, 17 bp, Homo sapiens
tcggagactgccccacg

SEQ ID NO: 1667170 - DNA, 14 bp, Homo sapiens
tcggagagcagcag

SEQ ID NO: 1667171 - DNA, 18 bp, Homo sapiens
tcggagcacccttgcccg

SEQ ID NO: 1667172 - DNA, 12 bp, Homo sapiens
tcggagctgcct

SEQ ID NO: 1667173 - DNA, 15 bp, Homo sapiens
tcggagctgcctgca

SEQ ID NO: 1667174 - DNA, 16 bp, Homo sapiens
tcggagctgcctgcag

SEQ ID NO: 1667175 - DNA, 14 bp, Homo sapiens
tcggagctggccca

SEQ ID NO: 1667176 - DNA, 15 bp, Homo sapiens
tcggagctggcccag

SEQ ID NO: 1667177 - DNA, 14 bp, Homo sapiens
tcggagtgcctgga

SEQ ID NO: 1667178 - DNA, 15 bp, Homo sapiens
tcggagtgcctggag

SEQ ID NO: 1667179 - DNA, 20 bp, Homo sapiens
tcggatctggggctctggga

SEQ ID NO: 1667180 - DNA, 16 bp, Homo sapiens
tcggatgacaccctgg

SEQ ID NO: 1667181 - DNA, 13 bp, Homo sapiens
tcggatgaccaaa

SEQ ID NO: 1667182 - DNA, 19 bp, Homo sapiens
tcggatgaccatactcaga

SEQ ID NO: 1667183 - DNA, 22 bp, Homo sapiens
tcggcaggagagtgtgtgggca

SEQ ID NO: 1667184 - DNA, 23 bp, Homo sapiens
tcggccaagatgtacttctctgt

SEQ ID NO: 1667185 - DNA, 13 bp, Homo sapiens
tcggccacagggc

SEQ ID NO: 1667186 - DNA, 23 bp, Homo sapiens
tcggcccacagctcccaccccac

SEQ ID NO: 1667187 - DNA, 16 bp, Homo sapiens
tcggccgaccaggctg

SEQ ID NO: 1667188 - DNA, 18 bp, Homo sapiens
tcggcctcccacagtgct

SEQ ID NO: 1667189 - DNA, 17 bp, Homo sapiens
tcggccttctgtggcct

SEQ ID NO: 1667190 - DNA, 19 bp, Homo sapiens
tcggctccccatgtgtcct

SEQ ID NO: 1667191 - DNA, 19 bp, Homo sapiens
tcggctggggactgctacc

SEQ ID NO: 1667192 - DNA, 20 bp, Homo sapiens
tcggctggggactgctacct

SEQ ID NO: 1667193 - DNA, 15 bp, Homo sapiens
tcgggaagcagccag

SEQ ID NO: 1667194 - DNA, 19 bp, Homo sapiens
tcgggaagcagccagctcc

SEQ ID NO: 1667195 - DNA, 21 bp, Homo sapiens
tcgggagacagcatcagggtt

SEQ ID NO: 1667196 - DNA, 14 bp, Homo sapiens
tcgggagcacccag

SEQ ID NO: 1667197 - DNA, 17 bp, Homo sapiens
tcgggagcacccagagc

SEQ ID NO: 1667198 - DNA, 22 bp, Homo sapiens
tcgggagcagtgtcttccataa

SEQ ID NO: 1667199 - DNA, 17 bp, Homo sapiens
tcgggcaccagccagcg

SEQ ID NO: 1667200 - DNA, 19 bp, Homo sapiens
tcgggcaggggctggaggg

SEQ ID NO: 1667201 - DNA, 22 bp, Homo sapiens
tcgggcagtggaggctgctgtg

SEQ ID NO: 1667202 - DNA, 18 bp, Homo sapiens
tcgggcccacctggccac

SEQ ID NO: 1667203 - DNA, 16 bp, Homo sapiens
tcgggccgaggcccag

SEQ ID NO: 1667204 - DNA, 14 bp, Homo sapiens
tcgggctccagcca

SEQ ID NO: 1667205 - DNA, 13 bp, Homo sapiens
tcgggctgtgccc

SEQ ID NO: 1667206 - DNA, 15 bp, Homo sapiens
tcggggaactcctgg

SEQ ID NO: 1667207 - DNA, 22 bp, Homo sapiens
tcggggaagctgcacatgtgcc

SEQ ID NO: 1667208 - DNA, 17 bp, Homo sapiens
tcggggcatgctggggc

SEQ ID NO: 1667209 - DNA, 17 bp, Homo sapiens
tcggggcttgccccact

SEQ ID NO: 1667210 - DNA, 15 bp, Homo sapiens
tcggggggctctgcc

SEQ ID NO: 1667211 - DNA, 16 bp, Homo sapiens
tcggggtaaaaagtgg

SEQ ID NO: 1667212 - DNA, 21 bp, Homo sapiens
tcggggtaaaaagtggctgcg

SEQ ID NO: 1667213 - DNA, 15 bp, Homo sapiens
tcgggtccagagacc

SEQ ID NO: 1667214 - DNA, 22 bp, Homo sapiens
tcgggttttattgtttaaaatc

SEQ ID NO: 1667215 - DNA, 20 bp, Homo sapiens
tcggtatccccccatcttgc

SEQ ID NO: 1667216 - DNA, 16 bp, Homo sapiens
tcggtatctggcttcc

SEQ ID NO: 1667217 - DNA, 14 bp, Homo sapiens
tcggtgctccatct

SEQ ID NO: 1667218 - DNA, 15 bp, Homo sapiens
tcggtgggccagagc

SEQ ID NO: 1667219 - DNA, 17 bp, Homo sapiens
tcggtgggccagagctg

SEQ ID NO: 1667220 - DNA, 15 bp, Homo sapiens
tcggtgtgctgccaa

SEQ ID NO: 1667221 - DNA, 15 bp, Homo sapiens
tcggttccacgtccc

SEQ ID NO: 1667222 - DNA, 19 bp, Homo sapiens
tcgtacctgtccctccagg

SEQ ID NO: 1667223 - DNA, 13 bp, Homo sapiens
tcgtagacacagg

SEQ ID NO: 1667224 - DNA, 13 bp, Homo sapiens
tcgtaggcagcca

SEQ ID NO: 1667225 - DNA, 19 bp, Homo sapiens
tcgtaggggatgtggagtg

SEQ ID NO: 1667226 - DNA, 18 bp, Homo sapiens
tcgtcacgagcacaatgg

SEQ ID NO: 1667227 - DNA, 18 bp, Homo sapiens
tcgtcattttatatttag

SEQ ID NO: 1667228 - DNA, 19 bp, Homo sapiens
tcgtccacaggggcaggcc

SEQ ID NO: 1667229 - DNA, 17 bp, Homo sapiens
tcgtccatgtttctcac

SEQ ID NO: 1667230 - DNA, 15 bp, Homo sapiens
tcgtccgtctgtctc

SEQ ID NO: 1667231 - DNA, 23 bp, Homo sapiens
tcgtcctccccctgccagtgcct

SEQ ID NO: 1667232 - DNA, 14 bp, Homo sapiens
tcgtctactgcaag

SEQ ID NO: 1667233 - DNA, 22 bp, Homo sapiens
tcgtctccctggtgcctctgtg

SEQ ID NO: 1667234 - DNA, 13 bp, Homo sapiens
tcgtctgtcccag

SEQ ID NO: 1667235 - DNA, 19 bp, Homo sapiens
tcgtcttgaacgagcagcc

SEQ ID NO: 1667236 - DNA, 15 bp, Homo sapiens
tcgtctttcccatgg

SEQ ID NO: 1667237 - DNA, 20 bp, Homo sapiens
tcgtctttcccatggggagg

SEQ ID NO: 1667238 - DNA, 21 bp, Homo sapiens
tcgtgaaaaccaaccctgtgg

SEQ ID NO: 1667239 - DNA, 23 bp, Homo sapiens
tcgtgaaaaccaaccctgtgggc

SEQ ID NO: 1667240 - DNA, 21 bp, Homo sapiens
tcgtgaagaagcctgtaacac

SEQ ID NO: 1667241 - DNA, 14 bp, Homo sapiens
tcgtgagctgggga

SEQ ID NO: 1667242 - DNA, 20 bp, Homo sapiens
tcgtgagctggggactcagg

SEQ ID NO: 1667243 - DNA, 13 bp, Homo sapiens
tcgtgaggggcaa

SEQ ID NO: 1667244 - DNA, 15 bp, Homo sapiens
tcgtgataaactttg

SEQ ID NO: 1667245 - DNA, 13 bp, Homo sapiens
tcgtgatggggca

SEQ ID NO: 1667246 - DNA, 11 bp, Homo sapiens
tcgtgatgtgg

SEQ ID NO: 1667247 - DNA, 12 bp, Homo sapiens
tcgtgatgtgga

SEQ ID NO: 1667248 - DNA, 20 bp, Homo sapiens
tcgtgatgtggaggaagagc

SEQ ID NO: 1667249 - DNA, 20 bp, Homo sapiens
tcgtgcattggaagacccca

SEQ ID NO: 1667250 - DNA, 22 bp, Homo sapiens
tcgtgcattggaagaccccacc

SEQ ID NO: 1667251 - DNA, 23 bp, Homo sapiens
tcgtgccgttactctccaacctg

SEQ ID NO: 1667252 - DNA, 18 bp, Homo sapiens
tcgtgcctgggggagaga

SEQ ID NO: 1667253 - DNA, 14 bp, Homo sapiens
tcgtgcctgtgtcc

SEQ ID NO: 1667254 - DNA, 15 bp, Homo sapiens
tcgtgcctgtgtcca

SEQ ID NO: 1667255 - DNA, 21 bp, Homo sapiens
tcgtgcctgtgtccatgcgct

SEQ ID NO: 1667256 - DNA, 18 bp, Homo sapiens
tcgtgctaaattttcagt

SEQ ID NO: 1667257 - DNA, 22 bp, Homo sapiens
tcgtggacacacacagactatt

SEQ ID NO: 1667258 - DNA, 12 bp, Homo sapiens
tcgtggccagcc

SEQ ID NO: 1667259 - DNA, 13 bp, Homo sapiens
tcgtggccagccc

SEQ ID NO: 1667260 - DNA, 22 bp, Homo sapiens
tcgtgggtgtgtgtagccaagg

SEQ ID NO: 1667261 - DNA, 19 bp, Homo sapiens
tcgtgtagtggaagagcag

SEQ ID NO: 1667262 - DNA, 13 bp, Homo sapiens
tcgtgtatcctgg

SEQ ID NO: 1667263 - DNA, 15 bp, Homo sapiens
tcgtgtatcctgggg

SEQ ID NO: 1667264 - DNA, 14 bp, Homo sapiens
tcgtgtctctggtc

SEQ ID NO: 1667265 - DNA, 12 bp, Homo sapiens
tcgttaacattg

SEQ ID NO: 1667266 - DNA, 17 bp, Homo sapiens
tcgttaacattgaccaa

SEQ ID NO: 1667267 - DNA, 15 bp, Homo sapiens
tcgttaactgtgtat

SEQ ID NO: 1667268 - DNA, 17 bp, Homo sapiens
tcgttgtccaatttgta

SEQ ID NO: 1667269 - DNA, 16 bp, Homo sapiens
tcgtttccatcatgtc

SEQ ID NO: 1667270 - DNA, 15 bp, Homo sapiens
tcgtttgatttcaaa

SEQ ID NO: 1667271 - DNA, 16 bp, Homo sapiens
tcgtttggatctgtga

SEQ ID NO: 1667272 - DNA, 17 bp, Homo sapiens
tcgtttggatctgtgac

SEQ ID NO: 1667273 - DNA, 20 bp, Homo sapiens
tcgttttcataacttgctga

SEQ ID NO: 1667274 - DNA, 14 bp, Homo sapiens
tctaaaaacaccaa

SEQ ID NO: 1667275 - DNA, 13 bp, Homo sapiens
tctaaaaagaaaa

SEQ ID NO: 1667276 - DNA, 21 bp, Homo sapiens
tctattgacttttcaataaat

SEQ ID NO: 1667277 - DNA, 18 bp, Homo sapiens
tctattgtactctgcttt

SEQ ID NO: 1667278 - DNA, 17 bp, Homo sapiens
tctattgtagcatttct

SEQ ID NO: 1667279 - DNA, 18 bp, Homo sapiens
tctattgttaaacaaatg

SEQ ID NO: 1667280 - DNA, 15 bp, Homo sapiens
tctatttatgtttgc

SEQ ID NO: 1667281 - DNA, 18 bp, Homo sapiens
tctatttccactgaacaa

SEQ ID NO: 1667282 - DNA, 19 bp, Homo sapiens
tctatttccactgaacaaa

SEQ ID NO: 1667283 - DNA, 21 bp, Homo sapiens
tctatttcccctcttctgcta

SEQ ID NO: 1667284 - DNA, 17 bp, Homo sapiens
tctatttctatgagaaa

SEQ ID NO: 1667285 - DNA, 15 bp, Homo sapiens
tctatttctgagaag

SEQ ID NO: 1667286 - DNA, 20 bp, Homo sapiens
tctatttctgagaaggtcct

SEQ ID NO: 1667287 - DNA, 17 bp, Homo sapiens
tctatttgagaagttct

SEQ ID NO: 1667288 - DNA, 19 bp, Homo sapiens
tctatttgagaagttctca

SEQ ID NO: 1667289 - DNA, 18 bp, Homo sapiens
tctatttgtacaatttta

SEQ ID NO: 1667290 - DNA, 13 bp, Homo sapiens
tctattttactgt

SEQ ID NO: 1667291 - DNA, 21 bp, Homo sapiens
tctattttactgtcttgaatt

SEQ ID NO: 1667292 - DNA, 19 bp, Homo sapiens
tctattttattatgagctt

SEQ ID NO: 1667293 - DNA, 16 bp, Homo sapiens
tctattttcataatca

SEQ ID NO: 1667294 - DNA, 23 bp, Homo sapiens
tctattttcttgaggaaaatatt

SEQ ID NO: 1667295 - DNA, 15 bp, Homo sapiens
tctattttgtatatt

SEQ ID NO: 1667296 - DNA, 22 bp, Homo sapiens
tctatttttacctactgtgtct

SEQ ID NO: 1667297 - DNA, 20 bp, Homo sapiens
tctatttttatcatgaattc

SEQ ID NO: 1667298 - DNA, 13 bp, Homo sapiens
tctcaaaaatcct

SEQ ID NO: 1667299 - DNA, 13 bp, Homo sapiens
tctcaaaacaaaa

SEQ ID NO: 1667300 - DNA, 14 bp, Homo sapiens
tctcaaaacaaaac

SEQ ID NO: 1667301 - DNA, 17 bp, Homo sapiens
tctcaaaacagagggct

SEQ ID NO: 1667302 - DNA, 23 bp, Homo sapiens
tctcaaaacagagggctgcattc

SEQ ID NO: 1667303 - DNA, 15 bp, Homo sapiens
tctcaaaatctttgt

SEQ ID NO: 1667304 - DNA, 13 bp, Homo sapiens
tctcaaacacagt

SEQ ID NO: 1667305 - DNA, 22 bp, Homo sapiens
tctcaaacacagttacacttgt

SEQ ID NO: 1667306 - DNA, 19 bp, Homo sapiens
tctcaaacctgtttaaata

SEQ ID NO: 1667307 - DNA, 12 bp, Homo sapiens
tctcaaactctt

SEQ ID NO: 1667308 - DNA, 17 bp, Homo sapiens
tctcaaagaaatattaa

SEQ ID NO: 1667309 - DNA, 11 bp, Homo sapiens
tctcaaaggag

SEQ ID NO: 1667310 - DNA, 16 bp, Homo sapiens
tctcaaaggagcgagc

SEQ ID NO: 1667311 - DNA, 14 bp, Homo sapiens
tctcaaaggagctt

SEQ ID NO: 1667312 - DNA, 22 bp, Homo sapiens
tctcaaaggtaattctgaacca

SEQ ID NO: 1667313 - DNA, 16 bp, Homo sapiens
tctcaaagtaaggctg

SEQ ID NO: 1667314 - DNA, 22 bp, Homo sapiens
tctcaaataggctattaaaaaa

SEQ ID NO: 1667315 - DNA, 16 bp, Homo sapiens
tctcaaatctgcttca

SEQ ID NO: 1667316 - DNA, 20 bp, Homo sapiens
tctcaacggaagccccctct

SEQ ID NO: 1667317 - DNA, 21 bp, Homo sapiens
tctcaagaaagccctcatttt

SEQ ID NO: 1667318 - DNA, 12 bp, Homo sapiens
tctcaagaatct

SEQ ID NO: 1667319 - DNA, 17 bp, Homo sapiens
tctcaagaatctagaag

SEQ ID NO: 1667320 - DNA, 17 bp, Homo sapiens
tctcaagagggcactgg

SEQ ID NO: 1667321 - DNA, 19 bp, Homo sapiens
tctcaagagggcactggtg

SEQ ID NO: 1667322 - DNA, 13 bp, Homo sapiens
tctcaagccagcc

SEQ ID NO: 1667323 - DNA, 14 bp, Homo sapiens
tctcaagccagccc

SEQ ID NO: 1667324 - DNA, 15 bp, Homo sapiens
tctcaagccagcccc

SEQ ID NO: 1667325 - DNA, 22 bp, Homo sapiens
tctcaagccagccccctccagc

SEQ ID NO: 1667326 - DNA, 17 bp, Homo sapiens
tctcaagctagccagag

SEQ ID NO: 1667327 - DNA, 14 bp, Homo sapiens
tctcaagggtggca

SEQ ID NO: 1667328 - DNA, 20 bp, Homo sapiens
tctcaaggtgggccttgcta

SEQ ID NO: 1667329 - DNA, 13 bp, Homo sapiens
tctcaagttctaa

SEQ ID NO: 1667330 - DNA, 23 bp, Homo sapiens
tctcaatgtcttcccacaaatgg

SEQ ID NO: 1667331 - DNA, 17 bp, Homo sapiens
tctcaattgaaagcttt

SEQ ID NO: 1667332 - DNA, 11 bp, Homo sapiens
tctcacaaaaa

SEQ ID NO: 1667333 - DNA, 16 bp, Homo sapiens
tctcacacacacacac

SEQ ID NO: 1667334 - DNA, 24 bp, Homo sapiens
tctcacacgtttaatcccagcact

SEQ ID NO: 1667335 - DNA, 13 bp, Homo sapiens
tctcacaggctga

SEQ ID NO: 1667336 - DNA, 12 bp, Homo sapiens
tctcacagtggg

SEQ ID NO: 1667337 - DNA, 21 bp, Homo sapiens
tctcacagtgggagccagggc

SEQ ID NO: 1667338 - DNA, 16 bp, Homo sapiens
tctcacattgctgtat

SEQ ID NO: 1667339 - DNA, 16 bp, Homo sapiens
tctcaccatttggatc

SEQ ID NO: 1667340 - DNA, 18 bp, Homo sapiens
tctcaccatttggatcct

SEQ ID NO: 1667341 - DNA, 15 bp, Homo sapiens
tctcaccccatccca

SEQ ID NO: 1667342 - DNA, 19 bp, Homo sapiens
tctcacccccatccctggg

SEQ ID NO: 1667343 - DNA, 16 bp, Homo sapiens
tctcaccctgtgaaac

SEQ ID NO: 1667344 - DNA, 14 bp, Homo sapiens
tctcaccggctctc

SEQ ID NO: 1667345 - DNA, 18 bp, Homo sapiens
tctcactaaagcatgaaa

SEQ ID NO: 1667346 - DNA, 20 bp, Homo sapiens
tctcactatatatatttcta

SEQ ID NO: 1667347 - DNA, 14 bp, Homo sapiens
tctcactccaccac

SEQ ID NO: 1667348 - DNA, 21 bp, Homo sapiens
tctcactccccagccccaccc

SEQ ID NO: 1667349 - DNA, 18 bp, Homo sapiens
tctcactcctacctggta

SEQ ID NO: 1667350 - DNA, 14 bp, Homo sapiens
tctcactgcttgaa

SEQ ID NO: 1667351 - DNA, 18 bp, Homo sapiens
tctcactgttgcagtggc

SEQ ID NO: 1667352 - DNA, 15 bp, Homo sapiens
tctcacttagtcctt

SEQ ID NO: 1667353 - DNA, 17 bp, Homo sapiens
tctcagaaagtgcctga

SEQ ID NO: 1667354 - DNA, 19 bp, Homo sapiens
tctcagaaagtgcctgaca

SEQ ID NO: 1667355 - DNA, 15 bp, Homo sapiens
tctcagaactcctgt

SEQ ID NO: 1667356 - DNA, 22 bp, Homo sapiens
tctcagaactcctgtgtgtgga

SEQ ID NO: 1667357 - DNA, 16 bp, Homo sapiens
tctcagaatccaaaga

SEQ ID NO: 1667358 - DNA, 15 bp, Homo sapiens
tctcagaatctaaac

SEQ ID NO: 1667359 - DNA, 24 bp, Homo sapiens
tctcagaatctaaacgtggtcacc

SEQ ID NO: 1667360 - DNA, 13 bp, Homo sapiens
tctcagacctcca

SEQ ID NO: 1667361 - DNA, 14 bp, Homo sapiens
tctcagactcacca

SEQ ID NO: 1667362 - DNA, 14 bp, Homo sapiens
tctcagagaccagc

SEQ ID NO: 1667363 - DNA, 17 bp, Homo sapiens
tctcagagaccagcact

SEQ ID NO: 1667364 - DNA, 21 bp, Homo sapiens
tctcagaggcctgctgccagt

SEQ ID NO: 1667365 - DNA, 18 bp, Homo sapiens
tctcagagtgacagtcat

SEQ ID NO: 1667366 - DNA, 18 bp, Homo sapiens
tctcagatccttgtttca

SEQ ID NO: 1667367 - DNA, 19 bp, Homo sapiens
tctcagatccttgtttcaa

SEQ ID NO: 1667368 - DNA, 20 bp, Homo sapiens
tctcagatccttgtttcaaa

SEQ ID NO: 1667369 - DNA, 15 bp, Homo sapiens
tctcagatcttgaca

SEQ ID NO: 1667370 - DNA, 19 bp, Homo sapiens
tctcagattttaaggggga

SEQ ID NO: 1667371 - DNA, 21 bp, Homo sapiens
tctcagcatagcctgcctgat

SEQ ID NO: 1667372 - DNA, 12 bp, Homo sapiens
tctcagcctccc

SEQ ID NO: 1667373 - DNA, 19 bp, Homo sapiens
tctcagcctctgccagcgc

SEQ ID NO: 1667374 - DNA, 21 bp, Homo sapiens
tctcagctccaggtggctctg

SEQ ID NO: 1667375 - DNA, 16 bp, Homo sapiens
tctcagctcccaggcc

SEQ ID NO: 1667376 - DNA, 13 bp, Homo sapiens
tctcagctgctga

SEQ ID NO: 1667377 - DNA, 14 bp, Homo sapiens
tctcagctgctgaa

SEQ ID NO: 1667378 - DNA, 20 bp, Homo sapiens
tctcagcttgcagctggaag

SEQ ID NO: 1667379 - DNA, 14 bp, Homo sapiens
tctcaggaaatcaa

SEQ ID NO: 1667380 - DNA, 12 bp, Homo sapiens
tctcaggaagag

SEQ ID NO: 1667381 - DNA, 16 bp, Homo sapiens
tctcaggacctaggga

SEQ ID NO: 1667382 - DNA, 21 bp, Homo sapiens
tctcaggacctagggatgttc

SEQ ID NO: 1667383 - DNA, 15 bp, Homo sapiens
tctcaggagatggag

SEQ ID NO: 1667384 - DNA, 16 bp, Homo sapiens
tctcaggagatggagg

SEQ ID NO: 1667385 - DNA, 22 bp, Homo sapiens
tctcaggagatggagggcttgg

SEQ ID NO: 1667386 - DNA, 14 bp, Homo sapiens
tctcaggagcacag

SEQ ID NO: 1667387 - DNA, 19 bp, Homo sapiens
tctcaggagcacaggcagc

SEQ ID NO: 1667388 - DNA, 17 bp, Homo sapiens
tctcaggaggggcagcg

SEQ ID NO: 1667389 - DNA, 19 bp, Homo sapiens
tctcaggaggggcagcgca

SEQ ID NO: 1667390 - DNA, 14 bp, Homo sapiens
tctcaggctctgcc

SEQ ID NO: 1667391 - DNA, 18 bp, Homo sapiens
tctccttactctgagccc

SEQ ID NO: 1667392 - DNA, 19 bp, Homo sapiens
tctccttcagccctcaccc

SEQ ID NO: 1667393 - DNA, 22 bp, Homo sapiens
tctccttccagtataaccagct

SEQ ID NO: 1667394 - DNA, 20 bp, Homo sapiens
tctccttcccccagcccaat

SEQ ID NO: 1667395 - DNA, 22 bp, Homo sapiens
tctccttcccccagcccaataa

SEQ ID NO: 1667396 - DNA, 14 bp, Homo sapiens
tctccttcccctac

SEQ ID NO: 1667397 - DNA, 15 bp, Homo sapiens
tctccttcccttctc

SEQ ID NO: 1667398 - DNA, 16 bp, Homo sapiens
tctccttcccttctct

SEQ ID NO: 1667399 - DNA, 16 bp, Homo sapiens
tctccttcctgtgtgt

SEQ ID NO: 1667400 - DNA, 19 bp, Homo sapiens
tctccttcgtgtctctccc

SEQ ID NO: 1667401 - DNA, 14 bp, Homo sapiens
tctccttcttagct

SEQ ID NO: 1667402 - DNA, 14 bp, Homo sapiens
tctccttggccaca

SEQ ID NO: 1667403 - DNA, 17 bp, Homo sapiens
tctccttgggctcctgg

SEQ ID NO: 1667404 - DNA, 19 bp, Homo sapiens
tctccttgggctcctggct

SEQ ID NO: 1667405 - DNA, 20 bp, Homo sapiens
tctccttgggctcctggctg

SEQ ID NO: 1667406 - DNA, 14 bp, Homo sapiens
tctcctttcaggga

SEQ ID NO: 1667407 - DNA, 15 bp, Homo sapiens
tctcctttccttccc

SEQ ID NO: 1667408 - DNA, 19 bp, Homo sapiens
tctcctttccttcccaggc

SEQ ID NO: 1667409 - DNA, 16 bp, Homo sapiens
tctcctttctaagccc

SEQ ID NO: 1667410 - DNA, 14 bp, Homo sapiens
tctcctttctgtgc

SEQ ID NO: 1667411 - DNA, 15 bp, Homo sapiens
tctcctttctgtgca

SEQ ID NO: 1667412 - DNA, 20 bp, Homo sapiens
tctcctttctttttcttctt

SEQ ID NO: 1667413 - DNA, 23 bp, Homo sapiens
tctcctttgcactgagggccaca

SEQ ID NO: 1667414 - DNA, 17 bp, Homo sapiens
tctcctttgctcttgcc

SEQ ID NO: 1667415 - DNA, 17 bp, Homo sapiens
tctccttttcctctctc

SEQ ID NO: 1667416 - DNA, 19 bp, Homo sapiens
tctccttttgaacttgtca

SEQ ID NO: 1667417 - DNA, 15 bp, Homo sapiens
tctccttttgaggct

SEQ ID NO: 1667418 - DNA, 15 bp, Homo sapiens
tctcgaactcctggc

SEQ ID NO: 1667419 - DNA, 23 bp, Homo sapiens
tctcgagccccctggatgtcccc

SEQ ID NO: 1667420 - DNA, 13 bp, Homo sapiens
tctcgcagcctga

SEQ ID NO: 1667421 - DNA, 21 bp, Homo sapiens
tctcgcagcctgaagcctgga

SEQ ID NO: 1667422 - DNA, 17 bp, Homo sapiens
tctcgctcgctcgctct

SEQ ID NO: 1667423 - DNA, 19 bp, Homo sapiens
tctcgctctcgctctctct

SEQ ID NO: 1667424 - DNA, 20 bp, Homo sapiens
tctcgctgcgtcctcatttc

SEQ ID NO: 1667425 - DNA, 17 bp, Homo sapiens
tctcggagctggcccag

SEQ ID NO: 1667426 - DNA, 18 bp, Homo sapiens
tctcggagctggcccagg

SEQ ID NO: 1667427 - DNA, 18 bp, Homo sapiens
tctcggatgaccaaacca

SEQ ID NO: 1667428 - DNA, 20 bp, Homo sapiens
tctcggatgaccaaaccagc

SEQ ID NO: 1667429 - DNA, 13 bp, Homo sapiens
tctcggccaggca

SEQ ID NO: 1667430 - DNA, 16 bp, Homo sapiens
tctcggtgctccatct

SEQ ID NO: 1667431 - DNA, 17 bp, Homo sapiens
tctcggttccacgtccc

SEQ ID NO: 1667432 - DNA, 23 bp, Homo sapiens
tctcgtatccaacccaaggacct

SEQ ID NO: 1667433 - DNA, 17 bp, Homo sapiens
tctctaaaattctagtc

SEQ ID NO: 1667434 - DNA, 19 bp, Homo sapiens
tctctaaatcttccttgtg

SEQ ID NO: 1667435 - DNA, 20 bp, Homo sapiens
tctctaaatcttccttgtga

SEQ ID NO: 1667436 - DNA, 18 bp, Homo sapiens
tctctaactcagaaacat

SEQ ID NO: 1667437 - DNA, 16 bp, Homo sapiens
tctctaactcctgcca

SEQ ID NO: 1667438 - DNA, 22 bp, Homo sapiens
tctctaacttcaaggcccatat

SEQ ID NO: 1667439 - DNA, 17 bp, Homo sapiens
tctctacagaggtgaaa

SEQ ID NO: 1667440 - DNA, 15 bp, Homo sapiens
tctctacccatctcc

SEQ ID NO: 1667441 - DNA, 17 bp, Homo sapiens
tctctacctccaccctg

SEQ ID NO: 1667442 - DNA, 17 bp, Homo sapiens
tctctactaccacaagg

SEQ ID NO: 1667443 - DNA, 19 bp, Homo sapiens
tctctactaccacaaggaa

SEQ ID NO: 1667444 - DNA, 21 bp, Homo sapiens
tctctactcctacctcagcct

SEQ ID NO: 1667445 - DNA, 19 bp, Homo sapiens
tctctagaatccagcaggt

SEQ ID NO: 1667446 - DNA, 17 bp, Homo sapiens
tctctagaattttaagt

SEQ ID NO: 1667447 - DNA, 13 bp, Homo sapiens
tctctagacaaaa

SEQ ID NO: 1667448 - DNA, 14 bp, Homo sapiens
tctctagctgttct

SEQ ID NO: 1667449 - DNA, 14 bp, Homo sapiens
tctctagttggcca

SEQ ID NO: 1667450 - DNA, 20 bp, Homo sapiens
tctctatcagaaatacaaaa

SEQ ID NO: 1667451 - DNA, 21 bp, Homo sapiens
tctctatcagaaatacaaaaa

SEQ ID NO: 1667452 - DNA, 22 bp, Homo sapiens
tctctatcagaaatacaaaaaa

SEQ ID NO: 1667453 - DNA, 16 bp, Homo sapiens
tctctatgacatgaaa

SEQ ID NO: 1667454 - DNA, 13 bp, Homo sapiens
tctctatttgaga

SEQ ID NO: 1667455 - DNA, 14 bp, Homo sapiens
tctctcaaaacaat

SEQ ID NO: 1667456 - DNA, 14 bp, Homo sapiens
tctctcacacacac

SEQ ID NO: 1667457 - DNA, 23 bp, Homo sapiens
tctctcatcctccagtaccttgc

SEQ ID NO: 1667458 - DNA, 14 bp, Homo sapiens
tctctcatctctta

SEQ ID NO: 1667459 - DNA, 14 bp, Homo sapiens
tctctccacagtgt

SEQ ID NO: 1667460 - DNA, 18 bp, Homo sapiens
tctctccacagtgttgtg

SEQ ID NO: 1667461 - DNA, 15 bp, Homo sapiens
tctctccaggaaggt

SEQ ID NO: 1667462 - DNA, 19 bp, Homo sapiens
tctctccccctatttattg

SEQ ID NO: 1667463 - DNA, 13 bp, Homo sapiens
tctctcctcccca

SEQ ID NO: 1667464 - DNA, 11 bp, Homo sapiens
tctctcctggc

SEQ ID NO: 1667465 - DNA, 16 bp, Homo sapiens
tctctcctggcctatc

SEQ ID NO: 1667466 - DNA, 14 bp, Homo sapiens
tctctcctggctcg

SEQ ID NO: 1667467 - DNA, 14 bp, Homo sapiens
tctctccttggcca

SEQ ID NO: 1667468 - DNA, 17 bp, Homo sapiens
tctctcgctgcgtcctc

SEQ ID NO: 1667469 - DNA, 13 bp, Homo sapiens
tctctcgttaatt

SEQ ID NO: 1667470 - DNA, 18 bp, Homo sapiens
tctctcgttaattttcct

SEQ ID NO: 1667471 - DNA, 21 bp, Homo sapiens
tctctctacaagagcccctgc

SEQ ID NO: 1667472 - DNA, 13 bp, Homo sapiens
tctctctacctcc

SEQ ID NO: 1667473 - DNA, 20 bp, Homo sapiens
tctctctactcctacctcag

SEQ ID NO: 1667474 - DNA, 13 bp, Homo sapiens
tctctctccaccc

SEQ ID NO: 1667475 - DNA, 14 bp, Homo sapiens
tctctctccagggt

SEQ ID NO: 1667476 - DNA, 22 bp, Homo sapiens
tctctctcctgtactttttcca

SEQ ID NO: 1667477 - DNA, 15 bp, Homo sapiens
tctctctgcagctgc

SEQ ID NO: 1667478 - DNA, 18 bp, Homo sapiens
tctctctgcagctgccgg

SEQ ID NO: 1667479 - DNA, 12 bp, Homo sapiens
tctctctgccca

SEQ ID NO: 1667480 - DNA, 17 bp, Homo sapiens
tctctctgcctgtgagc

SEQ ID NO: 1667481 - DNA, 14 bp, Homo sapiens
tctctctggagccc

SEQ ID NO: 1667482 - DNA, 11 bp, Homo sapiens
tctctctgggc

SEQ ID NO: 1667483 - DNA, 12 bp, Homo sapiens
tctctcttcaat

SEQ ID NO: 1667484 - DNA, 17 bp, Homo sapiens
tctctcttcccttctcc

SEQ ID NO: 1667485 - DNA, 18 bp, Homo sapiens
tctctcttcccttctccc

SEQ ID NO: 1667486 - DNA, 13 bp, Homo sapiens
tctctcttctagg

SEQ ID NO: 1667487 - DNA, 18 bp, Homo sapiens
tctctctttcctccaccc

SEQ ID NO: 1667488 - DNA, 19 bp, Homo sapiens
tctctctttcctccaccca

SEQ ID NO: 1667489 - DNA, 16 bp, Homo sapiens
tctctcttttcctcct

SEQ ID NO: 1667490 - DNA, 22 bp, Homo sapiens
tctctcttttcctcctccaccc

SEQ ID NO: 1667491 - DNA, 14 bp, Homo sapiens
tctctgaaagtgtg

SEQ ID NO: 1667492 - DNA, 14 bp, Homo sapiens
tctctgaatcctaa

SEQ ID NO: 1667493 - DNA, 18 bp, Homo sapiens
tctctgacgcttgtgaca

SEQ ID NO: 1667494 - DNA, 19 bp, Homo sapiens
tctctgacgcttgtgacag

SEQ ID NO: 1667495 - DNA, 20 bp, Homo sapiens
tctctgacgcttgtgacagt

SEQ ID NO: 1667496 - DNA, 13 bp, Homo sapiens
tctctgacttctg

SEQ ID NO: 1667497 - DNA, 16 bp, Homo sapiens
tctctgacttctgcct

SEQ ID NO: 1667498 - DNA, 14 bp, Homo sapiens
tctctgagactgct

SEQ ID NO: 1667499 - DNA, 15 bp, Homo sapiens
tctctgagtcaaatc

SEQ ID NO: 1667500 - DNA, 22 bp, Homo sapiens
tctctgagtcaaatccagtggt

SEQ ID NO: 1667501 - DNA, 24 bp, Homo sapiens
tctctgagtcaaatccagtggtgg

SEQ ID NO: 1667502 - DNA, 19 bp, Homo sapiens
tctctgatcttgtgctcag

SEQ ID NO: 1667503 - DNA, 22 bp, Homo sapiens
tctctgatcttgtgctcagcat

SEQ ID NO: 1667504 - DNA, 15 bp, Homo sapiens
tctctgattaaattt

SEQ ID NO: 1667505 - DNA, 22 bp, Homo sapiens
tctctgattaaatttaatatac

SEQ ID NO: 1667506 - DNA, 19 bp, Homo sapiens
tctgccatgttgccccttt

SEQ ID NO: 1667507 - DNA, 24 bp, Homo sapiens
tctgccattgggaccctccagtgc

SEQ ID NO: 1667508 - DNA, 19 bp, Homo sapiens
tctgcccaaaaatatggtt

SEQ ID NO: 1667509 - DNA, 20 bp, Homo sapiens
tctgcccaggggtgccccct

SEQ ID NO: 1667510 - DNA, 13 bp, Homo sapiens
tctgccccaagca

SEQ ID NO: 1667511 - DNA, 18 bp, Homo sapiens
tctgccccaagcagccag

SEQ ID NO: 1667512 - DNA, 21 bp, Homo sapiens
tctgccccaagcagccagcca

SEQ ID NO: 1667513 - DNA, 23 bp, Homo sapiens
tctgccccaatcgggtccagaga

SEQ ID NO: 1667514 - DNA, 20 bp, Homo sapiens
tctgccccagcccagattcc

SEQ ID NO: 1667515 - DNA, 14 bp, Homo sapiens
tctgccccagcctg

SEQ ID NO: 1667516 - DNA, 17 bp, Homo sapiens
tctgccccagcctgtcc

SEQ ID NO: 1667517 - DNA, 13 bp, Homo sapiens
tctgccccagtag

SEQ ID NO: 1667518 - DNA, 19 bp, Homo sapiens
tctgccccagtagtcagaa

SEQ ID NO: 1667519 - DNA, 16 bp, Homo sapiens
tctgccccctccccca

SEQ ID NO: 1667520 - DNA, 18 bp, Homo sapiens
tctgcccctcccccaacc

SEQ ID NO: 1667521 - DNA, 22 bp, Homo sapiens
tctgcccctctccaggcgccgg

SEQ ID NO: 1667522 - DNA, 18 bp, Homo sapiens
tctgccctaacctgacag

SEQ ID NO: 1667523 - DNA, 17 bp, Homo sapiens
tctgccctgcctgagga

SEQ ID NO: 1667524 - DNA, 13 bp, Homo sapiens
tctgccctggatt

SEQ ID NO: 1667525 - DNA, 14 bp, Homo sapiens
tctgccctggctgc

SEQ ID NO: 1667526 - DNA, 21 bp, Homo sapiens
tctgccctggctgctgccccc

SEQ ID NO: 1667527 - DNA, 19 bp, Homo sapiens
tctgcccttatggagctca

SEQ ID NO: 1667528 - DNA, 15 bp, Homo sapiens
tctgccgcctcagct

SEQ ID NO: 1667529 - DNA, 15 bp, Homo sapiens
tctgccgctacctcc

SEQ ID NO: 1667530 - DNA, 20 bp, Homo sapiens
tctgccgctacctccctccc

SEQ ID NO: 1667531 - DNA, 21 bp, Homo sapiens
tctgccggtcgggcagccagc

SEQ ID NO: 1667532 - DNA, 22 bp, Homo sapiens
tctgccggtcgggcagccagca

SEQ ID NO: 1667533 - DNA, 20 bp, Homo sapiens
tctgcctaacttgtaaaaag

SEQ ID NO: 1667534 - DNA, 17 bp, Homo sapiens
tctgcctcagcctcctg

SEQ ID NO: 1667535 - DNA, 18 bp, Homo sapiens
tctgcctcagcctcctga

SEQ ID NO: 1667536 - DNA, 14 bp, Homo sapiens
tctgcctctcctcc

SEQ ID NO: 1667537 - DNA, 15 bp, Homo sapiens
tctgcctctcctcca

SEQ ID NO: 1667538 - DNA, 15 bp, Homo sapiens
tctgcctctctagga

SEQ ID NO: 1667539 - DNA, 14 bp, Homo sapiens
tctgcctctgcctg

SEQ ID NO: 1667540 - DNA, 15 bp, Homo sapiens
tctgcctgagattct

SEQ ID NO: 1667541 - DNA, 19 bp, Homo sapiens
tctgcctgagattctttaa

SEQ ID NO: 1667542 - DNA, 12 bp, Homo sapiens
tctgcctgcact

SEQ ID NO: 1667543 - DNA, 15 bp, Homo sapiens
tctgcctgcactccc

SEQ ID NO: 1667544 - DNA, 21 bp, Homo sapiens
tctgcctgcactccctggcct

SEQ ID NO: 1667545 - DNA, 23 bp, Homo sapiens
tctgcctgcactccctggccttg

SEQ ID NO: 1667546 - DNA, 17 bp, Homo sapiens
tctgcctgccagctgca

SEQ ID NO: 1667547 - DNA, 18 bp, Homo sapiens
tctgcctgccagctgcac

SEQ ID NO: 1667548 - DNA, 13 bp, Homo sapiens
tctgcctgcctgc

SEQ ID NO: 1667549 - DNA, 16 bp, Homo sapiens
tctgcctgctggggat

SEQ ID NO: 1667550 - DNA, 23 bp, Homo sapiens
tctgcctggagacaaggtgctaa

SEQ ID NO: 1667551 - DNA, 14 bp, Homo sapiens
tctgcctggcctgg

SEQ ID NO: 1667552 - DNA, 15 bp, Homo sapiens
tctgcctggcctggc

SEQ ID NO: 1667553 - DNA, 16 bp, Homo sapiens
tctgcctgggcctgtg

SEQ ID NO: 1667554 - DNA, 18 bp, Homo sapiens
tctgcctgggcctgtgca

SEQ ID NO: 1667555 - DNA, 19 bp, Homo sapiens
tctgcctgggcctgtgcag

SEQ ID NO: 1667556 - DNA, 22 bp, Homo sapiens
tctgcctgggcctgtgcagcag

SEQ ID NO: 1667557 - DNA, 21 bp, Homo sapiens
tctgcctgtggccttgcccgc

SEQ ID NO: 1667558 - DNA, 15 bp, Homo sapiens
tctgcctgttataac

SEQ ID NO: 1667559 - DNA, 19 bp, Homo sapiens
tctgcctgttataactctg

SEQ ID NO: 1667560 - DNA, 22 bp, Homo sapiens
tctgcctgttataactctgcac

SEQ ID NO: 1667561 - DNA, 16 bp, Homo sapiens
tctgccttaaaaccaa

SEQ ID NO: 1667562 - DNA, 23 bp, Homo sapiens
tctgccttaaacacacattgcag

SEQ ID NO: 1667563 - DNA, 17 bp, Homo sapiens
tctgccttactggtttc

SEQ ID NO: 1667564 - DNA, 23 bp, Homo sapiens
tctgccttactggtttccccagg

SEQ ID NO: 1667565 - DNA, 15 bp, Homo sapiens
tctgccttagtctca

SEQ ID NO: 1667566 - DNA, 15 bp, Homo sapiens
tctgccttcacaaat

SEQ ID NO: 1667567 - DNA, 19 bp, Homo sapiens
tctgccttcacaaatgtca

SEQ ID NO: 1667568 - DNA, 13 bp, Homo sapiens
tctgccttctcag

SEQ ID NO: 1667569 - DNA, 21 bp, Homo sapiens
tctgcctttagcctggaccaa

SEQ ID NO: 1667570 - DNA, 14 bp, Homo sapiens
tctgcctttatgat

SEQ ID NO: 1667571 - DNA, 10 bp, Homo sapiens
tctgcctttg

SEQ ID NO: 1667572 - DNA, 11 bp, Homo sapiens
tctgccttttc

SEQ ID NO: 1667573 - DNA, 15 bp, Homo sapiens
tctgcgcaccaagga

SEQ ID NO: 1667574 - DNA, 14 bp, Homo sapiens
tctgcgccaggcag

SEQ ID NO: 1667575 - DNA, 18 bp, Homo sapiens
tctgcgccaggcagagct

SEQ ID NO: 1667576 - DNA, 11 bp, Homo sapiens
tctgcgcctga

SEQ ID NO: 1667577 - DNA, 17 bp, Homo sapiens
tctgcgcctgaaaaggg

SEQ ID NO: 1667578 - DNA, 16 bp, Homo sapiens
tctgcgctgtgtacaa

SEQ ID NO: 1667579 - DNA, 17 bp, Homo sapiens
tctgcgctgtgtacaat

SEQ ID NO: 1667580 - DNA, 21 bp, Homo sapiens
tctgcgctgtgtacaatgtga

SEQ ID NO: 1667581 - DNA, 17 bp, Homo sapiens
tctgcggatctcagctt

SEQ ID NO: 1667582 - DNA, 19 bp, Homo sapiens
tctgcggatctcagctttg

SEQ ID NO: 1667583 - DNA, 19 bp, Homo sapiens
tctgcgtctctgctttaaa

SEQ ID NO: 1667584 - DNA, 18 bp, Homo sapiens
tctgcgtggcgcaggtgc

SEQ ID NO: 1667585 - DNA, 14 bp, Homo sapiens
tctgctaataaaac

SEQ ID NO: 1667586 - DNA, 14 bp, Homo sapiens
tctgctacctcact

SEQ ID NO: 1667587 - DNA, 18 bp, Homo sapiens
tctgctacttcactgtca

SEQ ID NO: 1667588 - DNA, 13 bp, Homo sapiens
tctgctagaaagt

SEQ ID NO: 1667589 - DNA, 15 bp, Homo sapiens
tctgctagaaagtta

SEQ ID NO: 1667590 - DNA, 16 bp, Homo sapiens
tctgctagactcctca

SEQ ID NO: 1667591 - DNA, 21 bp, Homo sapiens
tctgctagactcctcaggaga

SEQ ID NO: 1667592 - DNA, 14 bp, Homo sapiens
tctgctatatataa

SEQ ID NO: 1667593 - DNA, 15 bp, Homo sapiens
tctgctatatataaa

SEQ ID NO: 1667594 - DNA, 10 bp, Homo sapiens
tctgctccac

SEQ ID NO: 1667595 - DNA, 16 bp, Homo sapiens
tctgctccacccttgg

SEQ ID NO: 1667596 - DNA, 21 bp, Homo sapiens
tctgctccacccttggcctgt

SEQ ID NO: 1667597 - DNA, 12 bp, Homo sapiens
tctgctccagca

SEQ ID NO: 1667598 - DNA, 14 bp, Homo sapiens
tctgctccagcaac

SEQ ID NO: 1667599 - DNA, 23 bp, Homo sapiens
tctgctccagcaactgcccttcc

SEQ ID NO: 1667600 - DNA, 13 bp, Homo sapiens
tctgctcctgctt

SEQ ID NO: 1667601 - DNA, 17 bp, Homo sapiens
tctgctcctgcttttct

SEQ ID NO: 1667602 - DNA, 19 bp, Homo sapiens
tctgctcctgcttttctgt

SEQ ID NO: 1667603 - DNA, 23 bp, Homo sapiens
tctgctcctgcttttctgtcctg

SEQ ID NO: 1667604 - DNA, 18 bp, Homo sapiens
tctgctccttcactgttc

SEQ ID NO: 1667605 - DNA, 23 bp, Homo sapiens
tctgctccttcactgttccctct

SEQ ID NO: 1667606 - DNA, 20 bp, Homo sapiens
tctgctcggcttcttggacc

SEQ ID NO: 1667607 - DNA, 21 bp, Homo sapiens
tctgctctagattcataaata

SEQ ID NO: 1667608 - DNA, 16 bp, Homo sapiens
tctgctctagccagga

SEQ ID NO: 1667609 - DNA, 13 bp, Homo sapiens
tctgctctgccat

SEQ ID NO: 1667610 - DNA, 16 bp, Homo sapiens
tctgctctgcctggag

SEQ ID NO: 1667611 - DNA, 18 bp, Homo sapiens
tctgctctgcctggagtg

SEQ ID NO: 1667612 - DNA, 14 bp, Homo sapiens
tctgctctttctct

SEQ ID NO: 1667613 - DNA, 16 bp, Homo sapiens
tctgctctttctctgc

SEQ ID NO: 1667614 - DNA, 19 bp, Homo sapiens
tctgctctttctctgccag

SEQ ID NO: 1667615 - DNA, 15 bp, Homo sapiens
tctgctgaccaaatg

SEQ ID NO: 1667616 - DNA, 20 bp, Homo sapiens
tctgctgaggcccagtgcat

SEQ ID NO: 1667617 - DNA, 16 bp, Homo sapiens
tctgctgagttggcct

SEQ ID NO: 1667618 - DNA, 18 bp, Homo sapiens
tctgctgagttggcctgg

SEQ ID NO: 1667619 - DNA, 22 bp, Homo sapiens
tctgctgagttggcctggccat

SEQ ID NO: 1667620 - DNA, 12 bp, Homo sapiens
tctgctgccagc

SEQ ID NO: 1667621 - DNA, 15 bp, Homo sapiens
tctgtatattttggg

SEQ ID NO: 1667622 - DNA, 16 bp, Homo sapiens
tctgtatattttggga

SEQ ID NO: 1667623 - DNA, 12 bp, Homo sapiens
tctgtatccgtg

SEQ ID NO: 1667624 - DNA, 16 bp, Homo sapiens
tctgtatccgtgaatt

SEQ ID NO: 1667625 - DNA, 19 bp, Homo sapiens
tctgtatccgtgaattgct

SEQ ID NO: 1667626 - DNA, 21 bp, Homo sapiens
tctgtattaatccccatcatt

SEQ ID NO: 1667627 - DNA, 21 bp, Homo sapiens
tctgtcataagcattacttta

SEQ ID NO: 1667628 - DNA, 15 bp, Homo sapiens
tctgtcatcactccc

SEQ ID NO: 1667629 - DNA, 17 bp, Homo sapiens
tctgtcatcctcaggaa

SEQ ID NO: 1667630 - DNA, 15 bp, Homo sapiens
tctgtccaaaggagg

SEQ ID NO: 1667631 - DNA, 19 bp, Homo sapiens
tctgtccaaaggaggctgg

SEQ ID NO: 1667632 - DNA, 22 bp, Homo sapiens
tctgtccaaaggaggctggcag

SEQ ID NO: 1667633 - DNA, 14 bp, Homo sapiens
tctgtccacatccc

SEQ ID NO: 1667634 - DNA, 19 bp, Homo sapiens
tctgtccacatccccagag

SEQ ID NO: 1667635 - DNA, 13 bp, Homo sapiens
tctgtccaggcca

SEQ ID NO: 1667636 - DNA, 23 bp, Homo sapiens
tctgtccaggccactgtggccag

SEQ ID NO: 1667637 - DNA, 15 bp, Homo sapiens
tctgtccccttctct

SEQ ID NO: 1667638 - DNA, 15 bp, Homo sapiens
tctgtccctgttaga

SEQ ID NO: 1667639 - DNA, 16 bp, Homo sapiens
tctgtcccttgctgta

SEQ ID NO: 1667640 - DNA, 15 bp, Homo sapiens
tctgtcctcagcctt

SEQ ID NO: 1667641 - DNA, 11 bp, Homo sapiens
tctgtcctcct

SEQ ID NO: 1667642 - DNA, 16 bp, Homo sapiens
tctgtcctgagaagca

SEQ ID NO: 1667643 - DNA, 13 bp, Homo sapiens
tctgtcctgggca

SEQ ID NO: 1667644 - DNA, 15 bp, Homo sapiens
tctgtctagactggc

SEQ ID NO: 1667645 - DNA, 17 bp, Homo sapiens
tctgtctagactggcct

SEQ ID NO: 1667646 - DNA, 23 bp, Homo sapiens
tctgtctccctcccctctcagaa

SEQ ID NO: 1667647 - DNA, 18 bp, Homo sapiens
tctgtctcccttctctct

SEQ ID NO: 1667648 - DNA, 19 bp, Homo sapiens
tctgtctcccttctctctc

SEQ ID NO: 1667649 - DNA, 15 bp, Homo sapiens
tctgtctcgatgcct

SEQ ID NO: 1667650 - DNA, 20 bp, Homo sapiens
tctgtctcgatgcctgattc

SEQ ID NO: 1667651 - DNA, 23 bp, Homo sapiens
tctgtctctaaccattcaaatga

SEQ ID NO: 1667652 - DNA, 14 bp, Homo sapiens
tctgtcttaaatga

SEQ ID NO: 1667653 - DNA, 14 bp, Homo sapiens
tctgtcttcccaaa

SEQ ID NO: 1667654 - DNA, 14 bp, Homo sapiens
tctgtcttgccagc

SEQ ID NO: 1667655 - DNA, 15 bp, Homo sapiens
tctgtcttgccagcc

SEQ ID NO: 1667656 - DNA, 16 bp, Homo sapiens
tctgtcttgccagcca

SEQ ID NO: 1667657 - DNA, 18 bp, Homo sapiens
tctgtcttgttaatgctt

SEQ ID NO: 1667658 - DNA, 13 bp, Homo sapiens
tctgtcttgttca

SEQ ID NO: 1667659 - DNA, 14 bp, Homo sapiens
tctgtcttgttcat

SEQ ID NO: 1667660 - DNA, 20 bp, Homo sapiens
tctgtgaaatgctggcattt

SEQ ID NO: 1667661 - DNA, 18 bp, Homo sapiens
tctgtgaaattctcagag

SEQ ID NO: 1667662 - DNA, 20 bp, Homo sapiens
tctgtgaagaggaacagtgt

SEQ ID NO: 1667663 - DNA, 22 bp, Homo sapiens
tctgtgaattaaaaaagctcaa

SEQ ID NO: 1667664 - DNA, 18 bp, Homo sapiens
tctgtgaattgagctgca

SEQ ID NO: 1667665 - DNA, 18 bp, Homo sapiens
tctgtgactataaagctg

SEQ ID NO: 1667666 - DNA, 19 bp, Homo sapiens
tctgtgagaaggtttattg

SEQ ID NO: 1667667 - DNA, 21 bp, Homo sapiens
tctgtgagactcgagaacttt

SEQ ID NO: 1667668 - DNA, 21 bp, Homo sapiens
tctgtgatccttggtgctgtg

SEQ ID NO: 1667669 - DNA, 20 bp, Homo sapiens
tctgtgatcttttaaagtgt

SEQ ID NO: 1667670 - DNA, 13 bp, Homo sapiens
tctgtgattggct

SEQ ID NO: 1667671 - DNA, 16 bp, Homo sapiens
tctgtgcacagtggct

SEQ ID NO: 1667672 - DNA, 17 bp, Homo sapiens
tctgtgcacagtggctt

SEQ ID NO: 1667673 - DNA, 20 bp, Homo sapiens
tctgtgcactagcctgtgat

SEQ ID NO: 1667674 - DNA, 21 bp, Homo sapiens
tctgtgcactagcctgtgatt

SEQ ID NO: 1667675 - DNA, 22 bp, Homo sapiens
tctgtgcactagcctgtgatta

SEQ ID NO: 1667676 - DNA, 20 bp, Homo sapiens
tctgtgcagatgagcagtca

SEQ ID NO: 1667677 - DNA, 21 bp, Homo sapiens
tctgtgcaggatatttgcact

SEQ ID NO: 1667678 - DNA, 22 bp, Homo sapiens
tctgtgcaggatatttgcacta

SEQ ID NO: 1667679 - DNA, 14 bp, Homo sapiens
tctgtgcaggtgct

SEQ ID NO: 1667680 - DNA, 23 bp, Homo sapiens
tctgtgccagctctataattgtt

SEQ ID NO: 1667681 - DNA, 14 bp, Homo sapiens
tctgtgccccatgc

SEQ ID NO: 1667682 - DNA, 17 bp, Homo sapiens
tctgtgccccatgcctg

SEQ ID NO: 1667683 - DNA, 17 bp, Homo sapiens
tctgtgccctccaaaga

SEQ ID NO: 1667684 - DNA, 12 bp, Homo sapiens
tctgtgcctccc

SEQ ID NO: 1667685 - DNA, 13 bp, Homo sapiens
tctgtgcctcccc

SEQ ID NO: 1667686 - DNA, 14 bp, Homo sapiens
tctgtgccttggtc

SEQ ID NO: 1667687 - DNA, 14 bp, Homo sapiens
tctgtgctcctcct

SEQ ID NO: 1667688 - DNA, 13 bp, Homo sapiens
tctgtgctgtgcc

SEQ ID NO: 1667689 - DNA, 23 bp, Homo sapiens
tctgtgctgtgcctgctagagca

SEQ ID NO: 1667690 - DNA, 22 bp, Homo sapiens
tctgtggaccactgcatgagct

SEQ ID NO: 1667691 - DNA, 18 bp, Homo sapiens
tctgtggagggttgccat

SEQ ID NO: 1667692 - DNA, 21 bp, Homo sapiens
tctgtggagttcctgctccgt

SEQ ID NO: 1667693 - DNA, 18 bp, Homo sapiens
tctgtggatggtcattgc

SEQ ID NO: 1667694 - DNA, 22 bp, Homo sapiens
tctgtggcctgtgtccagcagc

SEQ ID NO: 1667695 - DNA, 23 bp, Homo sapiens
tctgtgggctacatgctggggtc

SEQ ID NO: 1667696 - DNA, 23 bp, Homo sapiens
tctgtggggtggttccgggctgg

SEQ ID NO: 1667697 - DNA, 16 bp, Homo sapiens
tctgtggttcctctgc

SEQ ID NO: 1667698 - DNA, 19 bp, Homo sapiens
tctgtggttcctctgctca

SEQ ID NO: 1667699 - DNA, 21 bp, Homo sapiens
tctgtggttttcccctccctg

SEQ ID NO: 1667700 - DNA, 16 bp, Homo sapiens
tctgtgtcccagccac

SEQ ID NO: 1667701 - DNA, 17 bp, Homo sapiens
tctgtgtcccagccacg

SEQ ID NO: 1667702 - DNA, 14 bp, Homo sapiens
tctgtgtctaagat

SEQ ID NO: 1667703 - DNA, 22 bp, Homo sapiens
tctgtgtctaagattctagatc

SEQ ID NO: 1667704 - DNA, 21 bp, Homo sapiens
tctgtgtctttcacagctcct

SEQ ID NO: 1667705 - DNA, 13 bp, Homo sapiens
tctgtgtggctcc

SEQ ID NO: 1667706 - DNA, 16 bp, Homo sapiens
tctgtgtggctcctgg

SEQ ID NO: 1667707 - DNA, 17 bp, Homo sapiens
tctgtgtggctcctggg

SEQ ID NO: 1667708 - DNA, 21 bp, Homo sapiens
tctgtgtggtggagccagggc

SEQ ID NO: 1667709 - DNA, 22 bp, Homo sapiens
tctgtgtgtgtgtatgtggggg

SEQ ID NO: 1667710 - DNA, 16 bp, Homo sapiens
tctgtgtgtttatgtg

SEQ ID NO: 1667711 - DNA, 20 bp, Homo sapiens
tctgtgttaattgcgtagag

SEQ ID NO: 1667712 - DNA, 13 bp, Homo sapiens
tctgtgttcattt

SEQ ID NO: 1667713 - DNA, 15 bp, Homo sapiens
tctgtgtttctggag

SEQ ID NO: 1667714 - DNA, 14 bp, Homo sapiens
tctgtgttttgaat

SEQ ID NO: 1667715 - DNA, 19 bp, Homo sapiens
tctgttactttgctatgtg

SEQ ID NO: 1667716 - DNA, 23 bp, Homo sapiens
tctgttataggtcctttagaaac

SEQ ID NO: 1667717 - DNA, 12 bp, Homo sapiens
tctgttatatga

SEQ ID NO: 1667718 - DNA, 22 bp, Homo sapiens
tctgttatgcactgtggtttca

SEQ ID NO: 1667719 - DNA, 18 bp, Homo sapiens
tctgttcagattaaaaaa

SEQ ID NO: 1667720 - DNA, 19 bp, Homo sapiens
tctgttcagcgttttgcaa

SEQ ID NO: 1667721 - DNA, 21 bp, Homo sapiens
tctgttccaacctcctgctct

SEQ ID NO: 1667722 - DNA, 18 bp, Homo sapiens
tctgttcccccaccctcc

SEQ ID NO: 1667723 - DNA, 20 bp, Homo sapiens
tctgttcctttctctgggct

SEQ ID NO: 1667724 - DNA, 20 bp, Homo sapiens
tctgttctacatagatgctt

SEQ ID NO: 1667725 - DNA, 23 bp, Homo sapiens
tctgttctgttgatcccacttca

SEQ ID NO: 1667726 - DNA, 15 bp, Homo sapiens
tctgttcttacaaat

SEQ ID NO: 1667727 - DNA, 17 bp, Homo sapiens
tctgttcttacaaatgt

SEQ ID NO: 1667728 - DNA, 14 bp, Homo sapiens
tctgttcttgctac

SEQ ID NO: 1667729 - DNA, 12 bp, Homo sapiens
tctgttgaagtt

SEQ ID NO: 1667730 - DNA, 13 bp, Homo sapiens
tctgttgacctgt

SEQ ID NO: 1667731 - DNA, 17 bp, Homo sapiens
tctgttgacctgtgcac

SEQ ID NO: 1667732 - DNA, 17 bp, Homo sapiens
tctgttgatcccacttc

SEQ ID NO: 1667733 - DNA, 20 bp, Homo sapiens
tctgttgatcccacttcact

SEQ ID NO: 1667734 - DNA, 19 bp, Homo sapiens
tctgttgccagtcagcaac

SEQ ID NO: 1667735 - DNA, 14 bp, Homo sapiens
tcttgatctctctt

SEQ ID NO: 1667736 - DNA, 13 bp, Homo sapiens
tcttgatcttaaa

SEQ ID NO: 1667737 - DNA, 15 bp, Homo sapiens
tcttgatcttaaaga

SEQ ID NO: 1667738 - DNA, 16 bp, Homo sapiens
tcttgatgaaaagctt

SEQ ID NO: 1667739 - DNA, 22 bp, Homo sapiens
tcttgatgtcatgtacttcctg

SEQ ID NO: 1667740 - DNA, 21 bp, Homo sapiens
tcttgatgttttttctgtaat

SEQ ID NO: 1667741 - DNA, 14 bp, Homo sapiens
tcttgattcctggc

SEQ ID NO: 1667742 - DNA, 14 bp, Homo sapiens
tcttgcacccgcct

SEQ ID NO: 1667743 - DNA, 20 bp, Homo sapiens
tcttgcacccgcctctcccg

SEQ ID NO: 1667744 - DNA, 18 bp, Homo sapiens
tcttgcagcatttactat

SEQ ID NO: 1667745 - DNA, 13 bp, Homo sapiens
tcttgccagccag

SEQ ID NO: 1667746 - DNA, 14 bp, Homo sapiens
tcttgccagccaga

SEQ ID NO: 1667747 - DNA, 15 bp, Homo sapiens
tcttgccagccagaa

SEQ ID NO: 1667748 - DNA, 14 bp, Homo sapiens
tcttgcccatcctg

SEQ ID NO: 1667749 - DNA, 15 bp, Homo sapiens
tcttgcccttccctg

SEQ ID NO: 1667750 - DNA, 18 bp, Homo sapiens
tcttgcccttccctgtcc

SEQ ID NO: 1667751 - DNA, 20 bp, Homo sapiens
tcttgcccttccctgtccct

SEQ ID NO: 1667752 - DNA, 16 bp, Homo sapiens
tcttgcctaaatccca

SEQ ID NO: 1667753 - DNA, 19 bp, Homo sapiens
tcttgcctatattttcctg

SEQ ID NO: 1667754 - DNA, 17 bp, Homo sapiens
tcttgcctccaggtgca

SEQ ID NO: 1667755 - DNA, 18 bp, Homo sapiens
tcttgcctccaggtgcag

SEQ ID NO: 1667756 - DNA, 12 bp, Homo sapiens
tcttgcctctgt

SEQ ID NO: 1667757 - DNA, 21 bp, Homo sapiens
tcttgcctctgtccccttctc

SEQ ID NO: 1667758 - DNA, 13 bp, Homo sapiens
tcttgcctctgtg

SEQ ID NO: 1667759 - DNA, 15 bp, Homo sapiens
tcttgcctctgtgct

SEQ ID NO: 1667760 - DNA, 16 bp, Homo sapiens
tcttgcctctgtgctg

SEQ ID NO: 1667761 - DNA, 23 bp, Homo sapiens
tcttgcctgtttcccaggcccac

SEQ ID NO: 1667762 - DNA, 20 bp, Homo sapiens
tcttgccttaaccagtctct

SEQ ID NO: 1667763 - DNA, 22 bp, Homo sapiens
tcttgccttaaccagtctctca

SEQ ID NO: 1667764 - DNA, 23 bp, Homo sapiens
tcttgccttaaccagtctctcaa

SEQ ID NO: 1667765 - DNA, 14 bp, Homo sapiens
tcttgcgatcctta

SEQ ID NO: 1667766 - DNA, 18 bp, Homo sapiens
tcttgcgggcctggacaa

SEQ ID NO: 1667767 - DNA, 13 bp, Homo sapiens
tcttgctaccagt

SEQ ID NO: 1667768 - DNA, 14 bp, Homo sapiens
tcttgctctgtagc

SEQ ID NO: 1667769 - DNA, 19 bp, Homo sapiens
tcttgctggattaatgttt

SEQ ID NO: 1667770 - DNA, 18 bp, Homo sapiens
tcttgctggctctgagaa

SEQ ID NO: 1667771 - DNA, 11 bp, Homo sapiens
tcttgctgggc

SEQ ID NO: 1667772 - DNA, 22 bp, Homo sapiens
tcttgcttccctaatctatggt

SEQ ID NO: 1667773 - DNA, 17 bp, Homo sapiens
tcttgcttctttctaga

SEQ ID NO: 1667774 - DNA, 14 bp, Homo sapiens
tcttgctttcacaa

SEQ ID NO: 1667775 - DNA, 18 bp, Homo sapiens
tcttgctttcacaaatat

SEQ ID NO: 1667776 - DNA, 21 bp, Homo sapiens
tcttgctttcacaaatatagt

SEQ ID NO: 1667777 - DNA, 14 bp, Homo sapiens
tcttgctttcttta

SEQ ID NO: 1667778 - DNA, 14 bp, Homo sapiens
tcttggaaaaacag

SEQ ID NO: 1667779 - DNA, 16 bp, Homo sapiens
tcttggaaagaaacaa

SEQ ID NO: 1667780 - DNA, 21 bp, Homo sapiens
tcttggaacattggaatgttc

SEQ ID NO: 1667781 - DNA, 19 bp, Homo sapiens
tcttggaactgtcccagct

SEQ ID NO: 1667782 - DNA, 15 bp, Homo sapiens
tcttggaccagggca

SEQ ID NO: 1667783 - DNA, 15 bp, Homo sapiens
tcttggaccttggcg

SEQ ID NO: 1667784 - DNA, 20 bp, Homo sapiens
tcttggagaagtctcagcta

SEQ ID NO: 1667785 - DNA, 19 bp, Homo sapiens
tcttggagctttggaatat

SEQ ID NO: 1667786 - DNA, 15 bp, Homo sapiens
tcttggagtttttca

SEQ ID NO: 1667787 - DNA, 22 bp, Homo sapiens
tcttggatggtgacattgaaac

SEQ ID NO: 1667788 - DNA, 18 bp, Homo sapiens
tcttggcccctgtgtgag

SEQ ID NO: 1667789 - DNA, 15 bp, Homo sapiens
tcttggcggcagcag

SEQ ID NO: 1667790 - DNA, 19 bp, Homo sapiens
tcttggcggcagcagccat

SEQ ID NO: 1667791 - DNA, 18 bp, Homo sapiens
tcttggctatttctgtgt

SEQ ID NO: 1667792 - DNA, 15 bp, Homo sapiens
tcttggctgacccct

SEQ ID NO: 1667793 - DNA, 19 bp, Homo sapiens
tcttggctgacccctctgg

SEQ ID NO: 1667794 - DNA, 19 bp, Homo sapiens
tcttggcttaatcattttc

SEQ ID NO: 1667795 - DNA, 19 bp, Homo sapiens
tcttggcttactgcagcct

SEQ ID NO: 1667796 - DNA, 16 bp, Homo sapiens
tcttgggaactccact

SEQ ID NO: 1667797 - DNA, 20 bp, Homo sapiens
tcttgggcctcaggctctgc

SEQ ID NO: 1667798 - DNA, 15 bp, Homo sapiens
tcttgggctactggc

SEQ ID NO: 1667799 - DNA, 18 bp, Homo sapiens
tcttgggctactggcagc

SEQ ID NO: 1667800 - DNA, 22 bp, Homo sapiens
tcttgggctactggcagctcct

SEQ ID NO: 1667801 - DNA, 11 bp, Homo sapiens
tcttgggggtc

SEQ ID NO: 1667802 - DNA, 21 bp, Homo sapiens
tcttgggggtcaggggggaga

SEQ ID NO: 1667803 - DNA, 16 bp, Homo sapiens
tcttgggtaggcggga

SEQ ID NO: 1667804 - DNA, 15 bp, Homo sapiens
tcttgggtgtattct

SEQ ID NO: 1667805 - DNA, 18 bp, Homo sapiens
tcttggtagttctgtgcc

SEQ ID NO: 1667806 - DNA, 13 bp, Homo sapiens
tcttggtcagctt

SEQ ID NO: 1667807 - DNA, 19 bp, Homo sapiens
tcttggtgggtgtggccag

SEQ ID NO: 1667808 - DNA, 20 bp, Homo sapiens
tcttggtgggtgtggccagc

SEQ ID NO: 1667809 - DNA, 19 bp, Homo sapiens
tcttggttgaaaataaaaa

SEQ ID NO: 1667810 - DNA, 15 bp, Homo sapiens
tcttggtttccttcc

SEQ ID NO: 1667811 - DNA, 16 bp, Homo sapiens
tcttggtttggggaga

SEQ ID NO: 1667812 - DNA, 22 bp, Homo sapiens
tcttggtttgtcagtttatctt

SEQ ID NO: 1667813 - DNA, 14 bp, Homo sapiens
tcttgtaaatgttt

SEQ ID NO: 1667814 - DNA, 11 bp, Homo sapiens
tcttgtaccat

SEQ ID NO: 1667815 - DNA, 15 bp, Homo sapiens
tcttgtacttctgtg

SEQ ID NO: 1667816 - DNA, 18 bp, Homo sapiens
tcttgtacttctgtgttc

SEQ ID NO: 1667817 - DNA, 21 bp, Homo sapiens
tcttgtagaagatggactctg

SEQ ID NO: 1667818 - DNA, 17 bp, Homo sapiens
tcttgtagccatggctg

SEQ ID NO: 1667819 - DNA, 20 bp, Homo sapiens
tcttgtataagatcctagat

SEQ ID NO: 1667820 - DNA, 15 bp, Homo sapiens
tcttgtatttattgg

SEQ ID NO: 1667821 - DNA, 22 bp, Homo sapiens
tcttgtatttattggttttgca

SEQ ID NO: 1667822 - DNA, 11 bp, Homo sapiens
tcttgtatttg

SEQ ID NO: 1667823 - DNA, 15 bp, Homo sapiens
tcttgtcacaataaa

SEQ ID NO: 1667824 - DNA, 15 bp, Homo sapiens
tcttgtcatgtgtat

SEQ ID NO: 1667825 - DNA, 13 bp, Homo sapiens
tcttgtccctgtc

SEQ ID NO: 1667826 - DNA, 21 bp, Homo sapiens
tcttgtcctcttctgctcttt

SEQ ID NO: 1667827 - DNA, 15 bp, Homo sapiens
tcttgtcctggccct

SEQ ID NO: 1667828 - DNA, 20 bp, Homo sapiens
tcttgtcctggcccttcagt

SEQ ID NO: 1667829 - DNA, 14 bp, Homo sapiens
tcttgtctccacta

SEQ ID NO: 1667830 - DNA, 14 bp, Homo sapiens
tcttgtctctgggc

SEQ ID NO: 1667831 - DNA, 17 bp, Homo sapiens
tcttgtgaactgtcttg

SEQ ID NO: 1667832 - DNA, 17 bp, Homo sapiens
tcttgtgacgtgcactg

SEQ ID NO: 1667833 - DNA, 18 bp, Homo sapiens
tcttgtgctagaatactt

SEQ ID NO: 1667834 - DNA, 15 bp, Homo sapiens
tcttgtgctcacgct

SEQ ID NO: 1667835 - DNA, 13 bp, Homo sapiens
tcttgtgcttctt

SEQ ID NO: 1667836 - DNA, 18 bp, Homo sapiens
tcttgtggaggatgaata

SEQ ID NO: 1667837 - DNA, 18 bp, Homo sapiens
tcttgtgggagacagcag

SEQ ID NO: 1667838 - DNA, 15 bp, Homo sapiens
tcttgtggttaaaaa

SEQ ID NO: 1667839 - DNA, 15 bp, Homo sapiens
tcttgtgtcctggta

SEQ ID NO: 1667840 - DNA, 19 bp, Homo sapiens
tcttgttaatgtcattgct

SEQ ID NO: 1667841 - DNA, 21 bp, Homo sapiens
tcttgttactccctgttattt

SEQ ID NO: 1667842 - DNA, 13 bp, Homo sapiens
tcttgttgttatt

SEQ ID NO: 1667843 - DNA, 16 bp, Homo sapiens
tcttgtttaccaaaga

SEQ ID NO: 1667844 - DNA, 23 bp, Homo sapiens
tcttgtttacgatttcactagga

SEQ ID NO: 1667845 - DNA, 14 bp, Homo sapiens
tcttgtttcaattc

SEQ ID NO: 1667846 - DNA, 14 bp, Homo sapiens
tcttgtttcagtga

SEQ ID NO: 1667847 - DNA, 15 bp, Homo sapiens
tcttgtttccttgtt

SEQ ID NO: 1667848 - DNA, 19 bp, Homo sapiens
tcttgtttgtcagcatctg

SEQ ID NO: 1667849 - DNA, 16 bp, Homo sapiens
tcttgtttttaagttt

SEQ ID NO: 1667850 - DNA, 16 bp, Homo sapiens
tgaactaataaaagca

SEQ ID NO: 1667851 - DNA, 18 bp, Homo sapiens
tgaactaggctgagcaat

SEQ ID NO: 1667852 - DNA, 16 bp, Homo sapiens
tgaactattgagaaga

SEQ ID NO: 1667853 - DNA, 16 bp, Homo sapiens
tgaactcaaactgagg

SEQ ID NO: 1667854 - DNA, 16 bp, Homo sapiens
tgaactcaagaaggaa

SEQ ID NO: 1667855 - DNA, 18 bp, Homo sapiens
tgaactcaagaaggaatt

SEQ ID NO: 1667856 - DNA, 22 bp, Homo sapiens
tgaactcagtagctgaacctgt

SEQ ID NO: 1667857 - DNA, 14 bp, Homo sapiens
tgaactccaccgac

SEQ ID NO: 1667858 - DNA, 12 bp, Homo sapiens
tgaactccattt

SEQ ID NO: 1667859 - DNA, 14 bp, Homo sapiens
tgaactcctgccat

SEQ ID NO: 1667860 - DNA, 17 bp, Homo sapiens
tgaactccttccccact

SEQ ID NO: 1667861 - DNA, 12 bp, Homo sapiens
tgaactctgaga

SEQ ID NO: 1667862 - DNA, 16 bp, Homo sapiens
tgaactctgttccccc

SEQ ID NO: 1667863 - DNA, 19 bp, Homo sapiens
tgaactctgttcccccacc

SEQ ID NO: 1667864 - DNA, 15 bp, Homo sapiens
tgaactcttcaatct

SEQ ID NO: 1667865 - DNA, 14 bp, Homo sapiens
tgaactctttctgg

SEQ ID NO: 1667866 - DNA, 12 bp, Homo sapiens
tgaactgaaagt

SEQ ID NO: 1667867 - DNA, 13 bp, Homo sapiens
tgaactgaacacc

SEQ ID NO: 1667868 - DNA, 22 bp, Homo sapiens
tgaactgaacaccattgaaggc

SEQ ID NO: 1667869 - DNA, 16 bp, Homo sapiens
tgaactgaggccttgt

SEQ ID NO: 1667870 - DNA, 15 bp, Homo sapiens
tgaactgcttttcct

SEQ ID NO: 1667871 - DNA, 14 bp, Homo sapiens
tgaactggaagaaa

SEQ ID NO: 1667872 - DNA, 17 bp, Homo sapiens
tgaactggcaattgtct

SEQ ID NO: 1667873 - DNA, 22 bp, Homo sapiens
tgaacttaataactgtgtactg

SEQ ID NO: 1667874 - DNA, 23 bp, Homo sapiens
tgaacttacacttggagcccgtg

SEQ ID NO: 1667875 - DNA, 15 bp, Homo sapiens
tgaacttagaactat

SEQ ID NO: 1667876 - DNA, 21 bp, Homo sapiens
tgaacttagaactatgctaat

SEQ ID NO: 1667877 - DNA, 14 bp, Homo sapiens
tgaacttccatttg

SEQ ID NO: 1667878 - DNA, 19 bp, Homo sapiens
tgaacttcctgcttcctca

SEQ ID NO: 1667879 - DNA, 17 bp, Homo sapiens
tgaacttgactgggtga

SEQ ID NO: 1667880 - DNA, 22 bp, Homo sapiens
tgaactttgaatggtttaacaa

SEQ ID NO: 1667881 - DNA, 14 bp, Homo sapiens
tgaacttttgtact

SEQ ID NO: 1667882 - DNA, 14 bp, Homo sapiens
tgaagaaaatactt

SEQ ID NO: 1667883 - DNA, 20 bp, Homo sapiens
tgaagaaaatacttaaatgt

SEQ ID NO: 1667884 - DNA, 15 bp, Homo sapiens
tgaagaaaatcactt

SEQ ID NO: 1667885 - DNA, 16 bp, Homo sapiens
tgaagaaagtcaaaaa

SEQ ID NO: 1667886 - DNA, 20 bp, Homo sapiens
tgaagaaagtcaaaaaatta

SEQ ID NO: 1667887 - DNA, 21 bp, Homo sapiens
tgaagaaagtcaaaaaattat

SEQ ID NO: 1667888 - DNA, 14 bp, Homo sapiens
tgaagaacacagca

SEQ ID NO: 1667889 - DNA, 18 bp, Homo sapiens
tgaagaacacagcatgtg

SEQ ID NO: 1667890 - DNA, 15 bp, Homo sapiens
tgaagaacagtaact

SEQ ID NO: 1667891 - DNA, 14 bp, Homo sapiens
tgaagaactgcagg

SEQ ID NO: 1667892 - DNA, 17 bp, Homo sapiens
tgaagaactgcaggccc

SEQ ID NO: 1667893 - DNA, 18 bp, Homo sapiens
tgaagaactgcaggccct

SEQ ID NO: 1667894 - DNA, 22 bp, Homo sapiens
tgaagaagctaaatcctttact

SEQ ID NO: 1667895 - DNA, 22 bp, Homo sapiens
tgaagaaggggctgttcttcca

SEQ ID NO: 1667896 - DNA, 15 bp, Homo sapiens
tgaagaagggggtgg

SEQ ID NO: 1667897 - DNA, 20 bp, Homo sapiens
tgaagaagggggtgggggga

SEQ ID NO: 1667898 - DNA, 15 bp, Homo sapiens
tgaagaatctaatga

SEQ ID NO: 1667899 - DNA, 14 bp, Homo sapiens
tgaagacagagcaa

SEQ ID NO: 1667900 - DNA, 19 bp, Homo sapiens
tgaagacattttttgctat

SEQ ID NO: 1667901 - DNA, 15 bp, Homo sapiens
tgaagaccatggatt

SEQ ID NO: 1667902 - DNA, 17 bp, Homo sapiens
tgaagacggaaaacaat

SEQ ID NO: 1667903 - DNA, 17 bp, Homo sapiens
tgaagacgtggactcct

SEQ ID NO: 1667904 - DNA, 18 bp, Homo sapiens
tgaagacgtggactcctc

SEQ ID NO: 1667905 - DNA, 21 bp, Homo sapiens
tgaagacgtggactcctcttg

SEQ ID NO: 1667906 - DNA, 21 bp, Homo sapiens
tgaagagaaaaaaaggaaaag

SEQ ID NO: 1667907 - DNA, 23 bp, Homo sapiens
tgaagagaatgtattctgtatcc

SEQ ID NO: 1667908 - DNA, 12 bp, Homo sapiens
tgaagagaggga

SEQ ID NO: 1667909 - DNA, 23 bp, Homo sapiens
tgaagagagggacaggcactcca

SEQ ID NO: 1667910 - DNA, 13 bp, Homo sapiens
tgaagaggaacag

SEQ ID NO: 1667911 - DNA, 18 bp, Homo sapiens
tgaagaggaacagtgtgg

SEQ ID NO: 1667912 - DNA, 23 bp, Homo sapiens
tgaagaggcgggccagccaggcg

SEQ ID NO: 1667913 - DNA, 13 bp, Homo sapiens
tgaagaggggcag

SEQ ID NO: 1667914 - DNA, 16 bp, Homo sapiens
tgaagaggggcagccc

SEQ ID NO: 1667915 - DNA, 19 bp, Homo sapiens
tgaagagtgggtttcacaa

SEQ ID NO: 1667916 - DNA, 15 bp, Homo sapiens
tgaagatcagaacat

SEQ ID NO: 1667917 - DNA, 15 bp, Homo sapiens
tgaagatctaaactt

SEQ ID NO: 1667918 - DNA, 13 bp, Homo sapiens
tgaagatgctgcc

SEQ ID NO: 1667919 - DNA, 20 bp, Homo sapiens
tgaagatgctgcctgtattt

SEQ ID NO: 1667920 - DNA, 17 bp, Homo sapiens
tgaagatgctgtaaata

SEQ ID NO: 1667921 - DNA, 18 bp, Homo sapiens
tgaagattatttcattcg

SEQ ID NO: 1667922 - DNA, 19 bp, Homo sapiens
tgaagattcttaaaaattg

SEQ ID NO: 1667923 - DNA, 13 bp, Homo sapiens
tgaagcaaagaag

SEQ ID NO: 1667924 - DNA, 17 bp, Homo sapiens
tgaagcaattagtctga

SEQ ID NO: 1667925 - DNA, 23 bp, Homo sapiens
tgaagcacttaagtcttccttaa

SEQ ID NO: 1667926 - DNA, 13 bp, Homo sapiens
tgaagcaggaggc

SEQ ID NO: 1667927 - DNA, 17 bp, Homo sapiens
tgaagcagggtttcttt

SEQ ID NO: 1667928 - DNA, 13 bp, Homo sapiens
tgaagcagtcttg

SEQ ID NO: 1667929 - DNA, 15 bp, Homo sapiens
tgaagcagtgcctcg

SEQ ID NO: 1667930 - DNA, 23 bp, Homo sapiens
tgaagcagtgcctcgaggcaccg

SEQ ID NO: 1667931 - DNA, 18 bp, Homo sapiens
tgaagcattctccccagt

SEQ ID NO: 1667932 - DNA, 11 bp, Homo sapiens
tgaagccaaag

SEQ ID NO: 1667933 - DNA, 12 bp, Homo sapiens
tgaagccaaaga

SEQ ID NO: 1667934 - DNA, 22 bp, Homo sapiens
tgaagccctagtagctggcgcc

SEQ ID NO: 1667935 - DNA, 18 bp, Homo sapiens
tgaagccgactctggccc

SEQ ID NO: 1667936 - DNA, 17 bp, Homo sapiens
tgaagccggacagctgc

SEQ ID NO: 1667937 - DNA, 19 bp, Homo sapiens
tgaagccggacagctgccc

SEQ ID NO: 1667938 - DNA, 20 bp, Homo sapiens
tgaagccggacagctgccca

SEQ ID NO: 1667939 - DNA, 15 bp, Homo sapiens
tgaagcctaaatttg

SEQ ID NO: 1667940 - DNA, 17 bp, Homo sapiens
tgaagcctggattccag

SEQ ID NO: 1667941 - DNA, 15 bp, Homo sapiens
tgaagctattggaat

SEQ ID NO: 1667942 - DNA, 19 bp, Homo sapiens
tgaagctatttatctgtag

SEQ ID NO: 1667943 - DNA, 16 bp, Homo sapiens
tgaagctcacttctgg

SEQ ID NO: 1667944 - DNA, 15 bp, Homo sapiens
tgaagctggagcagc

SEQ ID NO: 1667945 - DNA, 13 bp, Homo sapiens
tgaaggaaaaatt

SEQ ID NO: 1667946 - DNA, 22 bp, Homo sapiens
tgaaggaaaagcaagaaacagt

SEQ ID NO: 1667947 - DNA, 17 bp, Homo sapiens
tgaaggaatagccagag

SEQ ID NO: 1667948 - DNA, 19 bp, Homo sapiens
tgaaggaatagccagagag

SEQ ID NO: 1667949 - DNA, 19 bp, Homo sapiens
tgaaggacacttcctgcct

SEQ ID NO: 1667950 - DNA, 20 bp, Homo sapiens
tgaaggacacttcctgccta

SEQ ID NO: 1667951 - DNA, 14 bp, Homo sapiens
tgaaggactgcaga

SEQ ID NO: 1667952 - DNA, 23 bp, Homo sapiens
tgaaggagaaaatagataattta

SEQ ID NO: 1667953 - DNA, 19 bp, Homo sapiens
tgaaggagaggaggaatta

SEQ ID NO: 1667954 - DNA, 16 bp, Homo sapiens
tgaaggcagtctgaac

SEQ ID NO: 1667955 - DNA, 19 bp, Homo sapiens
tgaagggaaacaaagaagt

SEQ ID NO: 1667956 - DNA, 21 bp, Homo sapiens
tgaagggaaaggatattttct

SEQ ID NO: 1667957 - DNA, 21 bp, Homo sapiens
tgaagggaggtgaagaggctg

SEQ ID NO: 1667958 - DNA, 14 bp, Homo sapiens
tgaagggccagagc

SEQ ID NO: 1667959 - DNA, 18 bp, Homo sapiens
tgaagggccagagccagg

SEQ ID NO: 1667960 - DNA, 21 bp, Homo sapiens
tgaagggggtaccttaagaga

SEQ ID NO: 1667961 - DNA, 20 bp, Homo sapiens
tgaaggggtgcacccacctg

SEQ ID NO: 1667962 - DNA, 22 bp, Homo sapiens
tgaaggggtgcacccacctgtt

SEQ ID NO: 1667963 - DNA, 14 bp, Homo sapiens
tgaaggtaaataaa

SEQ ID NO: 1667964 - DNA, 23 bp, Homo sapiens
tgaaggtagcattctttggagtt

SEQ ID NO: 1667965 - DNA, 23 bp, Homo sapiens
tgaccagtgagaactctctccct

SEQ ID NO: 1667966 - DNA, 22 bp, Homo sapiens
tgaccatccactctaccctccc

SEQ ID NO: 1667967 - DNA, 13 bp, Homo sapiens
tgaccatctgtga

SEQ ID NO: 1667968 - DNA, 14 bp, Homo sapiens
tgaccatctgtgac

SEQ ID NO: 1667969 - DNA, 23 bp, Homo sapiens
tgaccatctgtgactataaagct

SEQ ID NO: 1667970 - DNA, 19 bp, Homo sapiens
tgaccatgcgtcaggggcc

SEQ ID NO: 1667971 - DNA, 18 bp, Homo sapiens
tgaccattctcaccctgt

SEQ ID NO: 1667972 - DNA, 22 bp, Homo sapiens
tgaccattttttaatttacttg

SEQ ID NO: 1667973 - DNA, 16 bp, Homo sapiens
tgacccacactgccag

SEQ ID NO: 1667974 - DNA, 21 bp, Homo sapiens
tgacccacactgccagaagag

SEQ ID NO: 1667975 - DNA, 16 bp, Homo sapiens
tgacccaccagtgcct

SEQ ID NO: 1667976 - DNA, 17 bp, Homo sapiens
tgacccaccagtgcctt

SEQ ID NO: 1667977 - DNA, 14 bp, Homo sapiens
tgacccacccagtg

SEQ ID NO: 1667978 - DNA, 16 bp, Homo sapiens
tgacccagagccacca

SEQ ID NO: 1667979 - DNA, 20 bp, Homo sapiens
tgacccagagtggagtctga

SEQ ID NO: 1667980 - DNA, 18 bp, Homo sapiens
tgacccagcatctcccag

SEQ ID NO: 1667981 - DNA, 21 bp, Homo sapiens
tgacccagccccttgagaaac

SEQ ID NO: 1667982 - DNA, 23 bp, Homo sapiens
tgacccagccccttgagaaacct

SEQ ID NO: 1667983 - DNA, 15 bp, Homo sapiens
tgacccagcctgaaa

SEQ ID NO: 1667984 - DNA, 16 bp, Homo sapiens
tgacccagcctgaaag

SEQ ID NO: 1667985 - DNA, 16 bp, Homo sapiens
tgacccaggccgcagc

SEQ ID NO: 1667986 - DNA, 21 bp, Homo sapiens
tgacccaggccgcagctcttg

SEQ ID NO: 1667987 - DNA, 16 bp, Homo sapiens
tgacccaggctgcctg

SEQ ID NO: 1667988 - DNA, 19 bp, Homo sapiens
tgacccaggctgcctgagc

SEQ ID NO: 1667989 - DNA, 15 bp, Homo sapiens
tgacccagtccctgg

SEQ ID NO: 1667990 - DNA, 20 bp, Homo sapiens
tgacccagtccctgggggaa

SEQ ID NO: 1667991 - DNA, 18 bp, Homo sapiens
tgacccagtgcccccact

SEQ ID NO: 1667992 - DNA, 21 bp, Homo sapiens
tgaccccaaacaccttccagc

SEQ ID NO: 1667993 - DNA, 20 bp, Homo sapiens
tgaccccagaaattctggcc

SEQ ID NO: 1667994 - DNA, 16 bp, Homo sapiens
tgaccccattcctgat

SEQ ID NO: 1667995 - DNA, 20 bp, Homo sapiens
tgaccccgagaagtgctctt

SEQ ID NO: 1667996 - DNA, 12 bp, Homo sapiens
tgacccctctgg

SEQ ID NO: 1667997 - DNA, 14 bp, Homo sapiens
tgacccctgcctgt

SEQ ID NO: 1667998 - DNA, 20 bp, Homo sapiens
tgacccctgcctgttggcag

SEQ ID NO: 1667999 - DNA, 21 bp, Homo sapiens
tgaccctatgggtctaggaca

SEQ ID NO: 1668000 - DNA, 23 bp, Homo sapiens
tgaccctgaaaggaacactggct

SEQ ID NO: 1668001 - DNA, 20 bp, Homo sapiens
tgaccctgcgaaggggccct

SEQ ID NO: 1668002 - DNA, 15 bp, Homo sapiens
tgaccctgggcctgg

SEQ ID NO: 1668003 - DNA, 16 bp, Homo sapiens
tgacccttcagggcca

SEQ ID NO: 1668004 - DNA, 20 bp, Homo sapiens
tgacccttcagggccagaag

SEQ ID NO: 1668005 - DNA, 12 bp, Homo sapiens
tgaccgagagaa

SEQ ID NO: 1668006 - DNA, 20 bp, Homo sapiens
tgaccgagccctggagagcc

SEQ ID NO: 1668007 - DNA, 18 bp, Homo sapiens
tgaccgtgctggccccag

SEQ ID NO: 1668008 - DNA, 14 bp, Homo sapiens
tgaccgttaaaaaa

SEQ ID NO: 1668009 - DNA, 13 bp, Homo sapiens
tgacctaaaagtt

SEQ ID NO: 1668010 - DNA, 19 bp, Homo sapiens
tgacctaaaagttgaaaag

SEQ ID NO: 1668011 - DNA, 17 bp, Homo sapiens
tgacctaagtcaggtaa

SEQ ID NO: 1668012 - DNA, 15 bp, Homo sapiens
tgacctacagtgctg

SEQ ID NO: 1668013 - DNA, 13 bp, Homo sapiens
tgacctactctca

SEQ ID NO: 1668014 - DNA, 18 bp, Homo sapiens
tgacctattcaccctcca

SEQ ID NO: 1668015 - DNA, 15 bp, Homo sapiens
tgacctcacctggtc

SEQ ID NO: 1668016 - DNA, 22 bp, Homo sapiens
tgacctcatcattaataagtga

SEQ ID NO: 1668017 - DNA, 22 bp, Homo sapiens
tgacctccatactgggctaagg

SEQ ID NO: 1668018 - DNA, 13 bp, Homo sapiens
tgacctccatttc

SEQ ID NO: 1668019 - DNA, 14 bp, Homo sapiens
tgacctccctctaa

SEQ ID NO: 1668020 - DNA, 17 bp, Homo sapiens
tgacctccgccatccac

SEQ ID NO: 1668021 - DNA, 18 bp, Homo sapiens
tgacctcgtgatccaccc

SEQ ID NO: 1668022 - DNA, 16 bp, Homo sapiens
tgacctctctctctgg

SEQ ID NO: 1668023 - DNA, 19 bp, Homo sapiens
tgacctgagatgtgtgatt

SEQ ID NO: 1668024 - DNA, 12 bp, Homo sapiens
tgacctgaggct

SEQ ID NO: 1668025 - DNA, 17 bp, Homo sapiens
tgacctgaggctgtggt

SEQ ID NO: 1668026 - DNA, 13 bp, Homo sapiens
tgacctgccccgc

SEQ ID NO: 1668027 - DNA, 18 bp, Homo sapiens
tgacctgcctctcacaca

SEQ ID NO: 1668028 - DNA, 21 bp, Homo sapiens
tgacctggtgggagcacctgc

SEQ ID NO: 1668029 - DNA, 12 bp, Homo sapiens
tgacctgtcacc

SEQ ID NO: 1668030 - DNA, 20 bp, Homo sapiens
tgacctgtcatgcccccctc

SEQ ID NO: 1668031 - DNA, 21 bp, Homo sapiens
tgacctgtcatgcccccctca

SEQ ID NO: 1668032 - DNA, 13 bp, Homo sapiens
tgacctgtgacca

SEQ ID NO: 1668033 - DNA, 11 bp, Homo sapiens
tgacctgtgca

SEQ ID NO: 1668034 - DNA, 16 bp, Homo sapiens
tgacctgtttctctgc

SEQ ID NO: 1668035 - DNA, 19 bp, Homo sapiens
tgaccttagcgttctggac

SEQ ID NO: 1668036 - DNA, 15 bp, Homo sapiens
tgacgacaagtgctg

SEQ ID NO: 1668037 - DNA, 13 bp, Homo sapiens
tgacgcccagctc

SEQ ID NO: 1668038 - DNA, 23 bp, Homo sapiens
tgacgccctgcgttggagccact

SEQ ID NO: 1668039 - DNA, 23 bp, Homo sapiens
tgacgcctgatggtgctgctcag

SEQ ID NO: 1668040 - DNA, 12 bp, Homo sapiens
tgacgcttccct

SEQ ID NO: 1668041 - DNA, 18 bp, Homo sapiens
tgacgcttgtgacagtgc

SEQ ID NO: 1668042 - DNA, 21 bp, Homo sapiens
tgacgcttgtgacagtgcctc

SEQ ID NO: 1668043 - DNA, 17 bp, Homo sapiens
tgacggacatccaggcg

SEQ ID NO: 1668044 - DNA, 19 bp, Homo sapiens
tgacggccagggagaagct

SEQ ID NO: 1668045 - DNA, 18 bp, Homo sapiens
tgacggcgcccccagtgt

SEQ ID NO: 1668046 - DNA, 20 bp, Homo sapiens
tgacggcgcccccagtgtgc

SEQ ID NO: 1668047 - DNA, 21 bp, Homo sapiens
tgacggctgggtgtttcagtt

SEQ ID NO: 1668048 - DNA, 21 bp, Homo sapiens
tgacggtgttaattttgctaa

SEQ ID NO: 1668049 - DNA, 21 bp, Homo sapiens
tgacgtcagcgcaccaaaact

SEQ ID NO: 1668050 - DNA, 22 bp, Homo sapiens
tgacgtgaccggacttttctgc

SEQ ID NO: 1668051 - DNA, 15 bp, Homo sapiens
tgacgtgcactgtga

SEQ ID NO: 1668052 - DNA, 18 bp, Homo sapiens
tgacgtgccttttgcacc

SEQ ID NO: 1668053 - DNA, 23 bp, Homo sapiens
tgacgtgccttttgcacccctcc

SEQ ID NO: 1668054 - DNA, 18 bp, Homo sapiens
tgacgtgtgtggctggga

SEQ ID NO: 1668055 - DNA, 19 bp, Homo sapiens
tgacgtgtgtggctgggac

SEQ ID NO: 1668056 - DNA, 21 bp, Homo sapiens
tgacgtgtgtggctgggacct

SEQ ID NO: 1668057 - DNA, 12 bp, Homo sapiens
tgacgtttacat

SEQ ID NO: 1668058 - DNA, 16 bp, Homo sapiens
tgactaaagctatgtt

SEQ ID NO: 1668059 - DNA, 19 bp, Homo sapiens
tgactaaattcgtgatttt

SEQ ID NO: 1668060 - DNA, 20 bp, Homo sapiens
tgactaactcaaatacacat

SEQ ID NO: 1668061 - DNA, 21 bp, Homo sapiens
tgactaactcaaatacacatt

SEQ ID NO: 1668062 - DNA, 23 bp, Homo sapiens
tgactaactcaaatacacatttg

SEQ ID NO: 1668063 - DNA, 22 bp, Homo sapiens
tgactaattttacatgtttata

SEQ ID NO: 1668064 - DNA, 12 bp, Homo sapiens
tgactacatttt

SEQ ID NO: 1668065 - DNA, 15 bp, Homo sapiens
tgactactttgcctt

SEQ ID NO: 1668066 - DNA, 21 bp, Homo sapiens
tgactagaagggccagtcctg

SEQ ID NO: 1668067 - DNA, 18 bp, Homo sapiens
tgactaggcatacactgt

SEQ ID NO: 1668068 - DNA, 20 bp, Homo sapiens
tgactagggattcaggctgc

SEQ ID NO: 1668069 - DNA, 14 bp, Homo sapiens
tgactataaagctg

SEQ ID NO: 1668070 - DNA, 18 bp, Homo sapiens
tgactattctgtatcttt

SEQ ID NO: 1668071 - DNA, 20 bp, Homo sapiens
tgactattctgtatctttca

SEQ ID NO: 1668072 - DNA, 20 bp, Homo sapiens
tgactattcttgatgtaaaa

SEQ ID NO: 1668073 - DNA, 21 bp, Homo sapiens
tgactattcttgatgtaaaat

SEQ ID NO: 1668074 - DNA, 22 bp, Homo sapiens
tgactattcttgatgtaaaatc

SEQ ID NO: 1668075 - DNA, 20 bp, Homo sapiens
tgactcaattatttgcatat

SEQ ID NO: 1668076 - DNA, 19 bp, Homo sapiens
tgactcacacctgaactga

SEQ ID NO: 1668077 - DNA, 12 bp, Homo sapiens
tgactcacccaa

SEQ ID NO: 1668078 - DNA, 20 bp, Homo sapiens
tgactcagttccaggcctga

SEQ ID NO: 1668079 - DNA, 17 bp, Homo sapiens
tgagctggaaggggcca

SEQ ID NO: 1668080 - DNA, 19 bp, Homo sapiens
tgagctggcaaccagccag

SEQ ID NO: 1668081 - DNA, 21 bp, Homo sapiens
tgagctggcctctctagcaca

SEQ ID NO: 1668082 - DNA, 18 bp, Homo sapiens
tgagctggggactcaggg

SEQ ID NO: 1668083 - DNA, 21 bp, Homo sapiens
tgagctggggactcagggacc

SEQ ID NO: 1668084 - DNA, 13 bp, Homo sapiens
tgagctggggccg

SEQ ID NO: 1668085 - DNA, 21 bp, Homo sapiens
tgagctggggccgtctgtgtg

SEQ ID NO: 1668086 - DNA, 23 bp, Homo sapiens
tgagctggggtgggagctcctcc

SEQ ID NO: 1668087 - DNA, 22 bp, Homo sapiens
tgagctgtaatttcgccttaaa

SEQ ID NO: 1668088 - DNA, 21 bp, Homo sapiens
tgagctgtgttttgtctgagc

SEQ ID NO: 1668089 - DNA, 22 bp, Homo sapiens
tgagctgtgttttgtctgagcc

SEQ ID NO: 1668090 - DNA, 18 bp, Homo sapiens
tgagcttaaataacaaaa

SEQ ID NO: 1668091 - DNA, 14 bp, Homo sapiens
tgagcttcaatata

SEQ ID NO: 1668092 - DNA, 19 bp, Homo sapiens
tgagcttggcagctgaact

SEQ ID NO: 1668093 - DNA, 23 bp, Homo sapiens
tgagcttgggaagtcgaggctgc

SEQ ID NO: 1668094 - DNA, 18 bp, Homo sapiens
tgagctttccatgttgct

SEQ ID NO: 1668095 - DNA, 15 bp, Homo sapiens
tgagctttgctgcta

SEQ ID NO: 1668096 - DNA, 17 bp, Homo sapiens
tgagctttgctgctaca

SEQ ID NO: 1668097 - DNA, 23 bp, Homo sapiens
tgagcttttaaataaaattgaaa

SEQ ID NO: 1668098 - DNA, 18 bp, Homo sapiens
tgagcttttcatggaagt

SEQ ID NO: 1668099 - DNA, 14 bp, Homo sapiens
tgaggaaaaaatgg

SEQ ID NO: 1668100 - DNA, 14 bp, Homo sapiens
tgaggaaatttgca

SEQ ID NO: 1668101 - DNA, 21 bp, Homo sapiens
tgaggaactgtagatgatgta

SEQ ID NO: 1668102 - DNA, 17 bp, Homo sapiens
tgaggaagaacggggct

SEQ ID NO: 1668103 - DNA, 16 bp, Homo sapiens
tgaggaatatttcaag

SEQ ID NO: 1668104 - DNA, 18 bp, Homo sapiens
tgaggaatccaaaagaca

SEQ ID NO: 1668105 - DNA, 15 bp, Homo sapiens
tgaggaatttcacct

SEQ ID NO: 1668106 - DNA, 21 bp, Homo sapiens
tgaggaatttcacctgtaaac

SEQ ID NO: 1668107 - DNA, 19 bp, Homo sapiens
tgaggacaaccattccaga

SEQ ID NO: 1668108 - DNA, 22 bp, Homo sapiens
tgaggacaccagtgaaagaagc

SEQ ID NO: 1668109 - DNA, 16 bp, Homo sapiens
tgaggacagaaggact

SEQ ID NO: 1668110 - DNA, 14 bp, Homo sapiens
tgaggacaggcccc

SEQ ID NO: 1668111 - DNA, 15 bp, Homo sapiens
tgaggactcctgagg

SEQ ID NO: 1668112 - DNA, 17 bp, Homo sapiens
tgaggactgatttcaga

SEQ ID NO: 1668113 - DNA, 13 bp, Homo sapiens
tgaggagccctga

SEQ ID NO: 1668114 - DNA, 11 bp, Homo sapiens
tgaggagctgc

SEQ ID NO: 1668115 - DNA, 12 bp, Homo sapiens
tgaggagctgca

SEQ ID NO: 1668116 - DNA, 14 bp, Homo sapiens
tgaggagctgcact

SEQ ID NO: 1668117 - DNA, 12 bp, Homo sapiens
tgaggagctgct

SEQ ID NO: 1668118 - DNA, 15 bp, Homo sapiens
tgaggagctgctggc

SEQ ID NO: 1668119 - DNA, 14 bp, Homo sapiens
tgaggagctggagg

SEQ ID NO: 1668120 - DNA, 16 bp, Homo sapiens
tgaggagctggagggg

SEQ ID NO: 1668121 - DNA, 17 bp, Homo sapiens
tgaggagctggaggggt

SEQ ID NO: 1668122 - DNA, 19 bp, Homo sapiens
tgaggagctggaggggtgg

SEQ ID NO: 1668123 - DNA, 21 bp, Homo sapiens
tgaggagctggaggggtgggg

SEQ ID NO: 1668124 - DNA, 13 bp, Homo sapiens
tgaggagctgggg

SEQ ID NO: 1668125 - DNA, 12 bp, Homo sapiens
tgaggaggaaaa

SEQ ID NO: 1668126 - DNA, 13 bp, Homo sapiens
tgaggaggaaaag

SEQ ID NO: 1668127 - DNA, 23 bp, Homo sapiens
tgaggaggaggacacagcacaag

SEQ ID NO: 1668128 - DNA, 13 bp, Homo sapiens
tgaggaggggagg

SEQ ID NO: 1668129 - DNA, 22 bp, Homo sapiens
tgaggaggggagggtaaataaa

SEQ ID NO: 1668130 - DNA, 13 bp, Homo sapiens
tgaggagggtgga

SEQ ID NO: 1668131 - DNA, 16 bp, Homo sapiens
tgaggatgagctggaa

SEQ ID NO: 1668132 - DNA, 23 bp, Homo sapiens
tgaggattatgggtcctgcaatt

SEQ ID NO: 1668133 - DNA, 20 bp, Homo sapiens
tgaggattattgatagtact

SEQ ID NO: 1668134 - DNA, 13 bp, Homo sapiens
tgaggattgtgga

SEQ ID NO: 1668135 - DNA, 17 bp, Homo sapiens
tgaggattgtggaaaac

SEQ ID NO: 1668136 - DNA, 16 bp, Homo sapiens
tgaggcaaacagcaag

SEQ ID NO: 1668137 - DNA, 12 bp, Homo sapiens
tgaggcagacag

SEQ ID NO: 1668138 - DNA, 16 bp, Homo sapiens
tgaggcagacagcagc

SEQ ID NO: 1668139 - DNA, 17 bp, Homo sapiens
tgaggcagacagcagct

SEQ ID NO: 1668140 - DNA, 13 bp, Homo sapiens
tgaggcagcccag

SEQ ID NO: 1668141 - DNA, 14 bp, Homo sapiens
tgaggcaggagaat

SEQ ID NO: 1668142 - DNA, 13 bp, Homo sapiens
tgaggcagggcaa

SEQ ID NO: 1668143 - DNA, 15 bp, Homo sapiens
tgaggcaggggcgga

SEQ ID NO: 1668144 - DNA, 17 bp, Homo sapiens
tgaggcattcggggaag

SEQ ID NO: 1668145 - DNA, 12 bp, Homo sapiens
tgaggccaggag

SEQ ID NO: 1668146 - DNA, 14 bp, Homo sapiens
tgaggccatctcag

SEQ ID NO: 1668147 - DNA, 17 bp, Homo sapiens
tgaggccatctcaggag

SEQ ID NO: 1668148 - DNA, 19 bp, Homo sapiens
tgaggccatctcaggagat

SEQ ID NO: 1668149 - DNA, 20 bp, Homo sapiens
tgaggccatctcaggagatg

SEQ ID NO: 1668150 - DNA, 22 bp, Homo sapiens
tgaggccatctcaggagatgga

SEQ ID NO: 1668151 - DNA, 19 bp, Homo sapiens
tgaggccccgatggactcc

SEQ ID NO: 1668152 - DNA, 14 bp, Homo sapiens
tgaggcccctaggt

SEQ ID NO: 1668153 - DNA, 14 bp, Homo sapiens
tgaggccctgccca

SEQ ID NO: 1668154 - DNA, 19 bp, Homo sapiens
tgaggccgctagaggcctg

SEQ ID NO: 1668155 - DNA, 19 bp, Homo sapiens
tgaggcctaaaagtaaaca

SEQ ID NO: 1668156 - DNA, 16 bp, Homo sapiens
tgaggcctagactctg

SEQ ID NO: 1668157 - DNA, 14 bp, Homo sapiens
tgaggcctggactt

SEQ ID NO: 1668158 - DNA, 19 bp, Homo sapiens
tgaggcctggactttcctg

SEQ ID NO: 1668159 - DNA, 23 bp, Homo sapiens
tgaggcctggactttcctgcaac

SEQ ID NO: 1668160 - DNA, 23 bp, Homo sapiens
tgaggcgggtggatcacctgagg

SEQ ID NO: 1668161 - DNA, 16 bp, Homo sapiens
tgaggctctttctggg

SEQ ID NO: 1668162 - DNA, 14 bp, Homo sapiens
tgaggctgctgcca

SEQ ID NO: 1668163 - DNA, 22 bp, Homo sapiens
tgaggctgtaactgagagaaag

SEQ ID NO: 1668164 - DNA, 12 bp, Homo sapiens
tgaggctgtcct

SEQ ID NO: 1668165 - DNA, 13 bp, Homo sapiens
tgaggctgtcctg

SEQ ID NO: 1668166 - DNA, 14 bp, Homo sapiens
tgaggctgtcctgt

SEQ ID NO: 1668167 - DNA, 21 bp, Homo sapiens
tgaggctgtggtcacagcgga

SEQ ID NO: 1668168 - DNA, 13 bp, Homo sapiens
tgaggcttagaga

SEQ ID NO: 1668169 - DNA, 18 bp, Homo sapiens
tgaggcttccaggctctt

SEQ ID NO: 1668170 - DNA, 21 bp, Homo sapiens
tgaggcttccaggctcttcct

SEQ ID NO: 1668171 - DNA, 18 bp, Homo sapiens
tgaggcttttcccaccag

SEQ ID NO: 1668172 - DNA, 16 bp, Homo sapiens
tgagggaaggagccca

SEQ ID NO: 1668173 - DNA, 24 bp, Homo sapiens
tgagggaaggagcccagccagaaa

SEQ ID NO: 1668174 - DNA, 14 bp, Homo sapiens
tgagggacagagcc

SEQ ID NO: 1668175 - DNA, 19 bp, Homo sapiens
tgagggaccgagcccagca

SEQ ID NO: 1668176 - DNA, 18 bp, Homo sapiens
tgagggaccttggagagc

SEQ ID NO: 1668177 - DNA, 22 bp, Homo sapiens
tgagggacgtcagacttggctc

SEQ ID NO: 1668178 - DNA, 23 bp, Homo sapiens
tgagggaggacaggcgggaggag

SEQ ID NO: 1668179 - DNA, 20 bp, Homo sapiens
tgagggaggaggccacctct

SEQ ID NO: 1668180 - DNA, 22 bp, Homo sapiens
tgagggagggggcgctcaggac

SEQ ID NO: 1668181 - DNA, 18 bp, Homo sapiens
tgagggagttagggagag

SEQ ID NO: 1668182 - DNA, 19 bp, Homo sapiens
tgagggagttagggagaga

SEQ ID NO: 1668183 - DNA, 17 bp, Homo sapiens
tgagggatcacagggcc

SEQ ID NO: 1668184 - DNA, 18 bp, Homo sapiens
tgagggatcacagggccc

SEQ ID NO: 1668185 - DNA, 18 bp, Homo sapiens
tgagggatcactgccaaa

SEQ ID NO: 1668186 - DNA, 15 bp, Homo sapiens
tgagggcagtgccct

SEQ ID NO: 1668187 - DNA, 16 bp, Homo sapiens
tgagggcagtgccctt

SEQ ID NO: 1668188 - DNA, 15 bp, Homo sapiens
tgagggccagggacc

SEQ ID NO: 1668189 - DNA, 22 bp, Homo sapiens
tgagggcccagccaggagcaga

SEQ ID NO: 1668190 - DNA, 14 bp, Homo sapiens
tgagggcccctctg

SEQ ID NO: 1668191 - DNA, 16 bp, Homo sapiens
tgagggcccctctgcc

SEQ ID NO: 1668192 - DNA, 19 bp, Homo sapiens
tgagggcccctctgcccag

SEQ ID NO: 1668193 - DNA, 13 bp, Homo sapiens
tgagggccctgtg

SEQ ID NO: 1668194 - DNA, 16 bp, Homo sapiens
tgatcaaaaataaact

SEQ ID NO: 1668195 - DNA, 17 bp, Homo sapiens
tgatcaaaaataaacta

SEQ ID NO: 1668196 - DNA, 22 bp, Homo sapiens
tgatcaaattcatttttttcac

SEQ ID NO: 1668197 - DNA, 17 bp, Homo sapiens
tgatcaacatcttttct

SEQ ID NO: 1668198 - DNA, 21 bp, Homo sapiens
tgatcaacatcttttcttgcc

SEQ ID NO: 1668199 - DNA, 23 bp, Homo sapiens
tgatcaacatcttttcttgcctc

SEQ ID NO: 1668200 - DNA, 15 bp, Homo sapiens
tgatcaactcttcga

SEQ ID NO: 1668201 - DNA, 23 bp, Homo sapiens
tgatcaagagtccggatttctaa

SEQ ID NO: 1668202 - DNA, 20 bp, Homo sapiens
tgatcaagggaatgtaactg

SEQ ID NO: 1668203 - DNA, 18 bp, Homo sapiens
tgatcaattatagtttct

SEQ ID NO: 1668204 - DNA, 20 bp, Homo sapiens
tgatcaattatagtttctga

SEQ ID NO: 1668205 - DNA, 21 bp, Homo sapiens
tgatcaattatagtttctgag

SEQ ID NO: 1668206 - DNA, 22 bp, Homo sapiens
tgatcaattatagtttctgagg

SEQ ID NO: 1668207 - DNA, 13 bp, Homo sapiens
tgatcacacagtg

SEQ ID NO: 1668208 - DNA, 15 bp, Homo sapiens
tgatcacacagtgtt

SEQ ID NO: 1668209 - DNA, 12 bp, Homo sapiens
tgatcacagtga

SEQ ID NO: 1668210 - DNA, 19 bp, Homo sapiens
tgatcacccaatgcatcac

SEQ ID NO: 1668211 - DNA, 17 bp, Homo sapiens
tgatcagacatacagct

SEQ ID NO: 1668212 - DNA, 22 bp, Homo sapiens
tgatcagacatacagctgccta

SEQ ID NO: 1668213 - DNA, 20 bp, Homo sapiens
tgatcagctttcaaagcatt

SEQ ID NO: 1668214 - DNA, 21 bp, Homo sapiens
tgatcagctttcaaagcattt

SEQ ID NO: 1668215 - DNA, 14 bp, Homo sapiens
tgatcaggcttcct

SEQ ID NO: 1668216 - DNA, 18 bp, Homo sapiens
tgatcaggcttcctggtg

SEQ ID NO: 1668217 - DNA, 21 bp, Homo sapiens
tgatcagtactgactttctga

SEQ ID NO: 1668218 - DNA, 19 bp, Homo sapiens
tgatcagtagtttgcattt

SEQ ID NO: 1668219 - DNA, 21 bp, Homo sapiens
tgatcagtagtttgcatttca

SEQ ID NO: 1668220 - DNA, 22 bp, Homo sapiens
tgatcagtagtttgcatttcag

SEQ ID NO: 1668221 - DNA, 15 bp, Homo sapiens
tgatcagtgattttc

SEQ ID NO: 1668222 - DNA, 11 bp, Homo sapiens
tgatcagtgtt

SEQ ID NO: 1668223 - DNA, 18 bp, Homo sapiens
tgatcatcgccagaggtg

SEQ ID NO: 1668224 - DNA, 14 bp, Homo sapiens
tgatcatgtacttt

SEQ ID NO: 1668225 - DNA, 19 bp, Homo sapiens
tgatcatgtactttttagt

SEQ ID NO: 1668226 - DNA, 22 bp, Homo sapiens
tgatcatgtgtggaagttatta

SEQ ID NO: 1668227 - DNA, 13 bp, Homo sapiens
tgatccaactaat

SEQ ID NO: 1668228 - DNA, 19 bp, Homo sapiens
tgatccacactttgggctt

SEQ ID NO: 1668229 - DNA, 15 bp, Homo sapiens
tgatccacccaaccc

SEQ ID NO: 1668230 - DNA, 21 bp, Homo sapiens
tgatccacccaaccctatctc

SEQ ID NO: 1668231 - DNA, 16 bp, Homo sapiens
tgatcccagtcactcc

SEQ ID NO: 1668232 - DNA, 17 bp, Homo sapiens
tgatcccagtcactcct

SEQ ID NO: 1668233 - DNA, 20 bp, Homo sapiens
tgatcccagtcactcctctc

SEQ ID NO: 1668234 - DNA, 15 bp, Homo sapiens
tgatcccattttcct

SEQ ID NO: 1668235 - DNA, 23 bp, Homo sapiens
tgatcccggccggccctggcttg

SEQ ID NO: 1668236 - DNA, 22 bp, Homo sapiens
tgatccctgaacccctggccag

SEQ ID NO: 1668237 - DNA, 17 bp, Homo sapiens
tgatccctgctctctga

SEQ ID NO: 1668238 - DNA, 21 bp, Homo sapiens
tgatccctgttacccagagaa

SEQ ID NO: 1668239 - DNA, 16 bp, Homo sapiens
tgatccgcctgcctct

SEQ ID NO: 1668240 - DNA, 23 bp, Homo sapiens
tgatccgcctgcctctgcctccc

SEQ ID NO: 1668241 - DNA, 15 bp, Homo sapiens
tgatccggtttcttt

SEQ ID NO: 1668242 - DNA, 18 bp, Homo sapiens
tgatccgtccgaggctgc

SEQ ID NO: 1668243 - DNA, 18 bp, Homo sapiens
tgatcctcatatggccca

SEQ ID NO: 1668244 - DNA, 13 bp, Homo sapiens
tgatcctgcggag

SEQ ID NO: 1668245 - DNA, 16 bp, Homo sapiens
tgatcctgctccagca

SEQ ID NO: 1668246 - DNA, 11 bp, Homo sapiens
tgatcctgctg

SEQ ID NO: 1668247 - DNA, 14 bp, Homo sapiens
tgatcctggaggcc

SEQ ID NO: 1668248 - DNA, 15 bp, Homo sapiens
tgatcctggaggccc

SEQ ID NO: 1668249 - DNA, 18 bp, Homo sapiens
tgatcctggaggcccagt

SEQ ID NO: 1668250 - DNA, 23 bp, Homo sapiens
tgatcctggaggtcttttctagt

SEQ ID NO: 1668251 - DNA, 22 bp, Homo sapiens
tgatccttctgagctccacctc

SEQ ID NO: 1668252 - DNA, 16 bp, Homo sapiens
tgatcgagccactgca

SEQ ID NO: 1668253 - DNA, 15 bp, Homo sapiens
tgatcgtgctaaatt

SEQ ID NO: 1668254 - DNA, 14 bp, Homo sapiens
tgatctaaaatttg

SEQ ID NO: 1668255 - DNA, 12 bp, Homo sapiens
tgatctaacaaa

SEQ ID NO: 1668256 - DNA, 13 bp, Homo sapiens
tgatctaacaaaa

SEQ ID NO: 1668257 - DNA, 15 bp, Homo sapiens
tgatctaacaaaata

SEQ ID NO: 1668258 - DNA, 12 bp, Homo sapiens
tgatctaataaa

SEQ ID NO: 1668259 - DNA, 20 bp, Homo sapiens
tgatctacttctgtaattgt

SEQ ID NO: 1668260 - DNA, 17 bp, Homo sapiens
tgatctacttgcctcat

SEQ ID NO: 1668261 - DNA, 23 bp, Homo sapiens
tgatctcaggagcttgcaagaag

SEQ ID NO: 1668262 - DNA, 19 bp, Homo sapiens
tgatctcagggaagcccag

SEQ ID NO: 1668263 - DNA, 14 bp, Homo sapiens
tgatctcattgttc

SEQ ID NO: 1668264 - DNA, 15 bp, Homo sapiens
tgatctccctgccgc

SEQ ID NO: 1668265 - DNA, 18 bp, Homo sapiens
tgatctcccttggtcttc

SEQ ID NO: 1668266 - DNA, 20 bp, Homo sapiens
tgatctctactaccacaagg

SEQ ID NO: 1668267 - DNA, 15 bp, Homo sapiens
tgatctctcttgtcc

SEQ ID NO: 1668268 - DNA, 17 bp, Homo sapiens
tgatctctcttgtcctc

SEQ ID NO: 1668269 - DNA, 18 bp, Homo sapiens
tgatctctcttgtcctct

SEQ ID NO: 1668270 - DNA, 21 bp, Homo sapiens
tgatctctgttacaaaagaaa

SEQ ID NO: 1668271 - DNA, 23 bp, Homo sapiens
tgatctcttcttttggcttccat

SEQ ID NO: 1668272 - DNA, 16 bp, Homo sapiens
tgatctgccgcctcag

SEQ ID NO: 1668273 - DNA, 20 bp, Homo sapiens
tgatctgctagtgctgtaat

SEQ ID NO: 1668274 - DNA, 13 bp, Homo sapiens
tgatctggaaccc

SEQ ID NO: 1668275 - DNA, 14 bp, Homo sapiens
tgatctggaaccca

SEQ ID NO: 1668276 - DNA, 15 bp, Homo sapiens
tgatctgtatataca

SEQ ID NO: 1668277 - DNA, 19 bp, Homo sapiens
tgatctgtatatacaataa

SEQ ID NO: 1668278 - DNA, 11 bp, Homo sapiens
tgatcttaaag

SEQ ID NO: 1668279 - DNA, 18 bp, Homo sapiens
tgatcttaaagatcgtgt

SEQ ID NO: 1668280 - DNA, 18 bp, Homo sapiens
tgatcttgcctgtctggc

SEQ ID NO: 1668281 - DNA, 18 bp, Homo sapiens
tgatcttggaaaaacagc

SEQ ID NO: 1668282 - DNA, 13 bp, Homo sapiens
tgatcttggctca

SEQ ID NO: 1668283 - DNA, 18 bp, Homo sapiens
tgatcttgtgctcagcat

SEQ ID NO: 1668284 - DNA, 17 bp, Homo sapiens
tgatctttaaaatacac

SEQ ID NO: 1668285 - DNA, 14 bp, Homo sapiens
tgatctttctagag

SEQ ID NO: 1668286 - DNA, 14 bp, Homo sapiens
tgatcttttaaagt

SEQ ID NO: 1668287 - DNA, 14 bp, Homo sapiens
tgatgaaaagcttt

SEQ ID NO: 1668288 - DNA, 13 bp, Homo sapiens
tgatgaaagctga

SEQ ID NO: 1668289 - DNA, 19 bp, Homo sapiens
tgatgaaagctgattactg

SEQ ID NO: 1668290 - DNA, 18 bp, Homo sapiens
tgatgaaatctgctagaa

SEQ ID NO: 1668291 - DNA, 13 bp, Homo sapiens
tgatgaaattctt

SEQ ID NO: 1668292 - DNA, 16 bp, Homo sapiens
tgatgaaattcttgaa

SEQ ID NO: 1668293 - DNA, 12 bp, Homo sapiens
tgatgaagaagg

SEQ ID NO: 1668294 - DNA, 15 bp, Homo sapiens
tgatgaatgtaaagt

SEQ ID NO: 1668295 - DNA, 20 bp, Homo sapiens
tgatgacaaaaaatgtttta

SEQ ID NO: 1668296 - DNA, 15 bp, Homo sapiens
tgatgacccttttca

SEQ ID NO: 1668297 - DNA, 14 bp, Homo sapiens
tgatgacttgctgt

SEQ ID NO: 1668298 - DNA, 19 bp, Homo sapiens
tgatgacttgctgtccagg

SEQ ID NO: 1668299 - DNA, 20 bp, Homo sapiens
tgatgagttaactgtgaaat

SEQ ID NO: 1668300 - DNA, 15 bp, Homo sapiens
tgatgataataataa

SEQ ID NO: 1668301 - DNA, 17 bp, Homo sapiens
tgatgatccagaacagt

SEQ ID NO: 1668302 - DNA, 19 bp, Homo sapiens
tgatgatccagaacagtgg

SEQ ID NO: 1668303 - DNA, 15 bp, Homo sapiens
tgatgatgataatga

SEQ ID NO: 1668304 - DNA, 15 bp, Homo sapiens
tgatgatgatgaaaa

SEQ ID NO: 1668305 - DNA, 16 bp, Homo sapiens
tgatgatgatgataat

SEQ ID NO: 1668306 - DNA, 16 bp, Homo sapiens
tgatgatgatgatgaa

SEQ ID NO: 1668307 - DNA, 14 bp, Homo sapiens
tgatgatgtctctt

SEQ ID NO: 1668308 - DNA, 14 bp, Homo sapiens
tgatgattttcctt

SEQ ID NO: 1668309 - DNA, 16 bp, Homo sapiens
tgatgattttcctttt

SEQ ID NO: 1668310 - DNA, 13 bp, Homo sapiens
tgatgcaaatctg

SEQ ID NO: 1668311 - DNA, 11 bp, Homo sapiens
tgatgcaatat

SEQ ID NO: 1668312 - DNA, 13 bp, Homo sapiens
tgatgcagacaca

SEQ ID NO: 1668313 - DNA, 16 bp, Homo sapiens
tgatgcagcctgtggc

SEQ ID NO: 1668314 - DNA, 15 bp, Homo sapiens
tgatgcagttttaat

SEQ ID NO: 1668315 - DNA, 14 bp, Homo sapiens
tgatgcatacagtt

SEQ ID NO: 1668316 - DNA, 15 bp, Homo sapiens
tgatgcatgagctcc

SEQ ID NO: 1668317 - DNA, 13 bp, Homo sapiens
tgatgcatgtctt

SEQ ID NO: 1668318 - DNA, 18 bp, Homo sapiens
tgatgccacacagagtgg

SEQ ID NO: 1668319 - DNA, 12 bp, Homo sapiens
tgatgccagagg

SEQ ID NO: 1668320 - DNA, 18 bp, Homo sapiens
tgatgccagagggccagc

SEQ ID NO: 1668321 - DNA, 20 bp, Homo sapiens
tgatgccagagggccagcag

SEQ ID NO: 1668322 - DNA, 21 bp, Homo sapiens
tgatgccagagggccagcagg

SEQ ID NO: 1668323 - DNA, 15 bp, Homo sapiens
tgatgccgtgatcct

SEQ ID NO: 1668324 - DNA, 14 bp, Homo sapiens
tgatgcctccttgg

SEQ ID NO: 1668325 - DNA, 20 bp, Homo sapiens
tgatgcgtctacccagactc

SEQ ID NO: 1668326 - DNA, 11 bp, Homo sapiens
tgatgctaaat

SEQ ID NO: 1668327 - DNA, 16 bp, Homo sapiens
tgatgctcagagcttt

SEQ ID NO: 1668328 - DNA, 14 bp, Homo sapiens
tgatgctcaggctt

SEQ ID NO: 1668329 - DNA, 15 bp, Homo sapiens
tgatgctcaggcttg

SEQ ID NO: 1668330 - DNA, 20 bp, Homo sapiens
tgatgctccctcccctgccc

SEQ ID NO: 1668331 - DNA, 15 bp, Homo sapiens
tgatgctgcccctca

SEQ ID NO: 1668332 - DNA, 21 bp, Homo sapiens
tgatggaagatggtccgtgcc

SEQ ID NO: 1668333 - DNA, 14 bp, Homo sapiens
tgatggaggaaaaa

SEQ ID NO: 1668334 - DNA, 17 bp, Homo sapiens
tgatggagggtggaaat

SEQ ID NO: 1668335 - DNA, 20 bp, Homo sapiens
tgatggagggtggaaataat

SEQ ID NO: 1668336 - DNA, 21 bp, Homo sapiens
tgatggagggtggaaataatt

SEQ ID NO: 1668337 - DNA, 15 bp, Homo sapiens
tgatggagtgtgagc

SEQ ID NO: 1668338 - DNA, 21 bp, Homo sapiens
tgatggagtgtgcagacagcc

SEQ ID NO: 1668339 - DNA, 23 bp, Homo sapiens
tgatggagtgtgcagacagccat

SEQ ID NO: 1668340 - DNA, 13 bp, Homo sapiens
tgatggatgtctt

SEQ ID NO: 1668341 - DNA, 15 bp, Homo sapiens
tgatggattccaaac

SEQ ID NO: 1668342 - DNA, 18 bp, Homo sapiens
tgatggcaacagatctgg

SEQ ID NO: 1668343 - DNA, 17 bp, Homo sapiens
tgatggcaattttgtaa

SEQ ID NO: 1668344 - DNA, 12 bp, Homo sapiens
tgatggccacaa

SEQ ID NO: 1668345 - DNA, 21 bp, Homo sapiens
tgatggctcaagacaaggctg

SEQ ID NO: 1668346 - DNA, 13 bp, Homo sapiens
tgatgggaaaata

SEQ ID NO: 1668347 - DNA, 16 bp, Homo sapiens
tgatgggaaaatattt

SEQ ID NO: 1668348 - DNA, 20 bp, Homo sapiens
tgatgggaaaatatttcctg

SEQ ID NO: 1668349 - DNA, 14 bp, Homo sapiens
tgatgggaaagcat

SEQ ID NO: 1668350 - DNA, 22 bp, Homo sapiens
tgatgggcgagtcccggagccc

SEQ ID NO: 1668351 - DNA, 13 bp, Homo sapiens
tgatggggagaaa

SEQ ID NO: 1668352 - DNA, 24 bp, Homo sapiens
tgatggggcaagggcacaagtcct

SEQ ID NO: 1668353 - DNA, 15 bp, Homo sapiens
tgatgggtcagttgt

SEQ ID NO: 1668354 - DNA, 15 bp, Homo sapiens
tgatggtcagagggc

SEQ ID NO: 1668355 - DNA, 15 bp, Homo sapiens
tgatgtaaaatcttg

SEQ ID NO: 1668356 - DNA, 23 bp, Homo sapiens
tgatgtaaaatcttgtcatgtgt

SEQ ID NO: 1668357 - DNA, 17 bp, Homo sapiens
tgatgtaaggactgtaa

SEQ ID NO: 1668358 - DNA, 17 bp, Homo sapiens
tgatgtacagattcttt

SEQ ID NO: 1668359 - DNA, 16 bp, Homo sapiens
tgatgtacagatttta

SEQ ID NO: 1668360 - DNA, 19 bp, Homo sapiens
tgatgtacagtctgtcatg

SEQ ID NO: 1668361 - DNA, 20 bp, Homo sapiens
tgatgtacataactcctgtc

SEQ ID NO: 1668362 - DNA, 13 bp, Homo sapiens
tgatgtacatgtg

SEQ ID NO: 1668363 - DNA, 14 bp, Homo sapiens
tgatgtatatgttt

SEQ ID NO: 1668364 - DNA, 15 bp, Homo sapiens
tgatgtatgtgtgaa

SEQ ID NO: 1668365 - DNA, 21 bp, Homo sapiens
tgatgtattctagctaatgta

SEQ ID NO: 1668366 - DNA, 17 bp, Homo sapiens
tgatgtcaatttctgtg

SEQ ID NO: 1668367 - DNA, 13 bp, Homo sapiens
tgatgtcatcttg

SEQ ID NO: 1668368 - DNA, 18 bp, Homo sapiens
tgatgtccagggggagaa

SEQ ID NO: 1668369 - DNA, 21 bp, Homo sapiens
tgatgtccagggggagaagga

SEQ ID NO: 1668370 - DNA, 15 bp, Homo sapiens
tgatgtccatttgtc

SEQ ID NO: 1668371 - DNA, 18 bp, Homo sapiens
tgatgtgaagagtttcac

SEQ ID NO: 1668372 - DNA, 16 bp, Homo sapiens
tgatgtggactgtctt

SEQ ID NO: 1668373 - DNA, 14 bp, Homo sapiens
tgatgtggaggaag

SEQ ID NO: 1668374 - DNA, 15 bp, Homo sapiens
tgatgtggaggaaga

SEQ ID NO: 1668375 - DNA, 16 bp, Homo sapiens
tgatgtggaggaagag

SEQ ID NO: 1668376 - DNA, 18 bp, Homo sapiens
tgatgtggaggaagagcc

SEQ ID NO: 1668377 - DNA, 23 bp, Homo sapiens
tgatgtggaggaagagccacctg

SEQ ID NO: 1668378 - DNA, 16 bp, Homo sapiens
tgatgtgtgagtgtaa

SEQ ID NO: 1668379 - DNA, 14 bp, Homo sapiens
tgatgtgtttattt

SEQ ID NO: 1668380 - DNA, 14 bp, Homo sapiens
tgatgttaaaattc

SEQ ID NO: 1668381 - DNA, 21 bp, Homo sapiens
tgatgttaacccattccagta

SEQ ID NO: 1668382 - DNA, 16 bp, Homo sapiens
tgatgtttccagctgc

SEQ ID NO: 1668383 - DNA, 13 bp, Homo sapiens
tgatgtttctgtg

SEQ ID NO: 1668384 - DNA, 23 bp, Homo sapiens
tgatgtttgaaattcgctgaaat

SEQ ID NO: 1668385 - DNA, 19 bp, Homo sapiens
tgatgtttgcccaaaattt

SEQ ID NO: 1668386 - DNA, 20 bp, Homo sapiens
tgatgtttgtgcagtaactt

SEQ ID NO: 1668387 - DNA, 16 bp, Homo sapiens
tgatgtttgtggcctc

SEQ ID NO: 1668388 - DNA, 19 bp, Homo sapiens
tgatgtttgtggcctcaga

SEQ ID NO: 1668389 - DNA, 13 bp, Homo sapiens
tgatgttttttct

SEQ ID NO: 1668390 - DNA, 18 bp, Homo sapiens
tgatgttttttctgtaat

SEQ ID NO: 1668391 - DNA, 20 bp, Homo sapiens
tgattaaacgtgcagactat

SEQ ID NO: 1668392 - DNA, 17 bp, Homo sapiens
tgattaaataagattct

SEQ ID NO: 1668393 - DNA, 18 bp, Homo sapiens
tgattaaataagattcta

SEQ ID NO: 1668394 - DNA, 20 bp, Homo sapiens
tgattaaataagattctaac

SEQ ID NO: 1668395 - DNA, 18 bp, Homo sapiens
tgattaacaatgtatttt

SEQ ID NO: 1668396 - DNA, 14 bp, Homo sapiens
tgattaactcttag

SEQ ID NO: 1668397 - DNA, 11 bp, Homo sapiens
tgattaatcaa

SEQ ID NO: 1668398 - DNA, 14 bp, Homo sapiens
tgattaatgtttct

SEQ ID NO: 1668399 - DNA, 15 bp, Homo sapiens
tgattaatgtttctt

SEQ ID NO: 1668400 - DNA, 21 bp, Homo sapiens
tgattaattcaccttccagtg

SEQ ID NO: 1668401 - DNA, 14 bp, Homo sapiens
tgattacacagttg

SEQ ID NO: 1668402 - DNA, 18 bp, Homo sapiens
tgattacataatcaaagc

SEQ ID NO: 1668403 - DNA, 13 bp, Homo sapiens
tgattacctgcca

SEQ ID NO: 1668404 - DNA, 15 bp, Homo sapiens
tgattacctgccaat

SEQ ID NO: 1668405 - DNA, 14 bp, Homo sapiens
tgattactgtcaat

SEQ ID NO: 1668406 - DNA, 15 bp, Homo sapiens
tgattactgtcaata

SEQ ID NO: 1668407 - DNA, 18 bp, Homo sapiens
tgattactgtcaataaac

SEQ ID NO: 1668408 - DNA, 23 bp, Homo sapiens
tgattactgtcaataaacagctt

SEQ ID NO: 1668409 - DNA, 16 bp, Homo sapiens
tgattactttaaaata

SEQ ID NO: 1668410 - DNA, 23 bp, Homo sapiens
tgattagaaattacctgtggata

SEQ ID NO: 1668411 - DNA, 13 bp, Homo sapiens
tgattagatcaca

SEQ ID NO: 1668412 - DNA, 21 bp, Homo sapiens
tgattagtaagtcttgcctat

SEQ ID NO: 1668413 - DNA, 13 bp, Homo sapiens
tgattagttgaaa

SEQ ID NO: 1668414 - DNA, 18 bp, Homo sapiens
tgattatagcaactaatg

SEQ ID NO: 1668415 - DNA, 14 bp, Homo sapiens
tgattatattcaca

SEQ ID NO: 1668416 - DNA, 14 bp, Homo sapiens
tgattatattgttt

SEQ ID NO: 1668417 - DNA, 20 bp, Homo sapiens
tgattattaacgatgtccaa

SEQ ID NO: 1668418 - DNA, 17 bp, Homo sapiens
tgattattatgtttatt

SEQ ID NO: 1668419 - DNA, 20 bp, Homo sapiens
tgattattatgtttattaca

SEQ ID NO: 1668420 - DNA, 18 bp, Homo sapiens
tgattattctgattccac

SEQ ID NO: 1668421 - DNA, 17 bp, Homo sapiens
tgattattgaatgttat

SEQ ID NO: 1668422 - DNA, 22 bp, Homo sapiens
tgattattgaatgttatatcat

SEQ ID NO: 1668423 - DNA, 15 bp, Homo sapiens
tgattatttcacttt

SEQ ID NO: 1668424 - DNA, 14 bp, Homo sapiens
tgattattttcaag

SEQ ID NO: 1668425 - DNA, 16 bp, Homo sapiens
tgcactggggagcccg

SEQ ID NO: 1668426 - DNA, 20 bp, Homo sapiens
tgcactggggagcccgtctc

SEQ ID NO: 1668427 - DNA, 15 bp, Homo sapiens
tgcactgtaaaatgt

SEQ ID NO: 1668428 - DNA, 15 bp, Homo sapiens
tgcactgtaatgagg

SEQ ID NO: 1668429 - DNA, 19 bp, Homo sapiens
tgcactgtgaatcctggca

SEQ ID NO: 1668430 - DNA, 16 bp, Homo sapiens
tgcacttaaaaattag

SEQ ID NO: 1668431 - DNA, 21 bp, Homo sapiens
tgcacttaaggcactctgtta

SEQ ID NO: 1668432 - DNA, 16 bp, Homo sapiens
tgcacttacttgctta

SEQ ID NO: 1668433 - DNA, 18 bp, Homo sapiens
tgcacttacttgcttatt

SEQ ID NO: 1668434 - DNA, 16 bp, Homo sapiens
tgcacttctgtaaact

SEQ ID NO: 1668435 - DNA, 18 bp, Homo sapiens
tgcacttgtgatcctaaa

SEQ ID NO: 1668436 - DNA, 17 bp, Homo sapiens
tgcacttgtgattattt

SEQ ID NO: 1668437 - DNA, 20 bp, Homo sapiens
tgcacttgtgattatttatt

SEQ ID NO: 1668438 - DNA, 21 bp, Homo sapiens
tgcacttgtgattatttatta

SEQ ID NO: 1668439 - DNA, 21 bp, Homo sapiens
tgcactttcagactctctctg

SEQ ID NO: 1668440 - DNA, 21 bp, Homo sapiens
tgcactttcccccttcccgcc

SEQ ID NO: 1668441 - DNA, 19 bp, Homo sapiens
tgcactttctaatgtttct

SEQ ID NO: 1668442 - DNA, 22 bp, Homo sapiens
tgcactttctcatgatttacag

SEQ ID NO: 1668443 - DNA, 15 bp, Homo sapiens
tgcactttttaagtt

SEQ ID NO: 1668444 - DNA, 14 bp, Homo sapiens
tgcactttttctta

SEQ ID NO: 1668445 - DNA, 19 bp, Homo sapiens
tgcagaaaagcacctgccg

SEQ ID NO: 1668446 - DNA, 21 bp, Homo sapiens
tgcagaaaagcacctgccgac

SEQ ID NO: 1668447 - DNA, 22 bp, Homo sapiens
tgcagaaaagcacctgccgacc

SEQ ID NO: 1668448 - DNA, 16 bp, Homo sapiens
tgcagaaatagacaaa

SEQ ID NO: 1668449 - DNA, 20 bp, Homo sapiens
tgcagaaatagacaaaaagt

SEQ ID NO: 1668450 - DNA, 13 bp, Homo sapiens
tgcagaagaagct

SEQ ID NO: 1668451 - DNA, 15 bp, Homo sapiens
tgcagaagaagctgg

SEQ ID NO: 1668452 - DNA, 15 bp, Homo sapiens
tgcagaagagggtgt

SEQ ID NO: 1668453 - DNA, 20 bp, Homo sapiens
tgcagaagcatattttgctg

SEQ ID NO: 1668454 - DNA, 14 bp, Homo sapiens
tgcagaaggaaaga

SEQ ID NO: 1668455 - DNA, 22 bp, Homo sapiens
tgcagaagtattcttttcaatt

SEQ ID NO: 1668456 - DNA, 23 bp, Homo sapiens
tgcagaagtattcttttcaatta

SEQ ID NO: 1668457 - DNA, 17 bp, Homo sapiens
tgcagacaaagccctgt

SEQ ID NO: 1668458 - DNA, 23 bp, Homo sapiens
tgcagacaaagccctgtccttca

SEQ ID NO: 1668459 - DNA, 20 bp, Homo sapiens
tgcagacagccatgcgtggc

SEQ ID NO: 1668460 - DNA, 23 bp, Homo sapiens
tgcagacaggctctgaggggcac

SEQ ID NO: 1668461 - DNA, 23 bp, Homo sapiens
tgcagaccacgcccgtcctgcct

SEQ ID NO: 1668462 - DNA, 14 bp, Homo sapiens
tgcagaccatgcca

SEQ ID NO: 1668463 - DNA, 17 bp, Homo sapiens
tgcagaccccttggcca

SEQ ID NO: 1668464 - DNA, 18 bp, Homo sapiens
tgcagacctcatgcccag

SEQ ID NO: 1668465 - DNA, 17 bp, Homo sapiens
tgcagacctgtcaccct

SEQ ID NO: 1668466 - DNA, 19 bp, Homo sapiens
tgcagactagaattctagt

SEQ ID NO: 1668467 - DNA, 22 bp, Homo sapiens
tgcagactagaattctagtgct

SEQ ID NO: 1668468 - DNA, 20 bp, Homo sapiens
tgcagactcagtttgtcaga

SEQ ID NO: 1668469 - DNA, 21 bp, Homo sapiens
tgcagactccaatggggccag

SEQ ID NO: 1668470 - DNA, 22 bp, Homo sapiens
tgcagactccaatggggccagc

SEQ ID NO: 1668471 - DNA, 23 bp, Homo sapiens
tgcagactccaatggggccagca

SEQ ID NO: 1668472 - DNA, 22 bp, Homo sapiens
tgcagacttcccagctaggaag

SEQ ID NO: 1668473 - DNA, 21 bp, Homo sapiens
tgcagagaaacttaagcaaag

SEQ ID NO: 1668474 - DNA, 19 bp, Homo sapiens
tgcagagactcatttcaca

SEQ ID NO: 1668475 - DNA, 18 bp, Homo sapiens
tgcagagatttcctccat

SEQ ID NO: 1668476 - DNA, 13 bp, Homo sapiens
tgcagagatttct

SEQ ID NO: 1668477 - DNA, 15 bp, Homo sapiens
tgcagaggggaaaga

SEQ ID NO: 1668478 - DNA, 16 bp, Homo sapiens
tgcagaggggaaagac

SEQ ID NO: 1668479 - DNA, 22 bp, Homo sapiens
tgcagaggtctgtgctgaggcc

SEQ ID NO: 1668480 - DNA, 14 bp, Homo sapiens
tgcagaggtttctt

SEQ ID NO: 1668481 - DNA, 20 bp, Homo sapiens
tgcagagtccatttcccaca

SEQ ID NO: 1668482 - DNA, 18 bp, Homo sapiens
tgcagagtgcccagaact

SEQ ID NO: 1668483 - DNA, 20 bp, Homo sapiens
tgcagagtttccaaaaccag

SEQ ID NO: 1668484 - DNA, 17 bp, Homo sapiens
tgcagatatctgcatgt

SEQ ID NO: 1668485 - DNA, 17 bp, Homo sapiens
tgcagatgcaattgttt

SEQ ID NO: 1668486 - DNA, 17 bp, Homo sapiens
tgcagatgccaccctag

SEQ ID NO: 1668487 - DNA, 22 bp, Homo sapiens
tgcagatggggctcccgcccgt

SEQ ID NO: 1668488 - DNA, 13 bp, Homo sapiens
tgcagatgggtga

SEQ ID NO: 1668489 - DNA, 13 bp, Homo sapiens
tgcagatgtctta

SEQ ID NO: 1668490 - DNA, 17 bp, Homo sapiens
tgcagatgttagatatt

SEQ ID NO: 1668491 - DNA, 13 bp, Homo sapiens
tgcagattcattt

SEQ ID NO: 1668492 - DNA, 17 bp, Homo sapiens
tgcagattcctgggcct

SEQ ID NO: 1668493 - DNA, 18 bp, Homo sapiens
tgcagcacatgcgggctc

SEQ ID NO: 1668494 - DNA, 12 bp, Homo sapiens
tgcagcacctcc

SEQ ID NO: 1668495 - DNA, 14 bp, Homo sapiens
tgcagcacctccag

SEQ ID NO: 1668496 - DNA, 15 bp, Homo sapiens
tgcagcacctccagg

SEQ ID NO: 1668497 - DNA, 16 bp, Homo sapiens
tgcagcacctccaggc

SEQ ID NO: 1668498 - DNA, 14 bp, Homo sapiens
tgcagcagaggaca

SEQ ID NO: 1668499 - DNA, 15 bp, Homo sapiens
tgcagcagaggacag

SEQ ID NO: 1668500 - DNA, 11 bp, Homo sapiens
tgcagcagccc

SEQ ID NO: 1668501 - DNA, 13 bp, Homo sapiens
tgcagcagcccag

SEQ ID NO: 1668502 - DNA, 15 bp, Homo sapiens
tgcagcagcccagct

SEQ ID NO: 1668503 - DNA, 17 bp, Homo sapiens
tgcagcaggtgctgggc

SEQ ID NO: 1668504 - DNA, 23 bp, Homo sapiens
tgcagcaggtgctgggctggact

SEQ ID NO: 1668505 - DNA, 12 bp, Homo sapiens
tgcagcatacca

SEQ ID NO: 1668506 - DNA, 19 bp, Homo sapiens
tgcagcataccaattaccc

SEQ ID NO: 1668507 - DNA, 13 bp, Homo sapiens
tgcagcatgacct

SEQ ID NO: 1668508 - DNA, 16 bp, Homo sapiens
tgcagcatgagacttt

SEQ ID NO: 1668509 - DNA, 17 bp, Homo sapiens
tgcagcatgttgctgag

SEQ ID NO: 1668510 - DNA, 18 bp, Homo sapiens
tgcagcatgttgctgagg

SEQ ID NO: 1668511 - DNA, 14 bp, Homo sapiens
tgcagcatttacta

SEQ ID NO: 1668512 - DNA, 17 bp, Homo sapiens
tgcagccacttaggaca

SEQ ID NO: 1668513 - DNA, 16 bp, Homo sapiens
tgcagccagcccagcc

SEQ ID NO: 1668514 - DNA, 23 bp, Homo sapiens
tgcagccagcccagcccagctgg

SEQ ID NO: 1668515 - DNA, 11 bp, Homo sapiens
tgcagccagct

SEQ ID NO: 1668516 - DNA, 22 bp, Homo sapiens
tgcagcccaaaacccagggcaa

SEQ ID NO: 1668517 - DNA, 14 bp, Homo sapiens
tgcagcccatgccc

SEQ ID NO: 1668518 - DNA, 18 bp, Homo sapiens
tgcagcccatgcccacct

SEQ ID NO: 1668519 - DNA, 21 bp, Homo sapiens
tgcagcccatgcccacctgcc

SEQ ID NO: 1668520 - DNA, 12 bp, Homo sapiens
tgcagcccctcc

SEQ ID NO: 1668521 - DNA, 20 bp, Homo sapiens
tgcagcccggcgccaccatc

SEQ ID NO: 1668522 - DNA, 15 bp, Homo sapiens
tgcagccctcttgcc

SEQ ID NO: 1668523 - DNA, 19 bp, Homo sapiens
tgcagccggcacagggtct

SEQ ID NO: 1668524 - DNA, 16 bp, Homo sapiens
tgcagccgtggtccaa

SEQ ID NO: 1668525 - DNA, 19 bp, Homo sapiens
tgcagcctccacttccctc

SEQ ID NO: 1668526 - DNA, 20 bp, Homo sapiens
tgcagcctccgcctcccggg

SEQ ID NO: 1668527 - DNA, 15 bp, Homo sapiens
tgcagcctcctcctg

SEQ ID NO: 1668528 - DNA, 12 bp, Homo sapiens
tgcagcctgctc

SEQ ID NO: 1668529 - DNA, 15 bp, Homo sapiens
tgcagccttggggca

SEQ ID NO: 1668530 - DNA, 23 bp, Homo sapiens
tgcagcctttgcctccccggctc

SEQ ID NO: 1668531 - DNA, 16 bp, Homo sapiens
tgcagcggcagagcaa

SEQ ID NO: 1668532 - DNA, 23 bp, Homo sapiens
tgcagcggcagagcaattccagg

SEQ ID NO: 1668533 - DNA, 16 bp, Homo sapiens
tgcagctactggaatg

SEQ ID NO: 1668534 - DNA, 21 bp, Homo sapiens
tgcagctcaagggctggcact

SEQ ID NO: 1668535 - DNA, 18 bp, Homo sapiens
tgcagctgaaattgaaaa

SEQ ID NO: 1668536 - DNA, 19 bp, Homo sapiens
tgcagctgaaattgaaaag

SEQ ID NO: 1668537 - DNA, 20 bp, Homo sapiens
tgcagctgacctctgttgtc

SEQ ID NO: 1668538 - DNA, 15 bp, Homo sapiens
tgcagctgctcttgc

SEQ ID NO: 1668539 - DNA, 23 bp, Homo sapiens
tgccaagagagatgtatgtgtca

SEQ ID NO: 1668540 - DNA, 19 bp, Homo sapiens
tgccaagagcccgtctgct

SEQ ID NO: 1668541 - DNA, 23 bp, Homo sapiens
tgccaagagcccgtctgctcctg

SEQ ID NO: 1668542 - DNA, 19 bp, Homo sapiens
tgccaaggcagaggcctgg

SEQ ID NO: 1668543 - DNA, 12 bp, Homo sapiens
tgccaagggccc

SEQ ID NO: 1668544 - DNA, 16 bp, Homo sapiens
tgccaagggccccagg

SEQ ID NO: 1668545 - DNA, 19 bp, Homo sapiens
tgccaagggccccaggggc

SEQ ID NO: 1668546 - DNA, 20 bp, Homo sapiens
tgccaagggggtgactggaa

SEQ ID NO: 1668547 - DNA, 15 bp, Homo sapiens
tgccaagtctcagaa

SEQ ID NO: 1668548 - DNA, 17 bp, Homo sapiens
tgccaagtctcagaaga

SEQ ID NO: 1668549 - DNA, 18 bp, Homo sapiens
tgccaataaaagttttct

SEQ ID NO: 1668550 - DNA, 12 bp, Homo sapiens
tgccaataaagc

SEQ ID NO: 1668551 - DNA, 21 bp, Homo sapiens
tgccaataaagcttttggaag

SEQ ID NO: 1668552 - DNA, 20 bp, Homo sapiens
tgccaatgaggtctgaaatg

SEQ ID NO: 1668553 - DNA, 21 bp, Homo sapiens
tgccaatggtgtagctgtcct

SEQ ID NO: 1668554 - DNA, 20 bp, Homo sapiens
tgccaatgtgaaatgtaaat

SEQ ID NO: 1668555 - DNA, 23 bp, Homo sapiens
tgccaattgctaccgagaaggtt

SEQ ID NO: 1668556 - DNA, 15 bp, Homo sapiens
tgccaatttcctctc

SEQ ID NO: 1668557 - DNA, 21 bp, Homo sapiens
tgccaatttcttactagtact

SEQ ID NO: 1668558 - DNA, 18 bp, Homo sapiens
tgccaatttttgccttca

SEQ ID NO: 1668559 - DNA, 21 bp, Homo sapiens
tgccaatttttgccttcatta

SEQ ID NO: 1668560 - DNA, 15 bp, Homo sapiens
tgccacaaggacttc

SEQ ID NO: 1668561 - DNA, 16 bp, Homo sapiens
tgccacaaggacttcc

SEQ ID NO: 1668562 - DNA, 19 bp, Homo sapiens
tgccacaaggacttcctgt

SEQ ID NO: 1668563 - DNA, 18 bp, Homo sapiens
tgccacaatgcagttctg

SEQ ID NO: 1668564 - DNA, 13 bp, Homo sapiens
tgccacacagagt

SEQ ID NO: 1668565 - DNA, 21 bp, Homo sapiens
tgccacacagtgacttggccc

SEQ ID NO: 1668566 - DNA, 16 bp, Homo sapiens
tgccacaccctcccca

SEQ ID NO: 1668567 - DNA, 17 bp, Homo sapiens
tgccacaccctccccat

SEQ ID NO: 1668568 - DNA, 17 bp, Homo sapiens
tgccacacctggcctta

SEQ ID NO: 1668569 - DNA, 15 bp, Homo sapiens
tgccacactgatggc

SEQ ID NO: 1668570 - DNA, 21 bp, Homo sapiens
tgccacactgatggctcaaga

SEQ ID NO: 1668571 - DNA, 22 bp, Homo sapiens
tgccacactgatggctcaagac

SEQ ID NO: 1668572 - DNA, 12 bp, Homo sapiens
tgccacacttca

SEQ ID NO: 1668573 - DNA, 16 bp, Homo sapiens
tgccacagcttttgca

SEQ ID NO: 1668574 - DNA, 17 bp, Homo sapiens
tgccaccaggagaacca

SEQ ID NO: 1668575 - DNA, 23 bp, Homo sapiens
tgccaccccaggtttttcatctg

SEQ ID NO: 1668576 - DNA, 24 bp, Homo sapiens
tgccaccccaggtttttcatctga

SEQ ID NO: 1668577 - DNA, 21 bp, Homo sapiens
tgccacccccagttcctatga

SEQ ID NO: 1668578 - DNA, 16 bp, Homo sapiens
tgccacccccttccct

SEQ ID NO: 1668579 - DNA, 19 bp, Homo sapiens
tgccacccccttccctggg

SEQ ID NO: 1668580 - DNA, 22 bp, Homo sapiens
tgccacccccttccctgggagg

SEQ ID NO: 1668581 - DNA, 14 bp, Homo sapiens
tgccaccccttcct

SEQ ID NO: 1668582 - DNA, 19 bp, Homo sapiens
tgccaccccttcctcccca

SEQ ID NO: 1668583 - DNA, 22 bp, Homo sapiens
tgccacctcccctatccaccca

SEQ ID NO: 1668584 - DNA, 14 bp, Homo sapiens
tgccactcactagg

SEQ ID NO: 1668585 - DNA, 14 bp, Homo sapiens
tgccactccctgag

SEQ ID NO: 1668586 - DNA, 15 bp, Homo sapiens
tgccactctctggga

SEQ ID NO: 1668587 - DNA, 19 bp, Homo sapiens
tgccactctctgggactct

SEQ ID NO: 1668588 - DNA, 17 bp, Homo sapiens
tgccactgacttgctgt

SEQ ID NO: 1668589 - DNA, 18 bp, Homo sapiens
tgccactgacttgctgtg

SEQ ID NO: 1668590 - DNA, 19 bp, Homo sapiens
tgccactgacttgctgtgt

SEQ ID NO: 1668591 - DNA, 14 bp, Homo sapiens
tgccactgaggaga

SEQ ID NO: 1668592 - DNA, 18 bp, Homo sapiens
tgccactgaggagacaga

SEQ ID NO: 1668593 - DNA, 19 bp, Homo sapiens
tgccactgaggagacagaa

SEQ ID NO: 1668594 - DNA, 13 bp, Homo sapiens
tgccactgccagg

SEQ ID NO: 1668595 - DNA, 23 bp, Homo sapiens
tgccactgccaggcacctggcct

SEQ ID NO: 1668596 - DNA, 23 bp, Homo sapiens
tgccactgccccccgaggctgct

SEQ ID NO: 1668597 - DNA, 23 bp, Homo sapiens
tgccactgcgggagctctgtatg

SEQ ID NO: 1668598 - DNA, 16 bp, Homo sapiens
tgccactgggacagct

SEQ ID NO: 1668599 - DNA, 19 bp, Homo sapiens
tgccactgggacagctggc

SEQ ID NO: 1668600 - DNA, 21 bp, Homo sapiens
tgccactgggacagctggctg

SEQ ID NO: 1668601 - DNA, 22 bp, Homo sapiens
tgccactgggacagctggctgg

SEQ ID NO: 1668602 - DNA, 17 bp, Homo sapiens
tgccactgggcacctgc

SEQ ID NO: 1668603 - DNA, 18 bp, Homo sapiens
tgccactgggcacctgcg

SEQ ID NO: 1668604 - DNA, 17 bp, Homo sapiens
tgccacttaatgtatgt

SEQ ID NO: 1668605 - DNA, 19 bp, Homo sapiens
tgccacttcaacccccagc

SEQ ID NO: 1668606 - DNA, 16 bp, Homo sapiens
tgccacttgacattcc

SEQ ID NO: 1668607 - DNA, 18 bp, Homo sapiens
tgccacttgacattcctt

SEQ ID NO: 1668608 - DNA, 17 bp, Homo sapiens
tgccacttgtcaaagaa

SEQ ID NO: 1668609 - DNA, 21 bp, Homo sapiens
tgccactttacccacctagaa

SEQ ID NO: 1668610 - DNA, 20 bp, Homo sapiens
tgccactttcacgtggcctc

SEQ ID NO: 1668611 - DNA, 19 bp, Homo sapiens
tgccactttggcttctcct

SEQ ID NO: 1668612 - DNA, 10 bp, Homo sapiens
tgccagaaga

SEQ ID NO: 1668613 - DNA, 21 bp, Homo sapiens
tgccagaagagaattcagtat

SEQ ID NO: 1668614 - DNA, 20 bp, Homo sapiens
tgccagaatactgggttctt

SEQ ID NO: 1668615 - DNA, 12 bp, Homo sapiens
tgccagacatgt

SEQ ID NO: 1668616 - DNA, 21 bp, Homo sapiens
tgccagagaggggctgctctc

SEQ ID NO: 1668617 - DNA, 22 bp, Homo sapiens
tgccagagaggtggggatcctg

SEQ ID NO: 1668618 - DNA, 12 bp, Homo sapiens
tgccagagcagg

SEQ ID NO: 1668619 - DNA, 19 bp, Homo sapiens
tgccagagcaggagcccct

SEQ ID NO: 1668620 - DNA, 23 bp, Homo sapiens
tgccagagctttgttttatatat

SEQ ID NO: 1668621 - DNA, 23 bp, Homo sapiens
tgccagaggaatcctggcagccc

SEQ ID NO: 1668622 - DNA, 22 bp, Homo sapiens
tgccagaggatgctctttccca

SEQ ID NO: 1668623 - DNA, 13 bp, Homo sapiens
tgccagagggcca

SEQ ID NO: 1668624 - DNA, 15 bp, Homo sapiens
tgccagagggccagc

SEQ ID NO: 1668625 - DNA, 19 bp, Homo sapiens
tgccagagggccagcaggc

SEQ ID NO: 1668626 - DNA, 20 bp, Homo sapiens
tgccagagggccagcaggct

SEQ ID NO: 1668627 - DNA, 20 bp, Homo sapiens
tgccagaggtgggcaggtgg

SEQ ID NO: 1668628 - DNA, 14 bp, Homo sapiens
tgccagcacagggg

SEQ ID NO: 1668629 - DNA, 19 bp, Homo sapiens
tgccagcacaggggcccca

SEQ ID NO: 1668630 - DNA, 20 bp, Homo sapiens
tgccagcacaggggccccag

SEQ ID NO: 1668631 - DNA, 21 bp, Homo sapiens
tgccagcacaggggccccaga

SEQ ID NO: 1668632 - DNA, 10 bp, Homo sapiens
tgccagcagc

SEQ ID NO: 1668633 - DNA, 16 bp, Homo sapiens
tgccagcagcagcagg

SEQ ID NO: 1668634 - DNA, 21 bp, Homo sapiens
tgccagcagcctcgcacaggc

SEQ ID NO: 1668635 - DNA, 19 bp, Homo sapiens
tgccagcaggggggctgtg

SEQ ID NO: 1668636 - DNA, 21 bp, Homo sapiens
tgccagcaggggggctgtgcc

SEQ ID NO: 1668637 - DNA, 11 bp, Homo sapiens
tgccagccaca

SEQ ID NO: 1668638 - DNA, 11 bp, Homo sapiens
tgccagccaga

SEQ ID NO: 1668639 - DNA, 21 bp, Homo sapiens
tgccagccgtgatgctcaggc

SEQ ID NO: 1668640 - DNA, 21 bp, Homo sapiens
tgccagcctggcttctggagc

SEQ ID NO: 1668641 - DNA, 12 bp, Homo sapiens
tgccagccttcc

SEQ ID NO: 1668642 - DNA, 17 bp, Homo sapiens
tgccagccttcctctgc

SEQ ID NO: 1668643 - DNA, 17 bp, Homo sapiens
tgccagccttgagccct

SEQ ID NO: 1668644 - DNA, 19 bp, Homo sapiens
tgccagctacttcctcctc

SEQ ID NO: 1668645 - DNA, 13 bp, Homo sapiens
tgccagctgcctt

SEQ ID NO: 1668646 - DNA, 17 bp, Homo sapiens
tgccagctgccttcctc

SEQ ID NO: 1668647 - DNA, 22 bp, Homo sapiens
tgccagctgccttcctcatccc

SEQ ID NO: 1668648 - DNA, 18 bp, Homo sapiens
tgccagctgggcccagca

SEQ ID NO: 1668649 - DNA, 16 bp, Homo sapiens
tgccagcttctctctc

SEQ ID NO: 1668650 - DNA, 18 bp, Homo sapiens
tgccagcttctctctcca

SEQ ID NO: 1668651 - DNA, 21 bp, Homo sapiens
tgccagcttctctctccaggg

SEQ ID NO: 1668652 - DNA, 17 bp, Homo sapiens
tgcccgtcttcagccta

SEQ ID NO: 1668653 - DNA, 19 bp, Homo sapiens
tgcccgtcttcagcctagc

SEQ ID NO: 1668654 - DNA, 17 bp, Homo sapiens
tgcccgtgcccgcagga

SEQ ID NO: 1668655 - DNA, 14 bp, Homo sapiens
tgccctaagccccc

SEQ ID NO: 1668656 - DNA, 19 bp, Homo sapiens
tgccctaagcccccagggc

SEQ ID NO: 1668657 - DNA, 20 bp, Homo sapiens
tgccctaagcccccagggcc

SEQ ID NO: 1668658 - DNA, 15 bp, Homo sapiens
tgccctactcactct

SEQ ID NO: 1668659 - DNA, 17 bp, Homo sapiens
tgccctagagcacactg

SEQ ID NO: 1668660 - DNA, 23 bp, Homo sapiens
tgccctagagcacactgtagcat

SEQ ID NO: 1668661 - DNA, 13 bp, Homo sapiens
tgccctagctcca

SEQ ID NO: 1668662 - DNA, 14 bp, Homo sapiens
tgccctagctccac

SEQ ID NO: 1668663 - DNA, 15 bp, Homo sapiens
tgccctagctgaccc

SEQ ID NO: 1668664 - DNA, 15 bp, Homo sapiens
tgccctcaccaccac

SEQ ID NO: 1668665 - DNA, 16 bp, Homo sapiens
tgccctcaccacccac

SEQ ID NO: 1668666 - DNA, 12 bp, Homo sapiens
tgccctcactcc

SEQ ID NO: 1668667 - DNA, 21 bp, Homo sapiens
tgccctcactccctctgcaga

SEQ ID NO: 1668668 - DNA, 17 bp, Homo sapiens
tgccctcatggcccctc

SEQ ID NO: 1668669 - DNA, 19 bp, Homo sapiens
tgccctcatggcccctctg

SEQ ID NO: 1668670 - DNA, 23 bp, Homo sapiens
tgccctcatggcccctctgacct

SEQ ID NO: 1668671 - DNA, 14 bp, Homo sapiens
tgccctccaaagag

SEQ ID NO: 1668672 - DNA, 12 bp, Homo sapiens
tgccctcccaag

SEQ ID NO: 1668673 - DNA, 16 bp, Homo sapiens
tgccctcccacagcct

SEQ ID NO: 1668674 - DNA, 14 bp, Homo sapiens
tgccctcccctgct

SEQ ID NO: 1668675 - DNA, 15 bp, Homo sapiens
tgccctccctccttc

SEQ ID NO: 1668676 - DNA, 18 bp, Homo sapiens
tgccctccgcctgggatc

SEQ ID NO: 1668677 - DNA, 14 bp, Homo sapiens
tgccctcgctgctt

SEQ ID NO: 1668678 - DNA, 20 bp, Homo sapiens
tgccctcgggcgagtcactg

SEQ ID NO: 1668679 - DNA, 19 bp, Homo sapiens
tgccctcgtggccagcccg

SEQ ID NO: 1668680 - DNA, 14 bp, Homo sapiens
tgccctctgctctg

SEQ ID NO: 1668681 - DNA, 15 bp, Homo sapiens
tgccctctgctgctg

SEQ ID NO: 1668682 - DNA, 16 bp, Homo sapiens
tgccctctgctgctgc

SEQ ID NO: 1668683 - DNA, 17 bp, Homo sapiens
tgccctctgctgctgcc

SEQ ID NO: 1668684 - DNA, 21 bp, Homo sapiens
tgccctcttaagatctgactg

SEQ ID NO: 1668685 - DNA, 16 bp, Homo sapiens
tgccctgaaagggccc

SEQ ID NO: 1668686 - DNA, 17 bp, Homo sapiens
tgccctgaaagggccct

SEQ ID NO: 1668687 - DNA, 22 bp, Homo sapiens
tgccctgcacgtcatgggaggg

SEQ ID NO: 1668688 - DNA, 11 bp, Homo sapiens
tgccctgccat

SEQ ID NO: 1668689 - DNA, 15 bp, Homo sapiens
tgccctgcctgagga

SEQ ID NO: 1668690 - DNA, 17 bp, Homo sapiens
tgccctgcctgagggcc

SEQ ID NO: 1668691 - DNA, 16 bp, Homo sapiens
tgccctgcctgcccac

SEQ ID NO: 1668692 - DNA, 13 bp, Homo sapiens
tgccctgctgttt

SEQ ID NO: 1668693 - DNA, 14 bp, Homo sapiens
tgccctgctgttta

SEQ ID NO: 1668694 - DNA, 17 bp, Homo sapiens
tgccctggcagcagcag

SEQ ID NO: 1668695 - DNA, 22 bp, Homo sapiens
tgccctggcagggtcatcctgt

SEQ ID NO: 1668696 - DNA, 23 bp, Homo sapiens
tgccctggcagggtcatcctgtg

SEQ ID NO: 1668697 - DNA, 13 bp, Homo sapiens
tgccctggccctg

SEQ ID NO: 1668698 - DNA, 16 bp, Homo sapiens
tgccctggccctgagg

SEQ ID NO: 1668699 - DNA, 17 bp, Homo sapiens
tgccctggctgctgccc

SEQ ID NO: 1668700 - DNA, 20 bp, Homo sapiens
tgccctggctgctgccccca

SEQ ID NO: 1668701 - DNA, 13 bp, Homo sapiens
tgccctgggccac

SEQ ID NO: 1668702 - DNA, 16 bp, Homo sapiens
tgccctgggttcttcc

SEQ ID NO: 1668703 - DNA, 21 bp, Homo sapiens
tgccctggtccagggaagctg

SEQ ID NO: 1668704 - DNA, 14 bp, Homo sapiens
tgccctggtgctgc

SEQ ID NO: 1668705 - DNA, 18 bp, Homo sapiens
tgccctggtgctgccaca

SEQ ID NO: 1668706 - DNA, 13 bp, Homo sapiens
tgccctggtggag

SEQ ID NO: 1668707 - DNA, 22 bp, Homo sapiens
tgccctggtggagaaagcactg

SEQ ID NO: 1668708 - DNA, 23 bp, Homo sapiens
tgccctggtggagaaagcactga

SEQ ID NO: 1668709 - DNA, 16 bp, Homo sapiens
tgccctgtggacagga

SEQ ID NO: 1668710 - DNA, 19 bp, Homo sapiens
tgccctgtggacaggatga

SEQ ID NO: 1668711 - DNA, 15 bp, Homo sapiens
tgccctgtgtacttc

SEQ ID NO: 1668712 - DNA, 20 bp, Homo sapiens
tgccctgtgtacttcccggg

SEQ ID NO: 1668713 - DNA, 19 bp, Homo sapiens
tgccctgttaaaagatgaa

SEQ ID NO: 1668714 - DNA, 19 bp, Homo sapiens
tgccctgttgtgtatagat

SEQ ID NO: 1668715 - DNA, 20 bp, Homo sapiens
tgccctgttgtgtatagatg

SEQ ID NO: 1668716 - DNA, 18 bp, Homo sapiens
tgcccttccctgtccctc

SEQ ID NO: 1668717 - DNA, 23 bp, Homo sapiens
tgcccttcctcctgatggagtgt

SEQ ID NO: 1668718 - DNA, 18 bp, Homo sapiens
tgcccttgaaccccctcc

SEQ ID NO: 1668719 - DNA, 19 bp, Homo sapiens
tgcccttgttgcctgcacc

SEQ ID NO: 1668720 - DNA, 15 bp, Homo sapiens
tgccgaacacacatc

SEQ ID NO: 1668721 - DNA, 14 bp, Homo sapiens
tgccgacctcgtcc

SEQ ID NO: 1668722 - DNA, 21 bp, Homo sapiens
tgccgacctcgtcctccccct

SEQ ID NO: 1668723 - DNA, 22 bp, Homo sapiens
tgccgacctcgtcctccccctg

SEQ ID NO: 1668724 - DNA, 16 bp, Homo sapiens
tgccgagcctaatgaa

SEQ ID NO: 1668725 - DNA, 12 bp, Homo sapiens
tgccgcacccca

SEQ ID NO: 1668726 - DNA, 14 bp, Homo sapiens
tgccgcagagctgg

SEQ ID NO: 1668727 - DNA, 13 bp, Homo sapiens
tgccgcagggagg

SEQ ID NO: 1668728 - DNA, 21 bp, Homo sapiens
tgccgcatgacaactgaaggc

SEQ ID NO: 1668729 - DNA, 20 bp, Homo sapiens
tgccgccagctgccgcacca

SEQ ID NO: 1668730 - DNA, 17 bp, Homo sapiens
tgccgccccctcctgaa

SEQ ID NO: 1668731 - DNA, 16 bp, Homo sapiens
tgccgcctcaatgtgg

SEQ ID NO: 1668732 - DNA, 16 bp, Homo sapiens
tgccgcgggcggccag

SEQ ID NO: 1668733 - DNA, 17 bp, Homo sapiens
tgccgcgggcggccagg

SEQ ID NO: 1668734 - DNA, 21 bp, Homo sapiens
tgccgcgtcccacgtctcctc

SEQ ID NO: 1668735 - DNA, 22 bp, Homo sapiens
tgccgcgtcccacgtctcctcc

SEQ ID NO: 1668736 - DNA, 16 bp, Homo sapiens
tgccgctacctccctc

SEQ ID NO: 1668737 - DNA, 15 bp, Homo sapiens
tgccgctctaaattg

SEQ ID NO: 1668738 - DNA, 15 bp, Homo sapiens
tgccgctttctctga

SEQ ID NO: 1668739 - DNA, 17 bp, Homo sapiens
tgccgctttctctgagg

SEQ ID NO: 1668740 - DNA, 15 bp, Homo sapiens
tgccggatctgggct

SEQ ID NO: 1668741 - DNA, 14 bp, Homo sapiens
tgccggatgtgctt

SEQ ID NO: 1668742 - DNA, 17 bp, Homo sapiens
tgccggcggcagcccca

SEQ ID NO: 1668743 - DNA, 20 bp, Homo sapiens
tgccggcggcagccccactt

SEQ ID NO: 1668744 - DNA, 15 bp, Homo sapiens
tgccggctctgggcc

SEQ ID NO: 1668745 - DNA, 20 bp, Homo sapiens
tgccggctctgggcctgagg

SEQ ID NO: 1668746 - DNA, 18 bp, Homo sapiens
tgccgggcctgggcctcc

SEQ ID NO: 1668747 - DNA, 16 bp, Homo sapiens
tgccggtcgggcagcc

SEQ ID NO: 1668748 - DNA, 17 bp, Homo sapiens
tgccggtgcacaggcct

SEQ ID NO: 1668749 - DNA, 19 bp, Homo sapiens
tgccggtgcacaggcctct

SEQ ID NO: 1668750 - DNA, 13 bp, Homo sapiens
tgccgtaattatg

SEQ ID NO: 1668751 - DNA, 20 bp, Homo sapiens
tgccgtaattatgtaccatg

SEQ ID NO: 1668752 - DNA, 13 bp, Homo sapiens
tgccgtgagcagg

SEQ ID NO: 1668753 - DNA, 16 bp, Homo sapiens
tgccgtgagcaggctt

SEQ ID NO: 1668754 - DNA, 16 bp, Homo sapiens
tgccgtgcatggctcc

SEQ ID NO: 1668755 - DNA, 20 bp, Homo sapiens
tgccgtgggcctgtcgtgcc

SEQ ID NO: 1668756 - DNA, 12 bp, Homo sapiens
tgccgtgtccaa

SEQ ID NO: 1668757 - DNA, 22 bp, Homo sapiens
tgccgttactctccaacctgga

SEQ ID NO: 1668758 - DNA, 14 bp, Homo sapiens
tgccgtttcccctc

SEQ ID NO: 1668759 - DNA, 16 bp, Homo sapiens
tgcctaaaattgtatg

SEQ ID NO: 1668760 - DNA, 19 bp, Homo sapiens
tgcctaaaattgtatgaaa

SEQ ID NO: 1668761 - DNA, 17 bp, Homo sapiens
tgcctaaatccaaagaa

SEQ ID NO: 1668762 - DNA, 19 bp, Homo sapiens
tgcctaaatcccaagaaat

SEQ ID NO: 1668763 - DNA, 16 bp, Homo sapiens
tgcctaacaaaatatt

SEQ ID NO: 1668764 - DNA, 16 bp, Homo sapiens
tgcctaacttgtaaaa

SEQ ID NO: 1668765 - DNA, 22 bp, Homo sapiens
tgcctaagtccagtgtttcttt

SEQ ID NO: 1668766 - DNA, 14 bp, Homo sapiens
tgcctaagtggctg

SEQ ID NO: 1668767 - DNA, 22 bp, Homo sapiens
tgccttatgggctgaagtgttc

SEQ ID NO: 1668768 - DNA, 16 bp, Homo sapiens
tgccttattaaagttc

SEQ ID NO: 1668769 - DNA, 21 bp, Homo sapiens
tgccttattgctgttgcttat

SEQ ID NO: 1668770 - DNA, 20 bp, Homo sapiens
tgccttatttgtctgtaaaa

SEQ ID NO: 1668771 - DNA, 21 bp, Homo sapiens
tgccttcaacaacgtgagaga

SEQ ID NO: 1668772 - DNA, 15 bp, Homo sapiens
tgccttcaaggactg

SEQ ID NO: 1668773 - DNA, 16 bp, Homo sapiens
tgccttcacaaatgtc

SEQ ID NO: 1668774 - DNA, 19 bp, Homo sapiens
tgccttcattacctttttt

SEQ ID NO: 1668775 - DNA, 14 bp, Homo sapiens
tgccttccataatt

SEQ ID NO: 1668776 - DNA, 17 bp, Homo sapiens
tgccttccataattatg

SEQ ID NO: 1668777 - DNA, 14 bp, Homo sapiens
tgccttccctagct

SEQ ID NO: 1668778 - DNA, 15 bp, Homo sapiens
tgccttcccttctct

SEQ ID NO: 1668779 - DNA, 18 bp, Homo sapiens
tgccttcccttctctggt

SEQ ID NO: 1668780 - DNA, 13 bp, Homo sapiens
tgccttcctcatc

SEQ ID NO: 1668781 - DNA, 16 bp, Homo sapiens
tgccttcctcatcccc

SEQ ID NO: 1668782 - DNA, 15 bp, Homo sapiens
tgccttcctctctct

SEQ ID NO: 1668783 - DNA, 16 bp, Homo sapiens
tgccttcgcttcttgc

SEQ ID NO: 1668784 - DNA, 20 bp, Homo sapiens
tgccttcgtctttcccatgg

SEQ ID NO: 1668785 - DNA, 17 bp, Homo sapiens
tgccttctactcccctt

SEQ ID NO: 1668786 - DNA, 22 bp, Homo sapiens
tgccttctagattcactgtctt

SEQ ID NO: 1668787 - DNA, 16 bp, Homo sapiens
tgccttctcaggcccc

SEQ ID NO: 1668788 - DNA, 21 bp, Homo sapiens
tgccttctctcagctcccagg

SEQ ID NO: 1668789 - DNA, 22 bp, Homo sapiens
tgccttctctcagctcccaggc

SEQ ID NO: 1668790 - DNA, 17 bp, Homo sapiens
tgccttcttcacccagc

SEQ ID NO: 1668791 - DNA, 14 bp, Homo sapiens
tgccttctttccat

SEQ ID NO: 1668792 - DNA, 13 bp, Homo sapiens
tgccttcttttgt

SEQ ID NO: 1668793 - DNA, 14 bp, Homo sapiens
tgccttcttttgta

SEQ ID NO: 1668794 - DNA, 14 bp, Homo sapiens
tgccttgaagccac

SEQ ID NO: 1668795 - DNA, 15 bp, Homo sapiens
tgccttgaagccact

SEQ ID NO: 1668796 - DNA, 14 bp, Homo sapiens
tgccttgagacccc

SEQ ID NO: 1668797 - DNA, 20 bp, Homo sapiens
tgccttgctgtttgtcctga

SEQ ID NO: 1668798 - DNA, 22 bp, Homo sapiens
tgccttgctgtttgtcctgaga

SEQ ID NO: 1668799 - DNA, 17 bp, Homo sapiens
tgccttggatgagaagt

SEQ ID NO: 1668800 - DNA, 17 bp, Homo sapiens
tgccttggctcagacat

SEQ ID NO: 1668801 - DNA, 19 bp, Homo sapiens
tgccttggctcagacatgt

SEQ ID NO: 1668802 - DNA, 17 bp, Homo sapiens
tgccttgggctgctcct

SEQ ID NO: 1668803 - DNA, 21 bp, Homo sapiens
tgccttggggaatttcctcta

SEQ ID NO: 1668804 - DNA, 16 bp, Homo sapiens
tgccttggtgtgctgt

SEQ ID NO: 1668805 - DNA, 11 bp, Homo sapiens
tgccttgtata

SEQ ID NO: 1668806 - DNA, 16 bp, Homo sapiens
tgcctttaaagtatga

SEQ ID NO: 1668807 - DNA, 18 bp, Homo sapiens
tgcctttaaagtatgaat

SEQ ID NO: 1668808 - DNA, 14 bp, Homo sapiens
tgcctttaaatctg

SEQ ID NO: 1668809 - DNA, 23 bp, Homo sapiens
tgcctttagcctggaccaaaggg

SEQ ID NO: 1668810 - DNA, 18 bp, Homo sapiens
tgcctttagcgtgtaaat

SEQ ID NO: 1668811 - DNA, 13 bp, Homo sapiens
tgcctttatatac

SEQ ID NO: 1668812 - DNA, 16 bp, Homo sapiens
tgcctttatgatgcta

SEQ ID NO: 1668813 - DNA, 11 bp, Homo sapiens
tgcctttctgt

SEQ ID NO: 1668814 - DNA, 16 bp, Homo sapiens
tgcctttctgtgttta

SEQ ID NO: 1668815 - DNA, 16 bp, Homo sapiens
tgcctttctttgcctc

SEQ ID NO: 1668816 - DNA, 17 bp, Homo sapiens
tgcctttctttgcctct

SEQ ID NO: 1668817 - DNA, 18 bp, Homo sapiens
tgcctttctttgcctctg

SEQ ID NO: 1668818 - DNA, 12 bp, Homo sapiens
tgcctttgaaga

SEQ ID NO: 1668819 - DNA, 18 bp, Homo sapiens
tgcctttgaagagtgaaa

SEQ ID NO: 1668820 - DNA, 12 bp, Homo sapiens
tgcctttgtaag

SEQ ID NO: 1668821 - DNA, 15 bp, Homo sapiens
tgcctttgtaagtta

SEQ ID NO: 1668822 - DNA, 15 bp, Homo sapiens
tgccttttctggagt

SEQ ID NO: 1668823 - DNA, 13 bp, Homo sapiens
tgccttttctgtg

SEQ ID NO: 1668824 - DNA, 21 bp, Homo sapiens
tgccttttgcacccctcccat

SEQ ID NO: 1668825 - DNA, 22 bp, Homo sapiens
tgccttttgcacccctcccatt

SEQ ID NO: 1668826 - DNA, 19 bp, Homo sapiens
tgccttttgcagaagaggg

SEQ ID NO: 1668827 - DNA, 19 bp, Homo sapiens
tgcctttttatttatatgt

SEQ ID NO: 1668828 - DNA, 22 bp, Homo sapiens
tgccttttttctatatcaaaaa

SEQ ID NO: 1668829 - DNA, 19 bp, Homo sapiens
tgcgaaaaggtttttagga

SEQ ID NO: 1668830 - DNA, 18 bp, Homo sapiens
tgcgaaggggccctggtc

SEQ ID NO: 1668831 - DNA, 14 bp, Homo sapiens
tgcgaccccccacc

SEQ ID NO: 1668832 - DNA, 16 bp, Homo sapiens
tgcgaccccccacccc

SEQ ID NO: 1668833 - DNA, 13 bp, Homo sapiens
tgcgaccctgggg

SEQ ID NO: 1668834 - DNA, 16 bp, Homo sapiens
tgcgacggagagaaaa

SEQ ID NO: 1668835 - DNA, 15 bp, Homo sapiens
tgcgactttctgcct

SEQ ID NO: 1668836 - DNA, 16 bp, Homo sapiens
tgcgactttctgcctg

SEQ ID NO: 1668837 - DNA, 21 bp, Homo sapiens
tgcgagacgcacacagctgag

SEQ ID NO: 1668838 - DNA, 22 bp, Homo sapiens
tgcgagacgcacacagctgagc

SEQ ID NO: 1668839 - DNA, 21 bp, Homo sapiens
tgcgaggctcggagcaccctt

SEQ ID NO: 1668840 - DNA, 16 bp, Homo sapiens
tgcgatagagtctcac

SEQ ID NO: 1668841 - DNA, 21 bp, Homo sapiens
tgcgattctggataaagccac

SEQ ID NO: 1668842 - DNA, 15 bp, Homo sapiens
tgcgcagaggccagt

SEQ ID NO: 1668843 - DNA, 22 bp, Homo sapiens
tgcgcaggtctcttctgggcgt

SEQ ID NO: 1668844 - DNA, 23 bp, Homo sapiens
tgcgcaggtctcttctgggcgtc

SEQ ID NO: 1668845 - DNA, 17 bp, Homo sapiens
tgcgccaggcagagctg

SEQ ID NO: 1668846 - DNA, 15 bp, Homo sapiens
tgcgccagtcctgct

SEQ ID NO: 1668847 - DNA, 19 bp, Homo sapiens
tgcgcccagggctgggagg

SEQ ID NO: 1668848 - DNA, 23 bp, Homo sapiens
tgcgccccctccgccctgccact

SEQ ID NO: 1668849 - DNA, 18 bp, Homo sapiens
tgcgcccttgtgccctgc

SEQ ID NO: 1668850 - DNA, 13 bp, Homo sapiens
tgcgcctccagag

SEQ ID NO: 1668851 - DNA, 14 bp, Homo sapiens
tgcgcctccagagg

SEQ ID NO: 1668852 - DNA, 20 bp, Homo sapiens
tgcgcctcggtatctggctt

SEQ ID NO: 1668853 - DNA, 14 bp, Homo sapiens
tgcgcctgaaaagg

SEQ ID NO: 1668854 - DNA, 18 bp, Homo sapiens
tgcgcctgtgatgctggg

SEQ ID NO: 1668855 - DNA, 17 bp, Homo sapiens
tgcgccttgtagaatgc

SEQ ID NO: 1668856 - DNA, 20 bp, Homo sapiens
tgcgcgcatgtaatcccagc

SEQ ID NO: 1668857 - DNA, 22 bp, Homo sapiens
tgcgcgcatgtaatcccagcta

SEQ ID NO: 1668858 - DNA, 14 bp, Homo sapiens
tgcgctcacctcag

SEQ ID NO: 1668859 - DNA, 18 bp, Homo sapiens
tgcgctcacctgcagccc

SEQ ID NO: 1668860 - DNA, 20 bp, Homo sapiens
tgcgctcacctgcagcccct

SEQ ID NO: 1668861 - DNA, 21 bp, Homo sapiens
tgcgctcagggccatgctgag

SEQ ID NO: 1668862 - DNA, 22 bp, Homo sapiens
tgcgctcagggccatgctgagg

SEQ ID NO: 1668863 - DNA, 17 bp, Homo sapiens
tgcgctcttggtccctg

SEQ ID NO: 1668864 - DNA, 17 bp, Homo sapiens
tgcgctgcctggccagg

SEQ ID NO: 1668865 - DNA, 19 bp, Homo sapiens
tgcgctggtggaccacagg

SEQ ID NO: 1668866 - DNA, 21 bp, Homo sapiens
tgcgctggtggaccacaggca

SEQ ID NO: 1668867 - DNA, 23 bp, Homo sapiens
tgcgctggtggaccacaggcatc

SEQ ID NO: 1668868 - DNA, 23 bp, Homo sapiens
tgcgctggttccgccaggcgctg

SEQ ID NO: 1668869 - DNA, 22 bp, Homo sapiens
tgcgctgtgtacaatgtgagat

SEQ ID NO: 1668870 - DNA, 14 bp, Homo sapiens
tgcgcttgcttttc

SEQ ID NO: 1668871 - DNA, 20 bp, Homo sapiens
tgcgctttgcaatatttatt

SEQ ID NO: 1668872 - DNA, 13 bp, Homo sapiens
tgcggaagccaaa

SEQ ID NO: 1668873 - DNA, 14 bp, Homo sapiens
tgcggacgggctgt

SEQ ID NO: 1668874 - DNA, 16 bp, Homo sapiens
tgcggaggagctgcct

SEQ ID NO: 1668875 - DNA, 17 bp, Homo sapiens
tgcggaggagctgcctg

SEQ ID NO: 1668876 - DNA, 16 bp, Homo sapiens
tgcggagtgaagaggg

SEQ ID NO: 1668877 - DNA, 17 bp, Homo sapiens
tgcggatctcagctttg

SEQ ID NO: 1668878 - DNA, 15 bp, Homo sapiens
tgcggcaaaaggaaa

SEQ ID NO: 1668879 - DNA, 18 bp, Homo sapiens
tgcggccgcattccctga

SEQ ID NO: 1668880 - DNA, 17 bp, Homo sapiens
tgcggcgcgggcccctc

SEQ ID NO: 1668881 - DNA, 13 bp, Homo sapiens
tgcgggcctggcc

SEQ ID NO: 1668882 - DNA, 17 bp, Homo sapiens
tgctaggagctgacaat

SEQ ID NO: 1668883 - DNA, 17 bp, Homo sapiens
tgctagggaaacttccc

SEQ ID NO: 1668884 - DNA, 23 bp, Homo sapiens
tgctaggttaattccaattatat

SEQ ID NO: 1668885 - DNA, 14 bp, Homo sapiens
tgctagtagtgttc

SEQ ID NO: 1668886 - DNA, 20 bp, Homo sapiens
tgctagtcactggcagcctg

SEQ ID NO: 1668887 - DNA, 21 bp, Homo sapiens
tgctagtctcagataggtgct

SEQ ID NO: 1668888 - DNA, 13 bp, Homo sapiens
tgctagtgataca

SEQ ID NO: 1668889 - DNA, 22 bp, Homo sapiens
tgctagtgatacactgtatcta

SEQ ID NO: 1668890 - DNA, 16 bp, Homo sapiens
tgctagttggagtgct

SEQ ID NO: 1668891 - DNA, 22 bp, Homo sapiens
tgctagttggagtgcttgttta

SEQ ID NO: 1668892 - DNA, 13 bp, Homo sapiens
tgctagttttaca

SEQ ID NO: 1668893 - DNA, 16 bp, Homo sapiens
tgctagttttacagat

SEQ ID NO: 1668894 - DNA, 16 bp, Homo sapiens
tgctataatcattagt

SEQ ID NO: 1668895 - DNA, 21 bp, Homo sapiens
tgctataatctgtttttacgt

SEQ ID NO: 1668896 - DNA, 16 bp, Homo sapiens
tgctatatattaggca

SEQ ID NO: 1668897 - DNA, 20 bp, Homo sapiens
tgctatcctgccaaaatcat

SEQ ID NO: 1668898 - DNA, 17 bp, Homo sapiens
tgctatcgccctccttt

SEQ ID NO: 1668899 - DNA, 23 bp, Homo sapiens
tgctatcgccctcctttccctta

SEQ ID NO: 1668900 - DNA, 15 bp, Homo sapiens
tgctatctctattat

SEQ ID NO: 1668901 - DNA, 19 bp, Homo sapiens
tgctatgaaaatgagcatc

SEQ ID NO: 1668902 - DNA, 15 bp, Homo sapiens
tgctatgactacatt

SEQ ID NO: 1668903 - DNA, 18 bp, Homo sapiens
tgctatgactacattttg

SEQ ID NO: 1668904 - DNA, 16 bp, Homo sapiens
tgctatgagctgggga

SEQ ID NO: 1668905 - DNA, 16 bp, Homo sapiens
tgctatgagttttctc

SEQ ID NO: 1668906 - DNA, 17 bp, Homo sapiens
tgctatgtaagggtctt

SEQ ID NO: 1668907 - DNA, 19 bp, Homo sapiens
tgctatgtgtgagatatgt

SEQ ID NO: 1668908 - DNA, 14 bp, Homo sapiens
tgctatgttctgtc

SEQ ID NO: 1668909 - DNA, 16 bp, Homo sapiens
tgctatgttctgtctt

SEQ ID NO: 1668910 - DNA, 18 bp, Homo sapiens
tgctattgtagagccaga

SEQ ID NO: 1668911 - DNA, 12 bp, Homo sapiens
tgctatttatgc

SEQ ID NO: 1668912 - DNA, 13 bp, Homo sapiens
tgctatttatgca

SEQ ID NO: 1668913 - DNA, 19 bp, Homo sapiens
tgctatttattttcctaaa

SEQ ID NO: 1668914 - DNA, 20 bp, Homo sapiens
tgctatttcacttgagcaag

SEQ ID NO: 1668915 - DNA, 20 bp, Homo sapiens
tgctatttgaacaagtgggc

SEQ ID NO: 1668916 - DNA, 19 bp, Homo sapiens
tgctatttgagcatgcaca

SEQ ID NO: 1668917 - DNA, 10 bp, Homo sapiens
tgctatttgt

SEQ ID NO: 1668918 - DNA, 13 bp, Homo sapiens
tgctatttgtaca

SEQ ID NO: 1668919 - DNA, 14 bp, Homo sapiens
tgctatttgtacaa

SEQ ID NO: 1668920 - DNA, 16 bp, Homo sapiens
tgctatttgtacaaat

SEQ ID NO: 1668921 - DNA, 15 bp, Homo sapiens
tgctcaaaaaatgag

SEQ ID NO: 1668922 - DNA, 15 bp, Homo sapiens
tgctcaaaaatctgt

SEQ ID NO: 1668923 - DNA, 18 bp, Homo sapiens
tgctcaaaattgcttcta

SEQ ID NO: 1668924 - DNA, 18 bp, Homo sapiens
tgctcaaatctattcaga

SEQ ID NO: 1668925 - DNA, 21 bp, Homo sapiens
tgctcaaatctattcagacaa

SEQ ID NO: 1668926 - DNA, 15 bp, Homo sapiens
tgctcaaccactgtg

SEQ ID NO: 1668927 - DNA, 20 bp, Homo sapiens
tgctcaactctacccctgct

SEQ ID NO: 1668928 - DNA, 17 bp, Homo sapiens
tgctcaagccgcaagct

SEQ ID NO: 1668929 - DNA, 20 bp, Homo sapiens
tgctcaagccgcaagctctc

SEQ ID NO: 1668930 - DNA, 21 bp, Homo sapiens
tgctcaaggttactgggagtg

SEQ ID NO: 1668931 - DNA, 16 bp, Homo sapiens
tgctcacgctcccccg

SEQ ID NO: 1668932 - DNA, 17 bp, Homo sapiens
tgctcacgtcaaatgca

SEQ ID NO: 1668933 - DNA, 14 bp, Homo sapiens
tgctcacgtctctg

SEQ ID NO: 1668934 - DNA, 15 bp, Homo sapiens
tgctcacgtctctgc

SEQ ID NO: 1668935 - DNA, 16 bp, Homo sapiens
tgctcacgtctctgcc

SEQ ID NO: 1668936 - DNA, 15 bp, Homo sapiens
tgctcactttaaacc

SEQ ID NO: 1668937 - DNA, 13 bp, Homo sapiens
tgctcagacagaa

SEQ ID NO: 1668938 - DNA, 17 bp, Homo sapiens
tgctcagacccaacagc

SEQ ID NO: 1668939 - DNA, 16 bp, Homo sapiens
tgctcagcagccagtc

SEQ ID NO: 1668940 - DNA, 17 bp, Homo sapiens
tgctcagcagccagtct

SEQ ID NO: 1668941 - DNA, 23 bp, Homo sapiens
tgctcagcagccagtctcagaga

SEQ ID NO: 1668942 - DNA, 19 bp, Homo sapiens
tgctcagcccgcttggcca

SEQ ID NO: 1668943 - DNA, 13 bp, Homo sapiens
tgctcagccttgc

SEQ ID NO: 1668944 - DNA, 14 bp, Homo sapiens
tgctcagccttgct

SEQ ID NO: 1668945 - DNA, 18 bp, Homo sapiens
tgctcagccttgctgctc

SEQ ID NO: 1668946 - DNA, 22 bp, Homo sapiens
tgctcagccttgctgctctgcg

SEQ ID NO: 1668947 - DNA, 17 bp, Homo sapiens
tgctcagtaatttgagg

SEQ ID NO: 1668948 - DNA, 18 bp, Homo sapiens
tgctcagtggatcacaca

SEQ ID NO: 1668949 - DNA, 19 bp, Homo sapiens
tgctcagtggatcacacac

SEQ ID NO: 1668950 - DNA, 13 bp, Homo sapiens
tgctcagtgtcca

SEQ ID NO: 1668951 - DNA, 16 bp, Homo sapiens
tgctcagtgtttcata

SEQ ID NO: 1668952 - DNA, 20 bp, Homo sapiens
tgctcagtgtttttgtgaat

SEQ ID NO: 1668953 - DNA, 23 bp, Homo sapiens
tgctcatattgtgattctgcctt

SEQ ID NO: 1668954 - DNA, 21 bp, Homo sapiens
tgctcattacagttctttcct

SEQ ID NO: 1668955 - DNA, 16 bp, Homo sapiens
tgctcattgctaacca

SEQ ID NO: 1668956 - DNA, 19 bp, Homo sapiens
tgctcattttctggtttgg

SEQ ID NO: 1668957 - DNA, 21 bp, Homo sapiens
tgctcattttctggtttggca

SEQ ID NO: 1668958 - DNA, 13 bp, Homo sapiens
tgctccaacctga

SEQ ID NO: 1668959 - DNA, 14 bp, Homo sapiens
tgctccaagattct

SEQ ID NO: 1668960 - DNA, 16 bp, Homo sapiens
tgctccaagattctag

SEQ ID NO: 1668961 - DNA, 17 bp, Homo sapiens
tgctccaagattctaga

SEQ ID NO: 1668962 - DNA, 18 bp, Homo sapiens
tgctccaagattctagat

SEQ ID NO: 1668963 - DNA, 14 bp, Homo sapiens
tgctccaccacatc

SEQ ID NO: 1668964 - DNA, 19 bp, Homo sapiens
tgctccacccttggcctgt

SEQ ID NO: 1668965 - DNA, 23 bp, Homo sapiens
tgctccacccttggcctgtctca

SEQ ID NO: 1668966 - DNA, 22 bp, Homo sapiens
tgctccagcaactgcccttcca

SEQ ID NO: 1668967 - DNA, 14 bp, Homo sapiens
tgctccagggtctt

SEQ ID NO: 1668968 - DNA, 18 bp, Homo sapiens
tgctccagggtcttgggc

SEQ ID NO: 1668969 - DNA, 19 bp, Homo sapiens
tgctccagggtcttgggct

SEQ ID NO: 1668970 - DNA, 23 bp, Homo sapiens
tgctccagggtcttgggctactg

SEQ ID NO: 1668971 - DNA, 19 bp, Homo sapiens
tgctccataccttttctct

SEQ ID NO: 1668972 - DNA, 17 bp, Homo sapiens
tgctcccagcagcccta

SEQ ID NO: 1668973 - DNA, 20 bp, Homo sapiens
tgctcccagcagccctaagg

SEQ ID NO: 1668974 - DNA, 21 bp, Homo sapiens
tgctcccagcagccctaagga

SEQ ID NO: 1668975 - DNA, 21 bp, Homo sapiens
tgctcccatctcctgatttct

SEQ ID NO: 1668976 - DNA, 16 bp, Homo sapiens
tgctccccacccgcct

SEQ ID NO: 1668977 - DNA, 23 bp, Homo sapiens
tgctcccccaccccctccccagg

SEQ ID NO: 1668978 - DNA, 14 bp, Homo sapiens
tgctccctcccctg

SEQ ID NO: 1668979 - DNA, 14 bp, Homo sapiens
tgctccctggaggc

SEQ ID NO: 1668980 - DNA, 19 bp, Homo sapiens
tgctccctggaggcacgca

SEQ ID NO: 1668981 - DNA, 15 bp, Homo sapiens
tgctccctgtctgtg

SEQ ID NO: 1668982 - DNA, 16 bp, Homo sapiens
tgctccctgtctgtgt

SEQ ID NO: 1668983 - DNA, 18 bp, Homo sapiens
tgctccgaggacccagga

SEQ ID NO: 1668984 - DNA, 23 bp, Homo sapiens
tgctccgcccgctcctgccgcag

SEQ ID NO: 1668985 - DNA, 18 bp, Homo sapiens
tgctccgctgcctggaac

SEQ ID NO: 1668986 - DNA, 15 bp, Homo sapiens
tgctccgtgcctcca

SEQ ID NO: 1668987 - DNA, 19 bp, Homo sapiens
tgctcctcacccctgtagg

SEQ ID NO: 1668988 - DNA, 15 bp, Homo sapiens
tgctcctcacctgtc

SEQ ID NO: 1668989 - DNA, 13 bp, Homo sapiens
tgctcctccaggg

SEQ ID NO: 1668990 - DNA, 10 bp, Homo sapiens
tgctcctccc

SEQ ID NO: 1668991 - DNA, 18 bp, Homo sapiens
tgctcctccctgcccccc

SEQ ID NO: 1668992 - DNA, 15 bp, Homo sapiens
tgctcctccctggct

SEQ ID NO: 1668993 - DNA, 18 bp, Homo sapiens
tgctcctcttgattcctg

SEQ ID NO: 1668994 - DNA, 17 bp, Homo sapiens
tgctcctgcccaggagc

SEQ ID NO: 1668995 - DNA, 20 bp, Homo sapiens
tgctcctgcccaggagcagc

SEQ ID NO: 1668996 - DNA, 13 bp, Homo sapiens
tgctcctgctttt

SEQ ID NO: 1668997 - DNA, 17 bp, Homo sapiens
tgcttcatccaatgtga

SEQ ID NO: 1668998 - DNA, 18 bp, Homo sapiens
tgcttcatccaatgtgaa

SEQ ID NO: 1668999 - DNA, 19 bp, Homo sapiens
tgcttcatccaatgtgaag

SEQ ID NO: 1669000 - DNA, 18 bp, Homo sapiens
tgcttcatgtttgccttc

SEQ ID NO: 1669001 - DNA, 16 bp, Homo sapiens
tgcttcattgttacat

SEQ ID NO: 1669002 - DNA, 19 bp, Homo sapiens
tgcttcattgttacatgta

SEQ ID NO: 1669003 - DNA, 19 bp, Homo sapiens
tgcttccaaaagtgatagt

SEQ ID NO: 1669004 - DNA, 15 bp, Homo sapiens
tgcttccaattttct

SEQ ID NO: 1669005 - DNA, 16 bp, Homo sapiens
tgcttccaggaaactc

SEQ ID NO: 1669006 - DNA, 15 bp, Homo sapiens
tgcttccaggctggg

SEQ ID NO: 1669007 - DNA, 22 bp, Homo sapiens
tgcttcccagaggagcagctct

SEQ ID NO: 1669008 - DNA, 15 bp, Homo sapiens
tgcttcccatcctac

SEQ ID NO: 1669009 - DNA, 23 bp, Homo sapiens
tgcttcccattgtggctcctatc

SEQ ID NO: 1669010 - DNA, 14 bp, Homo sapiens
tgcttcccccaccc

SEQ ID NO: 1669011 - DNA, 16 bp, Homo sapiens
tgcttcccccacccct

SEQ ID NO: 1669012 - DNA, 20 bp, Homo sapiens
tgcttcccccacccctccac

SEQ ID NO: 1669013 - DNA, 22 bp, Homo sapiens
tgcttccccctccccctcctgc

SEQ ID NO: 1669014 - DNA, 18 bp, Homo sapiens
tgcttccgagacaccaca

SEQ ID NO: 1669015 - DNA, 12 bp, Homo sapiens
tgcttcctagaa

SEQ ID NO: 1669016 - DNA, 23 bp, Homo sapiens
tgcttcctcccaacaagcagctg

SEQ ID NO: 1669017 - DNA, 15 bp, Homo sapiens
tgcttcctcctggaa

SEQ ID NO: 1669018 - DNA, 22 bp, Homo sapiens
tgcttcctgtcttatcctccac

SEQ ID NO: 1669019 - DNA, 13 bp, Homo sapiens
tgcttcctttctc

SEQ ID NO: 1669020 - DNA, 14 bp, Homo sapiens
tgcttcctttctct

SEQ ID NO: 1669021 - DNA, 18 bp, Homo sapiens
tgcttcctttctctcctg

SEQ ID NO: 1669022 - DNA, 16 bp, Homo sapiens
tgcttcgaagtattca

SEQ ID NO: 1669023 - DNA, 14 bp, Homo sapiens
tgcttctactttca

SEQ ID NO: 1669024 - DNA, 19 bp, Homo sapiens
tgcttctaggagaactttt

SEQ ID NO: 1669025 - DNA, 19 bp, Homo sapiens
tgcttctataattttgcct

SEQ ID NO: 1669026 - DNA, 21 bp, Homo sapiens
tgcttctcaccacgggaaagc

SEQ ID NO: 1669027 - DNA, 16 bp, Homo sapiens
tgcttctccacctccc

SEQ ID NO: 1669028 - DNA, 19 bp, Homo sapiens
tgcttctcggggtccagtg

SEQ ID NO: 1669029 - DNA, 12 bp, Homo sapiens
tgcttctctgac

SEQ ID NO: 1669030 - DNA, 14 bp, Homo sapiens
tgcttctctgactt

SEQ ID NO: 1669031 - DNA, 17 bp, Homo sapiens
tgcttctctgacttctg

SEQ ID NO: 1669032 - DNA, 11 bp, Homo sapiens
tgcttctcttt

SEQ ID NO: 1669033 - DNA, 22 bp, Homo sapiens
tgcttctgaactcaagctgcgt

SEQ ID NO: 1669034 - DNA, 12 bp, Homo sapiens
tgcttctgctgc

SEQ ID NO: 1669035 - DNA, 15 bp, Homo sapiens
tgcttctgctgccct

SEQ ID NO: 1669036 - DNA, 16 bp, Homo sapiens
tgcttctgtatttcct

SEQ ID NO: 1669037 - DNA, 15 bp, Homo sapiens
tgcttcttactgata

SEQ ID NO: 1669038 - DNA, 14 bp, Homo sapiens
tgcttcttggagct

SEQ ID NO: 1669039 - DNA, 20 bp, Homo sapiens
tgcttcttggagctttggaa

SEQ ID NO: 1669040 - DNA, 21 bp, Homo sapiens
tgcttcttggagctttggaat

SEQ ID NO: 1669041 - DNA, 16 bp, Homo sapiens
tgcttgaaggccctgc

SEQ ID NO: 1669042 - DNA, 15 bp, Homo sapiens
tgcttgacaacatct

SEQ ID NO: 1669043 - DNA, 16 bp, Homo sapiens
tgcttgacaacatctg

SEQ ID NO: 1669044 - DNA, 14 bp, Homo sapiens
tgcttgacatacct

SEQ ID NO: 1669045 - DNA, 21 bp, Homo sapiens
tgcttgagccaggaggcctgc

SEQ ID NO: 1669046 - DNA, 13 bp, Homo sapiens
tgcttgagcccag

SEQ ID NO: 1669047 - DNA, 16 bp, Homo sapiens
tgcttgagcccaggag

SEQ ID NO: 1669048 - DNA, 14 bp, Homo sapiens
tgcttgatgtttgg

SEQ ID NO: 1669049 - DNA, 15 bp, Homo sapiens
tgcttgcacacttcc

SEQ ID NO: 1669050 - DNA, 16 bp, Homo sapiens
tgcttgcacacttccc

SEQ ID NO: 1669051 - DNA, 21 bp, Homo sapiens
tgcttgccaaggcagaggcct

SEQ ID NO: 1669052 - DNA, 14 bp, Homo sapiens
tgcttgccgagcct

SEQ ID NO: 1669053 - DNA, 18 bp, Homo sapiens
tgcttgctcatatgcatg

SEQ ID NO: 1669054 - DNA, 15 bp, Homo sapiens
tgcttggagcaatca

SEQ ID NO: 1669055 - DNA, 17 bp, Homo sapiens
tgcttggagcaatcaga

SEQ ID NO: 1669056 - DNA, 18 bp, Homo sapiens
tgcttggatccatacaaa

SEQ ID NO: 1669057 - DNA, 15 bp, Homo sapiens
tgcttgggccctgca

SEQ ID NO: 1669058 - DNA, 17 bp, Homo sapiens
tgcttgggccctgcatt

SEQ ID NO: 1669059 - DNA, 22 bp, Homo sapiens
tgcttgggccctgcattggcct

SEQ ID NO: 1669060 - DNA, 21 bp, Homo sapiens
tgcttgggcctccctggcact

SEQ ID NO: 1669061 - DNA, 13 bp, Homo sapiens
tgcttgggctgac

SEQ ID NO: 1669062 - DNA, 16 bp, Homo sapiens
tgcttggtctgtttga

SEQ ID NO: 1669063 - DNA, 15 bp, Homo sapiens
tgcttggtggggctc

SEQ ID NO: 1669064 - DNA, 23 bp, Homo sapiens
tgcttgtaacaagaaaacataag

SEQ ID NO: 1669065 - DNA, 12 bp, Homo sapiens
tgcttgtatgat

SEQ ID NO: 1669066 - DNA, 23 bp, Homo sapiens
tgcttgtcatccacacaacacca

SEQ ID NO: 1669067 - DNA, 20 bp, Homo sapiens
tgcttgtcattccagagtgc

SEQ ID NO: 1669068 - DNA, 12 bp, Homo sapiens
tgcttgtgttaa

SEQ ID NO: 1669069 - DNA, 15 bp, Homo sapiens
tgcttgtgttaagta

SEQ ID NO: 1669070 - DNA, 19 bp, Homo sapiens
tgcttgttccctctccctg

SEQ ID NO: 1669071 - DNA, 18 bp, Homo sapiens
tgcttgtttatgatattt

SEQ ID NO: 1669072 - DNA, 17 bp, Homo sapiens
tgctttaaagtacctgt

SEQ ID NO: 1669073 - DNA, 11 bp, Homo sapiens
tgctttaatat

SEQ ID NO: 1669074 - DNA, 20 bp, Homo sapiens
tgctttaatatgagcttcaa

SEQ ID NO: 1669075 - DNA, 20 bp, Homo sapiens
tgctttaatgagtgcacctg

SEQ ID NO: 1669076 - DNA, 22 bp, Homo sapiens
tgctttaatgagtgcacctgcc

SEQ ID NO: 1669077 - DNA, 23 bp, Homo sapiens
tgctttaatgagtgcacctgcct

SEQ ID NO: 1669078 - DNA, 19 bp, Homo sapiens
tgctttaattgctttaaat

SEQ ID NO: 1669079 - DNA, 20 bp, Homo sapiens
tgctttaattgctttaaatc

SEQ ID NO: 1669080 - DNA, 14 bp, Homo sapiens
tgctttaattttag

SEQ ID NO: 1669081 - DNA, 15 bp, Homo sapiens
tgctttaattttagc

SEQ ID NO: 1669082 - DNA, 14 bp, Homo sapiens
tgctttactgtcaa

SEQ ID NO: 1669083 - DNA, 20 bp, Homo sapiens
tgctttagagataattgctt

SEQ ID NO: 1669084 - DNA, 15 bp, Homo sapiens
tgctttatgccttct

SEQ ID NO: 1669085 - DNA, 15 bp, Homo sapiens
tgctttattaatgtt

SEQ ID NO: 1669086 - DNA, 23 bp, Homo sapiens
tgctttattaatgttttcaaaag

SEQ ID NO: 1669087 - DNA, 16 bp, Homo sapiens
tgctttattgcttttt

SEQ ID NO: 1669088 - DNA, 20 bp, Homo sapiens
tgctttccccgggggaggaa

SEQ ID NO: 1669089 - DNA, 15 bp, Homo sapiens
tgctttcccctgtgg

SEQ ID NO: 1669090 - DNA, 20 bp, Homo sapiens
tgctttcccctgtggggatc

SEQ ID NO: 1669091 - DNA, 17 bp, Homo sapiens
tgctttccgtggcactg

SEQ ID NO: 1669092 - DNA, 20 bp, Homo sapiens
tgctttccgtggcactgcat

SEQ ID NO: 1669093 - DNA, 20 bp, Homo sapiens
tgctttctcctttaattgta

SEQ ID NO: 1669094 - DNA, 13 bp, Homo sapiens
tgctttctgaaat

SEQ ID NO: 1669095 - DNA, 23 bp, Homo sapiens
tgctttctgaagctttaccagct

SEQ ID NO: 1669096 - DNA, 15 bp, Homo sapiens
tgctttctgaattgg

SEQ ID NO: 1669097 - DNA, 14 bp, Homo sapiens
tgctttcttaccta

SEQ ID NO: 1669098 - DNA, 16 bp, Homo sapiens
tgctttcttacctact

SEQ ID NO: 1669099 - DNA, 20 bp, Homo sapiens
tgctttctttagaattttta

SEQ ID NO: 1669100 - DNA, 17 bp, Homo sapiens
tgctttgccagagcagg

SEQ ID NO: 1669101 - DNA, 18 bp, Homo sapiens
tgctttggacctaaatgg

SEQ ID NO: 1669102 - DNA, 23 bp, Homo sapiens
tgctttggacctaaatggcctca

SEQ ID NO: 1669103 - DNA, 16 bp, Homo sapiens
tgctttggatgatttt

SEQ ID NO: 1669104 - DNA, 17 bp, Homo sapiens
tgctttgggaggccaag

SEQ ID NO: 1669105 - DNA, 20 bp, Homo sapiens
tgctttgggaggccaaggca

SEQ ID NO: 1669106 - DNA, 20 bp, Homo sapiens
tgctttgggctgccctggtg

SEQ ID NO: 1669107 - DNA, 12 bp, Homo sapiens
tgctttgggctt

SEQ ID NO: 1669108 - DNA, 16 bp, Homo sapiens
tgctttgtagagtttt

SEQ ID NO: 1669109 - DNA, 22 bp, Homo sapiens
tgctttgtagagttttgtcatt

SEQ ID NO: 1669110 - DNA, 16 bp, Homo sapiens
tgctttgtgtgattga

SEQ ID NO: 1669111 - DNA, 15 bp, Homo sapiens
tgctttgtgttcagt

SEQ ID NO: 1669112 - DNA, 19 bp, Homo sapiens
tggagactcctgccctgtt

SEQ ID NO: 1669113 - DNA, 19 bp, Homo sapiens
tggagactcctggtctgtg

SEQ ID NO: 1669114 - DNA, 14 bp, Homo sapiens
tggagactctgtgg

SEQ ID NO: 1669115 - DNA, 19 bp, Homo sapiens
tggagactctgtggggcct

SEQ ID NO: 1669116 - DNA, 12 bp, Homo sapiens
tggagactgctt

SEQ ID NO: 1669117 - DNA, 14 bp, Homo sapiens
tggagactgtctca

SEQ ID NO: 1669118 - DNA, 21 bp, Homo sapiens
tggagacttagggcaccaggg

SEQ ID NO: 1669119 - DNA, 17 bp, Homo sapiens
tggagactttctgttac

SEQ ID NO: 1669120 - DNA, 15 bp, Homo sapiens
tggagagaaggcctc

SEQ ID NO: 1669121 - DNA, 17 bp, Homo sapiens
tggagagaatgtgtgtg

SEQ ID NO: 1669122 - DNA, 23 bp, Homo sapiens
tggagagagaggctgcctcagcc

SEQ ID NO: 1669123 - DNA, 15 bp, Homo sapiens
tggagagatgtttgg

SEQ ID NO: 1669124 - DNA, 19 bp, Homo sapiens
tggagagcagcaggtgctg

SEQ ID NO: 1669125 - DNA, 16 bp, Homo sapiens
tggagagcagccagca

SEQ ID NO: 1669126 - DNA, 14 bp, Homo sapiens
tggagagctcagga

SEQ ID NO: 1669127 - DNA, 22 bp, Homo sapiens
tggagaggagggatgctgcctg

SEQ ID NO: 1669128 - DNA, 15 bp, Homo sapiens
tggagagggaatgtg

SEQ ID NO: 1669129 - DNA, 17 bp, Homo sapiens
tggagagggaatgtgaa

SEQ ID NO: 1669130 - DNA, 19 bp, Homo sapiens
tggagagggaatgtgaaat

SEQ ID NO: 1669131 - DNA, 16 bp, Homo sapiens
tggagagggggcctgg

SEQ ID NO: 1669132 - DNA, 19 bp, Homo sapiens
tggagatatttatgggggg

SEQ ID NO: 1669133 - DNA, 18 bp, Homo sapiens
tggagatcctcctgcaga

SEQ ID NO: 1669134 - DNA, 21 bp, Homo sapiens
tggagatcctcctgcagacca

SEQ ID NO: 1669135 - DNA, 22 bp, Homo sapiens
tggagatggaagcttgttgaaa

SEQ ID NO: 1669136 - DNA, 11 bp, Homo sapiens
tggagatgttt

SEQ ID NO: 1669137 - DNA, 19 bp, Homo sapiens
tggagcaacctactgtcta

SEQ ID NO: 1669138 - DNA, 21 bp, Homo sapiens
tggagcaacctactgtctaag

SEQ ID NO: 1669139 - DNA, 15 bp, Homo sapiens
tggagcaagaaggaa

SEQ ID NO: 1669140 - DNA, 16 bp, Homo sapiens
tggagcacaaaattca

SEQ ID NO: 1669141 - DNA, 22 bp, Homo sapiens
tggagcactctgagtttaccat

SEQ ID NO: 1669142 - DNA, 13 bp, Homo sapiens
tggagcagaccac

SEQ ID NO: 1669143 - DNA, 23 bp, Homo sapiens
tggagcagcagccactgcacagg

SEQ ID NO: 1669144 - DNA, 14 bp, Homo sapiens
tggagcagccagag

SEQ ID NO: 1669145 - DNA, 18 bp, Homo sapiens
tggagcaggactctattt

SEQ ID NO: 1669146 - DNA, 13 bp, Homo sapiens
tggagcaggagcc

SEQ ID NO: 1669147 - DNA, 18 bp, Homo sapiens
tggagcaggagccccgcc

SEQ ID NO: 1669148 - DNA, 19 bp, Homo sapiens
tggagcaggagccccgcca

SEQ ID NO: 1669149 - DNA, 22 bp, Homo sapiens
tggagcataactggagggtggg

SEQ ID NO: 1669150 - DNA, 14 bp, Homo sapiens
tggagcatggacag

SEQ ID NO: 1669151 - DNA, 23 bp, Homo sapiens
tggagccaagtggtccagcgtca

SEQ ID NO: 1669152 - DNA, 11 bp, Homo sapiens
tggagccactc

SEQ ID NO: 1669153 - DNA, 18 bp, Homo sapiens
tggagccactcctgtccc

SEQ ID NO: 1669154 - DNA, 15 bp, Homo sapiens
tggagccagcagggc

SEQ ID NO: 1669155 - DNA, 17 bp, Homo sapiens
tggagccagcagggctg

SEQ ID NO: 1669156 - DNA, 20 bp, Homo sapiens
tggagccagcagggctgtga

SEQ ID NO: 1669157 - DNA, 23 bp, Homo sapiens
tggagccagggagcggccgcctg

SEQ ID NO: 1669158 - DNA, 14 bp, Homo sapiens
tggagccagggcag

SEQ ID NO: 1669159 - DNA, 15 bp, Homo sapiens
tggagccagggcaga

SEQ ID NO: 1669160 - DNA, 23 bp, Homo sapiens
tggagcccagaggagggcagcag

SEQ ID NO: 1669161 - DNA, 22 bp, Homo sapiens
tggagcccagggcatcttgctg

SEQ ID NO: 1669162 - DNA, 14 bp, Homo sapiens
tggagccccacctt

SEQ ID NO: 1669163 - DNA, 19 bp, Homo sapiens
tggagccccaccttgtctg

SEQ ID NO: 1669164 - DNA, 21 bp, Homo sapiens
tggagccccaccttgtctgct

SEQ ID NO: 1669165 - DNA, 15 bp, Homo sapiens
tggagcccctcctcc

SEQ ID NO: 1669166 - DNA, 16 bp, Homo sapiens
tggagcccctcctccc

SEQ ID NO: 1669167 - DNA, 14 bp, Homo sapiens
tggagcccctgggt

SEQ ID NO: 1669168 - DNA, 19 bp, Homo sapiens
tggagcccgaggcaccagt

SEQ ID NO: 1669169 - DNA, 23 bp, Homo sapiens
tggagcctgccgcccccgcctgg

SEQ ID NO: 1669170 - DNA, 19 bp, Homo sapiens
tggagcctggcacaggact

SEQ ID NO: 1669171 - DNA, 23 bp, Homo sapiens
tggagcgagcatcccccaaagtt

SEQ ID NO: 1669172 - DNA, 22 bp, Homo sapiens
tggagcgcacctgccccctggt

SEQ ID NO: 1669173 - DNA, 14 bp, Homo sapiens
tggagctgccacag

SEQ ID NO: 1669174 - DNA, 16 bp, Homo sapiens
tggagctgccacagag

SEQ ID NO: 1669175 - DNA, 19 bp, Homo sapiens
tggagctgccacagagaag

SEQ ID NO: 1669176 - DNA, 16 bp, Homo sapiens
tggagctgggagacaa

SEQ ID NO: 1669177 - DNA, 23 bp, Homo sapiens
tggagctgggagacaaaggagga

SEQ ID NO: 1669178 - DNA, 17 bp, Homo sapiens
tggagctgtcctccaga

SEQ ID NO: 1669179 - DNA, 16 bp, Homo sapiens
tggagcttttaaaaat

SEQ ID NO: 1669180 - DNA, 22 bp, Homo sapiens
tggagcttttaaaaatgtttgg

SEQ ID NO: 1669181 - DNA, 16 bp, Homo sapiens
tggaggaaagggagga

SEQ ID NO: 1669182 - DNA, 15 bp, Homo sapiens
tggaggaagagccac

SEQ ID NO: 1669183 - DNA, 18 bp, Homo sapiens
tggaggaagagggacaga

SEQ ID NO: 1669184 - DNA, 14 bp, Homo sapiens
tggaggaaggtgct

SEQ ID NO: 1669185 - DNA, 17 bp, Homo sapiens
tggaggaaggtgctgag

SEQ ID NO: 1669186 - DNA, 22 bp, Homo sapiens
tggaggaagttctccagcttca

SEQ ID NO: 1669187 - DNA, 21 bp, Homo sapiens
tggaggagaagaattttcaga

SEQ ID NO: 1669188 - DNA, 15 bp, Homo sapiens
tggaggagagagacc

SEQ ID NO: 1669189 - DNA, 13 bp, Homo sapiens
tggaggagctggc

SEQ ID NO: 1669190 - DNA, 22 bp, Homo sapiens
tggaggagctggcctgtggcac

SEQ ID NO: 1669191 - DNA, 16 bp, Homo sapiens
tggaggaggaaggcaa

SEQ ID NO: 1669192 - DNA, 21 bp, Homo sapiens
tggaggatgaatagatgtgat

SEQ ID NO: 1669193 - DNA, 18 bp, Homo sapiens
tggaggattatcagtatc

SEQ ID NO: 1669194 - DNA, 18 bp, Homo sapiens
tggaggattctttcccca

SEQ ID NO: 1669195 - DNA, 20 bp, Homo sapiens
tggaggattctttccccaga

SEQ ID NO: 1669196 - DNA, 17 bp, Homo sapiens
tggaggcacgcaccact

SEQ ID NO: 1669197 - DNA, 19 bp, Homo sapiens
tggaggcacgcaccactgc

SEQ ID NO: 1669198 - DNA, 11 bp, Homo sapiens
tggaggcaggg

SEQ ID NO: 1669199 - DNA, 17 bp, Homo sapiens
tggaggccaccgggaca

SEQ ID NO: 1669200 - DNA, 22 bp, Homo sapiens
tggaggccaccgggacagacct

SEQ ID NO: 1669201 - DNA, 24 bp, Homo sapiens
tggaggccaccgggacagacctgg

SEQ ID NO: 1669202 - DNA, 22 bp, Homo sapiens
tggaggccattgtgtgagccta

SEQ ID NO: 1669203 - DNA, 18 bp, Homo sapiens
tggaggcccaggctggga

SEQ ID NO: 1669204 - DNA, 16 bp, Homo sapiens
tggaggcccctggagc

SEQ ID NO: 1669205 - DNA, 17 bp, Homo sapiens
tggaggcccctggagcc

SEQ ID NO: 1669206 - DNA, 14 bp, Homo sapiens
tggaggcccctggg

SEQ ID NO: 1669207 - DNA, 16 bp, Homo sapiens
tggaggcccctgggct

SEQ ID NO: 1669208 - DNA, 20 bp, Homo sapiens
tggaggccgaggaccaccag

SEQ ID NO: 1669209 - DNA, 23 bp, Homo sapiens
tggaggccgaggaccaccagcag

SEQ ID NO: 1669210 - DNA, 14 bp, Homo sapiens
tggaggcctcaggt

SEQ ID NO: 1669211 - DNA, 20 bp, Homo sapiens
tggaggcctgatgctgcccc

SEQ ID NO: 1669212 - DNA, 12 bp, Homo sapiens
tggaggctgctg

SEQ ID NO: 1669213 - DNA, 17 bp, Homo sapiens
tggaggctgctgtgaaa

SEQ ID NO: 1669214 - DNA, 13 bp, Homo sapiens
tggaggctgtctt

SEQ ID NO: 1669215 - DNA, 22 bp, Homo sapiens
tggaggctgtcttctcaggctc

SEQ ID NO: 1669216 - DNA, 22 bp, Homo sapiens
tggaggcttcctgcgtcctcct

SEQ ID NO: 1669217 - DNA, 21 bp, Homo sapiens
tggaggcttggctgctcttcc

SEQ ID NO: 1669218 - DNA, 23 bp, Homo sapiens
tggagggacttttaatcagtgaa

SEQ ID NO: 1669219 - DNA, 13 bp, Homo sapiens
tggagggaggccc

SEQ ID NO: 1669220 - DNA, 14 bp, Homo sapiens
tggagggaggcccc

SEQ ID NO: 1669221 - DNA, 17 bp, Homo sapiens
tggagggagggaagggt

SEQ ID NO: 1669222 - DNA, 13 bp, Homo sapiens
tggagggcttggc

SEQ ID NO: 1669223 - DNA, 20 bp, Homo sapiens
tggagggcttggcccagcgc

SEQ ID NO: 1669224 - DNA, 18 bp, Homo sapiens
tggaggggcagcctgtgc

SEQ ID NO: 1669225 - DNA, 19 bp, Homo sapiens
tggaggggcccacccacat

SEQ ID NO: 1669226 - DNA, 21 bp, Homo sapiens
tggcaggacacacatggtgag

SEQ ID NO: 1669227 - DNA, 19 bp, Homo sapiens
tggcaggacacatcccggc

SEQ ID NO: 1669228 - DNA, 19 bp, Homo sapiens
tggcaggagaatcagcctg

SEQ ID NO: 1669229 - DNA, 15 bp, Homo sapiens
tggcaggagctcctg

SEQ ID NO: 1669230 - DNA, 20 bp, Homo sapiens
tggcaggattcttcccgctc

SEQ ID NO: 1669231 - DNA, 19 bp, Homo sapiens
tggcaggcagttctagaag

SEQ ID NO: 1669232 - DNA, 12 bp, Homo sapiens
tggcaggcccac

SEQ ID NO: 1669233 - DNA, 22 bp, Homo sapiens
tggcaggcccactccccagccc

SEQ ID NO: 1669234 - DNA, 13 bp, Homo sapiens
tggcaggctggcc

SEQ ID NO: 1669235 - DNA, 14 bp, Homo sapiens
tggcaggctggcca

SEQ ID NO: 1669236 - DNA, 21 bp, Homo sapiens
tggcaggcttccatccccgtc

SEQ ID NO: 1669237 - DNA, 13 bp, Homo sapiens
tggcagggacctg

SEQ ID NO: 1669238 - DNA, 15 bp, Homo sapiens
tggcaggggacagga

SEQ ID NO: 1669239 - DNA, 21 bp, Homo sapiens
tggcaggggtggctgcctcat

SEQ ID NO: 1669240 - DNA, 16 bp, Homo sapiens
tggcagggtgggatgg

SEQ ID NO: 1669241 - DNA, 14 bp, Homo sapiens
tggcaggtcactgt

SEQ ID NO: 1669242 - DNA, 16 bp, Homo sapiens
tggcaggtcactgtca

SEQ ID NO: 1669243 - DNA, 18 bp, Homo sapiens
tggcaggtcactgtcact

SEQ ID NO: 1669244 - DNA, 19 bp, Homo sapiens
tggcaggtcactgtcactg

SEQ ID NO: 1669245 - DNA, 20 bp, Homo sapiens
tggcaggtgttgggacctgc

SEQ ID NO: 1669246 - DNA, 14 bp, Homo sapiens
tggcagtccagcca

SEQ ID NO: 1669247 - DNA, 19 bp, Homo sapiens
tggcagtccagccagctcc

SEQ ID NO: 1669248 - DNA, 20 bp, Homo sapiens
tggcagtccagccagctcct

SEQ ID NO: 1669249 - DNA, 18 bp, Homo sapiens
tggcagtcctggaggcag

SEQ ID NO: 1669250 - DNA, 15 bp, Homo sapiens
tggcagtggccaggc

SEQ ID NO: 1669251 - DNA, 18 bp, Homo sapiens
tggcagtggccaggcagg

SEQ ID NO: 1669252 - DNA, 11 bp, Homo sapiens
tggcagtgttt

SEQ ID NO: 1669253 - DNA, 23 bp, Homo sapiens
tggcataactaaaattaagtata

SEQ ID NO: 1669254 - DNA, 16 bp, Homo sapiens
tggcataagacagaga

SEQ ID NO: 1669255 - DNA, 20 bp, Homo sapiens
tggcataatagtcaatttct

SEQ ID NO: 1669256 - DNA, 16 bp, Homo sapiens
tggcatagccccggcc

SEQ ID NO: 1669257 - DNA, 22 bp, Homo sapiens
tggcatcaagaggtgggagggc

SEQ ID NO: 1669258 - DNA, 22 bp, Homo sapiens
tggcatcaagggagacaccagt

SEQ ID NO: 1669259 - DNA, 22 bp, Homo sapiens
tggcatcgaccacaccagcctc

SEQ ID NO: 1669260 - DNA, 23 bp, Homo sapiens
tggcatcgtagaagagatgtggc

SEQ ID NO: 1669261 - DNA, 13 bp, Homo sapiens
tggcatctcctgt

SEQ ID NO: 1669262 - DNA, 16 bp, Homo sapiens
tggcatctcctgtcct

SEQ ID NO: 1669263 - DNA, 18 bp, Homo sapiens
tggcatctgacacaaaaa

SEQ ID NO: 1669264 - DNA, 20 bp, Homo sapiens
tggcatcttagacctccaca

SEQ ID NO: 1669265 - DNA, 21 bp, Homo sapiens
tggcatctttgccttgggctg

SEQ ID NO: 1669266 - DNA, 23 bp, Homo sapiens
tggcatctttgccttgggctgct

SEQ ID NO: 1669267 - DNA, 14 bp, Homo sapiens
tggcatgaggaggt

SEQ ID NO: 1669268 - DNA, 15 bp, Homo sapiens
tggcatgaggaggtc

SEQ ID NO: 1669269 - DNA, 15 bp, Homo sapiens
tggcatgccttccag

SEQ ID NO: 1669270 - DNA, 17 bp, Homo sapiens
tggcatgcttaaatttt

SEQ ID NO: 1669271 - DNA, 18 bp, Homo sapiens
tggcatgcttaaatttta

SEQ ID NO: 1669272 - DNA, 19 bp, Homo sapiens
tggcatggaaggggcttct

SEQ ID NO: 1669273 - DNA, 15 bp, Homo sapiens
tggcatgtctcctca

SEQ ID NO: 1669274 - DNA, 22 bp, Homo sapiens
tggcatgtgctgtgaccattta

SEQ ID NO: 1669275 - DNA, 13 bp, Homo sapiens
tggcatgtggaga

SEQ ID NO: 1669276 - DNA, 16 bp, Homo sapiens
tggcatgtggagacac

SEQ ID NO: 1669277 - DNA, 18 bp, Homo sapiens
tggcatgtggcctgtggc

SEQ ID NO: 1669278 - DNA, 14 bp, Homo sapiens
tggcatgttgattt

SEQ ID NO: 1669279 - DNA, 23 bp, Homo sapiens
tggcattggccagaccacagcag

SEQ ID NO: 1669280 - DNA, 19 bp, Homo sapiens
tggcatttcaattcctggc

SEQ ID NO: 1669281 - DNA, 17 bp, Homo sapiens
tggcatttggtctcagg

SEQ ID NO: 1669282 - DNA, 17 bp, Homo sapiens
tggccaaataggaggga

SEQ ID NO: 1669283 - DNA, 18 bp, Homo sapiens
tggccaacgtggacctgc

SEQ ID NO: 1669284 - DNA, 19 bp, Homo sapiens
tggccaactcaactttcat

SEQ ID NO: 1669285 - DNA, 13 bp, Homo sapiens
tggccaagaagca

SEQ ID NO: 1669286 - DNA, 22 bp, Homo sapiens
tggccaagaagcagtggcctta

SEQ ID NO: 1669287 - DNA, 18 bp, Homo sapiens
tggccaatgcggcccact

SEQ ID NO: 1669288 - DNA, 23 bp, Homo sapiens
tggccacaaggaaaaggaggagg

SEQ ID NO: 1669289 - DNA, 19 bp, Homo sapiens
tggccacaaggacgctggc

SEQ ID NO: 1669290 - DNA, 23 bp, Homo sapiens
tggccacaaggacgctggctact

SEQ ID NO: 1669291 - DNA, 13 bp, Homo sapiens
tggccacagcagg

SEQ ID NO: 1669292 - DNA, 23 bp, Homo sapiens
tggccacagcccccttgccctcc

SEQ ID NO: 1669293 - DNA, 16 bp, Homo sapiens
tggccacatggcggag

SEQ ID NO: 1669294 - DNA, 13 bp, Homo sapiens
tggccaccaggct

SEQ ID NO: 1669295 - DNA, 19 bp, Homo sapiens
tggccaccaggctggcgca

SEQ ID NO: 1669296 - DNA, 22 bp, Homo sapiens
tggccaccaggctggcgcagcc

SEQ ID NO: 1669297 - DNA, 16 bp, Homo sapiens
tggccaccctggcccg

SEQ ID NO: 1669298 - DNA, 14 bp, Homo sapiens
tggccacgcagcca

SEQ ID NO: 1669299 - DNA, 16 bp, Homo sapiens
tggccacgcagccagg

SEQ ID NO: 1669300 - DNA, 17 bp, Homo sapiens
tggccacgcagccagga

SEQ ID NO: 1669301 - DNA, 20 bp, Homo sapiens
tggccacgcagccaggacac

SEQ ID NO: 1669302 - DNA, 19 bp, Homo sapiens
tggccacgggggcagtgtg

SEQ ID NO: 1669303 - DNA, 19 bp, Homo sapiens
tggccactgggtctcactc

SEQ ID NO: 1669304 - DNA, 21 bp, Homo sapiens
tggccactgggtctcactcct

SEQ ID NO: 1669305 - DNA, 21 bp, Homo sapiens
tggccagacacaggtgcctca

SEQ ID NO: 1669306 - DNA, 22 bp, Homo sapiens
tggccagagagggcccagctgt

SEQ ID NO: 1669307 - DNA, 20 bp, Homo sapiens
tggccagagctggaaggcag

SEQ ID NO: 1669308 - DNA, 21 bp, Homo sapiens
tggccagcacaccaagtggct

SEQ ID NO: 1669309 - DNA, 23 bp, Homo sapiens
tggccagcacaccaagtggctgg

SEQ ID NO: 1669310 - DNA, 14 bp, Homo sapiens
tggccagcccggct

SEQ ID NO: 1669311 - DNA, 22 bp, Homo sapiens
tggccaggagcaggcacgggtg

SEQ ID NO: 1669312 - DNA, 22 bp, Homo sapiens
tggccaggagctcttcaggcct

SEQ ID NO: 1669313 - DNA, 23 bp, Homo sapiens
tggccaggagctcttcaggcctc

SEQ ID NO: 1669314 - DNA, 21 bp, Homo sapiens
tggccaggaggttggtgactg

SEQ ID NO: 1669315 - DNA, 19 bp, Homo sapiens
tggccaggcagatctgtgc

SEQ ID NO: 1669316 - DNA, 20 bp, Homo sapiens
tggccaggcagatctgtgcc

SEQ ID NO: 1669317 - DNA, 14 bp, Homo sapiens
tggccaggcaggga

SEQ ID NO: 1669318 - DNA, 14 bp, Homo sapiens
tggccaggccctgg

SEQ ID NO: 1669319 - DNA, 20 bp, Homo sapiens
tggccagggccacgctccag

SEQ ID NO: 1669320 - DNA, 22 bp, Homo sapiens
tggccagggccacgctccagct

SEQ ID NO: 1669321 - DNA, 16 bp, Homo sapiens
tggccaggtggccact

SEQ ID NO: 1669322 - DNA, 22 bp, Homo sapiens
tggccagtaaaatactattgcc

SEQ ID NO: 1669323 - DNA, 16 bp, Homo sapiens
tggccagtcctggtcc

SEQ ID NO: 1669324 - DNA, 20 bp, Homo sapiens
tggccagtcctggtcctggc

SEQ ID NO: 1669325 - DNA, 21 bp, Homo sapiens
tggccagtcctggtcctggct

SEQ ID NO: 1669326 - DNA, 16 bp, Homo sapiens
tggccagtggctggat

SEQ ID NO: 1669327 - DNA, 18 bp, Homo sapiens
tggccagtgtttaaaact

SEQ ID NO: 1669328 - DNA, 16 bp, Homo sapiens
tggccagttatccctt

SEQ ID NO: 1669329 - DNA, 14 bp, Homo sapiens
tggccatagaggcc

SEQ ID NO: 1669330 - DNA, 15 bp, Homo sapiens
tggccatagaggccc

SEQ ID NO: 1669331 - DNA, 17 bp, Homo sapiens
tggccatagaggcccag

SEQ ID NO: 1669332 - DNA, 23 bp, Homo sapiens
tggccatagaggcccaggcacca

SEQ ID NO: 1669333 - DNA, 14 bp, Homo sapiens
tggccatcatttct

SEQ ID NO: 1669334 - DNA, 16 bp, Homo sapiens
tggccatgcaggaggt

SEQ ID NO: 1669335 - DNA, 19 bp, Homo sapiens
tggccatgcaggaggtgga

SEQ ID NO: 1669336 - DNA, 16 bp, Homo sapiens
tggccatggcctctgc

SEQ ID NO: 1669337 - DNA, 13 bp, Homo sapiens
tggccattcttat

SEQ ID NO: 1669338 - DNA, 22 bp, Homo sapiens
tggccatttgctagttctgctg

SEQ ID NO: 1669339 - DNA, 17 bp, Homo sapiens
tggctgttccagactca

SEQ ID NO: 1669340 - DNA, 14 bp, Homo sapiens
tggctgttctggaa

SEQ ID NO: 1669341 - DNA, 20 bp, Homo sapiens
tggctgttggcccctctgct

SEQ ID NO: 1669342 - DNA, 14 bp, Homo sapiens
tggctgtttgagat

SEQ ID NO: 1669343 - DNA, 17 bp, Homo sapiens
tggcttaaagggatgga

SEQ ID NO: 1669344 - DNA, 20 bp, Homo sapiens
tggcttaagtgagcagaaca

SEQ ID NO: 1669345 - DNA, 15 bp, Homo sapiens
tggcttaatcatttt

SEQ ID NO: 1669346 - DNA, 15 bp, Homo sapiens
tggcttaatgtttat

SEQ ID NO: 1669347 - DNA, 20 bp, Homo sapiens
tggcttcagaggcctggcat

SEQ ID NO: 1669348 - DNA, 23 bp, Homo sapiens
tggcttccagaaaaccccagcat

SEQ ID NO: 1669349 - DNA, 20 bp, Homo sapiens
tggcttcccatagtggggcc

SEQ ID NO: 1669350 - DNA, 14 bp, Homo sapiens
tggcttccccactc

SEQ ID NO: 1669351 - DNA, 18 bp, Homo sapiens
tggcttccccactccccc

SEQ ID NO: 1669352 - DNA, 22 bp, Homo sapiens
tggcttcccgctcagccctccc

SEQ ID NO: 1669353 - DNA, 13 bp, Homo sapiens
tggcttccctgga

SEQ ID NO: 1669354 - DNA, 16 bp, Homo sapiens
tggcttcctccgtcca

SEQ ID NO: 1669355 - DNA, 16 bp, Homo sapiens
tggcttctcctgtgac

SEQ ID NO: 1669356 - DNA, 16 bp, Homo sapiens
tggcttctctcttttc

SEQ ID NO: 1669357 - DNA, 22 bp, Homo sapiens
tggcttctctcttttcctcctc

SEQ ID NO: 1669358 - DNA, 15 bp, Homo sapiens
tggcttctgattttt

SEQ ID NO: 1669359 - DNA, 19 bp, Homo sapiens
tggcttctgatttttctct

SEQ ID NO: 1669360 - DNA, 20 bp, Homo sapiens
tggcttctgatttttctctt

SEQ ID NO: 1669361 - DNA, 21 bp, Homo sapiens
tggcttctgatttttctcttt

SEQ ID NO: 1669362 - DNA, 22 bp, Homo sapiens
tggcttctgatttttctctttt

SEQ ID NO: 1669363 - DNA, 16 bp, Homo sapiens
tggcttctgcttgtca

SEQ ID NO: 1669364 - DNA, 17 bp, Homo sapiens
tggcttctgcttgtcat

SEQ ID NO: 1669365 - DNA, 19 bp, Homo sapiens
tggcttctgcttgtcatcc

SEQ ID NO: 1669366 - DNA, 14 bp, Homo sapiens
tggcttctgggaga

SEQ ID NO: 1669367 - DNA, 17 bp, Homo sapiens
tggcttctgtgatgagc

SEQ ID NO: 1669368 - DNA, 22 bp, Homo sapiens
tggcttctgtgcactagcctgt

SEQ ID NO: 1669369 - DNA, 21 bp, Homo sapiens
tggcttgagctagagataaaa

SEQ ID NO: 1669370 - DNA, 20 bp, Homo sapiens
tggcttgccatttttcaaaa

SEQ ID NO: 1669371 - DNA, 15 bp, Homo sapiens
tggcttgctccaggg

SEQ ID NO: 1669372 - DNA, 16 bp, Homo sapiens
tggcttgctccagggt

SEQ ID NO: 1669373 - DNA, 17 bp, Homo sapiens
tggcttgctccagggtc

SEQ ID NO: 1669374 - DNA, 18 bp, Homo sapiens
tggcttgctccagggtct

SEQ ID NO: 1669375 - DNA, 14 bp, Homo sapiens
tggcttggagtggc

SEQ ID NO: 1669376 - DNA, 17 bp, Homo sapiens
tggcttgggcagggtct

SEQ ID NO: 1669377 - DNA, 22 bp, Homo sapiens
tggcttgttattgcctctactt

SEQ ID NO: 1669378 - DNA, 16 bp, Homo sapiens
tggcttgtttgatttc

SEQ ID NO: 1669379 - DNA, 20 bp, Homo sapiens
tggcttgtttgatttcaaca

SEQ ID NO: 1669380 - DNA, 17 bp, Homo sapiens
tggctttaattgtataa

SEQ ID NO: 1669381 - DNA, 16 bp, Homo sapiens
tggctttatgcacatt

SEQ ID NO: 1669382 - DNA, 18 bp, Homo sapiens
tggctttcacatttaaat

SEQ ID NO: 1669383 - DNA, 21 bp, Homo sapiens
tggctttcagagccagcctgg

SEQ ID NO: 1669384 - DNA, 17 bp, Homo sapiens
tggctttctctctggct

SEQ ID NO: 1669385 - DNA, 23 bp, Homo sapiens
tggctttctctctggcttctctc

SEQ ID NO: 1669386 - DNA, 15 bp, Homo sapiens
tggctttgcccaccc

SEQ ID NO: 1669387 - DNA, 17 bp, Homo sapiens
tggctttgcccacccct

SEQ ID NO: 1669388 - DNA, 11 bp, Homo sapiens
tggctttgcct

SEQ ID NO: 1669389 - DNA, 13 bp, Homo sapiens
tggctttgcctct

SEQ ID NO: 1669390 - DNA, 14 bp, Homo sapiens
tggctttgcctctt

SEQ ID NO: 1669391 - DNA, 20 bp, Homo sapiens
tggctttgtgattcaatctg

SEQ ID NO: 1669392 - DNA, 18 bp, Homo sapiens
tggcttttcactgctggc

SEQ ID NO: 1669393 - DNA, 22 bp, Homo sapiens
tggcttttcactgctggctgcc

SEQ ID NO: 1669394 - DNA, 23 bp, Homo sapiens
tggcttttcttacccagattgtg

SEQ ID NO: 1669395 - DNA, 17 bp, Homo sapiens
tggcttttgcctgtaag

SEQ ID NO: 1669396 - DNA, 22 bp, Homo sapiens
tggcttttgctttccctgaagc

SEQ ID NO: 1669397 - DNA, 14 bp, Homo sapiens
tgggaaaacatttg

SEQ ID NO: 1669398 - DNA, 14 bp, Homo sapiens
tgggaaactgcttt

SEQ ID NO: 1669399 - DNA, 17 bp, Homo sapiens
tgggaaagagatttaaa

SEQ ID NO: 1669400 - DNA, 16 bp, Homo sapiens
tgggaaagcattgtaa

SEQ ID NO: 1669401 - DNA, 19 bp, Homo sapiens
tgggaaaggacccacccat

SEQ ID NO: 1669402 - DNA, 20 bp, Homo sapiens
tgggaaatagtctgatttta

SEQ ID NO: 1669403 - DNA, 18 bp, Homo sapiens
tgggaacaaattagagga

SEQ ID NO: 1669404 - DNA, 21 bp, Homo sapiens
tgggaacaaattagaggagac

SEQ ID NO: 1669405 - DNA, 21 bp, Homo sapiens
tgggaacagcatggaggcaga

SEQ ID NO: 1669406 - DNA, 22 bp, Homo sapiens
tgggaacagtaaagaaagcaga

SEQ ID NO: 1669407 - DNA, 22 bp, Homo sapiens
tgggaaccccttcatcctctga

SEQ ID NO: 1669408 - DNA, 23 bp, Homo sapiens
tgggaacggctgatgtggactgt

SEQ ID NO: 1669409 - DNA, 19 bp, Homo sapiens
tgggaactccactctcctt

SEQ ID NO: 1669410 - DNA, 16 bp, Homo sapiens
tgggaactctgacaag

SEQ ID NO: 1669411 - DNA, 22 bp, Homo sapiens
tgggaactctgacaagggctga

SEQ ID NO: 1669412 - DNA, 23 bp, Homo sapiens
tgggaagaaagaatgcaagagtg

SEQ ID NO: 1669413 - DNA, 18 bp, Homo sapiens
tgggaagaattggaagtt

SEQ ID NO: 1669414 - DNA, 13 bp, Homo sapiens
tgggaagacatga

SEQ ID NO: 1669415 - DNA, 23 bp, Homo sapiens
tgggaagaccagctttgcagtga

SEQ ID NO: 1669416 - DNA, 22 bp, Homo sapiens
tgggaagactcaggagtctgcc

SEQ ID NO: 1669417 - DNA, 20 bp, Homo sapiens
tgggaagagcttagaaactg

SEQ ID NO: 1669418 - DNA, 19 bp, Homo sapiens
tgggaagcccatcctgacc

SEQ ID NO: 1669419 - DNA, 16 bp, Homo sapiens
tgggaagcctgtgcca

SEQ ID NO: 1669420 - DNA, 22 bp, Homo sapiens
tgggaagctgtactcagagcag

SEQ ID NO: 1669421 - DNA, 23 bp, Homo sapiens
tgggaagctgtactcagagcaga

SEQ ID NO: 1669422 - DNA, 24 bp, Homo sapiens
tgggaagctgtactcagagcagag

SEQ ID NO: 1669423 - DNA, 17 bp, Homo sapiens
tgggaagcttgagcctc

SEQ ID NO: 1669424 - DNA, 22 bp, Homo sapiens
tgggaaggacttggcgcgccct

SEQ ID NO: 1669425 - DNA, 17 bp, Homo sapiens
tgggaaggagggagctg

SEQ ID NO: 1669426 - DNA, 19 bp, Homo sapiens
tgggaaggagggagctgct

SEQ ID NO: 1669427 - DNA, 19 bp, Homo sapiens
tgggaaggctaagttcagt

SEQ ID NO: 1669428 - DNA, 21 bp, Homo sapiens
tgggaagggagagcggggcag

SEQ ID NO: 1669429 - DNA, 20 bp, Homo sapiens
tgggaaggtttttaagggcc

SEQ ID NO: 1669430 - DNA, 21 bp, Homo sapiens
tgggaaggtttttaagggccg

SEQ ID NO: 1669431 - DNA, 23 bp, Homo sapiens
tgggaagttgcattcctttgtct

SEQ ID NO: 1669432 - DNA, 15 bp, Homo sapiens
tgggaataattgctt

SEQ ID NO: 1669433 - DNA, 16 bp, Homo sapiens
tgggaatgaggaaaat

SEQ ID NO: 1669434 - DNA, 14 bp, Homo sapiens
tgggaatgaggtgg

SEQ ID NO: 1669435 - DNA, 17 bp, Homo sapiens
tgggaatgaggtgggag

SEQ ID NO: 1669436 - DNA, 20 bp, Homo sapiens
tgggaatgttacattgtttg

SEQ ID NO: 1669437 - DNA, 17 bp, Homo sapiens
tgggaattgctggagga

SEQ ID NO: 1669438 - DNA, 14 bp, Homo sapiens
tgggaattgtgtgt

SEQ ID NO: 1669439 - DNA, 14 bp, Homo sapiens
tgggacaccaggga

SEQ ID NO: 1669440 - DNA, 16 bp, Homo sapiens
tgggacacctgggaga

SEQ ID NO: 1669441 - DNA, 16 bp, Homo sapiens
tgggacactgggcagc

SEQ ID NO: 1669442 - DNA, 17 bp, Homo sapiens
tgggacactgggcagca

SEQ ID NO: 1669443 - DNA, 20 bp, Homo sapiens
tgggacactgggcagcaagg

SEQ ID NO: 1669444 - DNA, 14 bp, Homo sapiens
tgggacagcccaga

SEQ ID NO: 1669445 - DNA, 14 bp, Homo sapiens
tgggacagctggct

SEQ ID NO: 1669446 - DNA, 19 bp, Homo sapiens
tgggacagctggctgggcc

SEQ ID NO: 1669447 - DNA, 23 bp, Homo sapiens
tgggaccaaccctggggaaggag

SEQ ID NO: 1669448 - DNA, 15 bp, Homo sapiens
tgggaccagagccag

SEQ ID NO: 1669449 - DNA, 20 bp, Homo sapiens
tgggacccagctactctgtc

SEQ ID NO: 1669450 - DNA, 20 bp, Homo sapiens
tgggacccatagatcttctg

SEQ ID NO: 1669451 - DNA, 17 bp, Homo sapiens
tgggacccccgtggggc

SEQ ID NO: 1669452 - DNA, 16 bp, Homo sapiens
tgggctctcacccagt

SEQ ID NO: 1669453 - DNA, 20 bp, Homo sapiens
tgggctctccacctcagcct

SEQ ID NO: 1669454 - DNA, 23 bp, Homo sapiens
tgggctctgacccaagtggggcc

SEQ ID NO: 1669455 - DNA, 13 bp, Homo sapiens
tgggctctgccac

SEQ ID NO: 1669456 - DNA, 21 bp, Homo sapiens
tgggctctgccccagctctgg

SEQ ID NO: 1669457 - DNA, 23 bp, Homo sapiens
tgggctctgccccagctctggct

SEQ ID NO: 1669458 - DNA, 13 bp, Homo sapiens
tgggctctgcctg

SEQ ID NO: 1669459 - DNA, 13 bp, Homo sapiens
tgggctcttccaa

SEQ ID NO: 1669460 - DNA, 16 bp, Homo sapiens
tgggctgacccagcat

SEQ ID NO: 1669461 - DNA, 18 bp, Homo sapiens
tgggctgacccagcatct

SEQ ID NO: 1669462 - DNA, 12 bp, Homo sapiens
tgggctgagccc

SEQ ID NO: 1669463 - DNA, 18 bp, Homo sapiens
tgggctgagcccctaccc

SEQ ID NO: 1669464 - DNA, 19 bp, Homo sapiens
tgggctgagcccctacccc

SEQ ID NO: 1669465 - DNA, 18 bp, Homo sapiens
tgggctgagccctggcag

SEQ ID NO: 1669466 - DNA, 18 bp, Homo sapiens
tgggctgagtgacacaag

SEQ ID NO: 1669467 - DNA, 21 bp, Homo sapiens
tgggctgatggaagatggtcc

SEQ ID NO: 1669468 - DNA, 16 bp, Homo sapiens
tgggctgcagagtctg

SEQ ID NO: 1669469 - DNA, 15 bp, Homo sapiens
tgggctgccctggtg

SEQ ID NO: 1669470 - DNA, 19 bp, Homo sapiens
tgggctgccctggtgctgc

SEQ ID NO: 1669471 - DNA, 20 bp, Homo sapiens
tgggctgccctggtgctgcc

SEQ ID NO: 1669472 - DNA, 21 bp, Homo sapiens
tgggctgccctggtgctgcca

SEQ ID NO: 1669473 - DNA, 22 bp, Homo sapiens
tgggctgcccttgttgcctgca

SEQ ID NO: 1669474 - DNA, 16 bp, Homo sapiens
tgggctgcctgctgtg

SEQ ID NO: 1669475 - DNA, 18 bp, Homo sapiens
tgggctggaatcaggaat

SEQ ID NO: 1669476 - DNA, 17 bp, Homo sapiens
tgggctggactggccat

SEQ ID NO: 1669477 - DNA, 12 bp, Homo sapiens
tgggctggactt

SEQ ID NO: 1669478 - DNA, 23 bp, Homo sapiens
tgggctggacttctacctgccct

SEQ ID NO: 1669479 - DNA, 14 bp, Homo sapiens
tgggctgggccctc

SEQ ID NO: 1669480 - DNA, 20 bp, Homo sapiens
tgggctgggccctctcttct

SEQ ID NO: 1669481 - DNA, 12 bp, Homo sapiens
tgggctggggct

SEQ ID NO: 1669482 - DNA, 17 bp, Homo sapiens
tgggctggggctgctcc

SEQ ID NO: 1669483 - DNA, 20 bp, Homo sapiens
tgggctggggctgctcccct

SEQ ID NO: 1669484 - DNA, 12 bp, Homo sapiens
tgggctgggttg

SEQ ID NO: 1669485 - DNA, 17 bp, Homo sapiens
tgggctggttgctgtag

SEQ ID NO: 1669486 - DNA, 13 bp, Homo sapiens
tgggctgtagttg

SEQ ID NO: 1669487 - DNA, 20 bp, Homo sapiens
tgggctgtcactgcttgagg

SEQ ID NO: 1669488 - DNA, 15 bp, Homo sapiens
tgggctgtgagtgta

SEQ ID NO: 1669489 - DNA, 21 bp, Homo sapiens
tgggctgtgtcctaaggccca

SEQ ID NO: 1669490 - DNA, 22 bp, Homo sapiens
tgggctgtgtcctaaggcccat

SEQ ID NO: 1669491 - DNA, 23 bp, Homo sapiens
tgggctgttggcactcacagacc

SEQ ID NO: 1669492 - DNA, 13 bp, Homo sapiens
tgggcttcatctg

SEQ ID NO: 1669493 - DNA, 24 bp, Homo sapiens
tgggcttcattccggactggcaga

SEQ ID NO: 1669494 - DNA, 13 bp, Homo sapiens
tgggcttcattct

SEQ ID NO: 1669495 - DNA, 19 bp, Homo sapiens
tgggcttcctgatgatgat

SEQ ID NO: 1669496 - DNA, 14 bp, Homo sapiens
tgggcttgaccagg

SEQ ID NO: 1669497 - DNA, 22 bp, Homo sapiens
tgggcttggacttcctggggcc

SEQ ID NO: 1669498 - DNA, 15 bp, Homo sapiens
tgggcttggcctgct

SEQ ID NO: 1669499 - DNA, 19 bp, Homo sapiens
tgggctttgcaggctctgg

SEQ ID NO: 1669500 - DNA, 21 bp, Homo sapiens
tgggctttgcaggctctgggc

SEQ ID NO: 1669501 - DNA, 21 bp, Homo sapiens
tgggcttttggggagccagaa

SEQ ID NO: 1669502 - DNA, 23 bp, Homo sapiens
tgggcttttggtttgggggcgcc

SEQ ID NO: 1669503 - DNA, 14 bp, Homo sapiens
tggggaaaatggcc

SEQ ID NO: 1669504 - DNA, 21 bp, Homo sapiens
tggggaaaggggtcggctgac

SEQ ID NO: 1669505 - DNA, 22 bp, Homo sapiens
tggggaaaggggtcggctgacc

SEQ ID NO: 1669506 - DNA, 21 bp, Homo sapiens
tggggaactctccctctggtc

SEQ ID NO: 1669507 - DNA, 11 bp, Homo sapiens
tggggaaggag

SEQ ID NO: 1669508 - DNA, 15 bp, Homo sapiens
tggggaaggagccag

SEQ ID NO: 1669509 - DNA, 22 bp, Homo sapiens
tggggaagggttttcttttctt

SEQ ID NO: 1669510 - DNA, 14 bp, Homo sapiens
tggggaatttcctc

SEQ ID NO: 1669511 - DNA, 16 bp, Homo sapiens
tggggacagagggtgt

SEQ ID NO: 1669512 - DNA, 23 bp, Homo sapiens
tggggacagttggcagagaaggc

SEQ ID NO: 1669513 - DNA, 23 bp, Homo sapiens
tggggaccagcagtctgcctgga

SEQ ID NO: 1669514 - DNA, 22 bp, Homo sapiens
tggggacgaattccactcgtcc

SEQ ID NO: 1669515 - DNA, 17 bp, Homo sapiens
tggggactcaggaccag

SEQ ID NO: 1669516 - DNA, 14 bp, Homo sapiens
tggggactgctacc

SEQ ID NO: 1669517 - DNA, 16 bp, Homo sapiens
tggggacttgtgtctg

SEQ ID NO: 1669518 - DNA, 15 bp, Homo sapiens
tggggagcagctgag

SEQ ID NO: 1669519 - DNA, 16 bp, Homo sapiens
tggggagccaacagaa

SEQ ID NO: 1669520 - DNA, 21 bp, Homo sapiens
tggggaggcccaaatgatgga

SEQ ID NO: 1669521 - DNA, 12 bp, Homo sapiens
tggggaggctga

SEQ ID NO: 1669522 - DNA, 21 bp, Homo sapiens
tggggagggatgaagggcgag

SEQ ID NO: 1669523 - DNA, 22 bp, Homo sapiens
tggggagggattctggttccag

SEQ ID NO: 1669524 - DNA, 19 bp, Homo sapiens
tggggaggggcggcaggag

SEQ ID NO: 1669525 - DNA, 14 bp, Homo sapiens
tggggaggggtgga

SEQ ID NO: 1669526 - DNA, 17 bp, Homo sapiens
tggggataaaggagaag

SEQ ID NO: 1669527 - DNA, 18 bp, Homo sapiens
tggggataataatactga

SEQ ID NO: 1669528 - DNA, 20 bp, Homo sapiens
tggggatagatgtgtggaca

SEQ ID NO: 1669529 - DNA, 17 bp, Homo sapiens
tggggatcaattttcat

SEQ ID NO: 1669530 - DNA, 21 bp, Homo sapiens
tggggatccccgcctggccag

SEQ ID NO: 1669531 - DNA, 22 bp, Homo sapiens
tggggatccccgcctggccagg

SEQ ID NO: 1669532 - DNA, 20 bp, Homo sapiens
tggggatccctcccccccat

SEQ ID NO: 1669533 - DNA, 21 bp, Homo sapiens
tggggatcttcccacaggagg

SEQ ID NO: 1669534 - DNA, 15 bp, Homo sapiens
tggggattgcccctg

SEQ ID NO: 1669535 - DNA, 15 bp, Homo sapiens
tggggattgtacacg

SEQ ID NO: 1669536 - DNA, 13 bp, Homo sapiens
tggggcagaagag

SEQ ID NO: 1669537 - DNA, 14 bp, Homo sapiens
tggggcagacacaa

SEQ ID NO: 1669538 - DNA, 14 bp, Homo sapiens
tggggcagaggggc

SEQ ID NO: 1669539 - DNA, 16 bp, Homo sapiens
tggggcagaggggcag

SEQ ID NO: 1669540 - DNA, 17 bp, Homo sapiens
tggggcagaggggcagc

SEQ ID NO: 1669541 - DNA, 23 bp, Homo sapiens
tggggcaggagtgccaggaccag

SEQ ID NO: 1669542 - DNA, 17 bp, Homo sapiens
tggggcaggctggctgg

SEQ ID NO: 1669543 - DNA, 14 bp, Homo sapiens
tggggcaggctggg

SEQ ID NO: 1669544 - DNA, 17 bp, Homo sapiens
tggggcaggctgggcca

SEQ ID NO: 1669545 - DNA, 12 bp, Homo sapiens
tggggcagggag

SEQ ID NO: 1669546 - DNA, 14 bp, Homo sapiens
tggggcagggagct

SEQ ID NO: 1669547 - DNA, 21 bp, Homo sapiens
tggggcagggagctgggcccg

SEQ ID NO: 1669548 - DNA, 13 bp, Homo sapiens
tggggcagggcct

SEQ ID NO: 1669549 - DNA, 17 bp, Homo sapiens
tggggcatcctgtgcca

SEQ ID NO: 1669550 - DNA, 21 bp, Homo sapiens
tggggcatggttccttccctg

SEQ ID NO: 1669551 - DNA, 23 bp, Homo sapiens
tggggcatggttccttccctggg

SEQ ID NO: 1669552 - DNA, 14 bp, Homo sapiens
tggggcatgtcctt

SEQ ID NO: 1669553 - DNA, 21 bp, Homo sapiens
tggggccaccaaagctgccca

SEQ ID NO: 1669554 - DNA, 19 bp, Homo sapiens
tggggccactttcagagcc

SEQ ID NO: 1669555 - DNA, 18 bp, Homo sapiens
tggggccagatccagcct

SEQ ID NO: 1669556 - DNA, 20 bp, Homo sapiens
tggggccagatccagcctgg

SEQ ID NO: 1669557 - DNA, 11 bp, Homo sapiens
tggggccagga

SEQ ID NO: 1669558 - DNA, 12 bp, Homo sapiens
tggggcccagtg

SEQ ID NO: 1669559 - DNA, 14 bp, Homo sapiens
tggggcccagtgca

SEQ ID NO: 1669560 - DNA, 16 bp, Homo sapiens
tggggccccgctggga

SEQ ID NO: 1669561 - DNA, 20 bp, Homo sapiens
tggggccctcagctcctggg

SEQ ID NO: 1669562 - DNA, 14 bp, Homo sapiens
tggggccctgcccc

SEQ ID NO: 1669563 - DNA, 15 bp, Homo sapiens
tggggccctgcccct

SEQ ID NO: 1669564 - DNA, 17 bp, Homo sapiens
tggggcccttgggccac

SEQ ID NO: 1669565 - DNA, 15 bp, Homo sapiens
tggggccggagcctt

SEQ ID NO: 1669566 - DNA, 17 bp, Homo sapiens
tggtgcatagcagatgg

SEQ ID NO: 1669567 - DNA, 20 bp, Homo sapiens
tggtgcataggtctggaagg

SEQ ID NO: 1669568 - DNA, 17 bp, Homo sapiens
tggtgcatgcagttgat

SEQ ID NO: 1669569 - DNA, 18 bp, Homo sapiens
tggtgccaaatagcccca

SEQ ID NO: 1669570 - DNA, 20 bp, Homo sapiens
tggtgccaaatagccccaga

SEQ ID NO: 1669571 - DNA, 22 bp, Homo sapiens
tggtgccaaatagccccagact

SEQ ID NO: 1669572 - DNA, 23 bp, Homo sapiens
tggtgccaaatagccccagactg

SEQ ID NO: 1669573 - DNA, 21 bp, Homo sapiens
tggtgccaaatgaagattttt

SEQ ID NO: 1669574 - DNA, 15 bp, Homo sapiens
tggtgccaatttcaa

SEQ ID NO: 1669575 - DNA, 17 bp, Homo sapiens
tggtgccagagaggggc

SEQ ID NO: 1669576 - DNA, 13 bp, Homo sapiens
tggtgccagcctt

SEQ ID NO: 1669577 - DNA, 21 bp, Homo sapiens
tggtgccatccccagggggca

SEQ ID NO: 1669578 - DNA, 16 bp, Homo sapiens
tggtgccccacctgcc

SEQ ID NO: 1669579 - DNA, 22 bp, Homo sapiens
tggtgccccacctgcctggtgc

SEQ ID NO: 1669580 - DNA, 13 bp, Homo sapiens
tggtgccccagga

SEQ ID NO: 1669581 - DNA, 19 bp, Homo sapiens
tggtgccccaggaccagct

SEQ ID NO: 1669582 - DNA, 20 bp, Homo sapiens
tggtgccccaggaccagctc

SEQ ID NO: 1669583 - DNA, 23 bp, Homo sapiens
tggtgccccaggaccagctcagg

SEQ ID NO: 1669584 - DNA, 16 bp, Homo sapiens
tggtgccccccacccc

SEQ ID NO: 1669585 - DNA, 18 bp, Homo sapiens
tggtgccctggaacactc

SEQ ID NO: 1669586 - DNA, 17 bp, Homo sapiens
tggtgcctatatctgag

SEQ ID NO: 1669587 - DNA, 18 bp, Homo sapiens
tggtgcctatatctgaga

SEQ ID NO: 1669588 - DNA, 15 bp, Homo sapiens
tggtgcctgagaggc

SEQ ID NO: 1669589 - DNA, 17 bp, Homo sapiens
tggtgcctgagaggcag

SEQ ID NO: 1669590 - DNA, 14 bp, Homo sapiens
tggtgcctgccacc

SEQ ID NO: 1669591 - DNA, 14 bp, Homo sapiens
tggtgcctggcctg

SEQ ID NO: 1669592 - DNA, 19 bp, Homo sapiens
tggtgcctggcctggcaca

SEQ ID NO: 1669593 - DNA, 23 bp, Homo sapiens
tggtgcctggcctggcacacatc

SEQ ID NO: 1669594 - DNA, 15 bp, Homo sapiens
tggtgcgacccccca

SEQ ID NO: 1669595 - DNA, 22 bp, Homo sapiens
tggtgcgtttataattggctta

SEQ ID NO: 1669596 - DNA, 15 bp, Homo sapiens
tggtgctgcccaggc

SEQ ID NO: 1669597 - DNA, 14 bp, Homo sapiens
tggtgctgctcagg

SEQ ID NO: 1669598 - DNA, 20 bp, Homo sapiens
tggtgctggggagccaaagg

SEQ ID NO: 1669599 - DNA, 23 bp, Homo sapiens
tggtgctgtcttttgttctctga

SEQ ID NO: 1669600 - DNA, 13 bp, Homo sapiens
tggtgctgtgtgc

SEQ ID NO: 1669601 - DNA, 17 bp, Homo sapiens
tggtgctgtgtgcccca

SEQ ID NO: 1669602 - DNA, 19 bp, Homo sapiens
tggtgctgtgtgccccact

SEQ ID NO: 1669603 - DNA, 13 bp, Homo sapiens
tggtgcttccccc

SEQ ID NO: 1669604 - DNA, 16 bp, Homo sapiens
tggtggacagtcctgg

SEQ ID NO: 1669605 - DNA, 18 bp, Homo sapiens
tggtggacagtcctggga

SEQ ID NO: 1669606 - DNA, 15 bp, Homo sapiens
tggtggagccagggc

SEQ ID NO: 1669607 - DNA, 19 bp, Homo sapiens
tggtggcaacattcattgc

SEQ ID NO: 1669608 - DNA, 15 bp, Homo sapiens
tggtggcacaggccc

SEQ ID NO: 1669609 - DNA, 17 bp, Homo sapiens
tggtggcactgagcccc

SEQ ID NO: 1669610 - DNA, 17 bp, Homo sapiens
tggtggcagtggaggtg

SEQ ID NO: 1669611 - DNA, 19 bp, Homo sapiens
tggtggccctgtgcctggg

SEQ ID NO: 1669612 - DNA, 16 bp, Homo sapiens
tggtggccgcccaccc

SEQ ID NO: 1669613 - DNA, 22 bp, Homo sapiens
tggtggcgctttctcctgtgcc

SEQ ID NO: 1669614 - DNA, 14 bp, Homo sapiens
tggtggctcatgcc

SEQ ID NO: 1669615 - DNA, 20 bp, Homo sapiens
tggtggctccccctctgctt

SEQ ID NO: 1669616 - DNA, 20 bp, Homo sapiens
tggtggctttttttaaaatt

SEQ ID NO: 1669617 - DNA, 22 bp, Homo sapiens
tggtgggacactgggcagcaag

SEQ ID NO: 1669618 - DNA, 23 bp, Homo sapiens
tggtgggccaacaaagaacacta

SEQ ID NO: 1669619 - DNA, 15 bp, Homo sapiens
tggtggggaggggcg

SEQ ID NO: 1669620 - DNA, 20 bp, Homo sapiens
tggtggggaggggcgctggc

SEQ ID NO: 1669621 - DNA, 19 bp, Homo sapiens
tggtgggtaattgtacaat

SEQ ID NO: 1669622 - DNA, 21 bp, Homo sapiens
tggtgggtaattgtacaataa

SEQ ID NO: 1669623 - DNA, 21 bp, Homo sapiens
tggtgggttcaggggactcag

SEQ ID NO: 1669624 - DNA, 18 bp, Homo sapiens
tggtggtactttattctt

SEQ ID NO: 1669625 - DNA, 22 bp, Homo sapiens
tggtggtactttattcttgctg

SEQ ID NO: 1669626 - DNA, 18 bp, Homo sapiens
tggtggttaaggccaggg

SEQ ID NO: 1669627 - DNA, 20 bp, Homo sapiens
tggtggttaaggccagggcc

SEQ ID NO: 1669628 - DNA, 18 bp, Homo sapiens
tggtggttattttaaata

SEQ ID NO: 1669629 - DNA, 17 bp, Homo sapiens
tggtgtaatttgaagat

SEQ ID NO: 1669630 - DNA, 21 bp, Homo sapiens
tggtgtagaacactaattcat

SEQ ID NO: 1669631 - DNA, 15 bp, Homo sapiens
tggtgtagctgtcct

SEQ ID NO: 1669632 - DNA, 19 bp, Homo sapiens
tggtgtcagaccctggagg

SEQ ID NO: 1669633 - DNA, 14 bp, Homo sapiens
tggtgtcaggcagg

SEQ ID NO: 1669634 - DNA, 22 bp, Homo sapiens
tggtgtgaacccgggaggcaga

SEQ ID NO: 1669635 - DNA, 20 bp, Homo sapiens
tggtgtgccaagacattaat

SEQ ID NO: 1669636 - DNA, 17 bp, Homo sapiens
tggtgtgtccctggaca

SEQ ID NO: 1669637 - DNA, 18 bp, Homo sapiens
tggtgtgtccctggacac

SEQ ID NO: 1669638 - DNA, 20 bp, Homo sapiens
tggtgtgtccctggacacag

SEQ ID NO: 1669639 - DNA, 22 bp, Homo sapiens
tggtgtgtccctggacacagct

SEQ ID NO: 1669640 - DNA, 21 bp, Homo sapiens
tggtgttacacagcccaagag

SEQ ID NO: 1669641 - DNA, 14 bp, Homo sapiens
tggtgttcctggaa

SEQ ID NO: 1669642 - DNA, 20 bp, Homo sapiens
tggtgttcgtttccatcatg

SEQ ID NO: 1669643 - DNA, 16 bp, Homo sapiens
tggttaaaaacctgcc

SEQ ID NO: 1669644 - DNA, 16 bp, Homo sapiens
tggttaaaaaggccaa

SEQ ID NO: 1669645 - DNA, 21 bp, Homo sapiens
tggttaaaaaggccaaagata

SEQ ID NO: 1669646 - DNA, 20 bp, Homo sapiens
tggttaaaataaagcctatt

SEQ ID NO: 1669647 - DNA, 16 bp, Homo sapiens
tggttaaattaacatt

SEQ ID NO: 1669648 - DNA, 18 bp, Homo sapiens
tggttaaccctctcttga

SEQ ID NO: 1669649 - DNA, 17 bp, Homo sapiens
tggttaagagtccaaga

SEQ ID NO: 1669650 - DNA, 22 bp, Homo sapiens
tggttaatttttcctgcatgtt

SEQ ID NO: 1669651 - DNA, 19 bp, Homo sapiens
tggttacagtgcagacagg

SEQ ID NO: 1669652 - DNA, 21 bp, Homo sapiens
tggttacttcttctcttagat

SEQ ID NO: 1669653 - DNA, 14 bp, Homo sapiens
tggttagaaatgca

SEQ ID NO: 1669654 - DNA, 21 bp, Homo sapiens
tggttattttaaatataaata

SEQ ID NO: 1669655 - DNA, 13 bp, Homo sapiens
tggttatttttct

SEQ ID NO: 1669656 - DNA, 24 bp, Homo sapiens
tggttatttttctcttgtaccata

SEQ ID NO: 1669657 - DNA, 20 bp, Homo sapiens
tggttcaaacgggtgcctgg

SEQ ID NO: 1669658 - DNA, 19 bp, Homo sapiens
tggttcacctgtgactcct

SEQ ID NO: 1669659 - DNA, 16 bp, Homo sapiens
tggttcatgcagacaa

SEQ ID NO: 1669660 - DNA, 17 bp, Homo sapiens
tggttcatgcagacaaa

SEQ ID NO: 1669661 - DNA, 20 bp, Homo sapiens
tggttccaagtctttgctat

SEQ ID NO: 1669662 - DNA, 20 bp, Homo sapiens
tggttccatgcagccttggg

SEQ ID NO: 1669663 - DNA, 20 bp, Homo sapiens
tggttcccaataaaagtgac

SEQ ID NO: 1669664 - DNA, 11 bp, Homo sapiens
tggttcccctg

SEQ ID NO: 1669665 - DNA, 18 bp, Homo sapiens
tggttcccctgttcactc

SEQ ID NO: 1669666 - DNA, 23 bp, Homo sapiens
tggttcccctgttcactctactt

SEQ ID NO: 1669667 - DNA, 18 bp, Homo sapiens
tggttcccgtttctccac

SEQ ID NO: 1669668 - DNA, 20 bp, Homo sapiens
tggttcccgtttctccacct

SEQ ID NO: 1669669 - DNA, 19 bp, Homo sapiens
tggttcctgctgtcctggt

SEQ ID NO: 1669670 - DNA, 16 bp, Homo sapiens
tggttccttctctggg

SEQ ID NO: 1669671 - DNA, 16 bp, Homo sapiens
tggttcgtgctgtgct

SEQ ID NO: 1669672 - DNA, 17 bp, Homo sapiens
tggttcgtgctgtgctc

SEQ ID NO: 1669673 - DNA, 21 bp, Homo sapiens
tggttcgtgctgtgctctggc

SEQ ID NO: 1669674 - DNA, 17 bp, Homo sapiens
tggttctaaggacctga

SEQ ID NO: 1669675 - DNA, 15 bp, Homo sapiens
tggttctatgctaaa

SEQ ID NO: 1669676 - DNA, 15 bp, Homo sapiens
tggttctcatctttc

SEQ ID NO: 1669677 - DNA, 14 bp, Homo sapiens
tggttctcatttgg

SEQ ID NO: 1669678 - DNA, 22 bp, Homo sapiens
tggttctcatttggtctgccag

SEQ ID NO: 1669679 - DNA, 21 bp, Homo sapiens
tgtacacagtgggaagatttt

SEQ ID NO: 1669680 - DNA, 13 bp, Homo sapiens
tgtacacattaag

SEQ ID NO: 1669681 - DNA, 17 bp, Homo sapiens
tgtacactgaatattta

SEQ ID NO: 1669682 - DNA, 17 bp, Homo sapiens
tgtacactgacttgaga

SEQ ID NO: 1669683 - DNA, 15 bp, Homo sapiens
tgtacagaatatttc

SEQ ID NO: 1669684 - DNA, 18 bp, Homo sapiens
tgtacagaattctgctac

SEQ ID NO: 1669685 - DNA, 21 bp, Homo sapiens
tgtacagaattctgctacctc

SEQ ID NO: 1669686 - DNA, 20 bp, Homo sapiens
tgtacagaccacctttcaca

SEQ ID NO: 1669687 - DNA, 21 bp, Homo sapiens
tgtacagactgttttactgtt

SEQ ID NO: 1669688 - DNA, 19 bp, Homo sapiens
tgtacagatgaatgataaa

SEQ ID NO: 1669689 - DNA, 14 bp, Homo sapiens
tgtacagattcttt

SEQ ID NO: 1669690 - DNA, 18 bp, Homo sapiens
tgtacagattctttcagt

SEQ ID NO: 1669691 - DNA, 19 bp, Homo sapiens
tgtacagattctttcagtt

SEQ ID NO: 1669692 - DNA, 15 bp, Homo sapiens
tgtacagtctgtcat

SEQ ID NO: 1669693 - DNA, 17 bp, Homo sapiens
tgtacagtgtgtaaagt

SEQ ID NO: 1669694 - DNA, 11 bp, Homo sapiens
tgtacataaaa

SEQ ID NO: 1669695 - DNA, 18 bp, Homo sapiens
tgtacataaaagaatttt

SEQ ID NO: 1669696 - DNA, 21 bp, Homo sapiens
tgtacataccctggccgcccc

SEQ ID NO: 1669697 - DNA, 18 bp, Homo sapiens
tgtacatacgatttaagg

SEQ ID NO: 1669698 - DNA, 17 bp, Homo sapiens
tgtacatagtaaagtat

SEQ ID NO: 1669699 - DNA, 20 bp, Homo sapiens
tgtacatagtaaagtatttt

SEQ ID NO: 1669700 - DNA, 15 bp, Homo sapiens
tgtacatatatgtat

SEQ ID NO: 1669701 - DNA, 17 bp, Homo sapiens
tgtacatatatgtataa

SEQ ID NO: 1669702 - DNA, 18 bp, Homo sapiens
tgtacatatgtaaaataa

SEQ ID NO: 1669703 - DNA, 14 bp, Homo sapiens
tgtacatgtattaa

SEQ ID NO: 1669704 - DNA, 20 bp, Homo sapiens
tgtacatgtgtagcctgtgc

SEQ ID NO: 1669705 - DNA, 21 bp, Homo sapiens
tgtacatgtgtagcctgtgca

SEQ ID NO: 1669706 - DNA, 14 bp, Homo sapiens
tgtacatgttcctg

SEQ ID NO: 1669707 - DNA, 21 bp, Homo sapiens
tgtacatgttcgggtgtgggt

SEQ ID NO: 1669708 - DNA, 13 bp, Homo sapiens
tgtacattacact

SEQ ID NO: 1669709 - DNA, 14 bp, Homo sapiens
tgtacattacacta

SEQ ID NO: 1669710 - DNA, 14 bp, Homo sapiens
tgtacatttaaaat

SEQ ID NO: 1669711 - DNA, 12 bp, Homo sapiens
tgtacatttcta

SEQ ID NO: 1669712 - DNA, 21 bp, Homo sapiens
tgtacatttctataaatagat

SEQ ID NO: 1669713 - DNA, 20 bp, Homo sapiens
tgtacatttttaaattctta

SEQ ID NO: 1669714 - DNA, 12 bp, Homo sapiens
tgtaccagttaa

SEQ ID NO: 1669715 - DNA, 15 bp, Homo sapiens
tgtaccagttaattt

SEQ ID NO: 1669716 - DNA, 21 bp, Homo sapiens
tgtaccagttaatttttccaa

SEQ ID NO: 1669717 - DNA, 22 bp, Homo sapiens
tgtaccagttaatttttccaac

SEQ ID NO: 1669718 - DNA, 23 bp, Homo sapiens
tgtaccagttaatttttccaact

SEQ ID NO: 1669719 - DNA, 14 bp, Homo sapiens
tgtacccagctcct

SEQ ID NO: 1669720 - DNA, 16 bp, Homo sapiens
tgtacccgagcacata

SEQ ID NO: 1669721 - DNA, 22 bp, Homo sapiens
tgtacccttccacctcctagag

SEQ ID NO: 1669722 - DNA, 17 bp, Homo sapiens
tgtaccgcccggcagcc

SEQ ID NO: 1669723 - DNA, 20 bp, Homo sapiens
tgtaccgcccggcagcccct

SEQ ID NO: 1669724 - DNA, 20 bp, Homo sapiens
tgtacctcctctcagtgttt

SEQ ID NO: 1669725 - DNA, 19 bp, Homo sapiens
tgtacctcgggtgggaggg

SEQ ID NO: 1669726 - DNA, 20 bp, Homo sapiens
tgtaccttaagatattgaag

SEQ ID NO: 1669727 - DNA, 15 bp, Homo sapiens
tgtaccttgaccatc

SEQ ID NO: 1669728 - DNA, 21 bp, Homo sapiens
tgtaccttttgaggagcccca

SEQ ID NO: 1669729 - DNA, 22 bp, Homo sapiens
tgtaccttttgaggagccccag

SEQ ID NO: 1669730 - DNA, 14 bp, Homo sapiens
tgtacgaagagtat

SEQ ID NO: 1669731 - DNA, 15 bp, Homo sapiens
tgtacgctgctgcag

SEQ ID NO: 1669732 - DNA, 14 bp, Homo sapiens
tgtactaaacagta

SEQ ID NO: 1669733 - DNA, 19 bp, Homo sapiens
tgtactaagaatgtcctta

SEQ ID NO: 1669734 - DNA, 21 bp, Homo sapiens
tgtactactcctaattattgt

SEQ ID NO: 1669735 - DNA, 19 bp, Homo sapiens
tgtactataagtagttggt

SEQ ID NO: 1669736 - DNA, 15 bp, Homo sapiens
tgtactatgtctgaa

SEQ ID NO: 1669737 - DNA, 15 bp, Homo sapiens
tgtactattgcagac

SEQ ID NO: 1669738 - DNA, 14 bp, Homo sapiens
tgtactatttaact

SEQ ID NO: 1669739 - DNA, 15 bp, Homo sapiens
tgtactatttaactg

SEQ ID NO: 1669740 - DNA, 11 bp, Homo sapiens
tgtactcacat

SEQ ID NO: 1669741 - DNA, 20 bp, Homo sapiens
tgtactcacatataacatgc

SEQ ID NO: 1669742 - DNA, 12 bp, Homo sapiens
tgtactccagcc

SEQ ID NO: 1669743 - DNA, 15 bp, Homo sapiens
tgtactccagcctgg

SEQ ID NO: 1669744 - DNA, 20 bp, Homo sapiens
tgtactgaaaaatggtaatt

SEQ ID NO: 1669745 - DNA, 14 bp, Homo sapiens
tgtactgaattttt

SEQ ID NO: 1669746 - DNA, 12 bp, Homo sapiens
tgtactgcaaag

SEQ ID NO: 1669747 - DNA, 16 bp, Homo sapiens
tgtactgcatgtgact

SEQ ID NO: 1669748 - DNA, 18 bp, Homo sapiens
tgtactgcatgtgacttc

SEQ ID NO: 1669749 - DNA, 18 bp, Homo sapiens
tgtactggtaattgtaca

SEQ ID NO: 1669750 - DNA, 15 bp, Homo sapiens
tgtactgttctgtgt

SEQ ID NO: 1669751 - DNA, 19 bp, Homo sapiens
tgtactgttgctttaatat

SEQ ID NO: 1669752 - DNA, 18 bp, Homo sapiens
tgtactgttttctgggcc

SEQ ID NO: 1669753 - DNA, 15 bp, Homo sapiens
tgtacttaactattc

SEQ ID NO: 1669754 - DNA, 20 bp, Homo sapiens
tgtacttaataaattcagat

SEQ ID NO: 1669755 - DNA, 20 bp, Homo sapiens
tgtacttagccagttcaaag

SEQ ID NO: 1669756 - DNA, 17 bp, Homo sapiens
tgtacttcctgtgtact

SEQ ID NO: 1669757 - DNA, 19 bp, Homo sapiens
tgtacttcctgtgtactct

SEQ ID NO: 1669758 - DNA, 21 bp, Homo sapiens
tgtacttcgtcttctaatttc

SEQ ID NO: 1669759 - DNA, 12 bp, Homo sapiens
tgtacttctctg

SEQ ID NO: 1669760 - DNA, 19 bp, Homo sapiens
tgtacttctgtgttcattt

SEQ ID NO: 1669761 - DNA, 18 bp, Homo sapiens
tgtacttcttattgcaag

SEQ ID NO: 1669762 - DNA, 16 bp, Homo sapiens
tgtacttcttgaatat

SEQ ID NO: 1669763 - DNA, 22 bp, Homo sapiens
tgtacttggagtattggggtct

SEQ ID NO: 1669764 - DNA, 14 bp, Homo sapiens
tgtacttgtttgca

SEQ ID NO: 1669765 - DNA, 20 bp, Homo sapiens
tgtactttatttttctgata

SEQ ID NO: 1669766 - DNA, 19 bp, Homo sapiens
tgtactttctaagagaaag

SEQ ID NO: 1669767 - DNA, 12 bp, Homo sapiens
tgtactttctgt

SEQ ID NO: 1669768 - DNA, 12 bp, Homo sapiens
tgtacttttcat

SEQ ID NO: 1669769 - DNA, 13 bp, Homo sapiens
tgtacttttcatt

SEQ ID NO: 1669770 - DNA, 17 bp, Homo sapiens
tgtacttttcattctct

SEQ ID NO: 1669771 - DNA, 21 bp, Homo sapiens
tgtactttttagtaatttctt

SEQ ID NO: 1669772 - DNA, 15 bp, Homo sapiens
tgtactttttccaga

SEQ ID NO: 1669773 - DNA, 12 bp, Homo sapiens
tgtagaaaaggt

SEQ ID NO: 1669774 - DNA, 20 bp, Homo sapiens
tgtagaaaatgaggaaatgc

SEQ ID NO: 1669775 - DNA, 21 bp, Homo sapiens
tgtagaaacacagttttgaaa

SEQ ID NO: 1669776 - DNA, 18 bp, Homo sapiens
tgtagaaacttaaacaca

SEQ ID NO: 1669777 - DNA, 18 bp, Homo sapiens
tgtagaacactaattcat

SEQ ID NO: 1669778 - DNA, 19 bp, Homo sapiens
tgtagaacactaattcata

SEQ ID NO: 1669779 - DNA, 17 bp, Homo sapiens
tgtagaatgatttcatg

SEQ ID NO: 1669780 - DNA, 18 bp, Homo sapiens
tgtagaattgaaaatgca

SEQ ID NO: 1669781 - DNA, 15 bp, Homo sapiens
tgtagaattgtatat

SEQ ID NO: 1669782 - DNA, 16 bp, Homo sapiens
tgtagacaaagtacat

SEQ ID NO: 1669783 - DNA, 18 bp, Homo sapiens
tgtagacagatatttcaa

SEQ ID NO: 1669784 - DNA, 11 bp, Homo sapiens
tgtagactagt

SEQ ID NO: 1669785 - DNA, 23 bp, Homo sapiens
tgtagacttcctttataatattt

SEQ ID NO: 1669786 - DNA, 21 bp, Homo sapiens
tgtagacttctggttgtattt

SEQ ID NO: 1669787 - DNA, 21 bp, Homo sapiens
tgtagagacgaggtcttgtga

SEQ ID NO: 1669788 - DNA, 17 bp, Homo sapiens
tgtagagcaagccagtg

SEQ ID NO: 1669789 - DNA, 14 bp, Homo sapiens
tgtagagttgctga

SEQ ID NO: 1669790 - DNA, 15 bp, Homo sapiens
tgtagagttgctgag

SEQ ID NO: 1669791 - DNA, 16 bp, Homo sapiens
tgtagatggcgatgtg

SEQ ID NO: 1669792 - DNA, 17 bp, Homo sapiens
tgtagatggcgatgtgt

SEQ ID NO: 1669793 - DNA, 20 bp, Homo sapiens
tgtagatgggggaactgtga

SEQ ID NO: 1669794 - DNA, 18 bp, Homo sapiens
tgtattttattattttct

SEQ ID NO: 1669795 - DNA, 18 bp, Homo sapiens
tgtattttatttagacaa

SEQ ID NO: 1669796 - DNA, 20 bp, Homo sapiens
tgtattttcgggattctttg

SEQ ID NO: 1669797 - DNA, 19 bp, Homo sapiens
tgtattttcttttatatct

SEQ ID NO: 1669798 - DNA, 22 bp, Homo sapiens
tgtattttgcatactcaaggtg

SEQ ID NO: 1669799 - DNA, 22 bp, Homo sapiens
tgtattttgtaaataataaaat

SEQ ID NO: 1669800 - DNA, 21 bp, Homo sapiens
tgtattttttaaaattgattt

SEQ ID NO: 1669801 - DNA, 17 bp, Homo sapiens
tgtattttttaaagcta

SEQ ID NO: 1669802 - DNA, 22 bp, Homo sapiens
tgtattttttatttacatttta

SEQ ID NO: 1669803 - DNA, 15 bp, Homo sapiens
tgtcaaaataatttt

SEQ ID NO: 1669804 - DNA, 18 bp, Homo sapiens
tgtcaaactgtagaaatg

SEQ ID NO: 1669805 - DNA, 14 bp, Homo sapiens
tgtcaaagaagctt

SEQ ID NO: 1669806 - DNA, 16 bp, Homo sapiens
tgtcaaagatatgtta

SEQ ID NO: 1669807 - DNA, 12 bp, Homo sapiens
tgtcaaatgttt

SEQ ID NO: 1669808 - DNA, 18 bp, Homo sapiens
tgtcaaatgtttccttaa

SEQ ID NO: 1669809 - DNA, 15 bp, Homo sapiens
tgtcaacccctctca

SEQ ID NO: 1669810 - DNA, 20 bp, Homo sapiens
tgtcaacttcccatctggct

SEQ ID NO: 1669811 - DNA, 18 bp, Homo sapiens
tgtcaagctgctctgagc

SEQ ID NO: 1669812 - DNA, 16 bp, Homo sapiens
tgtcaaggaagacttt

SEQ ID NO: 1669813 - DNA, 15 bp, Homo sapiens
tgtcaaggtgaagca

SEQ ID NO: 1669814 - DNA, 16 bp, Homo sapiens
tgtcaagtctctgctg

SEQ ID NO: 1669815 - DNA, 18 bp, Homo sapiens
tgtcaagtctctgctggc

SEQ ID NO: 1669816 - DNA, 20 bp, Homo sapiens
tgtcaagttaacaaggaatg

SEQ ID NO: 1669817 - DNA, 18 bp, Homo sapiens
tgtcaataaacaacagct

SEQ ID NO: 1669818 - DNA, 23 bp, Homo sapiens
tgtcaataaacagcttcatgcct

SEQ ID NO: 1669819 - DNA, 14 bp, Homo sapiens
tgtcaatattaaat

SEQ ID NO: 1669820 - DNA, 18 bp, Homo sapiens
tgtcaatattaaatacag

SEQ ID NO: 1669821 - DNA, 23 bp, Homo sapiens
tgtcaatattaaatacagacact

SEQ ID NO: 1669822 - DNA, 17 bp, Homo sapiens
tgtcaatatttagtaaa

SEQ ID NO: 1669823 - DNA, 19 bp, Homo sapiens
tgtcaattcataaaaacaa

SEQ ID NO: 1669824 - DNA, 16 bp, Homo sapiens
tgtcaatttgtatatc

SEQ ID NO: 1669825 - DNA, 18 bp, Homo sapiens
tgtcaatttgtatatcat

SEQ ID NO: 1669826 - DNA, 22 bp, Homo sapiens
tgtcaatttgtatatcatgaaa

SEQ ID NO: 1669827 - DNA, 19 bp, Homo sapiens
tgtcacaaattgatcaaga

SEQ ID NO: 1669828 - DNA, 17 bp, Homo sapiens
tgtcacaacctctctga

SEQ ID NO: 1669829 - DNA, 22 bp, Homo sapiens
tgtcacaagtggtgtttattgc

SEQ ID NO: 1669830 - DNA, 13 bp, Homo sapiens
tgtcacaataaat

SEQ ID NO: 1669831 - DNA, 14 bp, Homo sapiens
tgtcacaatcctaa

SEQ ID NO: 1669832 - DNA, 19 bp, Homo sapiens
tgtcacaatcctaacacat

SEQ ID NO: 1669833 - DNA, 21 bp, Homo sapiens
tgtcacaatcctaacacatta

SEQ ID NO: 1669834 - DNA, 20 bp, Homo sapiens
tgtcacacaacactgatgtg

SEQ ID NO: 1669835 - DNA, 14 bp, Homo sapiens
tgtcacagaaatca

SEQ ID NO: 1669836 - DNA, 18 bp, Homo sapiens
tgtcacagaaatcagagg

SEQ ID NO: 1669837 - DNA, 14 bp, Homo sapiens
tgtcacagaaatta

SEQ ID NO: 1669838 - DNA, 20 bp, Homo sapiens
tgtcacagaaattatgatcc

SEQ ID NO: 1669839 - DNA, 20 bp, Homo sapiens
tgtcacagtccaaccagaaa

SEQ ID NO: 1669840 - DNA, 14 bp, Homo sapiens
tgtcaccaaggaaa

SEQ ID NO: 1669841 - DNA, 23 bp, Homo sapiens
tgtcaccaaggaaacgctacctc

SEQ ID NO: 1669842 - DNA, 19 bp, Homo sapiens
tgtcaccagagcttctctg

SEQ ID NO: 1669843 - DNA, 17 bp, Homo sapiens
tgtcaccagcaacatct

SEQ ID NO: 1669844 - DNA, 19 bp, Homo sapiens
tgtcaccagcaacatctcg

SEQ ID NO: 1669845 - DNA, 23 bp, Homo sapiens
tgtcacccaaaccggcaggtgcg

SEQ ID NO: 1669846 - DNA, 17 bp, Homo sapiens
tgtcaccctgcaggact

SEQ ID NO: 1669847 - DNA, 23 bp, Homo sapiens
tgtcaccgtgagcagctttggaa

SEQ ID NO: 1669848 - DNA, 12 bp, Homo sapiens
tgtcacctcagc

SEQ ID NO: 1669849 - DNA, 18 bp, Homo sapiens
tgtcacgatcacaggcct

SEQ ID NO: 1669850 - DNA, 22 bp, Homo sapiens
tgtcacgctcatgtcctgtcct

SEQ ID NO: 1669851 - DNA, 13 bp, Homo sapiens
tgtcacgctctgg

SEQ ID NO: 1669852 - DNA, 16 bp, Homo sapiens
tgtcactcagctgaga

SEQ ID NO: 1669853 - DNA, 22 bp, Homo sapiens
tgtcactcattgctgagcctct

SEQ ID NO: 1669854 - DNA, 23 bp, Homo sapiens
tgtcactcattgctgagcctctg

SEQ ID NO: 1669855 - DNA, 21 bp, Homo sapiens
tgtcactggtagaccaaaata

SEQ ID NO: 1669856 - DNA, 16 bp, Homo sapiens
tgtcactttttatgct

SEQ ID NO: 1669857 - DNA, 21 bp, Homo sapiens
tgtcagaaaccagttatgtga

SEQ ID NO: 1669858 - DNA, 16 bp, Homo sapiens
tgtcagaataggaaaa

SEQ ID NO: 1669859 - DNA, 17 bp, Homo sapiens
tgtcagaataggaaaac

SEQ ID NO: 1669860 - DNA, 18 bp, Homo sapiens
tgtcagaatttctttgtc

SEQ ID NO: 1669861 - DNA, 20 bp, Homo sapiens
tgtcagacctatttgacata

SEQ ID NO: 1669862 - DNA, 21 bp, Homo sapiens
tgtcagacttccaaatcctgg

SEQ ID NO: 1669863 - DNA, 19 bp, Homo sapiens
tgtcagagaaaatgaattt

SEQ ID NO: 1669864 - DNA, 14 bp, Homo sapiens
tgtcagagaatatg

SEQ ID NO: 1669865 - DNA, 16 bp, Homo sapiens
tgtcagagcccagccc

SEQ ID NO: 1669866 - DNA, 15 bp, Homo sapiens
tgtcagatacaatgt

SEQ ID NO: 1669867 - DNA, 20 bp, Homo sapiens
tgtcagatattcatattgac

SEQ ID NO: 1669868 - DNA, 23 bp, Homo sapiens
tgtcagatattttttcagaaata

SEQ ID NO: 1669869 - DNA, 12 bp, Homo sapiens
tgtcagcatctg

SEQ ID NO: 1669870 - DNA, 16 bp, Homo sapiens
tgtcagcatctggctg

SEQ ID NO: 1669871 - DNA, 17 bp, Homo sapiens
tgtcagcatctggctgt

SEQ ID NO: 1669872 - DNA, 23 bp, Homo sapiens
tgtcagccgagccgggcctgggg

SEQ ID NO: 1669873 - DNA, 16 bp, Homo sapiens
tgtcagccgggccctg

SEQ ID NO: 1669874 - DNA, 17 bp, Homo sapiens
tgtcagccgggccctga

SEQ ID NO: 1669875 - DNA, 21 bp, Homo sapiens
tgtcagctcccctcggagaag

SEQ ID NO: 1669876 - DNA, 20 bp, Homo sapiens
tgtcagctgagcttgagctc

SEQ ID NO: 1669877 - DNA, 16 bp, Homo sapiens
tgtcaggaacagaagg

SEQ ID NO: 1669878 - DNA, 18 bp, Homo sapiens
tgtcaggaacagaaggat

SEQ ID NO: 1669879 - DNA, 22 bp, Homo sapiens
tgtcaggcccgtcggagctgcc

SEQ ID NO: 1669880 - DNA, 17 bp, Homo sapiens
tgtcaggccctctgcct

SEQ ID NO: 1669881 - DNA, 11 bp, Homo sapiens
tgtcaggcctt

SEQ ID NO: 1669882 - DNA, 21 bp, Homo sapiens
tgtcagggatttagcccatga

SEQ ID NO: 1669883 - DNA, 15 bp, Homo sapiens
tgtcagggccaggtg

SEQ ID NO: 1669884 - DNA, 14 bp, Homo sapiens
tgtcagtatccagg

SEQ ID NO: 1669885 - DNA, 17 bp, Homo sapiens
tgtcataaattactgtt

SEQ ID NO: 1669886 - DNA, 21 bp, Homo sapiens
tgtcataacatccagagcttt

SEQ ID NO: 1669887 - DNA, 23 bp, Homo sapiens
tgtcataacatccagagctttgt

SEQ ID NO: 1669888 - DNA, 16 bp, Homo sapiens
tgtcataagaatgaat

SEQ ID NO: 1669889 - DNA, 13 bp, Homo sapiens
tgtcataagcatt

SEQ ID NO: 1669890 - DNA, 16 bp, Homo sapiens
tgtcataagcattact

SEQ ID NO: 1669891 - DNA, 13 bp, Homo sapiens
tgtcatagaaata

SEQ ID NO: 1669892 - DNA, 15 bp, Homo sapiens
tgtcatagaaattac

SEQ ID NO: 1669893 - DNA, 16 bp, Homo sapiens
tgtcatagaaattaca

SEQ ID NO: 1669894 - DNA, 21 bp, Homo sapiens
tgtcataggttttaaatctgc

SEQ ID NO: 1669895 - DNA, 23 bp, Homo sapiens
tgtcatagtcttgaaatgaaagg

SEQ ID NO: 1669896 - DNA, 17 bp, Homo sapiens
tgtcatatactgccatg

SEQ ID NO: 1669897 - DNA, 17 bp, Homo sapiens
tgtcatatgactgatta

SEQ ID NO: 1669898 - DNA, 13 bp, Homo sapiens
tgtcatcactccc

SEQ ID NO: 1669899 - DNA, 18 bp, Homo sapiens
tgtcatcactccctggat

SEQ ID NO: 1669900 - DNA, 20 bp, Homo sapiens
tgtcatcactccctggatgt

SEQ ID NO: 1669901 - DNA, 19 bp, Homo sapiens
tgtcatcagaagataactt

SEQ ID NO: 1669902 - DNA, 18 bp, Homo sapiens
tgtcatcagccaccatcc

SEQ ID NO: 1669903 - DNA, 21 bp, Homo sapiens
tgtcatcagccaccatcctat

SEQ ID NO: 1669904 - DNA, 23 bp, Homo sapiens
tgtcatccacacaacaccaggac

SEQ ID NO: 1669905 - DNA, 20 bp, Homo sapiens
tgtcatcctcaaagaaagtg

SEQ ID NO: 1669906 - DNA, 21 bp, Homo sapiens
tgtcatcctcaaagaaagtgt

SEQ ID NO: 1669907 - DNA, 22 bp, Homo sapiens
tgtcttgtacatgtgtagcctg

SEQ ID NO: 1669908 - DNA, 13 bp, Homo sapiens
tgtcttgtacttc

SEQ ID NO: 1669909 - DNA, 19 bp, Homo sapiens
tgtcttgtacttctgtgtt

SEQ ID NO: 1669910 - DNA, 18 bp, Homo sapiens
tgtcttgttcattttgag

SEQ ID NO: 1669911 - DNA, 15 bp, Homo sapiens
tgtctttaaaagaga

SEQ ID NO: 1669912 - DNA, 14 bp, Homo sapiens
tgtctttaaataga

SEQ ID NO: 1669913 - DNA, 19 bp, Homo sapiens
tgtctttaaatagatacaa

SEQ ID NO: 1669914 - DNA, 13 bp, Homo sapiens
tgtctttattctt

SEQ ID NO: 1669915 - DNA, 15 bp, Homo sapiens
tgtctttcagataca

SEQ ID NO: 1669916 - DNA, 21 bp, Homo sapiens
tgtctttgctgtactcttgct

SEQ ID NO: 1669917 - DNA, 20 bp, Homo sapiens
tgtctttgtaatattttcca

SEQ ID NO: 1669918 - DNA, 15 bp, Homo sapiens
tgtcttttaaaatgc

SEQ ID NO: 1669919 - DNA, 20 bp, Homo sapiens
tgtcttttaatgcttcattc

SEQ ID NO: 1669920 - DNA, 13 bp, Homo sapiens
tgtcttttagaca

SEQ ID NO: 1669921 - DNA, 22 bp, Homo sapiens
tgtcttttaggactctgatttt

SEQ ID NO: 1669922 - DNA, 17 bp, Homo sapiens
tgtcttttgttctctga

SEQ ID NO: 1669923 - DNA, 19 bp, Homo sapiens
tgtcttttttaaggctctg

SEQ ID NO: 1669924 - DNA, 23 bp, Homo sapiens
tgtctttttttttctttttccag

SEQ ID NO: 1669925 - DNA, 18 bp, Homo sapiens
tgtgaaaaaagaaaatgg

SEQ ID NO: 1669926 - DNA, 18 bp, Homo sapiens
tgtgaaaaaggaataaaa

SEQ ID NO: 1669927 - DNA, 21 bp, Homo sapiens
tgtgaaaaaggaataaattgt

SEQ ID NO: 1669928 - DNA, 12 bp, Homo sapiens
tgtgaaaaatca

SEQ ID NO: 1669929 - DNA, 13 bp, Homo sapiens
tgtgaaaaattaa

SEQ ID NO: 1669930 - DNA, 14 bp, Homo sapiens
tgtgaaaaattaac

SEQ ID NO: 1669931 - DNA, 18 bp, Homo sapiens
tgtgaaaatatctgctca

SEQ ID NO: 1669932 - DNA, 17 bp, Homo sapiens
tgtgaaaatcaaataca

SEQ ID NO: 1669933 - DNA, 20 bp, Homo sapiens
tgtgaaacaatgttgtccaa

SEQ ID NO: 1669934 - DNA, 15 bp, Homo sapiens
tgtgaaacacagctg

SEQ ID NO: 1669935 - DNA, 22 bp, Homo sapiens
tgtgaaactgaaggtcaataaa

SEQ ID NO: 1669936 - DNA, 13 bp, Homo sapiens
tgtgaaataccac

SEQ ID NO: 1669937 - DNA, 21 bp, Homo sapiens
tgtgaaatagttcaaagccaa

SEQ ID NO: 1669938 - DNA, 14 bp, Homo sapiens
tgtgaaatgctggc

SEQ ID NO: 1669939 - DNA, 18 bp, Homo sapiens
tgtgaaatttacagttac

SEQ ID NO: 1669940 - DNA, 13 bp, Homo sapiens
tgtgaacagcata

SEQ ID NO: 1669941 - DNA, 20 bp, Homo sapiens
tgtgaaccctggggcctgac

SEQ ID NO: 1669942 - DNA, 20 bp, Homo sapiens
tgtgaactagggaagctcag

SEQ ID NO: 1669943 - DNA, 14 bp, Homo sapiens
tgtgaactcaccct

SEQ ID NO: 1669944 - DNA, 19 bp, Homo sapiens
tgtgaactgactttaagta

SEQ ID NO: 1669945 - DNA, 13 bp, Homo sapiens
tgtgaactggaag

SEQ ID NO: 1669946 - DNA, 19 bp, Homo sapiens
tgtgaactggaagaaagca

SEQ ID NO: 1669947 - DNA, 14 bp, Homo sapiens
tgtgaagacatttt

SEQ ID NO: 1669948 - DNA, 19 bp, Homo sapiens
tgtgaagacattttttgct

SEQ ID NO: 1669949 - DNA, 13 bp, Homo sapiens
tgtgaagacccag

SEQ ID NO: 1669950 - DNA, 23 bp, Homo sapiens
tgtgaagacccagcaggaagcca

SEQ ID NO: 1669951 - DNA, 22 bp, Homo sapiens
tgtgaagagaatgtattctgta

SEQ ID NO: 1669952 - DNA, 14 bp, Homo sapiens
tgtgaagaggtctg

SEQ ID NO: 1669953 - DNA, 13 bp, Homo sapiens
tgtgaagcatgct

SEQ ID NO: 1669954 - DNA, 15 bp, Homo sapiens
tgtgaagcatttaca

SEQ ID NO: 1669955 - DNA, 15 bp, Homo sapiens
tgtgaagtattcaca

SEQ ID NO: 1669956 - DNA, 15 bp, Homo sapiens
tgtgaagttcatctt

SEQ ID NO: 1669957 - DNA, 16 bp, Homo sapiens
tgtgaagttcatcttg

SEQ ID NO: 1669958 - DNA, 12 bp, Homo sapiens
tgtgaataaatt

SEQ ID NO: 1669959 - DNA, 16 bp, Homo sapiens
tgtgaataattacagt

SEQ ID NO: 1669960 - DNA, 19 bp, Homo sapiens
tgtgaatacattctttgct

SEQ ID NO: 1669961 - DNA, 14 bp, Homo sapiens
tgtgaatcagaccc

SEQ ID NO: 1669962 - DNA, 14 bp, Homo sapiens
tgtgaatcgcagct

SEQ ID NO: 1669963 - DNA, 19 bp, Homo sapiens
tgtgaatcgcagctgtggg

SEQ ID NO: 1669964 - DNA, 13 bp, Homo sapiens
tgtgaatgttggt

SEQ ID NO: 1669965 - DNA, 15 bp, Homo sapiens
tgtgaattattgaca

SEQ ID NO: 1669966 - DNA, 16 bp, Homo sapiens
tgtgaattattgacac

SEQ ID NO: 1669967 - DNA, 21 bp, Homo sapiens
tgtgaattattgacactgaac

SEQ ID NO: 1669968 - DNA, 20 bp, Homo sapiens
tgtgaattcaatacaggcta

SEQ ID NO: 1669969 - DNA, 14 bp, Homo sapiens
tgtgaatttttaag

SEQ ID NO: 1669970 - DNA, 15 bp, Homo sapiens
tgtgaatttttaagc

SEQ ID NO: 1669971 - DNA, 13 bp, Homo sapiens
tgtgacaaaggat

SEQ ID NO: 1669972 - DNA, 22 bp, Homo sapiens
tgtgacacatatgcaccttgtg

SEQ ID NO: 1669973 - DNA, 12 bp, Homo sapiens
tgtgacacctgg

SEQ ID NO: 1669974 - DNA, 22 bp, Homo sapiens
tgtgacacctggtgcgggcctg

SEQ ID NO: 1669975 - DNA, 13 bp, Homo sapiens
tgtgacagtgcct

SEQ ID NO: 1669976 - DNA, 15 bp, Homo sapiens
tgtgacagtttccaa

SEQ ID NO: 1669977 - DNA, 16 bp, Homo sapiens
tgtgacagtttccaaa

SEQ ID NO: 1669978 - DNA, 15 bp, Homo sapiens
tgtgacatcctgctt

SEQ ID NO: 1669979 - DNA, 20 bp, Homo sapiens
tgtgacatggtgcctgagag

SEQ ID NO: 1669980 - DNA, 21 bp, Homo sapiens
tgtgaccaatacatttgtatt

SEQ ID NO: 1669981 - DNA, 14 bp, Homo sapiens
tgtgaccactgaat

SEQ ID NO: 1669982 - DNA, 19 bp, Homo sapiens
tgtgaccactgaattcact

SEQ ID NO: 1669983 - DNA, 22 bp, Homo sapiens
tgtgaccactgaattcactcca

SEQ ID NO: 1669984 - DNA, 17 bp, Homo sapiens
tgtgaccagcactgtct

SEQ ID NO: 1669985 - DNA, 14 bp, Homo sapiens
tgtgacccaccagt

SEQ ID NO: 1669986 - DNA, 17 bp, Homo sapiens
tgtgacccaccagtgcc

SEQ ID NO: 1669987 - DNA, 14 bp, Homo sapiens
tgtgacccctttca

SEQ ID NO: 1669988 - DNA, 15 bp, Homo sapiens
tgtgacgtgcactgt

SEQ ID NO: 1669989 - DNA, 17 bp, Homo sapiens
tgtgactaggcatacac

SEQ ID NO: 1669990 - DNA, 21 bp, Homo sapiens
tgtgactaggcatacactgta

SEQ ID NO: 1669991 - DNA, 19 bp, Homo sapiens
tgtgactataaagctgtta

SEQ ID NO: 1669992 - DNA, 13 bp, Homo sapiens
tgtgactcttact

SEQ ID NO: 1669993 - DNA, 19 bp, Homo sapiens
tgtgactcttactccttag

SEQ ID NO: 1669994 - DNA, 20 bp, Homo sapiens
tgtgactgaagaagatgagc

SEQ ID NO: 1669995 - DNA, 20 bp, Homo sapiens
tgtgactgtacccaaatgga

SEQ ID NO: 1669996 - DNA, 16 bp, Homo sapiens
tgtgactgtgtttgca

SEQ ID NO: 1669997 - DNA, 19 bp, Homo sapiens
tgtgacttcactgtatata

SEQ ID NO: 1669998 - DNA, 15 bp, Homo sapiens
tgtgacttcatgcta

SEQ ID NO: 1669999 - DNA, 19 bp, Homo sapiens
tgtgacttttatatgcttt

SEQ ID NO: 1670000 - DNA, 18 bp, Homo sapiens
tgtgagaaggtttattgt

SEQ ID NO: 1670001 - DNA, 23 bp, Homo sapiens
tgtgagaagtgaatgctgggact

SEQ ID NO: 1670002 - DNA, 14 bp, Homo sapiens
tgtgagaatcaaaa

SEQ ID NO: 1670003 - DNA, 16 bp, Homo sapiens
tgtgagacaccaggca

SEQ ID NO: 1670004 - DNA, 19 bp, Homo sapiens
tgtgagactcgagaacttt

SEQ ID NO: 1670005 - DNA, 16 bp, Homo sapiens
tgtgagacttaaaaca

SEQ ID NO: 1670006 - DNA, 19 bp, Homo sapiens
tgtgagacttaaaacatgg

SEQ ID NO: 1670007 - DNA, 15 bp, Homo sapiens
tgtgagacttctgtt

SEQ ID NO: 1670008 - DNA, 13 bp, Homo sapiens
tgtgagagaaagt

SEQ ID NO: 1670009 - DNA, 19 bp, Homo sapiens
tgtgagcatcctggcaggt

SEQ ID NO: 1670010 - DNA, 14 bp, Homo sapiens
tgtgagctctggtt

SEQ ID NO: 1670011 - DNA, 15 bp, Homo sapiens
tgtgagctcttccct

SEQ ID NO: 1670012 - DNA, 14 bp, Homo sapiens
tgtgagcttacatt

SEQ ID NO: 1670013 - DNA, 13 bp, Homo sapiens
tgtgagctttgaa

SEQ ID NO: 1670014 - DNA, 16 bp, Homo sapiens
tgtgagctttgaagta

SEQ ID NO: 1670015 - DNA, 23 bp, Homo sapiens
tgtgaggaactcacatactgact

SEQ ID NO: 1670016 - DNA, 20 bp, Homo sapiens
tgtgaggagctgctggcttg

SEQ ID NO: 1670017 - DNA, 17 bp, Homo sapiens
tgtgaggaggaaaagga

SEQ ID NO: 1670018 - DNA, 13 bp, Homo sapiens
tgtgaggcagggg

SEQ ID NO: 1670019 - DNA, 15 bp, Homo sapiens
tgtgagggaaagagc

SEQ ID NO: 1670020 - DNA, 14 bp, Homo sapiens
tgtgagggagggga

SEQ ID NO: 1670021 - DNA, 13 bp, Homo sapiens
tgtgagtattctc

SEQ ID NO: 1670022 - DNA, 15 bp, Homo sapiens
tgtgagtattctcat

SEQ ID NO: 1670023 - DNA, 20 bp, Homo sapiens
tgtggcatttccaaacatcc

SEQ ID NO: 1670024 - DNA, 16 bp, Homo sapiens
tgtggccacagccccc

SEQ ID NO: 1670025 - DNA, 19 bp, Homo sapiens
tgtggccagagctggaagg

SEQ ID NO: 1670026 - DNA, 22 bp, Homo sapiens
tgtggccagagctggaaggcag

SEQ ID NO: 1670027 - DNA, 16 bp, Homo sapiens
tgtggcccagttctga

SEQ ID NO: 1670028 - DNA, 13 bp, Homo sapiens
tgtggccccaccc

SEQ ID NO: 1670029 - DNA, 15 bp, Homo sapiens
tgtggccctggccac

SEQ ID NO: 1670030 - DNA, 14 bp, Homo sapiens
tgtggccctggcct

SEQ ID NO: 1670031 - DNA, 20 bp, Homo sapiens
tgtggccctggcctgctggg

SEQ ID NO: 1670032 - DNA, 19 bp, Homo sapiens
tgtggccgtctcctccctc

SEQ ID NO: 1670033 - DNA, 10 bp, Homo sapiens
tgtggcctca

SEQ ID NO: 1670034 - DNA, 11 bp, Homo sapiens
tgtggcctgca

SEQ ID NO: 1670035 - DNA, 21 bp, Homo sapiens
tgtggcctgtgtccagcagct

SEQ ID NO: 1670036 - DNA, 22 bp, Homo sapiens
tgtggcctgtgtccagcagctg

SEQ ID NO: 1670037 - DNA, 18 bp, Homo sapiens
tgtggcgccgtctccagg

SEQ ID NO: 1670038 - DNA, 19 bp, Homo sapiens
tgtggcgccgtctccaggg

SEQ ID NO: 1670039 - DNA, 13 bp, Homo sapiens
tgtggcggtgcct

SEQ ID NO: 1670040 - DNA, 22 bp, Homo sapiens
tgtggcgttctgctgcccctgc

SEQ ID NO: 1670041 - DNA, 23 bp, Homo sapiens
tgtggcgttctgctgcccctgca

SEQ ID NO: 1670042 - DNA, 23 bp, Homo sapiens
tgtggctcacagtggggccagca

SEQ ID NO: 1670043 - DNA, 17 bp, Homo sapiens
tgtggctcattcttttc

SEQ ID NO: 1670044 - DNA, 17 bp, Homo sapiens
tgtggctcctatctgtg

SEQ ID NO: 1670045 - DNA, 12 bp, Homo sapiens
tgtggctgaaaa

SEQ ID NO: 1670046 - DNA, 22 bp, Homo sapiens
tgtggctgaaaatgcaaagctg

SEQ ID NO: 1670047 - DNA, 22 bp, Homo sapiens
tgtggctggaggagctggcctg

SEQ ID NO: 1670048 - DNA, 23 bp, Homo sapiens
tgtggctggaggagctggcctgt

SEQ ID NO: 1670049 - DNA, 21 bp, Homo sapiens
tgtggcttggagtggccaaat

SEQ ID NO: 1670050 - DNA, 19 bp, Homo sapiens
tgtgggagacagcagcctg

SEQ ID NO: 1670051 - DNA, 19 bp, Homo sapiens
tgtgggatgttcagcactg

SEQ ID NO: 1670052 - DNA, 22 bp, Homo sapiens
tgtgggatgttcagcactgtcc

SEQ ID NO: 1670053 - DNA, 23 bp, Homo sapiens
tgtgggattatgggtcacaggaa

SEQ ID NO: 1670054 - DNA, 12 bp, Homo sapiens
tgtgggcagggt

SEQ ID NO: 1670055 - DNA, 21 bp, Homo sapiens
tgtgggcgcccaccctgggct

SEQ ID NO: 1670056 - DNA, 13 bp, Homo sapiens
tgtgggctgccct

SEQ ID NO: 1670057 - DNA, 14 bp, Homo sapiens
tgtgggctgtgagt

SEQ ID NO: 1670058 - DNA, 19 bp, Homo sapiens
tgtggggaacacagctaca

SEQ ID NO: 1670059 - DNA, 23 bp, Homo sapiens
tgtggggaagaggggctggggca

SEQ ID NO: 1670060 - DNA, 14 bp, Homo sapiens
tgtggggacacagc

SEQ ID NO: 1670061 - DNA, 21 bp, Homo sapiens
tgtggggacacagcagtgagt

SEQ ID NO: 1670062 - DNA, 20 bp, Homo sapiens
tgtggggatctcaggggctg

SEQ ID NO: 1670063 - DNA, 13 bp, Homo sapiens
tgtggggccagga

SEQ ID NO: 1670064 - DNA, 14 bp, Homo sapiens
tgtggggggaagct

SEQ ID NO: 1670065 - DNA, 18 bp, Homo sapiens
tgtggggggctgggggag

SEQ ID NO: 1670066 - DNA, 14 bp, Homo sapiens
tgtggggggtcctt

SEQ ID NO: 1670067 - DNA, 16 bp, Homo sapiens
tgtgggggtctgtgtg

SEQ ID NO: 1670068 - DNA, 13 bp, Homo sapiens
tgtggggttttta

SEQ ID NO: 1670069 - DNA, 21 bp, Homo sapiens
tgtggggtttttggagaaggt

SEQ ID NO: 1670070 - DNA, 16 bp, Homo sapiens
tgtgggtagtcattct

SEQ ID NO: 1670071 - DNA, 12 bp, Homo sapiens
tgtgggtctctg

SEQ ID NO: 1670072 - DNA, 17 bp, Homo sapiens
tgtgggtgaccaggtcc

SEQ ID NO: 1670073 - DNA, 15 bp, Homo sapiens
tgtgggtggagaagg

SEQ ID NO: 1670074 - DNA, 14 bp, Homo sapiens
tgtgggtgtcctgc

SEQ ID NO: 1670075 - DNA, 23 bp, Homo sapiens
tgtgggtgtcctgcctgtctgcc

SEQ ID NO: 1670076 - DNA, 14 bp, Homo sapiens
tgtggtaatctaca

SEQ ID NO: 1670077 - DNA, 15 bp, Homo sapiens
tgtggtactggcaat

SEQ ID NO: 1670078 - DNA, 20 bp, Homo sapiens
tgtggtaggggcagggaggc

SEQ ID NO: 1670079 - DNA, 17 bp, Homo sapiens
tgtggtaggtgataaag

SEQ ID NO: 1670080 - DNA, 22 bp, Homo sapiens
tgtggtaggtgataaagaggca

SEQ ID NO: 1670081 - DNA, 18 bp, Homo sapiens
tgtggtctctgccccagc

SEQ ID NO: 1670082 - DNA, 20 bp, Homo sapiens
tgtggtctctgccccagcct

SEQ ID NO: 1670083 - DNA, 14 bp, Homo sapiens
tgtggtgaggggct

SEQ ID NO: 1670084 - DNA, 13 bp, Homo sapiens
tgtggtgatgaaa

SEQ ID NO: 1670085 - DNA, 14 bp, Homo sapiens
tgtggtggagccag

SEQ ID NO: 1670086 - DNA, 23 bp, Homo sapiens
tgtggtggcacgcatctgtagtt

SEQ ID NO: 1670087 - DNA, 14 bp, Homo sapiens
tgtggtgggccctg

SEQ ID NO: 1670088 - DNA, 15 bp, Homo sapiens
tgtggtgtgaccatg

SEQ ID NO: 1670089 - DNA, 13 bp, Homo sapiens
tgtggttcctctg

SEQ ID NO: 1670090 - DNA, 17 bp, Homo sapiens
tgtggttcctctgctca

SEQ ID NO: 1670091 - DNA, 21 bp, Homo sapiens
tgtggttgaaaaccacagtca

SEQ ID NO: 1670092 - DNA, 21 bp, Homo sapiens
tgtggtttcagatgtgcaata

SEQ ID NO: 1670093 - DNA, 22 bp, Homo sapiens
tgtggtttcatgttagttacct

SEQ ID NO: 1670094 - DNA, 16 bp, Homo sapiens
tgtggtttctttttga

SEQ ID NO: 1670095 - DNA, 16 bp, Homo sapiens
tgtggttttcccctcc

SEQ ID NO: 1670096 - DNA, 13 bp, Homo sapiens
tgtggttttgtaa

SEQ ID NO: 1670097 - DNA, 16 bp, Homo sapiens
tgtggttttgtaattt

SEQ ID NO: 1670098 - DNA, 17 bp, Homo sapiens
tgtgtaaaaaatggaaa

SEQ ID NO: 1670099 - DNA, 14 bp, Homo sapiens
tgtgtaaatttctc

SEQ ID NO: 1670100 - DNA, 12 bp, Homo sapiens
tgtgtaacatcc

SEQ ID NO: 1670101 - DNA, 20 bp, Homo sapiens
tgtgtaacatccaagccaga

SEQ ID NO: 1670102 - DNA, 19 bp, Homo sapiens
tgtgtaacctcttcacctt

SEQ ID NO: 1670103 - DNA, 18 bp, Homo sapiens
tgtgtaactaatttgtgg

SEQ ID NO: 1670104 - DNA, 18 bp, Homo sapiens
tgtgtaataagaaagtat

SEQ ID NO: 1670105 - DNA, 12 bp, Homo sapiens
tgtgtaattatg

SEQ ID NO: 1670106 - DNA, 11 bp, Homo sapiens
tgtgtaattta

SEQ ID NO: 1670107 - DNA, 19 bp, Homo sapiens
tgtgtaatttaaaattgtg

SEQ ID NO: 1670108 - DNA, 20 bp, Homo sapiens
tgtgtaatttaagtgacaca

SEQ ID NO: 1670109 - DNA, 22 bp, Homo sapiens
tgtgtaatttaagtgacacaga

SEQ ID NO: 1670110 - DNA, 21 bp, Homo sapiens
tgtgtacagaattctgctacc

SEQ ID NO: 1670111 - DNA, 14 bp, Homo sapiens
tgtgtacagtgaat

SEQ ID NO: 1670112 - DNA, 16 bp, Homo sapiens
tgtgtacatagagcaa

SEQ ID NO: 1670113 - DNA, 19 bp, Homo sapiens
tgtgtacatagagcaatgt

SEQ ID NO: 1670114 - DNA, 20 bp, Homo sapiens
tgtgtacatagagcaatgtt

SEQ ID NO: 1670115 - DNA, 15 bp, Homo sapiens
tgtgtacatatatgt

SEQ ID NO: 1670116 - DNA, 17 bp, Homo sapiens
tgtgtacatatatgtat

SEQ ID NO: 1670117 - DNA, 19 bp, Homo sapiens
tgtgtacatggcagagttt

SEQ ID NO: 1670118 - DNA, 17 bp, Homo sapiens
tgtgtaccacttcctga

SEQ ID NO: 1670119 - DNA, 18 bp, Homo sapiens
tgtgtaccttaagatatt

SEQ ID NO: 1670120 - DNA, 17 bp, Homo sapiens
tgtgtactgataaaata

SEQ ID NO: 1670121 - DNA, 20 bp, Homo sapiens
tgtgtactgattcaagaaca

SEQ ID NO: 1670122 - DNA, 16 bp, Homo sapiens
tgtgtagacaaatatt

SEQ ID NO: 1670123 - DNA, 17 bp, Homo sapiens
tgtgtagccgccctgag

SEQ ID NO: 1670124 - DNA, 20 bp, Homo sapiens
tgtgtagcctttttgtataa

SEQ ID NO: 1670125 - DNA, 17 bp, Homo sapiens
tgtgtagctttgctctt

SEQ ID NO: 1670126 - DNA, 14 bp, Homo sapiens
tgtgtagggaaagt

SEQ ID NO: 1670127 - DNA, 16 bp, Homo sapiens
tgtgtataactggatt

SEQ ID NO: 1670128 - DNA, 19 bp, Homo sapiens
tgtgtatatattttgtgtg

SEQ ID NO: 1670129 - DNA, 22 bp, Homo sapiens
tgtgtatatattttgtgtgaaa

SEQ ID NO: 1670130 - DNA, 17 bp, Homo sapiens
tgtgtatctctttcaca

SEQ ID NO: 1670131 - DNA, 14 bp, Homo sapiens
tgtgtatgccaaga

SEQ ID NO: 1670132 - DNA, 15 bp, Homo sapiens
tgtgtatgtacatat

SEQ ID NO: 1670133 - DNA, 16 bp, Homo sapiens
tgtgtatgtacatata

SEQ ID NO: 1670134 - DNA, 23 bp, Homo sapiens
tgtgtatgtacttagctgtacta

SEQ ID NO: 1670135 - DNA, 22 bp, Homo sapiens
tgtgtatgtgagtattctcatt

SEQ ID NO: 1670136 - DNA, 20 bp, Homo sapiens
tgtgtattctgtggattcta

SEQ ID NO: 1670137 - DNA, 19 bp, Homo sapiens
tgttatttccccagccaca

SEQ ID NO: 1670138 - DNA, 15 bp, Homo sapiens
tgttatttcttccct

SEQ ID NO: 1670139 - DNA, 15 bp, Homo sapiens
tgttcaaagactgtg

SEQ ID NO: 1670140 - DNA, 16 bp, Homo sapiens
tgttcaaagatgcatt

SEQ ID NO: 1670141 - DNA, 17 bp, Homo sapiens
tgttcaaatattgtaaa

SEQ ID NO: 1670142 - DNA, 20 bp, Homo sapiens
tgttcacaaactacctctgg

SEQ ID NO: 1670143 - DNA, 15 bp, Homo sapiens
tgttcacaaactgtg

SEQ ID NO: 1670144 - DNA, 16 bp, Homo sapiens
tgttcacaatatattt

SEQ ID NO: 1670145 - DNA, 21 bp, Homo sapiens
tgttcaccttcaaaatgttct

SEQ ID NO: 1670146 - DNA, 15 bp, Homo sapiens
tgttcagatgtgcat

SEQ ID NO: 1670147 - DNA, 18 bp, Homo sapiens
tgttcagcactgtccctt

SEQ ID NO: 1670148 - DNA, 21 bp, Homo sapiens
tgttcagctctttccaaatta

SEQ ID NO: 1670149 - DNA, 17 bp, Homo sapiens
tgttcagcttttattcc

SEQ ID NO: 1670150 - DNA, 12 bp, Homo sapiens
tgttcatacatt

SEQ ID NO: 1670151 - DNA, 14 bp, Homo sapiens
tgttcatagcccag

SEQ ID NO: 1670152 - DNA, 19 bp, Homo sapiens
tgttcatcatcctaagcta

SEQ ID NO: 1670153 - DNA, 15 bp, Homo sapiens
tgttcatctgtaact

SEQ ID NO: 1670154 - DNA, 17 bp, Homo sapiens
tgttcattatttgtgct

SEQ ID NO: 1670155 - DNA, 22 bp, Homo sapiens
tgttcattcaagctatttaata

SEQ ID NO: 1670156 - DNA, 23 bp, Homo sapiens
tgttcatttggtgttcctggaag

SEQ ID NO: 1670157 - DNA, 18 bp, Homo sapiens
tgttcattttagtgactg

SEQ ID NO: 1670158 - DNA, 18 bp, Homo sapiens
tgttcattttattttcat

SEQ ID NO: 1670159 - DNA, 18 bp, Homo sapiens
tgttcattttgagctgaa

SEQ ID NO: 1670160 - DNA, 20 bp, Homo sapiens
tgttcattttgagctgaaat

SEQ ID NO: 1670161 - DNA, 19 bp, Homo sapiens
tgttccaacctcctgctct

SEQ ID NO: 1670162 - DNA, 20 bp, Homo sapiens
tgttccaacctcctgctctg

SEQ ID NO: 1670163 - DNA, 18 bp, Homo sapiens
tgttccaatgtcaatgtg

SEQ ID NO: 1670164 - DNA, 17 bp, Homo sapiens
tgttccaatttcacgct

SEQ ID NO: 1670165 - DNA, 18 bp, Homo sapiens
tgttccaatttcacgctt

SEQ ID NO: 1670166 - DNA, 16 bp, Homo sapiens
tgttccacctgccaca

SEQ ID NO: 1670167 - DNA, 19 bp, Homo sapiens
tgttccacttgtttgcact

SEQ ID NO: 1670168 - DNA, 20 bp, Homo sapiens
tgttccacttgtttgcactg

SEQ ID NO: 1670169 - DNA, 21 bp, Homo sapiens
tgttccagtgaggaaccctga

SEQ ID NO: 1670170 - DNA, 16 bp, Homo sapiens
tgttcccacaccccaa

SEQ ID NO: 1670171 - DNA, 16 bp, Homo sapiens
tgttcccatttcagct

SEQ ID NO: 1670172 - DNA, 17 bp, Homo sapiens
tgttcccatttcagctg

SEQ ID NO: 1670173 - DNA, 13 bp, Homo sapiens
tgttccccagaga

SEQ ID NO: 1670174 - DNA, 12 bp, Homo sapiens
tgttcccctcct

SEQ ID NO: 1670175 - DNA, 13 bp, Homo sapiens
tgttcccctcctc

SEQ ID NO: 1670176 - DNA, 17 bp, Homo sapiens
tgttcccctcctccact

SEQ ID NO: 1670177 - DNA, 20 bp, Homo sapiens
tgttccctagagagaataaa

SEQ ID NO: 1670178 - DNA, 21 bp, Homo sapiens
tgttccctagagagaataaat

SEQ ID NO: 1670179 - DNA, 23 bp, Homo sapiens
tgttccctagagagaataaattg

SEQ ID NO: 1670180 - DNA, 18 bp, Homo sapiens
tgttccctctggcttccc

SEQ ID NO: 1670181 - DNA, 15 bp, Homo sapiens
tgttccctgcaccct

SEQ ID NO: 1670182 - DNA, 16 bp, Homo sapiens
tgttccctgcaccctg

SEQ ID NO: 1670183 - DNA, 17 bp, Homo sapiens
tgttcccttatctgttt

SEQ ID NO: 1670184 - DNA, 20 bp, Homo sapiens
tgttcccttcctcttcctgc

SEQ ID NO: 1670185 - DNA, 21 bp, Homo sapiens
tgttcctaaaaatctgtggca

SEQ ID NO: 1670186 - DNA, 23 bp, Homo sapiens
tgttcctaaaaatctgtggcaag

SEQ ID NO: 1670187 - DNA, 20 bp, Homo sapiens
tgttcctaacaaaatgagat

SEQ ID NO: 1670188 - DNA, 19 bp, Homo sapiens
tgttcctactcacacttca

SEQ ID NO: 1670189 - DNA, 18 bp, Homo sapiens
tgttcctagtgaaagagg

SEQ ID NO: 1670190 - DNA, 23 bp, Homo sapiens
tgttcctcggtgggccagagctg

SEQ ID NO: 1670191 - DNA, 16 bp, Homo sapiens
tgttcctctatacttt

SEQ ID NO: 1670192 - DNA, 21 bp, Homo sapiens
tgttcctctatactttgttct

SEQ ID NO: 1670193 - DNA, 23 bp, Homo sapiens
tgttcctctatactttgttctgt

SEQ ID NO: 1670194 - DNA, 22 bp, Homo sapiens
tgttcctgaattctatttgctg

SEQ ID NO: 1670195 - DNA, 13 bp, Homo sapiens
tgttcctgctctt

SEQ ID NO: 1670196 - DNA, 13 bp, Homo sapiens
tgttcctggaagc

SEQ ID NO: 1670197 - DNA, 17 bp, Homo sapiens
tgttcctggctgatgat

SEQ ID NO: 1670198 - DNA, 22 bp, Homo sapiens
tgttcctggctgatgatccaga

SEQ ID NO: 1670199 - DNA, 18 bp, Homo sapiens
tgttccttcacatcctgt

SEQ ID NO: 1670200 - DNA, 16 bp, Homo sapiens
tgttccttgctagccc

SEQ ID NO: 1670201 - DNA, 13 bp, Homo sapiens
tgttcctttctct

SEQ ID NO: 1670202 - DNA, 20 bp, Homo sapiens
tgttcctttttaaatgtgaa

SEQ ID NO: 1670203 - DNA, 21 bp, Homo sapiens
tgttcctttttaaatgtgaat

SEQ ID NO: 1670204 - DNA, 15 bp, Homo sapiens
tgttcgggtgtgggt

SEQ ID NO: 1670205 - DNA, 18 bp, Homo sapiens
tgttctaaagctctgaca

SEQ ID NO: 1670206 - DNA, 14 bp, Homo sapiens
tgttctaaggctct

SEQ ID NO: 1670207 - DNA, 12 bp, Homo sapiens
tgttctaagttt

SEQ ID NO: 1670208 - DNA, 16 bp, Homo sapiens
tgttctaagtttctaa

SEQ ID NO: 1670209 - DNA, 22 bp, Homo sapiens
tgttctaagtttctaagattct

SEQ ID NO: 1670210 - DNA, 21 bp, Homo sapiens
tgttctaccgtggatttgtac

SEQ ID NO: 1670211 - DNA, 20 bp, Homo sapiens
tgttctagacttccccatcc

SEQ ID NO: 1670212 - DNA, 15 bp, Homo sapiens
tgttctcatgaagca

SEQ ID NO: 1670213 - DNA, 16 bp, Homo sapiens
tgttctcatttgatca

SEQ ID NO: 1670214 - DNA, 14 bp, Homo sapiens
tgttctcctcccca

SEQ ID NO: 1670215 - DNA, 19 bp, Homo sapiens
tgttctctgaattttcaga

SEQ ID NO: 1670216 - DNA, 13 bp, Homo sapiens
tgttctctgggag

SEQ ID NO: 1670217 - DNA, 17 bp, Homo sapiens
tgttctgaaaggagaca

SEQ ID NO: 1670218 - DNA, 18 bp, Homo sapiens
tgttctgaaaggagacat

SEQ ID NO: 1670219 - DNA, 18 bp, Homo sapiens
tgttctgaataatttctt

SEQ ID NO: 1670220 - DNA, 15 bp, Homo sapiens
tgttctgaccctgct

SEQ ID NO: 1670221 - DNA, 14 bp, Homo sapiens
tgttctgcactgaa

SEQ ID NO: 1670222 - DNA, 15 bp, Homo sapiens
tgttctgcatggatt

SEQ ID NO: 1670223 - DNA, 20 bp, Homo sapiens
tgttctgctaaatttcaaat

SEQ ID NO: 1670224 - DNA, 11 bp, Homo sapiens
tgttctgctga

SEQ ID NO: 1670225 - DNA, 13 bp, Homo sapiens
tgttctggaggaa

SEQ ID NO: 1670226 - DNA, 15 bp, Homo sapiens
tgttctggccctcac

SEQ ID NO: 1670227 - DNA, 12 bp, Homo sapiens
tgttctggcttt

SEQ ID NO: 1670228 - DNA, 22 bp, Homo sapiens
tgttctggggggacccagtgca

SEQ ID NO: 1670229 - DNA, 15 bp, Homo sapiens
tgttctgtcttccca

SEQ ID NO: 1670230 - DNA, 14 bp, Homo sapiens
tgttctgttgtctg

SEQ ID NO: 1670231 - DNA, 16 bp, Homo sapiens
tgttctgtttggcact

SEQ ID NO: 1670232 - DNA, 17 bp, Homo sapiens
tgttctgtttggcactt

SEQ ID NO: 1670233 - DNA, 22 bp, Homo sapiens
tgttctgtttggcacttgtatt

SEQ ID NO: 1670234 - DNA, 14 bp, Homo sapiens
tgttctgtttgtta

SEQ ID NO: 1670235 - DNA, 21 bp, Homo sapiens
tgttctgtttgttaaaactgg

SEQ ID NO: 1670236 - DNA, 14 bp, Homo sapiens
tgttcttacaaatg

SEQ ID NO: 1670237 - DNA, 15 bp, Homo sapiens
tgttcttacaaatgt

SEQ ID NO: 1670238 - DNA, 20 bp, Homo sapiens
tgttcttacaaatgtgaaac

SEQ ID NO: 1670239 - DNA, 17 bp, Homo sapiens
tgttcttacctgtatgt

SEQ ID NO: 1670240 - DNA, 14 bp, Homo sapiens
tgttcttagagtgt

SEQ ID NO: 1670241 - DNA, 16 bp, Homo sapiens
tgttcttagcaataaa

SEQ ID NO: 1670242 - DNA, 18 bp, Homo sapiens
tgttcttagcaataaatg

SEQ ID NO: 1670243 - DNA, 19 bp, Homo sapiens
tgttcttaggtttactgtg

SEQ ID NO: 1670244 - DNA, 21 bp, Homo sapiens
tgttcttaggtttactgtgaa

SEQ ID NO: 1670245 - DNA, 13 bp, Homo sapiens
tgttcttcagtgt

SEQ ID NO: 1670246 - DNA, 13 bp, Homo sapiens
tgttcttcttggg

SEQ ID NO: 1670247 - DNA, 15 bp, Homo sapiens
tgttcttgaatcctc

SEQ ID NO: 1670248 - DNA, 16 bp, Homo sapiens
tgttcttgaatcctct

SEQ ID NO: 1670249 - DNA, 10 bp, Homo sapiens
tgttcttgta

SEQ ID NO: 1670250 - DNA, 17 bp, Homo sapiens
tgttcttttcccgcctc

SEQ ID NO: 1670251 - DNA, 13 bp, Homo sapiens
tgttcttttctcc

SEQ ID NO: 1670252 - DNA, 16 bp, Homo sapiens
ttaaaaatatttcaga

SEQ ID NO: 1670253 - DNA, 14 bp, Homo sapiens
ttaaaaatgtaaat

SEQ ID NO: 1670254 - DNA, 19 bp, Homo sapiens
ttaaaaatgtaaatattct

SEQ ID NO: 1670255 - DNA, 12 bp, Homo sapiens
ttaaaaatgtgg

SEQ ID NO: 1670256 - DNA, 13 bp, Homo sapiens
ttaaaaattactt

SEQ ID NO: 1670257 - DNA, 13 bp, Homo sapiens
ttaaaaattgttt

SEQ ID NO: 1670258 - DNA, 16 bp, Homo sapiens
ttaaaacaaatataca

SEQ ID NO: 1670259 - DNA, 17 bp, Homo sapiens
ttaaaacaaatatacat

SEQ ID NO: 1670260 - DNA, 20 bp, Homo sapiens
ttaaaacaatattgtttcta

SEQ ID NO: 1670261 - DNA, 12 bp, Homo sapiens
ttaaaacagctg

SEQ ID NO: 1670262 - DNA, 13 bp, Homo sapiens
ttaaaactaaatt

SEQ ID NO: 1670263 - DNA, 14 bp, Homo sapiens
ttaaaactggacct

SEQ ID NO: 1670264 - DNA, 13 bp, Homo sapiens
ttaaaagaaatat

SEQ ID NO: 1670265 - DNA, 14 bp, Homo sapiens
ttaaaagaagcttt

SEQ ID NO: 1670266 - DNA, 15 bp, Homo sapiens
ttaaaagagctcaga

SEQ ID NO: 1670267 - DNA, 15 bp, Homo sapiens
ttaaaagatgaaaat

SEQ ID NO: 1670268 - DNA, 16 bp, Homo sapiens
ttaaaagattcatttt

SEQ ID NO: 1670269 - DNA, 13 bp, Homo sapiens
ttaaaagcctgct

SEQ ID NO: 1670270 - DNA, 16 bp, Homo sapiens
ttaaaaggaaaaataa

SEQ ID NO: 1670271 - DNA, 22 bp, Homo sapiens
ttaaaaggatttttatctttcg

SEQ ID NO: 1670272 - DNA, 14 bp, Homo sapiens
ttaaaaggggccca

SEQ ID NO: 1670273 - DNA, 23 bp, Homo sapiens
ttaaaagtcagtatcatattatt

SEQ ID NO: 1670274 - DNA, 23 bp, Homo sapiens
ttaaaagtgttgattacataatc

SEQ ID NO: 1670275 - DNA, 14 bp, Homo sapiens
ttaaaataaatatt

SEQ ID NO: 1670276 - DNA, 18 bp, Homo sapiens
ttaaaatacacactcaaa

SEQ ID NO: 1670277 - DNA, 17 bp, Homo sapiens
ttaaaataccactgtaa

SEQ ID NO: 1670278 - DNA, 17 bp, Homo sapiens
ttaaaatagaaattttg

SEQ ID NO: 1670279 - DNA, 18 bp, Homo sapiens
ttaaaataggggatattt

SEQ ID NO: 1670280 - DNA, 22 bp, Homo sapiens
ttaaaataggggatatttaagg

SEQ ID NO: 1670281 - DNA, 16 bp, Homo sapiens
ttaaaatatacttaaa

SEQ ID NO: 1670282 - DNA, 14 bp, Homo sapiens
ttaaaatatatgaa

SEQ ID NO: 1670283 - DNA, 20 bp, Homo sapiens
ttaaaatatatgaagacaat

SEQ ID NO: 1670284 - DNA, 14 bp, Homo sapiens
ttaaaatatggcta

SEQ ID NO: 1670285 - DNA, 12 bp, Homo sapiens
ttaaaatattta

SEQ ID NO: 1670286 - DNA, 17 bp, Homo sapiens
ttaaaatatttatttat

SEQ ID NO: 1670287 - DNA, 22 bp, Homo sapiens
ttaaaatatttgtctttaaaca

SEQ ID NO: 1670288 - DNA, 14 bp, Homo sapiens
ttaaaatattttat

SEQ ID NO: 1670289 - DNA, 16 bp, Homo sapiens
ttaaaatcaaatgtaa

SEQ ID NO: 1670290 - DNA, 16 bp, Homo sapiens
ttaaaatcagctattt

SEQ ID NO: 1670291 - DNA, 21 bp, Homo sapiens
ttaaaatgaacctgctactta

SEQ ID NO: 1670292 - DNA, 13 bp, Homo sapiens
ttaaaatgtaatt

SEQ ID NO: 1670293 - DNA, 17 bp, Homo sapiens
ttaaaatgtacatgtat

SEQ ID NO: 1670294 - DNA, 19 bp, Homo sapiens
ttaaaatgtacatgtatta

SEQ ID NO: 1670295 - DNA, 21 bp, Homo sapiens
ttaaaatgtcggatttatctt

SEQ ID NO: 1670296 - DNA, 23 bp, Homo sapiens
ttaaaattatcaatatctaatat

SEQ ID NO: 1670297 - DNA, 21 bp, Homo sapiens
ttaaaattctgatgtttctgt

SEQ ID NO: 1670298 - DNA, 15 bp, Homo sapiens
ttaaaattgctatgt

SEQ ID NO: 1670299 - DNA, 18 bp, Homo sapiens
ttaaaattgtgatgtgtc

SEQ ID NO: 1670300 - DNA, 17 bp, Homo sapiens
ttaaaattgttaatatg

SEQ ID NO: 1670301 - DNA, 14 bp, Homo sapiens
ttaaacaaaggttg

SEQ ID NO: 1670302 - DNA, 18 bp, Homo sapiens
ttaaacaatgtataaaga

SEQ ID NO: 1670303 - DNA, 23 bp, Homo sapiens
ttaaacacacagatacacacaca

SEQ ID NO: 1670304 - DNA, 21 bp, Homo sapiens
ttaaacacaggctgtccttaa

SEQ ID NO: 1670305 - DNA, 20 bp, Homo sapiens
ttaaacacagggaaagcatt

SEQ ID NO: 1670306 - DNA, 15 bp, Homo sapiens
ttaaacactgtaatc

SEQ ID NO: 1670307 - DNA, 17 bp, Homo sapiens
ttaaacactgtaatctt

SEQ ID NO: 1670308 - DNA, 23 bp, Homo sapiens
ttaaacagtgagcctgaattttg

SEQ ID NO: 1670309 - DNA, 16 bp, Homo sapiens
ttaaaccaatgaagaa

SEQ ID NO: 1670310 - DNA, 16 bp, Homo sapiens
ttaaacccatacaatg

SEQ ID NO: 1670311 - DNA, 18 bp, Homo sapiens
ttaaacccatacaatgta

SEQ ID NO: 1670312 - DNA, 20 bp, Homo sapiens
ttaaaccctggatcagtcct

SEQ ID NO: 1670313 - DNA, 19 bp, Homo sapiens
ttaaacgaagagttccctt

SEQ ID NO: 1670314 - DNA, 13 bp, Homo sapiens
ttaaactctgaat

SEQ ID NO: 1670315 - DNA, 20 bp, Homo sapiens
ttaaactctgaatttatctt

SEQ ID NO: 1670316 - DNA, 19 bp, Homo sapiens
ttaaactctggacactcta

SEQ ID NO: 1670317 - DNA, 12 bp, Homo sapiens
ttaaactgtgta

SEQ ID NO: 1670318 - DNA, 19 bp, Homo sapiens
ttaaactgtgtacataact

SEQ ID NO: 1670319 - DNA, 15 bp, Homo sapiens
ttaaactgtgtttta

SEQ ID NO: 1670320 - DNA, 16 bp, Homo sapiens
ttaaacttccaaagaa

SEQ ID NO: 1670321 - DNA, 18 bp, Homo sapiens
ttaaacttccaaagaaag

SEQ ID NO: 1670322 - DNA, 12 bp, Homo sapiens
ttaaacttgaaa

SEQ ID NO: 1670323 - DNA, 17 bp, Homo sapiens
ttaaacttgtcagaatt

SEQ ID NO: 1670324 - DNA, 18 bp, Homo sapiens
ttaaacttttaattcatt

SEQ ID NO: 1670325 - DNA, 14 bp, Homo sapiens
ttaaagaaacagct

SEQ ID NO: 1670326 - DNA, 16 bp, Homo sapiens
ttaaagaaacagcttt

SEQ ID NO: 1670327 - DNA, 17 bp, Homo sapiens
ttaaagaaacatggttt

SEQ ID NO: 1670328 - DNA, 20 bp, Homo sapiens
ttaaagaatccttatctata

SEQ ID NO: 1670329 - DNA, 9 bp, Homo sapiens
ttaaagaca

SEQ ID NO: 1670330 - DNA, 21 bp, Homo sapiens
ttaaagacaaagacaaattct

SEQ ID NO: 1670331 - DNA, 22 bp, Homo sapiens
ttaaagagcatggaaaaatact

SEQ ID NO: 1670332 - DNA, 14 bp, Homo sapiens
ttaaagagtctaga

SEQ ID NO: 1670333 - DNA, 19 bp, Homo sapiens
ttaaagagtctagattcaa

SEQ ID NO: 1670334 - DNA, 21 bp, Homo sapiens
ttaaagatgctgtcggcacca

SEQ ID NO: 1670335 - DNA, 19 bp, Homo sapiens
ttaaagatggatttgaaaa

SEQ ID NO: 1670336 - DNA, 22 bp, Homo sapiens
ttaaagcagagggactttgtat

SEQ ID NO: 1670337 - DNA, 13 bp, Homo sapiens
ttaaagcctcctc

SEQ ID NO: 1670338 - DNA, 19 bp, Homo sapiens
ttaaagctaaagtatctgt

SEQ ID NO: 1670339 - DNA, 17 bp, Homo sapiens
ttaaagctaaattttgt

SEQ ID NO: 1670340 - DNA, 15 bp, Homo sapiens
ttaaaggaaggaaaa

SEQ ID NO: 1670341 - DNA, 21 bp, Homo sapiens
ttaaagggggagaattctaga

SEQ ID NO: 1670342 - DNA, 16 bp, Homo sapiens
ttaaagtatatattta

SEQ ID NO: 1670343 - DNA, 15 bp, Homo sapiens
ttaaagtatgaatct

SEQ ID NO: 1670344 - DNA, 23 bp, Homo sapiens
ttaaagtatgttattgcataatt

SEQ ID NO: 1670345 - DNA, 21 bp, Homo sapiens
ttaaagtgctaaggttctaag

SEQ ID NO: 1670346 - DNA, 14 bp, Homo sapiens
ttaaagttcattgc

SEQ ID NO: 1670347 - DNA, 20 bp, Homo sapiens
ttaaagttcttattttagta

SEQ ID NO: 1670348 - DNA, 16 bp, Homo sapiens
ttaaagttgtttccca

SEQ ID NO: 1670349 - DNA, 16 bp, Homo sapiens
ttaaataaacacagtc

SEQ ID NO: 1670350 - DNA, 13 bp, Homo sapiens
ttaaataaaccta

SEQ ID NO: 1670351 - DNA, 11 bp, Homo sapiens
ttaaataacaa

SEQ ID NO: 1670352 - DNA, 16 bp, Homo sapiens
ttaaataaccttcatc

SEQ ID NO: 1670353 - DNA, 14 bp, Homo sapiens
ttaaataactgtgt

SEQ ID NO: 1670354 - DNA, 15 bp, Homo sapiens
ttaaataagattcta

SEQ ID NO: 1670355 - DNA, 22 bp, Homo sapiens
ttaaataaggttggagatgtca

SEQ ID NO: 1670356 - DNA, 18 bp, Homo sapiens
ttaaataatgcttcagat

SEQ ID NO: 1670357 - DNA, 20 bp, Homo sapiens
ttaaataatgcttcagatat

SEQ ID NO: 1670358 - DNA, 16 bp, Homo sapiens
ttaaatacagacacta

SEQ ID NO: 1670359 - DNA, 18 bp, Homo sapiens
ttaaatacagacactaag

SEQ ID NO: 1670360 - DNA, 14 bp, Homo sapiens
ttaaatacaggaaa

SEQ ID NO: 1670361 - DNA, 20 bp, Homo sapiens
ttaaatacaggaaacagttg

SEQ ID NO: 1670362 - DNA, 18 bp, Homo sapiens
ttaaatagagtttgctat

SEQ ID NO: 1670363 - DNA, 14 bp, Homo sapiens
ttaaatagcctaaa

SEQ ID NO: 1670364 - DNA, 17 bp, Homo sapiens
ttaaatagcctaaatga

SEQ ID NO: 1670365 - DNA, 20 bp, Homo sapiens
ttaaatatccatttatcttt

SEQ ID NO: 1670366 - DNA, 20 bp, Homo sapiens
ttaaatatgtatatgacatt

SEQ ID NO: 1670367 - DNA, 18 bp, Homo sapiens
ttaagatgttgtcttgcg

SEQ ID NO: 1670368 - DNA, 19 bp, Homo sapiens
ttaagcaaaagaaaaagat

SEQ ID NO: 1670369 - DNA, 16 bp, Homo sapiens
ttaagcaaaggggaca

SEQ ID NO: 1670370 - DNA, 11 bp, Homo sapiens
ttaagcacaca

SEQ ID NO: 1670371 - DNA, 14 bp, Homo sapiens
ttaagcacacacat

SEQ ID NO: 1670372 - DNA, 17 bp, Homo sapiens
ttaagcatgacagaaaa

SEQ ID NO: 1670373 - DNA, 21 bp, Homo sapiens
ttaagccaaactcaggcccag

SEQ ID NO: 1670374 - DNA, 20 bp, Homo sapiens
ttaagccaaagaaacaagct

SEQ ID NO: 1670375 - DNA, 23 bp, Homo sapiens
ttaagccaaagaaacaagctgtg

SEQ ID NO: 1670376 - DNA, 20 bp, Homo sapiens
ttaagcctaaagattttgat

SEQ ID NO: 1670377 - DNA, 15 bp, Homo sapiens
ttaagcctgaagagc

SEQ ID NO: 1670378 - DNA, 17 bp, Homo sapiens
ttaagcctttgttgaac

SEQ ID NO: 1670379 - DNA, 18 bp, Homo sapiens
ttaagcctttgttgaact

SEQ ID NO: 1670380 - DNA, 19 bp, Homo sapiens
ttaagctgcagagatttct

SEQ ID NO: 1670381 - DNA, 23 bp, Homo sapiens
ttaagctgcagagatttctcatt

SEQ ID NO: 1670382 - DNA, 14 bp, Homo sapiens
ttaagctgtttcca

SEQ ID NO: 1670383 - DNA, 12 bp, Homo sapiens
ttaaggaaacaa

SEQ ID NO: 1670384 - DNA, 20 bp, Homo sapiens
ttaaggaagatcctgaagca

SEQ ID NO: 1670385 - DNA, 21 bp, Homo sapiens
ttaaggaagatcctgaagcag

SEQ ID NO: 1670386 - DNA, 20 bp, Homo sapiens
ttaaggagaatcatgtttct

SEQ ID NO: 1670387 - DNA, 22 bp, Homo sapiens
ttaaggataaatcataaagtca

SEQ ID NO: 1670388 - DNA, 14 bp, Homo sapiens
ttaaggatggatgg

SEQ ID NO: 1670389 - DNA, 17 bp, Homo sapiens
ttaaggatggatggcac

SEQ ID NO: 1670390 - DNA, 18 bp, Homo sapiens
ttaaggatggatggcacc

SEQ ID NO: 1670391 - DNA, 20 bp, Homo sapiens
ttaaggattgtgatattttt

SEQ ID NO: 1670392 - DNA, 11 bp, Homo sapiens
ttaaggcctga

SEQ ID NO: 1670393 - DNA, 16 bp, Homo sapiens
ttaaggctaaaaagta

SEQ ID NO: 1670394 - DNA, 18 bp, Homo sapiens
ttaagggaagaattccag

SEQ ID NO: 1670395 - DNA, 19 bp, Homo sapiens
ttaagggggaaaactgttc

SEQ ID NO: 1670396 - DNA, 23 bp, Homo sapiens
ttaaggggtgggtcagaacatgt

SEQ ID NO: 1670397 - DNA, 13 bp, Homo sapiens
ttaaggtctgttt

SEQ ID NO: 1670398 - DNA, 18 bp, Homo sapiens
ttaaggtttgttttcatt

SEQ ID NO: 1670399 - DNA, 18 bp, Homo sapiens
ttaagtaatgatactgtg

SEQ ID NO: 1670400 - DNA, 17 bp, Homo sapiens
ttaagtactatgtatca

SEQ ID NO: 1670401 - DNA, 14 bp, Homo sapiens
ttaagtatatatat

SEQ ID NO: 1670402 - DNA, 14 bp, Homo sapiens
ttaagtatcttttt

SEQ ID NO: 1670403 - DNA, 17 bp, Homo sapiens
ttaagtcagatttttat

SEQ ID NO: 1670404 - DNA, 21 bp, Homo sapiens
ttaagtcagatttttatttat

SEQ ID NO: 1670405 - DNA, 19 bp, Homo sapiens
ttaagtctcgaatgtaatt

SEQ ID NO: 1670406 - DNA, 19 bp, Homo sapiens
ttaagtctgggatgtagaa

SEQ ID NO: 1670407 - DNA, 22 bp, Homo sapiens
ttaagtctgggatgtagaactt

SEQ ID NO: 1670408 - DNA, 16 bp, Homo sapiens
ttaagtgacacagaca

SEQ ID NO: 1670409 - DNA, 21 bp, Homo sapiens
ttaagtgcacttttttatgaa

SEQ ID NO: 1670410 - DNA, 23 bp, Homo sapiens
ttaagtgcacttttttatgaaga

SEQ ID NO: 1670411 - DNA, 20 bp, Homo sapiens
ttaagtggggttgataacac

SEQ ID NO: 1670412 - DNA, 13 bp, Homo sapiens
ttaagtgtttctc

SEQ ID NO: 1670413 - DNA, 23 bp, Homo sapiens
ttaagtgtttctcaaaagaggtt

SEQ ID NO: 1670414 - DNA, 15 bp, Homo sapiens
ttaagttttagtctt

SEQ ID NO: 1670415 - DNA, 23 bp, Homo sapiens
ttaagttttgattaatgtttctt

SEQ ID NO: 1670416 - DNA, 13 bp, Homo sapiens
ttaagtttttcca

SEQ ID NO: 1670417 - DNA, 22 bp, Homo sapiens
ttaataaaaatacacatgaaaa

SEQ ID NO: 1670418 - DNA, 18 bp, Homo sapiens
ttaataaaactgcgagga

SEQ ID NO: 1670419 - DNA, 20 bp, Homo sapiens
ttaataaaactgcgaggaca

SEQ ID NO: 1670420 - DNA, 17 bp, Homo sapiens
ttaataaatatgtaata

SEQ ID NO: 1670421 - DNA, 19 bp, Homo sapiens
ttaataaatttaataaata

SEQ ID NO: 1670422 - DNA, 22 bp, Homo sapiens
ttaataacaaggagatttctta

SEQ ID NO: 1670423 - DNA, 24 bp, Homo sapiens
ttaataatcagcaagaatttgatc

SEQ ID NO: 1670424 - DNA, 20 bp, Homo sapiens
ttaataatttttacctaatc

SEQ ID NO: 1670425 - DNA, 22 bp, Homo sapiens
ttaatacaaggtataataaaat

SEQ ID NO: 1670426 - DNA, 21 bp, Homo sapiens
ttaatactcaaatgagtaaca

SEQ ID NO: 1670427 - DNA, 21 bp, Homo sapiens
ttaatactgttattctttgca

SEQ ID NO: 1670428 - DNA, 19 bp, Homo sapiens
ttaatagaatataattatc

SEQ ID NO: 1670429 - DNA, 21 bp, Homo sapiens
ttaatagaggagctgcttgtt

SEQ ID NO: 1670430 - DNA, 15 bp, Homo sapiens
ttaatagcagccttt

SEQ ID NO: 1670431 - DNA, 13 bp, Homo sapiens
ttaatagctgtga

SEQ ID NO: 1670432 - DNA, 17 bp, Homo sapiens
ttaatagggaatatatc

SEQ ID NO: 1670433 - DNA, 16 bp, Homo sapiens
ttaataggtaaaccaa

SEQ ID NO: 1670434 - DNA, 23 bp, Homo sapiens
ttaatagtcatcacatttctatg

SEQ ID NO: 1670435 - DNA, 17 bp, Homo sapiens
ttaatagtttgaagtgc

SEQ ID NO: 1670436 - DNA, 15 bp, Homo sapiens
ttaatagtttgtcta

SEQ ID NO: 1670437 - DNA, 18 bp, Homo sapiens
ttaatagtttgtctattt

SEQ ID NO: 1670438 - DNA, 21 bp, Homo sapiens
ttaatatagtgaaatggccac

SEQ ID NO: 1670439 - DNA, 16 bp, Homo sapiens
ttaatatatacatttt

SEQ ID NO: 1670440 - DNA, 20 bp, Homo sapiens
ttaatatattaaaattccaa

SEQ ID NO: 1670441 - DNA, 18 bp, Homo sapiens
ttaatatcaactctgaag

SEQ ID NO: 1670442 - DNA, 18 bp, Homo sapiens
ttaatatctggcactgtt

SEQ ID NO: 1670443 - DNA, 19 bp, Homo sapiens
ttaatatctggcactgtta

SEQ ID NO: 1670444 - DNA, 20 bp, Homo sapiens
ttaatatctggcactgttaa

SEQ ID NO: 1670445 - DNA, 12 bp, Homo sapiens
ttaatatgagtt

SEQ ID NO: 1670446 - DNA, 19 bp, Homo sapiens
ttaatattactgtctttat

SEQ ID NO: 1670447 - DNA, 23 bp, Homo sapiens
ttaatattatataggatattgct

SEQ ID NO: 1670448 - DNA, 16 bp, Homo sapiens
ttaatatttaacatta

SEQ ID NO: 1670449 - DNA, 18 bp, Homo sapiens
ttaatatttaccaaagta

SEQ ID NO: 1670450 - DNA, 20 bp, Homo sapiens
ttaatatttaccaaagtagg

SEQ ID NO: 1670451 - DNA, 20 bp, Homo sapiens
ttaatatttgctgacagctg

SEQ ID NO: 1670452 - DNA, 15 bp, Homo sapiens
ttaatattttgtatt

SEQ ID NO: 1670453 - DNA, 19 bp, Homo sapiens
ttaatcaaaggcatatctt

SEQ ID NO: 1670454 - DNA, 12 bp, Homo sapiens
ttaatcaagaga

SEQ ID NO: 1670455 - DNA, 20 bp, Homo sapiens
ttaatcaagatttttttcct

SEQ ID NO: 1670456 - DNA, 22 bp, Homo sapiens
ttaatcaatcatgccctgcctt

SEQ ID NO: 1670457 - DNA, 15 bp, Homo sapiens
ttaatcatacaaact

SEQ ID NO: 1670458 - DNA, 21 bp, Homo sapiens
ttaatcatacaaactctcacc

SEQ ID NO: 1670459 - DNA, 16 bp, Homo sapiens
ttaatcatagattatt

SEQ ID NO: 1670460 - DNA, 21 bp, Homo sapiens
ttaatcatctataaagaagaa

SEQ ID NO: 1670461 - DNA, 13 bp, Homo sapiens
ttaatcatgaaat

SEQ ID NO: 1670462 - DNA, 15 bp, Homo sapiens
ttaatcattttcatt

SEQ ID NO: 1670463 - DNA, 19 bp, Homo sapiens
ttaatcattttcattccta

SEQ ID NO: 1670464 - DNA, 18 bp, Homo sapiens
ttaatccagttataagaa

SEQ ID NO: 1670465 - DNA, 17 bp, Homo sapiens
ttaatccattaaaaagt

SEQ ID NO: 1670466 - DNA, 13 bp, Homo sapiens
ttaatcccagcac

SEQ ID NO: 1670467 - DNA, 16 bp, Homo sapiens
ttaatcccagcacttt

SEQ ID NO: 1670468 - DNA, 23 bp, Homo sapiens
ttaatccccatcattactggtaa

SEQ ID NO: 1670469 - DNA, 21 bp, Homo sapiens
ttaatctcaaagagattcgaa

SEQ ID NO: 1670470 - DNA, 19 bp, Homo sapiens
ttaatctctaaaattctag

SEQ ID NO: 1670471 - DNA, 20 bp, Homo sapiens
ttaatctctaaaattctagt

SEQ ID NO: 1670472 - DNA, 17 bp, Homo sapiens
ttaatcttagcttttaa

SEQ ID NO: 1670473 - DNA, 20 bp, Homo sapiens
ttaatcttcaaagccttctc

SEQ ID NO: 1670474 - DNA, 15 bp, Homo sapiens
ttaatcttcagtttt

SEQ ID NO: 1670475 - DNA, 22 bp, Homo sapiens
ttaatcttcagttttatcttta

SEQ ID NO: 1670476 - DNA, 23 bp, Homo sapiens
ttaatctttctttacctgagacc

SEQ ID NO: 1670477 - DNA, 22 bp, Homo sapiens
ttaatgaaatatctgtatttaa

SEQ ID NO: 1670478 - DNA, 16 bp, Homo sapiens
ttaatgaaatcaaatg

SEQ ID NO: 1670479 - DNA, 17 bp, Homo sapiens
ttaatgaagcttttgaa

SEQ ID NO: 1670480 - DNA, 22 bp, Homo sapiens
ttagagtcaactacacaaagca

SEQ ID NO: 1670481 - DNA, 16 bp, Homo sapiens
ttagagttaacaatga

SEQ ID NO: 1670482 - DNA, 21 bp, Homo sapiens
ttagataaagatttctagtag

SEQ ID NO: 1670483 - DNA, 21 bp, Homo sapiens
ttagataataactgtcttctg

SEQ ID NO: 1670484 - DNA, 14 bp, Homo sapiens
ttagatataacact

SEQ ID NO: 1670485 - DNA, 17 bp, Homo sapiens
ttagatataacactatg

SEQ ID NO: 1670486 - DNA, 20 bp, Homo sapiens
ttagatcccatgtcacctca

SEQ ID NO: 1670487 - DNA, 22 bp, Homo sapiens
ttagatctaaacagttatttct

SEQ ID NO: 1670488 - DNA, 21 bp, Homo sapiens
ttagatgatgactcaagattt

SEQ ID NO: 1670489 - DNA, 16 bp, Homo sapiens
ttagatggattctcca

SEQ ID NO: 1670490 - DNA, 23 bp, Homo sapiens
ttagatggattctccactcagtt

SEQ ID NO: 1670491 - DNA, 22 bp, Homo sapiens
ttagatgttgccatgtgtttta

SEQ ID NO: 1670492 - DNA, 23 bp, Homo sapiens
ttagattgaaaacttttctcaga

SEQ ID NO: 1670493 - DNA, 13 bp, Homo sapiens
ttagattgagaaa

SEQ ID NO: 1670494 - DNA, 12 bp, Homo sapiens
ttagattgcaaa

SEQ ID NO: 1670495 - DNA, 18 bp, Homo sapiens
ttagattttctggttcta

SEQ ID NO: 1670496 - DNA, 14 bp, Homo sapiens
ttagcaaactttgt

SEQ ID NO: 1670497 - DNA, 15 bp, Homo sapiens
ttagcaaagaggttg

SEQ ID NO: 1670498 - DNA, 12 bp, Homo sapiens
ttagcaaggatt

SEQ ID NO: 1670499 - DNA, 18 bp, Homo sapiens
ttagcagggatgttcctt

SEQ ID NO: 1670500 - DNA, 13 bp, Homo sapiens
ttagcatcaagtt

SEQ ID NO: 1670501 - DNA, 14 bp, Homo sapiens
ttagcatccaggct

SEQ ID NO: 1670502 - DNA, 19 bp, Homo sapiens
ttagcatgcgcgctgtggg

SEQ ID NO: 1670503 - DNA, 23 bp, Homo sapiens
ttagcatgctgctttttgtactt

SEQ ID NO: 1670504 - DNA, 20 bp, Homo sapiens
ttagcatgttcctccttttc

SEQ ID NO: 1670505 - DNA, 19 bp, Homo sapiens
ttagcccaagaggtctgag

SEQ ID NO: 1670506 - DNA, 21 bp, Homo sapiens
ttagcccaagaggtctgagcc

SEQ ID NO: 1670507 - DNA, 19 bp, Homo sapiens
ttagccccagaaaatgaaa

SEQ ID NO: 1670508 - DNA, 21 bp, Homo sapiens
ttagccccagaaaatgaaatc

SEQ ID NO: 1670509 - DNA, 14 bp, Homo sapiens
ttagccctgtctgc

SEQ ID NO: 1670510 - DNA, 13 bp, Homo sapiens
ttagcccttcaga

SEQ ID NO: 1670511 - DNA, 17 bp, Homo sapiens
ttagccgcccatgcact

SEQ ID NO: 1670512 - DNA, 15 bp, Homo sapiens
ttagcctaagatata

SEQ ID NO: 1670513 - DNA, 16 bp, Homo sapiens
ttagcctaagatatac

SEQ ID NO: 1670514 - DNA, 19 bp, Homo sapiens
ttagcctaagatatacttg

SEQ ID NO: 1670515 - DNA, 13 bp, Homo sapiens
ttagcctggacca

SEQ ID NO: 1670516 - DNA, 18 bp, Homo sapiens
ttagccttgtgccctgcc

SEQ ID NO: 1670517 - DNA, 18 bp, Homo sapiens
ttagcgaacttgtatact

SEQ ID NO: 1670518 - DNA, 13 bp, Homo sapiens
ttagcgtcaagac

SEQ ID NO: 1670519 - DNA, 19 bp, Homo sapiens
ttagcgtcaagacatttgc

SEQ ID NO: 1670520 - DNA, 21 bp, Homo sapiens
ttagcgtcaagacatttgctg

SEQ ID NO: 1670521 - DNA, 16 bp, Homo sapiens
ttagcgttctggactc

SEQ ID NO: 1670522 - DNA, 21 bp, Homo sapiens
ttagctactttggcattgctg

SEQ ID NO: 1670523 - DNA, 23 bp, Homo sapiens
ttagctactttggcattgctgca

SEQ ID NO: 1670524 - DNA, 13 bp, Homo sapiens
ttagctatttctg

SEQ ID NO: 1670525 - DNA, 18 bp, Homo sapiens
ttagctcccctccaacct

SEQ ID NO: 1670526 - DNA, 14 bp, Homo sapiens
ttagctcctgtggc

SEQ ID NO: 1670527 - DNA, 20 bp, Homo sapiens
ttagctctggacgtgaaata

SEQ ID NO: 1670528 - DNA, 22 bp, Homo sapiens
ttagctcttaattgttcatttt

SEQ ID NO: 1670529 - DNA, 19 bp, Homo sapiens
ttagctgacagtcagctgt

SEQ ID NO: 1670530 - DNA, 23 bp, Homo sapiens
ttagctgtactataagtagttgg

SEQ ID NO: 1670531 - DNA, 15 bp, Homo sapiens
ttagctgtctgctca

SEQ ID NO: 1670532 - DNA, 10 bp, Homo sapiens
ttagctgtgc

SEQ ID NO: 1670533 - DNA, 16 bp, Homo sapiens
ttagcttacaggaagc

SEQ ID NO: 1670534 - DNA, 17 bp, Homo sapiens
ttagcttagacctcagc

SEQ ID NO: 1670535 - DNA, 13 bp, Homo sapiens
ttagctttctcag

SEQ ID NO: 1670536 - DNA, 17 bp, Homo sapiens
ttagcttttaccttaaa

SEQ ID NO: 1670537 - DNA, 20 bp, Homo sapiens
ttaggaaaataaacagacaa

SEQ ID NO: 1670538 - DNA, 18 bp, Homo sapiens
ttaggaaaatcactttgt

SEQ ID NO: 1670539 - DNA, 16 bp, Homo sapiens
ttaggaaatttaagac

SEQ ID NO: 1670540 - DNA, 17 bp, Homo sapiens
ttaggaacttcagagat

SEQ ID NO: 1670541 - DNA, 13 bp, Homo sapiens
ttaggaagtgtaa

SEQ ID NO: 1670542 - DNA, 19 bp, Homo sapiens
ttaggaagtgtaacagctg

SEQ ID NO: 1670543 - DNA, 20 bp, Homo sapiens
ttaggaagtgtaacagctga

SEQ ID NO: 1670544 - DNA, 21 bp, Homo sapiens
ttaggaagtgtaacagctgag

SEQ ID NO: 1670545 - DNA, 18 bp, Homo sapiens
ttaggacaattactgtac

SEQ ID NO: 1670546 - DNA, 13 bp, Homo sapiens
ttaggactagaag

SEQ ID NO: 1670547 - DNA, 19 bp, Homo sapiens
ttaggactcttcttccata

SEQ ID NO: 1670548 - DNA, 20 bp, Homo sapiens
ttaggactcttcttccatat

SEQ ID NO: 1670549 - DNA, 16 bp, Homo sapiens
ttaggagaagccagga

SEQ ID NO: 1670550 - DNA, 15 bp, Homo sapiens
ttaggagctaaggct

SEQ ID NO: 1670551 - DNA, 16 bp, Homo sapiens
ttaggagctaaggctc

SEQ ID NO: 1670552 - DNA, 17 bp, Homo sapiens
ttaggagctaaggctct

SEQ ID NO: 1670553 - DNA, 14 bp, Homo sapiens
ttaggatctgcaaa

SEQ ID NO: 1670554 - DNA, 23 bp, Homo sapiens
ttaggcagcagcttttaatacag

SEQ ID NO: 1670555 - DNA, 16 bp, Homo sapiens
ttaggcatttcctgct

SEQ ID NO: 1670556 - DNA, 17 bp, Homo sapiens
ttaggccagcaacgctt

SEQ ID NO: 1670557 - DNA, 16 bp, Homo sapiens
ttaggccttcctctct

SEQ ID NO: 1670558 - DNA, 20 bp, Homo sapiens
ttaggctgtaactactttat

SEQ ID NO: 1670559 - DNA, 15 bp, Homo sapiens
ttaggctgttggttc

SEQ ID NO: 1670560 - DNA, 19 bp, Homo sapiens
ttaggctttgtatgacagt

SEQ ID NO: 1670561 - DNA, 23 bp, Homo sapiens
ttagggactacccatagacatga

SEQ ID NO: 1670562 - DNA, 15 bp, Homo sapiens
ttagggagagaagat

SEQ ID NO: 1670563 - DNA, 21 bp, Homo sapiens
ttagggtcctgtcgaagggga

SEQ ID NO: 1670564 - DNA, 20 bp, Homo sapiens
ttagggtgaaacttaaaaaa

SEQ ID NO: 1670565 - DNA, 23 bp, Homo sapiens
ttaggtaagaagttttaaaaagc

SEQ ID NO: 1670566 - DNA, 14 bp, Homo sapiens
ttaggtagaaaaac

SEQ ID NO: 1670567 - DNA, 14 bp, Homo sapiens
ttaggtagcacagc

SEQ ID NO: 1670568 - DNA, 23 bp, Homo sapiens
ttaggtccctcactccacagagt

SEQ ID NO: 1670569 - DNA, 13 bp, Homo sapiens
ttaggttctaaag

SEQ ID NO: 1670570 - DNA, 18 bp, Homo sapiens
ttaggttctaaagttcta

SEQ ID NO: 1670571 - DNA, 19 bp, Homo sapiens
ttaggttctaaagttctaa

SEQ ID NO: 1670572 - DNA, 16 bp, Homo sapiens
ttaggtttactgtgaa

SEQ ID NO: 1670573 - DNA, 17 bp, Homo sapiens
ttagtaatttctttttt

SEQ ID NO: 1670574 - DNA, 17 bp, Homo sapiens
ttagtacaataatctct

SEQ ID NO: 1670575 - DNA, 16 bp, Homo sapiens
ttagtactcaatgttt

SEQ ID NO: 1670576 - DNA, 23 bp, Homo sapiens
ttagtactttagactaattgtgt

SEQ ID NO: 1670577 - DNA, 13 bp, Homo sapiens
ttagtatgtctgt

SEQ ID NO: 1670578 - DNA, 19 bp, Homo sapiens
ttagtatgtctgtttttgt

SEQ ID NO: 1670579 - DNA, 15 bp, Homo sapiens
ttagtattaaaatct

SEQ ID NO: 1670580 - DNA, 13 bp, Homo sapiens
ttagtattatctt

SEQ ID NO: 1670581 - DNA, 20 bp, Homo sapiens
ttagtatttatttatgtact

SEQ ID NO: 1670582 - DNA, 15 bp, Homo sapiens
ttagtatttcagtgt

SEQ ID NO: 1670583 - DNA, 22 bp, Homo sapiens
ttagtatttcagtgttttcatt

SEQ ID NO: 1670584 - DNA, 14 bp, Homo sapiens
ttagtatttctcag

SEQ ID NO: 1670585 - DNA, 15 bp, Homo sapiens
ttagtatttctcagg

SEQ ID NO: 1670586 - DNA, 23 bp, Homo sapiens
ttagtcactgcctgcagaggtct

SEQ ID NO: 1670587 - DNA, 17 bp, Homo sapiens
ttagtccctcatgcaaa

SEQ ID NO: 1670588 - DNA, 19 bp, Homo sapiens
ttagtctgaaactggcttc

SEQ ID NO: 1670589 - DNA, 16 bp, Homo sapiens
ttagtcttttgtaata

SEQ ID NO: 1670590 - DNA, 16 bp, Homo sapiens
ttagtgattgtgtctg

SEQ ID NO: 1670591 - DNA, 17 bp, Homo sapiens
ttagtgcggacaagttt

SEQ ID NO: 1670592 - DNA, 11 bp, Homo sapiens
ttagtgctagt

SEQ ID NO: 1670593 - DNA, 20 bp, Homo sapiens
ttagtggctcaacattgtgt

SEQ ID NO: 1670594 - DNA, 15 bp, Homo sapiens
ttatgcgtgtgacag

SEQ ID NO: 1670595 - DNA, 23 bp, Homo sapiens
ttatgcgtgtgacagtgtatggg

SEQ ID NO: 1670596 - DNA, 14 bp, Homo sapiens
ttatgctgagtatg

SEQ ID NO: 1670597 - DNA, 17 bp, Homo sapiens
ttatgctgtgacacatg

SEQ ID NO: 1670598 - DNA, 23 bp, Homo sapiens
ttatggaagatagttttctcctt

SEQ ID NO: 1670599 - DNA, 17 bp, Homo sapiens
ttatggatatgctgctt

SEQ ID NO: 1670600 - DNA, 14 bp, Homo sapiens
ttatggcaagtgat

SEQ ID NO: 1670601 - DNA, 11 bp, Homo sapiens
ttatggcctca

SEQ ID NO: 1670602 - DNA, 18 bp, Homo sapiens
ttatggcctcagctgcct

SEQ ID NO: 1670603 - DNA, 17 bp, Homo sapiens
ttatggctataggtgct

SEQ ID NO: 1670604 - DNA, 18 bp, Homo sapiens
ttatggctataggtgcta

SEQ ID NO: 1670605 - DNA, 21 bp, Homo sapiens
ttatggctcactatgaatcta

SEQ ID NO: 1670606 - DNA, 17 bp, Homo sapiens
ttatgggatgtaaacaa

SEQ ID NO: 1670607 - DNA, 18 bp, Homo sapiens
ttatgggatgtaaacaat

SEQ ID NO: 1670608 - DNA, 15 bp, Homo sapiens
ttatgggtcacagga

SEQ ID NO: 1670609 - DNA, 17 bp, Homo sapiens
ttatgggtcctgcaatt

SEQ ID NO: 1670610 - DNA, 14 bp, Homo sapiens
ttatggttacttct

SEQ ID NO: 1670611 - DNA, 20 bp, Homo sapiens
ttatggttacttcttctctt

SEQ ID NO: 1670612 - DNA, 17 bp, Homo sapiens
ttatgtaaacaaatctt

SEQ ID NO: 1670613 - DNA, 22 bp, Homo sapiens
ttatgtaaatcacttcattgtt

SEQ ID NO: 1670614 - DNA, 18 bp, Homo sapiens
ttatgtaatatattgtac

SEQ ID NO: 1670615 - DNA, 16 bp, Homo sapiens
ttatgtaccatgaata

SEQ ID NO: 1670616 - DNA, 21 bp, Homo sapiens
ttatgtaccatgaatatttat

SEQ ID NO: 1670617 - DNA, 11 bp, Homo sapiens
ttatgtagttt

SEQ ID NO: 1670618 - DNA, 21 bp, Homo sapiens
ttatgtagtttttatatgttg

SEQ ID NO: 1670619 - DNA, 22 bp, Homo sapiens
ttatgtatggatatatttgaaa

SEQ ID NO: 1670620 - DNA, 11 bp, Homo sapiens
ttatgtattta

SEQ ID NO: 1670621 - DNA, 11 bp, Homo sapiens
ttatgtcatac

SEQ ID NO: 1670622 - DNA, 17 bp, Homo sapiens
ttatgtccactgtgtat

SEQ ID NO: 1670623 - DNA, 13 bp, Homo sapiens
ttatgtctctgcc

SEQ ID NO: 1670624 - DNA, 14 bp, Homo sapiens
ttatgtctctgcct

SEQ ID NO: 1670625 - DNA, 24 bp, Homo sapiens
ttatgtctcttgagcatcaatctt

SEQ ID NO: 1670626 - DNA, 21 bp, Homo sapiens
ttatgtctgctgaataataaa

SEQ ID NO: 1670627 - DNA, 16 bp, Homo sapiens
ttatgtgaaaaattaa

SEQ ID NO: 1670628 - DNA, 11 bp, Homo sapiens
ttatgtgaatt

SEQ ID NO: 1670629 - DNA, 19 bp, Homo sapiens
ttatgtgaatttttaagct

SEQ ID NO: 1670630 - DNA, 24 bp, Homo sapiens
ttatgtgctatgcaaaatagacat

SEQ ID NO: 1670631 - DNA, 18 bp, Homo sapiens
ttatgtggttttagattt

SEQ ID NO: 1670632 - DNA, 19 bp, Homo sapiens
ttatgtggttttagatttt

SEQ ID NO: 1670633 - DNA, 13 bp, Homo sapiens
ttatgtgtatgtg

SEQ ID NO: 1670634 - DNA, 20 bp, Homo sapiens
ttatgtgtatgtgagtattc

SEQ ID NO: 1670635 - DNA, 19 bp, Homo sapiens
ttatgtgtgaggagctgct

SEQ ID NO: 1670636 - DNA, 10 bp, Homo sapiens
ttatgtgtgt

SEQ ID NO: 1670637 - DNA, 14 bp, Homo sapiens
ttatgtgtgtgtgt

SEQ ID NO: 1670638 - DNA, 14 bp, Homo sapiens
ttatgtgttatgaa

SEQ ID NO: 1670639 - DNA, 19 bp, Homo sapiens
ttatgttgggtcaagtgtt

SEQ ID NO: 1670640 - DNA, 16 bp, Homo sapiens
ttatgtttattacaat

SEQ ID NO: 1670641 - DNA, 12 bp, Homo sapiens
ttattaaaatct

SEQ ID NO: 1670642 - DNA, 13 bp, Homo sapiens
ttattaaaattgt

SEQ ID NO: 1670643 - DNA, 21 bp, Homo sapiens
ttattaaacagatttttacaa

SEQ ID NO: 1670644 - DNA, 13 bp, Homo sapiens
ttattaaatgtat

SEQ ID NO: 1670645 - DNA, 17 bp, Homo sapiens
ttattaaattgtaaaac

SEQ ID NO: 1670646 - DNA, 17 bp, Homo sapiens
ttattaaatttatttga

SEQ ID NO: 1670647 - DNA, 19 bp, Homo sapiens
ttattaactactgaataat

SEQ ID NO: 1670648 - DNA, 22 bp, Homo sapiens
ttattaagtctgggatgtagaa

SEQ ID NO: 1670649 - DNA, 13 bp, Homo sapiens
ttattaatataat

SEQ ID NO: 1670650 - DNA, 19 bp, Homo sapiens
ttattaatatgagttactg

SEQ ID NO: 1670651 - DNA, 20 bp, Homo sapiens
ttattaatatgagttactga

SEQ ID NO: 1670652 - DNA, 18 bp, Homo sapiens
ttattaatatttaacatt

SEQ ID NO: 1670653 - DNA, 17 bp, Homo sapiens
ttattaatcttagtgta

SEQ ID NO: 1670654 - DNA, 23 bp, Homo sapiens
ttattacagggcattcaaatggg

SEQ ID NO: 1670655 - DNA, 22 bp, Homo sapiens
ttattaccccctccttcagaca

SEQ ID NO: 1670656 - DNA, 14 bp, Homo sapiens
ttattactgctaag

SEQ ID NO: 1670657 - DNA, 19 bp, Homo sapiens
ttattactgctaagtattt

SEQ ID NO: 1670658 - DNA, 13 bp, Homo sapiens
ttattagagattt

SEQ ID NO: 1670659 - DNA, 16 bp, Homo sapiens
ttattagcatttgttt

SEQ ID NO: 1670660 - DNA, 14 bp, Homo sapiens
ttattataaactat

SEQ ID NO: 1670661 - DNA, 21 bp, Homo sapiens
ttattataaactataaactta

SEQ ID NO: 1670662 - DNA, 22 bp, Homo sapiens
ttattataatcttataattgtt

SEQ ID NO: 1670663 - DNA, 23 bp, Homo sapiens
ttattatgttcttagcaataaat

SEQ ID NO: 1670664 - DNA, 15 bp, Homo sapiens
ttattattatttgct

SEQ ID NO: 1670665 - DNA, 22 bp, Homo sapiens
ttattatttgtgttttaattta

SEQ ID NO: 1670666 - DNA, 18 bp, Homo sapiens
ttattattttaaaatata

SEQ ID NO: 1670667 - DNA, 13 bp, Homo sapiens
ttattcaacacat

SEQ ID NO: 1670668 - DNA, 23 bp, Homo sapiens
ttattcaagaatgccagtagaaa

SEQ ID NO: 1670669 - DNA, 23 bp, Homo sapiens
ttattcaataaaaaaaagaaatg

SEQ ID NO: 1670670 - DNA, 19 bp, Homo sapiens
ttattcaattcctctggga

SEQ ID NO: 1670671 - DNA, 22 bp, Homo sapiens
ttattcacctttttaataaaaa

SEQ ID NO: 1670672 - DNA, 15 bp, Homo sapiens
ttattcactgtaagt

SEQ ID NO: 1670673 - DNA, 19 bp, Homo sapiens
ttattcactgtaagtttat

SEQ ID NO: 1670674 - DNA, 17 bp, Homo sapiens
ttattcagtaaacaaat

SEQ ID NO: 1670675 - DNA, 22 bp, Homo sapiens
ttattcagtaaacaaattcttt

SEQ ID NO: 1670676 - DNA, 22 bp, Homo sapiens
ttattcataatgaattataaca

SEQ ID NO: 1670677 - DNA, 22 bp, Homo sapiens
ttattcatgccatctgttttca

SEQ ID NO: 1670678 - DNA, 13 bp, Homo sapiens
ttattcatttaaa

SEQ ID NO: 1670679 - DNA, 17 bp, Homo sapiens
ttattcatttaaaatga

SEQ ID NO: 1670680 - DNA, 18 bp, Homo sapiens
ttattcccgacgacacat

SEQ ID NO: 1670681 - DNA, 17 bp, Homo sapiens
ttattccgagcattcca

SEQ ID NO: 1670682 - DNA, 21 bp, Homo sapiens
ttattcctgataataattgat

SEQ ID NO: 1670683 - DNA, 19 bp, Homo sapiens
ttattcctgtatgttgtcc

SEQ ID NO: 1670684 - DNA, 15 bp, Homo sapiens
ttattctaataaata

SEQ ID NO: 1670685 - DNA, 16 bp, Homo sapiens
ttattcttattactat

SEQ ID NO: 1670686 - DNA, 15 bp, Homo sapiens
ttattcttccagaat

SEQ ID NO: 1670687 - DNA, 14 bp, Homo sapiens
ttattcttgatgaa

SEQ ID NO: 1670688 - DNA, 12 bp, Homo sapiens
ttattcttgctg

SEQ ID NO: 1670689 - DNA, 14 bp, Homo sapiens
ttattctttgcact

SEQ ID NO: 1670690 - DNA, 15 bp, Homo sapiens
ttattctttgcactt

SEQ ID NO: 1670691 - DNA, 22 bp, Homo sapiens
ttattgaaaggggacacctgta

SEQ ID NO: 1670692 - DNA, 23 bp, Homo sapiens
ttattgaaaggggacacctgtac

SEQ ID NO: 1670693 - DNA, 12 bp, Homo sapiens
ttattgaatgtt

SEQ ID NO: 1670694 - DNA, 14 bp, Homo sapiens
ttattgacactgaa

SEQ ID NO: 1670695 - DNA, 18 bp, Homo sapiens
ttattgacagttgtgcag

SEQ ID NO: 1670696 - DNA, 13 bp, Homo sapiens
ttattgaccattt

SEQ ID NO: 1670697 - DNA, 17 bp, Homo sapiens
ttattgcaataaagtat

SEQ ID NO: 1670698 - DNA, 18 bp, Homo sapiens
ttattgccctaacaattt

SEQ ID NO: 1670699 - DNA, 15 bp, Homo sapiens
ttattgcctcccagg

SEQ ID NO: 1670700 - DNA, 21 bp, Homo sapiens
ttattgctcgcccagacacca

SEQ ID NO: 1670701 - DNA, 18 bp, Homo sapiens
ttattgctggtgcaaaga

SEQ ID NO: 1670702 - DNA, 18 bp, Homo sapiens
ttattggactccaggcct

SEQ ID NO: 1670703 - DNA, 23 bp, Homo sapiens
ttattggactccaggcctgacca

SEQ ID NO: 1670704 - DNA, 12 bp, Homo sapiens
ttattggccact

SEQ ID NO: 1670705 - DNA, 15 bp, Homo sapiens
ttattggctgagata

SEQ ID NO: 1670706 - DNA, 22 bp, Homo sapiens
ttattgggagtcttaataaaat

SEQ ID NO: 1670707 - DNA, 19 bp, Homo sapiens
ttattgggcaagtgattga

SEQ ID NO: 1670708 - DNA, 19 bp, Homo sapiens
ttattggtgagttaggaac

SEQ ID NO: 1670709 - DNA, 15 bp, Homo sapiens
ttcagccctcagaag

SEQ ID NO: 1670710 - DNA, 23 bp, Homo sapiens
ttcagcctagccgacctcagcct

SEQ ID NO: 1670711 - DNA, 22 bp, Homo sapiens
ttcagctaaagtaacagagcat

SEQ ID NO: 1670712 - DNA, 20 bp, Homo sapiens
ttcagctaagctaggaatga

SEQ ID NO: 1670713 - DNA, 19 bp, Homo sapiens
ttcagctagcttttaggaa

SEQ ID NO: 1670714 - DNA, 22 bp, Homo sapiens
ttcagctcaactcacagcttct

SEQ ID NO: 1670715 - DNA, 19 bp, Homo sapiens
ttcagctctttccaaatta

SEQ ID NO: 1670716 - DNA, 20 bp, Homo sapiens
ttcagctctttccaaattaa

SEQ ID NO: 1670717 - DNA, 13 bp, Homo sapiens
ttcagctcttttt

SEQ ID NO: 1670718 - DNA, 15 bp, Homo sapiens
ttcagcttgtttcta

SEQ ID NO: 1670719 - DNA, 20 bp, Homo sapiens
ttcagctttaaaggccagga

SEQ ID NO: 1670720 - DNA, 22 bp, Homo sapiens
ttcagctttctcgcgccctccc

SEQ ID NO: 1670721 - DNA, 19 bp, Homo sapiens
ttcaggaatgtgtggcctg

SEQ ID NO: 1670722 - DNA, 19 bp, Homo sapiens
ttcaggaggccctggtgtc

SEQ ID NO: 1670723 - DNA, 20 bp, Homo sapiens
ttcaggatattggttcttcc

SEQ ID NO: 1670724 - DNA, 13 bp, Homo sapiens
ttcaggccagccc

SEQ ID NO: 1670725 - DNA, 16 bp, Homo sapiens
ttcaggccagcccagc

SEQ ID NO: 1670726 - DNA, 16 bp, Homo sapiens
ttcaggctgcttggga

SEQ ID NO: 1670727 - DNA, 22 bp, Homo sapiens
ttcagggaatttcaggaactag

SEQ ID NO: 1670728 - DNA, 17 bp, Homo sapiens
ttcagggaccgtccagg

SEQ ID NO: 1670729 - DNA, 16 bp, Homo sapiens
ttcaggggactcagcc

SEQ ID NO: 1670730 - DNA, 23 bp, Homo sapiens
ttcaggggactcagccctgaggt

SEQ ID NO: 1670731 - DNA, 23 bp, Homo sapiens
ttcagggtaaataggaatcattc

SEQ ID NO: 1670732 - DNA, 17 bp, Homo sapiens
ttcaggtacagaaaaca

SEQ ID NO: 1670733 - DNA, 20 bp, Homo sapiens
ttcaggtggatgaggagaca

SEQ ID NO: 1670734 - DNA, 17 bp, Homo sapiens
ttcagtaaataatgaaa

SEQ ID NO: 1670735 - DNA, 20 bp, Homo sapiens
ttcagtaataaactgtgttt

SEQ ID NO: 1670736 - DNA, 14 bp, Homo sapiens
ttcagtactttttt

SEQ ID NO: 1670737 - DNA, 17 bp, Homo sapiens
ttcagtagaattaccat

SEQ ID NO: 1670738 - DNA, 14 bp, Homo sapiens
ttcagtaggaactg

SEQ ID NO: 1670739 - DNA, 15 bp, Homo sapiens
ttcagtatactgtgt

SEQ ID NO: 1670740 - DNA, 17 bp, Homo sapiens
ttcagtattttttactt

SEQ ID NO: 1670741 - DNA, 17 bp, Homo sapiens
ttcagtccaataggtgt

SEQ ID NO: 1670742 - DNA, 17 bp, Homo sapiens
ttcagtcccctctctct

SEQ ID NO: 1670743 - DNA, 19 bp, Homo sapiens
ttcagtcccctctctctgg

SEQ ID NO: 1670744 - DNA, 15 bp, Homo sapiens
ttcagtctcacagag

SEQ ID NO: 1670745 - DNA, 17 bp, Homo sapiens
ttcagtctcacagagaa

SEQ ID NO: 1670746 - DNA, 23 bp, Homo sapiens
ttcagtctctataccaataaagt

SEQ ID NO: 1670747 - DNA, 21 bp, Homo sapiens
ttcagtgaagatgctgtaaat

SEQ ID NO: 1670748 - DNA, 22 bp, Homo sapiens
ttcagtgaagatgctgtaaata

SEQ ID NO: 1670749 - DNA, 21 bp, Homo sapiens
ttcagtgaatatttttgtatt

SEQ ID NO: 1670750 - DNA, 17 bp, Homo sapiens
ttcagtgactcctgctg

SEQ ID NO: 1670751 - DNA, 15 bp, Homo sapiens
ttcagtgccttcaac

SEQ ID NO: 1670752 - DNA, 21 bp, Homo sapiens
ttcagtgctgtggcctgggca

SEQ ID NO: 1670753 - DNA, 23 bp, Homo sapiens
ttcagtggaccgaaatctgtatt

SEQ ID NO: 1670754 - DNA, 19 bp, Homo sapiens
ttcagtggcttcccagctc

SEQ ID NO: 1670755 - DNA, 16 bp, Homo sapiens
ttcagtgtaaagtgtg

SEQ ID NO: 1670756 - DNA, 12 bp, Homo sapiens
ttcagtgtacat

SEQ ID NO: 1670757 - DNA, 13 bp, Homo sapiens
ttcagtgtcccgg

SEQ ID NO: 1670758 - DNA, 22 bp, Homo sapiens
ttcagtgttacctgtgtgcttg

SEQ ID NO: 1670759 - DNA, 16 bp, Homo sapiens
ttcagtgttttcattt

SEQ ID NO: 1670760 - DNA, 19 bp, Homo sapiens
ttcagttaattcttagata

SEQ ID NO: 1670761 - DNA, 14 bp, Homo sapiens
ttcagttctttgga

SEQ ID NO: 1670762 - DNA, 23 bp, Homo sapiens
ttcagttgtttgtttttgcttgt

SEQ ID NO: 1670763 - DNA, 18 bp, Homo sapiens
ttcagtttaatgtctcct

SEQ ID NO: 1670764 - DNA, 17 bp, Homo sapiens
ttcagttttatctttaa

SEQ ID NO: 1670765 - DNA, 13 bp, Homo sapiens
ttcataaaaataa

SEQ ID NO: 1670766 - DNA, 20 bp, Homo sapiens
ttcataaatacaaaaatgaa

SEQ ID NO: 1670767 - DNA, 16 bp, Homo sapiens
ttcataacttcctgta

SEQ ID NO: 1670768 - DNA, 23 bp, Homo sapiens
ttcataacttgctgaatttcagg

SEQ ID NO: 1670769 - DNA, 19 bp, Homo sapiens
ttcataagtattatgtctc

SEQ ID NO: 1670770 - DNA, 20 bp, Homo sapiens
ttcataagtattatgtctct

SEQ ID NO: 1670771 - DNA, 16 bp, Homo sapiens
ttcataataaaagtga

SEQ ID NO: 1670772 - DNA, 18 bp, Homo sapiens
ttcataatcagtaaatag

SEQ ID NO: 1670773 - DNA, 21 bp, Homo sapiens
ttcataatcagtaaatagtgt

SEQ ID NO: 1670774 - DNA, 19 bp, Homo sapiens
ttcatagagatttgtctaa

SEQ ID NO: 1670775 - DNA, 19 bp, Homo sapiens
ttcatagatattttatatg

SEQ ID NO: 1670776 - DNA, 17 bp, Homo sapiens
ttcatagcatcctgatt

SEQ ID NO: 1670777 - DNA, 15 bp, Homo sapiens
ttcatagctgtactt

SEQ ID NO: 1670778 - DNA, 21 bp, Homo sapiens
ttcataggcggtcatgtgtgc

SEQ ID NO: 1670779 - DNA, 19 bp, Homo sapiens
ttcatagtataactttaaa

SEQ ID NO: 1670780 - DNA, 20 bp, Homo sapiens
ttcatatgtaccatgtacat

SEQ ID NO: 1670781 - DNA, 22 bp, Homo sapiens
ttcatattaagacagtgtacaa

SEQ ID NO: 1670782 - DNA, 14 bp, Homo sapiens
ttcatattcagctt

SEQ ID NO: 1670783 - DNA, 21 bp, Homo sapiens
ttcatatttacttcttataca

SEQ ID NO: 1670784 - DNA, 11 bp, Homo sapiens
ttcatatttgt

SEQ ID NO: 1670785 - DNA, 14 bp, Homo sapiens
ttcatatttgtact

SEQ ID NO: 1670786 - DNA, 20 bp, Homo sapiens
ttcatatttgtactttctgt

SEQ ID NO: 1670787 - DNA, 21 bp, Homo sapiens
ttcatcatcctaagctattca

SEQ ID NO: 1670788 - DNA, 17 bp, Homo sapiens
ttcatcattccctctca

SEQ ID NO: 1670789 - DNA, 15 bp, Homo sapiens
ttcatcattgtttct

SEQ ID NO: 1670790 - DNA, 16 bp, Homo sapiens
ttcatccaatcctcac

SEQ ID NO: 1670791 - DNA, 15 bp, Homo sapiens
ttcatcccattccag

SEQ ID NO: 1670792 - DNA, 17 bp, Homo sapiens
ttcatcccgtatcacag

SEQ ID NO: 1670793 - DNA, 15 bp, Homo sapiens
ttcatccttccccaa

SEQ ID NO: 1670794 - DNA, 21 bp, Homo sapiens
ttcatctaatgtattatgagc

SEQ ID NO: 1670795 - DNA, 19 bp, Homo sapiens
ttcatctaccttttctggc

SEQ ID NO: 1670796 - DNA, 23 bp, Homo sapiens
ttcatctatggcagtccagccag

SEQ ID NO: 1670797 - DNA, 14 bp, Homo sapiens
ttcatctccaggga

SEQ ID NO: 1670798 - DNA, 22 bp, Homo sapiens
ttcatctccagggagtcccctc

SEQ ID NO: 1670799 - DNA, 20 bp, Homo sapiens
ttcatctctctacctccacc

SEQ ID NO: 1670800 - DNA, 16 bp, Homo sapiens
ttcatctgaaaagcag

SEQ ID NO: 1670801 - DNA, 17 bp, Homo sapiens
ttcatctgaaaagcagt

SEQ ID NO: 1670802 - DNA, 15 bp, Homo sapiens
ttcatctgctctcct

SEQ ID NO: 1670803 - DNA, 19 bp, Homo sapiens
ttcatctgctctccttcct

SEQ ID NO: 1670804 - DNA, 15 bp, Homo sapiens
ttcatctggattcta

SEQ ID NO: 1670805 - DNA, 19 bp, Homo sapiens
ttcatctggcaacatcttt

SEQ ID NO: 1670806 - DNA, 17 bp, Homo sapiens
ttcatctgggaggcaga

SEQ ID NO: 1670807 - DNA, 13 bp, Homo sapiens
ttcatctgtaact

SEQ ID NO: 1670808 - DNA, 19 bp, Homo sapiens
ttcatctgtaactctaaaa

SEQ ID NO: 1670809 - DNA, 23 bp, Homo sapiens
ttcatctgtaactctaaaagatc

SEQ ID NO: 1670810 - DNA, 14 bp, Homo sapiens
ttcatcttctggaa

SEQ ID NO: 1670811 - DNA, 15 bp, Homo sapiens
ttcatcttctggaat

SEQ ID NO: 1670812 - DNA, 18 bp, Homo sapiens
ttcatcttgcagcattta

SEQ ID NO: 1670813 - DNA, 21 bp, Homo sapiens
ttcatcttgcagcatttacta

SEQ ID NO: 1670814 - DNA, 17 bp, Homo sapiens
ttcatcttttattttgg

SEQ ID NO: 1670815 - DNA, 18 bp, Homo sapiens
ttcatcttttattttgga

SEQ ID NO: 1670816 - DNA, 19 bp, Homo sapiens
ttcatcttttattttggaa

SEQ ID NO: 1670817 - DNA, 19 bp, Homo sapiens
ttcatgaatgtgctggtga

SEQ ID NO: 1670818 - DNA, 21 bp, Homo sapiens
ttcatgaatgtgctggtgaac

SEQ ID NO: 1670819 - DNA, 15 bp, Homo sapiens
ttcatgacagcctcc

SEQ ID NO: 1670820 - DNA, 16 bp, Homo sapiens
ttcatgaccagtaaag

SEQ ID NO: 1670821 - DNA, 15 bp, Homo sapiens
ttcatgattagaaat

SEQ ID NO: 1670822 - DNA, 23 bp, Homo sapiens
ttcatgatttcatttcaactgtt

SEQ ID NO: 1670823 - DNA, 19 bp, Homo sapiens
ttcccttcagtaccctctc

SEQ ID NO: 1670824 - DNA, 22 bp, Homo sapiens
ttcccttcagtaccctctcagc

SEQ ID NO: 1670825 - DNA, 23 bp, Homo sapiens
ttcccttcagtaccctctcagct

SEQ ID NO: 1670826 - DNA, 13 bp, Homo sapiens
ttcccttccaaag

SEQ ID NO: 1670827 - DNA, 13 bp, Homo sapiens
ttcccttcccaga

SEQ ID NO: 1670828 - DNA, 12 bp, Homo sapiens
ttcccttccctc

SEQ ID NO: 1670829 - DNA, 21 bp, Homo sapiens
ttcccttcctcttcctgccct

SEQ ID NO: 1670830 - DNA, 11 bp, Homo sapiens
ttcccttctcc

SEQ ID NO: 1670831 - DNA, 22 bp, Homo sapiens
ttcccttctcccttgccctccc

SEQ ID NO: 1670832 - DNA, 12 bp, Homo sapiens
ttcccttctctt

SEQ ID NO: 1670833 - DNA, 14 bp, Homo sapiens
ttcccttctcttgg

SEQ ID NO: 1670834 - DNA, 22 bp, Homo sapiens
ttcccttgaaactttgggaaaa

SEQ ID NO: 1670835 - DNA, 14 bp, Homo sapiens
ttcccttgctttgt

SEQ ID NO: 1670836 - DNA, 11 bp, Homo sapiens
ttcccttggcc

SEQ ID NO: 1670837 - DNA, 13 bp, Homo sapiens
ttcccttgtattt

SEQ ID NO: 1670838 - DNA, 23 bp, Homo sapiens
ttcccttgtgtcaagacatttct

SEQ ID NO: 1670839 - DNA, 17 bp, Homo sapiens
ttccctttggagatgct

SEQ ID NO: 1670840 - DNA, 12 bp, Homo sapiens
ttccctttgtga

SEQ ID NO: 1670841 - DNA, 18 bp, Homo sapiens
ttcccttttacatactgc

SEQ ID NO: 1670842 - DNA, 20 bp, Homo sapiens
ttcccttttccctcccagtt

SEQ ID NO: 1670843 - DNA, 16 bp, Homo sapiens
ttccgacatcccagac

SEQ ID NO: 1670844 - DNA, 20 bp, Homo sapiens
ttccgagacaccacaaggca

SEQ ID NO: 1670845 - DNA, 16 bp, Homo sapiens
ttccgccactcagcca

SEQ ID NO: 1670846 - DNA, 23 bp, Homo sapiens
ttccgctttgaaagaagcaagac

SEQ ID NO: 1670847 - DNA, 22 bp, Homo sapiens
ttccggatcctaagcatctaag

SEQ ID NO: 1670848 - DNA, 20 bp, Homo sapiens
ttccgtaggtagatgtgtaa

SEQ ID NO: 1670849 - DNA, 18 bp, Homo sapiens
ttccgtatttaaagttgt

SEQ ID NO: 1670850 - DNA, 21 bp, Homo sapiens
ttccgtcacttaaatttgttc

SEQ ID NO: 1670851 - DNA, 17 bp, Homo sapiens
ttccgtgaaaacggagc

SEQ ID NO: 1670852 - DNA, 15 bp, Homo sapiens
ttccgtttgcttttg

SEQ ID NO: 1670853 - DNA, 17 bp, Homo sapiens
ttccgtttgcttttgtt

SEQ ID NO: 1670854 - DNA, 23 bp, Homo sapiens
ttccgtttttttttttttattgt

SEQ ID NO: 1670855 - DNA, 13 bp, Homo sapiens
ttcctaaagaaaa

SEQ ID NO: 1670856 - DNA, 16 bp, Homo sapiens
ttcctaacaaaatgag

SEQ ID NO: 1670857 - DNA, 18 bp, Homo sapiens
ttcctaacacagcatgtg

SEQ ID NO: 1670858 - DNA, 21 bp, Homo sapiens
ttcctaactagaattagtatg

SEQ ID NO: 1670859 - DNA, 21 bp, Homo sapiens
ttcctaacttacccagatgtt

SEQ ID NO: 1670860 - DNA, 22 bp, Homo sapiens
ttcctaacttttcaatgacatt

SEQ ID NO: 1670861 - DNA, 13 bp, Homo sapiens
ttcctaagccact

SEQ ID NO: 1670862 - DNA, 20 bp, Homo sapiens
ttcctacaacttaatggaaa

SEQ ID NO: 1670863 - DNA, 16 bp, Homo sapiens
ttcctacccaaccact

SEQ ID NO: 1670864 - DNA, 14 bp, Homo sapiens
ttcctacccccgtc

SEQ ID NO: 1670865 - DNA, 16 bp, Homo sapiens
ttcctacctccctgca

SEQ ID NO: 1670866 - DNA, 15 bp, Homo sapiens
ttcctagaagtggtt

SEQ ID NO: 1670867 - DNA, 18 bp, Homo sapiens
ttcctagataaaaagatg

SEQ ID NO: 1670868 - DNA, 19 bp, Homo sapiens
ttcctaggcattgcaggac

SEQ ID NO: 1670869 - DNA, 17 bp, Homo sapiens
ttcctagggatctgaaa

SEQ ID NO: 1670870 - DNA, 20 bp, Homo sapiens
ttcctataatataataaata

SEQ ID NO: 1670871 - DNA, 20 bp, Homo sapiens
ttcctatagctacatgttct

SEQ ID NO: 1670872 - DNA, 14 bp, Homo sapiens
ttcctatatcctgt

SEQ ID NO: 1670873 - DNA, 18 bp, Homo sapiens
ttcctatgacacagttat

SEQ ID NO: 1670874 - DNA, 13 bp, Homo sapiens
ttcctattgtaat

SEQ ID NO: 1670875 - DNA, 16 bp, Homo sapiens
ttcctatttcagaagt

SEQ ID NO: 1670876 - DNA, 15 bp, Homo sapiens
ttcctcaaaaagcag

SEQ ID NO: 1670877 - DNA, 14 bp, Homo sapiens
ttcctcaaattttt

SEQ ID NO: 1670878 - DNA, 13 bp, Homo sapiens
ttcctcacatttg

SEQ ID NO: 1670879 - DNA, 15 bp, Homo sapiens
ttcctcactatgaca

SEQ ID NO: 1670880 - DNA, 15 bp, Homo sapiens
ttcctcagcctccaa

SEQ ID NO: 1670881 - DNA, 21 bp, Homo sapiens
ttcctcatgaatgtaaatttg

SEQ ID NO: 1670882 - DNA, 22 bp, Homo sapiens
ttcctcatgaatgtaaatttgt

SEQ ID NO: 1670883 - DNA, 15 bp, Homo sapiens
ttcctcatgtaacat

SEQ ID NO: 1670884 - DNA, 21 bp, Homo sapiens
ttcctcatgtaacattggtga

SEQ ID NO: 1670885 - DNA, 16 bp, Homo sapiens
ttcctcattcctgaaa

SEQ ID NO: 1670886 - DNA, 17 bp, Homo sapiens
ttcctccacatcctttc

SEQ ID NO: 1670887 - DNA, 13 bp, Homo sapiens
ttcctccacccat

SEQ ID NO: 1670888 - DNA, 17 bp, Homo sapiens
ttcctccccacactcca

SEQ ID NO: 1670889 - DNA, 23 bp, Homo sapiens
ttcctccccattagagtcagcct

SEQ ID NO: 1670890 - DNA, 14 bp, Homo sapiens
ttcctccccctgca

SEQ ID NO: 1670891 - DNA, 14 bp, Homo sapiens
ttcctccgtccacc

SEQ ID NO: 1670892 - DNA, 22 bp, Homo sapiens
ttcctccgtccacccaggctgc

SEQ ID NO: 1670893 - DNA, 13 bp, Homo sapiens
ttcctcctcaggc

SEQ ID NO: 1670894 - DNA, 10 bp, Homo sapiens
ttcctcctcc

SEQ ID NO: 1670895 - DNA, 21 bp, Homo sapiens
ttcctcctccacagtgctgct

SEQ ID NO: 1670896 - DNA, 14 bp, Homo sapiens
ttcctcctccaccc

SEQ ID NO: 1670897 - DNA, 23 bp, Homo sapiens
ttcctcctccacccacccccttt

SEQ ID NO: 1670898 - DNA, 11 bp, Homo sapiens
ttcctcctccc

SEQ ID NO: 1670899 - DNA, 14 bp, Homo sapiens
ttcctcctgatgga

SEQ ID NO: 1670900 - DNA, 11 bp, Homo sapiens
ttcctcctgga

SEQ ID NO: 1670901 - DNA, 15 bp, Homo sapiens
ttcctcctttacctt

SEQ ID NO: 1670902 - DNA, 19 bp, Homo sapiens
ttcctcggtgggccagagc

SEQ ID NO: 1670903 - DNA, 15 bp, Homo sapiens
ttcctctaactcact

SEQ ID NO: 1670904 - DNA, 15 bp, Homo sapiens
ttcctctagaagcca

SEQ ID NO: 1670905 - DNA, 23 bp, Homo sapiens
ttcctctatactttgttctgttg

SEQ ID NO: 1670906 - DNA, 13 bp, Homo sapiens
ttcctctccactg

SEQ ID NO: 1670907 - DNA, 16 bp, Homo sapiens
ttcctctccactgcct

SEQ ID NO: 1670908 - DNA, 21 bp, Homo sapiens
ttcctctccactgctggacat

SEQ ID NO: 1670909 - DNA, 15 bp, Homo sapiens
ttcctctctccagat

SEQ ID NO: 1670910 - DNA, 11 bp, Homo sapiens
ttcctctgccc

SEQ ID NO: 1670911 - DNA, 16 bp, Homo sapiens
ttcctctgcctgcccc

SEQ ID NO: 1670912 - DNA, 13 bp, Homo sapiens
ttcctctggttcc

SEQ ID NO: 1670913 - DNA, 17 bp, Homo sapiens
ttcctctggttcctttc

SEQ ID NO: 1670914 - DNA, 22 bp, Homo sapiens
ttcctcttagcctctggatcta

SEQ ID NO: 1670915 - DNA, 15 bp, Homo sapiens
ttcctcttcttgttg

SEQ ID NO: 1670916 - DNA, 14 bp, Homo sapiens
ttcctctttctgct

SEQ ID NO: 1670917 - DNA, 18 bp, Homo sapiens
ttcctgaaacaacttgga

SEQ ID NO: 1670918 - DNA, 16 bp, Homo sapiens
ttcctgaacctggaaa

SEQ ID NO: 1670919 - DNA, 17 bp, Homo sapiens
ttcctgaacctggaaat

SEQ ID NO: 1670920 - DNA, 18 bp, Homo sapiens
ttcctgaatccaaactaa

SEQ ID NO: 1670921 - DNA, 22 bp, Homo sapiens
ttcctgacactttaattaccaa

SEQ ID NO: 1670922 - DNA, 13 bp, Homo sapiens
ttcctgacccagg

SEQ ID NO: 1670923 - DNA, 22 bp, Homo sapiens
ttcctgacccaggccgcagctc

SEQ ID NO: 1670924 - DNA, 23 bp, Homo sapiens
ttcctgacccaggccgcagctct

SEQ ID NO: 1670925 - DNA, 20 bp, Homo sapiens
ttcctgacctccgccatcca

SEQ ID NO: 1670926 - DNA, 16 bp, Homo sapiens
ttcctgactctcacct

SEQ ID NO: 1670927 - DNA, 17 bp, Homo sapiens
ttcctgagctgtcgctg

SEQ ID NO: 1670928 - DNA, 18 bp, Homo sapiens
ttcctgagctgtcgctgc

SEQ ID NO: 1670929 - DNA, 20 bp, Homo sapiens
ttcctgatatgatttaaaac

SEQ ID NO: 1670930 - DNA, 18 bp, Homo sapiens
ttcctgattgtttacagt

SEQ ID NO: 1670931 - DNA, 12 bp, Homo sapiens
ttcctgcattca

SEQ ID NO: 1670932 - DNA, 16 bp, Homo sapiens
ttcctgccccaggcct

SEQ ID NO: 1670933 - DNA, 16 bp, Homo sapiens
ttcctgcccttcctca

SEQ ID NO: 1670934 - DNA, 18 bp, Homo sapiens
ttcctgccgcaacagttt

SEQ ID NO: 1670935 - DNA, 16 bp, Homo sapiens
ttcctgcctgtctcct

SEQ ID NO: 1670936 - DNA, 15 bp, Homo sapiens
ttcctgcctttaagc

SEQ ID NO: 1670937 - DNA, 17 bp, Homo sapiens
ttcctgcctttaagcca

SEQ ID NO: 1670938 - DNA, 15 bp, Homo sapiens
ttctagcttttctct

SEQ ID NO: 1670939 - DNA, 19 bp, Homo sapiens
ttctaggcatctctgtact

SEQ ID NO: 1670940 - DNA, 22 bp, Homo sapiens
ttctaggcccattgtcctcctt

SEQ ID NO: 1670941 - DNA, 15 bp, Homo sapiens
ttctaggttctaaaa

SEQ ID NO: 1670942 - DNA, 17 bp, Homo sapiens
ttctaggtttcaaagat

SEQ ID NO: 1670943 - DNA, 21 bp, Homo sapiens
ttctaggtttcaaagatgctg

SEQ ID NO: 1670944 - DNA, 19 bp, Homo sapiens
ttctagtatttttttctta

SEQ ID NO: 1670945 - DNA, 21 bp, Homo sapiens
ttctagtctcctttgcactga

SEQ ID NO: 1670946 - DNA, 18 bp, Homo sapiens
ttctagtgcagctgaaat

SEQ ID NO: 1670947 - DNA, 21 bp, Homo sapiens
ttctagtgtaacactgcaaga

SEQ ID NO: 1670948 - DNA, 15 bp, Homo sapiens
ttctagtgtagaatt

SEQ ID NO: 1670949 - DNA, 22 bp, Homo sapiens
ttctagtttcccacaatataaa

SEQ ID NO: 1670950 - DNA, 18 bp, Homo sapiens
ttctagtttgcaacttca

SEQ ID NO: 1670951 - DNA, 13 bp, Homo sapiens
ttctagttttgtc

SEQ ID NO: 1670952 - DNA, 21 bp, Homo sapiens
ttctataaaactctgcatgta

SEQ ID NO: 1670953 - DNA, 14 bp, Homo sapiens
ttctataaatcagt

SEQ ID NO: 1670954 - DNA, 24 bp, Homo sapiens
ttctatactgtttgtaatatacag

SEQ ID NO: 1670955 - DNA, 15 bp, Homo sapiens
ttctatagttctaga

SEQ ID NO: 1670956 - DNA, 17 bp, Homo sapiens
ttctatagttctagaca

SEQ ID NO: 1670957 - DNA, 22 bp, Homo sapiens
ttctatatagttccttgcctta

SEQ ID NO: 1670958 - DNA, 12 bp, Homo sapiens
ttctatatgaat

SEQ ID NO: 1670959 - DNA, 15 bp, Homo sapiens
ttctatattttaata

SEQ ID NO: 1670960 - DNA, 14 bp, Homo sapiens
ttctatcacatatt

SEQ ID NO: 1670961 - DNA, 12 bp, Homo sapiens
ttctatcattcc

SEQ ID NO: 1670962 - DNA, 16 bp, Homo sapiens
ttctatccatctcctg

SEQ ID NO: 1670963 - DNA, 17 bp, Homo sapiens
ttctatctgcaaatagt

SEQ ID NO: 1670964 - DNA, 17 bp, Homo sapiens
ttctatgacaaattcaa

SEQ ID NO: 1670965 - DNA, 18 bp, Homo sapiens
ttctatgacaaattcaag

SEQ ID NO: 1670966 - DNA, 19 bp, Homo sapiens
ttctatgacaaattcaaga

SEQ ID NO: 1670967 - DNA, 14 bp, Homo sapiens
ttctatgcctgtat

SEQ ID NO: 1670968 - DNA, 17 bp, Homo sapiens
ttctatgtatgttaatt

SEQ ID NO: 1670969 - DNA, 12 bp, Homo sapiens
ttctattaaagt

SEQ ID NO: 1670970 - DNA, 21 bp, Homo sapiens
ttctattaaagtgctaaggtt

SEQ ID NO: 1670971 - DNA, 17 bp, Homo sapiens
ttctattaactttaatt

SEQ ID NO: 1670972 - DNA, 22 bp, Homo sapiens
ttctattaatatcaactctgaa

SEQ ID NO: 1670973 - DNA, 22 bp, Homo sapiens
ttctattaatcaagagaaactt

SEQ ID NO: 1670974 - DNA, 12 bp, Homo sapiens
ttctattgaaaa

SEQ ID NO: 1670975 - DNA, 17 bp, Homo sapiens
ttctattgacttcaatg

SEQ ID NO: 1670976 - DNA, 19 bp, Homo sapiens
ttctattgttaaacaaatg

SEQ ID NO: 1670977 - DNA, 17 bp, Homo sapiens
ttctattgtttattctt

SEQ ID NO: 1670978 - DNA, 15 bp, Homo sapiens
ttctatttatttact

SEQ ID NO: 1670979 - DNA, 16 bp, Homo sapiens
ttctatttctatctgc

SEQ ID NO: 1670980 - DNA, 15 bp, Homo sapiens
ttctatttgctgggc

SEQ ID NO: 1670981 - DNA, 18 bp, Homo sapiens
ttctatttttatcatgaa

SEQ ID NO: 1670982 - DNA, 15 bp, Homo sapiens
ttctattttttgttt

SEQ ID NO: 1670983 - DNA, 23 bp, Homo sapiens
ttctattttttgttttgtttcct

SEQ ID NO: 1670984 - DNA, 21 bp, Homo sapiens
ttctcaaaagaggttacttta

SEQ ID NO: 1670985 - DNA, 23 bp, Homo sapiens
ttctcaaaagaggttactttagt

SEQ ID NO: 1670986 - DNA, 13 bp, Homo sapiens
ttctcaaacacag

SEQ ID NO: 1670987 - DNA, 12 bp, Homo sapiens
ttctcaaagcag

SEQ ID NO: 1670988 - DNA, 18 bp, Homo sapiens
ttctcaaaggagcgagca

SEQ ID NO: 1670989 - DNA, 20 bp, Homo sapiens
ttctcaaaggccctcagtga

SEQ ID NO: 1670990 - DNA, 13 bp, Homo sapiens
ttctcaagaatct

SEQ ID NO: 1670991 - DNA, 14 bp, Homo sapiens
ttctcaagaatcta

SEQ ID NO: 1670992 - DNA, 16 bp, Homo sapiens
ttctcaagaatctaga

SEQ ID NO: 1670993 - DNA, 13 bp, Homo sapiens
ttctcaagacctg

SEQ ID NO: 1670994 - DNA, 14 bp, Homo sapiens
ttctcaagccctgc

SEQ ID NO: 1670995 - DNA, 15 bp, Homo sapiens
ttctcaagccctgca

SEQ ID NO: 1670996 - DNA, 14 bp, Homo sapiens
ttctcaagttctaa

SEQ ID NO: 1670997 - DNA, 22 bp, Homo sapiens
ttctcacacccaccgtccgccc

SEQ ID NO: 1670998 - DNA, 15 bp, Homo sapiens
ttctcactccaccac

SEQ ID NO: 1670999 - DNA, 21 bp, Homo sapiens
ttctcagaagcacagaatatt

SEQ ID NO: 1671000 - DNA, 17 bp, Homo sapiens
ttctcagaatccaaaga

SEQ ID NO: 1671001 - DNA, 18 bp, Homo sapiens
ttctcagaatccaaagat

SEQ ID NO: 1671002 - DNA, 20 bp, Homo sapiens
ttctcagaatccaaagatca

SEQ ID NO: 1671003 - DNA, 22 bp, Homo sapiens
ttctcagaatctcaaataacta

SEQ ID NO: 1671004 - DNA, 13 bp, Homo sapiens
ttctcagacctcc

SEQ ID NO: 1671005 - DNA, 12 bp, Homo sapiens
ttctcagagtgt

SEQ ID NO: 1671006 - DNA, 15 bp, Homo sapiens
ttctcagatccttgt

SEQ ID NO: 1671007 - DNA, 18 bp, Homo sapiens
ttctcagcttgcagctgg

SEQ ID NO: 1671008 - DNA, 20 bp, Homo sapiens
ttctcaggctctgccctgcc

SEQ ID NO: 1671009 - DNA, 17 bp, Homo sapiens
ttctcagggggtcagca

SEQ ID NO: 1671010 - DNA, 16 bp, Homo sapiens
ttctcaggtgttgcca

SEQ ID NO: 1671011 - DNA, 15 bp, Homo sapiens
ttctcagtgtctgaa

SEQ ID NO: 1671012 - DNA, 14 bp, Homo sapiens
ttctcagttttcat

SEQ ID NO: 1671013 - DNA, 15 bp, Homo sapiens
ttctcagttttcata

SEQ ID NO: 1671014 - DNA, 20 bp, Homo sapiens
ttctcataggaaaagtacat

SEQ ID NO: 1671015 - DNA, 20 bp, Homo sapiens
ttctcatcatattgtatgta

SEQ ID NO: 1671016 - DNA, 13 bp, Homo sapiens
ttctcatgaagca

SEQ ID NO: 1671017 - DNA, 14 bp, Homo sapiens
ttctcatgatccaa

SEQ ID NO: 1671018 - DNA, 13 bp, Homo sapiens
ttctcatgcctca

SEQ ID NO: 1671019 - DNA, 14 bp, Homo sapiens
ttctcatgcctcag

SEQ ID NO: 1671020 - DNA, 15 bp, Homo sapiens
ttctcattaaaagaa

SEQ ID NO: 1671021 - DNA, 14 bp, Homo sapiens
ttctcattctgtgc

SEQ ID NO: 1671022 - DNA, 18 bp, Homo sapiens
ttctcattgaccgtgctg

SEQ ID NO: 1671023 - DNA, 14 bp, Homo sapiens
ttctcattgtttgt

SEQ ID NO: 1671024 - DNA, 17 bp, Homo sapiens
ttctccacactccactg

SEQ ID NO: 1671025 - DNA, 19 bp, Homo sapiens
ttctccacactccactgac

SEQ ID NO: 1671026 - DNA, 21 bp, Homo sapiens
ttctccacctagactgtaaac

SEQ ID NO: 1671027 - DNA, 13 bp, Homo sapiens
ttctccagccagc

SEQ ID NO: 1671028 - DNA, 14 bp, Homo sapiens
ttctccagccagca

SEQ ID NO: 1671029 - DNA, 15 bp, Homo sapiens
ttctccagctgggct

SEQ ID NO: 1671030 - DNA, 17 bp, Homo sapiens
ttctccagcttcagctc

SEQ ID NO: 1671031 - DNA, 13 bp, Homo sapiens
ttctccagtggtg

SEQ ID NO: 1671032 - DNA, 15 bp, Homo sapiens
ttctccagttagaat

SEQ ID NO: 1671033 - DNA, 18 bp, Homo sapiens
ttctccatctggcagggt

SEQ ID NO: 1671034 - DNA, 15 bp, Homo sapiens
ttctcccaagaaacc

SEQ ID NO: 1671035 - DNA, 22 bp, Homo sapiens
ttctcccacatgaggccatctc

SEQ ID NO: 1671036 - DNA, 11 bp, Homo sapiens
ttctcccagcg

SEQ ID NO: 1671037 - DNA, 15 bp, Homo sapiens
ttctccccagccaga

SEQ ID NO: 1671038 - DNA, 14 bp, Homo sapiens
ttctccccctgggc

SEQ ID NO: 1671039 - DNA, 13 bp, Homo sapiens
ttctcccctccct

SEQ ID NO: 1671040 - DNA, 16 bp, Homo sapiens
ttctcccctccctcca

SEQ ID NO: 1671041 - DNA, 19 bp, Homo sapiens
ttctcccctgcactgtaaa

SEQ ID NO: 1671042 - DNA, 20 bp, Homo sapiens
ttctcccctgcactgtaaaa

SEQ ID NO: 1671043 - DNA, 15 bp, Homo sapiens
ttctcccctgccccc

SEQ ID NO: 1671044 - DNA, 16 bp, Homo sapiens
ttctcccctgccccca

SEQ ID NO: 1671045 - DNA, 16 bp, Homo sapiens
ttctcccctgccggtg

SEQ ID NO: 1671046 - DNA, 19 bp, Homo sapiens
ttctcccctgggtcctcca

SEQ ID NO: 1671047 - DNA, 21 bp, Homo sapiens
ttctcccgttcacgttgccta

SEQ ID NO: 1671048 - DNA, 22 bp, Homo sapiens
ttctccctcacccccaggtgtt

SEQ ID NO: 1671049 - DNA, 16 bp, Homo sapiens
ttctccgccagcctcc

SEQ ID NO: 1671050 - DNA, 18 bp, Homo sapiens
ttctccgccagcctcctc

SEQ ID NO: 1671051 - DNA, 16 bp, Homo sapiens
ttctccggggtctgtg

SEQ ID NO: 1671052 - DNA, 19 bp, Homo sapiens
ttctccggggtctgtgctg

SEQ ID NO: 1671053 - DNA, 16 bp, Homo sapiens
ttctccgttagctcct

SEQ ID NO: 1671054 - DNA, 13 bp, Homo sapiens
ttctgtgaagagg

SEQ ID NO: 1671055 - DNA, 16 bp, Homo sapiens
ttctgtgacccatctg

SEQ ID NO: 1671056 - DNA, 23 bp, Homo sapiens
ttctgtgactgaagaagatgagc

SEQ ID NO: 1671057 - DNA, 17 bp, Homo sapiens
ttctgtgatgagctgat

SEQ ID NO: 1671058 - DNA, 14 bp, Homo sapiens
ttctgtgcctcccc

SEQ ID NO: 1671059 - DNA, 15 bp, Homo sapiens
ttctgtgcctccccc

SEQ ID NO: 1671060 - DNA, 22 bp, Homo sapiens
ttctgtgcctccccccagaccc

SEQ ID NO: 1671061 - DNA, 13 bp, Homo sapiens
ttctgtgcctgaa

SEQ ID NO: 1671062 - DNA, 17 bp, Homo sapiens
ttctgtgcctgaatatt

SEQ ID NO: 1671063 - DNA, 20 bp, Homo sapiens
ttctgtgctaatcaaaactt

SEQ ID NO: 1671064 - DNA, 21 bp, Homo sapiens
ttctgtggagggttgccatgg

SEQ ID NO: 1671065 - DNA, 14 bp, Homo sapiens
ttctgtggattcta

SEQ ID NO: 1671066 - DNA, 15 bp, Homo sapiens
ttctgtggattctat

SEQ ID NO: 1671067 - DNA, 22 bp, Homo sapiens
ttctgtggcgaggcatgctatc

SEQ ID NO: 1671068 - DNA, 22 bp, Homo sapiens
ttctgtgggagaattcttacat

SEQ ID NO: 1671069 - DNA, 16 bp, Homo sapiens
ttctgtggttcctctg

SEQ ID NO: 1671070 - DNA, 22 bp, Homo sapiens
ttctgtggtttcatgttagtta

SEQ ID NO: 1671071 - DNA, 12 bp, Homo sapiens
ttctgtgtcttt

SEQ ID NO: 1671072 - DNA, 18 bp, Homo sapiens
ttctgtgtttataaaata

SEQ ID NO: 1671073 - DNA, 15 bp, Homo sapiens
ttctgtgtttctgga

SEQ ID NO: 1671074 - DNA, 17 bp, Homo sapiens
ttctgtgtttctggagt

SEQ ID NO: 1671075 - DNA, 16 bp, Homo sapiens
ttctgttaaaatgcat

SEQ ID NO: 1671076 - DNA, 22 bp, Homo sapiens
ttctgttaaaatgcatgattgc

SEQ ID NO: 1671077 - DNA, 15 bp, Homo sapiens
ttctgttattgtatt

SEQ ID NO: 1671078 - DNA, 14 bp, Homo sapiens
ttctgttctgttga

SEQ ID NO: 1671079 - DNA, 22 bp, Homo sapiens
ttctgttcttacaaatgtgaaa

SEQ ID NO: 1671080 - DNA, 17 bp, Homo sapiens
ttctgtttattcttcca

SEQ ID NO: 1671081 - DNA, 12 bp, Homo sapiens
ttctgtttcaag

SEQ ID NO: 1671082 - DNA, 23 bp, Homo sapiens
ttctgtttcaaggcactctagat

SEQ ID NO: 1671083 - DNA, 14 bp, Homo sapiens
ttctgtttggcact

SEQ ID NO: 1671084 - DNA, 13 bp, Homo sapiens
ttctgtttttaat

SEQ ID NO: 1671085 - DNA, 23 bp, Homo sapiens
ttcttaaaaaaataaaatatttt

SEQ ID NO: 1671086 - DNA, 14 bp, Homo sapiens
ttcttaaaaaggaa

SEQ ID NO: 1671087 - DNA, 12 bp, Homo sapiens
ttcttaaaagta

SEQ ID NO: 1671088 - DNA, 18 bp, Homo sapiens
ttcttaaaagtactttaa

SEQ ID NO: 1671089 - DNA, 23 bp, Homo sapiens
ttcttaaaagtactttaaaaagg

SEQ ID NO: 1671090 - DNA, 12 bp, Homo sapiens
ttcttaaatatg

SEQ ID NO: 1671091 - DNA, 23 bp, Homo sapiens
ttcttaacaaactcttcagttaa

SEQ ID NO: 1671092 - DNA, 21 bp, Homo sapiens
ttcttaagaaaacaaactctt

SEQ ID NO: 1671093 - DNA, 18 bp, Homo sapiens
ttcttaagacatgtatca

SEQ ID NO: 1671094 - DNA, 20 bp, Homo sapiens
ttcttaaggattgtgatatt

SEQ ID NO: 1671095 - DNA, 22 bp, Homo sapiens
ttcttaagtatgttattttctg

SEQ ID NO: 1671096 - DNA, 23 bp, Homo sapiens
ttcttaatgagatatttgtattt

SEQ ID NO: 1671097 - DNA, 18 bp, Homo sapiens
ttcttaatgtaacatgtt

SEQ ID NO: 1671098 - DNA, 22 bp, Homo sapiens
ttcttacagcacatcacctctt

SEQ ID NO: 1671099 - DNA, 14 bp, Homo sapiens
ttcttacatgcatt

SEQ ID NO: 1671100 - DNA, 22 bp, Homo sapiens
ttcttacctactattggcccta

SEQ ID NO: 1671101 - DNA, 15 bp, Homo sapiens
ttcttacctgtatgt

SEQ ID NO: 1671102 - DNA, 22 bp, Homo sapiens
ttcttactattaagcagtaaaa

SEQ ID NO: 1671103 - DNA, 23 bp, Homo sapiens
ttcttagctcttaattgttcatt

SEQ ID NO: 1671104 - DNA, 15 bp, Homo sapiens
ttcttagctttgaaa

SEQ ID NO: 1671105 - DNA, 23 bp, Homo sapiens
ttcttagggattaaatatagatg

SEQ ID NO: 1671106 - DNA, 18 bp, Homo sapiens
ttcttaggggaaggagaa

SEQ ID NO: 1671107 - DNA, 16 bp, Homo sapiens
ttcttaggtttactgt

SEQ ID NO: 1671108 - DNA, 23 bp, Homo sapiens
ttcttaggtttactgtgaagaga

SEQ ID NO: 1671109 - DNA, 23 bp, Homo sapiens
ttcttagtgcttcagagtttgtg

SEQ ID NO: 1671110 - DNA, 24 bp, Homo sapiens
ttcttagttcatatatcaagaagt

SEQ ID NO: 1671111 - DNA, 20 bp, Homo sapiens
ttcttatgtgacattaacaa

SEQ ID NO: 1671112 - DNA, 13 bp, Homo sapiens
ttcttatttcatt

SEQ ID NO: 1671113 - DNA, 15 bp, Homo sapiens
ttcttattttagtat

SEQ ID NO: 1671114 - DNA, 20 bp, Homo sapiens
ttcttattttgcattccaga

SEQ ID NO: 1671115 - DNA, 17 bp, Homo sapiens
ttcttatttttgtactt

SEQ ID NO: 1671116 - DNA, 16 bp, Homo sapiens
ttcttcaaacctttgt

SEQ ID NO: 1671117 - DNA, 15 bp, Homo sapiens
ttcttcacaggcact

SEQ ID NO: 1671118 - DNA, 14 bp, Homo sapiens
ttcttcacccagct

SEQ ID NO: 1671119 - DNA, 15 bp, Homo sapiens
ttcttcacctcttcc

SEQ ID NO: 1671120 - DNA, 16 bp, Homo sapiens
ttcttcacctttgtaa

SEQ ID NO: 1671121 - DNA, 14 bp, Homo sapiens
ttcttcagaagaca

SEQ ID NO: 1671122 - DNA, 18 bp, Homo sapiens
ttcttcagcttgatcctg

SEQ ID NO: 1671123 - DNA, 18 bp, Homo sapiens
ttcttcagtgtaatgtga

SEQ ID NO: 1671124 - DNA, 15 bp, Homo sapiens
ttcttcatattctaa

SEQ ID NO: 1671125 - DNA, 18 bp, Homo sapiens
ttcttcatgcaatgacat

SEQ ID NO: 1671126 - DNA, 21 bp, Homo sapiens
ttcttcattcaatacaagtgt

SEQ ID NO: 1671127 - DNA, 17 bp, Homo sapiens
ttcttccaaaaagattt

SEQ ID NO: 1671128 - DNA, 15 bp, Homo sapiens
ttcttccagaatgct

SEQ ID NO: 1671129 - DNA, 16 bp, Homo sapiens
ttcttccagaatgctg

SEQ ID NO: 1671130 - DNA, 19 bp, Homo sapiens
ttcttcccaacttgccttt

SEQ ID NO: 1671131 - DNA, 17 bp, Homo sapiens
ttcttcccactttcatc

SEQ ID NO: 1671132 - DNA, 20 bp, Homo sapiens
ttcttcccagaatctctgag

SEQ ID NO: 1671133 - DNA, 20 bp, Homo sapiens
ttcttccccaggtccttcct

SEQ ID NO: 1671134 - DNA, 14 bp, Homo sapiens
ttcttcccgctccc

SEQ ID NO: 1671135 - DNA, 17 bp, Homo sapiens
ttcttcccgctccccac

SEQ ID NO: 1671136 - DNA, 17 bp, Homo sapiens
ttcttcccttaactcca

SEQ ID NO: 1671137 - DNA, 21 bp, Homo sapiens
ttcttcccttctcttcactag

SEQ ID NO: 1671138 - DNA, 22 bp, Homo sapiens
ttcttcccttttacatactgct

SEQ ID NO: 1671139 - DNA, 14 bp, Homo sapiens
ttcttcccttttcc

SEQ ID NO: 1671140 - DNA, 18 bp, Homo sapiens
ttcttccgggggaagggg

SEQ ID NO: 1671141 - DNA, 15 bp, Homo sapiens
ttcttcctgccagca

SEQ ID NO: 1671142 - DNA, 19 bp, Homo sapiens
ttcttcctttgaagcttta

SEQ ID NO: 1671143 - DNA, 23 bp, Homo sapiens
ttcttcgctggactattgtgcca

SEQ ID NO: 1671144 - DNA, 14 bp, Homo sapiens
ttcttctaagaaga

SEQ ID NO: 1671145 - DNA, 20 bp, Homo sapiens
ttcttctaagaagacatttt

SEQ ID NO: 1671146 - DNA, 21 bp, Homo sapiens
ttcttctaagaagacattttg

SEQ ID NO: 1671147 - DNA, 22 bp, Homo sapiens
ttcttctaagaagacattttgt

SEQ ID NO: 1671148 - DNA, 15 bp, Homo sapiens
ttcttctagagttca

SEQ ID NO: 1671149 - DNA, 18 bp, Homo sapiens
ttcttctaggttctaaaa

SEQ ID NO: 1671150 - DNA, 19 bp, Homo sapiens
ttcttctcttagattctta

SEQ ID NO: 1671151 - DNA, 19 bp, Homo sapiens
ttcttctgaagattcttaa

SEQ ID NO: 1671152 - DNA, 14 bp, Homo sapiens
ttcttctggtgcta

SEQ ID NO: 1671153 - DNA, 16 bp, Homo sapiens
ttcttctggtgctact

SEQ ID NO: 1671154 - DNA, 21 bp, Homo sapiens
ttcttctgtgtttataaaata

SEQ ID NO: 1671155 - DNA, 12 bp, Homo sapiens
ttcttctttcta

SEQ ID NO: 1671156 - DNA, 17 bp, Homo sapiens
ttcttgaatataaaaaa

SEQ ID NO: 1671157 - DNA, 15 bp, Homo sapiens
ttcttgaatatctgc

SEQ ID NO: 1671158 - DNA, 22 bp, Homo sapiens
ttcttgacaagctgacttggca

SEQ ID NO: 1671159 - DNA, 21 bp, Homo sapiens
ttcttgatcaacatcttttct

SEQ ID NO: 1671160 - DNA, 18 bp, Homo sapiens
ttcttgatcttaaagatc

SEQ ID NO: 1671161 - DNA, 22 bp, Homo sapiens
ttcttgatgatcctcaaggaaa

SEQ ID NO: 1671162 - DNA, 20 bp, Homo sapiens
ttcttgatgtaaaatcttgt

SEQ ID NO: 1671163 - DNA, 15 bp, Homo sapiens
ttcttgatgtcatgt

SEQ ID NO: 1671164 - DNA, 16 bp, Homo sapiens
ttcttgcaaatacctc

SEQ ID NO: 1671165 - DNA, 16 bp, Homo sapiens
ttcttgcctctgtgct

SEQ ID NO: 1671166 - DNA, 22 bp, Homo sapiens
ttcttgcctctgtgctgtgtgt

SEQ ID NO: 1671167 - DNA, 22 bp, Homo sapiens
ttcttgcgatagtttactgaga

SEQ ID NO: 1671168 - DNA, 22 bp, Homo sapiens
ttgacttcttggtttggggaga

SEQ ID NO: 1671169 - DNA, 21 bp, Homo sapiens
ttgactttcaggtactaaata

SEQ ID NO: 1671170 - DNA, 21 bp, Homo sapiens
ttgacttttataaagcatgtt

SEQ ID NO: 1671171 - DNA, 17 bp, Homo sapiens
ttgacttttcaataaat

SEQ ID NO: 1671172 - DNA, 18 bp, Homo sapiens
ttgacttttctgtaattc

SEQ ID NO: 1671173 - DNA, 16 bp, Homo sapiens
ttgactttttgcattt

SEQ ID NO: 1671174 - DNA, 17 bp, Homo sapiens
ttgactttttgcattta

SEQ ID NO: 1671175 - DNA, 22 bp, Homo sapiens
ttgagaaatgaataatttccca

SEQ ID NO: 1671176 - DNA, 19 bp, Homo sapiens
ttgagaactgcatatgttt

SEQ ID NO: 1671177 - DNA, 21 bp, Homo sapiens
ttgagaactgcatatgtttcg

SEQ ID NO: 1671178 - DNA, 18 bp, Homo sapiens
ttgagaagaaaacatcta

SEQ ID NO: 1671179 - DNA, 21 bp, Homo sapiens
ttgagaatgtttgaaaattag

SEQ ID NO: 1671180 - DNA, 16 bp, Homo sapiens
ttgagacaagccctgg

SEQ ID NO: 1671181 - DNA, 22 bp, Homo sapiens
ttgagacactggtttacacttt

SEQ ID NO: 1671182 - DNA, 13 bp, Homo sapiens
ttgagaccagcct

SEQ ID NO: 1671183 - DNA, 21 bp, Homo sapiens
ttgagaccagcctggccaaca

SEQ ID NO: 1671184 - DNA, 23 bp, Homo sapiens
ttgagagaaatatgaagaactga

SEQ ID NO: 1671185 - DNA, 14 bp, Homo sapiens
ttgagagactgcca

SEQ ID NO: 1671186 - DNA, 23 bp, Homo sapiens
ttgagagcccgcgtgctggagaa

SEQ ID NO: 1671187 - DNA, 16 bp, Homo sapiens
ttgagagcttggcctt

SEQ ID NO: 1671188 - DNA, 19 bp, Homo sapiens
ttgagaggccctggggttc

SEQ ID NO: 1671189 - DNA, 14 bp, Homo sapiens
ttgagagttctaaa

SEQ ID NO: 1671190 - DNA, 18 bp, Homo sapiens
ttgagagttttgtcttga

SEQ ID NO: 1671191 - DNA, 16 bp, Homo sapiens
ttgagataaagtcaaa

SEQ ID NO: 1671192 - DNA, 16 bp, Homo sapiens
ttgagataaggtttta

SEQ ID NO: 1671193 - DNA, 19 bp, Homo sapiens
ttgagataatatctgtgag

SEQ ID NO: 1671194 - DNA, 23 bp, Homo sapiens
ttgagatgtgctttgctgcacaa

SEQ ID NO: 1671195 - DNA, 19 bp, Homo sapiens
ttgagcatgcacagctgct

SEQ ID NO: 1671196 - DNA, 13 bp, Homo sapiens
ttgagcccaggag

SEQ ID NO: 1671197 - DNA, 14 bp, Homo sapiens
ttgagccccaagtc

SEQ ID NO: 1671198 - DNA, 18 bp, Homo sapiens
ttgagcctcccccaaagc

SEQ ID NO: 1671199 - DNA, 20 bp, Homo sapiens
ttgagcgtgaatctgtatct

SEQ ID NO: 1671200 - DNA, 16 bp, Homo sapiens
ttgagctattcacctc

SEQ ID NO: 1671201 - DNA, 20 bp, Homo sapiens
ttgagctattcacctcagta

SEQ ID NO: 1671202 - DNA, 23 bp, Homo sapiens
ttgagctcagacccccactctca

SEQ ID NO: 1671203 - DNA, 19 bp, Homo sapiens
ttgagctcccctggagcca

SEQ ID NO: 1671204 - DNA, 14 bp, Homo sapiens
ttgagctgaaatgc

SEQ ID NO: 1671205 - DNA, 11 bp, Homo sapiens
ttgagctgcct

SEQ ID NO: 1671206 - DNA, 19 bp, Homo sapiens
ttgagctgccttccctagc

SEQ ID NO: 1671207 - DNA, 20 bp, Homo sapiens
ttgagctgctttttttgaaa

SEQ ID NO: 1671208 - DNA, 12 bp, Homo sapiens
ttgagctggcct

SEQ ID NO: 1671209 - DNA, 16 bp, Homo sapiens
ttgagcttaatctttg

SEQ ID NO: 1671210 - DNA, 15 bp, Homo sapiens
ttgaggacttcttgc

SEQ ID NO: 1671211 - DNA, 23 bp, Homo sapiens
ttgaggagaagggggtctctgtt

SEQ ID NO: 1671212 - DNA, 13 bp, Homo sapiens
ttgaggcaagtgt

SEQ ID NO: 1671213 - DNA, 13 bp, Homo sapiens
ttgaggccaggag

SEQ ID NO: 1671214 - DNA, 14 bp, Homo sapiens
ttgagggaaggttc

SEQ ID NO: 1671215 - DNA, 21 bp, Homo sapiens
ttgaggtaggagaattgcttg

SEQ ID NO: 1671216 - DNA, 17 bp, Homo sapiens
ttgaggtttggaagagt

SEQ ID NO: 1671217 - DNA, 20 bp, Homo sapiens
ttgaggtttggaagagtgaa

SEQ ID NO: 1671218 - DNA, 22 bp, Homo sapiens
ttgaggtttttaaatatatatt

SEQ ID NO: 1671219 - DNA, 12 bp, Homo sapiens
ttgagtaatggt

SEQ ID NO: 1671220 - DNA, 17 bp, Homo sapiens
ttgagtacctactgtgt

SEQ ID NO: 1671221 - DNA, 19 bp, Homo sapiens
ttgagtacctactgtgtgc

SEQ ID NO: 1671222 - DNA, 15 bp, Homo sapiens
ttgagtattgtttaa

SEQ ID NO: 1671223 - DNA, 20 bp, Homo sapiens
ttgagtcagtgcatttcaag

SEQ ID NO: 1671224 - DNA, 17 bp, Homo sapiens
ttgagtcctaggactta

SEQ ID NO: 1671225 - DNA, 12 bp, Homo sapiens
ttgagtgagaag

SEQ ID NO: 1671226 - DNA, 16 bp, Homo sapiens
ttgagtgcactaaaca

SEQ ID NO: 1671227 - DNA, 17 bp, Homo sapiens
ttgagtggatgatgttt

SEQ ID NO: 1671228 - DNA, 13 bp, Homo sapiens
ttgagtggctgtc

SEQ ID NO: 1671229 - DNA, 18 bp, Homo sapiens
ttgagtgttcctttttaa

SEQ ID NO: 1671230 - DNA, 23 bp, Homo sapiens
ttgagtgttcctttttaaatgtg

SEQ ID NO: 1671231 - DNA, 11 bp, Homo sapiens
ttgagtttgtc

SEQ ID NO: 1671232 - DNA, 15 bp, Homo sapiens
ttgataaaagagttc

SEQ ID NO: 1671233 - DNA, 13 bp, Homo sapiens
ttgataaagtttc

SEQ ID NO: 1671234 - DNA, 18 bp, Homo sapiens
ttgataaccttgaaaaaa

SEQ ID NO: 1671235 - DNA, 21 bp, Homo sapiens
ttgataagctattgtctgtaa

SEQ ID NO: 1671236 - DNA, 22 bp, Homo sapiens
ttgataagctattgtctgtaat

SEQ ID NO: 1671237 - DNA, 20 bp, Homo sapiens
ttgataagggactgatgttt

SEQ ID NO: 1671238 - DNA, 21 bp, Homo sapiens
ttgataatatatattaagtgt

SEQ ID NO: 1671239 - DNA, 16 bp, Homo sapiens
ttgataatattagtga

SEQ ID NO: 1671240 - DNA, 22 bp, Homo sapiens
ttgataatattagtgattctga

SEQ ID NO: 1671241 - DNA, 15 bp, Homo sapiens
ttgataatgctttca

SEQ ID NO: 1671242 - DNA, 23 bp, Homo sapiens
ttgataatgctttcacaacattt

SEQ ID NO: 1671243 - DNA, 15 bp, Homo sapiens
ttgataattgcattc

SEQ ID NO: 1671244 - DNA, 17 bp, Homo sapiens
ttgatacataataaaaa

SEQ ID NO: 1671245 - DNA, 19 bp, Homo sapiens
ttgatagctttatttttta

SEQ ID NO: 1671246 - DNA, 16 bp, Homo sapiens
ttgataggaactgtct

SEQ ID NO: 1671247 - DNA, 19 bp, Homo sapiens
ttgatagggaactggggaa

SEQ ID NO: 1671248 - DNA, 17 bp, Homo sapiens
ttgatagttctataaga

SEQ ID NO: 1671249 - DNA, 19 bp, Homo sapiens
ttgatatacattgtgtgaa

SEQ ID NO: 1671250 - DNA, 13 bp, Homo sapiens
ttgatataccaaa

SEQ ID NO: 1671251 - DNA, 17 bp, Homo sapiens
ttgatatctataaaata

SEQ ID NO: 1671252 - DNA, 15 bp, Homo sapiens
ttgatattatattaa

SEQ ID NO: 1671253 - DNA, 17 bp, Homo sapiens
ttgatcaaattcatttt

SEQ ID NO: 1671254 - DNA, 17 bp, Homo sapiens
ttgatcaacatcttttc

SEQ ID NO: 1671255 - DNA, 18 bp, Homo sapiens
ttgatcaacatcttttct

SEQ ID NO: 1671256 - DNA, 16 bp, Homo sapiens
ttgatcacacagtgtt

SEQ ID NO: 1671257 - DNA, 18 bp, Homo sapiens
ttgatcagtagtttgcat

SEQ ID NO: 1671258 - DNA, 16 bp, Homo sapiens
ttgatcatgtactttt

SEQ ID NO: 1671259 - DNA, 12 bp, Homo sapiens
ttgatctctctt

SEQ ID NO: 1671260 - DNA, 14 bp, Homo sapiens
ttgatctctcttgt

SEQ ID NO: 1671261 - DNA, 18 bp, Homo sapiens
ttgatctctcttgtcctc

SEQ ID NO: 1671262 - DNA, 22 bp, Homo sapiens
ttgatctctcttgtcctcttct

SEQ ID NO: 1671263 - DNA, 14 bp, Homo sapiens
ttgatctggaaccc

SEQ ID NO: 1671264 - DNA, 16 bp, Homo sapiens
ttgatctggaacccag

SEQ ID NO: 1671265 - DNA, 14 bp, Homo sapiens
ttgatcttaaagat

SEQ ID NO: 1671266 - DNA, 15 bp, Homo sapiens
ttgatgaaaagcttt

SEQ ID NO: 1671267 - DNA, 20 bp, Homo sapiens
ttgatgaaacgtcatgtgtt

SEQ ID NO: 1671268 - DNA, 18 bp, Homo sapiens
ttgatgagttaactgtga

SEQ ID NO: 1671269 - DNA, 16 bp, Homo sapiens
ttgatgccagagggcc

SEQ ID NO: 1671270 - DNA, 18 bp, Homo sapiens
ttgatgccagagggccag

SEQ ID NO: 1671271 - DNA, 19 bp, Homo sapiens
ttgatggagggtggaaata

SEQ ID NO: 1671272 - DNA, 22 bp, Homo sapiens
ttgatggtggactaagcaattt

SEQ ID NO: 1671273 - DNA, 13 bp, Homo sapiens
ttgatgtaaaatc

SEQ ID NO: 1671274 - DNA, 16 bp, Homo sapiens
ttgatgtaaaatcttg

SEQ ID NO: 1671275 - DNA, 18 bp, Homo sapiens
ttgatgtaaggactgtaa

SEQ ID NO: 1671276 - DNA, 21 bp, Homo sapiens
ttgatgtacagattttatttg

SEQ ID NO: 1671277 - DNA, 20 bp, Homo sapiens
ttgatgtacagtctgtcatg

SEQ ID NO: 1671278 - DNA, 11 bp, Homo sapiens
ttgatgtacat

SEQ ID NO: 1671279 - DNA, 20 bp, Homo sapiens
ttgatgtacataactcctgt

SEQ ID NO: 1671280 - DNA, 23 bp, Homo sapiens
ttgatgtacataactcctgtccc

SEQ ID NO: 1671281 - DNA, 12 bp, Homo sapiens
ttgatgtatgtg

SEQ ID NO: 1671282 - DNA, 15 bp, Homo sapiens
ttgctaatttttatt

SEQ ID NO: 1671283 - DNA, 12 bp, Homo sapiens
ttgctacaaatt

SEQ ID NO: 1671284 - DNA, 12 bp, Homo sapiens
ttgctaccagta

SEQ ID NO: 1671285 - DNA, 16 bp, Homo sapiens
ttgctaccagtattta

SEQ ID NO: 1671286 - DNA, 20 bp, Homo sapiens
ttgctacgattccactgaaa

SEQ ID NO: 1671287 - DNA, 23 bp, Homo sapiens
ttgctagataaaagctgaagtta

SEQ ID NO: 1671288 - DNA, 13 bp, Homo sapiens
ttgctagccctgg

SEQ ID NO: 1671289 - DNA, 17 bp, Homo sapiens
ttgctaggagccccagc

SEQ ID NO: 1671290 - DNA, 21 bp, Homo sapiens
ttgctagtgatacactgtatc

SEQ ID NO: 1671291 - DNA, 18 bp, Homo sapiens
ttgctatcaacaataaaa

SEQ ID NO: 1671292 - DNA, 22 bp, Homo sapiens
ttgctatcgccctcctttccct

SEQ ID NO: 1671293 - DNA, 22 bp, Homo sapiens
ttgctatctggaggccttccag

SEQ ID NO: 1671294 - DNA, 16 bp, Homo sapiens
ttgctatcttttctgg

SEQ ID NO: 1671295 - DNA, 22 bp, Homo sapiens
ttgctatggcaggataagaaag

SEQ ID NO: 1671296 - DNA, 16 bp, Homo sapiens
ttgctatgttactatt

SEQ ID NO: 1671297 - DNA, 19 bp, Homo sapiens
ttgctatgttactattttc

SEQ ID NO: 1671298 - DNA, 21 bp, Homo sapiens
ttgctatgttactattttcta

SEQ ID NO: 1671299 - DNA, 18 bp, Homo sapiens
ttgctcaaaaaatgagct

SEQ ID NO: 1671300 - DNA, 16 bp, Homo sapiens
ttgctcaaaaatctgt

SEQ ID NO: 1671301 - DNA, 20 bp, Homo sapiens
ttgctcacagttattacata

SEQ ID NO: 1671302 - DNA, 12 bp, Homo sapiens
ttgctcagagct

SEQ ID NO: 1671303 - DNA, 14 bp, Homo sapiens
ttgctcagagctag

SEQ ID NO: 1671304 - DNA, 21 bp, Homo sapiens
ttgctcagcccgcttggccac

SEQ ID NO: 1671305 - DNA, 18 bp, Homo sapiens
ttgctcagtgtccagctt

SEQ ID NO: 1671306 - DNA, 22 bp, Homo sapiens
ttgctccagataactctctttc

SEQ ID NO: 1671307 - DNA, 20 bp, Homo sapiens
ttgctccagattctgatgca

SEQ ID NO: 1671308 - DNA, 17 bp, Homo sapiens
ttgctcccctgatagaa

SEQ ID NO: 1671309 - DNA, 21 bp, Homo sapiens
ttgctcccctgatagaagatt

SEQ ID NO: 1671310 - DNA, 22 bp, Homo sapiens
ttgctctaaaatatttatgaag

SEQ ID NO: 1671311 - DNA, 23 bp, Homo sapiens
ttgctctattaagattggaaatg

SEQ ID NO: 1671312 - DNA, 13 bp, Homo sapiens
ttgctctctgggc

SEQ ID NO: 1671313 - DNA, 13 bp, Homo sapiens
ttgctctctgtga

SEQ ID NO: 1671314 - DNA, 16 bp, Homo sapiens
ttgctctggagcagcc

SEQ ID NO: 1671315 - DNA, 22 bp, Homo sapiens
ttgctctgttacccaggctgga

SEQ ID NO: 1671316 - DNA, 18 bp, Homo sapiens
ttgctcttctttctgaga

SEQ ID NO: 1671317 - DNA, 16 bp, Homo sapiens
ttgctcttggaaagct

SEQ ID NO: 1671318 - DNA, 14 bp, Homo sapiens
ttgctgaaagatct

SEQ ID NO: 1671319 - DNA, 11 bp, Homo sapiens
ttgctgaaatt

SEQ ID NO: 1671320 - DNA, 19 bp, Homo sapiens
ttgctgaaattttatatgc

SEQ ID NO: 1671321 - DNA, 18 bp, Homo sapiens
ttgctgaacattggagaa

SEQ ID NO: 1671322 - DNA, 11 bp, Homo sapiens
ttgctgaactc

SEQ ID NO: 1671323 - DNA, 17 bp, Homo sapiens
ttgctgaattcatctat

SEQ ID NO: 1671324 - DNA, 23 bp, Homo sapiens
ttgctgacaaccattaaagtcag

SEQ ID NO: 1671325 - DNA, 15 bp, Homo sapiens
ttgctgacaataaag

SEQ ID NO: 1671326 - DNA, 22 bp, Homo sapiens
ttgctgagcctctgctccccag

SEQ ID NO: 1671327 - DNA, 17 bp, Homo sapiens
ttgctgagttgttctaa

SEQ ID NO: 1671328 - DNA, 16 bp, Homo sapiens
ttgctgatggcccctc

SEQ ID NO: 1671329 - DNA, 22 bp, Homo sapiens
ttgctgatggcccctccagcac

SEQ ID NO: 1671330 - DNA, 23 bp, Homo sapiens
ttgctgatggcccctccagcaca

SEQ ID NO: 1671331 - DNA, 20 bp, Homo sapiens
ttgctgatggctgctagatt

SEQ ID NO: 1671332 - DNA, 17 bp, Homo sapiens
ttgctgattatttatga

SEQ ID NO: 1671333 - DNA, 17 bp, Homo sapiens
ttgctgattttattctt

SEQ ID NO: 1671334 - DNA, 18 bp, Homo sapiens
ttgctgattttattcttg

SEQ ID NO: 1671335 - DNA, 20 bp, Homo sapiens
ttgctgcaagcacagccctt

SEQ ID NO: 1671336 - DNA, 22 bp, Homo sapiens
ttgctgcacaaacatgaaaatt

SEQ ID NO: 1671337 - DNA, 12 bp, Homo sapiens
ttgctgcagaga

SEQ ID NO: 1671338 - DNA, 18 bp, Homo sapiens
ttgctgccacactgtctc

SEQ ID NO: 1671339 - DNA, 21 bp, Homo sapiens
ttgctgctatgaaaatgagca

SEQ ID NO: 1671340 - DNA, 11 bp, Homo sapiens
ttgctgctgcc

SEQ ID NO: 1671341 - DNA, 11 bp, Homo sapiens
ttgctgctgtt

SEQ ID NO: 1671342 - DNA, 14 bp, Homo sapiens
ttgctggaaagagc

SEQ ID NO: 1671343 - DNA, 16 bp, Homo sapiens
ttgctggatgcatttt

SEQ ID NO: 1671344 - DNA, 15 bp, Homo sapiens
ttgctggctctgaga

SEQ ID NO: 1671345 - DNA, 12 bp, Homo sapiens
ttgctggctgcc

SEQ ID NO: 1671346 - DNA, 15 bp, Homo sapiens
ttgctgggagctgaa

SEQ ID NO: 1671347 - DNA, 12 bp, Homo sapiens
ttgctgggccag

SEQ ID NO: 1671348 - DNA, 13 bp, Homo sapiens
ttgctgggccagg

SEQ ID NO: 1671349 - DNA, 14 bp, Homo sapiens
ttgctgggccaggg

SEQ ID NO: 1671350 - DNA, 16 bp, Homo sapiens
ttgctgggccagggaa

SEQ ID NO: 1671351 - DNA, 16 bp, Homo sapiens
ttgctggtgtagtctt

SEQ ID NO: 1671352 - DNA, 18 bp, Homo sapiens
ttgctgtatgctgatcat

SEQ ID NO: 1671353 - DNA, 21 bp, Homo sapiens
ttgctgtatgctgatcatcgc

SEQ ID NO: 1671354 - DNA, 21 bp, Homo sapiens
ttgctgtcataagaatgaata

SEQ ID NO: 1671355 - DNA, 19 bp, Homo sapiens
ttgctgtccaggcagctcc

SEQ ID NO: 1671356 - DNA, 11 bp, Homo sapiens
ttgctgtccta

SEQ ID NO: 1671357 - DNA, 20 bp, Homo sapiens
ttgctgtcttcagtctcaca

SEQ ID NO: 1671358 - DNA, 17 bp, Homo sapiens
ttgctgtgaggctgtcc

SEQ ID NO: 1671359 - DNA, 20 bp, Homo sapiens
ttgctgtgaggctgtcctgt

SEQ ID NO: 1671360 - DNA, 14 bp, Homo sapiens
ttgctgtgccgtgt

SEQ ID NO: 1671361 - DNA, 20 bp, Homo sapiens
ttgctgtgtgtcccaggcag

SEQ ID NO: 1671362 - DNA, 21 bp, Homo sapiens
ttgctgttattatatttgaca

SEQ ID NO: 1671363 - DNA, 23 bp, Homo sapiens
ttgctgttattatatttgacatg

SEQ ID NO: 1671364 - DNA, 12 bp, Homo sapiens
ttgctgtttatt

SEQ ID NO: 1671365 - DNA, 20 bp, Homo sapiens
ttgctgtttattttttttgg

SEQ ID NO: 1671366 - DNA, 18 bp, Homo sapiens
ttgctgttttaaacatta

SEQ ID NO: 1671367 - DNA, 17 bp, Homo sapiens
ttgcttaattttgattt

SEQ ID NO: 1671368 - DNA, 19 bp, Homo sapiens
ttgcttagtatggttctca

SEQ ID NO: 1671369 - DNA, 13 bp, Homo sapiens
ttgcttattttat

SEQ ID NO: 1671370 - DNA, 22 bp, Homo sapiens
ttgcttcaccatggccttatga

SEQ ID NO: 1671371 - DNA, 20 bp, Homo sapiens
ttgcttcataaatgaagcag

SEQ ID NO: 1671372 - DNA, 22 bp, Homo sapiens
ttgcttcctcagtaacatttct

SEQ ID NO: 1671373 - DNA, 15 bp, Homo sapiens
ttgcttcctcctccc

SEQ ID NO: 1671374 - DNA, 17 bp, Homo sapiens
ttgcttcctcctcccca

SEQ ID NO: 1671375 - DNA, 19 bp, Homo sapiens
ttgcttctactttcatctt

SEQ ID NO: 1671376 - DNA, 14 bp, Homo sapiens
ttgcttctgtagta

SEQ ID NO: 1671377 - DNA, 17 bp, Homo sapiens
ttgcttctgtatttcct

SEQ ID NO: 1671378 - DNA, 17 bp, Homo sapiens
ttgcttgagcccaggag

SEQ ID NO: 1671379 - DNA, 15 bp, Homo sapiens
ttgcttgagctcagg

SEQ ID NO: 1671380 - DNA, 16 bp, Homo sapiens
ttgcttgccaaagtac

SEQ ID NO: 1671381 - DNA, 15 bp, Homo sapiens
ttgcttgccgagcct

SEQ ID NO: 1671382 - DNA, 22 bp, Homo sapiens
ttgcttgccgagcctaatgaaa

SEQ ID NO: 1671383 - DNA, 16 bp, Homo sapiens
ttgcttggactattat

SEQ ID NO: 1671384 - DNA, 14 bp, Homo sapiens
ttgcttgtcttctg

SEQ ID NO: 1671385 - DNA, 19 bp, Homo sapiens
ttgcttgttatattaagca

SEQ ID NO: 1671386 - DNA, 23 bp, Homo sapiens
ttgctttaaagtacctgtagtga

SEQ ID NO: 1671387 - DNA, 14 bp, Homo sapiens
ttgctttaaatctt

SEQ ID NO: 1671388 - DNA, 16 bp, Homo sapiens
ttgctttaatatgagc

SEQ ID NO: 1671389 - DNA, 13 bp, Homo sapiens
ttgctttaatgag

SEQ ID NO: 1671390 - DNA, 14 bp, Homo sapiens
ttgctttaatgaga

SEQ ID NO: 1671391 - DNA, 20 bp, Homo sapiens
ttgctttaattgctttaaat

SEQ ID NO: 1671392 - DNA, 12 bp, Homo sapiens
ttgctttaattt

SEQ ID NO: 1671393 - DNA, 19 bp, Homo sapiens
ttgctttactgtcaaaata

SEQ ID NO: 1671394 - DNA, 12 bp, Homo sapiens
ttgctttcaatt

SEQ ID NO: 1671395 - DNA, 16 bp, Homo sapiens
ttgctttcctgggcct

SEQ ID NO: 1671396 - DNA, 17 bp, Homo sapiens
ttgctttcctgggcctt

SEQ ID NO: 1671397 - DNA, 13 bp, Homo sapiens
ttgtactatgtta

SEQ ID NO: 1671398 - DNA, 14 bp, Homo sapiens
ttgtactatgttaa

SEQ ID NO: 1671399 - DNA, 13 bp, Homo sapiens
ttgtactccagcc

SEQ ID NO: 1671400 - DNA, 15 bp, Homo sapiens
ttgtactccagcctg

SEQ ID NO: 1671401 - DNA, 15 bp, Homo sapiens
ttgtactctgcttta

SEQ ID NO: 1671402 - DNA, 17 bp, Homo sapiens
ttgtactgttgctttaa

SEQ ID NO: 1671403 - DNA, 22 bp, Homo sapiens
ttgtactgttgctttaatatga

SEQ ID NO: 1671404 - DNA, 23 bp, Homo sapiens
ttgtacttaaatggtaataagca

SEQ ID NO: 1671405 - DNA, 19 bp, Homo sapiens
ttgtacttctgtgttcatt

SEQ ID NO: 1671406 - DNA, 13 bp, Homo sapiens
ttgtacttcttat

SEQ ID NO: 1671407 - DNA, 14 bp, Homo sapiens
ttgtacttggaagt

SEQ ID NO: 1671408 - DNA, 19 bp, Homo sapiens
ttgtactttatttttctga

SEQ ID NO: 1671409 - DNA, 15 bp, Homo sapiens
ttgtactttctgtta

SEQ ID NO: 1671410 - DNA, 16 bp, Homo sapiens
ttgtacttttttctta

SEQ ID NO: 1671411 - DNA, 22 bp, Homo sapiens
ttgtagaaacacagttttgaaa

SEQ ID NO: 1671412 - DNA, 19 bp, Homo sapiens
ttgtagaactcactctggg

SEQ ID NO: 1671413 - DNA, 22 bp, Homo sapiens
ttgtagacttcctttataatat

SEQ ID NO: 1671414 - DNA, 23 bp, Homo sapiens
ttgtagacttcctttataatatt

SEQ ID NO: 1671415 - DNA, 22 bp, Homo sapiens
ttgtagcactgacagatttcca

SEQ ID NO: 1671416 - DNA, 14 bp, Homo sapiens
ttgtagcactgagg

SEQ ID NO: 1671417 - DNA, 16 bp, Homo sapiens
ttgtagcactgagggt

SEQ ID NO: 1671418 - DNA, 19 bp, Homo sapiens
ttgtagcagattgtttcct

SEQ ID NO: 1671419 - DNA, 18 bp, Homo sapiens
ttgtagcagctatatatt

SEQ ID NO: 1671420 - DNA, 23 bp, Homo sapiens
ttgtagcagctatatatttcccc

SEQ ID NO: 1671421 - DNA, 23 bp, Homo sapiens
ttgtagcatttaaaatggaaaat

SEQ ID NO: 1671422 - DNA, 15 bp, Homo sapiens
ttgtagccatggctg

SEQ ID NO: 1671423 - DNA, 14 bp, Homo sapiens
ttgtagctagaata

SEQ ID NO: 1671424 - DNA, 16 bp, Homo sapiens
ttgtagggatgccttt

SEQ ID NO: 1671425 - DNA, 15 bp, Homo sapiens
ttgtagtaaaagtgg

SEQ ID NO: 1671426 - DNA, 22 bp, Homo sapiens
ttgtagtaaaagtggtctctgc

SEQ ID NO: 1671427 - DNA, 14 bp, Homo sapiens
ttgtagtcttgtct

SEQ ID NO: 1671428 - DNA, 17 bp, Homo sapiens
ttgtagtttacctcttt

SEQ ID NO: 1671429 - DNA, 12 bp, Homo sapiens
ttgtataaaata

SEQ ID NO: 1671430 - DNA, 12 bp, Homo sapiens
ttgtataaaatc

SEQ ID NO: 1671431 - DNA, 13 bp, Homo sapiens
ttgtataaaatct

SEQ ID NO: 1671432 - DNA, 15 bp, Homo sapiens
ttgtataaaatctga

SEQ ID NO: 1671433 - DNA, 21 bp, Homo sapiens
ttgtataaaatctgaattttg

SEQ ID NO: 1671434 - DNA, 20 bp, Homo sapiens
ttgtataattggatttccta

SEQ ID NO: 1671435 - DNA, 21 bp, Homo sapiens
ttgtataattggatttcctaa

SEQ ID NO: 1671436 - DNA, 15 bp, Homo sapiens
ttgtatagttgcttg

SEQ ID NO: 1671437 - DNA, 19 bp, Homo sapiens
ttgtatagttgcttgcctg

SEQ ID NO: 1671438 - DNA, 15 bp, Homo sapiens
ttgtatatcatgaaa

SEQ ID NO: 1671439 - DNA, 22 bp, Homo sapiens
ttgtatattccaccattcacat

SEQ ID NO: 1671440 - DNA, 14 bp, Homo sapiens
ttgtatattgtaat

SEQ ID NO: 1671441 - DNA, 20 bp, Homo sapiens
ttgtatctcatactgtctgg

SEQ ID NO: 1671442 - DNA, 15 bp, Homo sapiens
ttgtatctttatgct

SEQ ID NO: 1671443 - DNA, 13 bp, Homo sapiens
ttgtatgcaggga

SEQ ID NO: 1671444 - DNA, 23 bp, Homo sapiens
ttgtatgcctttaaatctgtgat

SEQ ID NO: 1671445 - DNA, 15 bp, Homo sapiens
ttgtatgtaaatctg

SEQ ID NO: 1671446 - DNA, 12 bp, Homo sapiens
ttgtatgtttgc

SEQ ID NO: 1671447 - DNA, 12 bp, Homo sapiens
ttgtattaataa

SEQ ID NO: 1671448 - DNA, 17 bp, Homo sapiens
ttgtattaataaagcat

SEQ ID NO: 1671449 - DNA, 19 bp, Homo sapiens
ttgtattaataaagcattc

SEQ ID NO: 1671450 - DNA, 16 bp, Homo sapiens
ttgtattaatttctga

SEQ ID NO: 1671451 - DNA, 13 bp, Homo sapiens
ttgtattacagat

SEQ ID NO: 1671452 - DNA, 18 bp, Homo sapiens
ttgtattactgcttccca

SEQ ID NO: 1671453 - DNA, 19 bp, Homo sapiens
ttgtattatttcaccagca

SEQ ID NO: 1671454 - DNA, 13 bp, Homo sapiens
ttgtattgacttt

SEQ ID NO: 1671455 - DNA, 16 bp, Homo sapiens
ttgtattgactttatg

SEQ ID NO: 1671456 - DNA, 18 bp, Homo sapiens
ttgtattgttgaaaaagt

SEQ ID NO: 1671457 - DNA, 16 bp, Homo sapiens
ttgtattgttttccca

SEQ ID NO: 1671458 - DNA, 13 bp, Homo sapiens
ttgtatttaacag

SEQ ID NO: 1671459 - DNA, 17 bp, Homo sapiens
ttgtatttaacagaaat

SEQ ID NO: 1671460 - DNA, 18 bp, Homo sapiens
ttgtattttgattatttt

SEQ ID NO: 1671461 - DNA, 13 bp, Homo sapiens
ttgtattttgcat

SEQ ID NO: 1671462 - DNA, 14 bp, Homo sapiens
ttgtattttgcata

SEQ ID NO: 1671463 - DNA, 16 bp, Homo sapiens
ttgtattttgttaaag

SEQ ID NO: 1671464 - DNA, 18 bp, Homo sapiens
ttgtattttgttaaagct

SEQ ID NO: 1671465 - DNA, 20 bp, Homo sapiens
ttgtattttttatttacatt

SEQ ID NO: 1671466 - DNA, 22 bp, Homo sapiens
ttgtcaaactgtagaaatgatg

SEQ ID NO: 1671467 - DNA, 14 bp, Homo sapiens
ttgtcaaagaagct

SEQ ID NO: 1671468 - DNA, 20 bp, Homo sapiens
ttgtcaagtctctgctggcc

SEQ ID NO: 1671469 - DNA, 21 bp, Homo sapiens
ttgtcaataaattttaaatgt

SEQ ID NO: 1671470 - DNA, 18 bp, Homo sapiens
ttgtcaatattaaataca

SEQ ID NO: 1671471 - DNA, 19 bp, Homo sapiens
ttgtcaatattaaatacag

SEQ ID NO: 1671472 - DNA, 16 bp, Homo sapiens
ttgtcaccagcaacat

SEQ ID NO: 1671473 - DNA, 20 bp, Homo sapiens
ttgtcactagcagctgcagt

SEQ ID NO: 1671474 - DNA, 14 bp, Homo sapiens
ttgtcactttttat

SEQ ID NO: 1671475 - DNA, 14 bp, Homo sapiens
ttgtcactttttct

SEQ ID NO: 1671476 - DNA, 16 bp, Homo sapiens
ttgtcactttttctga

SEQ ID NO: 1671477 - DNA, 18 bp, Homo sapiens
ttgtcagactttaaagaa

SEQ ID NO: 1671478 - DNA, 13 bp, Homo sapiens
ttgtcagcatctg

SEQ ID NO: 1671479 - DNA, 20 bp, Homo sapiens
ttgtcagcatctgaccatct

SEQ ID NO: 1671480 - DNA, 21 bp, Homo sapiens
ttgtcagcatctgaccatctg

SEQ ID NO: 1671481 - DNA, 23 bp, Homo sapiens
ttgtcagcatctgaccatctgtg

SEQ ID NO: 1671482 - DNA, 14 bp, Homo sapiens
ttgtcagtattttt

SEQ ID NO: 1671483 - DNA, 21 bp, Homo sapiens
ttgtcatataagattcatatt

SEQ ID NO: 1671484 - DNA, 23 bp, Homo sapiens
ttgtcatccacacaacaccagga

SEQ ID NO: 1671485 - DNA, 21 bp, Homo sapiens
ttgtcatctttcttctatttt

SEQ ID NO: 1671486 - DNA, 18 bp, Homo sapiens
ttgtcattccagagtgct

SEQ ID NO: 1671487 - DNA, 16 bp, Homo sapiens
ttgtcatttttaatat

SEQ ID NO: 1671488 - DNA, 20 bp, Homo sapiens
ttgtccaacaataaacagga

SEQ ID NO: 1671489 - DNA, 21 bp, Homo sapiens
ttgtccaacccgaggcccgca

SEQ ID NO: 1671490 - DNA, 22 bp, Homo sapiens
ttgtccaattgttgacagttct

SEQ ID NO: 1671491 - DNA, 13 bp, Homo sapiens
ttgtccagcgcct

SEQ ID NO: 1671492 - DNA, 17 bp, Homo sapiens
ttgtcccatttccttgg

SEQ ID NO: 1671493 - DNA, 23 bp, Homo sapiens
ttgtcccatttccttggaggcca

SEQ ID NO: 1671494 - DNA, 24 bp, Homo sapiens
ttgtccccaatcccggtcatgctt

SEQ ID NO: 1671495 - DNA, 13 bp, Homo sapiens
ttgtccccagggc

SEQ ID NO: 1671496 - DNA, 18 bp, Homo sapiens
ttgtcccccaacttgaga

SEQ ID NO: 1671497 - DNA, 19 bp, Homo sapiens
ttgtcccggatttttgtta

SEQ ID NO: 1671498 - DNA, 13 bp, Homo sapiens
ttgtccctttccc

SEQ ID NO: 1671499 - DNA, 18 bp, Homo sapiens
ttgtccgtgttcatacat

SEQ ID NO: 1671500 - DNA, 15 bp, Homo sapiens
ttgtcctatgtcaat

SEQ ID NO: 1671501 - DNA, 15 bp, Homo sapiens
ttgtcctccccttgg

SEQ ID NO: 1671502 - DNA, 15 bp, Homo sapiens
ttgtcctcttctgct

SEQ ID NO: 1671503 - DNA, 12 bp, Homo sapiens
ttgtcctgccag

SEQ ID NO: 1671504 - DNA, 14 bp, Homo sapiens
ttgtcctgccagct

SEQ ID NO: 1671505 - DNA, 19 bp, Homo sapiens
ttgtcctgccagctgcctt

SEQ ID NO: 1671506 - DNA, 21 bp, Homo sapiens
ttgtcctgccagctgccttcc

SEQ ID NO: 1671507 - DNA, 17 bp, Homo sapiens
ttgtcctgggcctgccc

SEQ ID NO: 1671508 - DNA, 17 bp, Homo sapiens
ttgtccttcagagctct

SEQ ID NO: 1671509 - DNA, 17 bp, Homo sapiens
ttgtctactcctagaag

SEQ ID NO: 1671510 - DNA, 22 bp, Homo sapiens
ttgtctatgaagttgctgttta

SEQ ID NO: 1671511 - DNA, 12 bp, Homo sapiens
ttgtctatttta

SEQ ID NO: 1671512 - DNA, 21 bp, Homo sapiens
ttgtgttttttaagatagtgt

SEQ ID NO: 1671513 - DNA, 22 bp, Homo sapiens
ttgttaaagctggaacatttga

SEQ ID NO: 1671514 - DNA, 22 bp, Homo sapiens
ttgttaactcttgtctattttt

SEQ ID NO: 1671515 - DNA, 18 bp, Homo sapiens
ttgttaatcttcaatagt

SEQ ID NO: 1671516 - DNA, 17 bp, Homo sapiens
ttgttaatgaaaatgtc

SEQ ID NO: 1671517 - DNA, 19 bp, Homo sapiens
ttgttaatgaaaatgtcag

SEQ ID NO: 1671518 - DNA, 13 bp, Homo sapiens
ttgttaatgcttt

SEQ ID NO: 1671519 - DNA, 17 bp, Homo sapiens
ttgttaatgtcattgct

SEQ ID NO: 1671520 - DNA, 18 bp, Homo sapiens
ttgttaatgtcattgcta

SEQ ID NO: 1671521 - DNA, 15 bp, Homo sapiens
ttgttacaagtgttc

SEQ ID NO: 1671522 - DNA, 21 bp, Homo sapiens
ttgttacataaggatgacttt

SEQ ID NO: 1671523 - DNA, 16 bp, Homo sapiens
ttgttacgtagcctaa

SEQ ID NO: 1671524 - DNA, 18 bp, Homo sapiens
ttgttactgattcaatta

SEQ ID NO: 1671525 - DNA, 24 bp, Homo sapiens
ttgttactgctgattcttgtaaat

SEQ ID NO: 1671526 - DNA, 21 bp, Homo sapiens
ttgttagatctgtagggactt

SEQ ID NO: 1671527 - DNA, 16 bp, Homo sapiens
ttgttagcccttcaga

SEQ ID NO: 1671528 - DNA, 17 bp, Homo sapiens
ttgttagtttagtgtgt

SEQ ID NO: 1671529 - DNA, 22 bp, Homo sapiens
ttgttagtttagtgtgtgtgca

SEQ ID NO: 1671530 - DNA, 15 bp, Homo sapiens
ttgttatatataata

SEQ ID NO: 1671531 - DNA, 13 bp, Homo sapiens
ttgttcaagtttt

SEQ ID NO: 1671532 - DNA, 15 bp, Homo sapiens
ttgttcactgaaggt

SEQ ID NO: 1671533 - DNA, 15 bp, Homo sapiens
ttgttcatagcccag

SEQ ID NO: 1671534 - DNA, 13 bp, Homo sapiens
ttgttcattttga

SEQ ID NO: 1671535 - DNA, 17 bp, Homo sapiens
ttgttcattttgagctg

SEQ ID NO: 1671536 - DNA, 18 bp, Homo sapiens
ttgttccacttgtttgca

SEQ ID NO: 1671537 - DNA, 19 bp, Homo sapiens
ttgttccacttgtttgcac

SEQ ID NO: 1671538 - DNA, 20 bp, Homo sapiens
ttgttccacttgtttgcact

SEQ ID NO: 1671539 - DNA, 17 bp, Homo sapiens
ttgttccattttatgca

SEQ ID NO: 1671540 - DNA, 13 bp, Homo sapiens
ttgttcccctcct

SEQ ID NO: 1671541 - DNA, 14 bp, Homo sapiens
ttgttcccctcctc

SEQ ID NO: 1671542 - DNA, 15 bp, Homo sapiens
ttgttcccctcctcc

SEQ ID NO: 1671543 - DNA, 18 bp, Homo sapiens
ttgttcccctcctccact

SEQ ID NO: 1671544 - DNA, 11 bp, Homo sapiens
ttgttcctgga

SEQ ID NO: 1671545 - DNA, 13 bp, Homo sapiens
ttgttcctggagt

SEQ ID NO: 1671546 - DNA, 15 bp, Homo sapiens
ttgttctagacttcc

SEQ ID NO: 1671547 - DNA, 16 bp, Homo sapiens
ttgttctcagaatccc

SEQ ID NO: 1671548 - DNA, 13 bp, Homo sapiens
ttgttctctggga

SEQ ID NO: 1671549 - DNA, 21 bp, Homo sapiens
ttgttctctgggagaaaatca

SEQ ID NO: 1671550 - DNA, 16 bp, Homo sapiens
ttgttctgcctggaga

SEQ ID NO: 1671551 - DNA, 13 bp, Homo sapiens
ttgttctgttgtc

SEQ ID NO: 1671552 - DNA, 21 bp, Homo sapiens
ttgttctgttgtctgcgcctg

SEQ ID NO: 1671553 - DNA, 19 bp, Homo sapiens
ttgttctgttttgtgagaa

SEQ ID NO: 1671554 - DNA, 16 bp, Homo sapiens
ttgttctttgtgtttt

SEQ ID NO: 1671555 - DNA, 20 bp, Homo sapiens
ttgttctttgtttagcctga

SEQ ID NO: 1671556 - DNA, 16 bp, Homo sapiens
ttgttctttgtttcca

SEQ ID NO: 1671557 - DNA, 16 bp, Homo sapiens
ttgttgaaaaagtttg

SEQ ID NO: 1671558 - DNA, 22 bp, Homo sapiens
ttgttgaaaaagtttgtttttg

SEQ ID NO: 1671559 - DNA, 18 bp, Homo sapiens
ttgttgaactgttagaat

SEQ ID NO: 1671560 - DNA, 21 bp, Homo sapiens
ttgttgacagttctgaagaat

SEQ ID NO: 1671561 - DNA, 21 bp, Homo sapiens
ttgttgataaattccactgga

SEQ ID NO: 1671562 - DNA, 16 bp, Homo sapiens
ttgttgcaagatgtga

SEQ ID NO: 1671563 - DNA, 14 bp, Homo sapiens
ttgttgcggatgga

SEQ ID NO: 1671564 - DNA, 13 bp, Homo sapiens
ttgttgctgctgt

SEQ ID NO: 1671565 - DNA, 21 bp, Homo sapiens
ttgttggaaaagaatacagaa

SEQ ID NO: 1671566 - DNA, 18 bp, Homo sapiens
ttgttgtaacctgctgtg

SEQ ID NO: 1671567 - DNA, 20 bp, Homo sapiens
ttgttgtagattgattgtat

SEQ ID NO: 1671568 - DNA, 14 bp, Homo sapiens
ttgttgtctacatt

SEQ ID NO: 1671569 - DNA, 16 bp, Homo sapiens
ttgttgtctacattaa

SEQ ID NO: 1671570 - DNA, 12 bp, Homo sapiens
ttgttgtgactt

SEQ ID NO: 1671571 - DNA, 15 bp, Homo sapiens
ttgttgtgtgtgcag

SEQ ID NO: 1671572 - DNA, 13 bp, Homo sapiens
ttgttgttcctct

SEQ ID NO: 1671573 - DNA, 14 bp, Homo sapiens
ttgttgttcctcta

SEQ ID NO: 1671574 - DNA, 18 bp, Homo sapiens
ttgttgttcctctatact

SEQ ID NO: 1671575 - DNA, 15 bp, Homo sapiens
ttgttgtttcttgcc

SEQ ID NO: 1671576 - DNA, 14 bp, Homo sapiens
ttgttgtttgccat

SEQ ID NO: 1671577 - DNA, 18 bp, Homo sapiens
ttgtttaaaatcatttct

SEQ ID NO: 1671578 - DNA, 16 bp, Homo sapiens
ttgtttaaagaataaa

SEQ ID NO: 1671579 - DNA, 15 bp, Homo sapiens
ttgtttaaatataaa

SEQ ID NO: 1671580 - DNA, 20 bp, Homo sapiens
ttgtttaaatataaatgttt

SEQ ID NO: 1671581 - DNA, 18 bp, Homo sapiens
ttgtttacttaaagattt

SEQ ID NO: 1671582 - DNA, 15 bp, Homo sapiens
ttgtttagaaacaga

SEQ ID NO: 1671583 - DNA, 20 bp, Homo sapiens
ttgtttagaaacagaaatag

SEQ ID NO: 1671584 - DNA, 15 bp, Homo sapiens
ttgtttagaagaagt

SEQ ID NO: 1671585 - DNA, 9 bp, Homo sapiens
ttgtttata

SEQ ID NO: 1671586 - DNA, 14 bp, Homo sapiens
ttgtttataatgtt

SEQ ID NO: 1671587 - DNA, 20 bp, Homo sapiens
ttgtttattctttttaaagt

SEQ ID NO: 1671588 - DNA, 18 bp, Homo sapiens
ttgtttcaagaacctgga

SEQ ID NO: 1671589 - DNA, 11 bp, Homo sapiens
ttgtttcagaa

SEQ ID NO: 1671590 - DNA, 20 bp, Homo sapiens
ttgtttcagggctgtggcct

SEQ ID NO: 1671591 - DNA, 11 bp, Homo sapiens
ttgtttcagtg

SEQ ID NO: 1671592 - DNA, 16 bp, Homo sapiens
ttgtttccaacttgtc

SEQ ID NO: 1671593 - DNA, 23 bp, Homo sapiens
ttgtttcctcccctatctgtatt

SEQ ID NO: 1671594 - DNA, 16 bp, Homo sapiens
ttgtttcctcttccaa

SEQ ID NO: 1671595 - DNA, 16 bp, Homo sapiens
ttgtttcgtggggagg

SEQ ID NO: 1671596 - DNA, 12 bp, Homo sapiens
ttgtttctatac

SEQ ID NO: 1671597 - DNA, 13 bp, Homo sapiens
ttgtttctatact

SEQ ID NO: 1671598 - DNA, 15 bp, Homo sapiens
ttgtttctatactgt

SEQ ID NO: 1671599 - DNA, 16 bp, Homo sapiens
ttgtttctccccctgg

SEQ ID NO: 1671600 - DNA, 15 bp, Homo sapiens
ttgtttgcactgtgt

SEQ ID NO: 1671601 - DNA, 12 bp, Homo sapiens
ttgtttgctatg

SEQ ID NO: 1671602 - DNA, 21 bp, Homo sapiens
ttgtttggagacgtttataaa

SEQ ID NO: 1671603 - DNA, 16 bp, Homo sapiens
ttgtttggcaaggaaa

SEQ ID NO: 1671604 - DNA, 14 bp, Homo sapiens
ttgtttggcttcct

SEQ ID NO: 1671605 - DNA, 16 bp, Homo sapiens
ttgtttgggtatcctg

SEQ ID NO: 1671606 - DNA, 22 bp, Homo sapiens
ttgtttgtaaatgcctcttaaa

SEQ ID NO: 1671607 - DNA, 17 bp, Homo sapiens
ttgtttgtcagcatctg

SEQ ID NO: 1671608 - DNA, 15 bp, Homo sapiens
ttgtttgtctgtttg

SEQ ID NO: 1671609 - DNA, 18 bp, Homo sapiens
ttgttttaaaattaaagc

SEQ ID NO: 1671610 - DNA, 14 bp, Homo sapiens
ttgttttaatctta

SEQ ID NO: 1671611 - DNA, 16 bp, Homo sapiens
ttgttttagaaccagc

SEQ ID NO: 1671612 - DNA, 14 bp, Homo sapiens
ttgttttattttaa

SEQ ID NO: 1671613 - DNA, 16 bp, Homo sapiens
ttgttttcagtgtaca

SEQ ID NO: 1671614 - DNA, 13 bp, Homo sapiens
ttgttttctactt

SEQ ID NO: 1671615 - DNA, 17 bp, Homo sapiens
ttgttttctgactaatt

SEQ ID NO: 1671616 - DNA, 13 bp, Homo sapiens
ttgttttgcaaaa

SEQ ID NO: 1671617 - DNA, 23 bp, Homo sapiens
ttgttttgctacgattccactga

SEQ ID NO: 1671618 - DNA, 14 bp, Homo sapiens
ttgttttggatgcc

SEQ ID NO: 1671619 - DNA, 13 bp, Homo sapiens
ttgttttgtattg

SEQ ID NO: 1671620 - DNA, 22 bp, Homo sapiens
ttgtttttccttgtatttaaat

SEQ ID NO: 1671621 - DNA, 16 bp, Homo sapiens
ttgtttttgcatgaaa

SEQ ID NO: 1671622 - DNA, 18 bp, Homo sapiens
ttgttttttcttgccagg

SEQ ID NO: 1671623 - DNA, 15 bp, Homo sapiens
ttgttttttgtaact

SEQ ID NO: 1671624 - DNA, 14 bp, Homo sapiens
ttgtttttttgcca

SEQ ID NO: 1671625 - DNA, 18 bp, Homo sapiens
ttgttttttttttccact

SEQ ID NO: 1671626 - DNA, 13 bp, Homo sapiens
tttaaaaaaactg

SEQ ID NO: 1671627 - DNA, 22 bp, Homo sapiens
tttaaaaaaagctaaattacat

SEQ ID NO: 1671628 - DNA, 18 bp, Homo sapiens
tttatacccccaggaaac

SEQ ID NO: 1671629 - DNA, 18 bp, Homo sapiens
tttatacctgtttaaatt

SEQ ID NO: 1671630 - DNA, 23 bp, Homo sapiens
tttatactctagaacatgcacat

SEQ ID NO: 1671631 - DNA, 16 bp, Homo sapiens
tttatactgaaggaaa

SEQ ID NO: 1671632 - DNA, 18 bp, Homo sapiens
tttatagagataagataa

SEQ ID NO: 1671633 - DNA, 14 bp, Homo sapiens
tttataggttttat

SEQ ID NO: 1671634 - DNA, 16 bp, Homo sapiens
tttatatactgctatt

SEQ ID NO: 1671635 - DNA, 15 bp, Homo sapiens
tttatatatacagta

SEQ ID NO: 1671636 - DNA, 21 bp, Homo sapiens
tttatatatacagtaacttta

SEQ ID NO: 1671637 - DNA, 13 bp, Homo sapiens
tttatatatatat

SEQ ID NO: 1671638 - DNA, 19 bp, Homo sapiens
tttatatatatatgtatat

SEQ ID NO: 1671639 - DNA, 13 bp, Homo sapiens
tttatatatgtat

SEQ ID NO: 1671640 - DNA, 15 bp, Homo sapiens
tttatatatttataa

SEQ ID NO: 1671641 - DNA, 18 bp, Homo sapiens
tttatatcacacaatata

SEQ ID NO: 1671642 - DNA, 14 bp, Homo sapiens
tttatatgaagaaa

SEQ ID NO: 1671643 - DNA, 21 bp, Homo sapiens
tttatatgctttttctcagat

SEQ ID NO: 1671644 - DNA, 12 bp, Homo sapiens
tttatatgtact

SEQ ID NO: 1671645 - DNA, 14 bp, Homo sapiens
tttatattaatgta

SEQ ID NO: 1671646 - DNA, 18 bp, Homo sapiens
tttatattactgacattt

SEQ ID NO: 1671647 - DNA, 12 bp, Homo sapiens
tttatattattg

SEQ ID NO: 1671648 - DNA, 22 bp, Homo sapiens
tttatattccgtatttaaagtt

SEQ ID NO: 1671649 - DNA, 20 bp, Homo sapiens
tttatatttattgttagaaa

SEQ ID NO: 1671650 - DNA, 15 bp, Homo sapiens
tttatatttccttta

SEQ ID NO: 1671651 - DNA, 21 bp, Homo sapiens
tttatatttcctttatgtgaa

SEQ ID NO: 1671652 - DNA, 19 bp, Homo sapiens
tttatatttggggtccttt

SEQ ID NO: 1671653 - DNA, 22 bp, Homo sapiens
tttatcaaaccctagccttgct

SEQ ID NO: 1671654 - DNA, 21 bp, Homo sapiens
tttatcaaagggtgaaaatta

SEQ ID NO: 1671655 - DNA, 14 bp, Homo sapiens
tttatcaaatcagt

SEQ ID NO: 1671656 - DNA, 17 bp, Homo sapiens
tttatcacacttctgtg

SEQ ID NO: 1671657 - DNA, 13 bp, Homo sapiens
tttatcacttaaa

SEQ ID NO: 1671658 - DNA, 21 bp, Homo sapiens
tttatcatgaattccctttta

SEQ ID NO: 1671659 - DNA, 22 bp, Homo sapiens
tttatcatgaattcccttttaa

SEQ ID NO: 1671660 - DNA, 22 bp, Homo sapiens
tttatcatgcatgtcctgtaaa

SEQ ID NO: 1671661 - DNA, 23 bp, Homo sapiens
tttatcatgtcgtaggtaaacta

SEQ ID NO: 1671662 - DNA, 15 bp, Homo sapiens
tttatcattaaaaat

SEQ ID NO: 1671663 - DNA, 16 bp, Homo sapiens
tttatccaaaatgtgt

SEQ ID NO: 1671664 - DNA, 20 bp, Homo sapiens
tttatccaaaatgtgtattt

SEQ ID NO: 1671665 - DNA, 22 bp, Homo sapiens
tttatccaattttgatcttttt

SEQ ID NO: 1671666 - DNA, 15 bp, Homo sapiens
tttatcccttaagaa

SEQ ID NO: 1671667 - DNA, 20 bp, Homo sapiens
tttatctattctgagaaaac

SEQ ID NO: 1671668 - DNA, 13 bp, Homo sapiens
tttatctgattaa

SEQ ID NO: 1671669 - DNA, 15 bp, Homo sapiens
tttatctgtggagtt

SEQ ID NO: 1671670 - DNA, 16 bp, Homo sapiens
tttatcttaatccatt

SEQ ID NO: 1671671 - DNA, 20 bp, Homo sapiens
tttatcttattttctcaatc

SEQ ID NO: 1671672 - DNA, 15 bp, Homo sapiens
tttatcttctttcct

SEQ ID NO: 1671673 - DNA, 17 bp, Homo sapiens
tttatcttgaaggaaaa

SEQ ID NO: 1671674 - DNA, 13 bp, Homo sapiens
tttatctttacca

SEQ ID NO: 1671675 - DNA, 14 bp, Homo sapiens
tttatctttaccaa

SEQ ID NO: 1671676 - DNA, 12 bp, Homo sapiens
tttatctttgat

SEQ ID NO: 1671677 - DNA, 16 bp, Homo sapiens
tttatctttgataaca

SEQ ID NO: 1671678 - DNA, 18 bp, Homo sapiens
tttatctttgattctcct

SEQ ID NO: 1671679 - DNA, 18 bp, Homo sapiens
tttatgaaaggtttacat

SEQ ID NO: 1671680 - DNA, 18 bp, Homo sapiens
tttatgaagaaaatactt

SEQ ID NO: 1671681 - DNA, 20 bp, Homo sapiens
tttatgaatgaaaaaacagt

SEQ ID NO: 1671682 - DNA, 19 bp, Homo sapiens
tttatgacctaagtcaggt

SEQ ID NO: 1671683 - DNA, 21 bp, Homo sapiens
tttatgacctaagtcaggtaa

SEQ ID NO: 1671684 - DNA, 17 bp, Homo sapiens
tttatgatcaaggaaaa

SEQ ID NO: 1671685 - DNA, 20 bp, Homo sapiens
tttatgatcaaggaaaagat

SEQ ID NO: 1671686 - DNA, 12 bp, Homo sapiens
tttatgcaaata

SEQ ID NO: 1671687 - DNA, 16 bp, Homo sapiens
tttatgcaaatacaat

SEQ ID NO: 1671688 - DNA, 18 bp, Homo sapiens
tttatgcaaggaaggaaa

SEQ ID NO: 1671689 - DNA, 23 bp, Homo sapiens
tttatgcagaagcatattttgct

SEQ ID NO: 1671690 - DNA, 17 bp, Homo sapiens
tttatgcagacagtctg

SEQ ID NO: 1671691 - DNA, 18 bp, Homo sapiens
tttatgcagacagtctgt

SEQ ID NO: 1671692 - DNA, 17 bp, Homo sapiens
tttatgcagcaaatata

SEQ ID NO: 1671693 - DNA, 20 bp, Homo sapiens
tttatgcatgtatatgccat

SEQ ID NO: 1671694 - DNA, 12 bp, Homo sapiens
tttatgcatttc

SEQ ID NO: 1671695 - DNA, 13 bp, Homo sapiens
tttatgcatttca

SEQ ID NO: 1671696 - DNA, 14 bp, Homo sapiens
tttatgcatttcat

SEQ ID NO: 1671697 - DNA, 15 bp, Homo sapiens
tttatgcatttcatt

SEQ ID NO: 1671698 - DNA, 16 bp, Homo sapiens
tttatgcatttcattc

SEQ ID NO: 1671699 - DNA, 20 bp, Homo sapiens
tttatgccaagaacagaaaa

SEQ ID NO: 1671700 - DNA, 23 bp, Homo sapiens
tttatgctcttgaaatattcaga

SEQ ID NO: 1671701 - DNA, 13 bp, Homo sapiens
tttatgtaaatca

SEQ ID NO: 1671702 - DNA, 15 bp, Homo sapiens
tttatgtaaatcact

SEQ ID NO: 1671703 - DNA, 12 bp, Homo sapiens
tttatgtaatag

SEQ ID NO: 1671704 - DNA, 13 bp, Homo sapiens
tttatgtgaattt

SEQ ID NO: 1671705 - DNA, 12 bp, Homo sapiens
tttatgtgatgg

SEQ ID NO: 1671706 - DNA, 13 bp, Homo sapiens
tttatgtgtagaa

SEQ ID NO: 1671707 - DNA, 14 bp, Homo sapiens
tttatgtgtagaat

SEQ ID NO: 1671708 - DNA, 16 bp, Homo sapiens
tttatgtgtagaattt

SEQ ID NO: 1671709 - DNA, 20 bp, Homo sapiens
tttatgtgtagaatttgaaa

SEQ ID NO: 1671710 - DNA, 18 bp, Homo sapiens
tttatgtgtgaggagctg

SEQ ID NO: 1671711 - DNA, 11 bp, Homo sapiens
tttatgtgtgt

SEQ ID NO: 1671712 - DNA, 16 bp, Homo sapiens
tttatgtgttatgaac

SEQ ID NO: 1671713 - DNA, 17 bp, Homo sapiens
tttatgttagattttgc

SEQ ID NO: 1671714 - DNA, 14 bp, Homo sapiens
tttatgttgtatga

SEQ ID NO: 1671715 - DNA, 16 bp, Homo sapiens
tttatgttgtatgatt

SEQ ID NO: 1671716 - DNA, 20 bp, Homo sapiens
tttatgttttgtttctgaaa

SEQ ID NO: 1671717 - DNA, 16 bp, Homo sapiens
tttattaaaaataaaa

SEQ ID NO: 1671718 - DNA, 14 bp, Homo sapiens
tttattaaaatctt

SEQ ID NO: 1671719 - DNA, 16 bp, Homo sapiens
tttattaaaatcttaa

SEQ ID NO: 1671720 - DNA, 13 bp, Homo sapiens
tttattaaatgta

SEQ ID NO: 1671721 - DNA, 22 bp, Homo sapiens
tttattaaattaattgaatcta

SEQ ID NO: 1671722 - DNA, 13 bp, Homo sapiens
tttattaaattta

SEQ ID NO: 1671723 - DNA, 18 bp, Homo sapiens
tttattaacaaattatgt

SEQ ID NO: 1671724 - DNA, 20 bp, Homo sapiens
tttattaagctttttggaat

SEQ ID NO: 1671725 - DNA, 20 bp, Homo sapiens
tttattaataatatttatgt

SEQ ID NO: 1671726 - DNA, 13 bp, Homo sapiens
tttattacaaatc

SEQ ID NO: 1671727 - DNA, 11 bp, Homo sapiens
tttattacaat

SEQ ID NO: 1671728 - DNA, 16 bp, Homo sapiens
tttattacatctttca

SEQ ID NO: 1671729 - DNA, 17 bp, Homo sapiens
tttattaccccctcctt

SEQ ID NO: 1671730 - DNA, 17 bp, Homo sapiens
tttattatgcattatat

SEQ ID NO: 1671731 - DNA, 16 bp, Homo sapiens
tttattatttatttat

SEQ ID NO: 1671732 - DNA, 17 bp, Homo sapiens
tttattcaattcctctg

SEQ ID NO: 1671733 - DNA, 14 bp, Homo sapiens
tttattcacatata

SEQ ID NO: 1671734 - DNA, 18 bp, Homo sapiens
tttattcataatgaatta

SEQ ID NO: 1671735 - DNA, 21 bp, Homo sapiens
tttattcccaagtatgcctta

SEQ ID NO: 1671736 - DNA, 16 bp, Homo sapiens
tttattcctgttagta

SEQ ID NO: 1671737 - DNA, 17 bp, Homo sapiens
tttattcttattactat

SEQ ID NO: 1671738 - DNA, 19 bp, Homo sapiens
tttattgattaaaaatgtg

SEQ ID NO: 1671739 - DNA, 14 bp, Homo sapiens
tttattgcagaatg

SEQ ID NO: 1671740 - DNA, 22 bp, Homo sapiens
tttattgctcgcccagacacca

SEQ ID NO: 1671741 - DNA, 16 bp, Homo sapiens
tttattggctgagata

SEQ ID NO: 1671742 - DNA, 23 bp, Homo sapiens
tttattggttttgcagaagaagg

SEQ ID NO: 1671743 - DNA, 23 bp, Homo sapiens
tttctattgtactctgctttatc

SEQ ID NO: 1671744 - DNA, 23 bp, Homo sapiens
tttctattttgttttttaagtaa

SEQ ID NO: 1671745 - DNA, 22 bp, Homo sapiens
tttctcaaaagaggttacttta

SEQ ID NO: 1671746 - DNA, 21 bp, Homo sapiens
tttctcaactgggtccagaag

SEQ ID NO: 1671747 - DNA, 18 bp, Homo sapiens
tttctcaatgtcttccca

SEQ ID NO: 1671748 - DNA, 16 bp, Homo sapiens
tttctcacattgctgt

SEQ ID NO: 1671749 - DNA, 14 bp, Homo sapiens
tttctcactatata

SEQ ID NO: 1671750 - DNA, 13 bp, Homo sapiens
tttctcactgaaa

SEQ ID NO: 1671751 - DNA, 18 bp, Homo sapiens
tttctcagaatccaaaga

SEQ ID NO: 1671752 - DNA, 16 bp, Homo sapiens
tttctcagttttcata

SEQ ID NO: 1671753 - DNA, 19 bp, Homo sapiens
tttctcatttggggagggg

SEQ ID NO: 1671754 - DNA, 19 bp, Homo sapiens
tttctccacactccactga

SEQ ID NO: 1671755 - DNA, 11 bp, Homo sapiens
tttctccagct

SEQ ID NO: 1671756 - DNA, 23 bp, Homo sapiens
tttctccatattagatttaccca

SEQ ID NO: 1671757 - DNA, 13 bp, Homo sapiens
tttctcccaagaa

SEQ ID NO: 1671758 - DNA, 17 bp, Homo sapiens
tttctcccagtcattta

SEQ ID NO: 1671759 - DNA, 15 bp, Homo sapiens
tttctccccctgggc

SEQ ID NO: 1671760 - DNA, 17 bp, Homo sapiens
tttctcccctgccccca

SEQ ID NO: 1671761 - DNA, 13 bp, Homo sapiens
tttctccctcacc

SEQ ID NO: 1671762 - DNA, 15 bp, Homo sapiens
tttctcctcccttcc

SEQ ID NO: 1671763 - DNA, 13 bp, Homo sapiens
tttctcctgcccc

SEQ ID NO: 1671764 - DNA, 12 bp, Homo sapiens
tttctcctgtgc

SEQ ID NO: 1671765 - DNA, 11 bp, Homo sapiens
tttctccttgg

SEQ ID NO: 1671766 - DNA, 22 bp, Homo sapiens
tttctcctttaattgtaaagta

SEQ ID NO: 1671767 - DNA, 16 bp, Homo sapiens
tttctccttttcctat

SEQ ID NO: 1671768 - DNA, 16 bp, Homo sapiens
tttctcgacagatgat

SEQ ID NO: 1671769 - DNA, 19 bp, Homo sapiens
tttctcgtgctgcatccct

SEQ ID NO: 1671770 - DNA, 21 bp, Homo sapiens
tttctcgtgctgcatccctgt

SEQ ID NO: 1671771 - DNA, 12 bp, Homo sapiens
tttctctctcta

SEQ ID NO: 1671772 - DNA, 20 bp, Homo sapiens
tttctctctttatacagctg

SEQ ID NO: 1671773 - DNA, 21 bp, Homo sapiens
tttctctctttatacagctgt

SEQ ID NO: 1671774 - DNA, 18 bp, Homo sapiens
tttctctgtacttttcat

SEQ ID NO: 1671775 - DNA, 11 bp, Homo sapiens
tttctctgtgc

SEQ ID NO: 1671776 - DNA, 14 bp, Homo sapiens
tttctcttacctgt

SEQ ID NO: 1671777 - DNA, 12 bp, Homo sapiens
tttctcttagaa

SEQ ID NO: 1671778 - DNA, 21 bp, Homo sapiens
tttctcttagaacattgtatt

SEQ ID NO: 1671779 - DNA, 11 bp, Homo sapiens
tttctcttcat

SEQ ID NO: 1671780 - DNA, 12 bp, Homo sapiens
tttctcttcata

SEQ ID NO: 1671781 - DNA, 17 bp, Homo sapiens
tttctcttgagctggcc

SEQ ID NO: 1671782 - DNA, 22 bp, Homo sapiens
tttctcttttcccctttcctgt

SEQ ID NO: 1671783 - DNA, 13 bp, Homo sapiens
tttctcttttgct

SEQ ID NO: 1671784 - DNA, 20 bp, Homo sapiens
tttctcttttttaaaaacaa

SEQ ID NO: 1671785 - DNA, 14 bp, Homo sapiens
tttctgaaacacac

SEQ ID NO: 1671786 - DNA, 20 bp, Homo sapiens
tttctgaaatcgccgtgtta

SEQ ID NO: 1671787 - DNA, 15 bp, Homo sapiens
tttctgaactgttac

SEQ ID NO: 1671788 - DNA, 16 bp, Homo sapiens
tttctgaactgttaca

SEQ ID NO: 1671789 - DNA, 17 bp, Homo sapiens
tttctgaactgttacaa

SEQ ID NO: 1671790 - DNA, 15 bp, Homo sapiens
tttctgaagctttac

SEQ ID NO: 1671791 - DNA, 18 bp, Homo sapiens
tttctgaagctttaccag

SEQ ID NO: 1671792 - DNA, 21 bp, Homo sapiens
tttctgaattatgcttccaca

SEQ ID NO: 1671793 - DNA, 22 bp, Homo sapiens
tttctgaattggaagggaaaaa

SEQ ID NO: 1671794 - DNA, 13 bp, Homo sapiens
tttctgagaaaga

SEQ ID NO: 1671795 - DNA, 22 bp, Homo sapiens
tttctgagaaagactattcaaa

SEQ ID NO: 1671796 - DNA, 16 bp, Homo sapiens
tttctgagaaggtcct

SEQ ID NO: 1671797 - DNA, 19 bp, Homo sapiens
tttctgagaaggtccttaa

SEQ ID NO: 1671798 - DNA, 21 bp, Homo sapiens
tttctgagagttggctcaggc

SEQ ID NO: 1671799 - DNA, 15 bp, Homo sapiens
tttctgagcccgggc

SEQ ID NO: 1671800 - DNA, 17 bp, Homo sapiens
tttctgaggctttatga

SEQ ID NO: 1671801 - DNA, 15 bp, Homo sapiens
tttctgattggtgat

SEQ ID NO: 1671802 - DNA, 17 bp, Homo sapiens
tttctgatttgctgctc

SEQ ID NO: 1671803 - DNA, 14 bp, Homo sapiens
tttctgcagaaaca

SEQ ID NO: 1671804 - DNA, 14 bp, Homo sapiens
tttctgcagctgtt

SEQ ID NO: 1671805 - DNA, 21 bp, Homo sapiens
tttctgcagctgtttcaaagt

SEQ ID NO: 1671806 - DNA, 17 bp, Homo sapiens
tttctgccactgaggag

SEQ ID NO: 1671807 - DNA, 19 bp, Homo sapiens
tttctgccactgaggagac

SEQ ID NO: 1671808 - DNA, 13 bp, Homo sapiens
tttctgccctggc

SEQ ID NO: 1671809 - DNA, 20 bp, Homo sapiens
tttctgccctggctgctgcc

SEQ ID NO: 1671810 - DNA, 11 bp, Homo sapiens
tttctgcctga

SEQ ID NO: 1671811 - DNA, 16 bp, Homo sapiens
tttctgcctgagattc

SEQ ID NO: 1671812 - DNA, 14 bp, Homo sapiens
tttctgctctgcca

SEQ ID NO: 1671813 - DNA, 18 bp, Homo sapiens
tttctggaatacatgaaa

SEQ ID NO: 1671814 - DNA, 20 bp, Homo sapiens
tttctggaatacatgaaata

SEQ ID NO: 1671815 - DNA, 21 bp, Homo sapiens
tttctggaatacatgaaatat

SEQ ID NO: 1671816 - DNA, 15 bp, Homo sapiens
tttctggatttcata

SEQ ID NO: 1671817 - DNA, 16 bp, Homo sapiens
tttctgggataagtaa

SEQ ID NO: 1671818 - DNA, 14 bp, Homo sapiens
tttctggggcctag

SEQ ID NO: 1671819 - DNA, 18 bp, Homo sapiens
tttctggggggatatttc

SEQ ID NO: 1671820 - DNA, 20 bp, Homo sapiens
tttctggggggatatttcct

SEQ ID NO: 1671821 - DNA, 15 bp, Homo sapiens
tttctgggtcctgaa

SEQ ID NO: 1671822 - DNA, 17 bp, Homo sapiens
tttctggtgccatttct

SEQ ID NO: 1671823 - DNA, 15 bp, Homo sapiens
tttctggtgctgtct

SEQ ID NO: 1671824 - DNA, 15 bp, Homo sapiens
tttctggttgatttg

SEQ ID NO: 1671825 - DNA, 13 bp, Homo sapiens
tttctgtaaataa

SEQ ID NO: 1671826 - DNA, 16 bp, Homo sapiens
tttctgtaatgtaaat

SEQ ID NO: 1671827 - DNA, 13 bp, Homo sapiens
tttctgtagccta

SEQ ID NO: 1671828 - DNA, 18 bp, Homo sapiens
tttctgtagcctaaaacg

SEQ ID NO: 1671829 - DNA, 13 bp, Homo sapiens
tttctgtgcattc

SEQ ID NO: 1671830 - DNA, 17 bp, Homo sapiens
tttctgtgcctgaatat

SEQ ID NO: 1671831 - DNA, 13 bp, Homo sapiens
tttctgtgtttat

SEQ ID NO: 1671832 - DNA, 13 bp, Homo sapiens
tttctgtttcaaa

SEQ ID NO: 1671833 - DNA, 18 bp, Homo sapiens
tttcttaaaccttcagtt

SEQ ID NO: 1671834 - DNA, 17 bp, Homo sapiens
tttcttaaagcaaagtc

SEQ ID NO: 1671835 - DNA, 24 bp, Homo sapiens
tttcttaaatatgtatatgacatt

SEQ ID NO: 1671836 - DNA, 14 bp, Homo sapiens
tttcttaagaaatg

SEQ ID NO: 1671837 - DNA, 15 bp, Homo sapiens
tttcttaatcatttt

SEQ ID NO: 1671838 - DNA, 21 bp, Homo sapiens
tttcttaatcattttttatat

SEQ ID NO: 1671839 - DNA, 17 bp, Homo sapiens
tttcttacccagattgt

SEQ ID NO: 1671840 - DNA, 13 bp, Homo sapiens
tttcttactagta

SEQ ID NO: 1671841 - DNA, 13 bp, Homo sapiens
tttcttatgtgac

SEQ ID NO: 1671842 - DNA, 14 bp, Homo sapiens
tttcttattgcgct

SEQ ID NO: 1671843 - DNA, 17 bp, Homo sapiens
tttcttatttcatttct

SEQ ID NO: 1671844 - DNA, 14 bp, Homo sapiens
tttcttcaaatgtt

SEQ ID NO: 1671845 - DNA, 18 bp, Homo sapiens
tttcttcatgcaatgaca

SEQ ID NO: 1671846 - DNA, 17 bp, Homo sapiens
tttcttcatttctctgc

SEQ ID NO: 1671847 - DNA, 15 bp, Homo sapiens
tttcttccctgcttt

SEQ ID NO: 1671848 - DNA, 14 bp, Homo sapiens
tttcttcctcttct

SEQ ID NO: 1671849 - DNA, 13 bp, Homo sapiens
tttcttcgctgct

SEQ ID NO: 1671850 - DNA, 14 bp, Homo sapiens
tttcttcgctggac

SEQ ID NO: 1671851 - DNA, 16 bp, Homo sapiens
tttcttctagtatttt

SEQ ID NO: 1671852 - DNA, 16 bp, Homo sapiens
tttcttcttctaagaa

SEQ ID NO: 1671853 - DNA, 18 bp, Homo sapiens
tttcttgatcttaaagat

SEQ ID NO: 1671854 - DNA, 11 bp, Homo sapiens
tttcttgctgg

SEQ ID NO: 1671855 - DNA, 13 bp, Homo sapiens
tttcttggcaaat

SEQ ID NO: 1671856 - DNA, 21 bp, Homo sapiens
tttcttgggatgcttattaga

SEQ ID NO: 1671857 - DNA, 12 bp, Homo sapiens
tttcttgtttgt

SEQ ID NO: 1671858 - DNA, 18 bp, Homo sapiens
tttctttaggagatttat

SEQ ID NO: 1671859 - DNA, 17 bp, Homo sapiens
tttgctttgaaaatatt

SEQ ID NO: 1671860 - DNA, 19 bp, Homo sapiens
tttgctttggttaaaaatg

SEQ ID NO: 1671861 - DNA, 15 bp, Homo sapiens
tttggaaaaaactct

SEQ ID NO: 1671862 - DNA, 20 bp, Homo sapiens
tttggaaaagtggcgtggga

SEQ ID NO: 1671863 - DNA, 15 bp, Homo sapiens
tttggaaagagacca

SEQ ID NO: 1671864 - DNA, 18 bp, Homo sapiens
tttggaaagttactgtaa

SEQ ID NO: 1671865 - DNA, 20 bp, Homo sapiens
tttggaaagttactgtaaat

SEQ ID NO: 1671866 - DNA, 13 bp, Homo sapiens
tttggaaccttgt

SEQ ID NO: 1671867 - DNA, 12 bp, Homo sapiens
tttggaactatg

SEQ ID NO: 1671868 - DNA, 18 bp, Homo sapiens
tttggaataatttctatt

SEQ ID NO: 1671869 - DNA, 22 bp, Homo sapiens
tttggaatcttctctttgacaa

SEQ ID NO: 1671870 - DNA, 20 bp, Homo sapiens
tttggaccaatagcccacag

SEQ ID NO: 1671871 - DNA, 19 bp, Homo sapiens
tttggacctaaatggcctc

SEQ ID NO: 1671872 - DNA, 16 bp, Homo sapiens
tttggacctaatccaa

SEQ ID NO: 1671873 - DNA, 17 bp, Homo sapiens
tttggactgatttgtgg

SEQ ID NO: 1671874 - DNA, 14 bp, Homo sapiens
tttggagagaaata

SEQ ID NO: 1671875 - DNA, 15 bp, Homo sapiens
tttggagagaaatat

SEQ ID NO: 1671876 - DNA, 22 bp, Homo sapiens
tttggagagaaatattttaatt

SEQ ID NO: 1671877 - DNA, 18 bp, Homo sapiens
tttggagagtttcctgaa

SEQ ID NO: 1671878 - DNA, 16 bp, Homo sapiens
tttggagagtttgcct

SEQ ID NO: 1671879 - DNA, 18 bp, Homo sapiens
tttggagcactctgagtt

SEQ ID NO: 1671880 - DNA, 22 bp, Homo sapiens
tttggagctatcagtgctttgt

SEQ ID NO: 1671881 - DNA, 21 bp, Homo sapiens
tttggagtcagtaggtccaag

SEQ ID NO: 1671882 - DNA, 17 bp, Homo sapiens
tttggagtcccctcacc

SEQ ID NO: 1671883 - DNA, 16 bp, Homo sapiens
tttggataatcttaaa

SEQ ID NO: 1671884 - DNA, 21 bp, Homo sapiens
tttggatcatttttaactgat

SEQ ID NO: 1671885 - DNA, 15 bp, Homo sapiens
tttggatctgtgaca

SEQ ID NO: 1671886 - DNA, 10 bp, Homo sapiens
tttggatgcc

SEQ ID NO: 1671887 - DNA, 15 bp, Homo sapiens
tttggattctaaata

SEQ ID NO: 1671888 - DNA, 18 bp, Homo sapiens
tttggattctaaatacat

SEQ ID NO: 1671889 - DNA, 19 bp, Homo sapiens
tttggattctaaatacatg

SEQ ID NO: 1671890 - DNA, 18 bp, Homo sapiens
tttggattcttatgtagc

SEQ ID NO: 1671891 - DNA, 20 bp, Homo sapiens
tttggattcttatgtagcag

SEQ ID NO: 1671892 - DNA, 20 bp, Homo sapiens
tttggatttaaaagcctgct

SEQ ID NO: 1671893 - DNA, 23 bp, Homo sapiens
tttggcaaggaaaggggagaagg

SEQ ID NO: 1671894 - DNA, 17 bp, Homo sapiens
tttggcactggggcact

SEQ ID NO: 1671895 - DNA, 18 bp, Homo sapiens
tttggcatctcctgtcct

SEQ ID NO: 1671896 - DNA, 11 bp, Homo sapiens
tttggccctgg

SEQ ID NO: 1671897 - DNA, 18 bp, Homo sapiens
tttggccctggagccagg

SEQ ID NO: 1671898 - DNA, 19 bp, Homo sapiens
tttggccctggagccaggg

SEQ ID NO: 1671899 - DNA, 21 bp, Homo sapiens
tttggcctggggtgcatctcc

SEQ ID NO: 1671900 - DNA, 19 bp, Homo sapiens
tttggcctgtttgatgtat

SEQ ID NO: 1671901 - DNA, 22 bp, Homo sapiens
tttggctagttctcttaacact

SEQ ID NO: 1671902 - DNA, 23 bp, Homo sapiens
tttggctctcctcagaagaaaga

SEQ ID NO: 1671903 - DNA, 21 bp, Homo sapiens
tttggctgaaattctcctgga

SEQ ID NO: 1671904 - DNA, 22 bp, Homo sapiens
tttggctgagacctgggatttg

SEQ ID NO: 1671905 - DNA, 19 bp, Homo sapiens
tttggctggtagcagcagg

SEQ ID NO: 1671906 - DNA, 22 bp, Homo sapiens
tttggcttaaagcatcctcctc

SEQ ID NO: 1671907 - DNA, 19 bp, Homo sapiens
tttgggaaagatggataaa

SEQ ID NO: 1671908 - DNA, 16 bp, Homo sapiens
tttgggaacactggcc

SEQ ID NO: 1671909 - DNA, 17 bp, Homo sapiens
tttgggaagttaaaggg

SEQ ID NO: 1671910 - DNA, 23 bp, Homo sapiens
tttgggagagacttgttttggat

SEQ ID NO: 1671911 - DNA, 14 bp, Homo sapiens
tttgggagctctgc

SEQ ID NO: 1671912 - DNA, 17 bp, Homo sapiens
tttgggaggctgaggcg

SEQ ID NO: 1671913 - DNA, 15 bp, Homo sapiens
tttgggagtttttat

SEQ ID NO: 1671914 - DNA, 22 bp, Homo sapiens
tttgggcctccatgccccagct

SEQ ID NO: 1671915 - DNA, 16 bp, Homo sapiens
tttgggcctgttcctt

SEQ ID NO: 1671916 - DNA, 23 bp, Homo sapiens
tttggggctttcccaggagaaag

SEQ ID NO: 1671917 - DNA, 23 bp, Homo sapiens
tttgggggaaacgggctccttcc

SEQ ID NO: 1671918 - DNA, 16 bp, Homo sapiens
tttggggtctttgtgg

SEQ ID NO: 1671919 - DNA, 22 bp, Homo sapiens
tttgggtatgtttaatctgtta

SEQ ID NO: 1671920 - DNA, 16 bp, Homo sapiens
tttgggtgaccagcca

SEQ ID NO: 1671921 - DNA, 17 bp, Homo sapiens
tttgggtgaccagccac

SEQ ID NO: 1671922 - DNA, 18 bp, Homo sapiens
tttggtacttattactgc

SEQ ID NO: 1671923 - DNA, 13 bp, Homo sapiens
tttggtccaaaaa

SEQ ID NO: 1671924 - DNA, 19 bp, Homo sapiens
tttggtcgaggagtaacaa

SEQ ID NO: 1671925 - DNA, 20 bp, Homo sapiens
tttggtctccttgggccctt

SEQ ID NO: 1671926 - DNA, 21 bp, Homo sapiens
tttggtgagagtcaaagctga

SEQ ID NO: 1671927 - DNA, 14 bp, Homo sapiens
tttggtgcagaggt

SEQ ID NO: 1671928 - DNA, 18 bp, Homo sapiens
tttggtgccaatgtgaaa

SEQ ID NO: 1671929 - DNA, 15 bp, Homo sapiens
tttggtgtacagact

SEQ ID NO: 1671930 - DNA, 18 bp, Homo sapiens
tttggttaaaaaaaagaa

SEQ ID NO: 1671931 - DNA, 16 bp, Homo sapiens
tttggttattggtttt

SEQ ID NO: 1671932 - DNA, 21 bp, Homo sapiens
tttggttatttcagcccccat

SEQ ID NO: 1671933 - DNA, 11 bp, Homo sapiens
tttggttctaa

SEQ ID NO: 1671934 - DNA, 22 bp, Homo sapiens
tttggttgtaaatgctcgtgtg

SEQ ID NO: 1671935 - DNA, 16 bp, Homo sapiens
tttggttttgttcccc

SEQ ID NO: 1671936 - DNA, 21 bp, Homo sapiens
tttgtaaaaacagcattgctt

SEQ ID NO: 1671937 - DNA, 22 bp, Homo sapiens
tttgtaaaaatcttttgaagca

SEQ ID NO: 1671938 - DNA, 14 bp, Homo sapiens
tttgtaaaactgtt

SEQ ID NO: 1671939 - DNA, 16 bp, Homo sapiens
tttgtaaactcaaaat

SEQ ID NO: 1671940 - DNA, 14 bp, Homo sapiens
tttgtaaagctatt

SEQ ID NO: 1671941 - DNA, 14 bp, Homo sapiens
tttgtaaataagag

SEQ ID NO: 1671942 - DNA, 22 bp, Homo sapiens
tttgtaaataagagatttggag

SEQ ID NO: 1671943 - DNA, 20 bp, Homo sapiens
tttgtaaataggatttttag

SEQ ID NO: 1671944 - DNA, 23 bp, Homo sapiens
tttgtaaatgcatattaaataat

SEQ ID NO: 1671945 - DNA, 19 bp, Homo sapiens
tttgtaaatgcctcttaaa

SEQ ID NO: 1671946 - DNA, 20 bp, Homo sapiens
tttgtaagaaggcaatatta

SEQ ID NO: 1671947 - DNA, 16 bp, Homo sapiens
tttgtaagacatttgt

SEQ ID NO: 1671948 - DNA, 15 bp, Homo sapiens
tttgtaagatgctgg

SEQ ID NO: 1671949 - DNA, 14 bp, Homo sapiens
tttgtaagtaacac

SEQ ID NO: 1671950 - DNA, 16 bp, Homo sapiens
tttgtaagtaacacag

SEQ ID NO: 1671951 - DNA, 13 bp, Homo sapiens
tttgtaagtgtaa

SEQ ID NO: 1671952 - DNA, 14 bp, Homo sapiens
tttgtaataaagta

SEQ ID NO: 1671953 - DNA, 18 bp, Homo sapiens
tttgtaatatacagtttt

SEQ ID NO: 1671954 - DNA, 14 bp, Homo sapiens
tttgtaattaaaag

SEQ ID NO: 1671955 - DNA, 22 bp, Homo sapiens
tttgtaattaaaagcaaatcat

SEQ ID NO: 1671956 - DNA, 18 bp, Homo sapiens
tttgtaattgcttacatt

SEQ ID NO: 1671957 - DNA, 13 bp, Homo sapiens
tttgtacaaataa

SEQ ID NO: 1671958 - DNA, 15 bp, Homo sapiens
tttgtacaaataaac

SEQ ID NO: 1671959 - DNA, 20 bp, Homo sapiens
tttgtacaaataaacctgag

SEQ ID NO: 1671960 - DNA, 23 bp, Homo sapiens
tttgtacaaataaacctgaggca

SEQ ID NO: 1671961 - DNA, 18 bp, Homo sapiens
tttgtacaggactgtaaa

SEQ ID NO: 1671962 - DNA, 16 bp, Homo sapiens
tttgtacattacacta

SEQ ID NO: 1671963 - DNA, 14 bp, Homo sapiens
tttgtaccatggtg

SEQ ID NO: 1671964 - DNA, 15 bp, Homo sapiens
tttgtactgaaaaat

SEQ ID NO: 1671965 - DNA, 19 bp, Homo sapiens
tttgtacttggaagtgttt

SEQ ID NO: 1671966 - DNA, 20 bp, Homo sapiens
tttgtactttatcatgaatg

SEQ ID NO: 1671967 - DNA, 15 bp, Homo sapiens
tttgtactttctgtt

SEQ ID NO: 1671968 - DNA, 14 bp, Homo sapiens
tttgtagacttcct

SEQ ID NO: 1671969 - DNA, 21 bp, Homo sapiens
tttgtagatggcgatgtgtta

SEQ ID NO: 1671970 - DNA, 17 bp, Homo sapiens
tttgtagccttcctcca

SEQ ID NO: 1671971 - DNA, 23 bp, Homo sapiens
tttgtagtaaaagtggtctctgc

SEQ ID NO: 1671972 - DNA, 17 bp, Homo sapiens
tttgtagttttatttgt

SEQ ID NO: 1671973 - DNA, 20 bp, Homo sapiens
ttttcccatcatcctttgtt

SEQ ID NO: 1671974 - DNA, 23 bp, Homo sapiens
ttttcccatcatcctttgttctg

SEQ ID NO: 1671975 - DNA, 16 bp, Homo sapiens
ttttcccccttcccat

SEQ ID NO: 1671976 - DNA, 21 bp, Homo sapiens
ttttcccccttgaggattgtg

SEQ ID NO: 1671977 - DNA, 14 bp, Homo sapiens
ttttcccctggcct

SEQ ID NO: 1671978 - DNA, 15 bp, Homo sapiens
ttttcccctttctgt

SEQ ID NO: 1671979 - DNA, 15 bp, Homo sapiens
ttttccctgaagtta

SEQ ID NO: 1671980 - DNA, 22 bp, Homo sapiens
ttttcccttaaatacagataat

SEQ ID NO: 1671981 - DNA, 10 bp, Homo sapiens
ttttcccttt

SEQ ID NO: 1671982 - DNA, 19 bp, Homo sapiens
ttttccgtcacttaaattt

SEQ ID NO: 1671983 - DNA, 14 bp, Homo sapiens
ttttcctaaatgca

SEQ ID NO: 1671984 - DNA, 18 bp, Homo sapiens
ttttcctaagtgtttact

SEQ ID NO: 1671985 - DNA, 18 bp, Homo sapiens
ttttcctcaagcaataat

SEQ ID NO: 1671986 - DNA, 22 bp, Homo sapiens
ttttcctcaagcaataattgtt

SEQ ID NO: 1671987 - DNA, 13 bp, Homo sapiens
ttttcctgcatgt

SEQ ID NO: 1671988 - DNA, 20 bp, Homo sapiens
ttttccttatttgccttcta

SEQ ID NO: 1671989 - DNA, 14 bp, Homo sapiens
ttttccttgcctgt

SEQ ID NO: 1671990 - DNA, 11 bp, Homo sapiens
ttttcctttat

SEQ ID NO: 1671991 - DNA, 13 bp, Homo sapiens
ttttcctttataa

SEQ ID NO: 1671992 - DNA, 22 bp, Homo sapiens
ttttcctttgaacgtgcttctt

SEQ ID NO: 1671993 - DNA, 19 bp, Homo sapiens
ttttcggccccatgtatct

SEQ ID NO: 1671994 - DNA, 16 bp, Homo sapiens
ttttcgttaacattga

SEQ ID NO: 1671995 - DNA, 22 bp, Homo sapiens
ttttctaaactgttttcatgtg

SEQ ID NO: 1671996 - DNA, 17 bp, Homo sapiens
ttttctaagaaaagcat

SEQ ID NO: 1671997 - DNA, 13 bp, Homo sapiens
ttttctaagagaa

SEQ ID NO: 1671998 - DNA, 18 bp, Homo sapiens
ttttctaatcacagtgtt

SEQ ID NO: 1671999 - DNA, 22 bp, Homo sapiens
ttttctacataattgtgaccaa

SEQ ID NO: 1672000 - DNA, 13 bp, Homo sapiens
ttttctagagaca

SEQ ID NO: 1672001 - DNA, 11 bp, Homo sapiens
ttttctatata

SEQ ID NO: 1672002 - DNA, 15 bp, Homo sapiens
ttttctatatagttc

SEQ ID NO: 1672003 - DNA, 11 bp, Homo sapiens
ttttctatttt

SEQ ID NO: 1672004 - DNA, 14 bp, Homo sapiens
ttttctcacaaaaa

SEQ ID NO: 1672005 - DNA, 15 bp, Homo sapiens
ttttctcagatctgg

SEQ ID NO: 1672006 - DNA, 20 bp, Homo sapiens
ttttctccaatatcagtgct

SEQ ID NO: 1672007 - DNA, 19 bp, Homo sapiens
ttttctcccaagaaacctg

SEQ ID NO: 1672008 - DNA, 19 bp, Homo sapiens
ttttctcctcccaggaact

SEQ ID NO: 1672009 - DNA, 17 bp, Homo sapiens
ttttctcctgcagaaag

SEQ ID NO: 1672010 - DNA, 14 bp, Homo sapiens
ttttctcggtgggg

SEQ ID NO: 1672011 - DNA, 17 bp, Homo sapiens
ttttctctaactcagaa

SEQ ID NO: 1672012 - DNA, 14 bp, Homo sapiens
ttttctctgtactt

SEQ ID NO: 1672013 - DNA, 14 bp, Homo sapiens
ttttctcttagaaa

SEQ ID NO: 1672014 - DNA, 13 bp, Homo sapiens
ttttctcttccct

SEQ ID NO: 1672015 - DNA, 19 bp, Homo sapiens
ttttctcttcccttcccag

SEQ ID NO: 1672016 - DNA, 13 bp, Homo sapiens
ttttctcttgtac

SEQ ID NO: 1672017 - DNA, 16 bp, Homo sapiens
ttttctcttgtaccat

SEQ ID NO: 1672018 - DNA, 15 bp, Homo sapiens
ttttctgaaacacac

SEQ ID NO: 1672019 - DNA, 17 bp, Homo sapiens
ttttctgaactccattt

SEQ ID NO: 1672020 - DNA, 14 bp, Homo sapiens
ttttctgactagtt

SEQ ID NO: 1672021 - DNA, 18 bp, Homo sapiens
ttttctgagaaagactat

SEQ ID NO: 1672022 - DNA, 12 bp, Homo sapiens
ttttctgagccc

SEQ ID NO: 1672023 - DNA, 22 bp, Homo sapiens
ttttctgagcccgggctgcctg

SEQ ID NO: 1672024 - DNA, 12 bp, Homo sapiens
ttttctgcagct

SEQ ID NO: 1672025 - DNA, 15 bp, Homo sapiens
ttttctgcagctgtt

SEQ ID NO: 1672026 - DNA, 20 bp, Homo sapiens
ttttctgcagctgtttcaaa

SEQ ID NO: 1672027 - DNA, 13 bp, Homo sapiens
ttttctgccctgg

SEQ ID NO: 1672028 - DNA, 11 bp, Homo sapiens
ttttctggcac

SEQ ID NO: 1672029 - DNA, 20 bp, Homo sapiens
ttttctggccagtgtttaaa

SEQ ID NO: 1672030 - DNA, 10 bp, Homo sapiens
ttttctgggg

SEQ ID NO: 1672031 - DNA, 15 bp, Homo sapiens
ttttctggttctaac

SEQ ID NO: 1672032 - DNA, 16 bp, Homo sapiens
ttttctggtttggcat

SEQ ID NO: 1672033 - DNA, 14 bp, Homo sapiens
ttttctgtaattca

SEQ ID NO: 1672034 - DNA, 13 bp, Homo sapiens
ttttctgtcctgg

SEQ ID NO: 1672035 - DNA, 18 bp, Homo sapiens
ttttctgtgcctgaatat

SEQ ID NO: 1672036 - DNA, 14 bp, Homo sapiens
ttttctgtttctgt

SEQ ID NO: 1672037 - DNA, 22 bp, Homo sapiens
ttttcttaaagcaaagtcactt

SEQ ID NO: 1672038 - DNA, 17 bp, Homo sapiens
ttttcttacccagattg

SEQ ID NO: 1672039 - DNA, 23 bp, Homo sapiens
ttttcttacccagattgtgtaca

SEQ ID NO: 1672040 - DNA, 16 bp, Homo sapiens
ttttcttatttatatc

SEQ ID NO: 1672041 - DNA, 17 bp, Homo sapiens
ttttcttcactcaaatt

SEQ ID NO: 1672042 - DNA, 11 bp, Homo sapiens
ttttcttctga

SEQ ID NO: 1672043 - DNA, 21 bp, Homo sapiens
ttttcttgccaatgaggtctg

SEQ ID NO: 1672044 - DNA, 19 bp, Homo sapiens
ttttcttgcctctgtcccc

SEQ ID NO: 1672045 - DNA, 15 bp, Homo sapiens
ttttcttgtaaatgt

SEQ ID NO: 1672046 - DNA, 14 bp, Homo sapiens
ttttctttaactgc

SEQ ID NO: 1672047 - DNA, 18 bp, Homo sapiens
ttttctttaactgccgta

SEQ ID NO: 1672048 - DNA, 15 bp, Homo sapiens
ttttctttggctgca

SEQ ID NO: 1672049 - DNA, 12 bp, Homo sapiens
ttttctttgtgt

SEQ ID NO: 1672050 - DNA, 16 bp, Homo sapiens
ttttctttgtgtagct

SEQ ID NO: 1672051 - DNA, 18 bp, Homo sapiens
ttttctttttactgttga

SEQ ID NO: 1672052 - DNA, 15 bp, Homo sapiens
ttttctttttccagt

SEQ ID NO: 1672053 - DNA, 21 bp, Homo sapiens
ttttctttttttaactggtga

SEQ ID NO: 1672054 - DNA, 22 bp, Homo sapiens
ttttctttttttttaagttctt

SEQ ID NO: 1672055 - DNA, 13 bp, Homo sapiens
ttttgaaaagttg

SEQ ID NO: 1672056 - DNA, 23 bp, Homo sapiens
ttttgaaaagttgaaatgtgtaa

SEQ ID NO: 1672057 - DNA, 15 bp, Homo sapiens
ttttgaaacaaagta

SEQ ID NO: 1672058 - DNA, 15 bp, Homo sapiens
ttttgaaagaaaaat

SEQ ID NO: 1672059 - DNA, 13 bp, Homo sapiens
ttttgaaatcacc

SEQ ID NO: 1672060 - DNA, 13 bp, Homo sapiens
ttttgaaatgctg

SEQ ID NO: 1672061 - DNA, 20 bp, Homo sapiens
ttttgaaatgctgaaaattg

SEQ ID NO: 1672062 - DNA, 16 bp, Homo sapiens
ttttgaaatttactgt

SEQ ID NO: 1672063 - DNA, 21 bp, Homo sapiens
ttttgaactaataaaagcata

SEQ ID NO: 1672064 - DNA, 17 bp, Homo sapiens
ttttgaagccttttgtt

SEQ ID NO: 1672065 - DNA, 15 bp, Homo sapiens
ttttgaagctgttgc

SEQ ID NO: 1672066 - DNA, 17 bp, Homo sapiens
ttttgaatacatttgta

SEQ ID NO: 1672067 - DNA, 18 bp, Homo sapiens
ttttgaatacatttgtat

SEQ ID NO: 1672068 - DNA, 16 bp, Homo sapiens
ttttgaatccatgctt

SEQ ID NO: 1672069 - DNA, 20 bp, Homo sapiens
ttttgaatctcataatttat

SEQ ID NO: 1672070 - DNA, 15 bp, Homo sapiens
ttttgaatttaaata

SEQ ID NO: 1672071 - DNA, 16 bp, Homo sapiens
ttttgaatttaaataa

SEQ ID NO: 1672072 - DNA, 16 bp, Homo sapiens
ttttgacaaagtgcct

SEQ ID NO: 1672073 - DNA, 19 bp, Homo sapiens
ttttgacactatatctgta

SEQ ID NO: 1672074 - DNA, 22 bp, Homo sapiens
ttttgactagggattcaggctg

SEQ ID NO: 1672075 - DNA, 13 bp, Homo sapiens
ttttgagcacttt

SEQ ID NO: 1672076 - DNA, 19 bp, Homo sapiens
ttttgagtatttttaaaaa

SEQ ID NO: 1672077 - DNA, 14 bp, Homo sapiens
ttttgagtgtgtgt

SEQ ID NO: 1672078 - DNA, 18 bp, Homo sapiens
ttttgagtgtgtgtgtgc

SEQ ID NO: 1672079 - DNA, 16 bp, Homo sapiens
ttttgagttacaattt

SEQ ID NO: 1672080 - DNA, 19 bp, Homo sapiens
ttttgataaagtttctcag

SEQ ID NO: 1672081 - DNA, 20 bp, Homo sapiens
ttttgatgtttgtggcctca

SEQ ID NO: 1672082 - DNA, 16 bp, Homo sapiens
ttttgattaacaatgt

SEQ ID NO: 1672083 - DNA, 12 bp, Homo sapiens
ttttgattatgt

SEQ ID NO: 1672084 - DNA, 17 bp, Homo sapiens
ttttgcacagccaaatt

SEQ ID NO: 1672085 - DNA, 16 bp, Homo sapiens
ttttgcacgtcttgct

SEQ ID NO: 1672086 - DNA, 16 bp, Homo sapiens
ttttgcagtaactgtt

SEQ ID NO: 1672087 - DNA, 22 bp, Homo sapiens
ttttgcagtagagtcatctcca

SEQ ID NO: 1672088 - DNA, 14 bp, Homo sapiens
ttttgcattccaga

SEQ ID NO: 1672089 - DNA, 15 bp, Homo sapiens
agggttttccaccct

SEQ ID NO: 1672090 - DNA, 17 bp, Homo sapiens
agggtttttagagaatg

SEQ ID NO: 1672091 - DNA, 20 bp, Homo sapiens
aggtaaataaaaagaaaggc

SEQ ID NO: 1672092 - DNA, 23 bp, Homo sapiens
aggtaacactagggccttggaaa

SEQ ID NO: 1672093 - DNA, 13 bp, Homo sapiens
aggtaatatacct

SEQ ID NO: 1672094 - DNA, 20 bp, Homo sapiens
aggtaatatacctggtttac

SEQ ID NO: 1672095 - DNA, 21 bp, Homo sapiens
aggtaatatacctggtttact

SEQ ID NO: 1672096 - DNA, 11 bp, Homo sapiens
aggtaattgtt

SEQ ID NO: 1672097 - DNA, 21 bp, Homo sapiens
aggtaattgttttttaaagca

SEQ ID NO: 1672098 - DNA, 22 bp, Homo sapiens
aggtaattgttttttaaagcaa

SEQ ID NO: 1672099 - DNA, 16 bp, Homo sapiens
aggtacaggagaggca

SEQ ID NO: 1672100 - DNA, 17 bp, Homo sapiens
aggtacaggagaggcag

SEQ ID NO: 1672101 - DNA, 22 bp, Homo sapiens
aggtacaggagaggcagcatgc

SEQ ID NO: 1672102 - DNA, 17 bp, Homo sapiens
aggtaccaaacaaggaa

SEQ ID NO: 1672103 - DNA, 21 bp, Homo sapiens
aggtacccctttctggctctc

SEQ ID NO: 1672104 - DNA, 19 bp, Homo sapiens
aggtaccgatttctgctaa

SEQ ID NO: 1672105 - DNA, 20 bp, Homo sapiens
aggtactgtctgcttctctc

SEQ ID NO: 1672106 - DNA, 20 bp, Homo sapiens
aggtacttcctcctgatggc

SEQ ID NO: 1672107 - DNA, 23 bp, Homo sapiens
aggtagaaatatctgaaaatgta

SEQ ID NO: 1672108 - DNA, 22 bp, Homo sapiens
aggtagatcgcttgagcccagg

SEQ ID NO: 1672109 - DNA, 22 bp, Homo sapiens
aggtgggctggggctgctcccc

SEQ ID NO: 1672110 - DNA, 17 bp, Homo sapiens
aggtgggggaaaatgaa

SEQ ID NO: 1672111 - DNA, 14 bp, Homo sapiens
aggtgggtccagga

SEQ ID NO: 1672112 - DNA, 16 bp, Homo sapiens
aggtgggtgattcctc

SEQ ID NO: 1672113 - DNA, 20 bp, Homo sapiens
aggtgggtgattcctcccag

SEQ ID NO: 1672114 - DNA, 20 bp, Homo sapiens
aggtgggtgtgggacacctg

SEQ ID NO: 1672115 - DNA, 21 bp, Homo sapiens
aggtgggttttcttcccatca

SEQ ID NO: 1672116 - DNA, 19 bp, Homo sapiens
aggtggtaaattcagacaa

SEQ ID NO: 1672117 - DNA, 20 bp, Homo sapiens
aggtggtatgtaatttatgc

SEQ ID NO: 1672118 - DNA, 19 bp, Homo sapiens
aggtggtggggctgccgga

SEQ ID NO: 1672119 - DNA, 16 bp, Homo sapiens
aggtggttcgtgctgt

SEQ ID NO: 1672120 - DNA, 18 bp, Homo sapiens
aggtggttcgtgctgtgc

SEQ ID NO: 1672121 - DNA, 19 bp, Homo sapiens
aggtggttcgtgctgtgct

SEQ ID NO: 1672122 - DNA, 20 bp, Homo sapiens
aggtggttcgtgctgtgctc

SEQ ID NO: 1672123 - DNA, 19 bp, Homo sapiens
aggtggttgtcttattgca

SEQ ID NO: 1672124 - DNA, 17 bp, Homo sapiens
aggtgtcatccacaggc

SEQ ID NO: 1672125 - DNA, 15 bp, Homo sapiens
aggtgtccccaacgt

SEQ ID NO: 1672126 - DNA, 20 bp, Homo sapiens
aggtgtccccaacgtcccct

SEQ ID NO: 1672127 - DNA, 21 bp, Homo sapiens
aggtgtccccaacgtcccctc

SEQ ID NO: 1672128 - DNA, 15 bp, Homo sapiens
aggtgtccttttcct

SEQ ID NO: 1672129 - DNA, 20 bp, Homo sapiens
aggtgtctggggtgagggag

SEQ ID NO: 1672130 - DNA, 21 bp, Homo sapiens
aggtgtctggggtgagggagt

SEQ ID NO: 1672131 - DNA, 14 bp, Homo sapiens
aggtgtgcctgtgc

SEQ ID NO: 1672132 - DNA, 22 bp, Homo sapiens
aggtgtggggacacagcagtga

SEQ ID NO: 1672133 - DNA, 23 bp, Homo sapiens
aggtgtggggacacagcagtgag

SEQ ID NO: 1672134 - DNA, 16 bp, Homo sapiens
aggtgtgggggctgca

SEQ ID NO: 1672135 - DNA, 17 bp, Homo sapiens
aggtgtgggggctgcag

SEQ ID NO: 1672136 - DNA, 17 bp, Homo sapiens
aggtgtggtggctcatg

SEQ ID NO: 1672137 - DNA, 12 bp, Homo sapiens
aggtgttatttg

SEQ ID NO: 1672138 - DNA, 23 bp, Homo sapiens
agtatggtaggggagggcaggct

SEQ ID NO: 1672139 - DNA, 15 bp, Homo sapiens
agtatggttctcaga

SEQ ID NO: 1672140 - DNA, 23 bp, Homo sapiens
agtatgtattacttttgtaatca

SEQ ID NO: 1672141 - DNA, 20 bp, Homo sapiens
agtatgtccccataagacaa

SEQ ID NO: 1672142 - DNA, 22 bp, Homo sapiens
agtatgtctgtttttgtatctt

SEQ ID NO: 1672143 - DNA, 23 bp, Homo sapiens
agtatgttccaaaccctcctggg

SEQ ID NO: 1672144 - DNA, 20 bp, Homo sapiens
agtattaaaggggggagggg

SEQ ID NO: 1672145 - DNA, 15 bp, Homo sapiens
agtattaataaagaa

SEQ ID NO: 1672146 - DNA, 13 bp, Homo sapiens
agtattataaaca

SEQ ID NO: 1672147 - DNA, 12 bp, Homo sapiens
agtattatgcat

SEQ ID NO: 1672148 - DNA, 18 bp, Homo sapiens
agtattatgcatatataa

SEQ ID NO: 1672149 - DNA, 13 bp, Homo sapiens
agtattatgcctg

SEQ ID NO: 1672150 - DNA, 22 bp, Homo sapiens
agtattatgcctgagttataaa

SEQ ID NO: 1672151 - DNA, 20 bp, Homo sapiens
agtattcaataccgctcagt

SEQ ID NO: 1672152 - DNA, 14 bp, Homo sapiens
agtattcctgttgc

SEQ ID NO: 1672153 - DNA, 17 bp, Homo sapiens
agtattcctgttgctgt

SEQ ID NO: 1672154 - DNA, 15 bp, Homo sapiens
agtattctcattctt

SEQ ID NO: 1672155 - DNA, 12 bp, Homo sapiens
agtattctgaca

SEQ ID NO: 1672156 - DNA, 21 bp, Homo sapiens
agtattctgacatgtaagaaa

SEQ ID NO: 1672157 - DNA, 19 bp, Homo sapiens
agtattcttatttaatgaa

SEQ ID NO: 1672158 - DNA, 19 bp, Homo sapiens
agtattgagaacctggcct

SEQ ID NO: 1672159 - DNA, 14 bp, Homo sapiens
agtattgtttaaaa

SEQ ID NO: 1672160 - DNA, 19 bp, Homo sapiens
agtattgtttaaaatgtaa

SEQ ID NO: 1672161 - DNA, 13 bp, Homo sapiens
agtatttatatat

SEQ ID NO: 1672162 - DNA, 13 bp, Homo sapiens
agtatttatttat

SEQ ID NO: 1672163 - DNA, 15 bp, Homo sapiens
agtatttatttatgt

SEQ ID NO: 1672164 - DNA, 18 bp, Homo sapiens
agtatttatttatgtact

SEQ ID NO: 1672165 - DNA, 14 bp, Homo sapiens
agtatttcccttcc

SEQ ID NO: 1672166 - DNA, 12 bp, Homo sapiens
agtatttctcag

SEQ ID NO: 1672167 - DNA, 16 bp, Homo sapiens
agtatttggaattaga

SEQ ID NO: 1672168 - DNA, 14 bp, Homo sapiens
agtatttgtgggga

SEQ ID NO: 1672169 - DNA, 13 bp, Homo sapiens
agtatttttgccg

SEQ ID NO: 1672170 - DNA, 11 bp, Homo sapiens
agtatttttgg

SEQ ID NO: 1672171 - DNA, 20 bp, Homo sapiens
agtatttttgggctattgca

SEQ ID NO: 1672172 - DNA, 14 bp, Homo sapiens
agtattttttcaag

SEQ ID NO: 1672173 - DNA, 19 bp, Homo sapiens
agtattttttgtataattg

SEQ ID NO: 1672174 - DNA, 20 bp, Homo sapiens
agtatttttttatcttggga

SEQ ID NO: 1672175 - DNA, 15 bp, Homo sapiens
agtatttttttctta

SEQ ID NO: 1672176 - DNA, 20 bp, Homo sapiens
agtatttttttcttaccaaa

SEQ ID NO: 1672177 - DNA, 20 bp, Homo sapiens
agtatttttttttaattttg

SEQ ID NO: 1672178 - DNA, 21 bp, Homo sapiens
agtcaaaaaattatttgctat

SEQ ID NO: 1672179 - DNA, 21 bp, Homo sapiens
agtcaaaacagagatgtgata

SEQ ID NO: 1672180 - DNA, 22 bp, Homo sapiens
agtcaaacacttgtgacttttg

SEQ ID NO: 1672181 - DNA, 22 bp, Homo sapiens
agtcaaagacaaagtgtgtaat

SEQ ID NO: 1672182 - DNA, 12 bp, Homo sapiens
agtcaaagtaaa

SEQ ID NO: 1672183 - DNA, 21 bp, Homo sapiens
agtcaaagtaaaacttgctgc

SEQ ID NO: 1672184 - DNA, 17 bp, Homo sapiens
agtcaaagttgaaaatt

SEQ ID NO: 1672185 - DNA, 19 bp, Homo sapiens
agtcccaggggcagccaca

SEQ ID NO: 1672186 - DNA, 19 bp, Homo sapiens
agtccccaaggcctctctc

SEQ ID NO: 1672187 - DNA, 21 bp, Homo sapiens
agtccccaaggcctctctctg

SEQ ID NO: 1672188 - DNA, 11 bp, Homo sapiens
agtccccaccc

SEQ ID NO: 1672189 - DNA, 13 bp, Homo sapiens
agtccccagccct

SEQ ID NO: 1672190 - DNA, 15 bp, Homo sapiens
agtccccagcccttc

SEQ ID NO: 1672191 - DNA, 19 bp, Homo sapiens
agtcccccaaagggcctcc

SEQ ID NO: 1672192 - DNA, 21 bp, Homo sapiens
agtcccccaaagggcctcctc

SEQ ID NO: 1672193 - DNA, 23 bp, Homo sapiens
agtcccccaaagggcctcctcac

SEQ ID NO: 1672194 - DNA, 14 bp, Homo sapiens
agtcccccaccaca

SEQ ID NO: 1672195 - DNA, 18 bp, Homo sapiens
agtcccccaccacactga

SEQ ID NO: 1672196 - DNA, 19 bp, Homo sapiens
agtccccgaggagctgggc

SEQ ID NO: 1672197 - DNA, 18 bp, Homo sapiens
agtccccgtgccccgcct

SEQ ID NO: 1672198 - DNA, 15 bp, Homo sapiens
agtcccctactccct

SEQ ID NO: 1672199 - DNA, 16 bp, Homo sapiens
agtcccctcacctcct

SEQ ID NO: 1672200 - DNA, 13 bp, Homo sapiens
agtcccctccagg

SEQ ID NO: 1672201 - DNA, 15 bp, Homo sapiens
agtcccctccaggaa

SEQ ID NO: 1672202 - DNA, 16 bp, Homo sapiens
agtcccctcccatctg

SEQ ID NO: 1672203 - DNA, 14 bp, Homo sapiens
agtcccctctctct

SEQ ID NO: 1672204 - DNA, 15 bp, Homo sapiens
agtcccctctctctg

SEQ ID NO: 1672205 - DNA, 16 bp, Homo sapiens
agtcccctctctctgg

SEQ ID NO: 1672206 - DNA, 17 bp, Homo sapiens
agtcccctctctctggg

SEQ ID NO: 1672207 - DNA, 23 bp, Homo sapiens
agtccccttctgtgtttctggag

SEQ ID NO: 1672208 - DNA, 15 bp, Homo sapiens
agtcccgtcaggacg

SEQ ID NO: 1672209 - DNA, 23 bp, Homo sapiens
agtccctcgccgtccctcccagg

SEQ ID NO: 1672210 - DNA, 21 bp, Homo sapiens
agtccctgcacagtgacttct

SEQ ID NO: 1672211 - DNA, 15 bp, Homo sapiens
agtccctggttcatt

SEQ ID NO: 1672212 - DNA, 18 bp, Homo sapiens
agtccctgttttctgagc

SEQ ID NO: 1672213 - DNA, 20 bp, Homo sapiens
agtccctgttttctgagccc

SEQ ID NO: 1672214 - DNA, 13 bp, Homo sapiens
agtcccttcccct

SEQ ID NO: 1672215 - DNA, 14 bp, Homo sapiens
agtcccttcccctc

SEQ ID NO: 1672216 - DNA, 15 bp, Homo sapiens
agtcccttcccctcc

SEQ ID NO: 1672217 - DNA, 20 bp, Homo sapiens
agtcccttcccctccctggc

SEQ ID NO: 1672218 - DNA, 21 bp, Homo sapiens
agtcccttcccctccctggct

SEQ ID NO: 1672219 - DNA, 14 bp, Homo sapiens
agtcccttgttttg

SEQ ID NO: 1672220 - DNA, 13 bp, Homo sapiens
agtccctttaaag

SEQ ID NO: 1672221 - DNA, 15 bp, Homo sapiens
agtccgcagaagccc

SEQ ID NO: 1672222 - DNA, 20 bp, Homo sapiens
agtccgcctggccggctcca

SEQ ID NO: 1672223 - DNA, 22 bp, Homo sapiens
agtccgcctggccggctccagt

SEQ ID NO: 1672224 - DNA, 18 bp, Homo sapiens
agtccggatttctaacag

SEQ ID NO: 1672225 - DNA, 20 bp, Homo sapiens
agtcctacaagctaaaatta

SEQ ID NO: 1672226 - DNA, 16 bp, Homo sapiens
agtcctattctattgc

SEQ ID NO: 1672227 - DNA, 15 bp, Homo sapiens
agtcctcactcccag

SEQ ID NO: 1672228 - DNA, 20 bp, Homo sapiens
agtcctcccaccttggcctc

SEQ ID NO: 1672229 - DNA, 12 bp, Homo sapiens
agtcctctgctc

SEQ ID NO: 1672230 - DNA, 16 bp, Homo sapiens
agtcctcttattccta

SEQ ID NO: 1672231 - DNA, 14 bp, Homo sapiens
agtcctgaagaggc

SEQ ID NO: 1672232 - DNA, 23 bp, Homo sapiens
agtcctgaagaggcgggccagcc

SEQ ID NO: 1672233 - DNA, 15 bp, Homo sapiens
agtcctgctggatct

SEQ ID NO: 1672234 - DNA, 20 bp, Homo sapiens
agtcctggaagccagctttc

SEQ ID NO: 1672235 - DNA, 11 bp, Homo sapiens
agtcctggagg

SEQ ID NO: 1672236 - DNA, 19 bp, Homo sapiens
agtcctggctacatcccag

SEQ ID NO: 1672237 - DNA, 19 bp, Homo sapiens
agtcctgggattacaggtg

SEQ ID NO: 1672238 - DNA, 14 bp, Homo sapiens
agtcctggtcctgg

SEQ ID NO: 1672239 - DNA, 18 bp, Homo sapiens
agtcctggtcctggctgc

SEQ ID NO: 1672240 - DNA, 21 bp, Homo sapiens
agtcctggtcctggctgcact

SEQ ID NO: 1672241 - DNA, 16 bp, Homo sapiens
agtcctgtctctgcct

SEQ ID NO: 1672242 - DNA, 21 bp, Homo sapiens
agtcctgtctctgcctgcggc

SEQ ID NO: 1672243 - DNA, 19 bp, Homo sapiens
agtcctgtgaatgccactg

SEQ ID NO: 1672244 - DNA, 15 bp, Homo sapiens
agtcctgttactatg

SEQ ID NO: 1672245 - DNA, 15 bp, Homo sapiens
agtccttccacctgc

SEQ ID NO: 1672246 - DNA, 16 bp, Homo sapiens
agtccttccacctgcc

SEQ ID NO: 1672247 - DNA, 22 bp, Homo sapiens
agtccttgtcttgtaattgtgg

SEQ ID NO: 1672248 - DNA, 14 bp, Homo sapiens
agtcctttatgtgg

SEQ ID NO: 1672249 - DNA, 22 bp, Homo sapiens
agtcctttcccaccattcctgc

SEQ ID NO: 1672250 - DNA, 14 bp, Homo sapiens
agtctctcttctct

SEQ ID NO: 1672251 - DNA, 16 bp, Homo sapiens
agtctctcttctctcc

SEQ ID NO: 1672252 - DNA, 19 bp, Homo sapiens
agtctctgatttgcaaatg

SEQ ID NO: 1672253 - DNA, 17 bp, Homo sapiens
agtctctgctggcccag

SEQ ID NO: 1672254 - DNA, 17 bp, Homo sapiens
agtctcttacaaaagct

SEQ ID NO: 1672255 - DNA, 12 bp, Homo sapiens
agtctcttcaga

SEQ ID NO: 1672256 - DNA, 14 bp, Homo sapiens
agtctcttcccttt

SEQ ID NO: 1672257 - DNA, 17 bp, Homo sapiens
agtctcttctccactgg

SEQ ID NO: 1672258 - DNA, 18 bp, Homo sapiens
agtctcttctccactgga

SEQ ID NO: 1672259 - DNA, 17 bp, Homo sapiens
agtctctttaatcttca

SEQ ID NO: 1672260 - DNA, 21 bp, Homo sapiens
agtctctttaatcttcagttt

SEQ ID NO: 1672261 - DNA, 14 bp, Homo sapiens
agtctgaaactggc

SEQ ID NO: 1672262 - DNA, 15 bp, Homo sapiens
agtctgaacagctgt

SEQ ID NO: 1672263 - DNA, 16 bp, Homo sapiens
agtctgaacagctgta

SEQ ID NO: 1672264 - DNA, 13 bp, Homo sapiens
agtctgaatattt

SEQ ID NO: 1672265 - DNA, 17 bp, Homo sapiens
agtctgaatgctgccac

SEQ ID NO: 1672266 - DNA, 16 bp, Homo sapiens
agtctgaatttttaaa

SEQ ID NO: 1672267 - DNA, 12 bp, Homo sapiens
agtctgagcccc

SEQ ID NO: 1672268 - DNA, 15 bp, Homo sapiens
agtctgagcccccgg

SEQ ID NO: 1672269 - DNA, 16 bp, Homo sapiens
agtctgagtaaaatct

SEQ ID NO: 1672270 - DNA, 23 bp, Homo sapiens
agtctgagtcctgtctctgcctg

SEQ ID NO: 1672271 - DNA, 15 bp, Homo sapiens
agtctgataaactga

SEQ ID NO: 1672272 - DNA, 19 bp, Homo sapiens
agtctgattttaatgaaat

SEQ ID NO: 1672273 - DNA, 20 bp, Homo sapiens
agtctgattttaatgaaatc

SEQ ID NO: 1672274 - DNA, 15 bp, Homo sapiens
agtctgcgcccttgt

SEQ ID NO: 1672275 - DNA, 19 bp, Homo sapiens
agtctggctttgctctatt

SEQ ID NO: 1672276 - DNA, 17 bp, Homo sapiens
agtctgggatgtagaac

SEQ ID NO: 1672277 - DNA, 23 bp, Homo sapiens
agtctgtaactctttctgaggag

SEQ ID NO: 1672278 - DNA, 17 bp, Homo sapiens
agtctgtctactgtggt

SEQ ID NO: 1672279 - DNA, 19 bp, Homo sapiens
agtctgtctactgtggtga

SEQ ID NO: 1672280 - DNA, 17 bp, Homo sapiens
agtctgtggatcagaga

SEQ ID NO: 1672281 - DNA, 15 bp, Homo sapiens
agtctgtgtgaaggt

SEQ ID NO: 1672282 - DNA, 14 bp, Homo sapiens
agtctgtgtgactg

SEQ ID NO: 1672283 - DNA, 13 bp, Homo sapiens
agtctgttatgca

SEQ ID NO: 1672284 - DNA, 16 bp, Homo sapiens
agtctgttgtgtgtca

SEQ ID NO: 1672285 - DNA, 20 bp, Homo sapiens
agtcttaacaaaccaacatc

SEQ ID NO: 1672286 - DNA, 22 bp, Homo sapiens
agtcttaacaaaccaacatctt

SEQ ID NO: 1672287 - DNA, 14 bp, Homo sapiens
agtcttaactggtc

SEQ ID NO: 1672288 - DNA, 15 bp, Homo sapiens
agtcttaataaaata

SEQ ID NO: 1672289 - DNA, 22 bp, Homo sapiens
agtcttaatgttgaatgctgct

SEQ ID NO: 1672290 - DNA, 14 bp, Homo sapiens
agtcttagatgtat

SEQ ID NO: 1672291 - DNA, 14 bp, Homo sapiens
agtcttcagaccca

SEQ ID NO: 1672292 - DNA, 15 bp, Homo sapiens
agtcttcagacccag

SEQ ID NO: 1672293 - DNA, 23 bp, Homo sapiens
agtcttcctcttagcctctggat

SEQ ID NO: 1672294 - DNA, 12 bp, Homo sapiens
agtcttcctgac

SEQ ID NO: 1672295 - DNA, 19 bp, Homo sapiens
agtcttcctgacactttaa

SEQ ID NO: 1672296 - DNA, 23 bp, Homo sapiens
agtcttctcctccatgaacatca

SEQ ID NO: 1672297 - DNA, 20 bp, Homo sapiens
agtcttctgtaattcattga

SEQ ID NO: 1672298 - DNA, 23 bp, Homo sapiens
agtcttgaagttgggtgtttcca

SEQ ID NO: 1672299 - DNA, 16 bp, Homo sapiens
agtcttgaatttctga

SEQ ID NO: 1672300 - DNA, 15 bp, Homo sapiens
agtcttggcggcagc

SEQ ID NO: 1672301 - DNA, 16 bp, Homo sapiens
agtcttggtggttcta

SEQ ID NO: 1672302 - DNA, 18 bp, Homo sapiens
agtcttgtcttagctctg

SEQ ID NO: 1672303 - DNA, 13 bp, Homo sapiens
agtctttaataaa

SEQ ID NO: 1672304 - DNA, 17 bp, Homo sapiens
agtctttcatggctgct

SEQ ID NO: 1672305 - DNA, 19 bp, Homo sapiens
agtctttgagactaaattc

SEQ ID NO: 1672306 - DNA, 17 bp, Homo sapiens
agtctttgccagtcatt

SEQ ID NO: 1672307 - DNA, 14 bp, Homo sapiens
agtctttgctcagt

SEQ ID NO: 1672308 - DNA, 14 bp, Homo sapiens
agtcttttgctttt

SEQ ID NO: 1672309 - DNA, 18 bp, Homo sapiens
agtcttttgcttttggca

SEQ ID NO: 1672310 - DNA, 19 bp, Homo sapiens
agtcttttgcttttggcaa

SEQ ID NO: 1672311 - DNA, 21 bp, Homo sapiens
agtctttttataggttttata

SEQ ID NO: 1672312 - DNA, 22 bp, Homo sapiens
agtgggacccatagatcttctg

SEQ ID NO: 1672313 - DNA, 20 bp, Homo sapiens
agtgggactcggtgagccgg

SEQ ID NO: 1672314 - DNA, 12 bp, Homo sapiens
agtgggagaaaa

SEQ ID NO: 1672315 - DNA, 14 bp, Homo sapiens
agtgggagaaaaca

SEQ ID NO: 1672316 - DNA, 14 bp, Homo sapiens
agtgggagccaggg

SEQ ID NO: 1672317 - DNA, 11 bp, Homo sapiens
agtgggagggg

SEQ ID NO: 1672318 - DNA, 13 bp, Homo sapiens
agtgggaggggca

SEQ ID NO: 1672319 - DNA, 17 bp, Homo sapiens
agtgggaggggcaggct

SEQ ID NO: 1672320 - DNA, 18 bp, Homo sapiens
agtgggaggggcaggctg

SEQ ID NO: 1672321 - DNA, 13 bp, Homo sapiens
agtgggccaggac

SEQ ID NO: 1672322 - DNA, 19 bp, Homo sapiens
agtgggccaggacaggccc

SEQ ID NO: 1672323 - DNA, 21 bp, Homo sapiens
agtgggccaggacaggcccgg

SEQ ID NO: 1672324 - DNA, 18 bp, Homo sapiens
agtgggcccacccggtgg

SEQ ID NO: 1672325 - DNA, 23 bp, Homo sapiens
agtggggagcagttttcccctgg

SEQ ID NO: 1672326 - DNA, 18 bp, Homo sapiens
agtggggcctgccctctg

SEQ ID NO: 1672327 - DNA, 12 bp, Homo sapiens
agtggggcctgg

SEQ ID NO: 1672328 - DNA, 13 bp, Homo sapiens
agtggggctggca

SEQ ID NO: 1672329 - DNA, 14 bp, Homo sapiens
agtggggctggcat

SEQ ID NO: 1672330 - DNA, 19 bp, Homo sapiens
agtggggctggggaaaggg

SEQ ID NO: 1672331 - DNA, 16 bp, Homo sapiens
agtggggtaggttggg

SEQ ID NO: 1672332 - DNA, 19 bp, Homo sapiens
agtggggtctccctctcct

SEQ ID NO: 1672333 - DNA, 20 bp, Homo sapiens
agtggggtctccctctcctg

SEQ ID NO: 1672334 - DNA, 14 bp, Homo sapiens
agtggggtgctggg

SEQ ID NO: 1672335 - DNA, 18 bp, Homo sapiens
agtggggtgctgggagga

SEQ ID NO: 1672336 - DNA, 20 bp, Homo sapiens
agtggggtggtgtcagaccc

SEQ ID NO: 1672337 - DNA, 21 bp, Homo sapiens
agtggggttatctctgtgtta

SEQ ID NO: 1672338 - DNA, 15 bp, Homo sapiens
agtgggtttcacaag

SEQ ID NO: 1672339 - DNA, 15 bp, Homo sapiens
agtggtaaatactgt

SEQ ID NO: 1672340 - DNA, 19 bp, Homo sapiens
agtggtaaatactgtgaaa

SEQ ID NO: 1672341 - DNA, 15 bp, Homo sapiens
agtggtagtatctcg

SEQ ID NO: 1672342 - DNA, 20 bp, Homo sapiens
agtggtcatgctcagccttg

SEQ ID NO: 1672343 - DNA, 16 bp, Homo sapiens
agtggtctctgctggg

SEQ ID NO: 1672344 - DNA, 20 bp, Homo sapiens
agtggtctctgctggggaag

SEQ ID NO: 1672345 - DNA, 22 bp, Homo sapiens
agtggtctctgctggggaaggg

SEQ ID NO: 1672346 - DNA, 13 bp, Homo sapiens
agtggtctttctg

SEQ ID NO: 1672347 - DNA, 15 bp, Homo sapiens
agtggtctttctgga

SEQ ID NO: 1672348 - DNA, 18 bp, Homo sapiens
agtggtctttctggagag

SEQ ID NO: 1672349 - DNA, 20 bp, Homo sapiens
agtggtctttctggagaggt

SEQ ID NO: 1672350 - DNA, 22 bp, Homo sapiens
agtggtgatttgaaaaatataa

SEQ ID NO: 1672351 - DNA, 23 bp, Homo sapiens
agtggtgcgtttataattggctt

SEQ ID NO: 1672352 - DNA, 13 bp, Homo sapiens
agtggtgggtaat

SEQ ID NO: 1672353 - DNA, 18 bp, Homo sapiens
agtggtgggtaattgtac

SEQ ID NO: 1672354 - DNA, 14 bp, Homo sapiens
agtggtgtgactct

SEQ ID NO: 1672355 - DNA, 20 bp, Homo sapiens
agtggtttctgcgtgtgtat

SEQ ID NO: 1672356 - DNA, 20 bp, Homo sapiens
agtggttttatactgaagga

SEQ ID NO: 1672357 - DNA, 23 bp, Homo sapiens
agtggttttatactgaaggaaaa

SEQ ID NO: 1672358 - DNA, 12 bp, Homo sapiens
agtgtaaaattg

SEQ ID NO: 1672359 - DNA, 15 bp, Homo sapiens
agtgtaaactgaaac

SEQ ID NO: 1672360 - DNA, 14 bp, Homo sapiens
agtgtaaatccttt

SEQ ID NO: 1672361 - DNA, 16 bp, Homo sapiens
agtgtaacttgcttaa

SEQ ID NO: 1672362 - DNA, 18 bp, Homo sapiens
agtgtaacttgcttaaat

SEQ ID NO: 1672363 - DNA, 12 bp, Homo sapiens
agtgtaactttc

SEQ ID NO: 1672364 - DNA, 22 bp, Homo sapiens
agttattgataagttcatacat

SEQ ID NO: 1672365 - DNA, 18 bp, Homo sapiens
agttatttacttttacca

SEQ ID NO: 1672366 - DNA, 22 bp, Homo sapiens
agttatttatgcctctgtattt

SEQ ID NO: 1672367 - DNA, 16 bp, Homo sapiens
agttatttcatctttt

SEQ ID NO: 1672368 - DNA, 19 bp, Homo sapiens
agttattttaattatcttt

SEQ ID NO: 1672369 - DNA, 16 bp, Homo sapiens
agttatttttgtacat

SEQ ID NO: 1672370 - DNA, 18 bp, Homo sapiens
agttatttttgtacatgt

SEQ ID NO: 1672371 - DNA, 16 bp, Homo sapiens
agttcaaaccatttca

SEQ ID NO: 1672372 - DNA, 13 bp, Homo sapiens
agttcaaagtgta

SEQ ID NO: 1672373 - DNA, 21 bp, Homo sapiens
agttcaaagtgtatatttatt

SEQ ID NO: 1672374 - DNA, 19 bp, Homo sapiens
agttcaagactagcctggc

SEQ ID NO: 1672375 - DNA, 15 bp, Homo sapiens
agttcaagcctgtgg

SEQ ID NO: 1672376 - DNA, 21 bp, Homo sapiens
agttcaataaatgtctgttga

SEQ ID NO: 1672377 - DNA, 22 bp, Homo sapiens
agttcacgtaagatacaagttt

SEQ ID NO: 1672378 - DNA, 16 bp, Homo sapiens
agttcactataaatgg

SEQ ID NO: 1672379 - DNA, 16 bp, Homo sapiens
agttcagtagaattac

SEQ ID NO: 1672380 - DNA, 17 bp, Homo sapiens
agttcagtagaattacc

SEQ ID NO: 1672381 - DNA, 16 bp, Homo sapiens
ataaagatatttccaa

SEQ ID NO: 1672382 - DNA, 14 bp, Homo sapiens
ataaagatgatcta

SEQ ID NO: 1672383 - DNA, 13 bp, Homo sapiens
ataaagattgtac

SEQ ID NO: 1672384 - DNA, 20 bp, Homo sapiens
ataaagatttcttgagtttt

SEQ ID NO: 1672385 - DNA, 18 bp, Homo sapiens
ataaagcaaatagacaca

SEQ ID NO: 1672386 - DNA, 15 bp, Homo sapiens
ataaagcattactct

SEQ ID NO: 1672387 - DNA, 11 bp, Homo sapiens
ataaagcattc

SEQ ID NO: 1672388 - DNA, 12 bp, Homo sapiens
ataaagcattct

SEQ ID NO: 1672389 - DNA, 12 bp, Homo sapiens
ataaagccactt

SEQ ID NO: 1672390 - DNA, 21 bp, Homo sapiens
ataaagcctcaaggttttagg

SEQ ID NO: 1672391 - DNA, 13 bp, Homo sapiens
ataacatgtaatt

SEQ ID NO: 1672392 - DNA, 18 bp, Homo sapiens
ataacatgtaattaagta

SEQ ID NO: 1672393 - DNA, 15 bp, Homo sapiens
ataacattcagttcc

SEQ ID NO: 1672394 - DNA, 16 bp, Homo sapiens
ataacattcagttccc

SEQ ID NO: 1672395 - DNA, 20 bp, Homo sapiens
ataaccatgtgaaaaggcaa

SEQ ID NO: 1672396 - DNA, 20 bp, Homo sapiens
ataacctagttaaagaaagg

SEQ ID NO: 1672397 - DNA, 13 bp, Homo sapiens
ataacctggcaaa

SEQ ID NO: 1672398 - DNA, 22 bp, Homo sapiens
ataacctgtctcacctggactt

SEQ ID NO: 1672399 - DNA, 13 bp, Homo sapiens
ataacctttctgg

SEQ ID NO: 1672400 - DNA, 16 bp, Homo sapiens
ataactaaaaggtatg

SEQ ID NO: 1672401 - DNA, 15 bp, Homo sapiens
ataactaacatgtcc

SEQ ID NO: 1672402 - DNA, 17 bp, Homo sapiens
ataactacctcctcact

SEQ ID NO: 1672403 - DNA, 15 bp, Homo sapiens
atagttcaaagccaa

SEQ ID NO: 1672404 - DNA, 17 bp, Homo sapiens
atagttccttgccttaa

SEQ ID NO: 1672405 - DNA, 21 bp, Homo sapiens
atagttccttgccttaataaa

SEQ ID NO: 1672406 - DNA, 12 bp, Homo sapiens
atagttctaaac

SEQ ID NO: 1672407 - DNA, 12 bp, Homo sapiens
atagttctagac

SEQ ID NO: 1672408 - DNA, 16 bp, Homo sapiens
atagttctatcctttt

SEQ ID NO: 1672409 - DNA, 16 bp, Homo sapiens
atagttctatttctat

SEQ ID NO: 1672410 - DNA, 12 bp, Homo sapiens
atagttctgtat

SEQ ID NO: 1672411 - DNA, 19 bp, Homo sapiens
atagttgaagggaggtgaa

SEQ ID NO: 1672412 - DNA, 21 bp, Homo sapiens
atagttgaattagtgagtata

SEQ ID NO: 1672413 - DNA, 23 bp, Homo sapiens
atagttggaggtgattccagtga

SEQ ID NO: 1672414 - DNA, 17 bp, Homo sapiens
atagtttacctgaataa

SEQ ID NO: 1672415 - DNA, 13 bp, Homo sapiens
atagtttattgac

SEQ ID NO: 1672416 - DNA, 13 bp, Homo sapiens
atagtttgtctat

SEQ ID NO: 1672417 - DNA, 21 bp, Homo sapiens
atagttttacttttaaactgt

SEQ ID NO: 1672418 - DNA, 23 bp, Homo sapiens
atataaaaaccccaaactgttga

SEQ ID NO: 1672419 - DNA, 17 bp, Homo sapiens
atataaaaagaaaagat

SEQ ID NO: 1672420 - DNA, 20 bp, Homo sapiens
atataaaaagaaaagataaa

SEQ ID NO: 1672421 - DNA, 21 bp, Homo sapiens
atataaaaggcaaatgtgtac

SEQ ID NO: 1672422 - DNA, 23 bp, Homo sapiens
atataaaatgaaagatttttact

SEQ ID NO: 1672423 - DNA, 14 bp, Homo sapiens
atataaacatattt

SEQ ID NO: 1672424 - DNA, 17 bp, Homo sapiens
atataaagtattcaaca

SEQ ID NO: 1672425 - DNA, 17 bp, Homo sapiens
atataaatacatgcaca

SEQ ID NO: 1672426 - DNA, 22 bp, Homo sapiens
atataaatgcaatattaatgcc

SEQ ID NO: 1672427 - DNA, 14 bp, Homo sapiens
atataaatgtggag

SEQ ID NO: 1672428 - DNA, 14 bp, Homo sapiens
atataacacatttt

SEQ ID NO: 1672429 - DNA, 15 bp, Homo sapiens
atataacacattttt

SEQ ID NO: 1672430 - DNA, 16 bp, Homo sapiens
atataaccctaggaat

SEQ ID NO: 1672431 - DNA, 17 bp, Homo sapiens
atataactgtatttgaa

SEQ ID NO: 1672432 - DNA, 22 bp, Homo sapiens
atataagtattctaaattttat

SEQ ID NO: 1672433 - DNA, 21 bp, Homo sapiens
atataataaatgtacattaat

SEQ ID NO: 1672434 - DNA, 18 bp, Homo sapiens
atataatacacaaaatca

SEQ ID NO: 1672435 - DNA, 23 bp, Homo sapiens
atataatatgcacacagtgcttt

SEQ ID NO: 1672436 - DNA, 16 bp, Homo sapiens
atataatatttactgt

SEQ ID NO: 1672437 - DNA, 21 bp, Homo sapiens
atataatggtaatagaatagc

SEQ ID NO: 1672438 - DNA, 22 bp, Homo sapiens
atataatgtattttctttttat

SEQ ID NO: 1672439 - DNA, 22 bp, Homo sapiens
atataatgttgttatttaaaga

SEQ ID NO: 1672440 - DNA, 14 bp, Homo sapiens
atataattatcgga

SEQ ID NO: 1672441 - DNA, 12 bp, Homo sapiens
atataattctgt

SEQ ID NO: 1672442 - DNA, 17 bp, Homo sapiens
atataattctgtaaatg

SEQ ID NO: 1672443 - DNA, 21 bp, Homo sapiens
atatacaacaccaaaaaatat

SEQ ID NO: 1672444 - DNA, 16 bp, Homo sapiens
atatacaataacataa

SEQ ID NO: 1672445 - DNA, 18 bp, Homo sapiens
atatacaataacataatt

SEQ ID NO: 1672446 - DNA, 14 bp, Homo sapiens
atatacaattatat

SEQ ID NO: 1672447 - DNA, 23 bp, Homo sapiens
atatacagtaactttatgtgtaa

SEQ ID NO: 1672448 - DNA, 14 bp, Homo sapiens
atatacatatatat

SEQ ID NO: 1672449 - DNA, 22 bp, Homo sapiens
atatacatatgagaatatacct

SEQ ID NO: 1672450 - DNA, 15 bp, Homo sapiens
atatacattgtgtga

SEQ ID NO: 1672451 - DNA, 16 bp, Homo sapiens
atatacctggtttact

SEQ ID NO: 1672452 - DNA, 21 bp, Homo sapiens
atataccttatttatttttgt

SEQ ID NO: 1672453 - DNA, 12 bp, Homo sapiens
atatactgcata

SEQ ID NO: 1672454 - DNA, 14 bp, Homo sapiens
atatactgcatatc

SEQ ID NO: 1672455 - DNA, 17 bp, Homo sapiens
atatactgctatttaca

SEQ ID NO: 1672456 - DNA, 21 bp, Homo sapiens
atatactgggttcttgtttta

SEQ ID NO: 1672457 - DNA, 22 bp, Homo sapiens
atatactgggttcttgttttat

SEQ ID NO: 1672458 - DNA, 21 bp, Homo sapiens
atatacttgtttttgtaaaga

SEQ ID NO: 1672459 - DNA, 18 bp, Homo sapiens
atatagaattcagaaaat

SEQ ID NO: 1672460 - DNA, 22 bp, Homo sapiens
atatagagacaggacagaatgt

SEQ ID NO: 1672461 - DNA, 23 bp, Homo sapiens
atatagagacaggacagaatgtg

SEQ ID NO: 1672462 - DNA, 18 bp, Homo sapiens
atatagagtcattgtaat

SEQ ID NO: 1672463 - DNA, 23 bp, Homo sapiens
atatagatcagttataagtagca

SEQ ID NO: 1672464 - DNA, 15 bp, Homo sapiens
atatagattataact

SEQ ID NO: 1672465 - DNA, 18 bp, Homo sapiens
atataggacaaaatgtta

SEQ ID NO: 1672466 - DNA, 18 bp, Homo sapiens
atatagtatatttatact

SEQ ID NO: 1672467 - DNA, 17 bp, Homo sapiens
atatagtgggtacatca

SEQ ID NO: 1672468 - DNA, 16 bp, Homo sapiens
atatagttttactttt

SEQ ID NO: 1672469 - DNA, 18 bp, Homo sapiens
atatagttttacttttaa

SEQ ID NO: 1672470 - DNA, 17 bp, Homo sapiens
atatgacacaaaggtgg

SEQ ID NO: 1672471 - DNA, 18 bp, Homo sapiens
atatgacccacactgcca

SEQ ID NO: 1672472 - DNA, 20 bp, Homo sapiens
atatgacggaagaacataga

SEQ ID NO: 1672473 - DNA, 13 bp, Homo sapiens
atatgagcttcaa

SEQ ID NO: 1672474 - DNA, 18 bp, Homo sapiens
atatgagcttcaatataa

SEQ ID NO: 1672475 - DNA, 20 bp, Homo sapiens
atatgagcttcaatataaga

SEQ ID NO: 1672476 - DNA, 21 bp, Homo sapiens
atatgagcttccttctgtgaa

SEQ ID NO: 1672477 - DNA, 22 bp, Homo sapiens
atatgagcttccttctgtgaaa

SEQ ID NO: 1672478 - DNA, 21 bp, Homo sapiens
atatgaggggcagtggacagt

SEQ ID NO: 1672479 - DNA, 17 bp, Homo sapiens
atatgagttactgaagg

SEQ ID NO: 1672480 - DNA, 13 bp, Homo sapiens
atatgagttcttc

SEQ ID NO: 1672481 - DNA, 15 bp, Homo sapiens
atatgattctctgtg

SEQ ID NO: 1672482 - DNA, 20 bp, Homo sapiens
atatgattgaaaagaagaaa

SEQ ID NO: 1672483 - DNA, 20 bp, Homo sapiens
atatgatttaaaacatgtaa

SEQ ID NO: 1672484 - DNA, 16 bp, Homo sapiens
atatgattttatttga

SEQ ID NO: 1672485 - DNA, 19 bp, Homo sapiens
atatgcacacagtgctttc

SEQ ID NO: 1672486 - DNA, 15 bp, Homo sapiens
atatgcaccttgtgt

SEQ ID NO: 1672487 - DNA, 20 bp, Homo sapiens
atatgcaccttgtgtctgta

SEQ ID NO: 1672488 - DNA, 18 bp, Homo sapiens
atatgcagaaatagacaa

SEQ ID NO: 1672489 - DNA, 13 bp, Homo sapiens
atatgcagccaac

SEQ ID NO: 1672490 - DNA, 17 bp, Homo sapiens
atatgcagccatatatg

SEQ ID NO: 1672491 - DNA, 16 bp, Homo sapiens
atatgcagttttcctt

SEQ ID NO: 1672492 - DNA, 19 bp, Homo sapiens
atatgcatatatatatgtg

SEQ ID NO: 1672493 - DNA, 22 bp, Homo sapiens
atatgcatatatatatgtgtgt

SEQ ID NO: 1672494 - DNA, 22 bp, Homo sapiens
atatgcatctggcccaggaatt

SEQ ID NO: 1672495 - DNA, 14 bp, Homo sapiens
atatgccttgtata

SEQ ID NO: 1672496 - DNA, 22 bp, Homo sapiens
atatgctccaggatctttgact

SEQ ID NO: 1672497 - DNA, 17 bp, Homo sapiens
atatgctctgcatgtta

SEQ ID NO: 1672498 - DNA, 20 bp, Homo sapiens
atatgctgttatgtccagaa

SEQ ID NO: 1672499 - DNA, 16 bp, Homo sapiens
atatgcttaaaataag

SEQ ID NO: 1672500 - DNA, 14 bp, Homo sapiens
atatgcttactgat

SEQ ID NO: 1672501 - DNA, 19 bp, Homo sapiens
atatgcttatacacttaca

SEQ ID NO: 1672502 - DNA, 17 bp, Homo sapiens
atatgctttttctcaga

SEQ ID NO: 1672503 - DNA, 14 bp, Homo sapiens
atatggaagaaagt

SEQ ID NO: 1672504 - DNA, 16 bp, Homo sapiens
atatggaagaaagtaa

SEQ ID NO: 1672505 - DNA, 15 bp, Homo sapiens
atatggactctgcac

SEQ ID NO: 1672506 - DNA, 16 bp, Homo sapiens
atatggactctgcaca

SEQ ID NO: 1672507 - DNA, 15 bp, Homo sapiens
atatggaggattctt

SEQ ID NO: 1672508 - DNA, 20 bp, Homo sapiens
atatgggtgggattttgcaa

SEQ ID NO: 1672509 - DNA, 22 bp, Homo sapiens
atatgggttgcatttggtcaag

SEQ ID NO: 1672510 - DNA, 15 bp, Homo sapiens
atatggtatatatac

SEQ ID NO: 1672511 - DNA, 13 bp, Homo sapiens
atatggtgaaggg

SEQ ID NO: 1672512 - DNA, 24 bp, Homo sapiens
atatggtgaagggaagtggggagt

SEQ ID NO: 1672513 - DNA, 14 bp, Homo sapiens
atatggttctccaa

SEQ ID NO: 1672514 - DNA, 20 bp, Homo sapiens
atatggttctccaagaaact

SEQ ID NO: 1672515 - DNA, 13 bp, Homo sapiens
atatgtaaaataa

SEQ ID NO: 1672516 - DNA, 15 bp, Homo sapiens
atatgtaaaataaaa

SEQ ID NO: 1672517 - DNA, 20 bp, Homo sapiens
atatgtaacagtcaaatatc

SEQ ID NO: 1672518 - DNA, 20 bp, Homo sapiens
atatgtaatttcaaaataca

SEQ ID NO: 1672519 - DNA, 15 bp, Homo sapiens
atatgtacatttcta

SEQ ID NO: 1672520 - DNA, 19 bp, Homo sapiens
atatgtaccatgtacatga

SEQ ID NO: 1672521 - DNA, 13 bp, Homo sapiens
atatgtactaaga

SEQ ID NO: 1672522 - DNA, 13 bp, Homo sapiens
atatgtactgttt

SEQ ID NO: 1672523 - DNA, 18 bp, Homo sapiens
atatgtacttgtttgcta

SEQ ID NO: 1672524 - DNA, 17 bp, Homo sapiens
atatgtagcagaaaggc

SEQ ID NO: 1672525 - DNA, 17 bp, Homo sapiens
atatgtataatatatat

SEQ ID NO: 1672526 - DNA, 15 bp, Homo sapiens
atatgtatacatgtg

SEQ ID NO: 1672527 - DNA, 17 bp, Homo sapiens
atatgtatatgacattt

SEQ ID NO: 1672528 - DNA, 15 bp, Homo sapiens
atatgtatatgtata

SEQ ID NO: 1672529 - DNA, 16 bp, Homo sapiens
atatgtatatgtatat

SEQ ID NO: 1672530 - DNA, 17 bp, Homo sapiens
atatgtatatgtatata

SEQ ID NO: 1672531 - DNA, 18 bp, Homo sapiens
atatgtatatttttttaa

SEQ ID NO: 1672532 - DNA, 12 bp, Homo sapiens
atatgtatgggt

SEQ ID NO: 1672533 - DNA, 17 bp, Homo sapiens
atatgtatgggtagggt

SEQ ID NO: 1672534 - DNA, 16 bp, Homo sapiens
atatgtattcccttgt

SEQ ID NO: 1672535 - DNA, 14 bp, Homo sapiens
atatgtattctttt

SEQ ID NO: 1672536 - DNA, 14 bp, Homo sapiens
atatgtattttcct

SEQ ID NO: 1672537 - DNA, 15 bp, Homo sapiens
atatgtattttccta

SEQ ID NO: 1672538 - DNA, 11 bp, Homo sapiens
atatgtctttt

SEQ ID NO: 1672539 - DNA, 15 bp, Homo sapiens
atatgtgaaacattt

SEQ ID NO: 1672540 - DNA, 19 bp, Homo sapiens
atatgtgaacatttatcaa

SEQ ID NO: 1672541 - DNA, 20 bp, Homo sapiens
atatgtgagtgccttttgca

SEQ ID NO: 1672542 - DNA, 16 bp, Homo sapiens
atatgtgccacatttt

SEQ ID NO: 1672543 - DNA, 22 bp, Homo sapiens
atatgtgtatgtacgtttgtat

SEQ ID NO: 1672544 - DNA, 16 bp, Homo sapiens
atatgtgtgtgtatgt

SEQ ID NO: 1672545 - DNA, 17 bp, Homo sapiens
atatgtgtttttcacat

SEQ ID NO: 1672546 - DNA, 15 bp, Homo sapiens
atatgttcaactgga

SEQ ID NO: 1672547 - DNA, 17 bp, Homo sapiens
atatgttgagtgttcat

SEQ ID NO: 1672548 - DNA, 11 bp, Homo sapiens
atatgttgtaa

SEQ ID NO: 1672549 - DNA, 16 bp, Homo sapiens
atatgttgtaatattt

SEQ ID NO: 1672550 - DNA, 17 bp, Homo sapiens
atatgtttcaaactttg

SEQ ID NO: 1672551 - DNA, 12 bp, Homo sapiens
atattaaaaaac

SEQ ID NO: 1672552 - DNA, 19 bp, Homo sapiens
atcaaagtggtaaatactg

SEQ ID NO: 1672553 - DNA, 21 bp, Homo sapiens
atcaaagtggtaaatactgtg

SEQ ID NO: 1672554 - DNA, 15 bp, Homo sapiens
atcaaataagaaata

SEQ ID NO: 1672555 - DNA, 20 bp, Homo sapiens
atcaaatagaaccactatga

SEQ ID NO: 1672556 - DNA, 18 bp, Homo sapiens
atcaaatagcgatgtgca

SEQ ID NO: 1672557 - DNA, 16 bp, Homo sapiens
atcaaatatgcaaagc

SEQ ID NO: 1672558 - DNA, 17 bp, Homo sapiens
atcaaatatgcaaagca

SEQ ID NO: 1672559 - DNA, 17 bp, Homo sapiens
atcaaatctgtatatgt

SEQ ID NO: 1672560 - DNA, 17 bp, Homo sapiens
atcaacaataaaatttt

SEQ ID NO: 1672561 - DNA, 20 bp, Homo sapiens
atcaacagcatgtctactgc

SEQ ID NO: 1672562 - DNA, 12 bp, Homo sapiens
atcaacagggca

SEQ ID NO: 1672563 - DNA, 13 bp, Homo sapiens
atcaacatctttt

SEQ ID NO: 1672564 - DNA, 20 bp, Homo sapiens
atcaactaaagttgtacttt

SEQ ID NO: 1672565 - DNA, 21 bp, Homo sapiens
atcaactcccaacttcttcct

SEQ ID NO: 1672566 - DNA, 18 bp, Homo sapiens
atcaacttcgctagaaaa

SEQ ID NO: 1672567 - DNA, 14 bp, Homo sapiens
atcaactttaatca

SEQ ID NO: 1672568 - DNA, 15 bp, Homo sapiens
atcaactttaatcaa

SEQ ID NO: 1672569 - DNA, 14 bp, Homo sapiens
atcaacttttatgc

SEQ ID NO: 1672570 - DNA, 12 bp, Homo sapiens
atcaagaaagtc

SEQ ID NO: 1672571 - DNA, 15 bp, Homo sapiens
atcaagaaagtgttg

SEQ ID NO: 1672572 - DNA, 14 bp, Homo sapiens
atcaagaagggctg

SEQ ID NO: 1672573 - DNA, 16 bp, Homo sapiens
atcaagaagggctgca

SEQ ID NO: 1672574 - DNA, 12 bp, Homo sapiens
atcaagagaaac

SEQ ID NO: 1672575 - DNA, 22 bp, Homo sapiens
atcaagatgagagaactggagg

SEQ ID NO: 1672576 - DNA, 17 bp, Homo sapiens
atcaagcaggaattatg

SEQ ID NO: 1672577 - DNA, 19 bp, Homo sapiens
atcaagcaggaattatgtc

SEQ ID NO: 1672578 - DNA, 19 bp, Homo sapiens
atcaagcctttatggctgc

SEQ ID NO: 1672579 - DNA, 22 bp, Homo sapiens
atcaagcctttatggctgctgg

SEQ ID NO: 1672580 - DNA, 21 bp, Homo sapiens
atcaaggaaaggctcatttaa

SEQ ID NO: 1672581 - DNA, 22 bp, Homo sapiens
atcaaggaagaaatggttcaga

SEQ ID NO: 1672582 - DNA, 19 bp, Homo sapiens
atcaaggttataatttttt

SEQ ID NO: 1672583 - DNA, 22 bp, Homo sapiens
atcaagttctccccagggtaga

SEQ ID NO: 1672584 - DNA, 20 bp, Homo sapiens
atcaagttgtaacttatatt

SEQ ID NO: 1672585 - DNA, 22 bp, Homo sapiens
atcaagttgtaacttatattga

SEQ ID NO: 1672586 - DNA, 22 bp, Homo sapiens
atcaagttgttgactgtgatta

SEQ ID NO: 1672587 - DNA, 23 bp, Homo sapiens
atcaagttgttgactgtgattag

SEQ ID NO: 1672588 - DNA, 19 bp, Homo sapiens
atcaatacactagttgttt

SEQ ID NO: 1672589 - DNA, 15 bp, Homo sapiens
atcaatacttttgtg

SEQ ID NO: 1672590 - DNA, 14 bp, Homo sapiens
atcaatagttgaat

SEQ ID NO: 1672591 - DNA, 23 bp, Homo sapiens
atcaatcctgattcctctctaag

SEQ ID NO: 1672592 - DNA, 13 bp, Homo sapiens
atcaatcttgtta

SEQ ID NO: 1672593 - DNA, 19 bp, Homo sapiens
atcaatcttgttactgctg

SEQ ID NO: 1672594 - DNA, 21 bp, Homo sapiens
atcaattaacatcgtgggtca

SEQ ID NO: 1672595 - DNA, 16 bp, Homo sapiens
atcaattatagtttct

SEQ ID NO: 1672596 - DNA, 17 bp, Homo sapiens
atcaattatagtttctg

SEQ ID NO: 1672597 - DNA, 18 bp, Homo sapiens
atcaattatagtttctga

SEQ ID NO: 1672598 - DNA, 13 bp, Homo sapiens
atcaattgtaata

SEQ ID NO: 1672599 - DNA, 22 bp, Homo sapiens
atcaattttgacttaatgtgat

SEQ ID NO: 1672600 - DNA, 16 bp, Homo sapiens
atcaatttttcccagt

SEQ ID NO: 1672601 - DNA, 19 bp, Homo sapiens
atcaatttttcttatttca

SEQ ID NO: 1672602 - DNA, 14 bp, Homo sapiens
atcacaaagtggaa

SEQ ID NO: 1672603 - DNA, 15 bp, Homo sapiens
atcacaaagtggaac

SEQ ID NO: 1672604 - DNA, 16 bp, Homo sapiens
atcacaacaagaaatt

SEQ ID NO: 1672605 - DNA, 14 bp, Homo sapiens
atcacacaatatag

SEQ ID NO: 1672606 - DNA, 21 bp, Homo sapiens
atcacacaatatagttttttc

SEQ ID NO: 1672607 - DNA, 15 bp, Homo sapiens
atcacacccatttaa

SEQ ID NO: 1672608 - DNA, 17 bp, Homo sapiens
atcacacctcagtggga

SEQ ID NO: 1672609 - DNA, 16 bp, Homo sapiens
atcacacttctgtgag

SEQ ID NO: 1672610 - DNA, 20 bp, Homo sapiens
atcacagatgggtattaaac

SEQ ID NO: 1672611 - DNA, 12 bp, Homo sapiens
atcacagggcag

SEQ ID NO: 1672612 - DNA, 20 bp, Homo sapiens
atcacagggcagagccggga

SEQ ID NO: 1672613 - DNA, 16 bp, Homo sapiens
atcacagggccccaga

SEQ ID NO: 1672614 - DNA, 20 bp, Homo sapiens
atcacaggggcggggcagga

SEQ ID NO: 1672615 - DNA, 13 bp, Homo sapiens
atcacagtgtttt

SEQ ID NO: 1672616 - DNA, 18 bp, Homo sapiens
atcacagtttttcctgga

SEQ ID NO: 1672617 - DNA, 15 bp, Homo sapiens
atcacatattctagt

SEQ ID NO: 1672618 - DNA, 12 bp, Homo sapiens
atcacatcctgg

SEQ ID NO: 1672619 - DNA, 21 bp, Homo sapiens
atcacattaatctcaaagaga

SEQ ID NO: 1672620 - DNA, 19 bp, Homo sapiens
atcaccacagtaagttcct

SEQ ID NO: 1672621 - DNA, 15 bp, Homo sapiens
atcaccaccgcctct

SEQ ID NO: 1672622 - DNA, 20 bp, Homo sapiens
atcaccaccgcctctggccg

SEQ ID NO: 1672623 - DNA, 21 bp, Homo sapiens
atcaccaccgcctctggccgc

SEQ ID NO: 1672624 - DNA, 13 bp, Homo sapiens
atcaccatttctt

SEQ ID NO: 1672625 - DNA, 18 bp, Homo sapiens
atcaccccaacctctcct

SEQ ID NO: 1672626 - DNA, 16 bp, Homo sapiens
atcaccctcttcctgt

SEQ ID NO: 1672627 - DNA, 12 bp, Homo sapiens
atcacccttccc

SEQ ID NO: 1672628 - DNA, 22 bp, Homo sapiens
atcacccttccctgctcccacc

SEQ ID NO: 1672629 - DNA, 20 bp, Homo sapiens
atcaccgagagtagccgaga

SEQ ID NO: 1672630 - DNA, 16 bp, Homo sapiens
atcacctatttaatgt

SEQ ID NO: 1672631 - DNA, 13 bp, Homo sapiens
atcacctgaggtc

SEQ ID NO: 1672632 - DNA, 17 bp, Homo sapiens
atcacctgaggtcagga

SEQ ID NO: 1672633 - DNA, 23 bp, Homo sapiens
atcacgccactgcactccagcct

SEQ ID NO: 1672634 - DNA, 13 bp, Homo sapiens
atcacgctttcct

SEQ ID NO: 1672635 - DNA, 17 bp, Homo sapiens
atcacgtaccccactgg

SEQ ID NO: 1672636 - DNA, 22 bp, Homo sapiens
atcacgtaccccactgggccag

SEQ ID NO: 1672637 - DNA, 14 bp, Homo sapiens
atcactaatttctt

SEQ ID NO: 1672638 - DNA, 13 bp, Homo sapiens
atcactccctgga

SEQ ID NO: 1672639 - DNA, 19 bp, Homo sapiens
atcactgccacactctcca

SEQ ID NO: 1672640 - DNA, 10 bp, Homo sapiens
atcactggag

SEQ ID NO: 1672641 - DNA, 15 bp, Homo sapiens
atcactggagcccag

SEQ ID NO: 1672642 - DNA, 20 bp, Homo sapiens
atcactggctggcctgagca

SEQ ID NO: 1672643 - DNA, 15 bp, Homo sapiens
atcactgtaaagaca

SEQ ID NO: 1672644 - DNA, 17 bp, Homo sapiens
atcactgtaacctgatt

SEQ ID NO: 1672645 - DNA, 14 bp, Homo sapiens
atcacttaaacttg

SEQ ID NO: 1672646 - DNA, 17 bp, Homo sapiens
atcacttaaacttgcat

SEQ ID NO: 1672647 - DNA, 23 bp, Homo sapiens
atcacttaacggaccaaagcaag

SEQ ID NO: 1672648 - DNA, 13 bp, Homo sapiens
atcacttgaaccc

SEQ ID NO: 1672649 - DNA, 19 bp, Homo sapiens
atcacttgaggtcaggagt

SEQ ID NO: 1672650 - DNA, 17 bp, Homo sapiens
atcacttgtacaaaata

SEQ ID NO: 1672651 - DNA, 21 bp, Homo sapiens
atcacttgtacaaaataaaca

SEQ ID NO: 1672652 - DNA, 12 bp, Homo sapiens
atcactttcata

SEQ ID NO: 1672653 - DNA, 18 bp, Homo sapiens
atcactttctcagttttc

SEQ ID NO: 1672654 - DNA, 21 bp, Homo sapiens
atcactttctcagttttcata

SEQ ID NO: 1672655 - DNA, 20 bp, Homo sapiens
atcactttgagcctgggaaa

SEQ ID NO: 1672656 - DNA, 22 bp, Homo sapiens
atcactttgagcctgggaaata

SEQ ID NO: 1672657 - DNA, 21 bp, Homo sapiens
atcactttgtctaactcagaa

SEQ ID NO: 1672658 - DNA, 20 bp, Homo sapiens
atcagaaagtaacaatctat

SEQ ID NO: 1672659 - DNA, 16 bp, Homo sapiens
atcagaaataataaaa

SEQ ID NO: 1672660 - DNA, 17 bp, Homo sapiens
atcagaaatacaaaaaa

SEQ ID NO: 1672661 - DNA, 13 bp, Homo sapiens
atcagaacagcag

SEQ ID NO: 1672662 - DNA, 22 bp, Homo sapiens
atcagaacattcagctctggag

SEQ ID NO: 1672663 - DNA, 23 bp, Homo sapiens
atcagaacattcagctctggaga

SEQ ID NO: 1672664 - DNA, 14 bp, Homo sapiens
atcagaagaaaggc

SEQ ID NO: 1672665 - DNA, 13 bp, Homo sapiens
atcagaagataac

SEQ ID NO: 1672666 - DNA, 14 bp, Homo sapiens
atcagaagataact

SEQ ID NO: 1672667 - DNA, 20 bp, Homo sapiens
atcagaccctaccccaccac

SEQ ID NO: 1672668 - DNA, 12 bp, Homo sapiens
atcagacctgtc

SEQ ID NO: 1672669 - DNA, 16 bp, Homo sapiens
atcagacctgtcttcc

SEQ ID NO: 1672670 - DNA, 22 bp, Homo sapiens
atcagactagtgacaagctcct

SEQ ID NO: 1672671 - DNA, 15 bp, Homo sapiens
atcagactctagaaa

SEQ ID NO: 1672672 - DNA, 18 bp, Homo sapiens
atcagacttcacactgca

SEQ ID NO: 1672673 - DNA, 17 bp, Homo sapiens
atcagagcgcacaggga

SEQ ID NO: 1672674 - DNA, 14 bp, Homo sapiens
atcagagctcttaa

SEQ ID NO: 1672675 - DNA, 14 bp, Homo sapiens
atcagagggctgat

SEQ ID NO: 1672676 - DNA, 18 bp, Homo sapiens
atcagatcatttcaaaac

SEQ ID NO: 1672677 - DNA, 16 bp, Homo sapiens
atcagatgaattgata

SEQ ID NO: 1672678 - DNA, 16 bp, Homo sapiens
atcagatgcctgcttg

SEQ ID NO: 1672679 - DNA, 23 bp, Homo sapiens
atcagatgctccaagattctaga

SEQ ID NO: 1672680 - DNA, 13 bp, Homo sapiens
atcagcaaagaaa

SEQ ID NO: 1672681 - DNA, 13 bp, Homo sapiens
atcagcaagactt

SEQ ID NO: 1672682 - DNA, 17 bp, Homo sapiens
atcagcaatttcagaac

SEQ ID NO: 1672683 - DNA, 14 bp, Homo sapiens
atcagcaccccagt

SEQ ID NO: 1672684 - DNA, 15 bp, Homo sapiens
atcagcactgaaaat

SEQ ID NO: 1672685 - DNA, 18 bp, Homo sapiens
atcagcattcaaaatagt

SEQ ID NO: 1672686 - DNA, 20 bp, Homo sapiens
atcagccagcccatggcccc

SEQ ID NO: 1672687 - DNA, 23 bp, Homo sapiens
atcagccagcccatggcccccaa

SEQ ID NO: 1672688 - DNA, 16 bp, Homo sapiens
atcagccccaccctgg

SEQ ID NO: 1672689 - DNA, 17 bp, Homo sapiens
atcagccccaccctggc

SEQ ID NO: 1672690 - DNA, 23 bp, Homo sapiens
atcagcccctcaaagggagagaa

SEQ ID NO: 1672691 - DNA, 18 bp, Homo sapiens
atcagcctgagtctcctg

SEQ ID NO: 1672692 - DNA, 20 bp, Homo sapiens
atcagcctgttccagaagga

SEQ ID NO: 1672693 - DNA, 20 bp, Homo sapiens
atcagcgggtctcctcccag

SEQ ID NO: 1672694 - DNA, 19 bp, Homo sapiens
atcagctgcaatccattta

SEQ ID NO: 1672695 - DNA, 13 bp, Homo sapiens
atcagctgctact

SEQ ID NO: 1672696 - DNA, 23 bp, Homo sapiens
atcagctgctactactcctgtag

SEQ ID NO: 1672697 - DNA, 21 bp, Homo sapiens
atcagctgctgaaacaacaaa

SEQ ID NO: 1672698 - DNA, 22 bp, Homo sapiens
atcagcttgccctgttaaaaga

SEQ ID NO: 1672699 - DNA, 18 bp, Homo sapiens
atcagctttcaaagcatt

SEQ ID NO: 1672700 - DNA, 20 bp, Homo sapiens
atcaggaaatatatatgtgt

SEQ ID NO: 1672701 - DNA, 22 bp, Homo sapiens
atcaggaatattttccaaagag

SEQ ID NO: 1672702 - DNA, 20 bp, Homo sapiens
atcaggaattctaaataaat

SEQ ID NO: 1672703 - DNA, 15 bp, Homo sapiens
atcaggaccactcag

SEQ ID NO: 1672704 - DNA, 22 bp, Homo sapiens
atcaggagactgggctctggct

SEQ ID NO: 1672705 - DNA, 19 bp, Homo sapiens
atcaggataccagaggaag

SEQ ID NO: 1672706 - DNA, 19 bp, Homo sapiens
atcaggcctaatctcatac

SEQ ID NO: 1672707 - DNA, 18 bp, Homo sapiens
atcaggctaagaccctgt

SEQ ID NO: 1672708 - DNA, 20 bp, Homo sapiens
atcaggctaagaccctgtgt

SEQ ID NO: 1672709 - DNA, 15 bp, Homo sapiens
atcaggctatgtatg

SEQ ID NO: 1672710 - DNA, 15 bp, Homo sapiens
atcaggcttcctggt

SEQ ID NO: 1672711 - DNA, 21 bp, Homo sapiens
atcaggcttcctggtgagaac

SEQ ID NO: 1672712 - DNA, 16 bp, Homo sapiens
atcaggcttttgtttc

SEQ ID NO: 1672713 - DNA, 18 bp, Homo sapiens
atcagggaggtcattttg

SEQ ID NO: 1672714 - DNA, 20 bp, Homo sapiens
atcaggggtgcattctggcc

SEQ ID NO: 1672715 - DNA, 14 bp, Homo sapiens
atcaggtagacttt

SEQ ID NO: 1672716 - DNA, 20 bp, Homo sapiens
atcaggtcctcagagaattt

SEQ ID NO: 1672717 - DNA, 18 bp, Homo sapiens
atcagtaaatagtgtcat

SEQ ID NO: 1672718 - DNA, 22 bp, Homo sapiens
atcagtaaatagtgtcatataa

SEQ ID NO: 1672719 - DNA, 19 bp, Homo sapiens
atcagtaacccccttaaat

SEQ ID NO: 1672720 - DNA, 23 bp, Homo sapiens
atcagtaacccccttaaatttaa

SEQ ID NO: 1672721 - DNA, 23 bp, Homo sapiens
atcagtaagaggtgttatttgga

SEQ ID NO: 1672722 - DNA, 21 bp, Homo sapiens
atcagtataattctgtactga

SEQ ID NO: 1672723 - DNA, 20 bp, Homo sapiens
atcagtatcacgatttgcag

SEQ ID NO: 1672724 - DNA, 12 bp, Homo sapiens
atcagtattctg

SEQ ID NO: 1672725 - DNA, 13 bp, Homo sapiens
atcagtattctga

SEQ ID NO: 1672726 - DNA, 19 bp, Homo sapiens
atcagtattctgacatgta

SEQ ID NO: 1672727 - DNA, 15 bp, Homo sapiens
atcagtcccctccca

SEQ ID NO: 1672728 - DNA, 16 bp, Homo sapiens
atcagtcccctcccat

SEQ ID NO: 1672729 - DNA, 22 bp, Homo sapiens
atcagtcccctcccatctggga

SEQ ID NO: 1672730 - DNA, 22 bp, Homo sapiens
atcagtcgttttagtgtctgac

SEQ ID NO: 1672731 - DNA, 14 bp, Homo sapiens
atcagtgactgaaa

SEQ ID NO: 1672732 - DNA, 19 bp, Homo sapiens
atcagtgactgaaaccatt

SEQ ID NO: 1672733 - DNA, 15 bp, Homo sapiens
atcagtgaggaggga

SEQ ID NO: 1672734 - DNA, 17 bp, Homo sapiens
atcagtgaggagggatg

SEQ ID NO: 1672735 - DNA, 14 bp, Homo sapiens
atcagtgataattg

SEQ ID NO: 1672736 - DNA, 16 bp, Homo sapiens
atcagtgatctatgtt

SEQ ID NO: 1672737 - DNA, 17 bp, Homo sapiens
atcagtgatctatgttt

SEQ ID NO: 1672738 - DNA, 17 bp, Homo sapiens
atcagtgtcctcttgct

SEQ ID NO: 1672739 - DNA, 14 bp, Homo sapiens
atcagtgttaaaaa

SEQ ID NO: 1672740 - DNA, 21 bp, Homo sapiens
atcagtgttgttgctctagga

SEQ ID NO: 1672741 - DNA, 15 bp, Homo sapiens
atcagtgtttggtgt

SEQ ID NO: 1672742 - DNA, 19 bp, Homo sapiens
atcagttaccaaacattac

SEQ ID NO: 1672743 - DNA, 18 bp, Homo sapiens
atcagttactcagccctg

SEQ ID NO: 1672744 - DNA, 19 bp, Homo sapiens
atcagttactcagccctgg

SEQ ID NO: 1672745 - DNA, 12 bp, Homo sapiens
atcataaaataa

SEQ ID NO: 1672746 - DNA, 13 bp, Homo sapiens
atcataaaataaa

SEQ ID NO: 1672747 - DNA, 14 bp, Homo sapiens
atcataaagcattt

SEQ ID NO: 1672748 - DNA, 13 bp, Homo sapiens
atcataaagtcag

SEQ ID NO: 1672749 - DNA, 18 bp, Homo sapiens
atcataagtatttggaat

SEQ ID NO: 1672750 - DNA, 23 bp, Homo sapiens
atcataagtatttggaattagaa

SEQ ID NO: 1672751 - DNA, 12 bp, Homo sapiens
atcataattaca

SEQ ID NO: 1672752 - DNA, 13 bp, Homo sapiens
atcataattacat

SEQ ID NO: 1672753 - DNA, 16 bp, Homo sapiens
atcataattacattcc

SEQ ID NO: 1672754 - DNA, 15 bp, Homo sapiens
atcataccagttgtt

SEQ ID NO: 1672755 - DNA, 20 bp, Homo sapiens
atcatactcttctaaaactt

SEQ ID NO: 1672756 - DNA, 14 bp, Homo sapiens
atcatagaaaaact

SEQ ID NO: 1672757 - DNA, 21 bp, Homo sapiens
atcatagattattataaacta

SEQ ID NO: 1672758 - DNA, 22 bp, Homo sapiens
atcatagattattataaactat

SEQ ID NO: 1672759 - DNA, 18 bp, Homo sapiens
atcatagcaagacctcat

SEQ ID NO: 1672760 - DNA, 20 bp, Homo sapiens
atcatagcaagacctcatct

SEQ ID NO: 1672761 - DNA, 21 bp, Homo sapiens
atcataggaagggaccaaggc

SEQ ID NO: 1672762 - DNA, 15 bp, Homo sapiens
atcatattgtatgta

SEQ ID NO: 1672763 - DNA, 22 bp, Homo sapiens
atcgggtccagagaccacacca

SEQ ID NO: 1672764 - DNA, 14 bp, Homo sapiens
atcggtaggcaaag

SEQ ID NO: 1672765 - DNA, 18 bp, Homo sapiens
atcggtgaaactaacaga

SEQ ID NO: 1672766 - DNA, 13 bp, Homo sapiens
atcgtaaagtgct

SEQ ID NO: 1672767 - DNA, 17 bp, Homo sapiens
atcgtacctgtccctcc

SEQ ID NO: 1672768 - DNA, 18 bp, Homo sapiens
atcgtaggcagccacggc

SEQ ID NO: 1672769 - DNA, 23 bp, Homo sapiens
atcgtgaagaagcctgtaacact

SEQ ID NO: 1672770 - DNA, 21 bp, Homo sapiens
atcgtgacccttcagggccag

SEQ ID NO: 1672771 - DNA, 23 bp, Homo sapiens
atcgtgccgttactctccaacct

SEQ ID NO: 1672772 - DNA, 15 bp, Homo sapiens
atcgtgctaaatttt

SEQ ID NO: 1672773 - DNA, 16 bp, Homo sapiens
atcgtgctaaattttc

SEQ ID NO: 1672774 - DNA, 17 bp, Homo sapiens
atcgtgctaaattttca

SEQ ID NO: 1672775 - DNA, 15 bp, Homo sapiens
atcgtggcacgtatt

SEQ ID NO: 1672776 - DNA, 19 bp, Homo sapiens
atcgtggcacgtattgctg

SEQ ID NO: 1672777 - DNA, 22 bp, Homo sapiens
atcgtggcacgtattgctgtgt

SEQ ID NO: 1672778 - DNA, 15 bp, Homo sapiens
atcgttgttattaaa

SEQ ID NO: 1672779 - DNA, 13 bp, Homo sapiens
atctaaaaaataa

SEQ ID NO: 1672780 - DNA, 14 bp, Homo sapiens
atctaaaaaataac

SEQ ID NO: 1672781 - DNA, 15 bp, Homo sapiens
atctaaaaaataact

SEQ ID NO: 1672782 - DNA, 16 bp, Homo sapiens
atctaaaaaataactg

SEQ ID NO: 1672783 - DNA, 23 bp, Homo sapiens
atctaaaatactcaccaaaatat

SEQ ID NO: 1672784 - DNA, 13 bp, Homo sapiens
atctaaaatttgt

SEQ ID NO: 1672785 - DNA, 18 bp, Homo sapiens
atctaaacgtggtcacct

SEQ ID NO: 1672786 - DNA, 18 bp, Homo sapiens
atctaaatctatttatta

SEQ ID NO: 1672787 - DNA, 20 bp, Homo sapiens
atctaaatctatttattaat

SEQ ID NO: 1672788 - DNA, 15 bp, Homo sapiens
atctaaatgttgaaa

SEQ ID NO: 1672789 - DNA, 12 bp, Homo sapiens
atctaacaaaat

SEQ ID NO: 1672790 - DNA, 18 bp, Homo sapiens
atctaacgggcattcaca

SEQ ID NO: 1672791 - DNA, 17 bp, Homo sapiens
atctaagcctttccata

SEQ ID NO: 1672792 - DNA, 15 bp, Homo sapiens
atctaataaacttta

SEQ ID NO: 1672793 - DNA, 22 bp, Homo sapiens
atctaataaactttatttttta

SEQ ID NO: 1672794 - DNA, 15 bp, Homo sapiens
atctaataattattc

SEQ ID NO: 1672795 - DNA, 15 bp, Homo sapiens
atctaatatatatga

SEQ ID NO: 1672796 - DNA, 21 bp, Homo sapiens
atctaatctcttattctaata

SEQ ID NO: 1672797 - DNA, 17 bp, Homo sapiens
atctaatgcttgtttat

SEQ ID NO: 1672798 - DNA, 16 bp, Homo sapiens
atctaattattttgca

SEQ ID NO: 1672799 - DNA, 12 bp, Homo sapiens
atctaatttcaa

SEQ ID NO: 1672800 - DNA, 16 bp, Homo sapiens
atctacaatatatatt

SEQ ID NO: 1672801 - DNA, 18 bp, Homo sapiens
atctacaatcagttgact

SEQ ID NO: 1672802 - DNA, 14 bp, Homo sapiens
atctacaatctctt

SEQ ID NO: 1672803 - DNA, 15 bp, Homo sapiens
atctacacagcctgg

SEQ ID NO: 1672804 - DNA, 17 bp, Homo sapiens
atctacacagcctggac

SEQ ID NO: 1672805 - DNA, 13 bp, Homo sapiens
atctacacatgtt

SEQ ID NO: 1672806 - DNA, 11 bp, Homo sapiens
atctacaccaa

SEQ ID NO: 1672807 - DNA, 22 bp, Homo sapiens
atctacaccaatgaaaacatgt

SEQ ID NO: 1672808 - DNA, 18 bp, Homo sapiens
atctacagtacttccaga

SEQ ID NO: 1672809 - DNA, 17 bp, Homo sapiens
atctacatcttttttca

SEQ ID NO: 1672810 - DNA, 13 bp, Homo sapiens
atctaccaactgt

SEQ ID NO: 1672811 - DNA, 19 bp, Homo sapiens
atctaccttttctggcaaa

SEQ ID NO: 1672812 - DNA, 13 bp, Homo sapiens
atctactcccaag

SEQ ID NO: 1672813 - DNA, 18 bp, Homo sapiens
atctactcccaagtatgg

SEQ ID NO: 1672814 - DNA, 19 bp, Homo sapiens
atctacttctgtaattgtg

SEQ ID NO: 1672815 - DNA, 13 bp, Homo sapiens
atctacttgcctc

SEQ ID NO: 1672816 - DNA, 13 bp, Homo sapiens
atctagaagatgt

SEQ ID NO: 1672817 - DNA, 14 bp, Homo sapiens
atctagaagatgtg

SEQ ID NO: 1672818 - DNA, 15 bp, Homo sapiens
atctagaagatgtgt

SEQ ID NO: 1672819 - DNA, 23 bp, Homo sapiens
atctagaagatgtgtaaacaggt

SEQ ID NO: 1672820 - DNA, 15 bp, Homo sapiens
atctagaagggacca

SEQ ID NO: 1672821 - DNA, 16 bp, Homo sapiens
atctagaggcaagcct

SEQ ID NO: 1672822 - DNA, 18 bp, Homo sapiens
atctagcaaatgttatgc

SEQ ID NO: 1672823 - DNA, 19 bp, Homo sapiens
atctagcaagaagattcta

SEQ ID NO: 1672824 - DNA, 19 bp, Homo sapiens
atctagccagcccctcttc

SEQ ID NO: 1672825 - DNA, 16 bp, Homo sapiens
atctaggatgtgatga

SEQ ID NO: 1672826 - DNA, 18 bp, Homo sapiens
atctaggtggagttgaaa

SEQ ID NO: 1672827 - DNA, 19 bp, Homo sapiens
atctaggtgtggctgtgaa

SEQ ID NO: 1672828 - DNA, 16 bp, Homo sapiens
atctagtatgaaatta

SEQ ID NO: 1672829 - DNA, 18 bp, Homo sapiens
atctagtatgaaattata

SEQ ID NO: 1672830 - DNA, 23 bp, Homo sapiens
atctagtccttgtcttgtaattg

SEQ ID NO: 1672831 - DNA, 17 bp, Homo sapiens
atctagtttacagaaaa

SEQ ID NO: 1672832 - DNA, 20 bp, Homo sapiens
atctagtttacagaaaaatc

SEQ ID NO: 1672833 - DNA, 12 bp, Homo sapiens
atctataaaagg

SEQ ID NO: 1672834 - DNA, 23 bp, Homo sapiens
atctataaggtgctctctttctg

SEQ ID NO: 1672835 - DNA, 14 bp, Homo sapiens
atctatatcatatt

SEQ ID NO: 1672836 - DNA, 17 bp, Homo sapiens
atctatatcatatttct

SEQ ID NO: 1672837 - DNA, 20 bp, Homo sapiens
atctatatcatatttctgtg

SEQ ID NO: 1672838 - DNA, 20 bp, Homo sapiens
atctatatttgtcttccgat

SEQ ID NO: 1672839 - DNA, 19 bp, Homo sapiens
atctatatttttgtactga

SEQ ID NO: 1672840 - DNA, 16 bp, Homo sapiens
atctatctagttctaa

SEQ ID NO: 1672841 - DNA, 19 bp, Homo sapiens
atctatctcatctatctca

SEQ ID NO: 1672842 - DNA, 15 bp, Homo sapiens
atctatggcagtcca

SEQ ID NO: 1672843 - DNA, 18 bp, Homo sapiens
atgagtcactgagcatca

SEQ ID NO: 1672844 - DNA, 16 bp, Homo sapiens
atgagtccttgaaaat

SEQ ID NO: 1672845 - DNA, 20 bp, Homo sapiens
atgagtccttgaaaatattt

SEQ ID NO: 1672846 - DNA, 21 bp, Homo sapiens
atgagtccttgatttcaaagt

SEQ ID NO: 1672847 - DNA, 13 bp, Homo sapiens
atgagtctagatg

SEQ ID NO: 1672848 - DNA, 19 bp, Homo sapiens
atgagtctgttgtgtgtca

SEQ ID NO: 1672849 - DNA, 22 bp, Homo sapiens
atgagtcttctgtaattcattg

SEQ ID NO: 1672850 - DNA, 14 bp, Homo sapiens
atgagtgcacctgc

SEQ ID NO: 1672851 - DNA, 15 bp, Homo sapiens
atgagtgcacctgcc

SEQ ID NO: 1672852 - DNA, 12 bp, Homo sapiens
atgagtgggaat

SEQ ID NO: 1672853 - DNA, 13 bp, Homo sapiens
atgagtgggaatc

SEQ ID NO: 1672854 - DNA, 16 bp, Homo sapiens
atgagtgggaatccgg

SEQ ID NO: 1672855 - DNA, 17 bp, Homo sapiens
atgagttaactgtgaaa

SEQ ID NO: 1672856 - DNA, 18 bp, Homo sapiens
atgagttaactgtgaaat

SEQ ID NO: 1672857 - DNA, 22 bp, Homo sapiens
atgagttaactgtgaaatacca

SEQ ID NO: 1672858 - DNA, 19 bp, Homo sapiens
atgagttccctaaacaaaa

SEQ ID NO: 1672859 - DNA, 17 bp, Homo sapiens
atgagttggacttcagt

SEQ ID NO: 1672860 - DNA, 20 bp, Homo sapiens
atgagttgtgaaatttaatg

SEQ ID NO: 1672861 - DNA, 19 bp, Homo sapiens
atgagttgttttcagactc

SEQ ID NO: 1672862 - DNA, 18 bp, Homo sapiens
atgagtttaaaaaaataa

SEQ ID NO: 1672863 - DNA, 20 bp, Homo sapiens
atgagtttaaaaaaataaca

SEQ ID NO: 1672864 - DNA, 17 bp, Homo sapiens
atgagtttcactgtact

SEQ ID NO: 1672865 - DNA, 18 bp, Homo sapiens
atgagtttcactgtactg

SEQ ID NO: 1672866 - DNA, 13 bp, Homo sapiens
atgagttttggga

SEQ ID NO: 1672867 - DNA, 19 bp, Homo sapiens
atgagttttgggaagttaa

SEQ ID NO: 1672868 - DNA, 14 bp, Homo sapiens
atgataaaagagaa

SEQ ID NO: 1672869 - DNA, 15 bp, Homo sapiens
atgataaactcagat

SEQ ID NO: 1672870 - DNA, 20 bp, Homo sapiens
atgataacaccagtgggaat

SEQ ID NO: 1672871 - DNA, 18 bp, Homo sapiens
atgataagccgaggaggc

SEQ ID NO: 1672872 - DNA, 17 bp, Homo sapiens
atgataagtaaatgcta

SEQ ID NO: 1672873 - DNA, 13 bp, Homo sapiens
atgataataataa

SEQ ID NO: 1672874 - DNA, 19 bp, Homo sapiens
atgataatagattctcttg

SEQ ID NO: 1672875 - DNA, 17 bp, Homo sapiens
atgatacaatgaacact

SEQ ID NO: 1672876 - DNA, 19 bp, Homo sapiens
atgataccacctttactgt

SEQ ID NO: 1672877 - DNA, 15 bp, Homo sapiens
atgatatttcttgct

SEQ ID NO: 1672878 - DNA, 16 bp, Homo sapiens
atgatcaaaacatgct

SEQ ID NO: 1672879 - DNA, 20 bp, Homo sapiens
atgatcaattatagtttctg

SEQ ID NO: 1672880 - DNA, 16 bp, Homo sapiens
atgatcagacatacag

SEQ ID NO: 1672881 - DNA, 20 bp, Homo sapiens
atgatcagtgttgttgctct

SEQ ID NO: 1672882 - DNA, 12 bp, Homo sapiens
atgatccagaac

SEQ ID NO: 1672883 - DNA, 14 bp, Homo sapiens
atgatcctctattt

SEQ ID NO: 1672884 - DNA, 15 bp, Homo sapiens
atgatctaataaact

SEQ ID NO: 1672885 - DNA, 16 bp, Homo sapiens
atgatctactcagaaa

SEQ ID NO: 1672886 - DNA, 13 bp, Homo sapiens
atgatctattgct

SEQ ID NO: 1672887 - DNA, 15 bp, Homo sapiens
atgatctcaggagct

SEQ ID NO: 1672888 - DNA, 12 bp, Homo sapiens
atgatctccctg

SEQ ID NO: 1672889 - DNA, 15 bp, Homo sapiens
atgatctccctgccg

SEQ ID NO: 1672890 - DNA, 19 bp, Homo sapiens
atgatctcggatgaccaaa

SEQ ID NO: 1672891 - DNA, 20 bp, Homo sapiens
atgatctcggatgaccaaac

SEQ ID NO: 1672892 - DNA, 14 bp, Homo sapiens
atgatctgaaaaat

SEQ ID NO: 1672893 - DNA, 18 bp, Homo sapiens
atgatcttctttataatt

SEQ ID NO: 1672894 - DNA, 20 bp, Homo sapiens
atgatcttgttactgtgata

SEQ ID NO: 1672895 - DNA, 23 bp, Homo sapiens
atgatcttgttactgtgatattt

SEQ ID NO: 1672896 - DNA, 14 bp, Homo sapiens
atgatgaaaataat

SEQ ID NO: 1672897 - DNA, 20 bp, Homo sapiens
atgatgacccactaaagagt

SEQ ID NO: 1672898 - DNA, 18 bp, Homo sapiens
atgatgatctttaaaata

SEQ ID NO: 1672899 - DNA, 14 bp, Homo sapiens
atgatgatgaaaac

SEQ ID NO: 1672900 - DNA, 14 bp, Homo sapiens
atgatgatgatgat

SEQ ID NO: 1672901 - DNA, 15 bp, Homo sapiens
atgatgatgatgata

SEQ ID NO: 1672902 - DNA, 13 bp, Homo sapiens
atgatgatgttaa

SEQ ID NO: 1672903 - DNA, 15 bp, Homo sapiens
atgatgcatacagtt

SEQ ID NO: 1672904 - DNA, 17 bp, Homo sapiens
atgatgctaagctgata

SEQ ID NO: 1672905 - DNA, 23 bp, Homo sapiens
atgatgcttctataattttgcct

SEQ ID NO: 1672906 - DNA, 17 bp, Homo sapiens
atgatggagcaactgaa

SEQ ID NO: 1672907 - DNA, 19 bp, Homo sapiens
atgatggcaattttgtaac

SEQ ID NO: 1672908 - DNA, 15 bp, Homo sapiens
atgatggcagagcca

SEQ ID NO: 1672909 - DNA, 24 bp, Homo sapiens
atgatggcaggtcctctgttgcaa

SEQ ID NO: 1672910 - DNA, 17 bp, Homo sapiens
atgatgggaaaatattt

SEQ ID NO: 1672911 - DNA, 21 bp, Homo sapiens
atgatgggaatagggagacag

SEQ ID NO: 1672912 - DNA, 17 bp, Homo sapiens
atgatggggaaggagta

SEQ ID NO: 1672913 - DNA, 14 bp, Homo sapiens
atgatggttcacgt

SEQ ID NO: 1672914 - DNA, 12 bp, Homo sapiens
atgatgtatatt

SEQ ID NO: 1672915 - DNA, 14 bp, Homo sapiens
atgatgtccagaag

SEQ ID NO: 1672916 - DNA, 15 bp, Homo sapiens
atgatgtctcttgta

SEQ ID NO: 1672917 - DNA, 11 bp, Homo sapiens
atgatgtttgc

SEQ ID NO: 1672918 - DNA, 15 bp, Homo sapiens
atgatgttttaaaaa

SEQ ID NO: 1672919 - DNA, 21 bp, Homo sapiens
atgatgttttaaaaaaatttg

SEQ ID NO: 1672920 - DNA, 17 bp, Homo sapiens
atgattaaataagattc

SEQ ID NO: 1672921 - DNA, 19 bp, Homo sapiens
atgattaaataagattcta

SEQ ID NO: 1672922 - DNA, 15 bp, Homo sapiens
atgattaatcaaagg

SEQ ID NO: 1672923 - DNA, 23 bp, Homo sapiens
atgattttttgaaagttaacatt

SEQ ID NO: 1672924 - DNA, 21 bp, Homo sapiens
atgatttttttttcatacact

SEQ ID NO: 1672925 - DNA, 23 bp, Homo sapiens
atgcaaaaaaaaaaaaagcaatt

SEQ ID NO: 1672926 - DNA, 11 bp, Homo sapiens
atgcaaaaatc

SEQ ID NO: 1672927 - DNA, 23 bp, Homo sapiens
atgcaaaattgttttcacttgta

SEQ ID NO: 1672928 - DNA, 15 bp, Homo sapiens
atgcaaagaaaatca

SEQ ID NO: 1672929 - DNA, 15 bp, Homo sapiens
atgcaaagcactgac

SEQ ID NO: 1672930 - DNA, 12 bp, Homo sapiens
atgcaaatacaa

SEQ ID NO: 1672931 - DNA, 21 bp, Homo sapiens
atgcaaatagtagacatttgt

SEQ ID NO: 1672932 - DNA, 15 bp, Homo sapiens
atgcaaatgttttga

SEQ ID NO: 1672933 - DNA, 18 bp, Homo sapiens
atgcaaccaagtcacacg

SEQ ID NO: 1672934 - DNA, 23 bp, Homo sapiens
atgcaacgggattgaagggtcct

SEQ ID NO: 1672935 - DNA, 21 bp, Homo sapiens
atgcaagagtgattgcagctt

SEQ ID NO: 1672936 - DNA, 15 bp, Homo sapiens
atgcaagagtttctt

SEQ ID NO: 1672937 - DNA, 16 bp, Homo sapiens
atgcaagagtttcttg

SEQ ID NO: 1672938 - DNA, 21 bp, Homo sapiens
atgcaagcagaggaccagggc

SEQ ID NO: 1672939 - DNA, 14 bp, Homo sapiens
atgcaaggaccagg

SEQ ID NO: 1672940 - DNA, 15 bp, Homo sapiens
atgcaaggaccagga

SEQ ID NO: 1672941 - DNA, 20 bp, Homo sapiens
atgcaaggtatttctccagt

SEQ ID NO: 1672942 - DNA, 15 bp, Homo sapiens
atgcaataactctgg

SEQ ID NO: 1672943 - DNA, 15 bp, Homo sapiens
atgcaatccttccct

SEQ ID NO: 1672944 - DNA, 18 bp, Homo sapiens
atgcaatgaaaaatactt

SEQ ID NO: 1672945 - DNA, 19 bp, Homo sapiens
atgcaatgacatcttcaaa

SEQ ID NO: 1672946 - DNA, 24 bp, Homo sapiens
atgcaatgtaagcatactttgtaa

SEQ ID NO: 1672947 - DNA, 13 bp, Homo sapiens
atgcaatgtgcta

SEQ ID NO: 1672948 - DNA, 17 bp, Homo sapiens
atgcaatgtgctactga

SEQ ID NO: 1672949 - DNA, 15 bp, Homo sapiens
atgcaattagaattt

SEQ ID NO: 1672950 - DNA, 19 bp, Homo sapiens
atgcaattgctcccatcag

SEQ ID NO: 1672951 - DNA, 23 bp, Homo sapiens
atgcaatttgaagtaacttattt

SEQ ID NO: 1672952 - DNA, 11 bp, Homo sapiens
atgcacacata

SEQ ID NO: 1672953 - DNA, 18 bp, Homo sapiens
atgcacacggctggtcac

SEQ ID NO: 1672954 - DNA, 19 bp, Homo sapiens
atgcacacggctggtcact

SEQ ID NO: 1672955 - DNA, 21 bp, Homo sapiens
atgcacacggctggtcactct

SEQ ID NO: 1672956 - DNA, 21 bp, Homo sapiens
atgcacacgggcgagctttct

SEQ ID NO: 1672957 - DNA, 20 bp, Homo sapiens
atgcacactagcctctccag

SEQ ID NO: 1672958 - DNA, 22 bp, Homo sapiens
atgcacactagcctctccagga

SEQ ID NO: 1672959 - DNA, 15 bp, Homo sapiens
atgcacagctgcttg

SEQ ID NO: 1672960 - DNA, 16 bp, Homo sapiens
atgcacagctgcttgt

SEQ ID NO: 1672961 - DNA, 14 bp, Homo sapiens
atgcacagtacaat

SEQ ID NO: 1672962 - DNA, 17 bp, Homo sapiens
atgcacagtacaataat

SEQ ID NO: 1672963 - DNA, 19 bp, Homo sapiens
atgcacagtacaataatgt

SEQ ID NO: 1672964 - DNA, 19 bp, Homo sapiens
atgcacatatggactctgc

SEQ ID NO: 1672965 - DNA, 21 bp, Homo sapiens
atgcacatttatatatatatg

SEQ ID NO: 1672966 - DNA, 17 bp, Homo sapiens
atgcacatttctggatt

SEQ ID NO: 1672967 - DNA, 15 bp, Homo sapiens
atgcacattttgtac

SEQ ID NO: 1672968 - DNA, 18 bp, Homo sapiens
atgcacattttgtacatt

SEQ ID NO: 1672969 - DNA, 20 bp, Homo sapiens
atgcacattttgtacattgt

SEQ ID NO: 1672970 - DNA, 14 bp, Homo sapiens
atgcaccaccaagc

SEQ ID NO: 1672971 - DNA, 18 bp, Homo sapiens
atgcaccaccaagccaag

SEQ ID NO: 1672972 - DNA, 22 bp, Homo sapiens
atgcacctcccttccctccctg

SEQ ID NO: 1672973 - DNA, 15 bp, Homo sapiens
atgcaccttgtgtct

SEQ ID NO: 1672974 - DNA, 16 bp, Homo sapiens
atgcaccttgtgtctg

SEQ ID NO: 1672975 - DNA, 19 bp, Homo sapiens
atgcaccttgtgtctgtac

SEQ ID NO: 1672976 - DNA, 23 bp, Homo sapiens
atgcactcacccctagccctggt

SEQ ID NO: 1672977 - DNA, 22 bp, Homo sapiens
atgcactgaaaacttagccaga

SEQ ID NO: 1672978 - DNA, 18 bp, Homo sapiens
atgcacttttagaaatgc

SEQ ID NO: 1672979 - DNA, 16 bp, Homo sapiens
atgcagaaagcatccc

SEQ ID NO: 1672980 - DNA, 18 bp, Homo sapiens
atgcagaaatagacaaaa

SEQ ID NO: 1672981 - DNA, 20 bp, Homo sapiens
atgcagaagcatattttgct

SEQ ID NO: 1672982 - DNA, 21 bp, Homo sapiens
atgcagaagcatattttgctg

SEQ ID NO: 1672983 - DNA, 20 bp, Homo sapiens
atgcagacctcatgcccagc

SEQ ID NO: 1672984 - DNA, 19 bp, Homo sapiens
atgcagactgttagctttt

SEQ ID NO: 1672985 - DNA, 20 bp, Homo sapiens
atgcagagtaagtattatgc

SEQ ID NO: 1672986 - DNA, 15 bp, Homo sapiens
atgcagatgcctggg

SEQ ID NO: 1672987 - DNA, 23 bp, Homo sapiens
atgcagatggggctcccgcccgt

SEQ ID NO: 1672988 - DNA, 21 bp, Homo sapiens
atgcagattcctgggcctgtc

SEQ ID NO: 1672989 - DNA, 22 bp, Homo sapiens
atgcagattcctgggcctgtcc

SEQ ID NO: 1672990 - DNA, 15 bp, Homo sapiens
atgcagcaaatatat

SEQ ID NO: 1672991 - DNA, 16 bp, Homo sapiens
atgcagcaaatatatg

SEQ ID NO: 1672992 - DNA, 22 bp, Homo sapiens
atgcagcaggaaggaacaaaga

SEQ ID NO: 1672993 - DNA, 17 bp, Homo sapiens
atgcagccacttaggac

SEQ ID NO: 1672994 - DNA, 23 bp, Homo sapiens
atgcagcccatgcccacctgccc

SEQ ID NO: 1672995 - DNA, 21 bp, Homo sapiens
atgcagcctaaggctgtatga

SEQ ID NO: 1672996 - DNA, 13 bp, Homo sapiens
atgcagcctgtgg

SEQ ID NO: 1672997 - DNA, 16 bp, Homo sapiens
atgcagccttggggca

SEQ ID NO: 1672998 - DNA, 16 bp, Homo sapiens
atgcagctgctcccca

SEQ ID NO: 1672999 - DNA, 17 bp, Homo sapiens
atgcagctgctccccag

SEQ ID NO: 1673000 - DNA, 14 bp, Homo sapiens
atgcagctttgcaa

SEQ ID NO: 1673001 - DNA, 17 bp, Homo sapiens
atgcaggaagaggccca

SEQ ID NO: 1673002 - DNA, 19 bp, Homo sapiens
atgcaggaagaggcccact

SEQ ID NO: 1673003 - DNA, 12 bp, Homo sapiens
atgcaggacagg

SEQ ID NO: 1673004 - DNA, 13 bp, Homo sapiens
atgcaggacagga

SEQ ID NO: 1673005 - DNA, 16 bp, Homo sapiens
atgcaggacaggaggc

SEQ ID NO: 1673006 - DNA, 16 bp, Homo sapiens
atgcaggaggtggaga

SEQ ID NO: 1673007 - DNA, 23 bp, Homo sapiens
atgcagggaagagggcagtacct

SEQ ID NO: 1673008 - DNA, 22 bp, Homo sapiens
atgcagggattgctgccacttt

SEQ ID NO: 1673009 - DNA, 16 bp, Homo sapiens
atgcaggtgaactttt

SEQ ID NO: 1673010 - DNA, 14 bp, Homo sapiens
atgcgcagtgcctt

SEQ ID NO: 1673011 - DNA, 22 bp, Homo sapiens
atgctttattaatgttttcaaa

SEQ ID NO: 1673012 - DNA, 20 bp, Homo sapiens
atgcttttagttttaaaagt

SEQ ID NO: 1673013 - DNA, 22 bp, Homo sapiens
atgcttttggaagttaaaattt

SEQ ID NO: 1673014 - DNA, 19 bp, Homo sapiens
atgctttttagaaagcatt
